United States Patent 7,468,248 (METHODS AND SYSTEMS FOR INFERRING BOVINE TRAITS) - sequence listing, part 17

SEQ ID NO: 52547 - DNA, 1216 bp, Bovine  19866880805965
gccaggaatggagaatctgggcttttcattttcagtaccactcccattaaaaactcccacacctatactaggtgtttggttatttgtgagccaagtcatacacacagacacacacatacacgcacacacgtagtcattcagtcaacaaatatttattgagcacctactctgtgccagcccagagttaatgacagtgtggctttctattgcacatgtttcaaatgagtcacgtgccccaggaacagttttatagcatagaacttaggtacttatttatgatgtaaattcattctgtttttgttttcaacatagggagtatggaaaatacagaaaaggataataaaaagatattttgcttaagaccacccaccgaagatgactactacatttacactttcgatttattttctttccatttttttctgtgttgagcttctgttgtagttgtttaacgtagatgtttgtgtactgcacatataattttctatcttgcttgttttgccctcctattgatataacacatggtttttccaagtgcaaaatcctgtggcttggaaaaaaattctaagaagatggagtaggaagcaccaggaacctgtctcctgacctagacaataattgcactgacagaatctgtctgacgtaaccattttggaacttcagagtctgttgaggcttgcgacttccaggagaaggtttggatggtaaattgcggttaatttttgtgcaatttcagcttttcaaacagttgaagctgtctacccctcacttctagccacacggcaggcagcaatatatgtgttcctgtgcacacactttgcacaagtcaggacaggaattaagaaccctctcctcaaaatatcaggggtctgtgcttccatctctgcattctgtgtctaatcactgagatgtagacaaggaaatgggctgcctttgttgtacttcccctctttgtgtcaagcctctccccactggctgaagtgacttcctggagatttaaagagatagtgctcttttgtttcttctcttcatgtctctctttttccccttttgggagccagacattaaagactaagatattcaaaagcaactgcatatatagaaaaattagaaaatgaacatgaaaacccagggaaagatgcaggctcaggaaaaagcctgagaagactaaatatacacctcaggattatcctggcaaaaagacagtatacaacaa

SEQ ID NO: 52548 - DNA, 1232 bp, Bovine  19866880819987
atcagagagaaaaagactccaagatgagttatccttaatgtgtactccacactgacactttgcctctgaacattaaccatctaaacagcctggacactcttaagatgtgtgggacttgagatgggcaatctgcacatcctatggataccgaagggaaagctctgccccctgaccagtgtggacctgagcagaaccagttgggaatgtctctgtctttaggaaatgatggatgcaccacaactgtttcgcacgtcatcccaaggaatttgaaaactctcaatgcccaagctttgtcaatcattcccattcatgatgccttctgtgaaaaacactgaaaaatggctctcctgtcacagctaatttatgacgaagtaaatgagaatagtggtcatccttttgagtcagtcatgtcaggacaggcacatctaagagccttctggggtcctgtaaacattctgtattttgacaggaggtagttaaatgcatgtctacatacttttaaatgtttgcttaaaagttacaaaccactgtatataaattatacctcagtttttaaaaatgaccctgggatttccttctattcagtcacaacgtacttgggcctgggtcacccacatttctctttccccgccataaagggtcaaactcacctgttcagcaaaattctagggccaagtagtacaaatgctaagtcagaaggaaaacagaaacacaaacatattgagctggtgtagagatcaaagagaagtaaataaatgaactgtggcttcatcaaacatttacacaacagtacagggcagaacaaagcagccaataatcaggatatacgttgggattatatttgttttagaacaatttattttcaaatttgtgattggcttttaagtcatttaagtctaacattttattaaaagattataataaaattttggttaattgtagctttaattgtggctatgaattttagtgcttttacaaatactttttgaaattaaaaaaatactctttcctttttgaaatattttgcatttgcattgccctgctgctaagttacttcagtcgtgtccgactctgtgcgaccccatagacggcagcccaccaggctcctccgtccatgggattttccaggtaagagtactggagtggggtgctattgcattgccctacagtccagcaatttatatgtgtcaaagcagctaccagaattttagcaagactaagaaaaatttaaa

SEQ ID NO: 52549 - DNA, 1642 bp, Bovine  19866880876300
ctgctgctgagtttgaattcctattattcccctttcattcactcagttacatcaatcacatggatgacctcctcctctctgctccctaatctttcatcttctctccaattctagatttcaaactcctcaaagagtacttcccttataggactttgtcaccttaatgaactttctctcatatataatctcttctgtttgcctactactcaactagctatgctggaagacacaacaagggctttgtgttttttaagccctgctttttatgaactctccatctccatttaagatggtgctaggatctgactttgttgattccctcctggtttgaatggtccctcccagtttaaattaactctctcttctcataatggataactcagcctggtttatgacttttccaagaaatattgatacttgccagcccagtagtgggcattgggacataatggagacccaagtttatctagagttgggattagtataatggatgctggaaaaggacagaagggtgagggggattagcttacttattaaagagttattgaaaatagtaggtcccggctgggggggaaaggaagtcagactagatgcaactcagaggatagggagaaaaagagggtctgtgggattttaaaaacctagattcaatagcttcaatcttctctactttcaaaatcccaaatatcaattccactgcattaacacttttaatgaactgagattatataaattatcacagaattatcccatgtaaccctagagttcaaaacaaaactgttggcagggaacttaattttgtattatccataatattctatgccacttccataatttattaattatataatctcctgataaatgggaaacaaccattttgaacttaaggctttcacatttatttttcttttagactttgttaaggtcttcataggggtcactgaaggtttcctccttttgggattctttgaaagttttttttgtgaggttgtatttgtgcttatttgagggctgtgttgttgatggtttgaaatagatctaagaaatttgcttaatgaaattgagaatgacatgatctcacagagatattttctaggaagccagtaaaacttttgttatgacctgttattttagtattaacacctatttataaagacatgcttccttctttaacttgagaaaaatggctattgtaccttattgattaacatttctatttccagtttatagagaatatatactggtaatggatgacactgttcttgattgaaagtttgggttgtcttatcagacaatatgccatgaatttagataatatttttcagcagttttagtttctcagttatgtatagcaacaactacagataactttttggtaagagtgttgatatgagttaattatatattttttaaatcatgtccctgtggatcttggaatttatgtttctgtgactgtgttctaactgacctctcatctgatatacatgacatctccccagaaaagaactgttttttcttatataggtatcagattgactattctttacaacgcttaaattgcatctcctcttttaactgctcacttaacacatctgaagtcttcaatcctgcttcaaatcacaataccaggctattaataaat

SEQ ID NO: 52550 - DNA, 1730 bp, Bovine  19866881076424
atagaacagacagaaaatcttttaagaataaactagatgatcatcaggtttaatctaggaaaaacaaggtggaccacagatttcacgtgaagagtgtaaacacagaaactcaaggcatttagaagaatggtgaatggaagcatgtaaaacgctcaccattcattcattcattgagttagatggaggaaaggaagaaaatttgagtgggtagccatttcctcctccaggggatcttcccaaccctcaaactgaatcaagtctcctgcactggcaggtagattctttaccacttacagcttacttgggtctagcaaatatggcagagaggcacatgaaccacagtacaagagcattaataaataggaactgacaaagccacagtatcaggaaaaactgttaagtggtgagggacatatgccatccaaatagcaaacagttgttttacagaaatgcagtgttaccagatcttcagatttttcaagagaagccaaaaatctagatgttaatgggaaatctcaacatctgtaaatgccagtaactaattaaaaattttttttcaaatttgggcaggccaatattgtgtaaatgcaggccatgagtttgcaacttcttccagtgttaagtatcagggaggtgagagagttaagcaggggttaacacaatcatatttgtatacagaaggaaaactctgggaagaatttaaagaaactggagatggggtgacaaattagcaaattatttcaggtgctgagaagattaaaagatgctaggaaggaagtaaatttctaggtatcacacattgcttagctggatttagcaaagggaaggaattgtggtgtagacttaagaggttgttcattcaaatttacttttggaatggctttgttcaactacttcctcctgtttttatatatggtattctgtatcaataagtagctgtgtaaaatcacactagtaaacattcatctgcaaagaagtatcctagctaagaagaaatgagagactgttacatggacttttccaactgttgtctcaacactggagcaaagaaacaaaatgccctccttgaggctgtattcagctttttttattgcttgcaatgctgctaaagcacctgtctaccttgccttgttaaagtacaagtgctttgaacatggtaagaatttttaaaaattgttgtatgcatgaatggccagtacctaacttggaaccaaaaaaaaaaaaagaatcctatcaaaacaggaagcatcaagcataggtttccggaggtaagaaagagagaagaatcggaagttctctcgtatcttgtaaaatgacatctggattaagaacagaaatagtagtggtctttgaatcataacccaatgttcacttggatgttggctggggagtgagtgatccatgttgccaagatcatttaaagactctttccttgtacttgaatgtttacagcaactttattcataatctaaacactggaaaaaaatccaaatgtccacaagtgggagagataaactgtggtatacccatgcaatggaatactaggaactaaccaaaaaaaaaaaaaaaaacaaacacacacacacacacacaaacgcacagatacaagcagcatgaataaatctaaaagcattcgctaaattagagaagacacaaaaggctacacactatgatttcctttacatgacattctaaaaaggcaaaactgtcaggaattgatatcacatcag

SEQ ID NO: 52551 - DNA, 1654 bp, Bovine  19866881143493
acactcagatcacctttttatattttggttgctttttttttttttaagttaaacacatggatttggtctgctaataaagtatgcttattaactattttgtttttagaaagatatagaatatcttttatgatatttctatctgctgctgctaagtagcttcagtcgtgtccaactctgtgcaaccccatagacggcagccccaccaggctcccccgtccctgggattctccaggcaagaatactggagtgggttcccatttccttctccaatgatatttctatctagaatatcataaaaaaataaatgaaaaaaactttcaaatgatctctcaaagctaacagggcatgcacttttaattatacactgaaatatttaacaggtttaatttttcaaaagtagtactatgtctctttgggttcaatccctgagttgggaagattccctggagaagggagtgacaacccactccagtattctgctctggagaattccacagatagtcatggacagaattccatggacagtccatggggctgcaaagagtcagacacaactgagtgacttccactcactgtctctttagatgccgacccaacaatttctctttgtataaattgtgctacctatctaccaataactcagggaacctcactccataaattaagagacattgttacttattttaatcatctgtggaatctagtggctctctattaatgtaccagttcactgcaatcaaagaaaaaaagggaagacagtccaactgaaagtataaagggaagctgggcagaatctaatttaattatcaaggctgaaattattccaggactccacctgccataaggagagtatcctgggatctttaatgaccaaagtggtcaggatttcagtcttacagctcatccaattaattgccaagcacatcttctgctataccattaggtgacagggcgggatccactctgctaattaagaacttagggcctcctgttagtttcccagatgacttttcagggtatgtgtacctggccatgtaaacatatactcggtaagagatacctctatcatagacagtgaacaggagagacttcagacatttcttctccacactattaggactgtgtaatctctatagcacaagtcagacaagattgaagatgctggactctttggcagttcccaggagccaaccctatctcttcattatggtcaagtctagaatgtacaaattgccttgaatagccctacatgccctctggaggtatgtactctcattctttatagcaggtctcatttcaggacattaatatattcttaaaagtgaaagtggagggtaaaaattctcttactcatacattaaaatgtaactctaactttctcaaatttcctctctttgaaggaagcataaagatacctaccatcgcaaaaaaagtgaagtccggaatatttttctcaagttgaaattaggaaagcctcttcaaataacctagcccagtggttccagacatcgtccattgaccagttgcacctctgagtcacttttgaaatttactaaaactagagatttcaaagtcccactccagagtcactgaatcagactgaccaaccatggaagccaggtacttgagttttcaaccagctagtaagatcaat

SEQ ID NO: 52552 - DNA, 949 bp, Bovine  19866881231807
cattgtgctgaataggctaatcaccaaaactgttattaaataaaccaacaatttaaaaaaattcttgagtcttatggtgattggatgtttctgctgccacagtgattaaaagactctgtgaattaactgttgtatgctcatatcctgagtggtattggtggaggtcaatgagggctgatagaataaaaataaagtaaaaaatatgatttcagaatgtgagtttatatctagatgaggagactgaataaccgtgtagtgctgacagtaaagtgcagcagttcagggaaaggcaagataaataactgtgtgggccagagctgtccatcagagaggaatgagagattttagaagcatcttttcattttagagaacataaataacagaagataagagtttcagccaaataaaacattcttcattggggaaggagttaggtagaaaatgtaagaaatacattggaatgtaacttgctgcagtttaccaggtacaagtgaatgacttggtttatccaacaattggaatataatgtgacttttaaaattctttgaataatggcagtaaccccccaaatttgatgaaatacaacagggtttcaatgttaaccttttaaaaactttttaaaaattatacttacctgttcagttcagttcagtcactcagtcgtgtctgactctttgtgaccccatgcatcacagcacgccaggccttacctgtagaattagcaaaagtagattatattaattaatcagttgacttgttcacagaccatggtggatgctcatttgatttacaaaattttacttgtgcttttagaaacaccctacagtctttcaactttcaggctgtttggtattatatttgttcttattatggatatatgttcacttctatgtcattaggtctgataaataaatatcactgtaaccttcactttttttttatggtaaag

SEQ ID NO: 52553 - DNA, 1769 bp, Bovine  19866881285879
gagttggagtagcttccctctgcataagactatttggggtacatattccactttgccaagtgaggatagtatataaaaatggttacttatgatagtgagattcgttaatcagtttatgtcacggaggctgtttgtggagtgtcttacatggaaaattttaagaattgtttatgtatgtttatcatggataaacagattaatccgtgttgctgcagagatgaacttaggtgacctttgtacatccttctcagaattatgatgtaatggttttgaaacaagaatgtccctgaaattttttattcttttgctgtttgccaattaagccaaattcctttttttttaaaaagcagagtgtactcaatacccttaggagttacttttggtaggtggtgttactgtgttccagcaatctgtattaaaattatcctttgtgagttaccaaaattttaacacagaggccacagagaaattacatttaattgattctgcttcatttatgaggaaggaataacttaggtgtaatggaaaatgtgacttctggatgcagatttacaggaaacacgccgactgtatagctggctgtgtttgttcaaaactgaagttgttttcagcaaaaaataggctgatttctgttaccaagtcatgggaatagcaatttctgtaaccagaaattcactgcagatttgtgtagtatccagaatgcatgcatgagcagcttataaaatcctaggtcagttctttgactctgcttttttatttcttgtgaaattgctgaattccccaaatgaacaaaaaccaaggaaacaaacaagcaaaaaagttcagagagatttttggattattttattgatgtccacacccagagatggctaatattctcccttgttcctccaattcttaaatatagattttgaacagaagatactatggttaatgagaactgaaggtagataactggtattccactggccactcatttagatcaaatgctaatcaaagttttctaaagtgcgtgagaagtgtgtggctaaaggaaacttttcctgagttattatttcttgctcaaatcaaacttggaaggtttatagattttttttttcccctatcagattgactggaaaatgtgtatgccacattctctttaagctccttttattctattgttttatgattctttctgacatttgtaaaacacctaagtgatgaatataatgggataaacttcaggatctttgcattgcatattttttgtgtacagtagaagtgacagagaggctttccttgtctggcaggtggggaaaatgttctgtctttaagtgtgaagatggggaattttaatagaaggctcgtactagcttggatgaaaaagagatcaatcaagggcaacgtattagtagaaaaaccaacctgaagcttatatttattttaagtaacaattgattttttaaaatgtcactgaattccacattttggccagtgggggtgggggggcacagaaaaaaagtacatgaataacactgaaggtaaggagataggaaagtgttagccgctcagttgtgtccgattctttgcagtccgtgaaccatagtccaccaggctcctctctgaccatggaattatccagggagtaataccggagtgtgttgccattcccttctccaggggatcttcccaaccccgggattgaaccctggtctcctgcaatgcaggcagattctttgccatctgagccactagggaagcccaaggagagtgaggagagaccagtt

SEQ ID NO: 52554 - DNA, 925 bp, Bovine  19866881295624
tctgttatttcatgtgtcatgtggctgggaagaggacagtctggactttgaggcagctctggtaaatattggcataatcccggtgacactggaaaatcattttcacatcctgattcctcagcactcaatgtttacaaatgtccttaacggacttgctttttgcagtagcgtgccccttttctatctgtattgcaaaacattttggtaacttgtgcctcattctgggattctgaaaacatttggtttacttctgggaaatctttactgctttatgtatctctcacctcttgcaacacagctgacaatacttgttcatacatgggacagacgtgtcttgaggacttactctgtgccaggcattgggttcagtactaaatatacaataaagagcaaaatagacatgaccttgcccttgtggaacttttactctagtggggatagacgatatgatacttactgtggtgatacaaactttagggtattttgaatgttttaactattggtttaatctttctctaaaaccatattgatcctctagagaagctgtatagcagtagctatggttagagcctaaataatactgaattgaattaaaaaaaaaaaaaaaaaagcaggatgctaagaactgtcttaagttgctattttcctattatgttctggagaatcatgggcttccagagctgttgggcattgacatttttgcagttttatttgtttgacatttttatttccatcctgcactgacagactcatctatgtcagaaaaggtcagtatactcatgctttagacttaaagaataaggtttgtactattcatttggactagtagggctagatattcagagtagtggttttagttgagaaattaaacactgttgggctaatttaggaagttgccctgttaatcaaaactaaaggaaaaaaa

SEQ ID NO: 52555 - DNA, 1155 bp, Bovine  19866881311747
ccccctgggcaagacaaaagagtaactttggatcaggctcctggagaaggaaatggcaacccactccagtattcttgcctggaaaatcccatggacagaggagcctgatgggctacaatccatggggtcgcgaagagtcagacacgactgaatgacttcactttcacttttagatcaaggctaactcacccctcagttagctgtctagtcattatgcagagtgtaactgtgctgcagaggcaataccttcaataacccccgtctcccctacccctgccaggagccagcgtcaggtcatcaccatcctgctgcgggagggtctccccggagctttcacactgtgggtgccaagccccagggctcaggtctgttgtcctttttacttgaaagccagaggagagtggattcaaaaggtctggaaggtcagagccagccagggcagtgcaaagaggagccacttaacaggagcagatgaacccttgactcctcctgataccccagaaccctgaaagagctggagaattttaatgtgcaatacacatgcagtcagacaaaatccacctgtgagccaaacacagagaactgacagtttccattatctctcttgtggtctccatttgcacaactgaatggcaagtagggctggaagagagaaaacaaaggctaatccaatggtcattgataaccggatttgcaattgcagccagagaggcagcttagacagacacataaatgcacacattcacactctcattctaaccacattgtccgtctgcgactctattctggcttcccttttagcactagcctaagccctgctgggcaataggaagagtagacttagtcactatagacagataatccaccatatagtcaatgcactcacagctaatcaggtatcaaacatctaatattagttcacataattccctcctctcacacacctgtacataggtaaatgagatttggatcatgcgggggcgggggagggggagcaggttgggggggttgctaaaacaatgaccaagaaatagagaaagtgctacaaatgactcaaactagcatgctgctgctgctgctaagtcacatcagtcgtgtccgactctgtgtgaccccatagacggcagcccaccaggctcccccatccctggggat

SEQ ID NO: 52556 - DNA, 1970 bp, Bovine  19866881322267
cttttgtgcatatatataataagcacatattgctatttagtcactcagtcatgtccaactcttttgggaccccatggactgtagcctaccagggtcctttgtccacattctccaggcaagagtactggagtggattcccatttccttctccaggggatcttcctgatccagggatcaaatctgcatctcctgcactggcaggaggattctttaccactgagtcaaatcacatatatacatgtctaaatatgtacacatagacacatttacatatattgatatatataatgtgtatatgtatgtatgaacatacccactatcaatttcctaatcaaacagagaacaaatgaaaatgactcagacctctgaaccatttaccatctatatgatcttgtagaagttacttaaactctcaaactgtttcttcatctataaaatcccttatagtttatactttaaaaattattatgagtattaaataggctaatccatcagaaactattccatagtccaattaattattataatcattattactactatacatgtgccaagtcaaccaagagcatgaaagtcagactgaaccgttatttcaagttaaacctttccaacatgcttgctttgggtgaaccctcatcctattggctctctagcctgagcgggaggagttttccctatgaccacacgggaccccagtgagtcagggagcagcttaccttgtgggcacagggacctcagtcagggcacccagcatgactgcctgctgcagccgaacaaaagcaatgaaaggagaatccaagaagtctacctcgccaacaagcacgttggaagcttctgcatcacgtggcagttttttcatgaacttattcttcagctgcatgggaagagccaagaagacacaacttatttccagagaagggaactcaaagaaatttctttatgagtctacgtgcaccaggcaggccctagctagccattcttctattatgtctaaccattctattatataagtttttctctgtattttggatgcaaaaacattatgtgtacagccatgtggtttacatataaaacaatatttacatacgtatcaattcattaacttattcaactcaataaacatgagtttaagagtctccttggagccaggaactgatctaagccctgatgataagggatgtgtcaactaatgacatggccttcttgagctcatattccagcaggggagaagtaaaatagaatttaaagtagtgataagtgttgagaaaaaaaagtaagacatgtaagaggatacgtctttagacaaggaggtcagggaaggcctctgaagcagcacgtttgacactggggtaaggggacaagccaagaaaagatctgggcaaagaaaattctaggcaaagaaaagagaaagtccaaagcctctgagccaggcaagagctaggcagttacagcaacagcaggtggccaagtgtgtgggagcagatggagcacaggagagaaaacggcagcagatgaagttgcagacgtgaggggggccagcaggtgagggtcttgaaggcacagtaaggagtttcagatgttttaaacagaacttacccactaaagaaaagtccatggaaaggtggagtagaaagacctaaatttaggagatatcaccatgtaatcaggatttaagaccatgtgataggatgatacaacctcgggtgttagtgtagacagaggaaagggctgtccattgacccttaacatctgcccactgaccctaaatcctggggtacctaaccttttataggaatggaagcagatattggcagaggacactgaaaaagagcagcctgtgaggtaggaatagaagcaggccttcaccaaccaggactttaggtgaagaaagggaacaatgaagagaggattatctgcttcagtgtcaaaggatgcttggaagttcaaataagatgaaaagtaataaagga

SEQ ID NO: 52557 - DNA, 1430 bp, Bovine  19866881329357
taacacttcttaccctgagaagtcctgaaaaattagtaactctgagaaagaaaggataaaatatagttatctgtgaaacagtagcatattttttgataaatcattcttgaaaattaattaagaatgcttaataaaataccactcataccctttgaaatcgcctaacttttgtcaacccttttatgattatcttgtctaatagactctgattcttttgaccaaacttaacttgattgaacttgcaatgtctcaaaggttagactagaagtaaaagataaatgattttgaatctctacttgataattctcatttttactcatcttggcaataatctatgctttctgtaaagtcatgaagtgttctgtcatgaagtgaattatagatataaatacaaaaacagattaaagttacctgtaatcccaccaccccatatgtaacttttatatagttgagatgatgatttattatatccaactttgacaggtgagtggagaatatgaaataatatgtgcttattgttcaaaattaagtaatatcatggactaccaaggagggaagtaaaactttcttagatcttacttgaaccaacaatacataattttttactttgcttttctttcctataatgtttatgtcaaaggaaattgaaaatgttattaaaagtttactataatttataaagtcagcctaatttattgggtgcatgtaccattatttacttaattaagtgcctaataaatagaatgatagcctatttccttagcactgtgataaccatctttctggttaaatctgtgttttggattatttctttaagataaattttcaaaagtgtaattaagttggcctgtggatacagaatttttaaagtgaatgtagctaaactgctttctagagatgttctattagtttttatttaatgtagtttgaccctgaggcattcatattttttatctaaatacttttcggagggaaaaaacactaaaattacgctcagtttggtaaagatgatacacagtatttttttgatagaacttctaatattttattcttaattgcattcagaaaaccggcagtttcaaaactttggtgcataagatcagaagaaaatatttttgtatgggctctttgattatcctgaagaactagaaaatggtatcctggcttactgttaattttctaattcggtaccatgttaaactaagagccaaaaagtatcatcttcaaagctgtaaatttgtgttacgggttttttatttagttttaatttaacgcatctgtatttttagaacaactaggctgattattatttttttgattaggtgatgaatcaagattgatcctctaaattattttcatatagcagattttggacttgctttgggcaagagagatgacatttattagaaatccaagtaaaagaagacctg

SEQ ID NO: 52558 - DNA, 1587 bp, Bovine  19866881499192
ccagtaataccaagtggctcagcttagttgcgctcagtggcaggagacattctgaggtttcccatgtgttgggagggggcccaagacaaagaggtccttgtaaaactcagctagagacttggccatgggacagagtccttgaagaatctgcattaaccgtgccttgcccaggggcatgcagctgtcgcccctgtactataaaccatcagcatcatggactgagtctgcatctccagatagatatttgaacttctttagcttattgacgttataattatccctgaaccctggagctgcccttgtaacatcacgtgctttttctccagaatcatatcacacttcatcattaaaaactgcttactctgttttctcacatatggcttttttttttttttttttcctgtagaagatggttacttagcctcacatcttactttcatatttgccctgtatgtgtacatattgttgtttagtctctgagtcacatctgactcttctgcgatcccatgaactgtagcccaccagctcctctgtgcatgggatttcccaggcaagagtactggagtaggttgccatttccttctgcaggagatttcctgcacccagggatcgaacccatgtctcctgcatcggcaggtggattctttaccactgaaccactaggggatttcacatgtcacacgtatgaataaaattttaaaatccaccaatacatttgtttcttttgccattgtaaacagagaacatggtatcctagtatttgaaatcagaggactgtgggttcaggttttgcttctgccacttaatagcactctgacctgctgaggctctttttccattaccctttcccatcttggttgggatttgtgagcttcaagtgaggtaatatagttaaaagcattatgtgaactgtaaactgccatgcaaatgttaattattgttattattttaaatttactctgtctagtataatccagcattagtaatgaatgcctcatgagtcctcttaatcccagagaagatataaacttaatataccctactttggtggtcagaagctatattcatttaagagctactgataaggagtgaaagttgcagatacactggggttctgtaagcagccttggctagagaaatggaaagaggctgagaatagagatcagtaatggcttagtttctgtacagcctggtgaaagactacagtttgaaggattaacttcaatgttgaggctgatagtgttttatacttcacattgatactccaaggtagcatttatcagctattaaaacagtaattttgtgaatcactaaatacacacatatggtcagatgtgtattatgctttttcagggaaatgatctagatgttttggtgaaagtaagagtcctttggttacacaatcaacagtataggaaggaagatttcaggatttccgaaggtgagtttcacatcctggaaaatgtgtttccctcagttggactccagagtcatcttcaggttagaaaatgtcaacaggaaacagttctggttcaggaagtgatggattctgtttctcactttgcagaaaggcttctgggggtcagt

SEQ ID NO: 52559 - DNA, 715 bp, Bovine  19866881534723
caccctaggatctgcctccccacttcttcaggactttcctcaaatgctgcaattccctctatggccttcccttacagaccatgctatgtaaaatggtattacctagtacctttcgcctgttgcaaaactccctacttctgctttactttgccccacacaatcagattcacatttcgttatctgctcactgtttgtctcccaccactacaaagacccctaaggacagaggttttccattcattcactgctgcagcccaagcacctgtgactaataatacaccataaacctgtgttggctgaccgaacatagaaaccagtaacaaagcactgacagaaagattaaggggaattcagaccagaggggaacctcattatgaacaacagaagaatccataagttaccttccagtgcgctgcaattcctcacaatctgcatgtcctcctcctccatggcctccatcgtggggcgtgtccccattcatctgaacattctctccacctgagtacatattctttctaatcaagacaacagagcccaagagaagattagttttattttattcacctgcctcttagctacatcatgcactaactaatgaagagatggaccaaaaaccctttgggagaaagattatgatttcctgccaccatcctgtgtgtgcttaatagctcattggtgtcgactcgtcgcgacctcgtgggtgtaggttcctctg

SEQ ID NO: 52560 - DNA, 1284 bp, Bovine  19866881586177
aatgctagcaagcccatatgaagttctgcaatctatctgtgtactgagatctgcccagtaaaggcagttctctctcagaggtatcaagttcattagaaagaagctggaattcccaatttgattttgaagccatttgtgggctaatgtggctatttagataatttggttaattaaattttctccatcttaaaataatccatcaatttctaaaagaaaatactggtaccacaattgccaagcccattagtaatgtctagtgattccacaagaggtttaggctctggagtcagaaagcagggattcaaatccccaccctgcaacaactggttgatgcaaccttcagcaatttattacctactctgtgcctgctttctcatcgataaaacaggatatagtccctactccacaggactgctacaagaaataaatgagggagtacatgtaatgcacttaggacaatacttggaacacggccaagcactcaataaatgttagctgttacccagttgattctagaaatccatcattagttaagaacacaggaatgggatttaggagcagtgggccacgggagcacccggcctcttccacagacaagctatgtcaccttgaacaagtcacttcacttctctagtgtcaatacgatcatagcaggaaatagaaggcaacctcagatggaattctgaggaaaacttttaagatgtgaactatttacagaggaatgagtaacaaaaatggcaaggttctcagggactagagatgtcaggaagccatttctaccctcgtcccccgacccccacaacagcttagaaaggctaaggaaagaagagtcaccagagcctgatgagggcagaaccagggtggggtagggggagccaccggatggaacaagccactgccagactgcccgggagagcagtgaccaagcgcggcgggggaagcagacatgccctgacctctctgccttcctgtgctcctgaggctctgctttagccaaacccaacaggaagccagagggcagaggagcctgcatgctggggtccaccggggtcagcctccagaggcacaaagcaggacaatgaggcagagaagaacgggggcggaggagaagcaatgtgacagagggacctccactgcatcaaatgttagcacctgccaggtgacttaatctctgagggcctctcaatctccagatgctaaaatttccaaattccacttaactactattctgtgcaggcttccttggggctcagacagtaaagaatccacctgcaatgcaggaga

SEQ ID NO: 52561 - DNA, 911 bp, Bovine  19866881708374
aacaaaaagttgattctctaaacctagattttttctgaaagctaattctgcctcagggatctttgatgttgaatgttgatgaaaaatcagtcaaatttgtgactgtcagtttcagaaccactgtgctgaataactatatctagattccaaattctgccaaccgtttcttaccattctcttattccctctatgtgttctctgatcctctaatacagtcacacatcccatttcttgattggaaagacattgcaagtgtttttacacaaaaatcctggaactttagttttttttttctcccagagatttaggaaatttcaaagacacttttgttctaattacaaaagtaaaacatattgtatcttatattaatatgtattcaattaccttgttttaatgttctgtaagcacagaacaatttgcagatgtttttcttgtttgctggtttatatactaactttcttattcacttaactaattaattaattagttaatgtttgttttccctccagcatataaattagaatctttttgtcaggttctttgctttatcttcaaagcctgaagcaaaacctatttagagcatagacattactcaataaatattgctgactgaatacatgaatgaattatgcatgtattagaattgatatgaaagtgaaaagaagaaaatagaagccctagaaataaactgaataacgtttaaaagatacatatacaggcagtccttgctttgcattttattgcaggaccataaaaatgactatgcaagatgaaattatataaaacaatcctaatgatcaatgagaaaagttattattggtctttgacatttaaaaaattttccaaatcattaaaatttctcttagtgttgactgtaaaggtagagggaaatgaaagaaataataaaacca

SEQ ID NO: 52562 - DNA, 1099 bp, Bovine  19866881938134
cagggggcactaaagtttttgagcagagggagtgacatgtttgcatctgtgacttagataggcccttctggcagttgtgaaggatggatttcaaggagtaagaatgaaggctgggaaaagaggaggatattataataattcatgcaagagataatacagatccaaagtagagaagttgtcatggagagttagggaaaggaaggaatgaataggaaggaaaatagcagaaggggatgaaggacaaggagaaggaggagatgacagggacttctggcctgacaagggaaggatgaggggctcctgagacggggggcacagtaagaggaatagagttgggatccaaattaccaggacaatgctaaacaccataagcattcagtttaccacagaaagaaggccattatttctgaagattctgccagtgattttcatcaaagtaaaattctactgcttgatgccaagaagaaatttcattattaactttggaattgatatctgcagctagaatattacatttgcttttcctccagtctctctcattcacatgtggacagacatactaattcaagtagttagatcttcagtggtctccaataattaaattcaggcattgtttggtcgaataaaagtggtttactcttatctgcatgaaacattctccatcagttttgaatgaatccctcctatctcagaagtctcccgtaaaaccacagcctcagcagttatttgggaggccttgaactgataaccccagtcctttctcactatgagaaaagctctcttcctccatctatgagggtgtgcaagaggtgaatacttccttcacactggccttgcatagttttacataactctcagcactgcccaaaaggacacactccaagtcaagcccacaatttctgttacaactgggtgggagtcattggtgctattcaccaaagatttcttaatctccaccctctatgcacatggtaggataacaattctttgaaattaggtgtggacatatgactcactttggttagtgaaatatgagtgaaagtaacacgtcatttcggacacaagttattgaggcaacccagagtcactctaactcttc

SEQ ID NO: 52563 - DNA, 609 bp, Bovine  19866882170533
agaacaatattcaattatctgtgtaaggacagtctgttaaaaggttaccacacttaacaggtctctttcatttactaatttagcaaccagttcatgtcaaccatcagtgacataactaatgtccatattgtctactgtctccaagctagtgatttgatagctagtatcctaagttctaagcactgtacaacatatcaaaatagtgttgctgagccaagtgaagcataaattgtcttataacattagccaatttcctaatttactcttctaacagagtgattccactgacagtaacagcaaggaaaaaaggcagctttagaagatgccttatctttgactgcatcttattagtttgaacgagggatagcagtaaaagcggtgcatccacacacatatacatctattcagtatcaccaaaataccaccaacatttcgaagtgatgccaactaacattaaaggggctatgtttcagatgatgtgttaatcgaagatcaggtttcacctacgcttgatactgaatcactttctagatcatgatttccttaagtaaaacttccttctgaaaaaacaagcatctggctgagctccatgtatttccacagaataat

SEQ ID NO: 52564 - DNA, 1446 bp, Bovine  19866880265776
tgcaaagaatataatcaatctgatttcggtgttgaccatctggtgatgtccatgtgtagagtattctcttgtgttgttgcaagagggtgtttgttatgaccagtgcactttcttggcaaaactctattagtctttgccctgcttcattccgtattccaaggccagatttgcctgttactccaggtgtttcttgacttcctacttttgcattccagcccctataatgaaaaggacatctttttttgggtgttagttctaaaaggtcttgtaggtcttcatagaactattcaacttcagcttcttcaacgttactggttggggcatagccttggattactgtgatactgaatggtttgccttggaaatgaacagagatcattctgtcgtttttgagactgcatccaagaactgcattttggactcttttgttgaccatgtgtcaattatatttcaataaaactggaaaaaataaaaggaaaaaagatattatccaggatccttcagctagaggtaagactttattcagctgtttttgtttttttttgtttttttttttttttccctacatatgattatgccagttttagaggaatagatttccctctgggccatcatggttgaattgtatggagtggagtaaatgtcacagaatttttcacactcttcccctgggagccctgtactttcctttaggaacctacaggggccagtgggagagcatgagctggagagccttcaagtgttcccattggtcagggaagatctacttttatctcttttgcacatgaatttctatgaaataatattttagatacaatattcttcagcttaaaaaccactgtcaaaacaagaaaagaaatccagaataaaaaaaacttcctattccaaacctcagataaggtaaataatttcccacaaatcacatagctcacagacacacagaaccagcaaggccataacccagttctcccaagtcatatcccagagctctttctaccatcatgataaatgctactttcctgaagaaaaaagtcatttaaaagctcattacagaaatgataaactgggagccagaaacaaaatcttaagaaaaaaagtaggccaagtgctgtattgaggtctgagaaggccatctttgcctactcaggcactgattcaattgttcattttggcatgatttgagctttcttctttcttatgtccaggtacaactctttttcaggaaaattcactacgggcaattatctacttggggaaacaaatgagactctttttaatggtgttccttgccctgctttgaagaaggataaatcagaacttgttctcaaaagaccttaccaaaaataaaaatatatttcaatattcacaggcagccctgggtaaggaaaaatatacatgataagcaggaaaatgcaaacaatcaaaatgttattaatgatataatgt

SEQ ID NO: 52565 - DNA, 1490 bp, Bovine  19866880367682
acatcctagctaccatttttattattaactgttggttagatgctaaagagtgaagaaataataataaaaaaccggtctgggaaaaaggctgagaaaaagactctctatagagattttcaaggcaagtaaaacagcattagcctgctgactggttgtgatggggaacagttgaaaagagcttagaatttctgaatggacacaaaagcagtacaggtgtcacttcaatctcatataatcttaaacgaagccccaaatccttgttccttttgtgagtcagaatcaatataggcaagaacgaggccacaggaaggaagcatggtatttgcttattcacaatgaatacttttcctgcaatatgtttataatattggtgcttttgttttagaggtataatacaccctcccaccaccacatacacacattccaagctgaaacatggtaccaagagcatagcatcatcccacacagtttcattattaatagtgttatcatgaatgcaaatgttgacacattatctgcacaactattttctagtaaggaagtccacaaataacacttgacatcttgtttgcatagcagctaccatgtatatttttcaccgttctttgtatcttcactgcatattggagctccgcatcattttggcctagttcaacatctttaaatatgcaaacctgattcaacatcaaaggacaaatcagcttcaaactgattttccgcactaacagtcttgtgcatcaccaccaaatattatcacattgattaccacacagttttaagattcaatggttttgtgttgatttttttctccattaatttatgtggcctttcataatatgcttttgagggcataattttttagttctcattttcttaaatctattcttcattaaatgtgtaattttcagtacaactcagggttttctagcatcatgccgttaatgatacttcaattcttttactctattgtttgcaatgcaattaagcaagacactgaatctttaacattaacaattcttccgtatgactacaaccattaaataactactgcaaacttgctatcaattctgtagggtttacatcagaaacaatcttagaagagctatgtttcaccataagatgcaaacatcttggttcctaagaaaggcatcgtggagagggtttgctaattgatttttctttaagaacaatctgtttctcttccagtttattataggaaacactggtatttgtcatttttccaatatttggaggctgctgccttaataaatgcacatatcagatgatgctcactccctgtctgatgggcgaatggtgttgggcagaagaaggtcacactgatgttaaatttgctgctgagcaaaggatcaaagtgtaaatggaattctgaaagctgggaaagtgtgagtgtgccagtgtaaagtaatctattaattattgacagctaagaggctaaaaattcctatttggtcatgacatcttaattttta

SEQ ID NO: 52566 - DNA, 697 bp, Bovine  19866880596354
acttttaaaatgatccgcatcaacaaaacacaagttacattctagaatatggtaaaactttagagggagatttatgccattttgaatgaattgtttcaggttgcctgcatttttaatacctctttcttttcacagagaagagaagagaagtttgttatttttggctttcattagcgttctcacttcagagtttgtataggattctgctttcaaagccagcatctctcttctttttagcatctgttacataaacagggtgaacagctacaggattccaaattggtgaaggaagcagctaacccgcttattcctcactagccagtgtaactgacagcacttagctctctccacccctgccacctcagttttgaagggaagcactgttttgctcctttcccaacactgaggttctgacaacaggcagatctgaggcaacgagtgttcctgggaaaagagcagaggagggaagcatggtagtaggagaatgaaggtaataagggaaatgattaatacttctatagtatttttttgcatatttctttcactgattcttataccatccctttgagaacatataattgtgtgtgtgtatgtgctcagtcatgtctgactctttgcaaccccatggactatagcttgcctggatcctctgtctatggaattctccaggcaagaatgctggagtgggttgccattt

SEQ ID NO: 52567 - DNA, 1805 bp, Bovine  19866880608375
aaactacgaactatgcagtttaaaacatcagaaattcattgtctcagagttcatgaggttagaactcttaaatcaaggtgtgggcagggccatcctctctttgaaggctctagaatattgtcgttccttgcctccttctagcttctgatgacagccattcttggccttccttggggaaccaaaactccaacctatgccttcttcttcacatggcttacttctccatatgtgtctgtgttcaaataaccttcctcctataaggatgccacgtgtgatcttaatcttaacataactacattttcaaacaccatatttccaaatataatcacactctgagatttggcaaaccacatcctgaggtggacatgaattttagtggaacacaattcaatccaacactgttggttatgttggaagattagattgtgtgctacaggagatcgaggaccatcaccgactaatctcaatattctcagaacctagtatgaagtattgtaagtatcatgtataagtacatcatatacttataaatgtttaatggagtatatggatgaattagtaataggctagataatgacccttagatatgaaaaactaataaattgcatccgtctctctttcaatcacaccatgagccccaaaataaagcagcagtgttagagaaccagtgaagatctttccagtttaatcagactctcctgatcttctctaaagtacatgaaaataaaacagagcttcttataaaacagcatttccaattaaggaaaaagacagaacagtaagctgtcttcatttcatgtcaggctctcttggttctttatatactgtttttccaggagtctagaaaaatgtgtcagaagttttctcagaattttcttgctttggcagagctatgacagattataaggttagctctgccacttaagagaaagagacatctcctttgtctttattaaatagaaggggtgactagagttagcatcttgtggtatgaggaccccactgtgtgctcatttcccaaagatgtctgagtttagcattgtaataatgggccaaagggctataaaaagaaaatactgtgaatctttgtggtactttgtattcactttgatgaaaaaccctggaaatgaatcacagctttaaaagacaaccacaggacagcaaaacaaagaagatttacaaccgtgctatccccttaaatccttccttgtttctattctttttggttgttgttctggagctaagtggcacactcaccctgacattagggaatagcatctgtcaaaaataaatatctaaaatcacaactgcttatttataaaggtccagactcatgcatccattgataacaatatactgttatttgaggaacagcaatcgcactcattcttcagtaacacttcctcaccaaccttattacagaaattccactgttcagtcatcaggtattgggtaatggtttctcctactatggaaagtgcaaatgttcccagaggtggaccacattaaaggcttcatccataatactttattatgatccagataatatctttacaaattaaaaaataaaactacctccaactattataatagaggttcaatctcgtgtccctggagaaggaaatggcaacccactccaatactcttgcctggaaaatcccatgggtggaggagcctggtgggctacagtccatggggttgcaaggagtcggacacaactgagtgacttcactttcatgcactggagaaagaaatggcaacccactccagtgttcttgcctggagaatcccagggacgggggagc

SEQ ID NO: 52568 - DNA, 2572 bp, Bovine  19866880856111
atttttaaatgaattttactatacctaattcataaaaaccttcattttctagaacttttaggacatattcagtaaatctcttattgataaaaatctcatgaaatcacagatttcatgcctcacaaatttcttcatttcattcaagggagaattgattccatacttttttctttttctttttggtcatgaatgaaactcaattgtaacaatttattgcatgtgcttgtttatctgtttgtctgtctttccagaccatatgctccttgtgcttagcagaatccatggtacacacagtaggtgttgtaagaatgtgttgttttgtttgaaagactggctgagtgagtgaatctaagaggctgtgaaactagaaaagtacagaatatacaagacatatcagagggagactggctggttacacatggagcaaagggatatggcagatgaaagaggtgatgacacatgattaaatattgagtaaaatgaaaggatgatataatgtatgcaactgggcattaagatattgatagagaaggaaagtggggctaggttggaagaagaaaaaatgttttcagggaagtaggtggatagagagggaaaattgggagaccagaattagggcaggggaaactcatctctttcagaggctggtataataacatggacataagttcttctattatggaagactcagatctccttttggtggccaggccagttattaatttttccttcaaaaaaaaagtagggagagggattccctggtggcttagtggtaaagaattggcctgccaatgcaaaagacacaagttgaatccgtaatctgggaagattgcacacaccgcagagcagctaaacccatgcaccgcagctgttgagcctgtgctctagagcccgggaactgcaaccactgagcccatgtgctgcagctactgaagcctgcacaacccataggccatgccctgcaacaagagaagccacttctctgagaagcccatgcactgcaacttgagaaaagcctgcacagcaacaaagaccggcacagccaaataattaattaactattattattttaaaaaggagggagaccatttagggaagaggtcaacaaattttttctattgagtaattattttcagctttgcaggctatacagtctctatagagaattcttaactctggagaaaattctcaattctgctcctgtgaaaacagccagagactatatgtaagtggtccaatttaattttatctagagaatcagatattggctgggttttgcttggaggcataattttctaactcctgacttggagctcacagattatagtcagtgttggtcggtcctctgtttactctgttgtgttttcatggcttgtgcaataaattggcttaatgtgaaattaaggcctctctgctcagaacaaacgaacaacttagcttgcttactaataaactccttaatagtaaacagtctaactgaaaggaaaaaaagcacaatgtgagggttgtgagttaggtttatttggggcaaaatgaagactatagcctgggagacagcatttcagaaagttgtgagaaactgttccaaagaggtaggggagttatatatgtgattttggtgaagagtgagtagtacacgcaattaagggtacatttttgcagaaggttgctgccagtctggtgactgtgattcacaagaagtagacatcactagaaaagattttatttatgagaagatgcaagagttgggctcctaaaatcttctcctgaaagtatctatctggagacctgttctgccagtttttcccagagcagagcagggcctcatttctgatctccactctgaactcctttcagggggttttgaagctacagtggcacataatttaatccttgtagaggtattttgacaagtgccaatttgtaaggaacaaaataaaatcttttatttcctattagctacaaaccattttactattcgaaagttaatacaatatttggaatgcactcttaaaatatacctatcaagcagttgagaatttcaaatgatctattttaatccttttgttgttcaaaggggaagagacaaagaggaaatgattgcttcagacatgtgaactgggggaagtgctggacatgaggtgataggtgaacaggctagctggagaagaaaattaagtttgttctcctcatcgtttgacttaaaatcagtacagtttgtctcaaattaaccataaattatttcttacaggggcatttttgttagcaatgactattaatgttccatggctttgttttgcaagatttctgaaaaaacttttttttttgttttgtttaaatatgattgatcacataaaaaaaggagtctcagtggattccaattgtggtgctcttcattccttaggatactagagaggtagtattctgatcacaatggcactgtaagtttatgtataaaactgtctcttcccaactataaatgtatggcaatagcatctataaataatacatataggatcactgttattcggaaaagaagataaacatcttacgacaaaaaatttaaaagaca

SEQ ID NO: 52569 - DNA, 1435 bp, Bovine  19866880961908
acttattcttttaattctctgattatttttccatgataaggcttgatgatttaagtaatattgtactaccaaggtatctccattataaatcctagacttaaagtttctttgaacaaaatttccatcatctttgaatattttggtgaagttgtatgattgtttaattgtgtattggcatggtagagatgtattttagaagaaaccattttctatagaaatgaagcatttgtttacctaggctgttgtgtgtagactgatatagcaaatgtattgatgttttatacatgtttcatgaattactagtttttcttgaattagcaacaaagaaaaatgataaactacttagaactataatttgggaacctacgtatctcagaatatgcaggaacaaaatgactgtgagtacatacctaggaattaggaatgtatctttacattggcagcattttaagatagccattgaatgttaaatggaaacaacctatgaagtataacgggatctatggtatttaacatggggaagttagtaataccatagaataaagtggtagatcctaaaaggtgctaaagattacttagtatgtataataatgattagacatgaggagtttctgtgttaaaattagatccttatttctgcatttactttaaaaatgaaattgatgaatagatgaaacaagattggccttgagttagtaattgttaaacagttatgatggatacatggggctcattattctagtctctgtacttgtgtatatgttggaaattttccaaaacaaagagtgaaaaatctaaaaaataaaattgaagaaataataaaaaggggggactcccaaaatattgtattgggggagaaaaacctgtaaactcacccagagcttgaacatatatgagaaacaccattccactgatgaaaggtactcagtaaagatcaaaggaaatctgagggaaaatttttacaagtcaaaaactaaagaggttaagaattgtcaatcctgaagaagcttcagcctgccaataaaaggtcatagtagtttctgtaaagtaaaaacataaacgtggctaaaagagtaagatctgacaccagagttaacagtacatccttataacatgtacaagaaagctgaaaagaagaaataaaacatgaatttatgggacaacagtactaagggccagttctacccaggtatgtcatgaattaattttatgtaggttgaatgtttatctcctttatcatggaaagaaaaaaaaacatgtaatttgttttttttttagtgaactaatatttattaagaaataagttagtatgtaagaatataaggaatgaaaggaatcaaagtttattaattgttgaaaagtagattaaagatgctgagacaaagggaattctgtggaataaatgaagaatcctgaagatgacagagcaatagta

SEQ ID NO: 52570 - DNA, 623 bp, Bovine  19866880978289
gtttggagtctgatgattttaggtacaacctaaactaagacatgcttgggcatattatttaacactcagcctcagtttattaatctctataatttacagagttgctctgaagatttgaactacttcattgggaggtaaaaaggaaaggcaactgctggcctctggactttcttatccatggagaaatagaacttcagacccttgtatctcctaaacattcctgatccttcagaccatcaagtctcctgaccgtggattagacaggctgctcacagtttccctctcacagccaacccatgatggaaacaacatgactaaataggatagcacccaaaaatttttttatgtcccaactgatctatgaaattattgttttccctcataacatttcaattgatggaataaagtatgctaaaagtatattgcctttcccagtggataaagattaattcaagtagtacttataagaagtagtcaagaggaaaataagatttaaagcttatttctctaattttatggctgtggtcagctcctagtggttcagtgatcctgattgtgtgtatgtgtatacatatatgtatacaaacacacacatgtatatatatatatatatatatatatat

SEQ ID NO: 52571 - DNA, 1381 bp, Bovine  19866881063746
aggaagagattattccctccctacattccatcggacacatgaatatagtagaatagaagatggcagcctggctactctgatgttatatgtgctttggaatgcaaagtgaccaattagggtatattttaagccaaggttttaataatttatgaaatatatctttggaccttttttaatacttgtcaagtgtaggcatatcttctggatctccttcccaaaatctctttaaaaaaaagaaaaaagagaagatttagacactacaataaaaactttaaaagaaaactccacaatattcagatttttgtggcttttataacttcaaagattgaatcagatttatataaagttcatcttccccaaaagaattccttacttacaaacaacacgacttaattgtctgagtgtaagcagaatgaatgttaaaataacattaactataaactatttctaagcaccttcaacaccctcaagtacttcagaactaattaatttacatacaattgatatgataactttggttaatttatgaataattcttatctatttgttcaatcagtcccctaggatttttattagtcagcacattgttagctggaagagtttttgttacttcagacttgacagcaaatgaataagatgaattggtgaaatagttgctgcctttcatctttgtcaagtgaacttggacatttatttccccttttctcagtgactatctcatcttgtttggtacttttttgcttaggacccaatgccattatgtctgttgaaatgtgaaagtgtttgtcactcagtcgtgactgactcttgcaaccccaaggactgtagccctccaggctcctctgttcacagaattctccaggcaagaatactggagtgggtatccactcccttctacaggggatcttcctgacttaggaatcaaaaccgggtctcctgtattccaggtggattctttaccatctgagccaccaagttggatatgtctgctgaaaatacccaccagatattttatcagccagagtggttttttgaagacataattaggtacaaaattaaagtttccatcatatagggtctggactcactaaaataggtaaccttagtacagttaatatcttatttttcgaaaagggcagaagcaggaaggtcactctgacctcccatcaccccccacacccttgttctctgaagaagaagaaaaatatgtgaaagattcactccctgtaccagaacgaaagacaacattcttattaccagagctggggaaatctgcacaaacaaaccttgttaaacacacccttaccttcctagttatttcttcaccacccatacctcaaactgctttggtcaattcttcacaaacttactacttcttttt

SEQ ID NO: 52572 - DNA, 1242 bp, Bovine  19866881150125
ctggcatcttgaggatacaggtaaggaaggcaagactgccagcagctgtagagacatctatgaaacagtgagcagaggtggccctctttggagaagccatgcaagcaggtgctgggagactgtccctggcccccagaggattattcttcttaactacaaatcctttcctcagagtcacactgccgtgcctggctgccatcagataagcatccactccccaccagcccggcgatgagtatcactgggcaaagttgatcccccctgggaaaaatccctttgatcagaaattttgttttatttcagctcatgtagacagatcacagtgaggcttctgagagtcaataaggaaatgttaatagatttactctcgctggggaagcccagaccagtgttttaatcatctcgtggctgtttaattaacatttgttggcattatttctgctactgttagcaaaatgtaaatatttaaatggcatgtatttttcatggagcaggagagctgtgagtagggaacttgaggcaaagatctggcctcatcttaatctcagccctcatcaaacatcctttccagcttttggcaaatgtctcaatctcctaacttttttgtcttgtttttttcacccctactatagacagaaggcaaacacttctaaaaggggtttataaagaatgatcatcaactatacaggaaaattctttgaaggtaaaaatgggcaggtgttgcatttccacttgagagcgagagggcttggcagagagagtacgtggagacctggaatcacactcggaaatgattctttgcgttcactctgttttaattgctcaggaagccatgagtcagggataggctctcataggccatggtgagcaagagaatattcaagagaataagctgtgtgagtgtttagttgctcagtcatatctgactctttgcaaccctatgtagcctgccaggttcctctgtccatgggattttccagacaagaatactggagtgggttgccatttcctcctccaggggatcttcctgacccagggatcaatcctccatctactgtgattgtaggcaaattctttactaactctaaaattaaagttgttcactgagaagctgttgatttcaaaccacagcataccccagttggttttgcttgaacttctagattcaacccatctttgttgtttaatctccaagttgtgtctgactctttgccaccccaggactgggcacaccaggcttcc

SEQ ID NO: 52573 - DNA, 847 bp, Bovine  19866881188312
tttctaatgatacactggtaaatctagatgttgcacgtattttttttaagttggagctttttttttttttttaaagatgtgtttctttttggctgcactgggtctttgtttcagtgagtgggcttcttactgtggtggcttctcttgttgaggaacacagggtccagggtgtgcggtcttcagtagttgagagtatgtacttagttgccctgggcagggatcttcctggaccagggattgaacctgtgttccctgcaatggcaggcagattgttaaccgctagaccaccagggaagccctgaaaatgtttttaatatgcaatttgatcaccctatttttattgatacttggtgtgtttaatcaactaactcattgtgactactgaattatttaggctcatttatgttacattcttttgtgttttcttttctccatatttcttcctttgtccctttcacttccagcctattatttgataacatttattctcactccctctttttttctctctgccaatttagaattatacttgtatttctattcttttagtgtcaacattaaaatttttaacaatcctattttatttcatatttttctaacaaagtctattttaccctctaaacactagccctctgtttgtcttggatcttgtacttttcattagttttaagagaattggtggttactggcttccctggtggctcagtcagtaaagaatccacctgtgatgtgggagacatgggttcgatccctgggctgggaagatcccctgcaggagggcatggtagttcactccagtattcttgcctagagaatccccataacagggagccggcgggctacagtc

SEQ ID NO: 52574 - DNA, 1368 bp, Bovine  19866881265220
cagacatgacagcaatttgaggagctctgagctatctccttgatataatattttactaactctccatttcacatctttttaaataagaaataaatgctaaattctaccccagagaaataaaatcttttataatctttgagacagttgttgtcatccctcaggagagctttatgcctgctgctaaatgtctacaaatcaatatttaatattttgaaacatgaagtcttaattatccatctcccctttaagcgtgaaaccctcactgagtgaaaataaaaccatttgttggctgatggattgattgccacttattagcacttttttgatctgcaggtcagattgcagggctccattccaaacacatacgatgacgccttatcatttatgcctggatgtatgagtgagtagaaaagaatttgttaacttggggctgtgtgaagatcttttcacttttgtttgtcagactaacactgatgacttcataatgaaaaaaagcaatgatcaagtcataactattatttatactccagacagacttttttattctttgatacaataacaacacacatcctaatgccctgtgtacaaactgacacatagaaaagagagttgtgtatcaaagaaggaagggaaaattctgattctggtcagttgtgaaatatgacaaaactcccaattataaaatgaaaaaaaacccgcaaacttctgtagatttttaacttgtctatatttgctcagaagattgaacccacagcgaaaggtaatccctaagcaaggagatcttctgccttggggaacaaagagatcagagattggtaacaccctgggttttctctgtatgttcatctagaacacagcaggagcttcctaaaatgaaacatgcgggaaagtggggaaaagatgtgtccatgctcttgaacctgtgaatctgaccttactgaaaaagtgatctttgctgttaaattgaggttctatatgtgaaacagatcatcctggatcatctgctaagctgctaagtcacttcagtcgtgtccgactctgtgcgaccccatagacggcaacccaccaggctcccccgtccctgggattctccaggcaagaacgctggagtgggttgccatttcctcctccaatgtgtgaaagtgaaaagtgaaaatcaagttgctcggtcgtgtccgactcttcgcgaccccacggactgcagcccaccaggctcctccgcccattggattttccaggcaagagtactggagtggggtgccattttggacatgtgtcctagaaaagaaacactgagaaaagacacactgtaaaaaagaagtccatgtgaagaggaggcagagaaggagttatgcagccacgagccaa

SEQ ID NO: 52575 - DNA, 1914 bp, Bovine  19866881382564
agaaggagatagtatagttggaaataaacagtcatatttgttttaaacatatattttgtaaaacaaagaagcagctgtggtttccataagagaacctttgagaatgcattaaatggaatatttaaagctgtaaagttgaagtgggaattcataccaattatcattgcctctaataatttagatagtatttcctagtatgcaagaaaatctctaaagtatatgatcatgttcagatttatacataggtttcaaagaaaaaaaatctctctctttctgagagcttccaggaaattcttactcaacatacaaatcccttctgattatcaggtgatcaaggaagtatttgtcatttctaaaacactaaacattagattctaaagataattcaccccaaagaggggaaaacctggctcgtttaataatgtatacttcatttacagttccgaggaacttcgttcttctggctatgacatttcccccagtcatggttctgatgtatgcagatctctaagtacattttaaatagaacaacaactgaacgatacactcaacaggattcatgaagaggaaatagacatatttcggcgtgggagaatatttatgcattatttaacagcaataatgtttgaattcatacattatgcaaatgcagttataatcaggaaaatgaaagaacttggactgctgcaacgtccttaaaccaaccattaggtacctatttgtgcataacatttaatactgcacaatgccttacgatactacagtgtatcactcaaagagaaaagttatcagagattaactgggtataaaatgaaaagttgatgaacccctgattgctaccttgatactgacttctataaatttatctttaaacaagtgcaaggatgttaatgataattaacatgatattggaataaaatgcacttgactcaaaggctgcccccaattaaacctttctgctatttagttggatatgaacaacttctttatccagagagccactgcacttaaatgcaggcactattctaagaattttacatgacttatctcatttaatctcataacaattagctcataacaatgttatgaggtagatgctattattattcctatcttacagatgagaaaactgaaacacagagaggatgggtatcctgcctgaagccactgaagtattaagtggtagatccttgactttgaatgcaggaaatctgaatccagagtctacactcttagtctcaatgccatgttgtttatattactatgatagttatttatgttctacttctttcttttaaactgtaagttctctgcattagaaatgataatagttgagtatttattatatcccaggcagcgtgccaggccaggtgaatgtaagatgagcacacatggcccctgctctccaggggctcaccgtccagcaggtagataaacatgaaactagactgcatcgtgggaagcaagagacaggcatgtagaaagagaattagggaagtgattggaagggcatctaacccatctggaactttaggagtaggaactattcaggaatagaaatctaagaaaagctaaaggaagagatacccctaattgggactgcatcctagttactgaggcctttccttatcctctagttcctggcacggaattcttcacagagaaattgattacgtagatcagactaatgtttaattggttgaattaagccattgtttcccaacaccagggacttccatattggcagtcttgggtccaacagggtctagggagagtttggagactacatgtgccctgattttaactgaagaaacatgtgccctggtttctgttgatttgtagagaattttataatatccctgacctcgccccatggggaaaaaatgtacatctctgtggaattctgtgaaattt

SEQ ID NO: 52576 - DNA, 2348 bp, Bovine  19866880358233
ttggaatagtagaggtctctgtttcctctgtaaaatatggtgcgttgtgttttaagagttgtggtaagtacctaatgctctattaccaaccacttctgctcccacggatgacttcacttctcaagagtcagctgcctttgtgcaaacttgtttatgcccattgtctttgttatcataattatataactttattaaatattacataagtatatgggactttaatgcaagaagaaagtgtttctatgaaagctaagcttctttggaaaagatttgataaaacaagtaactaagaagaattgttatcaaattagggatgggcaaaacatctgcaaaagattagaaaatattataaaagtctgggagaattcagcatttagattgttttgtctcatctaaagaaattagatgctgcattatggatgtggtttatgcaagaaagacaataaagaactccaatcaacaggctcaaagtagaagcagcagctttggctctgcatgaatacattgatgaataaatgtgcatctataggtttagctttgaataatatgtttaagaaattttaactgccttttctgattaggccaactgtcagttcccattgtgtttactcctcatgcaacccaagtgtgacctggatattcctgctctatgagaatcacaggaaattgtcccagagctccatactgggtcttggggattttgagttcggggagggctcacatgttcatggtcacctcaggctttgaacttctgcttttctgtattttggatttttcatcatcacctgtcccttatgtgctgtttgttcggtgcctcttagccctgcctatataacttggatttctttaatttctataaaataaacttaaataaaaaatttatatgtatagtgactgaagtggggaaaagggaggacagggcaaggttttacaagttagaatgaaaagaatttcagattggaaatgaggtatcttaaggcaccctactgctgagaacataacaccctacggtgtgctgctgctactgctaagtcacttcagtcgtgtccgactctgtgcgaccccatagacggcagcccaccaggctccccggtccctgggattctccaggcaagcacactggagtgggttgccatttcctgctccaatgagtgaaagtgaaaagtgaaagtgaagtcgctcagtcgtgtccaactcttagtgaccccatggactgcagcctaccaggctcctccaggtccatgggattttccaggcaagagtactggagtggggtaccattgccttctccgagtcagacatgacttagcaactacacaacaatatggagggcactgcagagtggccgtcacagagtaagtgcttagtggacgtcaccatcaggcatctcttcctatcagcacatctgagtgcatgttcccgcctgggcacattcactccccactgttctctctcaaggacaaaacataacttgaggtacatcttactcattctgtgcccattgtctttttctctgtttcctcagcatttttcatttccagcgcacccttaagaaactccatgaatttttctaccatccagatgaatcatgtcttcctttcaaaattggagaacttcctttgggaattctggtacatttcaaaacactttctgtcgcagtatatttgatcaacagtgctgtgttagtttccggcatacaccaaagtgattcagttatccatacacaagtgtctattctttttcaaaatgtttgtcccatttaggctattattgagcagagttccctgtgctatacagtaggtccttgttggttgtttattttaaatatagcggtgtatacgtgtcaatctaaccttctgcttttaacctgattatgtaaaattgttgtcctgatcctgtagaaagatcgtatgtcccttacaaggaaagatggatttatattcattcttcaaacccccacagtgcctactcagcatagaaaccttcacaaagcaggcaagcaacttatgtttgtccatgtgaaccattttagcgattctgtttttttatccttcttacaattgaggatgtatttatagctgtctgtttggaccacttagcacaagttaatcgtgcgccggtttaaattcctataacccattcaggtgagtttattgtccatgtgagtgaggatattcagtatgtgtaagcaaatagtgaccaaccctgctaatggatatttttcatctcttcctgctccattgatccaatattcaaaccgtcactgctcacatgaagctgggctgccagaccgtggcccgggcctcagccacagacctgccactttcgtttaatttaagaacaggaga

SEQ ID NO: 52577 - DNA, 1899 bp, Bovine  19866880457233
ttgacagagcaattgatttattataacagaacttattataaagcataaatttataaggtatgcaattattggtctctttagtttttaacatttaaacatattctgttagtcatttctagacccatgactcttcaaatgacaccaaaaataatttgctgattcaatgcaaataaatcaaactaatcattttcttatatatccaaaataactacctgaagacttttctttaactttacaaccaactgggatggcattgcatggataaggtatggatgatctatgatcattgagtccagagaaattcccaatgtatttccatctggacaacatgaaaagtaccaggagccactcacatttacttctgcttatagttgcaacaatgcaacatggctttaaaaatctttatttgtggaattttcaattgctataaagttagaatctctctctgaaattctttcttctactctgtgtctatgtacaataatctccagccacaccagcgtatctggaactttcattctccatgtatgagtctgactctatgtaattctcttgctcagatgacctactccattgcctgattcttgtctctccacattcaattttcttctcatcccctgtttatctttctgttttctatcctgctgctgtccaataaaactttctgtagtgttgaaaatgttctatatacgcactttccaatacagcacccctagtgacaggtagcattaaatgagaggagcattacaatgtggataatgcaactgaagaagtaatttttttaaatttttcattcaaatttaattttaaatagttatatctaggtagcagttaccatactgaacagtgcataattccaatacattgaagtaatactggagttcatattttctatcactatagtatatgtgtatataatcttcatctcttagaaataagaaattaaatttatgtggctctcaaatgatttctccctttcaacaaaaccatggtccctgatcatttatttaactccctcagcttgaaatctctaaggagttcaagggagaaaaaggaatagtgaagccaggaagcaagaaacagaaataatttttttttcaggctataaacttgagcagcaatgtaaatccaggaagccattccctcgagtcggctttggccctgcctatcaatagaacattaatggctgattaacaaatactgaatatttgtggatttggcatgaggagatctgtgcctgggccctttgatgagacctcccagtgcagagatttcacagggctgccgcactctgccgggccagaatcggatgtcagccaggaaaactgctcgcgccttgaacctgcgggtgattcaatctagagcaaaagctccgcctacaggccgcataagttaatgcagtctggctaacagggtcttcattcatcctgacaagaagcctatacagtagaaaatctcatctccaaatcctgccacaaaatcacacgttcatgggggtgtgaggagatggataaagtgaagcatttgtcaattccatctcaccaaaacactacctccctgattccaccagagcgaagcacttcatttcagaacaaatagcagttcatcaccgacctccttcctaggcatagtttaactggacaccagggtcttaagtccttgtcacagatcccaattctctgctgaatgtatgtgccactatacacctccttctttcatttggagaatgaacaatgtaaatgatttcactgacaatgaagtacttattaaggaattcagagatagaattagttcctcctactttctcttcatttaatgacaatggaataatctattgttacattaaatgcattagagacgagcataataaccctgctatttttagcacttgccaccacc

SEQ ID NO: 52578 - DNA, 1067 bp, Bovine  19866880472079
atgtgggatatctcttcatggctgctccagcaaggcatagccactgctcccttaccttggacatggggttgctcctcttggccgccacccctgacctcaggcatggggtagctctggtaaagtgtttgcctgcaatgcaggagacccaggttcaatccctgggtcaggaagatcccctggagaaggaaacagcaacccactccagtactcttgcctagaaaattccgtggaggagcctggtgggctacagcccatggggtcacaaagagttggacacaactgagtgacttcactttccttctttgcttgcctaaaggaaataaaattacatgaagcagctcaaaaatagtctgcttatgaatgagctaggtccccacaatgcctctcaaaaagaagaaagtagagaggagagagatgaaagattaggaagaaagggaggagaaagacaaggttaatttcacgacttgtccaagatcatatagctaatggggtactggattgaaacacaaacccaggcggtttcattacaaaacctattccttttctactctgccacactgatgagaccaatctgaatgaagacattttgtccatttgaatagtgtctagttaggaagaactgcccctagtcctaatcatcttgtctttatgagcacaccttcattcatccccaaccactcttctcctcacccagtttgcttcttcacccttgctaatcccagaagttagaagcaggtgtcacgattttggccaaagagaatgaatatcactatgaattttaatagaccagggcagatgggaccaacaccagaatgccatcaacatatactttgcatctgaaaatttgccctgtctccactgaagaaattatctaattatgccttcaacctattacacaatgtattaataataggtgtcaagtgctttattggaacctacaattgtgctcacagtttcatgatctgagaacaggaagaaatttgccagtgatactgataatactggatgggaaaacactgcacatgatgaaaacttagaaatggaaaacaaaaccctaaggctttaaa

SEQ ID NO: 52579 - DNA, 1255 bp, Bovine  19866880517688
ttttttttttggacaaaaatatacataaatggtaagtatgtttgcagccctaagagtctctgctctgtaataaccatgttaatgttctcataaaaagatatggggcaagagcaaagtgacagaaaggctgattagcattttatgacagaattaagctgcatgacaaataactcactggtttacagcccaacaaattctactttcaaatgccggaggtgctagaatgtttttgttcatttatttgtttttttatttaaccatgaaggtgtccacagctatttgaataaagatggaatacaattgtaatagtagtaaatataattagtgctaatatttattaagaatccttttgctccaaaatgtctaaaaaattaatacggtcaacaacaggatttttcagacttccagatttagaactggaagaaaaagttcagattactactcctcggtgtcgtaattcgtaatgggttttacaaaactgaacaattctcctattagttctccccaactttgaggaaatctcattgaggccattattctgtgggtgttaaagggaaaataacttccacttgttcaaggtaccaacttctagattaaggactcctctatacttgtagttttatttgttacagataaagaatggaaatgtgtagaaaaagacaggacagacatcatgtttaattctacaatggaaatgtgtattaataaaggatcagatattgttgctaagaaatgattcaacagctagttttcttatctatagatataggagtcaccccaggtttccttaattgctggtggtaggtgaggatattagttctcatttacttcattaaaatattaatgtctgaattacaacattaaaaaagaataaaagacacgtccataattttccccttctaagatgatatagaacatcatatatttcaatgcagagggtgccaaaattcacctctttctttgtaatcaacgatctgatctgatctgaacacattaggtgtttgttgggggtatgccttgtgtcttgtaccatgacaggcagctagtaatgcacagagacaatctaatgcctgccctccaagaatgtcagtccattggaaagccaggatgattgagtgaagcaattcacgagcaatgcagggtcataaggtaaagtgctataggatgtggatagaaattatgcagttattgtagtctgattgcatctgtaatttagattgataacactttatacattctaactgctaacaaatat

SEQ ID NO: 52580 - DNA, 931 bp, Bovine  19866880546750
ggagagattcatagattattcatgtggggacaatctaatcatatgagccaagagtcagtcagagaaatgtggtgaaaaagcaataggagagctttgaagtaggagatagacttaaccccaccattgctgaaaatggaggaagacagcctccagcatctgaggaggtcctcaggcaacagccagcagggaaatgggacctcagtcctacaaccattagaaagtgaattctgccaacaatcctaaggatcaggtaaacagattaacccttaaaacctccagaaaagaatgtagtcctgtgacatcttgattttagacaggtgagaaccttgccaggatggtgatttatagaactgaagataattttctttaaccactaagccattaagcttgtggtaacttgttatagcagcaatagagaatagaaacatccccttctttctgaaagtttctccttggttttcataataatgccttttgtggttctgtcccctctcctggaactcctcttgtgttcttctttactcccattctccctatacacaggtaattatatttttgttttcattcctgttctcctcctggcaatattataaaatttcataatctcaacaaccacttccactcatatggaaccaaaagctaaactcctgcctctgacatttcccccaactgtctgctggtcatcatcatctaaataatccaccactcaaacatttagtatgtcccaaactattagtattagtcccaaacatttagtatgtcccaaaagatgaattcatcatctttttttccagggattgcttaccctcattattgttctatctttttactcacattaccattctcagttgccctaattcagaaaccccaagtgaccgtggaaatctattgacattctaaaatacccacttctaccattcttttcaaaatc

SEQ ID NO: 52581 - DNA, 1389 bp, Bovine  19866880560286
cccttctcctcctgccctcaatctttcccagcatcagggtcttttcaaatgagtcagctcttcacatcaggtgaccaaagtattggagtttcaacttcaacatcagttcttccaatgaacacccaggcctgatctcctttaggatggactggttagatctccttgcagtccaagggactctcaagagtcttctccaacaccaaatggctgtctgaggaggccttacaaatagctgtgaaaagaagagaagcaaaaagcaaaggagaaaaggaaagatatacccatttgaatgcagagttccaaagaatagccaggagagataagaaagcctttctcagcaatcaatgcaaagaaatagaggataacaatagagtggaaaagactagagatctcttcaagaaaattggagataccaagggaacatttcacgcaaagatgggctcaataaaggacataaatggtatggacctaacagaagcagaagatattaagaagaggtggcaagaatacacagaagaactgtacaaaaaagatcttcacgacccacccagataatcacaatggtgtgatcactcacactcacctagagccagacatcctggaatgtgaagtcaagtgggccttaggaagcatcactatgaacaaagctagttgaggtgatggaattctagttgagctatttcaaaaattatctctttaaaaatatagtatcttaggggatagagtatactgaacattgaacaggtgaagaataatgaaacaggatccataaaaactgttttccaggtctggctttaccacttactagtcacatagttttggacaaagtacttcatctttctgagcttcaaactctctatattgaaaataccagcataattctaagctgttccccatattattatatggatgaaatgccttgcaatgaaaatcaaataaaattatgaaggaacaactcatcaaatctgaagcactaaatgaattaaatggctactaaagtatttatattttcttacaagcccttaaagatgttagtctcacattaggaatcagtctcattctccccagctgtataaattaagtttaaagtggttgacatccaatcagtacctgctttaaagcatcaggttcctgaaagctaagtggaaatcaacactacctcaggtcaggagccaactaaacttaaaatcctactgtgcccatggtaacatagtacatgttaattggtattatgttagcagttatttgagccaagaatgaaaatgtaagaaagctatgtctaatatctacttaaaatcagctgacaaacaaaagcaatctgactttgccatccaggctattaaccacatttttttgtatatacatatatatatatatttttttaacctg

SEQ ID NO: 52582 - DNA, 1847 bp, Bovine  19866880778500
aactgtatataaactaagatatactcatcttaggaaaaattattccaaagcacaaatattcattgagaataaaaaaatatataggctgaaagcaactagggagtgacaggtaagaatgaatgttggtgataaatatgaataagatgaaatttcaatgtgctattccaacaaagaggtccactgcttctatttttttcccttagattatataagaaaagggcctgcgtcccagaaaaaaacaaatgatcatttatctttaaacagctgattaaactgtacctagaatactgaatactgcatttgtagcagtttcagaataagaaataataagagaatgcaggttgttctgagtaggatggtcaggacagcaaatggggaggcgacttgaagccaactaacaccttctcaggatccactgtggtccagctctgtcttgggtcaaaagttataaagagtttccaatttactttggttttcagtctagtttggtttcagtcttgactgaaatcaaaagaaagcgtatacattaactctactacttttacccctgaacaggagtgaaaagcttgtgaagaaacataaaccacacacacataattctgattcacttttaatctcaggagttggttaactccagcacacgagccacatctgtaacagtgtccttcatctccgctgcctttgtcaagaggactcagaaatataaactgagtgattagaaagagagcccctttactgttagaatcaacagtgtggtgtgtttggatggctgcctaacagctctccccccagtctctctgctgttgttagaatttgctctttcaaatcaaagtgctcctccaccaaggcctgcttcttcttcttgaatgctacagggaaaggtaaaaagtttcattatgcctctaaccaatagcacagcaccatttatagtggaaattttcttcgcagcctctacccaaagtgcaacatgggatatcagccactactattcacaaactaaggcgatgaagggaagcacccgttggggcctaatgaaatctccatacaaatgagtgggtagatctgggaatgcaaagagaaaaaaatatgtccagatacaagatggagaagtgactctgtgtacaaatgagtgaaaaagttagtctagaaatcagtgaggatcacaatgtgaccaagaaataaccacatgccactcaagcccaaacagttctggaacatggggtcagttctaagcttaacaatatagaagagttaatacagctaatagtttttacacagcatgctcggtacttgtgatgcaaatattaattcacttaatttttagactaattggagtatccttgttcccagtttagagatgaagaaatgtcactgagaaagataaacaaagtagtgtatgatcacagggctagaatttctgtaggagtgagatttgaactcatgcagggtcgctaagagtcagacatgactgagcaacttcactttcacttttccctttcatgcattggagatggaaatggcaacccactccagtgttcttgcttggagaatcccacggatgggggatcctggtggtctgccatctatggggtcacacagagtcggacacgactgacacgacttagcaacagcagcagcagcagcagcagtctgaccaaggaaacatgcatgaacattgcatcacgcagcctgcagcacttgtaagtacaacatgagggccaaaaaaagagccacaaagacaaaggaaagaacatttttatagcaagtcatgaggttaattttttttaagtcagtctatttatgtgaaaataaaaaggaaggagactcccggaggagtaagagaagga

SEQ ID NO: 52583 - DNA, 1431 bp, Bovine  19866880786352
tccaaggagcttagtaaatggagctgaagttttttaagtttctataggatttacacctgattttcctgaagacttaatagcttgccaatacaaagcacagggaacaacagtcatgccctgctccctccagtggctgcatcctggtcagcctgcagacattccatgggctgctcctactgatctcctttcagtgggatgcacctggctcagaagaaaaacaatcatccctgtcatggtaaaaaaatcactcccatttctaactgaataatcttattgtgtgatgggcttcgacatacactcaaccctcagtgaagtcccttaaaagaagctctgctgtaccaaaagccagacagatcagttccaggagactctcagtaagaagcgtaacatttagtggtaatgactaaacgcatgtattcagtgtacattaggactctcttcccctggaaagggcaaagagctaaatctcagaagtggtcagagaaaagcaaattttctcctaatcagaaaagcacaatcatggtgaagtggagcaggtaaatggagctggtgtatataattaggatcttttctcttttcctctaaaccatgaaaaaggaaaggtgggcatgtgaggagaaggaagtttaaaatgtctggaagctgactttagttaattgtagagataggttaagctttgataactgtctttattaaagaagaactgaaaatacctaaagctcaagaaagtgcatgaatttacagggatttcagatgtcagaaattctaaagtgacagcatcctttttttaagttatagattttttaaaggattgacattaagtactatataagcatttaataagcaagattactaaaatacctaggttttatgtctcttacattttaacctatatatatatatatattcttcattaatatagcatttaataaatacacatgggtagtttagtacaaagggtggttgtttttataaaaaaggtaaaattgagtaaaagaaatgtacgtactattgagggcttaccaggtggcgcagaggtaaagaatctgcctgccagtgcaggagatgtgggttcaattcctgggtcgggaagatcccctagagtaggaaatggcaactcactccagtattcttgcctggagaatcccatggacagagaagcctggcaggctacagtccacggggtcgcagagttcacagagtcggacatgactgagcatgcacacacacacacatgtaccattgtctctggaactctgtctcacctatgggtcacctagaaatccacaaccaaggaagtttaattaatcagatctagaaccacagggaaaccagacagcaaactgaaaataagaactgttttcttaagaaaacaagaattggcaactggcagaggcaggatctgtaaaaagtgataaagttaattggatg

SEQ ID NO: 52584 - DNA, 1037 bp, Bovine  19866880827645
ctacttcactctttatcatttaatcccatttctgatatgaaatgtaggcagaggaagtactctgggtacagccatccagagctagtggaggaaaaggaaacagcaatccttgaggatgaactttttaggatcacactgtgggagagagtacattgcaaagaacttgccacttgccatctttgcagtgatgacaggagttgaagaagtaggcttggaaaactcagagatctgcagcccaattaatggctgtggttgctcattatggtgggaaacctgtacccacactgcagcagaagctgcccacatttgagtggcttcattaactaccttctttctcctggatgagaccacagagggacatggtgttgtcatctaacaagagatcaccagcaaagtcagctccaatcttgcagccattatgagaatattgtgaccaacttgtagtgcctcagaatcacacaatgagcagaatgtatagctggaagtcaagcaccaaaatataattgcacaagattgaaaaaaaatgcctatgaggaaaagttacagcaattagcttatttaatgtggaaaaggaaaatacaggggaatttactgcattaaaggctttgagtccatgaagggtaattctagaggatggtgaatttatggttgtatatattaaagaatctttcctgttgtcttcttttcgtttcttccttgacttctcttctgtgatatgtaatgaaagataatgacgtggtaacttctgaagacatatgagaattaatacttggggagtttgcagcatctttgcactgtcttacaactacctcccaccctgccccctccaaaaagaaaaacacagaaaggagtgagtataccatttgcaagagctcttttctcttttacagccatcctgttgccatctgctaaaatcctcagcccacctgtgtagtgaacaacatcaattgtcttctagaaaagcacaaggaccacagtctcccccaagattgagggtaggaatatggagacattttacagcactttcaaatgagctt

SEQ ID NO: 52585 - DNA, 1347 bp, Bovine  19866880855346
ctatcctcagtctctattattaattgagattggattgttaacagaagagtaagagttttcctgtcaaacaaatccataggaaggtattacacatgaaagggaacagtacctgcaatggcttgaattagtgaatgatacttacatatttgggaaactggagcaaaggatggactgaatagctaggctgggaatataaagggccatgatgcacaaataaaatgtatagattttatcctgtgggcaatgttcagagccaatagaagttagcaagtcacagaatgatataattagatctcttttgtagtgtgaagggcagattggaatagagaagagattgtagcctagaaatcagttagaggtaacagggctcttgcactgggcagcagagtgggagtagagagaaagaatctggtttaagagacagaaccctttcgatgtggccatggggcagagggagagttatgaatgctaggatgctgcagactgatactaagaatttgcagcagacagagtgaatttggttggtgagagtcagggttgggaattatagatagtgcttaatataaggacttagaaatacttctgtttgaggttgatttgattatctgacatggagcagggtgaggtctgatgcgcaattgctatttgaagtgaaaacaaaaagcaatactgctctgccatcagcttgaccgtccccatctactcctctaatgaaaactgcagaagcatgcatttgtggtacagaattgtgctaagtggacaggggcagggacgagcactgcagaggatgtgttctgataagactggctaaaccttgttcctagacactgttgggcttcccaggtggcactagtggtaaagtactcacctgccaatgtaggagacataagagatcaggttcaatccctgggttgggaagatcccctgaaggagggcatggcaacccactccagtattcttgcctgggaaatcccttggatagaggagccttggcagtctacagtccaaaggatcacaaagagtcagacaccactgaagtgacttagcacacatgaacttcattcctagagactgataggatgtggaaacagtttactcatacagaaacttgttgacagaacttgaatcaaagcagggaaaaaagtgttagactaacacatttttaaaatatgataataatacctgccatttattgttccaggcatttgactcacattaattttattgaaacctcacaataacacagtgaaggaaatattttcattcttgcagagaagaaactgagactcagagatactaagtaactgacccaagggaatattgctaagtggcagagtaattacaaaa

SEQ ID NO: 52586 - DNA, 1668 bp, Bovine  19866880937823
agtgaagtttccctataggacagaaaatatggctgaatcaatactacctgtcagcacagccaagcagaattccagctctgtgagaaggaggtccctctcccaggcctcccgtaagcaaacaccagctccaggctgcagcaaacactctaagtgtctgcaaacatagggtcccatgaccaaatccacgaggaactcaaacatatgtgaaatggttttaggctcactgccttctttcccaagctggcctggcctgcccccaaaagagaatcagaaatcactcagctgtagaaatgtgtttgaaagcacctcaggggagcccccatccttcccacaaaagctgagtgtttcaggaaaaaactaaattcactaagacctcctagatttcatcctatattttatcatctctgaaattggcatgtgtgttatatagccaatgtgtatccttactgcaacaagtattccacttttttgctcctgtttttgtatttaaattgatattttacagttaatggtattttggaaagggaggaaattagttatacaattcctttcttgttttaggacttccccaggtggcacagtggtaaagaatccgccatgccagtgcaggagacacaagggattcaggttccagccctgggtctagaaaatcccctggagaagggaatggcttacccactccagtattcttgcctggaaaattccatggacaaaggagtctggtggtctacagttcctgaggtcacaaacagtcaaatgcaactgagcatacagtcttgttttagggaagtatacgtcaagaaaacaaacgaaggccctggtcgggacatttgacagatttcaataacagtaagacctcatatttgttgacatcttgccatgtggcagctatgtaacagcttcacctatattaactcatttaaaccttataatgatcttctatggttggtgatcattttacagattaggtaaatgaggcatagaaaggttaattttttttttccccaagatcatacagctagaaagctttgcagccaaggttcaaactgatggttcaaaccactgttgattgcagacttcccaatgaaattacctaatcaatttactgataaagcaaagttgaagttcattacttagtatactaaggaagcatactcccttgacaagactcttattttcaaagagggatatttatgaggtttggggtctagtttaaggcaagtagaggttggattcagattggctcaactgtctgacacagttattgaggcttggttgacacatcaaggaaatggttgcaagagtcctaaagcatcaacagcaacttgatgagtttggtaaagtgatttatattgtcctaaaagggggttatttactccactgagagatacttgaattatctttttttttttcatataaatggatttttcagaaagcttcttaaccaaatcataattatttgcaatttcctgttcctgggcaagagtctcctgaaataaggtcattttaatatagacagtaatctgagtggcttgcagatggtttgtgttctcaccaggtggttgccacacagtgtggactgaaatgagtcccctccaaatccatatgttgaagcccctaatccccccccaccccaccctactccccaaagtgactatatctggagaa

SEQ ID NO: 52587 - DNA, 1792 bp, Bovine  19866880968346
tgttgaaagacccatgtactctactctgcataagtactgggttccactttcatggcatgagtgtcagagtctacctgagtatggagggcctgtcgctgtgggcacacctgttatgctcctccttggaaacatagtcacaaatgggttggggccctttcatgaatgaaggtcagggaggaagctctcattttagaagttgttgttgcttagtagccaagtcgtgtctgactcttcagtggccccatggactgtagcctgtcagactcctctgtccatgggatttcccaagcaagaatatgggagtgggttgccatttccttcttcaggggatcttcctgacccaaggatcaaacctccatctcctgcattggcaggtggattctttactgctgagccacctgggaagcccccattttagaagcaactccacttaaatatttatgataagtttcaagtcactgagaatattagttcttaatgagaacatcgataggcccatagcttgaatgaggtgaaagccactactagtcttgtaatgcatcagcttaaatagtcccactgacacaagcccgcacttgactttctttgttatgcattaccaaggagaagaaataaatctcagcatgaggtttgctggaacaaaataattcacctcaatggtatctctgttatcctaaatttcattctttccctgatagctacatcaacacgcattgatcatcttcgactacacagtcaagacttgaatggatttaacttttttcgtggaaaacttctcaagtggaaactttttgtgccaaacgctttacctcaaacgttaaagacattccttagcagtgttatgatcatgtgtgaattcaaaggcaatttaagataggttgccttcagttgataagatttcttagaatcttgtccattatttttactttgcatcatgactttgaagctgactctggcctttgtaccctgacactgaattaattctaggaaatagagttttggatgaagtagaaaagaatagctttattgctttgccaggcagggggtgcacagagagctaatgccctcaaaactatgtattccaacctagaggggttagtgaaaaggtttatagtaatggttcaaagagggcatgatccgcttgtggacattcttctgactggttgatggtgaaataagtgggagtcagcatcatcaacctttgggttccaaccagtctggggtctttgtacttgtggacagcatatcgttaatttttctcaaacctggttggcatttctgtatctgcaaaacagttcaaagatattgttatgtgtatcgcttggggggatccaagaccttgcccccaagactgcactactgtttctcttgactgttcctccattgtctctgcatctcctcccttccctaattagtatctgtttgaacttgcccttggaactcagagaagttctaggaggctgaatgaagcctgtgtcctgtattcaagaaatggggtatacctgtggctgattcatgttgataattggcagaaaacaacaaaattctgtaaagcaattatccttcaaataaaaaataaattaaatttaaaaattatatcatatgaagaaaaaaagatacataggggacacagagaagcttttgtgtcaggaacctgtgagccttttgtgcacaaggtcctgcttggaatcatcttatgattgatttcatttaaagaagactgtacaattaatgcttcttaaaaataaggacattgtactttcctcctcttctgacatttttgaaagcatct

SEQ ID NO: 52588 - DNA, 675 bp, Bovine  19866881017187
ttaattcccttctctgctgggagctctcactggctccatgcagcgtgaatgttaaacagctactcaaggctccaggaatacagcagagtcattaggtggtggctgtttcaaaccactcagagcaagtctctgaaatggagggcctcgttgtcccttctgaatctttattgagctgataaccaacagaagaaaaagcagacctaaagatctcaaaaggacctgatttagttgaaaaatccaccttccctgtctcactccctctgtgtgaataaagggagagagaagagtttttgaacacacttcactccaccagctacaacatgagaccactagacacaagggttagtaccttacaattccctgccaagagcctttctccatcactcccctctttatcctggtccagaagctgatatcatatcagaaagtgtaagtacactgcagtgctagaagaaagccaacagattgcatgtgctgagttgctcaggcgtgtctgactctttgcaaccccattagactgtaggtcaccagactcctctgcccatgggattttttcaggcaagaatgctggagtgggttgccatttccttttccagaggatcttccctacccagggaatcaaacctgcaactcctgtgtctcctgcattgacaggtggattctttacctgctgag

SEQ ID NO: 52589 - DNA, 1496 bp, Bovine  19866881035949
ttgccttggaataaaaatggatataataatagtatctcccctgacaatgttcttttgatggctaaatgacttaatgcctataaaagccctgagggcagtgtcagccacaaaataatcattcagtacatattagtttttactacagttcccacaaagtccaaaaaccagcagttatgtctattttcacccaatcctatggtagaaactctaagcagtgtcatgagattaactgtcatttgtactgtgaaattttaaatactcagaccatctcacctggttctatctggtgcttaattttctcatatccacagttacacatgtaagtaacagcaatgggggaaaggcatatagtcaactttctgtccattcaatttgtttctaagcagttcactatgtatctattgactatacagaatgctaggtttggtatattagaggatagaaagatttataatagggactgtcttctaggagcatatgtggaataataacataatatggttaaaactatgtatcataaaagatttaagtaatatttcatagggaaaacagaaaagacagttaaaggtaatattggattgctgaaatataattgaaaaactgagtcacaagatttctattgaaaccattcctgaattatttaaataaatcttttaataccagggatggatttgccatgaaattaatgcaactttagaattcagggacttttatttacatggggctcctaccaagccctatgagaggttctacagatacgttcacgtggttacatttatataaaatttggaaaagtaaggtgttttaaaaactatttaaagtctgacttttgtggcagatagcgctggagtgactatgagcattttgggacctctacaaaagagaatttcagtggagaatctacttcatttgggtttggtgggataaaaactatgtggctcacaataagttctggtacgggaagagattccaaaatacttgtacctctcgatgcatgaacccactcagtgtggtggtgcaagcagtgagtatcagagggcctgtttatggtatgaacatgccctacaggtttcaatacacaaagtatcaggataacgggaaaaaaggtttgaaatgtgtgcagccaggaggcagcctgtggatatttcttccagtcaccagtggtatacaattaaaagctgtgcattcagttttcatggagtctagtcaaaacaatgccacctgtcaggcatgtactcagtaagacagcaaacaccgttaccaacatatcacatttttttaaaagaaaattgtgcctaaaattgaattaccggaattattttgcttatagggaacacacctgttcttccagaagccaggacaccagaatgggaagctacgtgttgatgcatctcaaggtattgggccgtatcttagcacatccgatgcatctgccctgatgtagtctggcatgcccagacaaatcagtgagcaaagactgccagtaaggccacaaa

SEQ ID NO: 52590 - DNA, 869 bp, Bovine  19866881046277
accgattctacctttgtgcaccccaaacctttgtacatctctacctgagaactctgcctctgaactgcagtgtgagctctgcaaaaacaggaaaactgtattcatcaagagtttctcttaatgtctagaaagaataggaattaagaaattctgaatgaatgcaaagctgccaaaacaaaaaacaaaacaacaacaacaaaaaacttcctcaaaagaaatttattccacaagttgatttggagatgtactagcaaatgagtttataatgctcccctaaatgtcacgaggaggtagccaacctaaactgtaattaattaaaagtaatctgtaaacttgtcgaacgtaaatggttacaaaaggatgctaaatgagaaagggaaagactcatgtaacaacaaaggcaggtgacggtggtcatcagagaggagagctaaagccagggggtcatctgtctcctgctatgctcagcaggagggtgttcagactggaaatgttctggctcttccaacagaaacctctcctgggacgagagacacaattcatcaagctaccaagacttggcaggaccatccctcgaggacaccagctttgattctgtattcaccaagaaaccttctgaactgtcatgtgtttttcagagtgaactcacagtctcaggccaggattttccccagcttcaggttaataaagctgcattctaacttacatgtcagaattggggtggaagaaggtattgtcctgagccaattatccagtgcctaattgtgccaggaaaaaactaaataggattaaattgttggtgctataaaactatggactggacttacagctaataaggtccaggcctgctaactttacctgtcacatca

SEQ ID NO: 52591 - DNA, 861 bp, Bovine  19866881132329
tttcatctgtccctcttgcctccacttgcctggccatgatattagtttgaagtacattttatttgtgatgtctattgattaaagttttatgttccttgttcttaattaacttatcactcattctgtgcccatatactgctgttgtatattataaacaatagatatattgctgataaagctatttgtaaatcaatgttctgtaaacagaattatatttcaaatgtgctagaagaacttgccagataaaagaatcctttgatgaaaaattcaacaattctcaataatgcattttctggtaaatcctaggcttcagataatgaccatgtgaaataaaacgaacttactttaatgccatcatccattatcatcctgtcccagtttggatggatctcctcaagacagatattagatctcaaaaaagtctgtagaaaggaactaaataatctccccagtagtttcttttttatgaaaatggaaacactggaagatgaaggatgagtaacaacatgttcaaagtctgcaaatttataaaatgtaaaaatacgaagagcattcattcatgatacacacacaagtatggttactactatattctaggcactcaggtaggtactgaggataaaaaacttgattaagacacagtatttgccctcaaggactcacatctaataggatacagagacatataaataagtaatttcaaaacaatgtgtaagtattataaataatggtagcatgcatttattaaattaaaaaaaaaaaaggctcagcagtggcaccagatggggaaaaaaggtcacaagagcagacactgggtactgtttttgtttgctgttttatcatcagtgctcgcacagaacc

SEQ ID NO: 52592 - DNA, 1036 bp, Bovine  19866881162715
agaggctggtaaatatattcttagcatttctaggtttttgtatccaataacatcatgctatgaagtttggaatgacatttagaaagctgcaatttgctatcctgtataaattatgtttattatgtttaactctcttgtctaaatatttgggagatattctatatacaaaatcataccactcagaaataaatatatctttcttatttcttatttcttttaattcttttcttattaaaaggctaagacctcccaataaatcctgactataataaaaatggctctaatgtaaatattttgaccacctgatgtgaagaactgactcattagaaaagaccctgatgctgggcaagattgaaggcaggaggagaagggaacagaggatgagatggttggatggcatcaccaattcaatggacatgagtctgagcaagcatcgggatttggtgatggacagggaagccatgcatgctgcaatccatcgggtcgcaaagagtcagacaagactgagcgcctgaactgaactgaactgaatgtaaaaccataaaatagtctgttcgctacaggcgttttgtaaattctctttatcaagttaagaatgtttacttctatccgctttactatgaggctgctttttttgttttaaaaacaggaataagaattgaattttacataataatttgctgaagtagtcaacatgattgaaaatttttctcaatctatgaatgcagtgaattaatagtttttgcaagggtgaacaatctttacatttcatgagtatcctgtttttatgatgcctcctatctgtcctttccatgctccacttgcccctgtgttagttcatatccccattatctttcacctgcactactgtaatagcctcctaattggtttttctgtcaaagatatttggcttctgcaatgcagtcttcacatttaaaccagaattatcttcctctttggaagatttcactctgatcctcaaatccctttagtgcctcttcataaactagaaaggaagattaaaaccaggcctttt

SEQ ID NO: 52593 - DNA, 1057 bp, Bovine  19866881206813
acttacagattccagcaccattggacaaggcatcctgaatgatacaaaacagcaagacactcattttcgatttgggggataaataaaatcctcactaaccttacagcaaacagtcattaaagttataataactcctctagaaaggttaaaaaagacagaggacattccaaaggaagtgtccagcttccccgagagctgcttggggagattcataagggagccctgtaaacaccaggagcatcttgctggctgcacaggtggctttgcatggtcaaacacattcaaagacccgacagggaagcgaggtgaatgggaaaagcctttcacattttttaatcttctgtgttgatttatcttcccctgtgctgagagtggaagtaaggcattctcctcgcctcctcccaatttcacctccttcccaacttgtacatgtgcgcatgcacgcatgcatacacacacacacacacaatcaatttaaatttataattcattggtgttcctcttcattcaggtttcagtgactcaattttagggaatgcaaatccatgttcttatgccacctgccctggctcagtgatcacttgtcagtaaactgactttaaatgaatatacatgaaattaaaggacatttgaaaaggcctgcagttctaagaatagacattagagagtataaaaagtaatgaatccatatttggacaccaagtaaacttctcttcctgttatttctttggctcatgtatatctgataatgcacttgtgcctctaaagttaggtatattaggtcagggattcaatttcgattttcttttcacatacctaacatgatctattgctacagttccataaaaatattaaattgatgctaatcacatatatatgtgcaaatatatatgaataaacacacacacagtcctcacccagagataaactgcgtctgttcaccctctccttccattggtatctaagtttttactgttaccaaggaaagaagatattaatgttttgctctagtagtcagaagattggaagcagtaaaacagatgcaccacagtcatgt

SEQ ID NO: 52594 - DNA, 602 bp, Bovine  19866881249522
acctgtaaccccttcctccctccggcctcctcctcactctggcccgtggtgttgctgatgggtagtaatggtgcagctggaaatgcatttatgttccattttcccccagtattattaaaactgctccatcaccgcctataatgggggtgtccgtattttctctcgcctgtatctctgacatgacataacgcttgccctcaccagcatgctataaaacagtggtaattgaaacataactcaccctaaattacagtctctgtgcacgcagggccccactgagcttcccaaggctcattacaagtataagctaaatatttccttaaagggggctgcgggggacccagaaaggagggaagggtgttgtgggggtttggggtggggggaatgcaagagcctcctaaaagcaaatgaggctgaggcaggttgctaaaaagggagatttacccccaacagttttaggtgagccccctgtttggcaggatctgtagcaacctgtcatcattattagctgaacggctatttcctggactacttgaaattataggtttccattcatttcctaggagacacaagtccacctaattgtatttcctggcccagag

SEQ ID NO: 52595 - DNA, 768 bp, Bovine  19866881432072
attttggagtgaccaaattctttcctttattttgttattataggtaaaatagagatatttcaaagaagatagaaacaaatgcagtgcttgttttttttagcatatctttgtatatctaaagcaattttgttaatttagaagcataataattggtttgttcataaaatgttcatgttttctatattaaattttaaagtatagcttactcagaccattacaaatttgctaggagaatgccttaaaacatagtaaattaaaccacaagatgctaaactctaagaaatatattctcaatcccacaactgtataagaaataggcaaaattttgaggatagaagaaaacattgataatatagtaaaatgaaattatttcattttctttaatcagtctcttccaatacaatgtcaagaacttacagaaagcactggttttcagaagaactttagaataaaagaaaaatgtacactgaatattttttccaaatgagaatttatctaattatcaccagtctctgaggcatctctcagcagtgtttgcatcatctgatgctttgatttgaaaactgaagacactccctttgcagaaaaacaactggtcttagggccaagtctctgagttccagaacagtgtgacctagaacaagtcacttcatttctgtgggaataaaacagctctctcaagttctttccagcattatgaataactgtggaatggaaccataaagacgcctgcctcaaccagccccatgcacctctgtgggaaaggtg

SEQ ID NO: 52596 - DNA, 2293 bp, Bovine  19866881642768
agaagctcctttaattgaaaacagggtcctaaaagttctctgagataggtatttctacaacatttagtataaagctgtcctcctctgctatcaataattgtcctctgctttccccaaactttcagcacaagttgcctgtgcttaataaccttgtatgtgtggtctttggatagataaaatagcagtaaaggtggggctgagtagctaagggtgatatttttaggttctgagagctaagggtactaccagcaaaaaatttcaaagcatctctcagtgtagaataagtcagaagagaataaatgccccctacctaataaatacacacacacacacacacagatttctgtcaaggcttgatgaacctccacagaccatggagttgggggctcaatattgaaagagagagaataccagagcctggaagacttggaaacatccagcctgaagacctttgagctgcataatatcgaatcatatgaaatggcctcttcttggtccacatagtgacatacctattcttcacaatagtacctcaatgtcacctttatagagagaccttccataatcctccaggatgggatttgtccatcccttctccatagtaacaaggtatatgatacatttctcttctgttgcccattgcccatgatgagctatttgagaccatatcttatgttctgtcttacctcaagtgcccagcacagagttaaaaccccaaaaaaaaaacctttaaagaactgaactgagtcatgagttttatgataaaacaactggcgtggtaggaaccttaaaggcaatcttcatgaatctttactttgcaaataaagaaattaaggacttgagagcctaactgcatttccaaaagttgcacagctaagaagaggaagaaggaggactagggcccacgtctttagatcccgaatcacccaccgtggccatcatgttatgttcacaaatgatagggtggtgaaacactcaggaaaacctggggaaatagacaattaagatcaattccaaattgagtgctattttctatatgccaaatgaagctgcttctatttgcttcaacttttggaaaaggaaagcatgagatgcatgcttcctgtttctagggttccttgtaagtaagtgctaaatatgaataatgatgaaacagattcagcaacatacagaagagtactaaatacatcagtcctcccggggctcaaaagttgcagcgaaaggtacacttttcaaactcaatattgttatatggggctgacagaaaccaaaacacacacacatatacacacacaaaataaggggaaatggaagaatttgaataaggaatcaggcagggtggtacacccattcttgttattttcagccccatgcacagaatcacactagagcagttctcccagctcttcatattcaccacaacaccttattttatctcccttattttttctcctttcctgaatccactcaatcatttcgtgcttccaggactctagtgtgcttctagagtgctttactatctcccacttttcaaagataaacacctcacacctgggaaacagatgcctctaattagctttaaacctgaagtttatgcctgcctttgatgttttctaggatgcattttggtgaataataatattctcaattcagaacgtttcaacacttaatcaaaagtcagtctgtgtgtgtgtgtgcatgcatgcacacatgcgtgcactcagtcgtgtcaaattctttgcaactccatggactgtagttcaccaggctcctctgtccatggcacttttcaggcaagaatgctggagcaggttgccatttcctcctccagggggatcttcctgaccaaggaatcgaaccctagtctcctgtgtctcctgcactgcaggcagattctttacctgctgagccatcagggaagctctaaccaaaaatcagtttagcaaagatattctggcagtcacccaccatcgtgctccagacctaagcctgtctgttaagggaagtgaaaaaactggattcggaaattagaaagtttctttttcacaaaccacacttttctgggctgattttatgggagaagtggggaccccaattttataaaatctgaataggaatcaaagactgtaatacaataatagtaggggatttaaatactccactttaagcaatggacagattatccagaggaaaaaaatcaacaagaaatcagcagatttgaacttcattgtaggcccaaatcgatcaaaccaatatatgcaaagcatcatacaatagcagcagaatatatatt

SEQ ID NO: 52597 - DNA, 849 bp, Bovine  19866881848004
ttgttggtttgtgtgtggacagattcttgcttttttctgctgctcttcagtcaagggaactttttatctgtgtttgtgtatgtgtgtgtgtgtgtatctgtatatatttaaactacacttttagccaaggacccagggtgtctaccaaactgggatcaatttaaatcaaatttcctcagtgttttttcagataacatgaatttagaccaaaaaaacccatgtggctggcttgttacagatattccggtatatttcttcacctctgtccggtgccagaaccgagagtggtgataatctttgctgtctggcagggttagtttctcatccatcctctctctagggaggtgcttttgggggcatgaggttttatcctatgttccccattcccactgctcatgtggtagatgatgcagaagcttagggtctttaggtttcaagcaaaaaggcttcaaggaaaaatccagtcctggtgcttacttattttccaggattcctgatgtcacttcagttttggggctctgtgaattctttttgtcactttagcggtatgcttgaaaatgtatttctgtgtactttttaatccagtgttttagttgcttctatcaatagcagttattcagagtatttaatttgcagtattgccagtaatgtatgtcttcatcctttttctgctccttactccccctctgtcccttctctccttcccttcccctcctccttcctttcctcccttccttccttagcttgcctataattgttcagcaaaccagcttcatcctagaaagaggaggcctaaagaataaaagccttttgtatgagtgatgggctttcatatccagcaccaatttt

SEQ ID NO: 52598 - DNA, 1092 bp, Bovine  19866881954209
tggggacagcctgacaggaagctagagaaactctgagctccccttttcaggggagcactctgagtgttccctgtatctcctgtgagtggctgtgagatgtctaggcaatcagaagtcaactgtcatcaaaaagaaaattcctgtcaagagtcatttaaattgtgtcaggcaggatgaaaaatcaataccaacagtctcactgacattaccgatttggaaaagtctcccatcccctccccactcacactaagcagctatgttactgcacttacttaggcagcaaaagaaaatggaaaatgaagtcccaccactgagcaagcaacaccttcaccctaaagcctagtggctcttcactcactctctgacatccaggaaatgttttagcatactaagtctgaatgaattttaccatttctctgttttatggaagtgaattctcttctgtcctctcttcactagctcactctccaaatataaaccaaattccctttctttacaaggctttcttttcataaacactcattaaggactgacaaaaagtgatgccttgcagatgggagctagtattctttcctagttctgaccctcattcagtagagagtgaatagtatcagtaatgataatgggcctcagatgtaggccggatggtctgataagtacctaagtaaacagacttgatctaggagaaggagttattacgtgctgctacattttttcatgaagaatgacttccttgtagatcaaggtttgcaaatttgactccttctcaaattactcagcctttccatgcatatgggaaagaagattgttttttttaactttttggtagtaggtcttctgtctgtggattaactcttgaaaaagctccaaagagatagtatatctaagactatcctttagatatggcagaaacacagtctggaatggatagtcattctgctcaatcctgatagctcagatgaaaatgcgcagaaggaagcaggattcaatacaagaaaatgataatgcatttcatagcttgtaaaagaagcactgagagtttgcctcagcttctgttgaaccttgctgtcaatcaacaaaatgaaccaaaca

SEQ ID NO: 52599 - DNA, 738 bp, Bovine  19866882169195
aattttggaaacttttaccatagcttttaataaatatataagaattcagactttggatgatctattactttcctaaggtcttaacttgaaagaatctcttattatcgaaatatagaggttttgtgacacatggaaggaaaaaatgaaatgaaaatagattctaacacttccagcagatatttttcaacgcctagttcccttaaaatcatgcctatatatttacatatttgtttcttccctggatattcttctccctggtctcaatcagagccatgagtcatcctcaaagtaaaacttctgaaagcctgcttatcactctcataagtatgcaacaaacaggagagatttagggtctttcctccaccattttcccccttctgttatgaggaaatcaagccctgccagtgctgcctcacttctcccttgtctcaggcaggatacagtcaggcaatgcattttcatcaaggctcaggctccattatgctctagagaattggggtttaatgtaatttatgggtagccacttccaagggagatcatggaacctccagtttaattgaggtgatctagacggttcagcatctgtcaatgagcaaggagagaatgctgcctgaatagaaatagaaatcactttgcacaccctccttattctatatactttttcttggaagcacccagctgtggtttctcttactgattttctgctactcttactctcctttttcatcttttcatact

SEQ ID NO: 52600 - DNA, 1668 bp, Bovine  19866880513959
gcttctcttcttttacagctatttgtaaggcctccccagacagccattttgcttttttgcatttcttttcctggggatgttcttgatccctgtctcctgtacaatgtcacgaacctcattccatagttcatcaggtactctatctatcagatctagtcccttaaatctatttctcactttccctgtattatcataagggatttgatttaggtcatacctgaatggtctagtggttttccctactttcttcaatttaaatctgaatttggcaataaggagttcatgatctgagccacagtcagctcctggccttgtttttgctgactgtatagagtttctccatctttggctgcaaagaatataatcaatctgatttcggtgttgaccatactctattcaataatcagataattatgaatatttacattttaaatataaaaatagccacaaaattatacacttgtttttattttaaagttatagatgatctggttagctttgcacacttgacagaaacctactgccaattaccaagttttatgaattagtgaacaagccagcaaatgtgacttaaagtgatcaagaccacatcacaaaatttgctttgttcatttagcttcacaaatgtagcttggtatcaattcttgagaatgctttagggtagactagcaaatttcttccaacacattttgtgaaaattgtttagtatgagagataatgaggtctcactctcattctcagctgatttgctagtgagacctgaaggcctgccaggtagcagggttttgaagtgatgggatttgtaagctgtagaagggacacttgacaaggtcacttaatggggaatcattttatctttttggagaagtatgtgatttcatgcctgtttgtaattttaaaaggctgtggtgagggtactctttctgcccccttctgatgcctatgtcagaagctttctctatatcctttatactttaataaaactttattacacaaaagctctcagcgatcaagcctcgtctctggccccggattgaattcttctcctccgggggccaagaatccccggtgtcttcacgtgattcaacaacaacctttcaacaatagctttagaggtgcagttgtgcttccaagtataaagaccatcagtggttccttggcattccaaatctcttcatgtcccagctccttccacgttcttacacagtctggagactcactgaactccttacagtttagaggtcttttgcaattaaaggtcatggccctggggccagtgtacatgctgttgcctgtcttcctcatcactcactgggcaactgtcacctcgttggctcttaggactcaacacagtaggtacctcttcttggaaccctttctcaactgcctttatctgccttttctcactctccactcccacccaggctgaagttgaagcctgtgtatgacttttcatggtacatatcacattatattgaaatcactcaagggtttgatcttttttcctcactgaacttgagttcttggaggcaaggcaaatttttatctttggtgcttaattcagtgcctggaagctggtcaaaaattaagtattgaaaaaaaaattaagtattgaatggatgaaggaattcaacacaaaatatctattgattgaatgtcaactctgtt

SEQ ID NO: 52601 - DNA, 1213 bp, Bovine  19866880973856
cctagacagcatattaaaaagcagagacgtcactttaccaattaaggtctgtatagtcagagctatggtttttccagtagtcatgtatggatgtgtttgttggatcataaagaaggctgagagccaaagaattgttgcttttgaactgtggtactgtagaagactcttgagagtcctttcagcaacaaggaaatcaaagcagtcattcctaaaggaaatcactccagagtattcattggaaggacagaactgaaactccaaaaccttggccacttgatgcagtgagctggctcattggaaaagatcctgaaaaaagactgggaaagattgagggcaagaggagaaaagggtgacagagtatgaaatggttggatagcaccattgacacaatgaatatgaatttgagcaagctccaggtgatggtgaaggacagggaagcctcattgcttcagaccataggttctcaaagagtcagacgtgattcagtgactgaacaagaaccatttttaagaaaatggcattatgccacaactcgtagaagtagtaatctgaaagactattttggaaggattgatactttccaatttagttgactgacaatatactatattcatttttggttaatttctgtgcctggtcctagaacagaaagacaggaaaatttaaaggcctaacacagtagagatagactattccctggtagttcagcaacaaagaatctgcctaaaatgcaagagactctcaggttcagtctctgggtgaggtagatcccctggagaagggcatggcaacccactttaatgttctcttgcctggagaatcccatggacagaggagcctggcagtctacaatccatagggttgcaaagagttggacaggactgatgcaactgaactaaaagcaaagatagtagcctaggaaactatttgggaacaggaattttgttgatagtaaactacatgaactataattcacctatatacactgaaaccttgtgtttaagatgaagacattatatatataaatatttataatttacatttgtcatagtattataaatgaagtggacatgataattttattatgtatgaaatatgttgtatttcaaagaaatcaaacactgtttcactgctaaagacaggcattattttgctaatatgtgaaaatcactaatgtaattacattcatgcattattaggatccataaacata

SEQ ID NO: 52602 - DNA, 1956 bp, Bovine  19866881380040
ctatagggtttattatgcctttccgataattctaaaactgggcatcatattctggtgcatgagcataggaccagtgttctcaactgtgatatatatatactgctttgaaatacaaagactgacaatgagctctgtgcttctttctgaacacagggtaccagacaataaacttcattaagcaatgacaactaggaaacttcagcaatgctgacaaacccttaatatattttgtatgtcaaatactttgtattcagcattgggaatattatttatattggaaaataaagctaaacaaaggatatatgaggatgaagtgttgctagatatatagaatataatttgacaaagaagaaaagagcaaacattttgttttaataggaaaaaaagtagagaaaatgataaaaaataaagtatcccacgttattacctcctaggtaatagatgtaagataaacatatcacttaaagttgataaatcaaataatagaatcttaagtacatataagttgataaatcaaataatagaatcttaagtacatataagaaaaacactacaatattgtaaagtttaaaaataaaataaaattttttaaaaaagaagaaaaacactaagtaaaataacttgactaaataaaatcaagtaaaacaataaaagggtaacaagtttattttgctttgctcacacgaggaaatactgaaagaaataaacaaaatacactatatgctagtataaatgtaatttctagaacaaaagtatgaaccttattaaatatcagagctacatcataatgaaaaacaagctgcatatgttattttaaaataagtcaaagtaatatttacatatgtactgattatatcaataatgtaaataagaatggctcacctattagaatcatttccagattgtctttcaaagcaaaaaccaactctatgctatagacataaacctaagcaagttgattaagaaaagttaaaaacaaataaaaaagcaacaagcatgtagactactgcaagcaaaaagaaagtggaatttttttgctattagacaagctagttttgagtgcaaaaacattgaataaaaaataaaccattattcactgccactcacaatgtttataaacagtgtagcatatatgtatgctccaaatatcataaatgatccaaatatcatgaatttttttgtgaccatccctcacttccctctttaaagagtaaatgatctcagatatttcaaatattgaaaaacataaaaagaaaagaaacattaagtggtttctatgaaatgagtatcacagttgataccagaactttaaaaatattgtaattaattattattttggtgattacattgcagagatgagtcgttttctctcagaattacgccttcaataatttggtgatggtgactagaattttatgttgagaaggattctgagtgcatctgagtgcagtgaatgtcttagtcagatactgttctcatcaggataaaagtaagctatcattgatcagataattatgactccttacttagggcaaaaaacaaaatcttgtagagttattgtacaaatgatttttattttacatctgtgtgtatgtgtgcatatacatctaagtttattattgtgatctattttccacaaactatatcacaatgataaatttagttactcaaggtaggtttcccaagagtaattttgctgaattccagtcctgagttaggaagtggcagtttataaataagcaagtcatatggatgatatgcttcccttgtggctcagctggtaaagaatccacctgtaatgcaagagacctgggttggatccctgggttgggaagatcccatggagaagggaacggctacccactccagttttgtggcctggagaattccatggactgtgtagtccatggggtcacaaacagtcagacacaactgagcccctttcacttttcatgt

SEQ ID NO: 52603 - DNA, 735 bp, Bovine  19866880445577
cccttcaccctgggagcttggagtcttagccactggactaacagcgaagttccttgcagggagaattctaatgtgtggaagtgttaaagttaaggacatatgggtgggtatcactagcatctgctgtactttccctagctcaaagcagacagtattgtctccataaatatctgtcaaatgaatgacctataggatgaatgcaccctctagcactgtgtggttccttctctggttgcacattcaaatcagatgggaagcttttaaataccgttacatccaagccctaatgcagaccatttaaatcaaagtcagaatgtttaatagccaggacagagaaccactgctcttgctcaactaatgtatgaattatttctaccaaattcctgacagatggccatataacctctttttgaaatccttcttgggagggactttgctattctcaaaaacaaagcattccctttctcgacagcactaattattccaatgttttgtccttatattgagccaaaatttgcctctgtaccttccatcagtcatccaccctctgcacttctagaataaagcaaaatgagtctattccattttctacatgactgcccgttagatattcaaaggcagtcataatgccctaacttgaccttcatttttcacactccaaacacacttagctctttcaacactggctattcaacctgctctaatcatatttgagtatgccaattcacttttatc

SEQ ID NO: 52604 - DNA, 1809 bp, Bovine  19866880521282
tcctccaattcttttctattctgcacacaagaaaatcctcaggcatttggttttaatgttgcaaacattatttaaaaaatcaagcatgtccattcggctttatagaaaaaaagtgcattacattattttcaaatgcagttacctgtggtttcgacacttacaatcatatttcctttctaaacctgtcaaagatgcacatatttcataagattttaatttattcttaggcttgcatttggggaaatcagtcttcattgttggtaaaagctaaggtgtaggaatatgcctaactggggaaaaataatgacttggttggtaacatcagaaacagctgaatgggtttctgattaaattttcaaacttccgttttgtgtggatgaggcagaagagatttttagcctaataggtaaatcttctatacacaccaaaatgttaaagaacaaagcaccattaacatattttcttctatgatggtttgatgtgatttagaacatcagaaataacccattcaccccaaatagctccacgctagatggcacatattgttaaaatgttaaaagagaatcattttttcaaatgtatatgatatctttagttaaaatgcaaacactcagcctgaggaaatacatttatgctcaagctaattattaacacattgatattaattagttttcaaatgctgtctaggtagggttgagtataattttgtctggtagagaaaaggagacagggttgggaatatggaatactgatcatggagcagacatcatgggccgtctacataacacagagaccagcattgggccaaataatatctcaagaatagaggaaaataagagagacagagcagggacatatgaaggggagtttgggcaagacataaaatacgattgttttgcttctgaatttttctatgtctggatcatgaccgggtaagcactgtatttcattttcagtaccttcagaggagttttagaaaaatcctaacccttgatcttgtttctatctagaaaccaaaggtaatggtgacttagaatcataatcagagataaacaagatgtcagagcttgatgagaccacagtgcccatttgccgagccatatgcaacatttggtgtgacctcctcctctttgaaaatccagatttactttatctgaggtaggtcctggaaattggtaaatgtgacaaatagctcatgtgatttccataaaggcaagattgaaagtgaaagttactcagtcatgtgccgacactttgcgacgccacgtactatacagttcatggacttctccaggccagaacactggagaaggtagccctttcccttctccaggggatctttccaacccaggaataaaacccagggtctccctcattgcaggcagattctttaccagctgagccacaaggtaaatccaagaataccggagtgggtagcctagcccttctccaggggattcttcctgacccgggaattgaaccggggttctcctgcattgcagttggcttctttaccaactgagctatcagggaagtccaagtttggaaaaccacaattatttgacacatagcaaaactgagtccaactttaggcaagtttggaaagcaataattatttaacacgtagtgaaacggagcccaagaaagaggaaggaatttgccctcagaaatctactgatgagagtcttgctgagttaaaaatctgaaagtcttgtatacaagtgtagaagacaaatttatagtgatcagggggtaagtcgggaagagacaagtgggaagcttgggactacatatgcacattactatata

SEQ ID NO: 52605 - DNA, 1507 bp, Bovine  19866880525142
ctgggtgttcattggaaagactatgttgaagctgaaactctaatactttggtcatctgatgcaaagagctgactcattttaaaagaccctggtgctgggaaggattgagggcaggaggagaagatgatgacagaggatgagatggttgaatggcattactgactcaacggacatgagtttgggtagactctggaagttggtgatggacagggaggcctggcattctgcagttcatggggtaacaaagagttggacacaactgagtaactgaactgactgaactgaatgccaaaaggattttttgcttcttttgtccattttcaacctctttttgtttttttttttttaacttatctgaaatctctgtcatgtgtttataacatcaaagtcctttcctcaatgactaaagtgctgtaacaaatagaagattacaaatttgggaccaagtgaagcagcaagaaaagataagctctaaagaaataaaaatcttatttttagagtaatttgccatgcaatgtctaacaaagcaagaggagggcagagtatatgattcagccatgttttacatccctcagaaaatattgtctcaaacagattgatagtatatgctgtcagacatttttaagcaccacttaaactctcaacaaaaagcctctcactagaattttccttgtttggaggtcaaataatttctggtggctgaaataaacagttaagaaaaaatattgcatatttttattcatatatgatgaaaattttggtgaaatctaataatttagcttattctttacatttaacacattgtacataaatacttcatttgcctgactttcattctccacagatttacaaatcattttagcatggatatattgttttatataaactgaaaccccaattgtaaatattggcctataatagtcacttactatatttgttagcatgaacttaatttagtctattagtttttattaaatatattttattgaaatgattcaattcatttaagatttttttgtaatgaagtaattccaaatagtgacagatttctttttaaaaaattgaacccataattataaatagtacaaatggaatattaaatgaataaaatacatatggctacagacttttgacgctctggaactaagtcattttaatttttcagttcacattgttatttttcttttccagggagagtgaatttctgatatatttacctcacaataaaaatgttttgaaatagggaaatatttataaaatggaattttcttactgaatttcttttcacaaaggtgctaaaaatatccaattttaataaacatacatcaaagttaaaaaacaaatgttagggcttctaaggcaccaagacaaacagtaatttagacaagttaattagctatgtgattcaatcaatgaaaaaagtcaaatcagctaatccacaatatttggactgttgattgattgagtgcatgtgtctgtgtgtggtttaaggaaaacttaaaaggaa

SEQ ID NO: 52606 - DNA, 732 bp, Bovine  19866880547823
aaaagaaacctatcttggaatgacatgattgggtctgatgaaaccactctacttcatcttaaacatttaatcactcaggaaagacgcagtatcatcctcttgagccttgtttgttcaaaatttcttctaatttgcagaaaacattgaagtcagtgcctgtctagggctttgttttgattgtggactgataaggaaacacacgattggccatatggggtattaagacatggtaatttccatataaagttgactatcatgaataattagacagaggtaaatgttttctaagatctgtttggattttctctgtaggagtaaaggccttatatttttaactgaattaccacattttcccagtaattcttttaaaataatttgtgattccttcagtgggaattaattaaatgagcagaatctgcttatagattattataaacttgttattttcaaagtctatcttaaaatatagcattgggtctactaggcctaatgatcttggatattttgagcaaatcaatgatcttgttatcttgcctaactcagggactggcttcctctgtgtttgtaaaacatgccatctaagtcctaaaagttccttcaactttcttagcgttaattacatttatgctccaaatattcattagagaatgaactgacactgagagcttaacacaacaagaatgatgttccattggctgaaccatagggtcactggcaggaaggtaacaacat

SEQ ID NO: 52607 - DNA, 2081 bp, Bovine  19866880562323
tatacatatgtatgtgtacatatgtgtatatacctaacaaacatacatatatatatatatatgtacatatatatccacaatttgccacttctaacttaaataatagggtaacattctaacaatagcagacttttcactcatatctttacatttcaataaaggtagtctgtaagatttcaagtttctagaaaaaatgatttacaaagtagtcttattgattttgcaaatatctcaaaaagttcctgcaactagacagttatttttaaaacctaccatgttataagaaagaagattttgcattttctattatgagtatttgacttatcattatacaaaattgacaaagccatttactgagttgtcatttagctgttttaggagttattcactcattggcagtccatgtcagaaagagaagtccagcacataatgcagaataaggaaaggtacatataaaggaagcattaacaacagattaggatccccaccaaagaaggagacactggactccaggccatgctgggcagctgcctctctcctaggggtgcctcagagataaagtaacttgggcccagccaagcagagcaatttttcctcaccatgagccccctcgaatgcacctgcagatgccacatacacgatggtagccatggtgtttctggacaggagcaccagagggcaactggcttgatggaatggggaccaaaggatagatcctcaggtgaagtgtggctgacaagcacaagatcttccccaaatattttgttattcaagtagtttaggtgcccctcccaagctatggcgtggtacatgcacatcccttcttaaattctcacatactcaaagcactcatataaacacagtgtctgaaacacaatacctacagacttatgcaccaggtaggagggataccaggatatagaaattttaggcagaaagtcacccccactcagaagcagacccacagacatagaaagcaagctcatgtttatgaaaggggagatgggggttagggatagattagggaaattacaattaacatatacacactactatatataaaataatcaaccaaagaccccctgtacagcacagggaaccccactcaatattttttaataaccgataagggaggaaaatataaaaaaaatcatgtatatgtatatatacagtatatacctgaatcactttgctggatatctgaaactaacacagcattgtatataaactatatttcaatacaaaataaataaaacaaaagagtggattttgtcatggatccctacagtactcagggctcttcattttctcacctatacttagagactttcatatccacagatgttatgacacacaggcaggtgagctgatcagaatatggcactaacttgtccaggcttatcttcttagccttcctcaattcctcctactttgtttcagagtcctttaatgagattctggccctcagatattgcactgggtcacaaatggggacaaataggacacaatgatgaatgaacagctgctagatcaaaagagttaatgtgaaaaacattcatagcacttgttttattgacaagtcagaaacttcatgctctcatctctatgcccatctgcacataccctttcactatgtacctttccatgtatttatctcacctttgactaaggatatctacattcttactcttgaagtctccttaatttattctatgcagaatgcagctaacagatgcttgatatcctaaattacaatcagataagacaggatgctagaggtccatgattctctggtacagattttttttttttaaactgctatttgcaactatatttccctgccacacaacaaagcacctgtgatgttcaggtcaaaataatttcaacccgatttttctgagtccctctctctccttccagtacttaaacaaaacagaaaagctctgttccctttttctatggacttgagatttcatttccaagtaattctggagtccttaaattagacaattattgtcaaggttaatgtctagacaaatttagtgctatcaatcagcttatctctggaatttagagagcca

SEQ ID NO: 52608 - DNA, 1742 bp, Bovine  19866880563678
tggaaaatgaactgtagatgatgctgtcatacattctgtttccatccagctcaagttgtccactccacatcatcccccttatggttgtttttggagttatgctagacctgtgtctgaagtctgcttttcttattctagaaatggctggtacccaaagtgctttttattgagaactaattggaggtgaggtgaggtgatgtggtcagctcctggagctagagaaaaggaaaatgtctagagaacctatttttaactgccttggcgcctaaattggacgctcagtgggggagctgctcacagtgttcaataaacatatccctaatgtattacacctgaaacctaatccatgctggctaggatgcaccttattatataaagggtacctttcccagcatcttacagttctgctgcctttacaaacctgtaatcccatgtttattgaaaactatagcacattagaacaaataaaccacttcaaggtagaacactcttgaacgagatggatcccttttagatacaaaagttattacttaaaaataattacttagaattgtcatcaattgaggatagtattttctcttctatttcaataggaattcatttattaatttatttttggtccagtgaatcttattcttttcatttatttttaatttttattggagtatagttgattaacaatgttgtgttagtttcacatgtacaacagagtgttcagttatacatatccatgtatctatttttttttaaattattttcctgtttaggttgttacagaatattgggcagagttccctgtgctatgcagtaaatccttgtctactgtattttaaatacagtagtgtatacatttcaatcccaaactcatataagttaatatatcattgcctggcagatactgtcagattgcgattgcatgttccttgaagatctactcctgtcctcaagggcctccctgtttatttctataatcccagtcagaaatcaatataaaatatggtacaaagaagaaacatatacatgtttaagtgaaatattgcatcaagaattaaaatggaattcaaaatgctacttaaaatggataaatataaattcctcagaaattcttaatagtgggcttattctcacctccatcatgtaaccttcctaacatcatcccataatgattaccttgttctcaaaatttcatgagaagttaatgtctctcacatttattcaactttgagtgtatctttggttctatagttgcttatggagaaggcaatggcaccccactctagtactcctgcctggaaaatcccatggatggaggagcctggtgggctacagtccatggggtcgctaagagtcggacacgactgagcgactcactttcacttttcacttgcatgcattggagaaggaaatggcaacccactccaagtgttcttgcctggagaatcccaggggcgggggagcctggtgggctgccgtctatggggtcgcacagagtcagacacgactgaagcgacttagcagcagcagcagcagcatagttacttatgtgttatgaacacaaactatatgccaaatcctgtatgattaataagggaaattttagatgaataaaatgtacccaccttctaaaaaagcaagagtctatgcacatttacactaaaataaaaaaataatttagatacaatgtcttgtttttcaaaaagaaggcatcctagggaagcacttgaatagaaacatttaaccca

SEQ ID NO: 52609 - DNA, 1722 bp, Bovine  19866880618061
cttttattaacattgaagtaacaaccaatatttaacaggaaatagaaacttgcgggtttctatgttatgcttttccccttagtatcaaccactgtcattaaaataataaacttaatgaagcttactttcctttggactttttaaaaaacacttgagagactcttagcctccttgaggtccccactggcctggaatctttccatctggctagagccaagcaggcacttggggcttcagactttggactagagccctattcttgaggagtcagtaactcccctaggctactttctagctcttctgtctgcgaacagaactctcagctaattgtctttaatgggactgggtgggtaactatctttgccagtaatcacaaggagatcgcaccttcttcactgagtactcagtttatttaaaaaaaaaaaaatctggcgtattaaaacttgcttccattttagatgcaaaattcaaaagaaagaaacctgagagatgcggtcctctgggtatcgtcaccaggtatttcacttgtacctacatttggtagggatagcaattttatcacttatttgcttttttcaaacttgaaaatttttattttgtatcagggtatggcaggttaacaatgtcatgatagtttcaggctcacttgatttttttagataagcaatttttactgaagtatagttgatttattttaccagactattactttcaggtgtacaacatcgtgactcagtatttttacaagttatactccattgcaagttattgcaaggtaatggccataattccttgtgctgtacaatatatccttgtttatctattttcttttttttctgttctttttttaaattgaagtatagttgatatacaatgttgtgttagtttcaggtatagagcaaagtgattgtaaaccttataggcatttatccatttatagtgtacacactagttctcaaagtgagatccccttatcagctgtgccagtatcacctttataacttcaggttataaatggaagttttcagccccacctcagatctattggatcagaagctccccaagaatggcccagcaacctgtgtcttaataagcctgtggggcattctgatacacattcatttttgagaatccctcctttacagatatagtgtactcattatgtccacttaacagaggaggaaactgaggtttcctaaggttttagctatttatcaaagtcatagaatctttaggtattagacttaaaacctaagataatctatgtaaaaagaaaaagaaaaaaaatcatggtagttgaacactaaataaataaaggatagttgagttcttttttgtagttattatatctagctagcataatttattaacataagaaaatttaaatctttgctacatgttaaagctgagatactaactctaatttcttctgatctaaggagggtagttcaaaaactgaactggtgtataaatattggaaatacaattataagtcaagtttcctgtgaaccactaagtaccttagtgataagattaatctaaaaacagtagatttagaagaattaattttaagcagatcatcctccttgctttgatataagctgctggatcctttcccattacaaatgcaaccagtttgtagagactgcaaacatctgctcccccctagaaagtgtctgtatgaatattaatcccaaagactacatgtgactctctgtccat

SEQ ID NO: 52610 - DNA, 1286 bp, Bovine  19866880645194
cacttgttgaatgagtgacaagaaaactataaatgttttcctgcccagtcattctattccctattttttgtaagtggtttttcatagtaattagcatgctcattaatacttaaggccaaagcagatggcaagtctctgctcttgggattttcaggctattaatatgataaatggcaaaagaaaaaaaaaatgtatacaaacaaatcacttcaacttgacaccaagaaaatgaagaggtctcataagttccctgtgaaatgtatcaaagacagtttcttgttcggatttagcttcctggagacatgaagaagagttaaactccatacttggatattcaaaataggtacccagggacctccctggtggtccagtggttaagaatacaccttgcaatgcaggggaggtgggtttgatccctggtcaaggaactaacattccatatgctgcagagcaacaaagcccacccactgcaactactgagtccacttgctctagagtccatgtgccacaacagaagattctgcatgctgcaactaagaactgtcacagtcaaataagtaaataaaaagataggtaaccaatctcatatttcagttcaaatttgcatatacatgacacttgtctgtattttggtaagatgtttgtttgtttgggctatgtttctatttgtgtgtatgtatgttaacattactttgccaacaaaggtccatctagccaaggctatggtttttcctgtggtcatgtatggatgtgagagttggactgtgaagaaagctgagtgccaaagaattgatgcttttgaacggtggtgttggagcagactcttgtgggtcctttggactgcaaggagatccaatcagtccattctgaaggagatcagccctgggatttctttggagggaatgatgctgaggctgaaactccagtactttggccacctcatgcgaagagttgactcattggaaaagactctgatgctgggagggattgggagcaggacgagaaggggacgacagaggatgagatggctggatggcatcactgactctatggacatgagtctgagtgaactccaggagctggtgatggacagggaggcctggtatgctgcgattcatgggtctcaaagagctggacatgactgagcgactgaactgaactgaactgaactgatgttgacatagacttctttaaaagaatgcacagtcatttttcttctttcactttactcatctcacacccatatttttcttctcctttccatattcattctctaaattgacatt

SEQ ID NO: 52611 - DNA, 1028 bp, Bovine  19866880651873
taggatggactggttggatttccttacagtccaagggactctcaggattcttctctagcaccacagttcaaaagcatcaattcttcagcactcagctttctttatagtccaactctcaatccatacatggctactggtaaaaccatagctttgactagatggatatttattggcaaagtaaggggtgacactatttttaaatagcaaagactcaaattcagctttgcctaaatccaaggttcatgttctaaatctattcgcaaagaagtattttattaaatacttttaaatgaaaagagattcaagtgaaataatataatcctgatacaatttgaatcaaaaatcctccttctccatcatcttcttatctaaatccatggagtacaaccccagggtgctgacagcactatatctagtgttagataaacgaaagtacttgcaagtggaaaacaattcacagtccacttgccttattattattactctgtcttccaaaagtctgataagtagtgttcaattagttccaaaatgcattcatttattttctttggcttcttttttcctgttttgaacaagtaaatcacccaagtcatagaatgacagaacaacacactcaataaaactttaatatgttccttcatcaggggtcatcctgagtagaaaaagcaaatgatcatgccagtctcaaagaatggtgatagctacttttaaaggaaagcagctggcacatctgtatgccagcaggaggggagtgcttttgctgattagagatgagtcctgtaatgggaaggacatgcattttggactcagatggtgccttttaaaatctcagtcctgctattcacttggagtagggtttgtgattaactccacaaatcctgttgtctcacctttaagtggaaatgacctctcttctgcagagtttataaaagcagtcagcacaaatggggctcatagtagacatcctacatgttgctagtaccattgtttctggtatgcctaaaaggtagatacaggaaaaattatat

SEQ ID NO: 52612 - DNA, 1319 bp, Bovine  19866880687411
gttccctatgaatcagaaggctttctttcatatctacagattcagggaccaatagagttagtagaagaattgtttgcagacagatgggtgggggtattggattcagtgggctttcccaagtgcagtgggtggtagatctctgtcaggactgctcctagaataggctttgatgggagatttcacatttggtgaccgtgcctacatatttagcaaggcagcatcagaatgcaacagatgtttttctcccctcttttcacatcttaacataatcagggaaaagccaatggtattacccaaaatacgcagccgcatgacagagaggagtggggaagagaggaagggtggcagagaagaagggacataatgtatatattcagcaaacagtggcctagactaacacctacaagcatctgtctgttaggcaaatctctttagacagctatttgcctcggaatgtcttcagaaggatgtatctgcttccaaaggtggatagttaaaaataatatacaccacaagggatgttttggcattttccttcactttctttctatcttcaacattgatgttgtcatcctttaaaactcaatcagttcagctgatccaaggaacagatggcattaatcaaccccccagaatatccacaaaagcaattagaaacgtagagatgtggaatttatgccagcaaatcaattaccaatgatggcaaatcaacctggcacacccagcttccccggtttctccttccccagagcagccacttatagcagttatgatccctggtttacctccctgccagagggggatgagaaggtgggggattgaggtttaattgctccttccttaatgactagttctcactctgctgacaaaaaccagcataatttacagactataagatgcatcaggatgatggatacagacagcatgtgctatatggtgtcatgcaaatatgaaatacaccgcactcagaatatggtcgcttggtattccccgagaagaacttcatttcagagaactgagcaccttttctagtacctacagttctcatttgtcaaaaacaatggaagctgcaataaaatacattttaaccacaaatctgtgccttctgtgagtttactagctcatagattccttggttttgaaattacttggctcatgattttctttctgattctttatgacctttgcaggttctgaaactttccttcttaggcccttattaattatcacctgtgttattgtaataagctcttcactggttttcttatgactagccttcattcattttaatttttccttcatacagtatattttaaaca

SEQ ID NO: 52613 - DNA, 1473 bp, Bovine  19866880779870
taaggaaaagtagaacattttgaagcatttttgcctgaaacagcttttatttttagcctgttccccaaaaatcattatctagaggcctgaaatgtctcaaaaaatcattatatttgagtgcctggtgggtcatctcacagagtcctgtaagatcatatttgctaacaaatgggaaggatctctggaccacagaaacatttggtgaaataaatttatgtggtgaaactttccccttcctctgtcttctgatgagcaaatattctctagagtttgatccagtaaattatatccaggatttttactgagttctataaaaggtagcatttccaaaattgaaatctgataatctgaggatctcagaataattaatatttatatgcatgcattaaattgccttctctctagagccttggctgggatcaattttgtttgagtaagagcatacacaagaatgcccaggaaaaaagggccagatttgggacttagccctgaactatgcctagttccctccctttagtgagaaaagtatttttataagagggaaaaacataaagccaagccattcatctcaatttcagagaaatagctggtcagatggggccacccataccatttattggtcatgtcagcctagttgccatcccccacatatgaaaaccagacaaagagaggcctactgataaattaagggggatggtaattgggaactgaaagtattttcatttctcaatttcagaattcaaatttgtgtactctcaaaatgtaatttccttactcaaaaatctttagggatagtcatcataataatgttatagttaatatataagtaaatgcagatcattagtacattttgcctcattaattgagccgttcttatgtgtcaaacactgatttttttcttggtgtctcataatattcctaatttgtcacatctcccctttgaggaatagacgctatcagttccatttccaaggaggaagctgttgcacagaaaagggaatggatttgcctggattcaccaagttggtccttaggatgacagactatacaagcagcatgctcggacccagagctggacccttttcattctgcttcacactccacatctgtcagagcttgaaccctcagtgggcttacacatcagccccccaccccccaccacctccatgggttaatgtttatcctcaacactctcagagccttggtttattttacctgtgaataacagggggttttgaggttagaccaggtaatttgccttcccagctaatacctctgtgatgctgataactgtgccctcatttgtcatacagtcacccttaagactgacctacctacctgaagtgtttttcccccaagatcaaataaagtcagtatttggaaatcatgcacatattaaaaatagcaatgatgattcatcaagattcgttttaagcactcacaactcacagtctttatttttaattttttaat

SEQ ID NO: 52614 - DNA, 953 bp, Bovine  19866880784015
tggatgttggatgctcctagtcctatttgcaatgatgtagccctacactcacagactgagatggtgtttaaaccgaaggaacctctgaaataaggaattcaatcccttcaattacaaacgaagacctcagggtgtaggagatgacaggcctgcttaggactggtcagttaattaatggactggcccgggtagaaattcaagtttgctcaaccccagatggtgaccactaggtcagaattatgccacctgtgcataagtctggtaaccattagttatatcattctccataggatttgttttaacaaatgatttattttctgctaaaggaagggtatagtttcatttcctggataacagaaaaactttgaaaaatagtgcataattttcataagaatttgcattccttctcatttattcttgccttctttacttctttgacactccaccaaaagaggggaggaaagtccacaaagggagaataagtgaaagaaatgtatctgtttccttattaatatttgtaggaatattcatgggaagcattttttttggaataagtagggatagttttcccctcaatatacatgcgtgagtaaatattaaaggtcttctttgacattaattaaaaggtaaagacacagaagagaattctgaataaatatgatatttacacagcttctgagaaattatcattgactctttaagctggttctactttaagtaacgtttttgtttgccaatgtatatttttattcattattattaaaataccaatagagttacagatggtaacatgaagttaaattgtgagcatcgccttgattaccagagtaaattgtctgtatatgggggatttggagcttaagggattcactgtatttataggtgagataaaattcctcttagcattacgcacttaatggcccactttgtttaaaaggcataaagcaggcatt

SEQ ID NO: 52615 - DNA, 1662 bp, Bovine  19866880930505
tgagcacttaaatgcaaaacagagcaaaggattagatcaaccatgctttattattattattttaatttttgctattattaattttccttaagagcaaatgcagtaagtctcctacatacaaatcttcaagttgtgaactttcacagatgtgaacatgggttcacatgtccaatcacataaattagttcacttgtctcatgttcattgtcacgtgtgtgtattcttcacaggtagttatgtttttatgcactttattgtacagagtactatatacagtacagtagttcagtatctttacttcaagcccaggatgtccagaagcaggttcaaaagcagaagtgatatagctgatacagttctactcagacatcactggattgtttttacaagagggtagattgaatccagtaagcaaccagagtctgtgccatcagagtcaggtgtgagggaaattgcagcttgccctccgtctcctatcgctgatgattcttcagctctaccatctctcacctcccttccctcttccagtcagtaattcttcttgcctgttcacctgatgccagcccctgtatgccagctgttgtataccataccactgttcttttcaaggtactgcactgtaagatttaagacattttctttattcttttgtgtttgtttttaatgtgtatgaaaagtactagaaacctattacagtactgtactatatagctgattctgttagttgggtacctaggctaactttgttggacttatgaacaaatcggacttatgaaagcactctcggaatagaactcattccaatataggagacttgttgtagtctacttcagcaaaagttttccctgaagcagtcacctattgtgggtgtcatctctgaaataagtcccaaaagagatcagagacaaaataaaaaagtcaggatcatcactctaggcctgataacttactgtgagcaaggacgggatggtaaatggtgttcaaatagaaaatcctgagaataaggcttgaggatgctcccaatgagtgggatatgagtgggtgtgatggtcactttcaccaggcagtgtgtgggtatgccaggcagaaccaaaggtagtaagccaagctaagtggtataacctaataaggcaattattattatgcaataagaaaagatctttttttccaaaataatatgaataaaacttaattataggaggagagccaatgataccacactatacataaatctttcattaatgatttcctttcaaatatccaggatctatatgaagagaggataaagactagaaatcaagtgtgacagatgagggcaaaatgaacagagcaatgttagtacacaaattgcaaaaggcatgagagtttaagagggtgatcgattctgtactttatttagcaaacataggctgtctggattttggagattacatagtgcttctgcaaagaaaataaagattcagagactatcaattgcaagtgttacctagtccatcatcagggcaaaagagctcatggttgtggtaattacaaactgatgtccttgtgagacaagcaaagcctaatcacacgattgctaaatcacaacctggagaagaaacaagtgtgcccttagataatgcaaccttttccagagaaaatgcaattttttcttttattttt

SEQ ID NO: 52616 - DNA, 1991 bp, Bovine  19866880934112
ttggtaagcttttgtatcatctcagttgatctcaatttacccttccagtgtcaaaccaaaacccttggagttctctcaactaccctctttctcctacatgccccatgctctatgttagataatcacattgactctctcttcaaaatgcatccagagtcttgcctcttctcaccagccccttggctgtcattttgtttcaagccattacagtcgtaccttgcatgatcttcttgaactgaacatggccactgcccacgtacaacaggttatgtaactgccttaaaatataaagtagatcatgttatccctcacaacctcccaccactggcttccatattactcaaagtaaaattccaggcccttagtgaccaacaagctctcacaatctggccagtgatttcatggacctcacaccccatgttcttcactctcacttggcttgtcccaacagctacagtttgctgggcttttgtccatccgttcctgtacctgcatgttcttcccttagatattatctgggctaccatcctcgactctggtcagatgttatgatcataagaagtcctattcaatccacctgatttaatatcctgtctcatctctcacttccccctaatatgccaccctctccttgtgtggttctcttttttctttgtttcctagcttttatcattttcaaacatgcattgtatactagttccctagggctgccataacaaattaccaaaaactggttggcttaaaataacagaactttattgtctcacagttccagaggataaaagtccaaaatcaaggtgtaagcagctgtgctccctctgaaatatctaggggagaagcctccctaccacttccggcttgtggcagcaccagatcttccttggctgtggatcaaaactccaatctttttctttgtcttcacgtggttgtcttctgggtgtctatgagcctctatgtctccacatgacattgtccctgtgtgtcagtgtatgtgtgtcaaaatttacctctttttataagaataccagttatagtggattaaagctcaccctccatgtgcttctcttaatttaaataaatcaaatttgcaacgactctatttcagaatgtcgtgtactcagttcctgaggggtccacatatctttctcttttattggtgggctaggtgaggagacacgattcaacctccaccccatggtttaccctatattttattatgtccattatttattgtctgtctccactggccaagagttaggatttttcaggccaggaatctttgtctcttttgttcactgatgtatcccaagcattcaaggctgtatgggcccacaacaggttctcaatagaaatttgttcaataaaggaaaagtttgaagtataggacataatgatatttcactcagccagcacggggggaaaaatttgtctgtgaagctctggtcctgattggactcgtggaatccacattctaccctaatagtttcttttccctgttctatagcttgtttatgaaatttgaagctcttgtttttaaaccaatccctattaaatattctcagtttcagacctagagtttcactctccagcacatggttgatctgtaccttggaaaggaagggagagtggggagggaggagactgggatggagggagacatgcgaggttgctaaacctccgccctgagcagacctcagcaaagaacagaagtgaagcccagcaggaccatgtgtggaactggccttcaccagctccaggtcataagtggcctaatcaaccttggccccgaatctctctggctatagctttgtgcctgttcactgcacatggccccacctctctcttgcccagtgcctgcgagtgcatccaggtctctttatgatttccaggacacagctgctgtaacatcatttccaattgcctccaatccccccaccatttttgttctctttgggttactgagcctttccaacacatggttcatgaacaca

SEQ ID NO: 52617 - DNA, 640 bp, Bovine  19866880935277
atagtaccttagtctcttgcattggcagatggattctttaccactgggcgacctatttcacagatgaggaaataagctcagagaactttggtaatttgatcatcagcacacagctaatgactggcaaagaagaatttgtattaaaatgtatttaattcactaactcccttcttttctatgagacaataaagttagagttatattttgactgtaaatgataatgttttaatataccgtttttctttttcttttctaaactcctctgaagaggtgaagggtaggtcagatgatttctgaaaagttcttagttttcagattgcctttctgtaagcacattctataaaaatgcctgatgtgtatatgcgacagccagttcttattaaagaccatttcaatccactttcataacatatttaaaagtaaagtttattgctagagaaagtacctacttcataagccaaagcaatccatcttatcctaacataagaaaataaatgaaaactaaatgtccagaataagaactgggaaaactaaaaatatcttagaaataagctccttctctgttttaatttttgatgacagctatctcaaatatggagggacaataaaaataagtctatgtcatagacacacacacaat

SEQ ID NO: 52618 - DNA, 1407 bp, Bovine  19866880980656
cctattatatttgtcatgtgctaaacaaactgagacttgaaatgcagagacacacggttttaaacatgcctaagatgcaagtacctcagcttgtttattcattgtgtgcagccattaattcccttacccaataaaagttataactacaagccaggggctctgctggtaacttgcaaatggccattgataaggataataggaacatataatctagagatgctgggttagagacttggggtatttattgctcaggatccccacccctgttctgaagggctctcagttatttttattgacacacccaaatctgtacagttattttaagagtatgcctcaggatttccctgttggttcagtggttaagattccacacacccagtgcagagggaccaggttcaatccctgatcgggagttagatctagcattctgcaaataaaagaccctgcacactgcaatgaagatcacacatcctgcagttaagacttggcacagccaaatagctaaatttaagggaaattaataataaaaagggtgtgcccatttaatacctactccttgcccatgcattaagctttgtgctaggaatgcacatgtaataaactcagaatgtgggaagtgtctcgagggcaggcggcacacgaggagtcctaagttaagggccaatttagtgtaggatgtgatgctgtacctaagatcccatactgcggcagagaaaagagggttctaggatgtagagagagcacatgaccagagcccatgggagagacagcctgccatggaaaaaaattcaagatagctagatcattgaatacacagggagagcagttcattacagggagtgaattggtctggagtttgtgataagaagacttggggctggtattaggaatttgggctgtctcataaaagcaatcccacgccatggaagatttgtaaacagaggacagacagaaacacattctctcccgtgtccttcagattcatcctgctctgcctgcaggatgactgttccttctctgaccatccgcttgagctttctttcaggacttggtggtaatgctaaccttgcgagaaggacttgggcgtgtgatgaaccacatttaaaaatctactctgccacttgctagatgtgagattttagacatcgccttgcaaagatgttcttccttaattgggcctcctaatgggctactaattaagtctatgtttcaacactttaaaaatgttctcctctgttgtcgttgtcatatgaatttcaattaaatgtcttaactcactggccttgggcacttaagtggattgccaagatgaagtcatttaaacatatatatctatttcaagaccgcttatgtgaaagataacaaaggaactagctctgtgaagttttcccatggaaatgataatga

SEQ ID NO: 52619 - DNA, 1017 bp, Bovine  19866880987242
aagttagatgacagcttctgtgacctaaggtgttcgggtgaaaacagcacagagtgtctgaagatggcttctgggaaaagcccaaagtaggtcaaatacacatgacctgatattcctggggaatatggggccttctgctttgtatatgttttatatatgacaggtccttagcttccatgccgcctttgtgtcagtctgagttggtgtccttttgaacttatacagataatgttccttacgtcacttctgatgccctcttctgtttttattatattttgttttctgagcacctctttttgtttttttgttaaagcaagatctctttctgggctttataattctcctatcactatgctgggttacatttattatacccattacacaggggggcaaactaagatacaggaaagttaagggatttatttgggtcaacatcctctagagtaaagctagtcatgaaactatggagaaacctgaaggcttgaagagactacagccatccgctcatccacgactgaataaaccttagaatggaacagatagtaaatattttaggttttgtcagccagatactgtctcccttgcctattctcccccttctccatctcctcattcctcctctttaataattctttgaaagcttaaaaatcactgttagcttgcaggttgtatagaccggccatgaatcaaatttgtcaacttcgaaccaatttaattctttcactttctagatgaggtgagaaacagatgggtttagtgagatgcccagggtgacccagcaggagagtgatggagctgtttagacctcagattttttcaccaacatttccctcctcaccatagctcaaaatcttgaaccatagccaattgtggaagtagttcttacctacttaaatttccaataggaccacttgaagggccatggctatgagggaaccaggttttgtctctcgacctctgtgcttgttcttgtcactcactttttaaaaaatatcattgtgcattgccttagtccaa

SEQ ID NO: 52620 - DNA, 1752 bp, Bovine  19866881002769
attggcttttgtatgttcgtttttcctccttggctcttttgtaagtcttcaactggaggttccatatcagctaattcataatggaaggagaggtgatgctaaatagctgtatatttattaaaggtgggattacttggtgggtctgattcatggcttattatctacaataggcgtgtttcttctgccaccattttatccttgaaaatcctccctcatccctgcaaggggaaccatgccagagctccatccagctatatttagacagccagaagtgaactaactgtaacatgatttataatcttaagtccagggaagtgatattactaattaaatcgtgaaacattaggcaggctgtcaagcacagatatatttaaagtcataacagcccttgcttatttgtaaagtgtttgcatattgaatgattctagtgaaattgtttctatttatcagaccaagtataaagtgttcatcaccaaggcatctgcaaacaagacagaccatctaagataaacccaagcccaagagagcaatttctccttcatttcacattttccgtttctctacagcccttctgtgaatctgagcttcacccaattttggagtcagcaatttcaaaacttggcaacttctagcagcgaaagtgcatgataacgtgaggcagaaggaagagatagaagcagcagagcctagaacctatctcgtgccaggttcttaaaacactgatcctgcctgtcccattccacagatgagaaaaccaaaacaaagatgtgaaaagaaaaaattattctcatttatggcctggctaacaaggggcagaccatgtggaactgaggactctctaatgctgatgttagtggtcctttgaggccaatttcactttttgggaggaaactttccctcccaggctctctacctttatacctattgaaatactcaagtttgataagaaagggcttcccaggtggtgctcatggtaaagaacctgcctgccgatgcaggaaacataacaggtgcaggttcaatcccttggttgggaagatcccctggagaagagccgggcaacccactccaggaatcttgtctggaaaatggcatggacagagaagcctggtgggctatggtccatagggttgcagagtcagacacagctgaagcaatttagcaggcgtgtagcacaacgataagaaaactaagaaaaatgagtagatgaaggtgtcagtgctcttcagcgatggtcacattcacaagttaaattcttgtaagggataaatttctaaattcaagagtgatgagaactctttgggtttgggggtctaacagatcttttgtcccgctgccagggcacacagagaactcctctgctctaggtatcctcatcttgaaagtgggataatgatacctatatcaacagattttaagaagattaaacggagataatttttagatatctacaagaaggcaaaggaaaggccacagcaggagaaagtaggacttttctacatttcccaaatcatattcatgtgtttgcttgttctctgcttgaagatggcctcaagtattgcatattctacaaattttggcaaacatgataggcacatcctgcttcagcacaaagtattatattgagcataataaaattgtggtttaagatgaaagacttgaaaatcaagttaaatagaatactgaagccttaattgaagtaccaaaatgattgctttaaaatctctttatcttgctttggtactttgctat

SEQ ID NO: 52621 - DNA, 744 bp, Bovine  19866881049773
agtcagacatgactgagaaacgttcattttcactttcatggacatattttaagcaaagtgattccatgcatagttttgtatcacagaggaacactctacaaacaaagtgaaaaaggttttaaagaccctttgagagaatctctataacttgtacctggttcaactgtgctgactgcagttgagttgatatttttagagtataaaaatatttatgtatactactttttactggcacagttgctgcataaaatgaggtatatgtgtacactcacaaatatgaaagagttttccaataggtaatacaagcccacaaccatttaaataaaattctgaaatccataaacctcagaagaaaaaaaaattggtaatagaataaactcaccttatttggactcatttgagacaaagttgaatagatatgaaatattattttaaattttcccacttaggtaatctttatatttttgctaatttcctttttaatatagggtgagtatacaataaaatatatatcatatgcatgctgtatatgatatataacatacccacactgcattaccattctagaatgttatatatataatgaattctaaaatgcagtatatatatatatatatatatatgaaattcaaaatatttctggttcctagaactttagataaaagattatgtctctgtgatatataattataacaaactaatagcatgattatccaaatcagagcaagaaaaaagtcaaaatat

SEQ ID NO: 52622 - DNA, 3048 bp, Bovine  19866881085361
cagttcttaggctatagtcgatactgaggaagaatgattactttcttaatttgaaatttctgagattttattaaaaaaaaatttttccccactggagtatagttgcttacaatgctgtattagtttctgctgtacagcaaagtaaatcagctacatgtatacattttggatttccttcccatttaggtcaccaagagcactgagttccttgagttacacagttgtttctcattagttatctattttataaatagttgtgtttgtatgtccactctaatctcccattccctcccacaacttagatgcccactgacaaatgaatggataaagaagatatggtacatgcatacaatggagtatcacttagccataaaaaggaacagcattgtgtcatttgtagagatgcggaaggacctagagtctgtcacacagactgaaataagtcagaaacagaaaaacaaatatcatatattaatgcatatatatggaatctagaaagatggaatagatacacaaacatagagaacaaatataaggacaccaagggggaaaagggaggtggggtgtgggatgagaaagaatgacttgaacaaactcattcttcaggatttttgaattttcagcatcaaataaacctcttactttggagctcttaaagcattccagtattaacctaaaaaaattatatgtgtgcccatggttgcatcatccttctcagcccatcatcaagctcatttcctgtgcatgaagcacaggtttacttatgtgacataaaatgcttttgcctctgtgacatcctttttcatcgacatcctttttcatctctctctgtagagaatccccttagcattaacaaccccaattgtctgggtttttgtatgaaatatactgcatccctttaacttgatctgataggggtgattagttaattgctgtgggcacctgacatttgcaaggaaaaatggatacctcaagccctctttcttccaatgcaatggaaaatgattaaggtttgctggtttctcagtgggggactgctgttttcaggtggatattcagagacttgcaaattctagatattaagctgttcttgtctgtctttttctcttttgtgaagggatcgctggggaggggtcaggaaggacaaggggacaagctatgaatagcttttttaaaaaacctattctttgtaataaaactgttcatccatattaattccagcttcttcgcaatgtgcatacctggccactggcaaaaattgtgaaatctctaaagtttcccttccctgtccttgtctgttatattctacatggccttgttcctttgaaggacacattttgctcctctctgtcccccagaactcatggccatggtgtcaggaatgagaaggaacatgcagttagtacacatttaggtaaaaatcaccatcactggtatgtagaataagaccttcccctcctcccctccctgaggacctacaggatgatgaggctcacagtgtcttttccttatcatcttttctgggtcatttggaaatcttttctgagtgttttggaaatcatatgacatgaaaggtttttatccaagaaaaatgcacagctgctcatacaacacatagtaatttgtgcagcatttcaggggatatgaagcacctaatgcaacatggagatccttaagagtcctaagcagagttcaggcaagacttccttcctgtgagaaggtagggataggtgggaaaaataagcagaagaacagggcttctgtcaatatcactgtattctacattctttcccaagacataaaacctagagtggagatatgtctaaaaattcatattagaataagaataaggtgaatattaatattatcaatgtacttacagtgcttttttatcagaggatgctgagagatgacacacagtactataccatcattctgtgttgtaacacaacctagtaactctgtgttaagggaaaaagaacaaaacaacccgaacaaaacaaagaaacacaatatttggagaaagacatttttaattggaggccaagctgaaaggttacagtaggcccatggaaattgatttagggatactctttacaatttgttttttccctaaggagtccctaagtcagagaagagtgagtctgtaactgttaatttctggatacacattttgaagccagagacatatgtgaaacttcaggttttgtctgaacactccatgagacttgaaattctactccagaatatatctgcatttttcttaatataaaataatgtgcacttcttaacctttgagtgaagttggtgccctaggaaaatgggtttttaaaaattgaggtgtgggtgtgtgtgcacatgtgtacgtgtttcctcattgtcatggcttacttctgcaggatggatggtgctaaagttacatttgaaaagcttggattcagagctgaggttaccctgagtgatagatgtctccaaacacgctgtgatcatttcacagcatccatcatcatgacagttgaggggatatgaaaagccaagggttttataaaaagaatttaagcaagagtaaaagcatagagcagaactactaactagaggtcaatataaatcatcatctccacaaggaggccttagggaggtagatccccaggctggtgggaagctctggtctgtgtttcactttggtctatatttagatattgaacatgttttttcaccaaaggttaaaagcagtccttagtttggaacaggtgctcaaaaaatattgtgaaatgatgtgatttcctcgaatcaactagaatgatgctagactgagaaactattaggagcttagctcctttccagggtctaccatgctgttctctatggaaaaaacacagtactttggaatcagaaaccagggttggatctcaggtcagtcacttcataggtgtaaattagcctatataaatctcagtttcttaagaaatattaatcatatagattatggagtagattagcagtgatataagtgaatgataagatctggtacacagtgaacagtcaata

SEQ ID NO: 52623 - DNA, 1090 bp, Bovine  19866881105887
tttgagcctgaaagcatccttttaaatccacatgaaagtaactccatagcacaaaaggaccaagatgaaattgcatggaacatctgtggcctgtgactgtagatggccccaatttggggagtttacagcatgcaggggttgcaagaaagaagactcgtaaagcagaatgaaatcagctttgagtgagggccttgaatgtcaagctgaggatctcagaatccctgtttgcctggattcaaatgtggtcaacactgaagtcagaccaagtgtagaatcatcaagtgggatattctgaaaatcactacttaaattggggagcaaagcaaagtatgaacagggcctgagtgtctcctgctgcagggaggtacacataatttatccagccctaatcctctgcatttgatatagagcatgcagacctccctactgtttatgcgcaagagcaactggaaggatgattgatgtgagccacggaagctgctgctgcaaactgctgggaaagaggaatcaacgaatagttttaggggaactggtctgggataaaagaagctttaatgaatgattcctttcctatggattattatctccatttaatggataaagaaaccaagatactgaaagatgatatgaatggcctttggctacacatggagccagaataggtggtaaaggtcaagggtcccttcctgcaaagccctgcatcgtgcagcctagggtccagcaacgcttctcaaggaggatcagggataagaagcagagtgaagaatggaaaccttatctattttccaccttctgggtgctacagtctgtgcagagtactagagagaaaatgaatgaaggcagagatcctcatgatgagtgctatctggaggcagagaccaccttaaatgcatccattctgacctttgtgctggtgtgctgctgagacagaagagacagtagcagtaaataaagagtgtcaccagcttaaacaaagaggttgaaaagaacacagtgaaggaggtgcttaaaagaggcatttgctggtgtgcttgagggaacctctggtagtctgatatggtggaaggagggctggggcagagaggagacg

SEQ ID NO: 52624 - DNA, 753 bp, Bovine  19866881113057
cacttcctgcccttttttctgctctggtagtcttttcaccaatcagagttgccctttgccataggggtgggtatccacatgtggagagatggccacagctccccgtggcccatggcaacaccatgactgtgaccctgctctgtggccacttgctctcacccagcagctcctcagcctggaagtttgtcccagacactctgtggaaagctcccacagtttacccagaggaggacatccagaagtggccacctttcaaagtggcagaggacactgctgtgtgtttaaacagcacatctctacccaggtcccagggcatcattcatttgagaagcatctgcacacaatgctaatattggcaagatatctgtaaagctaactcaggtactcagtcatgtcaaatggccaagtcagatccttgggatttctcccagagtaatgcacggagagaaaaggaaaggttatgtcagtgactgaaatgaagtcaacccaatgccctttcagaaaaaaaaataaataaaaagttaggcagatgaagtattatagtgggtttttgttattgctcttcagtcgctaagtcatgtctgactttttgggaccccatggattgcagcacgctaggtatccctgccttcactgtctcccaaagtttgctcaaactcatgtccattgggttgaagatgtcatgcaaccatttcatcctctgtcacccccttcttctcctgccctcaatctttcccaacatcagggtctttt

SEQ ID NO: 52625 - DNA, 1149 bp, Bovine  19866881194480
tgggagtcaaagtgttctgatctcactagtttcctggtctctacccttctgagctgatttttaacaggaaatgggaagggctgattctggggattggggccccatctgcacaaaggccttcctggcagcctttctttcaagaagtgtttctggaaagattatcattgacccgtgtggaaaacaggaattcagagggcaggaaaaacaatggtaaagagattcatgaaatcagctaaatcagtgtttcagtgatgcttggagaagtttaaaaatcatatccccttacaagttgtagagtgattcttaaaattaagcaaattcattgaaatatctatttataaaagagagagaggactacttcagcactagccagaattaaagagtggcatctgtcacattttggacattctgctgtcatgaagaatgaacttaattgtgacctaagggattttacatctggatgccttaaatcttgcctaaatgattgaacccaagaccatgtataatgtaatttcagtattttgaagattaagcctttcatgaattcttcaatgtttccttccatcagtcaaactgaaattaaccaaaatgtttaggaaatacatactccaatcaagtgcattctctagaaaaattacagattgtcatttttaattcctgtcatttatgcaaaaaatattcaatggacacctgggtcaggcattcttttaggtaccagacatacagcaataaacaaaacagaaatttctgacctgttaagtttacattctagtggagggaagtacaataaatcagtacagtgtgtgatattctgagtattttgcatgtttaaaattttcataaggtctcctgggctttgttattcaggtggccccaggagtcattgctaactctgtgagaagtagaagccatatcaaacacctactctgaaatttcctggtcccttgaccctggacatgtcactgaacaaaccagagcctacagctccagtattatggttatcatgtttaccttgaatgttattaagagtttggtagaagattatctatatataaaacagtatgaaggaactaataataaggatcttcacaacctttctggataatcttctttatcatactcttatccacatgataaactcatgataaa

SEQ ID NO: 52626 - DNA, 709 bp, Bovine  19866881207148
tggggaaaaggacatatattcttgtcctttgcatatcaagtgtcagtattaagagtggggctaagaagtgtgtgcaaaattcagtagctccagagacagtaggtcataccatagagtgtctcccatagcatcttcagagacatgatagtatctttcctgttgagacagtgctatcacagggaggaatccaccaagcaaacttgatgaaaggagtggaaaattgacaggaatttctttataaagagtacatgctattctttgacatggaaggcgacaatagtgagaaagcatgtaagtctcattagactccgtgcccaacagggtaattaatcccgctactgccccactcaacgtcctgtgttcctggccctttgcatatatcctgggttgctgaatcagctctccactttccagattccagaggagtggtacctaaatgtaaacacaacatatcaaagacaattatccatcctttgttttaggaataggcattaaattttagagttgtctcattttaaaaggatgaataaagatggataaaaaataatatcaaactcaagaaaatctgctgttatgtcagaaacaagacataacaataaaaggcagaaaggcatttttttcccaacagattcactgtagggaaaaggaataaactttaaatagcatccattgttatcttagtcaaatttatggagcatgattccatata

SEQ ID NO: 52627 - DNA, 1184 bp, Bovine  19866881207989
tgagttttattggcatttttaataaggtggaatgaatgttagactagagccagcagggggtgtgttgactagtaggaactagtagggaaaaaaaaaattgaagcagcagcatgaaagtctgtaggttgttcaataattgttcctttggaagaaggtgaagagcagatccaagaggaggcaacaaaacaggaacttatttaaaataagtataagacttatttcaaatgtttccttttaactctaatattatctattaagaaatcatgcatagccaaaaataataaactttataatcccacatattgaataaattattttattaaacataaatatgccactaaagcttccagaggaaaaattagagttttttttaatgacttgaagctgtaaaatttagaaaaataatttagggtagataaatatgcatactgtatgatgattccacttatatgtggaatctaaaaaaagaatgcagatgaatgtatatgcaaaatgaaacagattcacagatataaaaaaatctactgattggaaaagaaagggaggagttgtaaattagggctataagggatacaaatactactacatataaaacagtaagtgacaagaatgcatgtatagcacttatagtcattgtcttgtaataacttttaatggagtatgatctgaaaaaattctgaattacagtgctgtacacctgaaactagtaaacagatataatattgttagtttataattcagatttaaaaagaagaaataaatacataagtatgtaaatacagccatgctaatttgtttatgtgttatccatggctacctttgcattagaattgcagtgttgagaagtttccatgtaaatataggatctgcaaagccgaaattatttgctaaattactctttactcacccctgtctcctgagtgcaacactaggacagagtacaatgtacagaagtactataccatagatgatacaatatgattcactcatcagttcagaatgctttttatcaaggtattttgccatacaagatgccatgggataagtcaattaacaaaacaatctcacaagttttagaaaatatcagctagatatgcagatttattggttcttattagagttgtttaatgttaactcaactctgttcaattagttggttcagaacttcacattattatcttttt

SEQ ID NO: 52628 - DNA, 2997 bp, Bovine  19866881240287
tttaaaatatgaagttttaggaccatttttcaggcctctttaattcagctacagctctggggccacatgggcttcccaggtggcactagtggtaaggatctcacctccccaatgcaggtagatgtaacagactcaggttcaatccctgtgtcaggaagatcccctggagaaggcacggtagcccactccagtattcttgccttgagaatccgcatggacagaagagactggcaggctacaatccatagcatcacaaagagttggacatgattgaagtgacttaacacacacactcactagggctacatatgatggaatagccgtggccccatccttgagagcctcagatgattacaagatgaaaaaaatgggaactatatttaattgaaaatggggcatcacaatctttaagtgtaaagaccgcatgtcctagatgatttgggtgacacaatttcaaactccacatcttttgttagttcatatagatttagggttcgttattgccacagtaatacattatgcaggagttcaagaattgcatgatgaataaagatcagggctgccaataagcctacctgaaggaggttgtggatgtcctagctttagaggatgaaataggaataaatgaagtttatgcagcaaagagcaactttcattacaagaccaggccagaatcacagtctgtgtaaacacactagaaatgaaacaaaacagaaaaatgaacacaacatccctaggtctccacacctaatttttggtggagagaataatggtaatagggatgaagatgtggttagaggcgtagatctccatgtacatgttggtgatagtaggtatagaggaaggagtagaagtggaaacagctagatggtgagacacacttaaagtcagctctgggggaaatagtatttgctgtttcaaaaggaaatagatatcactttgataaatagaagttcttcctgtgaccatttgaggtgttcattaagtttttcttctctctcttcaagtccatccttcctcacccagtatagacatgtataatattagctattccattagtcacgtatggatgtgagagttgggccataaagaagacagagcactgaagaactggtgtttttgaactgtggagaagactcttgagagttccttggatagcaaggagatcaaacaagtcaatcctaaaggaaatcaactatgaatattcactggaaggactgatgctgaaactccaatactttggccatgtgatgcaaagagatgactcattgaaaaagaccctgatgctgggaatactgagggcaggaggagaaggtagcaacagaggatgagatggtcagatggtcactgacttaatggacatgagtttaagcaaattctgggagatagcaaaggacagggaagcttggtgtgctgcagtccatggggtcccagagttggatatgacttagtaactgaacaacaatacttaggttggccgaaaatgtcattcaggtcttctgtagcatcttacagaaaaccccaataaacattttaacccacccaatagaagcataggggagatgaggcaagcttacatcctccatgtacaactaaggtccaaagaagtccaggttttccagggctcttctttttcctataactgagctttggtgggatgctgagttgtcagctaccaatgctcctgttgccttctggatacacacttagcctcaattcaagctgatatgggaaacaccctctctccagccagaacgagggcttccctggtggctcagatggtaaagaagctgcctgcaatgcaggagacccagcttcaatccctgggtcagaaagatcccctgaagaagggaatggctacccactccagtattcttgcctggagaattccatggacagaggagcctggtgggctgcagtccacggggtcacaaagagtcagatatgacccaatgactaacacttttactttccagccagaatgaattctcagaagatgttgcagttataaggctacagaagacctaaaaagtctggccatttgttacttatacagagaataattatatccttttagagttttttagggtctcttagtttcttacttttggtccctgtttgctttctcttgaggatctcagtgcttctttgcccagtgtagcggaacgaatagagaactgtgctagttatgttggcatgcactgtccctttcaatttatttcaattgtctcaataatctgtagagtagatattcttatcccaattatacaaataaggaaactgaaatgctagtgtaaaagctcaggtcacacacccaggaagaactagactggcaatttgaagcttagtgtaactgatcataaagttcagtgatctttctgaaaaataatgcctcttctcagagaatagagttctggggtggggtcaggtcttggggagtactgaggaataatgtatgctgagattaggaaagagtgctgataaatgcaactatatttaaaaagccaaaagggagggatcatcagggctattgactacagccaattatttgtatttctgtgtctttcatttcaattatctacaatttctgggccccaggatcatgcacaattgagttttattagatagtgagttttattgactagaagtagacaatatggattttatgagatagaaatagcattgtaccagaccccttgctgggcgtattttattaacagctagctttctgaagaagagagtgccatataaaagaacccattgttgtgttgtttccaaactaatatttattagtagattgcatagtttctgtctggaactcaagttcattaatgtaaatgtcagtcaaggcttactgatattttttgtagttgttcttttccataggctaattagtctgggaaatatttcttaattatctcacccttctttccctttaatggagacagtcaccctgtccttggagttttttttttcccttttactccaggaacagaa

SEQ ID NO: 52629 - DNA, 871 bp, Bovine  19866881402005
ctgacgtttggaaagacactcaactgtccaagcgtgttcaattgtgtctgctctgagcacaggaaaagggggaaaatgctgattggtgtgtttctatagctctaaccatcccaaaagttagcagagctcgaaggagccagcccctctggattttctgcccttcttcccgaatcggaaagttcgggggagaagggaagattttcttgcctcagcctcccgccagctccgcgttctctacctgcctgatcttagcagagcttctcccgggaagggtccccgattctggctgtaggaatgggggctgatcttccagacacagagatgctcccagccactgcactcggtgacagcggttcctttctgaatgcggctgcctcgctccgatttgcagtatgccctgtgcctccttatccatggctttcagctctcccctaggcagaaggctctagttgggataccttgcaaccaatggtcatctgtttaatagggttgggagttttggcctaaaagtcatgggccgatgtagtcaaacgacaagatcaatggctgcccctgttataggagaaagagctttgatgcacactccacccccaaaatctttgtgccaaagaacacataatgagtatgcactaagtgtacactgccatccaagctctaacctcggcaagtgcggggcatttaatttaataggcaggaaagctggacacctggggatccgccacctgcactgtgtatttaaagaacccagttcgtcaaacttgaataaattgctggagccatcataggtgcaagttcaattgctcaactgcttctctaggcagagaaagggaagttcccccacctctggaaactcctaaatgaaggaagaatg

SEQ ID NO: 52630 - DNA, 2436 bp, Bovine  19866881552797
tccattttataggtagtgaaactgaggcacttaaatttctaaattatgaactcaactgggttgaaactaagtcacattatcttctgactttaagcccacatggagagacttacttgacaaaggatacctcaagatcactttatctccttaaactacaaatttaaattacttggataaactttaatacattttagcacaatttcttctggaagaagaaaagagatataaaaatatatttgaagaaatgaaaacatatagatgatttatattttatgtatatatatgttatgtatatatatgtttatatgataggaatatgactagagatctcttcaagaaaattagagaaaccaagggaacatttcatgcaaagatgggcccaataaaaggcagaaatggtatggacctaacagaagcagaagatattaagaagtggtagcaagaatacacagaactatacaaaaaagatctgcatgacccagataatcacaatgatctgatcacgcacctagagccagacattctggaatgcgaagtcaagtgggtcttaggaagcatcactatgaacaaagtggaggtgatggaattccagttgagctatttcaaatcctaaaagatgatgctgtgaaagtgctgtagtcaatatgcaagtgaatttggaaaactcagcagtggccaaagggctggaaaagttcagttttcattccaataccaaagaaaggcaatgccaaagaatgttcaaactatggcacaattgcactcatctcacacactactaaagtaatgctcaaaattctccaagccaggcttcaacagtacatgaactgtgaacttccagatgttcaagctggatttagaaaagacagaggaaccagagatcaaaatgccaacatctgttggatcatagaaaaagcaagagagttccagaaaaacatttacttctgctttattgactatgccaaagcctttgactgtgtggatcaccacaaactctggaaaattcttggagatgggaataacagaccacctgacctgcctcctgagaaatctgtatgcaggtcaggaagcaacagttagaaccggacatggaacaacagactgtttccaaacagggaaaagagtatgtcaaggttgtatattgtcaccctgcttatttaacttatatgtagagtacctcatgtgaaatgccagtctggatgaagcacaagctggaaacaagattgccaggagaaatatcaataatctcagatatgcagataacaccacccttatggcagaaagcaaagaaaaatgaaagagcctcttgatgaaagtgaaagatgagagtgaaaaagttgggttaaaactcaacattcggaaaactaagatcatggcatcattgcctcatcacatcatggcaactatatgggtaatcaatggcaacaatgacagactattttggggggctctaaactcactgcagatggtgagtgcagtgatgaaattataagatgcttgctcctggaagaaaagttatgaccaacttagacagcatattaaaaagcagagacaatactttggcgacaaaggtccatctaatcaaggctatggtttttccagtggtcatgtatggatggatgtgagagttggactataaagaaagctgagaactgaagaattgaagttttttaactgtggtattggaaagactcttgagagtcccttggactgcaaggagatccaaccagtccatcctaaaggaaaacagttctgaatattcattggaaggactgatgctgaagcccaaactccaattctttggccacctgatgggaagaactgactcatttgaaaagaccctgatgctgggaaggattgaaggagggaggagaaagggatgacagaggatgagatggttggatggcatcaccgactcaatggacatgagtttgagtaaactctgggagtttgtgatgtacagggatgcctggtgtgctgcagtccatggggtcgcagactcggacacagctgagcgactgaactgaactgaactgaactgaaccagtataaaaggaaagtagaaacattatagattcacaaaagggtttgaatcaaagacaatgaagttctttgactttatgtcatggaaggttttgttatagttccaacgatttgaaagcatttgttttctaaaatatgttaactatgttggaatatgtattttcatcctctccgttgtgggatgggcaggcagacttctaagaaacagtttcctctcagtcctgttttcctctattaatgtgacccaaataaaaactcagtggaaaccaggacaacatcatagcaagctcattatcagctgtgtggaggtgggggatttgctgtcattactatgggaaggatagatgctaaaattctgtcttttctaaagaggaattatacagcaaatgtgaacaa

SEQ ID NO: 52631 - DNA, 903 bp, Bovine  19866881818754
gaagtgggagatggtagagctaaaagattgtcagcaatacgagacagaagggcaaactgcaatttcactcactcctgaagttgatggcacaggttctggttccttcttgaaatcagaggcacatttgcaactggaaggtttgtatgcagagggctcactatacataaaatgcatatctgtgtatcttcacttcatgcagctgtaaggcactgattggcctgattctagttgacctctctcaactcaactctccttcctggctgtgcaggtagccttgcatttaatgttctaattgtcctgaattcttgacagttccctgctcactttgctttctcattctttggtaccttctttttgtttatgcattttcctctacttaacccagcatcaatctcgtgctcagttccagttatcctttagaatgacttcagatgtcctccagaaaaccttacttgactctccctccccgagtctgggctagatttccctgctctgtaggtccatattctcctcttcatttcttgaccgctgaaccaatgccactattctaaaaccatctgtttgttctcattttttattcatcggcaaatgcccaataaatgtttgagaattgaccataactgaggtagctctcatggccctgttgagaggcactcaagaatggtcctgcatactaataagcaaaaaaccaaaatccattgtgcaaatgtagttgtgaggcaaagcaaaaccgaaagtcatcagattcacccatcagttgaacaagaaacatataattaaggcagtctctggatatagtcccaatggcccagatggtaaagaatctgcctgcagtgctggagactggatttttatccctgggtttggaagatcccctgaagaagggaatggctactcactcca

SEQ ID NO: 52632 - DNA, 750 bp, Bovine  19866881992693
aatggaagtaagaatttcttgagaagggagcaggaagtatccgcctgaaattttctaaagtgtattactgaactctattatttaaagaagcgcctatctttactccacgttcatagtgaatgtgaaaattgaggtaactttaaagaagaaaggagagaggaagagagggagagggggagacagctagcagaatttcttatccagaataatctataaattgcttcattctgttttatttgggtttctcataactggctttaccaagagaaaacttctgcaagaagcaaaaattaacaattccaacagagcagtgaaactttaagaagtatagctaatggagaagccatacaaaaataatgagctatgagtttcaatcattataagactaatgccacatccttatgacagaaacactaatcaagtttagaacatccggtttgtttctgatttttttcttaagtaaccaaattagtcacccatacaatattaaatctcctgttcattatccataaaatgttttgctttatttggggagagaagttcctgaaattaaacagagaatgacacataaagttataactagttttccagtaaatgaatgtcttcgagtagcatattttttccttccttaagcacagttggcctcatacacatcataattcctgcagcaaattcaattttgatactcaaaacagaaacattcttacaagttttattggcctatattatctagtgcaattttctatcttc

SEQ ID NO: 52633 - DNA, 1006 bp, Bovine  19866880410653
atggaggagcctggtgggctgcagtccatggggtcgctaagagttggacacgactgagcaacttcactttcacttttcactttcatgcattggagaaggaaatggcaacccactccagtgttcttgcctggagaatcccagggatgggggagcctggtgagctgccgtctatggggtcgcacagagtcggacacgactggagcgacagcagcagcagcagcagcattcccatccattttagttcactgattcctaagatgctgatgttcaatcttgccatctcctgtttgaccacatccaacttacctcgatttatggatctaatattccaagttcctatgcaatattgttctttataacattgggctttacttctaccaccagacatatccacaactgagtgtcatttcagctttggcctagtaattagtaattgccctcctctatttccccagtagcatgttagacaccttccaacctgagggactcatattccggtgtcacattttttgccttttcttactgtctgtgtaattcgctaggcaagaatactgaaatgagttgctgtttcctcctccagtgggccatttttgtcaggactcttcactaagacccatcagtcttgggagtccctactcagcatggctcatagcttcattgtgttatgcaagcccctttgccaagaaaaaactgtgatacatgaagggaatgggggggattacttattagctaatcctgatagctaaaacacaattgcactagattctgagtatataaaatatattaagaaattcagcagatatttaattttgatacataatttgcccttatatctgatgaaagtgaaagtgaagtccttcagtcgtgtccgactctttgtgccccatggactgtagcccaccaagctcctctgtcaatgggattctccaggcaagaatactggactgggttgccatttccttctccaaaggcattatatctgatagaacagtccatttcaaatgtt

SEQ ID NO: 52634 - DNA, 3029 bp, Bovine  19866880567542
catggaaagctgcctgtattacttttgattcttctcttttgatttttaaatcctagagtcaaatcatactagagacagatgcttgctattagtagcaggcagctatttggttcgttcatttatatccaattgtcagtcatcttctggttataatggatcgggttttattctaattgaaataagtttgtctgtaacagaatagagaatatcctgatactgctgctgctgctgctaagtcacttcagtcgtgtccgactctgtgcgaccccatagacggcagcccaccaggctcccccgtccctgggattctccaggcaagaacactggagtgggatgccatttccttctccagtgcatgaaagtgaaaagtgaaaaggaagttgcttgtcgagtctgactcttagctaccctatggactgcagcctaccaggctcctccatccatgggattttccaggcaagagtactggagtggggggcattgccttctccaatcctgacaataccatatccttattagtgtttttattctagctgatgataccctgtttcccattatatgctgtactattattatattctgataacagatttgtttatcttgctccttatagcttactgtgaaacaattcagttaaattattaataattataatatttcaaacacaaaaagattagagaagataatctatatacttaaaatatattatatatatacatataatttcagagtaagcataaggacaaaaaatattaacagagaagaaatcatagccaggatttttgccctgcatatgatagctagagaatattgccctctgctgttaaaaatttgagactttccagtagaactgattgaactctagtagagtttttaagaattcttatctttaatattcagaaattcttctcataaatggttttattcagagtaggaaagtattaccaacaatgataaaaagtcagataatgtgtattttcgcatttttaaacttacagagatcatgctctatctctttatgtacgaggtttcattgtactctagtatacatttctaatcattttggtgaagtacaacaaaggttaatattatttcaaaatcctattagtgtgttgaaccaaactcaaatatattccaaaaaagctttagtgttggcctttttaagaagaatcttagcaagctatgagtcaagtgggtaaaagaccttaagctgaatatgtgtagcatccaagttgttaagttttctctcttccattttactaaagaactatgtaattgcttgatgttttgagatatgatattgccaaacatttatacgcaaaattactgagaaatcagaaaatgatagctgaacacgtgggaacaaatctttctgcttctgtgctgttactgaatttgaggttgttcaagcttgcttggtaatgtggcagtaggggaagtgaaaatgggatctcagttccaacagcaatttaccagaatgattacaaaagtctaaatgatggcacattagagttgacatgtttttgactacaatttaacacagaattgcaaagagtttgtcctgtattgactccaaacttgaataaaagcttccggaatagtcagagacaaacatctgctcatttagcaatcttcaggatcaatgtaaattcattggtcataccaagtatgtcatacatcaaatgtgaaaacatccataattatgttactttgcattacatacatctggatctataatgaattcatttcttaagaattagaagaaatagacaaggtttctttcccacctctatattttgtagatgcatttttaagcccatttatttcctatttttactacctaaaaaagggatatttccaaagatgtcgaggacactgatttgcctttaggaagattctatgtggtctgcttcacactataatagtaagaaatctttactgtcaagatacttcctgattgcattttaatctaagacatgtctgatgaattacatgtatgattcatttattttagttaaggaaacaaggtgaacagtgaatttgttaaggtcacagaaaataagcggtagtgacaggacttaaactcacgtttcttgtttcatagtgttctttattctgagagtttctccatagcttaaatgtaaaatttgctagaaagaaataaatactttctcgaccagagttttatttcaaaatttagctcccactagggcttttagggaggcctggcttgctgtaattcatggggttgcaaaggtcggacacaactgagtgactgaactgaactgagagcttttatctgaatatatatatatatttttagtttgggtctactttcagttctttatttcttcaatgttggtaaatatgagctgcattcactctagaaataaagtcaatatttgttataattttgcagtaatctatggaatacatattttatattatcagagttataaactacaatttgaaagaaattctattcccaacaaagcttacaatttcactgtggcaacagagcataatagagaaaaatggatatgataaccactaaaagagacttgcatatgaatatatgttaaaagaaaaagtagtgctttctatgtttgcttgatattaaaaaatcacttttgataatgatgcctttccttatacatatttaattgacaaaacatttttgtaaatggtttaaatttctgtttatgtgtggtgatgcttcaatcgctaagttgtgtccaaattttttgtgaccccatggactgtagccagccaggcttctctgtccatgggatttcccaggcaagaatactggagtgggttgccatttccttctccattgtatcatcccaacccagggatcaaacccatgtctcttgcattgcaggcagattctttaccactgagccatcagagaagtccttcataaataaaatttaactttttatttgttatgacaaaaagtaaatttttattacaattgcttttaaaagtaagattgatcaaaaacacttaattagaaattttcaagt

SEQ ID NO: 52635 - DNA, 1614 bp, Bovine  19866880804432
agcctcttgatgaaggtaaaagaggaccatgaaaaagctggcttaaaactcaacattcaaaaagctaagatcactgtatctgttcccatcatttcatggcacatagagatgggaagggaatggaaacagtgacagacttcttgggctccaaaatcactgaagatggtgactgtagccatgaaattcaaagatgcttgctctttgaaagaaagttatgacaaacctagacacatattaaaaagcagagacatcactttgccaacaaaggtctgtatagtcaaagctatgattttctcagttgtcctgtacggatgtgagagttggaccattaagaaggctgagcaccaaagaactgatgcttacaaattgtggtgctggagaagacttttgaaagtcccctgggcatcaaggatatcaaaccagtcaatcctaaaggaaatcaaccctgactattcattggaaggactgatgctgaagctgaagcttcaatactttggccacctgaggtgaagagctgactcatttgaaaagaccctgctactgggaaagattgagggcgtgagaataagggggtaacagaggatgagatagttgtatggcataaccaactccatggacataaatttgagcaaattctgggagacagtgaaggacagggaagcctggcatgctgcagtccatggggtcacaaagagtcagacaggactgagctactaagcaacagtaaagctaagccaaagtagctgacaaatttcttaaagagtccgtaggagcatttttgttttctggtcttggagaaataaattgcttgtattttttattttgacctcaatctctcttttttaagcaaaacctccattctggataacatctcaaagagcactgagcagtgagaccaagcaatgagaattcccattgctaatagttttgattgttcaccattgttatttttggaaaggacttatcttcagtcaaagtcaatattaatgtcaggagaacatggaaatgtccttttctaatgtatgtagtcatgtatgacaaagggaaggaccccaagttagacattgtctctgggacaattttaatgaatcactccactgatgaataccacattatgaagacacaaagcaaattcctgtaaggaaactggagtcaatattgatctcttcctgactgtcctcaatgtcacaccacgctgacatttgaaaggattgtacagcatagttttgaatgacagaggcaacccagccatgtcagggaatgccctgtgtaaattggaggtttttcataccacattctctgttaatatttgatttcaggcaatagtaagctggccattagttaggtttatgaaaagctgactgcacagtagtcttgagagcttgccttaacttattacttgtattgtcacaattcttctgccattgactgctttacaataagcctgaactatattttaaattcttctgatttcagacttatggtctaagaactaaacctaatgaattcttgcagcaagcacaatttccttttactatttggaatgcacattgaatcattcagggattctgccttctaaacaaaagagaaaatagagattgtaaatagggaaat

SEQ ID NO: 52636 - DNA, 1419 bp, Bovine  19866880978593
agcctctgtacttctctctggcacaggctttgtgtgtcctgggcacttagtgaatacttgtcaatgatgctattctgatctgtccatcacccttcagacaaatttcacttcccagcatctctctcacatccaagaaaatcattatgtttacaatttggtattataaaatgattgatccaaagcactttaccaattaaaacacaatttgatgcaggaaaaggacattaaagaatgagtttctgaggtaaaaccactctcaaattacctacacttagattatcaatggtgagaatctgactgaatatcaattgaacttttgctttttccagcagagagactaacataatttctaaaatacatttataatctgtcataacacagcactcaactttcttgagccatataaaatacctgctaatacacaatcccaaataaatgttatttttagaactgaaatttttgcaaggtttggaagcagattattttggtgttcagccacacagagtgataattaccatttataactaatgctattttcaaggcctttaaaagaagaagaaaatgtatcaacatagtctgctcttaatactcatcttcatctaaaatgcatataatattttcttcataccgttttctgtttcttaggcaagtagcctgaaatcacttggcccgcttgtagatatttaacaattaaaaagacctatttaaaataaaattatatcttcacttccaacttctttgtgactagagataaatttggaatgcaactaaagatggctccttaagactggcatatgtttatgcaagtttaggataatttttaaaatgattttagctaaataagcgacagaattttttacaaacttctattaatttatgaatcacgaaaataactctttagcttggtgcttaaagatggtttttatctttacaattccaatggaaaaatccaaataagttaagtctgaggaatttgcagtatcttaagagagtatcagaaagcacattgagtgagtaatcatttaatcattaacaaaacacaacagtattgttttgttgaaattgattgaattagttgttttaaactaacaggaagagaaatccagttgttatgaaatatgcaaacagtaaaactgagtaagcatatctttaacttttcattcacagtaaccagaatttatttatttactatatattacacaagccataggttaggatatagcaatggcacttcactccagtactcttgcctgggaaatcccatggacggaggagcctggtaggctacagtccatgaggtcactaagagtcggacacaactgagtgacttcactttcactttcatgcattggagaaggaaatggcaactcactccatgttcttacctggagaatcccagggacaaaggagccctggtgg

SEQ ID NO: 52637 - DNA, 1383 bp, Bovine  19866881938315
aatctgggagggaaaactgaatagtaaatctttctctttctattcaggaataaaactcaaggtttttcttgacctttttctagttttcctttttctttttctaagaatatattgaatatcagtgtggaggtcgatgggatttttctttacccataaactgagagattaggccattgtgattctagttccatgaagatcattttctactagactcctctatagcttctatcctatgggctgcagagctatgaaaatcaaagttaacgcttcttggaattgaagaatgcccacagggcaaatgcagcttcactgctctacttatatttctggattctaactttcacttagtatttgacctctgagaattgcttcttttctttctagttaaaggatgtattttaaaatagactgaagagtacatccaacatttttagttgttttaatcaggagggacattcaatatatcctatctcctaaactattagtgacataagtctaatgctctactatttgaatactaatttactttcaattataaatactactaaatcttggtgcacatctttaaatagacttataagaatagcacaataagtgaaatgattgggcaaatagcatgcatatatttaaggctcttgattttgtactgataaattgaccataaataagttttgccaattacacagagccagcaacacaggataagaaactaaataaaattattattccaccattttacttttgaaatacagaaaactaatatgatcttaatactggaaatcttattttgggaagttctttggtgtcttggtggttaggactccaggcttttactaccatggccagggttcagttcctggtcggggaactgagaccccacaagccatgcagtgtgaccaaatgtgtgtgtgtgtgtgtgtgggtgggggggctttcctggtagctcagcaggtaaaggatccaccagcaatgcaggagactctggtttgattcctgggtcaggaagatccctagaagaagacatatgctccccactccagtattcttgggcttccctggtggctcagatgttaaagaagctgcctgcaatgtgggaaacctgggttcaattcctgggttgggaagatcccctggaggatggcgtggaaacccacgacaatattcttgtctggaggatcaccatggacagaggagcctggcaggctacagtctatggagtcaaaaagagttggagatgactgagcgactaagcacaacacaatatatatatatatgggcttcccttgtggctcagctgtaaagaatccagctgcaatgcaggagacctgggtttgacccctgggtatacatatgtatatatacataatacataaatatgtatgt

SEQ ID NO: 52638 - DNA, 1756 bp, Bovine  19866880352371
cccagtaaagggatattcttcccctgctggtcttcttcttgtctcatgccttctagtttctggtcaagtcctatattcagaactatttttaagactccaggctagatcctctacctgactttgagactgtaccttttatgaggtcatctctgtctttcttccggaaagtgcttcttggaggagccagaaggtcatgttgtttggtagacgatggtgaggtaatgctatagatccagaatgctcttgtgttgcttccccgttctctgctgtgaagtattcagctggcttggtttcatttctattttcctggcctgattcagctcttctgaagcaagcataaaaattgctatttctttcttagaccatcactcagcttatgcttgccttttatcccttttttcttcttaagtgctagaaaattttgcttcaaatatgaagtcaatataacatgacctgtatgcataaaagctgtaattaaatcactaatttaatatttattgagtgctgacagtgctcttgggttagtatgaagtataggaaaacagacaaaatctgtttgaggtcacagcgagtgagttttcttccatgttacctttggaaggctcatcagagagaaactcagcagtgaaacaagttttgaaacattaaagttggatgctggatctttaatatggattttattatcactgacccaccaggtggatagtttacagagctgagtgcatgctagtcacaaactatcatgagcaaacctctgtgccagctgataagaggatcagttcagttcagttccgttgctcagtcatgttagactctgcgaccccatgaattgcagcacgccaggcctccctgtccatcaccaactcccagagttcactcaaactcacgtccatcgagttggtgatgccatccagccatctcatcctctgttgtccccttctcctcctgcccccagataggaggatacagagatgtaaaagttgtaagcctaaggagaggttgcaaatgtgggcctgcaggctagagtcagctgacagatatttttattctggtctgcagtattgtttcttttttctttttttgatgagctaatattttaaatcttggagctttacatttaaaaaatatggatctcttatttttcctgacatattgtaaggcccatattcccacgccggagaaaatggcaggagctgaggatactgccctctttcggtaaaatattcattcaccaattcttcacactctgctacaagcttcccttgtcagcacagagcaggaaatgtaattgcacattggagacaccatgacttctgttggggttgtgaggtagagatcaatagaaatgcaaagacaggatgaattaagaaacatttgagccaaatattgaataaaaatcaaaatttaaaaagattgagatggaagaacgcattctcggtggacggactgatggaaggcagggcccagcagctagcaagtatggacagtgcagatagagatgcagaatctaaatggtgctgctttagcgaagaagagaatgatgagaatgtgtttctgatcttctggacttcctgactggcaatatgagtccagaaagtaccttgcttgaagcaaaggagaacctgagatgggcagaagagatgcttttaagaatcctttcaggaatgaaagagaaaagatgtccatttctgctactaaagaatttttttttcctgaactttaaaaataatgccagttcattgttaaaaagtctgta

SEQ ID NO: 52639 - DNA, 1533 bp, Bovine  19866880408595
ctcctggaacatttatgtctctcaattgcttttactttctctctgctctgaggcttagatttagaatgtagactgggtttcagtgacagatggcagaggataatctttcatttcgtcataaagttacccggagaggggcttgaaaaaaaagacctttctcttggaaaagtggtggcttcatatttccttgcttttgatgaagtagaaaatgcatctcttttctgattttcaagatagagaacatgcctttccttttaagctaacccaccctgcaaaattctaagttgaggctgccttctccaccctgttttatttatgctttctgtgagtgccttgcacattttaattaatgatgatttgactgcactagagccctaaaaataaataagaaaatggggctattaaagataatccaataaacaaacccaagaaaagctatcttccactgttatttgttgatatttttacaggggacagaagatcaaataaaatgcagtgctgaaattaattttcaaggttgataaacaaagacaaaacatgtgatttttaagatgtcttttaaatcttatactggctaagaaatcaatgggctataatcagatgaagcatttgttttattctttgagcaagtttagccaaagacggttgtgatttaatgaacaaagaatatgcgtactaggtgttagaacaaggctaagagaatgtcactgagaaccagtagcttctgactttaatcactagaagacaaagaagccccaaaacacattatatactggacaagatcctgggtattttatgattacctaataaaaatgagagttaagatggttccaaatatgaaaggaggcagatggttagttcagattgaagggaatgttgaagaataaaaatcttaacctgggctgatgcctggacatccaagtcacaacatgttcaggtaaaactcttcacatttgggcttcagggaaaagtaaaagggcacaagatcatatgaagaagaatgggcctctatgtggctttgaataatagtgatgcatattctccttcaggtagcttcacatgatggtaatgattggagaatacatgtatgatatatgaagggaaacctggatttcattagactccagatcagggacaaactattattgcatacgttaacaatctctcctaaactgccctcctgcattgaaagtctaactccagagaagctgatgagcaagaataacctctgtcaactgaaaaaaaaaaaaaatacataagctaaaagttgagaattatgttttatttcggatccttactgaggactatagcccagagaatcagccttccatacctctaagccactgttctaaagaggtaagggaagagccaggatatatgggagttttagatgggaaaaaagctgtagtcaaataaaaaaatatccctgctatcaataattatgggcttcccagatggctcagtggtaaagaatctgcctgccaatgctggagatgcaggtttgatcctgggtcagggaagatcccctagaga

SEQ ID NO: 52640 - DNA, 1570 bp, Bovine  19866880475137
cagctgtggatctgttgtgctcttatcacagatgatgacttgaacttggtcccaaggacagtaccatggccatcgtctagaggcagtgaccaacatgcaatgttcgggacatggtaaaggttgaaactcttacactgatagggaaaaatagaagccagaagcaaagatttttttccccagagtcaatgagaaacccttgaggaatttatgcatggatgaactctggtatatagaaagtgaaatctgaaagcagatgacatgtgtctccattctattttgcttctacttctcaagctgttgactcctctgtctaaactctgcattcttgcccctcaaggcatgggtcttatttcttctgataatactgcaacctgaatccagggcctttcctaaatcctaaagagcccttcaggtatatcactgttttcaaataggtttgctaggtgtaatatcttgagattagttgattgggaagaagataaggaaagaatggtgacaggacaagaagacatgactgctgccatgaactgacagtgtcgagagtagtattatccttgagttttgctgagttttcatcctccaataagtagtcttttcatgtagcaaaataattaacctctttatatcttacatgacagaaattaaaatcttgataagagctagacaactaaagaccagaaaaatcttttccagttagaccatattctttttaagatatgtgttcagataaaaattctgaaggcttttaatctcttcactccctgacctatttaatatcaccctctcttactttaataatattaacaaagagagtagccctgccagtcacaggttctggagtcagaactcattatatattagcaatatcatcttgagtaaattacccttttatttctgctattctatcatcaactgtaaaagtggctagcagtaatatagggttgcattgtgcactaaattttttttaattagtattaaaaattatcaccacaaaagttagctttttttgttatattattagctaaaaagaaacaacacaatttgtgattcaactttaatcctttaaaattcagttttttaggtactgattaatgctaattcaatgattgttaatgcaatgacttggcaatgtattgttactaaagtcctgtattaaaaatttttttttagtttccttttgtcacttaagaaaaatgttttatataaataaaggatttctccactttttaaacctatgaccactcacttcatacgcagtctgttcatacagtaaatatagatactatttaaattgaaaaacaagcaaggaaaataatatgaaaagaaactccacacccagaagaacaggctcatcattattaggtgactattgagtaccctttatgtaccaatatttccccagatgccctggaaaccatattttcatgacatgactatttgaaggtggaataggggttaggcactcagaatggtgagaaacaaagaaacctggcataaaatgcaaatagtgttacaaaactcaccttatctccttcttccacctcacagagtttctcctcagttgcaggat

SEQ ID NO: 52641 - DNA, 925 bp, Bovine  19866880546116
ccctcctcctctctttataataccattgaaaggctgtatgtagcccattgttagctccattctactcataaattaaatccttaaaacctcttggctcattatctaaagagtcagttccagaatattaggtttactgtgaccctgtaatttactagatttgtaccttcactaagcaacgttagaagttaccatacatttgtcggcaaacttgtgagaacagcaataattatttaaaaacaaaagctggtagattatttcagaaaagaatatgatgacaagagcactggatcttaagcaaacagttgcttgctatggacagtttataccgtaaacaatctaacttgagagataagtattcagccaactccattagcacagtgacctgatttgaagctttgttggacgttaatgaatgtttttaatctacatttgcacagacagttcttctcttggacaagcagcagtaaccgtcaataagcagagagcaaatggataataggtatttctaaagcttcaggtgtgatcatcagctttccctcactccactttagaagagggtaaatctcaccaacgatgccaagtcctcagatgacctgacaagatttcacctggaattccaggcacagatttgttttactgaggaagctcattccagaagctaggggcaaagtgagaggtccaaggccccagagctaaagaattaagaaatgttttttctttcgctaacgcaaactgcaaacggttctgcggtatccctcctgagaggccgggacacctctggagagaaagagtacgcaaccatcaggggctcaactctgccctcagcttgcctgttattgcttttcccatctcttcagggttgtcagagccactcaagtaactaggatatttgaggtcatgtaatgcctggagaatcccagggacg

SEQ ID NO: 52642 - DNA, 783 bp, Bovine  19866880569114
atgttggcagctgaacacctgaaaattgtgatctcaaggtatcacacttttagatccatttgcattaataaaaaatttttttttcaagctcaactccttaaaaaacttcttagccaccaagcactgtcttcaatcaatatggaaatttatggcaaagtccttaaaatctgcttcctaaacattgtcccttgtcatgcacaaatagaatctaagctgggtttttttcttttaatcatctagcaagtccctctatttgcttttcactaagtctaatagttatgcaataattgaaaataattttaaagcagtccatctctaatgaacgaaagcacaatgacaataattaaagtttattaggtttgtaaagagcttaacagattatcttgtctaaaagcactttaaaaatgtttgtttcctgtaacatatggggcagggagaagcagctccccctatagccacatagcaagtccatagtgagtctagtcttttctttactttgtgcaaaggttctcatacaatcttacttgcaaaattttgtatcttttttctttcattttatctaaccacagggagaactgtctgggaattgaacgttcctttgccctgctgtatcctgagtgcttggtctgtacaaagtaggtaacatcttgatgacactttaaagaacaggtggtttttatctctcagtcctgtttcccttttataatcttaactttcagttgagttcctgtttttaaattttccattctcaggcaacattcacactttatgaaaatagccatg

SEQ ID NO: 52643 - DNA, 975 bp, Bovine  19866880782235
ctgttatatagatgaataatttctgaggacctaatgtacagcataatgactacagttaataatattgtgtactttaaagttgctaaaagagttgatcttaaatgctctcaccacaaaaaagaaacggccattatatgatgtgatggaagtgttagctaacactgcaatagtcattttgtagtatattcatgtatcaaatgaatgtcatataacttaaatttacacaatgttatatgttaattctattttaataaagctagaaaaaatggggggatgtttctattcttaggtacagtaatttgaggtcactgcttttgtgtggagaaatatttagatcagatttaacaatagttttcatcagactatatatatggtgagaaaattaattaaaataccatctaattattatttgttacccttaattaaatgttaattgagcacaaagtaaaataagatagaaaaggataactctttttctttgctaaaaactcttaaagggtttcaaaatcccaaaattatgtacagggcttacaaatcatttttaaatggcttaaaatttttaatatggtttgaaacagtatttttcaaatgacaaatcaaataataagtcaaattaattgtccaactgaaatgtaaatgatatcaatttagtgggtttaaaatgagcatttttactactgagtccaagctcatatagcctcacaataggccaataaattgggaaatgaggtgttggggcaaggaacagaggcttattcagaaagtcagcagactgaaaagatgatggattagtgtcccaaagaaccatcaaaactgagttagaattcatgcttcttttatgctaaaaggggaggggatgtggctggttgtagcaaactacttgttggccagaccccctgggactaattgaatcctttgttctcacagctgtccacttaggtccagtcatgatgttcctctaaacttttaacaaga

SEQ ID NO: 52644 - DNA, 1350 bp, Bovine  19866880826885
ttggtcatgactttccttccaaggagtaagcgtcttttaatttcatggctgcaatcaccctctgcagtgattttggagctcaaaaaaataaagtctgacactgtttccccatctatttgccatgaagtgataggaccagatgccatgatcttagttttgtaaatgttgagctttaggccaactttttcactctcctctttcactttcatcaagaggctttttagttcctcttcactttctgccataagggtggtgtcatctgcatatctgaggttattgatatttctcccggcaatcttgattccagcttgcgcttattccagcccggcgtttctcatgatgtactctgcatgtagtcaaatggaatatgttgatttttcaaagtgaacatggtagagcaaagtataaaggaaaggggaaaattccagaagccctgcatcctcaaacgggagtccccaattcggtctactctcctcagatcaattccagtgctgaaaagtggaaaactatctaccgaccaataggaactatgatgggttagttttctattctccgatgccttgctcattccgttcctttcgtatgccctggggcaccgctaaagtgtttctcagaatggtaggcttagaaaaaaactgcaggtgatgtggtttcaatgataaatatgaaaaatgacatgtcctattaactcattcttgactatacccagagcacatgagtatattttatacttcaagaaagttccctcattggaaatccttatttctatctcctgggagcacaagcaggaaacactgccctgtggcaaagtctgccacaccctctgcttgccccacagccaagatctggaactgaaagctgcactgtctaaatgcaaagttgttcagactccaaaacacttcttgtttgaaagaaaacttctcttggctttcagagtcaccgcctgcaaaaagggagggataagaacatcacctgtttgtcgattgcctttcgtcactggagagattaataagcagatatacatttaataacatgaacacacctgcacaggattctctaccccctcgtagagagatacacacacatacaacagatacgcactttcacaataagaactggggagagagaaatccttagtgttaaagaaaaaaatgacataaagttcttgagaaagaaaataaaagtacaagaagtgaagatgaaaacagcctgctggctgggtgtaggtccataatgcatttggcttgttttccagcaagctaatactcccctcccttgaaactccagcttgtaaatatatttatagccactcagacataatacgccagatactaaaaaaatccacttagt

SEQ ID NO: 52645 - DNA, 1119 bp, Bovine  19866880852437
ccgctccgaaattgacatgaatgacatcaaagcatgctatcagaagttgtatggcatctctctctgtcaagccatcctggtatgttgtaattctcataatgttacccccacaaaatgataatttttttgcaacttcttcataaaagaagggctgacttactgtatccataaattacatatataagattcatttgttatattaagatacagagaattttcttgtggtctagtggttaagactatatactttaactgcaagggacatgagtttgatccctggttgctgaactaagatcccacttgctgcacagtatgaccaaaaaataaaaatttttaaaaagatacataatttaaagtaaattgaactttcactggtaaaatctactagtgagttctatgtagaaagactgcagatttttcaatagtcatggaaacagtttaccatacatacatttagcaatcaaaatactttggtagagatatataatgatttatgttgcaataaatattgatcagaggattagaaactttttactctaaaattttccttaactttgtcatatgtagaagatatagaatgcatgttcaagttagaaagtaaaaaagaaagacaagtcaaggagttttgaacttaatgaaagatgactatttaaattcaatttgaaaataaataaataaataaataaattcagtttgacatttatattggataacaaaaatctaacatgaaaattgagactatcgtggacttgtaaccttcactctggtgtagcaagtcagaggtgatatgaaattatattttgctatatttattctgtgttatatttcattcttggaaaataatggctttaatgtagagtaatcgagagaagtttgcaatctgaattttgaaagctattgctttcatataatcaattaaaaataccagttatctgctatataaattttattaattaaataagtgatattcttatccaagatcctaaaaaattgatatactgtgatgtatgttaagcctaatacaataattagtctacaatttaaaaatattttctattgattgtggtctcaggtagcattaagtatacttattttatcaacaggataaaccaaaggaga

SEQ ID NO: 52646 - DNA, 1905 bp, Bovine  19866880869147
ataagaatgtctgggacttccctggtggtccagtggcaaagactctgaactcccaatgcaaggggcctgggtttgattcctggtcagggaactagatcccgaatgctgcaactaagaccctgtgcagccaagtaaatttaaaaaataaaaataaatattttaaaagtatgttgcttattgctcttggaagcttattatgctggcctgcaccagacgatgtctgcattactcattgctaaaaatgttgtgtagaacaaaactgcactaggattaatttatttacaagaagaaattaaaactctacgtttggttttcacatacagcagctctttggagtaacatgcatctgaattttaagttgcaaaggtatctgaatagttaatttttcatgtgcatattttgttgaatgttttggttcaagaaagaatgtttaaagcttttttaaagacttcagttcttaatgtaactgtacccttctgcatggaaaatcataaccaacatggctgcagtagacttcttagtggtatccagcaccacttgcagagggctgctttatattaattgtacttgggtgtaggactctagtgttcttgggtgtattgcatgggctgcattatctacagcattgtacaataacaactagaagaggcagtatacttcactgatgcttgtctggtaatatcacttctgtgttataatggaaggttttttgtgatgtatgaaacttgtgttttttatatataaatgagtatagttagattagtgtcgtggtaatgcctgttttcatctgtaaatagttttaagtatgtacacgaggcactacttctgatttattgcagtgttcagtcttagtttttacttttattcttaaagcattcagttttgctttcaattttatgtaccttagttctaaagttagatctgcagatgtgtacagatagtacatatttatgtattgcacataatcatgctattcagcattgatgctatattgtattatgtaaataataaaagccatgtacagagggagactttccacttgtttattgggtttttaagccatagttagatatcctaaagggggataattagggaaatgtttgatattgaactttagtcgtatttatagactttgcatggctatattataaattttttttcatttccatccctaaacattcacatgagaaccatgagatgagtgtcaaacatctcttatggtacataataggcagtttaatcttgaagacatgaataggcacttttaggatcaaaacagtgttagaatttaggtcagttattccatctatctcccttttctttctttttttttttttttttgctttataaatggcactttaggcattacaattggtttatagcaactggcatagttttatttggggtttgattctaatgttgagatggtcccatgggcttggtctttgcaggtgtcatgtgagataacaaagaacaagagctaacagtggcatgttgacttggccaatgcaataatagctgaagccaaaaagcagaaccattacatctcagtgatggagttggaaatggaaatattcagtacttactatgatgattcgctgccacctgtcacagttctctgctgctacttttgcttcaggtgaggggatatgtatactattgaagtatgagacaaggatagtgtctcgaattatgaaggatactgaatcatagttgagctaaaaattgtggtgttcgaaggcaaacaatttttattcaaagtttaagactttgttttccttcagtgctacctctgtaaacatttgcttggtaagtttttaaatcttcaggttttgaaatccaagaggggtatattggggacaaagaagacttagatggaaagatgacggacccttaggcttcact

SEQ ID NO: 52647 - DNA, 1385 bp, Bovine  19866880904034
taatcctacatagtggtgctatcataatcccagttttactgatgaggaaactttcagcccaatcgagcaaattacttaagatcacattttcagcaggtaacagaagcaggattcacatccagtgcaaatcctatttaatatgcaaatctggtttgatggaaattatatgctccatgtagcgagggcttgatgtttccagcaaactgataaagactgcattcttttctctttttttggtttccttggctataccacatggcttgccagatcttagttcccctactgagggtccaacctgggccccagcagcaaaagcacctagtcctaaccattggaccaacagggaattcccaagactgcattcttatacactcagctagccatatgtacagtactctgtatagcttctccctctttatccaagacctcatctgactgatggcttagatgctaggcttttagggagggaaattattatcctgtgctcctaacagcaccttcacgatctctgtaaccagcaaaatggtgggatacactgtatagtctgtcccactggaaagcttattgtcagagagattgatacatctcttctccacctagtgattacgctggataaacctaaacatttttaaacctactgtaaaaagaaatacagtcagtgtaaactgaatgggtatttattttctgttagtacaaccctaagtatctcaagtgttctagtatcctaagaacttgtgattatattgactattgagtaatgagcaaacaagctcagttaacacagggtgctaataaagaaatactctttgtaagaaggcacttgtttaagttaaatgagtatgtaattcaagacttgatattatggggaaattattcaaaaggtcacaagttcaagcacgcactgaacaatggaaaatatgaaaagtgattgtatgttgaagcagtggggagaggtcatctgttgtatctatccaacccagtaaactattggtgagcaggacactgtcgcagtgttatcagctcttttagttataaacaaaaacttggaaatggagattttcttgtggaatcttctgatttttaaatgttagcagcaatgaattacttttaaaatattatgagagcaaaacgaagtttgttggaggactgaatatcatttgtaatcctccaggtctatgacctccggtgcagagaaaacaaatttttctcctaggaagagggtgacatctatagacaaagagacccagttcttcatgaagtcaggtgagtctctgatgtatggctaaggatggaggtaacacactctcagttgtggatgagcctgatgcagtgcttgtaacaaaaggggaaggaggagagagaaccaaatgtgggcaaccccctca

SEQ ID NO: 52648 - DNA, 1348 bp, Bovine  19866880910705
agtgataaattgtttctttgttttttaattatttaggttccagctttgagctttggaacttttgatgtcagatattagcaataaataaattgcaagcttggcttttttgtggcattgtggttattacatgcttagattaatttggtaaatatatcagtgtacagcacttacatggcatgaatatatgcttgcatatacatatatttttatcataaataaaagacatggcactttaaaagatcaacattaattggctaatgtagtccatagattgtaaagaaatgaagctttcattaactgtttacatttacgattcaattggtgcagagaggttttcatttctgacctagatacttcaagtggcttgcttctgggaaaaataatagatagttagacaccaacagcaaaaacccatgtcctacttagaatccctaaaatgttttattttcatatgcattgttttgaaattgtatcagtaggttaagaatatagttttctaggttaaatcagaatttaattgctagtttagaaatgtcctgatatacatgtaatgcgtttcacctcaaaatattttaggttctattgcaatcctaataaattggggaccccaaggtttcagtctctgaagagtatggagtttcagaaaaactgttcactaagcaacctcataggctgccgtccatggggtcgcacagagtcggacgcgactgaagcgacttagcagcagcagcagcaagcctttgaaaacaaactcagagaaacagagagcactttcagcatataagtgcatgaaagcatatacaactgttgcttttaaaaaccatcatgtattaactatcactgtcaatatttaataaataagagccatggtttttgagttatcgttgcatgcagctgcttattagccaaagtggaacacacacacacataaacacacacacactcagctaaacatttaaacaatgcgcctaagtattttatgggcttcgtaggtagctcagtgataaagaagcagccggagacacagattcgattcctgggtcaagaagatcctctggagaagaaaatggcaacccactccagttttcttgcctgggacagcccatggccagaggagcctggcaggctaaaattcatggggtcacaaagagttgtacacaacttagcaattgagcatgcacacacctaagtgttttataaaactcctgctgctgttgctaagtcgcttcagtcgtgtccaactctgtgcgaccccatagacggcagcccaccaggctcctctgtccctgagattctccaggcaagaacactggagtgggtcgccattgccttctccaatgcatgaaag

SEQ ID NO: 52649 - DNA, 1563 bp, Bovine  19866880938011
aatttcttcttgtaaataaattaatcctagtgcagttttgttctacacaacatttttagcaatgagtaatgcagacatcgtctggtgcaggccagcataataagcttcaaagacagctcaagaccctgttggcttgatgcattttactctttaaccagttaaacaatgtgtacctttcacagagtgtcttatttgacagtttttagaacaccaattaaccaggcttacatatggcaccgaacactggtttcatagaaaggtctgattctttttatagctttcttcctgcttccaaggaacatgtggaaattaacagggtgaagtttaactatggtagaagtagactgccagtccttttctggtgtaccatttctttaaaaaaatacaggcacataacactagccaaagattataccttgattacattcccaaaggcagatatgctgcaaacatgcagataggtatttcagttattttgtttggcacgaaggaactaaattttgtccttattatctgtgtatttcaatttgctgtgcagattttcatccaattttattcaggggagggcatatacattttgtagggctgtatctatccaattctgcctgtaacaaacacccaaacatcctaaaatatcaattataagacagacaaagtgtaaagtaaaactctggagaacatcaaaaggaaaatggccatgcatctgctctttaatgttttcctacggtatattaaaataaaaacaaattatcagtctcttcacaagtagtaatttatattctctgaattttttcagccacaacaactggattctcttttctgatttttgctgcagcttctgctttgtaatcatatggacagttgtgcttgtcagagtaacggtgaagtccacaaaacaaatttccacatctggcagtcaaaccctgtacatataaaaggaagcagagtcatttaggaacttatagcaattagaagaaacaaagtcaatatagaaaaggaaccagattttcatgattctctgtaacattaaaccaattgtcattttaaattgtcaaagtgttttcaacctcttttgacatggcgagaaatacaagtaactatcttccataaactctggtagatatcaaatacagtagaaaaatcacaaagctctggagtcagactgaactggatttaaattctagtcctgctgctgctgctaagtcgcttcagtcgtgtccgactctgtgcgaccccatagacagccgcccatcaggctccaccatccctgggattctccaggcaagggtactggaaaggggtagccatttccttctccaatgtatgaaagtgaagtcgctcagtcgtgcccgactcttagcgaccccatggactgcagcctaccaggctcctccgtccatgggactttccaggccagagtactggagtggggtgccattgccttcctactatacactgactaataatgtttccacacattgtagaaggaaatgtgttgtagaagacaaccacatacagttctgagatttaaaaggaaataattaaaaagtatctagaagattt

SEQ ID NO: 52650 - DNA, 2107 bp, Bovine  19866880981745
tcaatgtttgtaatgcaatatacttacagatgattatgcttgccttctcaaagtcaggcttagccacgtgatttattttggccagtaaattagagataaaaatgaagtgtctcactactggatgaaaactttaataatgctctgggtttttgttctcttctttctctactgctctgaccagtgatgctccagaaggatcctgttctgtcccgatctatgagtctataatgagagtaacttacaggagcagagtcctttactaactcacatttcacatggaataaacaagaaataaacttttccttttctaagtcactaagatttggggattgtatgtcattggtacacaacttagtctaccctaagatacagttttgcacataattcagggtgcaaacttgcgtaatttcacatacatgtgtatctatacgtaggcatgtgtcatttatctgtatgcacacatgtacactcatatacgtaagtgcatatataagtaaataaatttaagaatttaaaaataaatatcacacaggcatttcaaacaaatgactcaagaacattaatctagaaagagagatgccagcacagtgatatctgaatcttaaagctcattccatctttgcctgctactcactaatcagctcagctcactaagtcccttactcagacctgatcccatcatctgtcagttgaagatcactctaataccttagccttataaaatgcttttcttccaagaagatcaaagcaaatgaaagcttcttttatttagctctccttattattctagtgacatggtacagtgtcagataaattactcacatttgatcaagtgagaaaacaagatagcaaactgtgacaagactggcaggaagatacaggagacggtgttggaacaatgtccaaacccatcttctttttcactgtgtgttctctgcatactactatatcctgctctgatagagacatgatcttattccatcatttaaaaatatgattacaaaatctgtgctgtctgttttaaaaatatgtgtgtaatatagttttactgatcagttcatttcagtcgctcagttctgtccaattcattgcgaccccatggactgcagcatgccaggcttccctgtctatcaccaactcccgaagcttgctcaaactcatgtccgtcgaatcagtgataccatccaaccatttcatcctatatcgtcccattctcctgccttcaatcttgcccagaatcagggtcttttctaatgagtcagttcttcgcatcaggtggccaaaatattggagtttcagcttcagcatcagacctccagtgaatatgaaggactaaattcctttatgattgactggtttgatctccttgaagtccaaaggactctcaagagtcttctccaacaccacagttcaaaagcatcaattctttggcactcagctttctttatagtccaattctcacatccatacatgactactagaaaaaccatagcttggactagacagacccttgttggcaaagtaatgtctctgctttttaatatgctgtctaggttgctcatagcttttcttccaaggagctgatactgatcatattagctaattcgtaacaaaatggattttacctatgatggacaattttttatatctgtgtaaatagcttacactactcagaaactcctaaagcagttattgaatgtctccagtcacaaaccagtaacattgaacacaaaatctccataatatttcaattgtttctgtagaaaatggccaaattcgggtatcagatccttatgcctcataaaatagtgtgagtacaagggggcctactaaacttggactacacactccccacaccatatccctaccccctcaccaatgttctgggaaggaggaaaagaccgtttgtacaaagggttgacccaaaagtgaatgatacttttttgctttagaactctgggaagcatgtaaatgtcttatacactcaaaaaacagaatcactttctaaagtcctcttcaaactaaccagaagcaagattcatctgaagggtgaatatagataaagtgagagtataatggtactgcaaagattctgatgatgggtttg

SEQ ID NO: 52651 - DNA, 1022 bp, Bovine  19866881079957
ttggaacttagctttagcatcagtctttccatgactattcagagttgattttctttcgaattgactggtttgatctccttgcagttcaaaggactctcaagagtcttctccaactttataattcaagagtataaattctttggtattcagcctttatggtccaactctcacatccatacatgactactggaaaacccacagctttgactacatggttctttgtgggcaaagtgatgtctctgttctttaattcaattttgtgaaaccaagctaaaataaatgaagttcccccaatgcaaggactgaaattagaagatgaagatgtgaacaacagcatacatttaataactcagtgatttaaatcagtcactttaaaggaattcatggataatttaggtgataattatactactgttggaattgatgtttatgatacagaaagatggctaatatttacacagtaaggaaaatcttcattcaaccctgggctgcatttaccctattcttaaattgttcaaattctggatgagccaagttatcacatgccccccatcttagatgtttgactatatggaacaattgttttttcaagttttccccctttatgtcacatctacatttgtgagattacgtgacaaacacaaaaacaaatatcagtcttttccactaacctcgatggaaccacagtcacattgttcaggtggctccagaactccattgccgcaaatggattgtcttccttggggaaccacttttggaactgttcgattctgaagacattcaaatttaggctgtgaagttgtatgtttaaattcatctatgctgcaactgctaaaaaactttatgccatgggaacgtctaaaattaaattgtatttcttagttaaaaggaatgaaatcactatcaaagtaacactcttcaataacatgctgtgaattatttacttcttcattagagatagccaagaaaggagagtgctttatttttaattcaattagtaataaaagaataagctcatttct

SEQ ID NO: 52652 - DNA, 859 bp, Bovine  19866881085779
attacctcgtggtggataaatcttctgtctagatatattaatacaatttattggatgtacagaaaagtgaaataggtttactcacaggtgtaatcatgaacattgacactgatctatgatgtgcacctggtgtgatattcacagtcctctccttctgggatgacaaatcataagtttatcctataatttacaacaagtcaattactcccagtcctgtcagtaccattagctcagtgtatgataggctgcacacactgtacactgacaatcagccttctgagcacaagggatctgtgaaacatacctagtaaacggagttgatcttaagattctttcaggctataacaggcttccctcgtagttcagtcagtaaagaatctgcccgaactgcagaagacccggatttgatccctgggtcaggaagatcccctggagaaggaaatggcaacccactccagtgttcttgcctggagaatcccatggacacaggagcctggcagactacagtccatggggtcgcaaaagtcaggctcgacttagcaactaaaccatcaccaacctatagcctgcactctatccctttttcattaagtatttaactttttcacaagaaaatctatgtctatattctcaactaaggccaaagctgactatccatgtctcactactctcttcactataatgaactaaatagaaacaatctgtactgtctcccctcccagctcagtctttgttggtggaagagttgtaaccacctgctctgacttaaaaggaatgaaaatgtttttccttcagcactctgttctacagtaattctgcactttcacagcacatgttcaacaagacattagcacctcta

SEQ ID NO: 52653 - DNA, 913 bp, Bovine  19866881099017
aaacggaggacagattttaagggataaaggaaaggtgaggtaggagagacatgtatgaaaatagaagaacaccataagggatccacaaggtgacaaaaatatctcttatcttgggctgtaatggcatcagtgttctggttgtgatattgcattataattttgtgacatcttcctcttggggaaaaggtgtgatctctttctactattccttacaactaaacatgaatctacaattatttaaagatttaattgacaaaaattttaatgaatttacattcactttaagattttcctttgtctgttacatttttatgacaagttggaattcaaggtttacatgatcttgtcccaaactgcctgtccagctttacctcccaaacaagccgaaccttcactgttcaccttataaaacttggacttttccgttttacttctatttgtggccagaacacctttcctgcttcatcttgttcagatcctcctccatgccaaacgactgcagattttttttctgtatcaatcttgatatattttgtacattctatcttttatttctatgattttgtatacatttctcattttttctattagatgtaagcattgagagagcaggagctttcatttttatgagaagcaaataacctctgtaaatcactagaattgtgttttcacagaacaagacctgaatacctgttatttcttttgcattctttggctgcagtccatggggtctctaagagttggacacgactgggcaacttcactttcacttttcactttcatgcactggagaagaaaatggctacctactccagtgttcttgcctggagaatcccagggacaagggagcctggtgggctgccgtctatggggttgcacagagtcagacacgactgaagtgacttagcatcag

SEQ ID NO: 52654 - DNA, 750 bp, Bovine  19866881172024
gtagggatgggagagaggaaaagaatgagggatggcttatgaagcttatttatagactttatagattgggctcattgcagtatgaattaatatatgtcaataaatgattaccactgctctgataagttgaaggcatttgttaagtagcaactcatcttcctggaaaatttcctatacctcatacaggtgaatcatttacttccagaaaatagtacacttactatagactcaatttagtcctagtaattaaattcagttaaccaagtagggtagagattttacagtatcatgacaggagggagcatacaactctgaaaggattttgaaaatgttttaaacaccatatatgtgtgtttggttgctcagttctgactcttattgatcccatgaattgggatgatttcccagtaagaatactgaagtgggttgcttcagtatactgaagattccctcttccaggaaatcttccctaccagggactgaaactgcatctcctgtgtctcctgcactgcaggcaaatattttgccactaagtcatgaaggaagcccttaaataccatatccagtggtttttcatagtcttcatccccctaaactccagagcaccacttgacaggaataagtttccctttattattttcttctccatcaccttctgtgatgtgattcccaaagccctcctcttactgctccgaactggcttgtcagggagtcagcgtagcatcaactgaagtgctgaggttgtggggt

SEQ ID NO: 52655 - DNA, 1534 bp, Bovine  19866881208917
cctgaatcgcagcacgccaggcatacctaaataaatatttatttaggtgtggataaacacatactgtagatttatatgttttactatagacttttgtaaatacatataagcatgtatcttattgactagttacttgcatttttcacctaatggtgatctttcctctacgttattaactggtcttttataatttttaaatgactgtgtattattctacatatgaatttactataattagctattttttatttgttgtcagttaattgtacctaatggtttattattataataaacactgtgatcacatttatttatatccatgcagataaatatctccatagataaatcatagtggtatgcacaaattatttccttatgagaaatttctctaaattgaattgaccactcatagagaagatatttttgaaaaagtacattcacattttctacagctaacctctataaaatgtaaactctgcagactccagcattagactcagagatccataaaatgttaaggttaggtgaaattttgacaaaataaatcataatgcttttattttacccataaaaaaaatcaagagtctgtgaattgaagtgagttgcttaagttatttagtcagaggataaataatgacaatgaagtgttcttttcttttttgaaagttattatgtttagtataccgaattacatactgtttaaatctgagtaaattggatttaaagtgaccttatatatttttccagttgtaaattcacggccaaagtatcatcacaacaaacctaagaggatgaattgaggtaggaaaattactggctaggagcagactattagaccatgtaatgtaagttaatctttctgtaaggtttctctgagcatagcagatggttctcaatgtttctaaagagttcactggctcgtggaagtggaatgctttgctcacagaaagaattttaaccaccctgattcagcaaaatcaccctgaggcctcttgtaaactctggattttataatggctcgacactactctcactttaatttatgttgacaccatccttgccatttgtcaatgaagtaagtaaagagcatccaggaagacatggactgaatacatggcatgaggtaagagtatattcaatcaaattaaaacctcagtgttttgttttaaattacatttttaaggtgctgctgctgctaagtcgcttcaatcatgtccggctctgtgcgacccgatagatggcagcccaccaggctcccccatcatttttaaggtggtcctcactaaattccactttatgtaagtggaaaatatggaagatttccctgagatctgatgaaaggagtactagattacctataaataagaggcatatgattcacagaccatcagaggatattcctagttatattacactgtattatatttttctgtagtgcttactatgtgttagaacatctacaaaatacctatgttattctgtataatcatgccagcaaccctatgaagtagatattttcctcctttacagtaag

SEQ ID NO: 52656 - DNA, 1673 bp, Bovine  19866881215520
gtatagaaatcttgaagaagatagagaacagaagggtctgtgctgacatctgggttttattaataatactgttgctactgttattattctccactaggaagccaaatagaacacacacaacacacctcccaataacatccaaggcatgatagcccctatatctaggtcagggacttgtgagaggcctattatcaactctctacatgcctctaataagcactgacttttattcctactcagggtcatgtggtgaacaacttggaaaatgtagccatgtcctggagctgacatgtgggtagccaggatcacctcaggccaagttgctacgaacagctactatcgttcttcaatcttaagctaatagagggtgaacagcaggtgccctcaaggtggccattcctttcccagaaactgaaatctgtcagggagcactgagtgcacagagttgagtaaatctgagccaatctgcactattgtgaggcatgctgtccccgtggtgtcctgctgacctgcttggcaagagcacgagctagaactttggtcctaaacaaatgtaaaatgtgcttctttaaagagacagcattagaaagtttttgctaataaacttttctttttaggaatgccacatcttgtcatctgagaagtctcccacgtggcggttttgcgatagtggccacagcttctgaacagtagcagcaaagccctcagctggtggtatctcactttgtgaaattcaaatccacagatacataccagggacactagcgatcaatgtgccttctaccgtgtcacaacatgaagtgagggcacaaggacctttcggcacctacttcacacacttcttttcagagacctcagtgggtttttctttgttgctttttcctgctttttagatgtgcatttcttttgttagttgtgtattttcctcaacgtagagtgaaagtttttaatatttgaattccacaaaaggacctaatgataatacaactcaactactttaagctgccctaagctactgtgatcaacacacagtatgctgagtttccagagcgggcagtgcacacagctccttatcaggtgtgctttggtgtacatttacaccatgtgcctgtgactgtctttcgtcttggtagagtccttgctgcttgtgagaaggtgcactactactttcaataaagacagcctttattgttagggtcacttattgtgtaagcttggaagagtaacaaggtttgtgtctcacttttctctttcacacaattgctgctgctaagtcgcttcagtcgtgtccgactctgtgcgactccatagacggcagcccaccaggctcccccgtccctgggattctccaggcaagaacactggagtgggttgccatttccttctccaatgcatgaaagtgaaaagtgaaagtgaagtcgctcagtcgtatctgaccctcagcgactccatggactgcagcctaacaggctcctccgcccatgggattttccaggcaagagtactggagtgggatgccattgccttctctgttcacacaattaggttgttgtatgatcttctgtctagcaagctccctcatgaatcaccatggcatacaaagaagaatcagttagtgaaccatacctccagtaccaaacttcagtgtacccggcacatgaaagcaaaataat

SEQ ID NO: 52657 - DNA, 1658 bp, Bovine  19866881243634
ctaatcccatcaccataaaacccaagactgcgaagccatgtagcagagcagttctcctgggttcccttaccctactgctctccacccaggtgctttttcccaataaaatctcttgctttgtcagcacatgtgtctcctcagacaattcatttcctagtgttagacaagagcccagtttcaggccctggaaggggtccgccttcctgcaacagcatgacttgggtccagttctgtttagaagttagtgggagagataattggtactctgaggctatagctgcttaatgtgcagtaaggaaattcttatgcatccatgctggtttttcccttacaaaccagcatttttaagtcagagagtaagggtcaatttgagccaggctacatgcaaccaattccattattatcaatactcataattaaactggaaagaaaatttcagtaaaaatctttttaaataaattaaaaataataaaactaatttaactaataaaactaattttaaaaatggaaagaacactggaaatgtaacatctcaaaagcattatgcaactgggtagagtaaaaggtaagaagggttccttgggaaacttaagaagtgctggactggacttctctggtggtccagtggttaagacacggtgcttccactgcaggagccatggttagggaactaagatcccacatgccacaaggagcagctaaaaaaaaaagtcctagatttttctaccatttctggtgtgtaaatatagtactaggaagaagaaatatgaacacataagatattctagtcctggtttattgatataacaggttgacctctacaaaaatgctcattaggaatgtcataataataatcatggacataataattgtttacaattataattacaagttggacgaatgcaactttcaggcaaacaaagattttggagcagcatgatcctctccacaagctgatagaatacgtatttgtgtgtgttcaattgtttaaatggtttgggaaccttgttttcaaaaggcaatttcaagacctaaaactgttttactccattaaaaaaaatatatacgtttgagagactagctagagagttacccactaattcatgtagcaagtatttctctaagcatttactgagtgcctggtactgtgacaagcattggaacacagaaatggaaaaacaaacatggtttgatgactataccagttcacataaaaatattaattaatataacacattacctatggtggataaataacatactgtcaaaagtaattttctataaaaaacaaaaaaatgattttctgcctctggtttagcagaaggtgctaaaccacaaaaatttacaattctgtgtgcaaatgaaaattcacaatttcttcaatatgagtgtggaaatatacatatattttggcctttgagagagagaagtgtcatcataatttttaactactgtttattgagtactattattggacctgtgtttaatattaactctggatcttcaaaacaaccctgaaagtaggtattatttacattttatggatgatttatgttgagaatcccctcccaaataagcccatgatattttgaacaatttgcagttccagggcagcagctgcagctcatttaaaaagatgaaacaatagtgaccactta

SEQ ID NO: 52658 - DNA, 1247 bp, Bovine  19866881254743
taaatgatagtaatctttccttttgttagcaaaaagacatattacaagcttgaaaatattttaagccaatgaagcttgcatggaaattgaccaatatttgcaacttacttcagacaacagtactaatttagttaacaccatctctttaaatagtaagtggaatttagctgactcattttggagcagggtagtgtaaacatttcaacattacttacgaagtttattgataaacactttcagttgagtttttaatattttgagtataacgtgcaaaaaaaaaatgcattgtgcatttatttgcatgctcaccatgcaaaatatgtgaatctttgccctatgcaaaaaggacggccactcctggaagtcctcttaagaattatgctttagcttacctgctatatttttaacttttgctatcatttgacaagtggcttaaagagtaaactggcctaaaagtcaacttacattaatattaacctgattcttaaaatcttttgtttatataaatgtgggtggggatcttaaccaatgatttcacatgcaaagtattccaacttttttcaggaaacacatctaccttcaacttaccataaatagcctccaaactgagacacagaagataacaggacattagtcttatacatggcttctcatcttgtagacttttctccccctagaaaggcagcttttaaatgccatcacaagtgcacagcttgccttaatatttctcagaagcttagatcacatgggcgggcgcttcagcctgtcacaaggctgcaatgtgacaggctgagctggatggaggctctcacataaagcctagtcaacaggggcctctgaaatcagcttctatttatatctcagagcctgccaactcctacacaaccccaagaactaaagatgcagcacttgtatacctaatataataagcaaacacaacaaaaagatgccattaaggttgttagttttttctgaggtagggaaggagaacaatctcaaatcagaaaggcaagtatcaccaatcactcaaagacgaaacggtcagagttgtttgtaaaatccaagcacaacgaagagagcacaaaggtagaaacaaccctcctgtttagtggcaattttgaggtgggtgtggggaataagttgccatttccctatttgtattttagaaaaaaatacaataccgttattacttagcatctttaataaagttgttagaaactgagcattcattgtgtcagctctatcaa

SEQ ID NO: 52659 - DNA, 1257 bp, Bovine  19866881300720
aaaaatctgttaaactgtcctaaagttacaaagcctagataagtccaacgcagacacaatttcttcctaatttggaatagtttgctgttttctccggcttccttcatagctcagttggtgttttctcagttgaactctcaagaaactgttatgcatttaggagccataaaatatattcttaatttcataccttaaatattagcatcaccttaagtgtggtaagataccctcagacatgttgcactaagaccagctggagaaacagcaagttgtgcatttgtcatctcccttctgtcgggatcacacgttcactgaatgaaatggccagaggaaaggacaccaactacttaaataatttctttcattttttttttctagcaggtgtagttgaatttacatatattaaatatttaattatgatgggactccattatatcctaagttcatcctgattatattatcaagtaaaatgccacaattatttcctaattggggagttagcagaaaacaatcaaacattcctctgtatctttaagagctgcattattggtttgaggcaatcaaccatttagagcacactaccttattatacattctacagacatgacatgatttctcattttaccaaacctttctgtaaaatgcttttgctacaacttaagcatacgtgattagttcacaaaataaaagatgctatgcttagtcgctcagtcatgtccaactctttgtaacctcatggactgtagccccgccagactcctctatcagagttctccaggcaagaatactggaatgggttgccatgccctcctccagaggatcttcccaactcaggtatcaaacccaggtctcctgcattgcagacagactctttaccatctgaacaaccagggaagccccaaataaagataacaatagccagttgctataatgttaaatctcctgcattcataaaattaaaatgcaaagaaaactttcttctggttgtttaggatctactaatgaaacaaactatttcctctttttaagacccttgtaaccatttcaaataaacagataagaatttataggcatatgtgaaataacatggcacactttagataaatttggaaaaattttcatagaatagggttgtaaggtggttgagcaattctgaatattagttgtttggggttttgagggggttatgatttttcttagaaataccactttttctattgatcagagtatataagaatgtttttacattcttaacat

SEQ ID NO: 52660 - DNA, 577 bp, Bovine  19866881320414
tcccaaggcccttcatggcagcacggagctcttcggcatcaaactgggctggagttttcaatagagccaaaacaacttcctcaaggggaccgaggagggctttcttcagaacttcatccaggggctttcctttctcctgcagataggccgctttgatctgctgacgctgtgcattgtttctcttagtcagaatttcaatgatggttgcttcatccacacctttaactgtgattgctttgtgcaaggcctcaacatccgaggatggattgagcataggataggggctcactgctgacccaggaccacctttggatcctttcaccgttttaatgtattcctgctcttcattttcaataaaccaggcctgcttgaggaattcagatcccattgccatttttgaaggatctttttgtttttttcacctccgtacaaagaactaaagagagattcttctctgaacggtttgtgctgccagaatgtaatttttagctttaaaactccagggggtcagtatcttctattgttttcatgacatagtttaaaaagcaaccctaataatttctaaaatcttcttcct

SEQ ID NO: 52661 - DNA, 918 bp, Bovine  19866881325196
ataacagtaactttataaatatctctccagatcttattaagctctatatcaaggattttttgttttatttttgtttttgtcttgttttaatgaatcaatgagcatgcaattagcagcactaaaatctgaaagtaggggtggcattacatgggctgcagagttctgggccatatccctaagacatctaggtatatcccagtatattgctattgctttgactttagggcagaaatgagatttaggaagaccaagtccttaaagacacaaatgaatcttaaaatcaagaggttaagagtaataagaaaagtgaaatataaaatctcatcttgactaatcttaaccccaaagattttcaaaatggcagagtatcctctccctaccttcattgtgggaaaattatactcacaattaggtagaaatagcactgaaaatgtagattgctacacatagatgtaagaaagacctatctgaaattctgatcaacaaggaaatttatttctataattttttattctcctttttactcattttttctaagtattcattgagtgtgttttatgtttttagcagacttaagtggttcaaaaaactaaagaaacatggagattccttcctgaagcttaaaccctattaagaaaaaatgagatataggcccacagaactgttatacaacagtactagacagccttgaagtgaaaagggagaggttagtggaggcttgagagcttgttgaagacattgtagatgagataagaactaaacaagacattaaagggctgatagacttgagtaggcagagaaagacatttcaggcataaatttgcagaaatttcctcaacaaaggagacatttccaccatgaatatcaagtacaatctcatattcttagatacactaacatccagggatggcagacaga

SEQ ID NO: 52662 - DNA, 1056 bp, Bovine  19866881397479
gctccggccgactgacgcgttctctccgccccgcgatggaaagagggagggggcggggcctgtgcgtcagcgaaaaccccgacggcggcggcggcggcggggagcgccttgacgtcacgtgcccgacgccgcgcctctgtcttcagtcacccggccggggaggcggggccgagcctgaccgcgctgctgttgcgcggagcctatttactggcccggctgccggctccagggtggagctggaaagaaatagtcctgtggaggatgcgtttctatttttagctcgattgtccgccctcagcctttctccttccgattttctcagtcaagcccgcttttcgccctctaagttctcacgctttgtctagagtctttggcagacatttcccttccctcctcattctccctcctcacccacccatccagaacgagttagaaggatttgcttcgagaagagaaaatgaaccgctctttgcttctgggtcttctccccggtttatgaagctcccaagtccagttccctcacacccttttcgattctaaagtccaacctgagcattgccctgatgctaccgggaaggagcggggcaaggcggcgctcactcgcttcctcgctcgcccaaggtcacgggtggttgtgcagagtcaggaaaggctcgccggactggctgccagccctcggccttggcgtcacggttctgaacaaactgttttggccagcatgtaaaatccctggaaatcatctattccagcaaagcctcgtgaactgggaaagcaccaaatgttctactctagaaatgaagctaagggacaaacaagccagacctgagggagagatcaataaggagacgctgtaagaggaagttcaagagggtgcaattcagaaatgaggcacctgctccgactagtttgaaagggtgagttaactaaaaacactgagaaccttttcaaagcaccaacaaaaaaataccccgtttgcagctggcctctccaggtgacttgttcaactcaaaaaacaaacttagtaagacagaaaggacttatgaaatttcctggtaa

SEQ ID NO: 52663 - DNA, 1611 bp, Bovine  19866881400359
ctgcagtttcatcagttcccccaatgaaattctttcccatgctctaataaatcctcttccaagataaaatatgattacacagttgatcatgatgatctcgttgagggccatttgtttgcactgtcttacacagctgaaatttttcggatgagtgattattctgcttttttgtggggtttttgtgttgttttttaatgaacagagaacaacagattctgcctattgagctgatcctgcaagtcacaaacctctctgcacactaaaagaggggtcagcagctgttttcctgtcttgtttgcaacactgacttacaccttaaaatacaaaagagcacaattttaaaatatgcttaaccacagaataggtacacaaccatcactctgacccagtgatatgatcaaaggcttgcccttattttcaatccttttgcgtgggaaatgtaatagtctaacattagtacaggtattaaaaccacattttatcttttatatactctgcattctctagacatgaagcagaaaaaaaaaaatacaattcccagattaactttcccatttgattccagcaatcattgcttgcttcccaggagatcaatgaaacttacgctttaaggacaaccagaaaactgtatccaatgcacatgatccccacgagaaaataggagagtggcagtctgaaattcatccatccaattgttcgtttattgtcgtaatagccataaaagaggacggaatattgagccaagccctaaaatccaaaaacaaagccgtttaacagatgctgtgaagagcaactcaaagaaaaaagatcgacttctaagaagaataacaaaatgacattaattctcaaacttgggagatggctctgacatgagccctattgttttgtttcatggagtgactgtttcagctgccacatggactgacagcctcttggtttacttgaaattcagggacttctaaatagatcagatttttaaccaaatataggcttgctcagctgtggagccattaccgtgaaatgcccattgattgaaacatcaaaacacacttcatggtgtcattagatttacaattttaagagcttgcttaatattggggggaaatctgaaatgtgcttcctcaaagtttcatggcaggtttccactttcagtcacctaagccacagtcagatttgttctccataaggtacagaggccatgtctcagctcatacttagaaaaaacaaggagcagatgagatgacattggaaccaatatatacaaccttctattcatcaagattattatccccaaatgagcatgtttattcatacaactacatgctctttcccaaaaagtatctgccagggttggcatcactgtcttccaaagccaattaggtaactgctctctgtacatagaacatggcatattttggatgctgtttcccttataatattcttcctctttctctcctctcattcactgtgttcttcactcttagtttggaggcattggtttctgtattactatgcatctacttcccccttttctcttcaatttcatctctttggcaataatttaaaacttctatgctttgtgaagtgagaggataattgcagtaataatat

SEQ ID NO: 52664 - DNA, 1610 bp, Bovine  19866881424552
aaatagatagatctttccttacatacaaagtgacaactctcaacagctttatgttcagaaaagaacaagaaggctggatgtatttcttaagactataaggaaatattatgttttaactagaatatttttttacacttcaacagaagtggacatgttctttgtgatgcatgtgaataaatattgaatttatatggctaaatatggcattaggcattgatgaaaaacattttccagtaggaacaccaaaatacgaaaaagatttagttaattcataaatttgcaaagatgtagtttccttctatatgctggaactcaaattccacagtaactatttatattaaaataaaaatatgtaaaatagtatggttttctatacgctaactgttgtattactgattacaacctgcgttatacacaatacaatgtccgtgtaaaaactgtcaggtgtattaacagactatctgcaatgagatttgtcttgtaaaagctagtttcctttaaagagatgaggctgcatgcttttcttatttgtgcatcattctctgcatagaacactgctttatcactgcaattcatcgcctcttcatggagttactagaagattcagcatatttatagtagcatgaattacattgctgaaataaatcttacaatgcttccctactcagaggacttcatgaagaggaacataacaagacaattgctttctctgaaataaattccatgagcactctttttaattttcagtagaaggaagaacaatttgtgaacctagaaccaggttgtgtcatttaccagtaaaagtcatttgagttcataccaagtcaagtccagatacaaagttgtttatacaactgaatagattttgcaaactgaaaagattcagtaaaggataaaattttaatgattaattgctcccaatattttggacactttctcactgactggttttgggtggtatatccatataaaacaatgaagtgttgctgtatgatctttttagtatgtaattttaagacaatgtaaccatttttgaggaaaatgattttatgcaattgtctattataaaatttccatctttttcatcttatcaaaatatcatacacaaaaaaattaattcaagatgtttttagaaaccgaggtatacatattttcaataaatagaattatggaaaatgaaaatatttaatttctgaaatgtttatcaagtgttcacatatattacacatatatactttacaatggacataatgaaaacttccaaggtcagttaagcagaaacatataaaaagtcggaacggtatttggtcatttacttggagaggggaaggttattacattcaaatttgctttcctgtagagaacatctattcagaattttcatctcattacttgatagtgactacagttgtacagaataatagaatagaataaatcctcaagaatcttttctccatcaaaataataaagcttatctctaaaaagtggacattctctagaacatatactactactactactactaagtcacttcagttgtgtccgactctgtgaccccatagacggcagcccaccagcttcccgctgtccctggggattctccaggcaag

SEQ ID NO: 52665 - DNA, 2487 bp, Bovine  19866881681681
ctaagtgaaataagccagtcacagaagaaagcagtgaactctctccctcagttaaagaggtgcttgctctcccagtcatagtattctactttagattcaaattgcacgggggaagtctgtttaacttaatcacgagttctccctaggctaaccaaccatggccaggggtgttctattctgtttgtaaacagactttgaagataggattcatgtctatttcgttcttgaattttctgaagtacttgctctagtgccttgcacatagcacatatacaaatattggttgaatgaataacagaatgaaacaccaactcttcagggcttatcttgacctttgtctcttattttgtaattatagcatgtggttgtgttgtttctgtggtagatttaacctaagaattatgtggaaaagccttttttaaaaagttaaagttcaggttcagaaatatgctattattaaactaattttcagaggtttcctctttatagtaaaaaatgaactgagagtgttcagaaggaaccagactataatttaaacccagatatacatagtgcattaagtaaatcaacaaagaaatgaataaaattcatagtttatcagtttgggctcactaatatacttttattcaacctagtaaatattctcagttttcttgaattacagcaaaccacagcccacaggttaaagctggcccactgcttgttttgcaaataacatttcattggaacacaacaatgctcttctccttactgctttgtcatagctgctttggtgctacgatggcagagctgagtacttaacaacagcaatcctgtggccggcagcgctaaaatgtttactatctagctttttacagaaatatttgctgactcctgatttggactctacaagtctctttattggcaatgtacactaaccttaacaaaaaagctcaaaagcctaccccttaccctcttttctcactccaagaggagaggattgtgaactgaatcaaagacaggtgaagggcactcagattatagtggggctttgttgggaggtgaaaggagccaaattcttttcctattcatgatttatgctgtcctgtctcatagtgtctttggagatagattgcagaaacaaagtggaaccacggtgggtactgggaaagcatcctgcagttgttgagagcagatttaggtttacatttccagagagaaaagtcaaagcagggtgtatgaagctgacccagacaggcattggagcagggctgggaatagtgagcctaaactcagcgaaaccatcctgtcattctttagctctgttccattatgggaaatgttaaaatattacaaagcttccttctcacagtgaacagaaattctcttcactggtattgatccattcttctagaactttctttgtgttgtgggctgaactatcaccccacctccccaaattcacatgttgaagtcctaatcttcaggacctcagaacatggtatcttccttgaaaacagggtctttaaagaggtaattaaattaaaatgaggttattagagtgaccctaatccaatctgtctgatgtccttagaagaggaaactggaacacagacacacacagaggaaaggctataggaacacacaataccatccataagtccaggagagagccttcagttagccctgctaactccctgatcttgaacttttatccttggaaactgtgagaaattaaatttatatcatttaagccacctgatctgtggtactagcacatgaatatgccatgtatcggccttcatatatgagtagacagctatcatctcttctgttcatctgttaaatatctcttctctcacatagtttagtttactgactggataccatctccagtatatattatcttttaaatatatatttctccaaaggtttctatccattggttcaacagttctacctccaggaatcttccattttaaggaaatcattctacagtagtgcaacgctttatgcacaaagatttgcaccccagtgctgcattttattttcaacttagaaaaatggtctatatatctatactactttatttattttacaaacaaaaattaaccccaagtgcatgtctggtgaagttttcaaaaatatgaaaatttgtaagtaaaaatttcctcttgcactctccagagataactataaacttcacatatgattataaacaatatactcatacatatttttaaacagaaatggggagacttgtacataatattaaaattttttcccttatgatagcagggagatctccctacagttattgaattcctcattgttccttccatcactgctttcataactcctgcccagctttaaagattctggttgtcatcttcgtcttcttccctagtggtaagtgtcctttctctaggctctaaaccatagttaagaataatgggggaaaaaaaaaaaagaataatggctctagagtcaaactgcctgggtttgaac

SEQ ID NO: 52666 - DNA, 967 bp, Bovine  19866881691214
aatgagtgaatgaataaatgaatgaataaaccgtcctcagtgaacaatagggatattgtacagtaaattcctaccagtctcagacttaccacatttccccctgagtcttgcttggggcctttcggttaatataggaaacctttccaagaggaaaaaagatacggagcaaagtcacaggaaggaggaggcacaggccatggagggaatagataagagctgtgccccaagagatgagggctgcttctttaggctctttcctaactttcttagagaagatcctgttttccttaactacatcactcatacctctcaacatcaaagcacttttaaatgtagctattgtaaatttttctccttgaaatttttgatatttaatttcctgccttctcactatagcatttgttcagtctggcagctctgctcctcacgtaaccccagcctcctccacacaaatgaaacataactgcagggggatggagaggaacatggctcggaactgcaggccatgttcccacttctgcacagttatacagatcattcctcttcacagagaaagcaaatgtcactttctcacgagtgggatacattttcttcctagtggtcagtgctgataagctcacagacatctggtgccctcacctatagacaagagaagtttaaagagaagcagaaagctacacagattttttttagataaaacaaatgattgaaggtctattagattaatctcaaagtctataagctaaggcagcatcatggtgccaaaggtaatattcaggtctgctgacccacagcctgagtcaccagctgccagacttgttccacccaacccctcccagatcactggaatgcagtgttaaagcacccttgatgtgatattctatgtgtgaatatctttgcaccaccttctacagcaacttatctaaataagtctccaagtctaaaaatagacctatttccttaattt

SEQ ID NO: 52667 - DNA, 1761 bp, Bovine  19866880612923
ccgggtgttggtgagggacagggaggcctggtgtgctgcgattcatggggtcgcaaagagtcggacaggactgagtgactgatctgatattaaaattaataaaaggattcttaaaatataacaaaaacaaatcctatgaaatattgtttctacttagctatcatttaaaaaataaacaagtattttgtaagaagtttttaaattagtgatagcatcagtttgtctatattcttatgacttgtttaggctgtaagtaatatattttaccagcatatggaagaaatcaaggtaatgattatttcctgcctttgctgatgggaatatattgttctgtgtatactgccctgcagccatttaccatgttatatggaaaatatcacaatataaaattattaaacttagcacccaactatccattgaatgttttaacatggtgaaattcaaaatatatttagtgtttttaaagtaaatttaaatctttgtaaataaaaagagttcaaagcagtgcttactaaggtattatttcaagcaagctttacaaaattataatagaatagtcatttggaaattcagcatggaacttacttcctattgaggagtctaattaccagacactttttgctcacattgtcagaaggttatgattagaacacattaaaaaacaagcagattcagatctaagtgaacaacaaggtacataaggtaaggaaaggtctcccatgaaagcacaaggccacagccattaagtatcttctgtgagagtaaaatcatttagaaatcaatgcacaatcttttagagtccatgttcagtaaaatacaaataaaactgcccggaagaatgagagcttctgaattttgcatgaactagaaattacatggagagtcatagggaggaaaaagacttgagtatgtagattcataacaaatattagctgttttaatgctttatagttgttattgagcattgctgcaaacactattatattacttctaatattatcatttcaatttttatgttataaaaatagtaatggatatacctactaaactggcagaaactactacaattactttatttgcatattgaaaacagaatacttttaattttatagatagtatagataggattaatctatagaaatgaatagataaatagaaaagttagagtccagaaatagacataaacatatgaaaaaatgtttttgacaaaacatttgtgaaggagctcagtggaaaaagggtagtgttttcaacaatcagtgctggaatagctggacatccacacaaataaaatttagtaacacaccctgcactacacacagatattaattttaagtggatcatagatacaaatgtaaaacctaaaggtataaactttcagaagaaaacatgaagacaaccatttggccttgtcttgaccaaataactcttagctatattaccaaaaacatgatctgtacaagaaaatttgataatttgacttcatgaaaattaaaaatactgctcttcaaattaaagattggggaattactatttagaataattatctaccttatcaggtaaattattcatcttatcagaacttatatttaaaatatacagaacatccaaaactcagtaagaagagctacaatgaaagtggtcaaaatatttgaactgttaatttatgaaagagcatttgcatatgacaaattcataaaaatgtgttcaatattattagccattaagaaaatgtaaaaattaaagttacaatgattaaca

SEQ ID NO: 52668 - DNA, 1514 bp, Bovine  19866881209407
aacttgtagtaagtagtataaataagaatgtaacagacctggaatttggaaacatgcctgagacattgaaactcacacaaccatctacttgttcaaagttccttatctgtgttaaaacaaaaatatctcagagacaggaaagctgactgttccatatcacatcaaaaaagtgctcagctacctcagctgtcactaatgatgagatctatgaaatcagttgaaatttcagaaggtaattttctttcctgtcatttctcctcaccaccatctggtgaaggtataaagagaaatcctcacaaatgtttgggggtttttataggcatacatatggaattgtttcaagtttgctttccaccaactttgatttatactcagctttaaaacatattaagtcttattctcctctcactagcagaagggagctgctgccataaatccttgatagtgccacttactttgtgtaaggactgttctggattgcatgacagatgtaatcccagctcaggggcaggaaaaatgtgatgggagaattctctagtgtcctctaggcaaagaaatgtatggaataggcctttcattaccaaggagaaattaagctaattcatttgtagtgctaaaattgtacaatggagaaacatttttttcaaagatctagccataaacaaaacaaatagaacattttttaaaccaataggatccaagtaaaatcaattacagctgctcagaaataattatatttgcaatcatattctacatattatgatgcatatcagtttttctcatttatatcaaagacataaggagtctgcattttccaaaacattaaataaattaaaaaaaaaaaaaactaaaggtctgatgaacatgacttagatcatgtttaaaatttcaatatgatttatttagtaaatacagaatacatagtttatcacaaagtactacacagtttttaggtgcatctaattattattaatattattattatttagactcattggaaaagactctatgatggaaaaattgaaggcaaaaggagacaaggacagcagaggatgagatggttagacatcatcaatgactcaatgggcatgaacttgaaaaaactctggggaaatagtgaagaacagggaagtctggcatgctgcagtccatgtagttgcaaagagtcagacatgatgtagtgactgaacaacagaaaaattgttatttagtccctgagaggtagtaaagatcatatgtatgccaatgtaattttgggtctgcgtagttggcaggactttgtggtcatgagaaataaattttattttagatagaaacatgttaagattattttataaaaaatgcacagattgtttcagatataataagatgtcctagaaaatatgcttataaaaatattccataatattcactggtttatatttgtagaaactattttttgttttatttatttatttttattattttttattactttataatattgtattgtgtacacccaaggcggactcatg

SEQ ID NO: 52669 - DNA, 1759 bp, Bovine  19866881234215
aaccctacactgagcatccgaaaagatcacagacatttgaaataaagttcacgtcaaaacgaactcttaaaaaaaaaaaaaaaagaactcatcatcctctttccctgacacaatgcttctgtctcttctaggaacagctaggtgcctagtttaagcctacattaaacctagtttctcaaaattttcttgacacttctcactttgtcatctacttaattaaatcattacttttgcagatttcatttctaaaatatctttctaatcttcctgtaaattggatctccactgtcattgttatagtgtctatttttctttctgtttggccctttctatttattcctcatgctacagccagagtgatctttcacaaaacaaatattattctctgcataaaaccctttagtgaccatgcagtagcaacaaaataatgtatcccatatcatttttttacttcatgttgtcaaagaggatgcacagagaaaaaggggcacatccataaatatctaataattagaaaacaagcaaccacctaattactctctaggtctagatcaggaaatcaccacacatacagaagctcctggactctttttaaccaaataaaccctcttcctactcccaaagatgattgttagcttgacttttaatgttatctaaatcaaaactctaaataataaaaatctagctttgcctaattttgaacctagatcctatacctaccatggtgttaattattcatacatcattttccctccttggacctaagtgagtaccctctctgaatcacagaagttgtacaaaactagtatctatgatgattattaaacaaaggaatgtttttctgtgagcagttgttccttgaattatggtgtttactatttgcactacctgatatacaactctaacattaaattgtcatatatagattagttttctctgaaatctctcactactagagtttaactgattctgaatacagaacaccaaccaagcagtgagcctatttactgaataaatgaagatgtctcctcacagagcaaaatcttcagtatttaatgttcattcagccacaggaatggtttaactttgattttttatcccaatcctaatattagttttgcctggaaggaagtgtttttctatcaagggacaattccataaatattacagtccagagtaggcactccaattatgccccaggtatttggtttcatagaacactcagggaactagtcctcaaaagtaagtactttgcatgataaaattttttaaaacctccatcccaacatatatgttcaacacttcaaaaatatgttgagcctgtccatctgctaccaggtcttatataagcatgaaaaaaagtgaaagttgctcaggcatgtccagctctttatgaccctatgaactatagcccaccaggctcctctgtccatggaattctctaggcaagaatactggagtaggttgctatttccatctccagggatcttccccacccagagatgaaacctgagtctcccaaactgcaagcagattctttaccatctgagacaccagggaagcccaataggaaatggatattaaatttcaatcatctctattacagtagatttgtgtttgatgaatcttcctgccacttaatatttactgataaggtttaaaaaattataaccaaatatatagctaattctttactgaatactgtatctacttcatataaaatcatctcaaaatgtttactaatagctttctgccaaaa

SEQ ID NO: 52670 - DNA, 1825 bp, Bovine  19866880347107
cattggagcggagagagtgctgccatgacggccccctgctcagccccaagaaaaatcgtggcccctacggtgtcccagatcaacgcagagttcgtgacccaggtgggctagggcgagtctggtgtgtatgaagggatgaggactctgaggccagggggtggaattttcttcgggaagggagcacccaggaggcatttgttcatcgattcattaactcaagtctttttactgaagtgtatgtgctgtgtgccagccaccgcactagctcttggggaaaccatggttaaagagactctgccctgaggagttcacattccgggggatacagatacatgaaaagaaagcttttatgttagagtttgtcgctcgagcgatgaagtcgcagaaggaacaccccagtctacctgagactggcaagatttcgtagcagaggtgatgttgaactgagtgttgaaggaggaataggcttattcttatccttagagtaacctcgatctttgagcggagcgatgagagtcagacaagagacttgctccaaataaatgcgtttaggaagagcagtctccgacgctaatgcgtgagtgctcctctagaacccgttactgtgttttattgtgaaccgcggttggctttgaacagggaaatacaatccccggtagctcttagcaacattcctatccttatcagtgcaagtaactcaaggtagaacttgctactcaccaacttcttctctgtgccctgtctcagcagatttgccaaggcagaagcataggagtcactttgagtccttcttttcctagcctgcactttgctacattctaaatgtctcttaaatctgtgtgctttctgtgccctaagccaaatttccatggttttcttcctgaacctaggtatcctaacctgtgttcctgtctttccacttgctttcctcaagctcatttttcatattgttgtcagagtgattacccaagtacaaatctgatctcctcacttatcttcttacaatttctaatgagttctaattgcccttaggataatgactggaatcatccaacgcattttatagtctagcctgtgcttatatccaagttttgtctgttatttccccttttctaattgtgttttagccatactgaactgcacttaattgtgctgtgctatctttcacctcctggcctttcaacattgttccctctacttagattcctaatcctctctgctcctcccacccttttcttatatggttaattcgttgtcatcaatctacattaatttggagaggtttttgcagataacttaagactagattgttatggttgttcagtcgctaagttctgtccaactctttgcaaccccatgaactgcagcacaccaggctttcctgtccttcactctctccctttgcttgaactcatgtccagtgagtcactgatgccatccaaccatctcatcctctgtcatccccttctccccgtgccttcagtctttgccagcattagagtcttccagtgagtaggcccctcacatcaggtggccagagtattggagtttcagctttagcatcagtccttctagtgaatattcaagattgatttcctttaggattgactggttggatctccttgctgtccaagggatctcaagagtcttctccaggaccgcagttcaaaagcaacagttcttaggctctcagcgttctttatggtccaactctcacttctatacatgactgctggaaaaaccatagctttgactatacggacctttgtcagcaaagtgatgtctctgctttttaatgtgctgtttaggtttgtcatagctccag

SEQ ID NO: 52671 - DNA, 2447 bp, Bovine  19866880347406
gaatctaaaaagagtgaatgtatgtgcctgtataactgattcactttgctggatagccaaaactaacacaacattgtaaatcaaccctactccgataaaactttggtttaaaaaaatcctaatatctgatttgctgtaggttagaattaagaataataaaaatggggggcagatgcagccccaaattctgttgatgctgccatcacagggggaaaggaggccttcagcagtcgcaggaactaagccaaagaaagggcttgatggccatggagactgaagagaggaacgaataacttagcttttcctcctaccttgctattttttttcaatatagagaagagtatcactaattgtgaattgcaaaattctcatcagaaaattctgagtggcataaatcctcaggagttcctgctaattgtatgggtctatatatttacagtgatgtagagaggttttttttttccattaaaatgattgacttcctttgattagttccttaatgtttctttagtattgggattgcagttttaagttcttccctgtagaagtagaccaagtatatgagatagacttaacaatttattcactgtgtgtactttattctcacctaaataaaacatttgtacacgttctgaaatgtttgctgtagtgtttacattccaaagctttttggtacctctaagaaggtatgtggacttatttattatttttaatagtgtctgtttcggccttcttgctctcatgtttgcacagtttgttaatttaagtgtctcctttcagctcttggacatgcttaagttctatactggttttgagattaacgaccagactggaaacgctctgacagagaatgagatgacaactattcactatgatagaatcacttctctccaggtaagtgaaatgcattatagcctttgcatctgttccatgaagttgtgtcataaataatttaggttttatatagtacaaatggagaaggcaatggcaccccactccagtactcttgcctggaaaaccccatggacggaggaggctggttggctgcaatccatgcggtctcgaagagtcagacacgactgagcgacttcactttcacttttcactttcatgcactggagaaggaaatggcaacccactccagtgttcttgcctggagaatcccagggacagaggagcctggtgggctgcagtctgtggggtcacacagaatcggacacgactgaagtgacttagctttttagctttatagtgcaaataggaaaggtacttatttaatagtatgctcatcttgaatttttaaaatattgctaattctgatggatttatgaaaaagaaagttttcttttatagtcctcagtcttgagaatcagtatattgatatttgacagtcaaaaaatattagttattgggcaaacttggtacatttaaatatcaactttattttatgaaagagtatttcaacttgacaaagtagatgtgcatacttcatacattttaaagataaaggcatgtaatggtactgaaatttaccaatgcagctcagatatgccctaaaagtacctttgtttttattactgagctcattttgctcttgaactccatttcctctggtggcagaaagagacttttatttctcaatttaaagtaattgagatcctaaccttttaaagagtcttttgcggggaggagagcagggaacctgtacagacacagccaaacttaagttcagattatctttcaccatcaggtccactgtctctcaaggtcattgctcttcctgcacacagtcccaactcagatatcttttcctgcttttctcagagggttagtgtttttgttcctctgcctctgccctagaagtgaccatggctggtgtggtgtgtgctgttctcttggcaccggcaaggctcaatgattggtctcttagaggctggttgtcagcctactgacagggtcccagtgcttgatcttgatggtgccggagtcctcctgggagctgactgcttcatcttctagcttggggaacttacttgcaggcttggtgcagggtcattttgccattgtctatggtaatctcatggcaggccgttatccataaccttggcaagcttttgtgcaatcctctacaggggacttaaaaacttgtggaacttttaccttggcattaaggaggactagagatgttacctctcacacacttaatcaaatcagcataatgctgctctttctgttttcttgcagcttaccccatgttgattggaagtgttaccctgggagggcctctctttcctgagttccaaagtcaagcagggtgcatgcacactaagctgtaggcccctccctcagatacctcttcagtgggagttgcgcttgagacttccttttagttttgttaagccagttctttattttatttatttttttaagccagttcttaataatga

SEQ ID NO: 52672 - DNA, 887 bp, Bovine  19866880364307
cacccacaccaccctggagcactctgattgtgccttcatggtagacaatgaggccatctatgacatctgtcgtagaaacctcgacgttgagcgcctgacatatactaacttgaataggttgataggtcaaattgtgtcctccaccactgcttccctgaggtttgatggcaccctgaatgtggatctgacagagttccagaccaacctggtgccctatccccgcatccacttccctctggccacatacgcccccgtcatctctgctgagaaagcctaccatgaacagctttctgtagcagagatcaccaatgcttgctttgagccagccaaccagatggtgaaatgtgaccctcgccatggtaaatacatggcctgctgcctgttgtaccgtggtgacgtggttcccaaagatgtcagtgctgccattgccaccatcaagaccaagcgtaccgtccagtttgtggactggtgccccactggcttcaaggttggcattaactaccagcctcccactgtggtacctggtggagacctggccaaagtacagcgagctgtgtgcatgctaagcaacaccacagccatcactgaggcctgggctcgcctggaccacaagttggacctgatgtatgccaagcgtgcctttgttcactggtacgtgggtgagggcatggaggaaggagagttttctgaggcccgtgaagacatggttgcccttgagaaggattatgaggaggttggtgtggattctgtggaaagagaaggagaggaagaaggagaggaatactaaagttaaaatgtcacaaaggtgctgcttttacagggaagcttattctgtttcaaacattgaaaagttgtggtctgatcagttaatttgtatgttgcagtgt

SEQ ID NO: 52673 - DNA, 2944 bp, Bovine  19866880450898
tattttgatagaattcctattggaggtatttaaagatttaaagataatgtctaaaataatattgagctggccaaaaaatttatttgggtttcatgtacgatgttatagaaagcttgaacaaacattttggccaacccaatacttaaacttcagtctcgttgcaaattgctcagtccttcctggcagctctttctcagggaacagtaaatagtggagctggctccagatcctctttttatgagattctatgtatgtgtgatggtaaattttatgtgtcaacttgattgggccacagggtgatatctaatttaaaaattaccctagatatttctgtgagggtgtttctgaatgagattaatattggaattggtaggatgactaaaccagattgccctctcctctgcaggtggacctcatcctatcttctagaggcctgaatgaaataaaaaatggtcaataagagagaattcatgctttctctgtctgcctgtttttgagctggaacatcagcttttcctgctttcagatttggactaaactgtggctcagctggtaaagaatccacctgcaatgtgggagatctgggttcaatccctggattgggaagatttcctggaggagggcatggcaatccacgccagtattcttgcctggggaattccatggacagaagagcctggcgggctacagtccacggggtcacaaagagtcagacacgactgcatgactaagcacacgcacacacactatcagctctcctgggtctctgatttgggacttctcagcctccataatcctgtgaaacaactcagagtaaatctcttgtatacctatacattctatcggttctgcttctctggtgaaccttgagttctccggagaacttctgtgggttgatcatgatgaagcaatgaatcagggagttcaactatcttctcactccctagtcatacagctccttagggtatgagtccagagcgaggagtgggctctcctgccctctcaaatctctaggtctgatctggaatgggaggaattcctataaatctggatcaataagatctggaggccaaggattggatgtgagtgatattcctatgactgaagacttagtagtctcccccagacttttaagagaaaatttattcaaacagcatgactttgggtaacaaataaaacaataaagggaaaaacagactatccaagaaaggcatgggagtcttgtcaccagacttgggcttggaatgttacattcataagcctacctggtatcactctgaaaatcatcggcaagtacagacaagcaatcccaaaatagaaaaatgaccaagcttcagttcttcagctaagtagggcttgttccactgagtcagactctgaggttaactctgttccagccagaatatggacttctttgtccagagtaagctttgccacatgaaacacttagaccaacaaaccaacaaacttggagctggggctcttcctccagtattaagatttaattatttgagcgacaatttaacacaaataaattttcagtactctagtaattctaaaatgcaactgggattaagaagcactggtctagaccactctacagtaatattccatataggaccaagacataagattagcctacaaattctgaagacaattagattcctgtaattctcttatatgtaattttgccagaataagacagcacacatcagtcctgtcctactttccctgttttgcagcaattcgggagtcttttagggggccgctcgcccatctctttcctccatatttgtttgatccctatcaccctcttcttagactaagcctctgctttttaaagtatggtcctcagacaagccccagtgccattacctggatagaaatagggcttcctttggtaaagaaaggtggtaaaggatctgctcagatggtaaagaatctgcttgcagtgcaggagacccaggtttaatccctgggtcaggaagatcccctggagaagcaaatggcaacccactccagtattcttgcttggaaaatcccatggacagagaagcctggtgggctacagtctatgtggttgcaagagtcagatatgacttagttaataaaccacctaaggtaagaaagctgagcctctaaatagagttgctccaagtgatccatagctgtgatttcaggaaggcctgtagctgtttcctcactgcagatatgagtgatcacagaaactgccaccccacaggaggctacagctgagctgggggctgggcaagctgttcttcacttgccccacccccatccattcatcagggttctgtgtccttcctgcatcctgggaagctggcctttccagattccatacagattgcatttccaggtttctctttcctgctgttttcatcttaggcttggccaatgggaaacctttagcaagacactgagaggagaaagatatttcttctctacgtcctgtttggtcctatgggctggctgtagtggcatcctttcaggctgtcactccctccaggatgccctcttcatgcctccacctttaactgggcttctgtggaaatgctgctccttttcttgtctctctgtttctactggtagtactgtcttctcactgttgctagtctcaccgttcattacctcgccatcttgtttgttcctttactctgtctgcatgttggtaaatagccccttcattaaaatctcttcagttgaaccacctgggataaattctgtttccttttgggaccctgactgataacggagactgatagcacacccatatgaaaataggtcatagataatttgcaaagcaattttaaaaactctaaattaggatcactagcatgtacaaaagcacagataagaaaatgagtatttcatacagggcctggcaggtttctttctttttgtttctttctaaactaatgtagaa

SEQ ID NO: 52674 - DNA, 1450 bp, Bovine  19866880539722
ttactcaagaataatcctttcaactgcctatttatactgcagatggaaacctatagattgaaataaacagattttcattctaaaattggcatccacactgtcatagttaaaggatgcaacaatcgtgtttgaaaagcaatcatccaagaaatttcacgttgctttgcaatattcagatgaagggcgtattggaattagaaggtgaatagcatttaagagctgaggaagagcattagtttacggaactaaggggaccattaacgtagacagaaaatgccaaacacgaacaaatatgtgtatatctataactgaatcactttgctgtatacctgaaactatcacaaacactgtttatcaactattctgcaatataaaataaaaaggtgtttttaaaaaaaaaaaactaaaaaagaaagaaaatgtcaaatatgttagtaaaatgtgttgctaaaaagtaatatcttaggacacataagcaaaggattaatctcttttggaataacccagtaagaagtgcttgattaaaagtctataattgtgctttatgatacagtagcaactaaccctatatggttatttaaattaattaaaattaaataaaattagaatttcagttattcaattgtcctagccacattttaagagctcaatagtcattgtcatattaagcagcaaagacaacagaagtttctgtcactacaccaagttgtattgaacaatgctggtctagaaggttctgtttgactactggattagcatcatttaaacatcaggtctcaaatagatgagcacagggagcatggcctgctgccaaatgtgacagctgagagcaggaaagtatggtaaaatgggaaaaataattccactcctggaataaactaatatgttgcagcattgacattttattacaagaaatatccttagacaagcagagaaatcttggactaaaatggaaaggagttagtaaacaccactatttgaatacctcatcacagtcttctaaactttcacaaaatgtaccagtcttgtctcatctgttagtgactagacattatcagtcatcccccaagtactattcaaccatccatcacttcctgccctcacggttccgatttttaaatatgtgacaaaacatttttgaacatatatttagataaatagaatccaaatcaaaacataaaattgcagactcttcccattaaaaaaaaaaggcaagaactttattttaaacatatcctcagttgtgtattacatcacgtctgttacctaaaccaaaaatcataatgataatgcaaaggaaacggagggcttcataaaagcacatttatccaaatattactcttggccaatgctttaactaaataaacagtggatatgaaaggtacagtatggcacttaaataaataagagcaaagagaaggaaacaattcacagtccaaagcaacaggtt

SEQ ID NO: 52675 - DNA, 841 bp, Bovine  19866880589453
attaaattgcacgtgtgtaaacaaactgtccaatgattgatgagagatgagggagggtggttcagaagactccaaaaagcatcataccatcatcctgaatgtaatgtagactaagagagaaggcaccttagaagcacttgcggtggacgatggaggggcctgcctcatcatactcttgcttgctgatccacatctgctggaaggtggacagggaggccaggatggagcccccaatccagacagagtacttacgctcagggggagcaataatctgcagaaggaaatcgaaaactgccagtgaactctgaggttccaagcaacagagaaagcaacatggtggggagattcacggaaaatacactggtgatcaagttgctgtaatgtgatacaaatgaataagctcagtaatcctacaaatgaatatggttgactcacgatgaatgcatttttctctatttcatcaattccatgatcaaagactctgtaaaatagaagttccccacttctctgaaccagagaatatgtggcaataagctataggcatggtgaagcctagtttgaaagttggggtcttttaaaatgtgttcaaagatttagatttttttttcctcaaagatttatttttatccactgcttcaaagtgttttaaaatctcctatctggggaaaagtgccagaaaagtcagaaaaggtgctataaaagcaaaaggtttctgtgagaacaggaagctatttgtgtgaggggaaaggagttaggaattctgcttggtatatggagacctgccttggttccccctaccccaccacagaagttctttaccttaattttcatggtgctggga

SEQ ID NO: 52676 - DNA, 803 bp, Bovine  19866880598027
tttctaactttcggtctctgtgaatctgactgctgcagactgaagcgacttagcagcagcagcagcagatacctcgtataactggtgtccttcagtatccatacttttgtgaagttacaagcacttcacgccgtttaacttgtttaattatcatgctagctccataaggtaagattttgcttcccaagtggcacagtggtaaagaatctgcctgccaatgcaggccactgcagccttgatccctgggtcaggaagatcccctggaggaggaaatggctccctgctctagttttgttgcctggaaaattccatggacagaggagcctgatgggctacagtccctggggttgcagagtctgacacaactgagcaattgaccgaatgtatgtatgtatgtatataaggtaggattactaacccattttatagatgaggacattgaaacacaaataggttaagtgagaagtagaaagtaaatgttctgagagaaaggaaagatcttccttaatttggttctctggacgcagggatccacgaggcagacaatcctcttgttggaggcgcctctgagcacctgccagccccagctttccacataagttacggtctgggcaactggacaggcactcccgcaggagagaagagggaatgtgttgaacgagttaagtgcccccctgttcccaccccaccaccctcccagcacgcgtcgcaggctgagctggtgacccgggcaggatcggagccaaaggactaatccatcacaaaatagacgttctatttcgggcaggcggcaggagcagatg

SEQ ID NO: 52677 - DNA, 1503 bp, Bovine  19866880671936
tctcagtcactacactgtgtaaaactggtgtgttaaaaatagtatgacatatttgcatatttatctgtattaaaagccccgtgaaacagttattgcagatacacagctgttgctttttacgtattttttaaaggaaccatatctcctcttctatgtaaattacatacattctcaaatatatcatctgagccaagggagtttcaaagcttttaactggaaaacttactctcataggagaagaatgttaaaggagaggaattgtagatttttagtcattgtgtccaaatgataaatttttaacctaaaatgataaacttgttcctttgccaagtaaaatatcatacattgtaagcagaaagtaattctggatgcttttacaaactatggccttatttcaacatggagactgtttacctcgtctacagagcacataagagatgctgctctatatcgatcaagttacagaagtctctgctttgtgacttaaaagtgacaaattctgttgtgaagaatttttctttaaattgcattctcatatcttcacaaaagctaatagtagcatttttctttttagttaaaaatgaaattatgcccctggaatgctagctactatcatcttgtatttcccagaaaagagatccaattgaaaaacagttctggcaattttccttattttctctataattgtaatatggacactttcaattttaagaaaacatgtgtattttcaactctgaccatattaagttgattaatatatagttcagatgcacatgatgtgttctcattttagtatctgaactatagttttatttttaaaggcttttaaatataaatagttgaatcaaagatatatttcatagttcaattttaccatgttagctaaataagagggtattaaaagaaaggattatcatatattaaattaaaagtttgtcactttgcagctctaatccatttgaaaaaaaaagatgatttcgatacaatttaatcagttagaggtctttattgccttaagtattaattgattaggttctcacctaaggtcaaaagtacacttggctgcctggagacggccaattagcaaattgtcaactgtgcttatttacattgaccgaacataatagtagttatttgacagtcaagtcagaaggtcaccaaatcttttgtacactttgccctccaaaagggcaacagtcatttagacaccagaaagcattcataacaaagatttagtttattacttattgacttaaatcactcttagaaacaggtgtttcattctctttggacaactgatatatcacttctttgtgaaatacttgcagtacagttgaaatcctgtggttgattgtatctgaagatttttgttcagcaagcagcttgctcttgaaactctaaataccttttttaagagcaaaccaatgcaataactataatcctttgcaatatagacttttctcctgctaaggatcgcaggagtggaacaagtggacacaggtg

SEQ ID NO: 52678 - DNA, 1370 bp, Bovine  19866880691278
ggagattctgacagggaaactggtggagcatgggaactgatatcgcaatatacaaattattgtctgaatctgtgccatctctagtaaggataggtgaatgcataaaatcaacaacagattgtacctgacaattaaaagctcaacaaatattatctgaattagtggttgaagaattaatgttcaccagtgtattttaaactgttaatgaaacttatctctccgtctctctttgcatttgcttctgaatgtcctaagtcccattccttaagccttcttaactgattttaatttcttatagataacactgtaagttattttattgtgggaggctcttgaagtaaaagatttcaaaaatgcttaattgcatgaaaagttaaaatgtgttgatttagttgatttgaaagagctgttctgcagttcattgaagtgataagctacatggaaataagtcttcttggaaaataaaagcatcagattaggctttctctggtttgtaaacccagaagctaaccaggttttaaactgaatttctactttccctcataatctctcttccttacaccaatgtaaacaatgacccagaaatattcgtaagactattgtttacccctaaattatgtgtgagttggagacatgtttctggtttaatagactcttgaattatatgatggattcttttataaattgtcgatttttttcctgatgggcatgttcatatttaaaccacattaatgatgtgtaccattatccacctctccccaaaagtgtactgactttgctctaaatttcttatgagtatcagatttcttcacgatgttactacctgtcagtggcagttgagaaatcatagaatattgtagctagatggaactttcagagccatttagttcagtcctcacattttacacataagcaagctgatctccaagaagcttaatttaccttcccaagttcataggtaatgataggaccctaactagaattttggtctcctgatccccattgtagccctggtgtatatagctgactcaacccaagtgtatagtagaagtctagctttactccctcatcacacgctatcttctttcctaattccaaagttgttttaaatttgtgattaatcagagtaaaagaaaccctgaaggagctattcttctggatgtatgttgagatcagttcttttacttcagatcagcctgccttataagccttataaccttataagcattagcttttcatcttttcacctgcttagaaattgaaagacattgataatggatgcataaatgcatcatgggatgaataaattgtgtgagttagagaagagaaaatgaatgtgttcgtgaaagagcgagcacatcaatcagtgg

SEQ ID NO: 52679 - DNA, 1163 bp, Bovine  19866880731975
ctaaagattgcagagctgtactatgaattacagtattaacatcccctatattttagaggactgtgcgcacaagaattattacacctgggtccaggaatttttccttttggcctttgaaaagtccaatgcaatttaatctttagtagtaactaggttatgaatgtattgtacaattacaaaaaaatttaaaagtacaaaaacaatggataattgattcaagaattccaaagaaatgtttggcttacaggaggtacccagttgaaaatggtaaaacttttaagtaataaccgactcacataaatatagattcttaggactttcttagctacaatgctataaattcaggagcatcctgaatggatacttccactgccagtgctgtctctaccctagcttgctggtgatgtagggaaaaggcaaggacacaaataactcagcaaacctcttttcaacacgttgtcaagtcccttataaagcaagcgcaaacatggcagaaagccatcaccagattccagagttgaagaaagcataaattgttacaagcttatgctatagatcaactacccagatttggggaggtttctgctaataccttactctcaaccatccttgtcatttctttttcccctggcctacgtgggctttactgcccacttactcctccaaaacaataggccaggtgacaactcgttccagctaatatttcagctgatgtgatcactggaactttactgaatttcagaacttcaccctttttattaaccttagaatctctaccaaggactcccctatcacttaagtaaatgattaatattgattcaaaaaatgacaaattgaaaaagctttagggatttttgtctcttccctacaagtagcagagttcctgaacaacagttttcacttgtgataattttgttttatgatcgatttagcacagcacagtactcttgttaatcttttgagaaatgtttatacagtcttactttaaattgttttcttttatttaatctttgttttttaattagtggaaaattgctttacaatcttccatacatcaacacaaattaatcattattttatatatatatatatatatatatatatatatatatcccttccctcctgagcctccctccctttcccccattaaatttcttttttaa

SEQ ID NO: 52680 - DNA, 951 bp, Bovine  19866880742391
ataatacatgattaaatgcttaggtgtcaggatttatggtaaatttttctctactttggagaaaattttgttaataactttaacttatttatgtatttattaatttattaatattgggtttccctgatagctcagttggtaaagaatccgcctgcaatgcaggagaccccagttcgattcctgggttgggaagatcccatggagaagggaaaggctactcactccagtattctggcctagaaaattccatggactgtatagtccatgggatcacaaagagttggacatgactgagtgaatttcattttcactttcattattaatattaatacttttgatgtttgcatttatataaatgttattaaatattactgtctcgatgattataaaggttttcataaaggaactagaaacactgaaacacattccacaactgacggattcaggaggtaaattgaacagactgttagggttttggtgaagcacagtttatgtcctttcatgacccagccttcgctagagaagagacacctaaattgaatgaaactgaaaaagaaacatttttttcaaaaactaggataaattgaagcttttagataaagttgaattgcattgaaaaagccggtgaaccattgtggctttttcataggcttttcacagtccctcaaaagttctaacgttgtataaaataaaatgcgaatgatgacattacaaagattaggatagagatttcaaattatactgaaattgtattgggtctagatactagcatttattcaaagtaagagaagattatgactttggactggctacacttaccagttaaatgcttactgcttaaaaattgaaaatagaatgaatatataagatggatcttaaaattactgaggtattgttatatattcatatattctaaaaggttctatatagtgagtcattgagagcaaatat

SEQ ID NO: 52681 - DNA, 860 bp, Bovine  19866880759253
tgtgtgtatatatacacatgtactcatacacgtatgtagagaagtctatcttctctttaatagctttgagattcttatattggattaaaacatatgctttaaaaccattgttcaaaatctgctagtggacaagccaggttatatgtcaggaatacctaaaggcagttacctattatcagtagcatcgctctcagtcctgtacctgaatgtctctcaccaagcagcatgctactggataaaacatcgaaaaaggaaacagaaaacaccatcatgaaagccaagaggtcctttgggagctgacagatggctatgtcatcttctattcttgtttatcttttctcatttaccttatagttttctcctgtggttaggagccatgtttaacctcccccacaaatgtcacatctaacctctttattgagttttagaaagtgattggtcctaaataattggaattataaaaatcaagataaaaaataatctatttccctttgtgatatgatttaaatgtctctgaacacaatgaaaatcaatgttgggatcaccactgctgtttatacttagccatgttcacatgtgatgtttagaagttattcatctaatttgggaatttcctgactgcagtaaatttaaactaagcatgatatcatcacactgaaattctcattttcactgtaatatctaaagaagggagaatggcacccgacctatgaaaactgcctcacgtatgtgagaagtgtgcttctcctgatggcatgtgttaatcaggacgtgaggttgaaatagatttactgtgatgttgggaggttttcccacacagataatgatgatggtgtgtgtgtttgagagatatgttttta

SEQ ID NO: 52682 - DNA, 812 bp, Bovine  19866880773955
cctcctctgcagcaatgatatgataaaggatgacacaccggcttcatcttgaaacaaggaatgagatagagtagtaacggaataatccatatctgcaaggaagagatgatgactcaagagtgctgacttattctggtagattccatcaccaagtagttagaccttacttctgagtcactcattactaagtgtgataacaatcctacttatagtaataactggacactcacgtgtcactgaacatctttcctaagcagggatttccaagaggaagcttgccagtatcttattttagtccataaataagaatggcattcatttcacatgaatgtgtgtctcatgcttttctattacatctccataggtctgatgggtacagtgcgtgttccctccaaacaggtgctaaaagcagttgtttgtgtcttggcagtctgttgtagattactctcagcacttttaagacatctgttccacaaaactctgcagtgtatcttatagaggaacatatgtttcagagacaaatggtgacagtttaccaacacagagaagtcttgttctcttccctccaccctggccccatggcctgaatgcactgtgacttttttaaacttgctcataggtatggaatctgccggcatccatgaaacgacttacaacagcatcatgaaatgtgacattgatattcgcaaggacctgtatgccaacaatgtctttatcccggaggtaccaccatgtaccctggtatttgctgatcgcatgcaaaaggaaatcactgccctggctcccagcaccatgaaaattaaggtaaagaa

SEQ ID NO: 52683 - DNA, 1298 bp, Bovine  19866880939123
actcacatcttgtacatctcctgcattggcaggcaggttctttactactagaaccacctagtattcagaatagtacttgatgtacaggtgtacagtatgtgcctaatatttattgagtaaataaatgaaggaatggttaacaaataatcatacatctaagtgattagtctcattcttctgtctggtcccagattgggcctttaggaaattctgggatgtccacttcaaaagctgcgtgcaatagcaaacctctgttcccactgagtgaatgtggcaggaaagcttttctgtttttccgtttgcaggggtagggcgatgaggtgatagtggtggtagtgacaacagaggtagggtatcccattcagcacataccccagcctgacttctgggaattctctgtctctccttccacttaacccaagtctgctaattccaactgggttcacaacttgggtaaaacactatcatgtctatagcttaaaattacataagttcagaatacagccaatccagttaacagttagaataagagaccagtggctatttgttcatttctttcctagcgtgtacttcttcttcctttctaatattatttttaatgtccagactatgacatttgaatgatattgactcagcttacagactgaagctcaatttaggaatggacatgtaacactggcttaagtcgatgaatctattacatttctgtggccttatcaattggaacagaattgagtatgtgatctaaactagatcaatgaaagtaattcagtatttttgatgtgaaaattaagctatggattccttcatttctacctgtgctttcggtatggagatataaagtctgtaactgcaatggcaataagaagagagataggagctgctaaaagaccatatcaggatgtagtaaacccaggggaagtagactaagagatggaacccaaatatattgtgtggatacaggatcaagctgtatctgaagtgagatctattcaatttctatatcctgaagtcaaatactcttaatgaacatcaagacatagatcctaagttggacactatttccatctctggtatttggggtataacctgttgcagacaatgtcagtgctctgcccagaaacccttttcctctgtgtactcaccctttgatgtaatagccatattctcttgggctaccagagtcaattagcccacaagtagcagagactgtgtagtccagagatagggaagtccatttccttgccccaactgagacagctctatggcacaatgtgtattccagagttctcctgagg

SEQ ID NO: 52684 - DNA, 1083 bp, Bovine  19866880975157
tgacaataagaatcgtacgtaaaacactcatacatcgtcttgccagattcacctgttgttgatattttgccccatttcctctatcggatgaatgtgcactctccttctctctttgcatatgtgtatatgcatagacatgtatatattatgaatatatttgtatgtgtgtgtttatatgcacacatatgcattttttctaaaccttttaaatattagttgcatggtcttttattcatacacttcaacgtgtattttttctacaaataagaatattgtcttacatacaagtagatttaagatagacttttttcccgctaatcttccatctgtattccagttgtgttagttgacccagtgatattcattacaaggtatccaggtcttacttttggagtcaggttgcatgtgttgtatgcgataccagtagtgggctatgttgagaaagttatagggccctggaaaccttagtggcccaaacgtttgctgaaagaagtaacttatttagaggaaaaatccaaatatagtcaggaatgaaagcaaaaagttgaagccagaaattcagttctaggcctcagaatgagaggtcatacaaggccccaaagggacaatcaatcatgagattggaaacgtgatacaatatgtgttaaggcaagagatttagaattaatgccctgagattgatggaggtctgtcttcatgtgaaaacatccctatagtaaggaaataagcttgatagcctgaaagagacagagcctgccttgcttgggctttgcctgatagaagactgtgactcagttagtggcatggcttacttgggtgagatgagcttcccttggtgacgctctggagcagaacctgaaatgtccttcagagatagaggagttcaagaccttctgtacttgttgcctctgatcatgagggaaaaggtagagagccatccaaataagagtaaaaacagtaagaagtaacaggggaaaggagtaaaagatgggtagggaaatgatttctgattttcagagtggacctaggaaacatgcttcgggtttgtccaatggacgcacagttccagagggaagagagtca

SEQ ID NO: 52685 - DNA, 2133 bp, Bovine  19866881103902
cttactcaaactcaagtccattgagtcagtgatgccatccaaccatctcatcctctgtcattcccttctcctccggccttcaatctttttcagcatcagggtcttttcaaatgagtcagttcttcccatcaggtggccaaagtgttggagtttgagcttcagtatcagtccttgcaatgaatattcaggagtgatttcctttaggatggactgattggatctccttgtagtccaaggggctctccagagtcttctccaacaccacagttcaaaagcatcaattcttcggtgctcagctttctttatagtccaactctcgcatccatatataactactggaaaaaccatagctttgactacatggacctttgttggtaatgtccctgctttttaatatgctatctagattggtcatagcttttcttccaaggagcaagtgtcttttaatttcatggctgcagtcaccatctgcagtgattttggagcccccaaaaataaactctcactgtttccattgtatccccatctatttgtgatgaagtgatgggaccggataccatgatcttagttttctgaatgttgaattttaagccagcttcttcactctcctctttcactttcattaagaggctctttagttcctcttcggtttctgccataagggtggtatcatctgcatatctgaggttattgttatttctcccggcaatcttgattccagcttgtacttcatgcagcctggcatttcacatgatgtactctgcatataggttaaataagcagggtgtcaatatacagccttaacgtactcctttcccaatttggaaccagtctgctccatgtacagttctaatctgtatgcagatttcttaggaggcagctaagatgatctgttattctcatctcttgaagaattttccacagtttgttgtgatccacacagccaaaggctttggcatcgtcaataaagcagaagtagtactcttgcctggaaaatcccgtggacggaggagcctggtaggctgcagtccatggggttgctaagagtcggatatgactgagcaacttcactttcactttcatgcaatggagaaggaaatggcaacccactccagtgttcttgcctggagaatcccagggacaggggagcctggtgggctgccatctatggagtcacacagagttggacacgactgaagtgacttagcagcagcagcaggtgtttttctgggactcttttgcttttgtgaggactatttaaaggagccatatatttaggctgaagtgaaggcagcaggttactgggccaaggagaatggcaatttttatagcagtccataatatttgagggcttccctggtggctcagatggtaaagcatctgtctgcaatgctggagacccgggtttgatccctgggtcgggaagatcccctggagaaggaaatggcaacccactcctttactcttgcctggaaaatcccatgaacagaggagcctggtaggctacagtccatggggtcacaaagagttggacacaactgaacgactttacttatagtatttgaaagtctactgatactttctgtggcttcagagaacaattctaagagaaagtggaagccgtatagtgaagcaaatcttggtttggtatcagaactttttgacatttggagctgtcaagtagtggcattaggaggttgccataggcccttgtgtgactttcttcaacttctacttcatgcccttgctcttccttatgtaaacctgtcccgtcatgctgaaacagaagtaatctgaggttgtagaactgagctgactaaggttgcttctgggaggaaattccatccttccccaaagactgtattcatggctctattcatgaagggtagaggtttgcccccattaggtaactttagaacaatatgccacttgctctgagggcagttctatagagagaattttggaaatggattgattaaaggcgaatatgtatttctactggaaaaagcatatatactgtgcaaaggtggccactgtgaaggtgacagccctcatttaaatacataaaaatcagtctaattatgacttcttagttttcattaaaatctgaagcttacatggaacatgatgaga

SEQ ID NO: 52686 - DNA, 770 bp, Bovine  19866881144587
ctggtcctaaccagaatgaatatatccccttctagagaaatttaatagatgaatcaccaactcctgttcagtctacaagacatttagcttaagtccagccagtcctccatgtctgggtctctgttgtgagacaagatcttttgcagactgatacgagagtattggatacctgtttttctccctgaactgttagcactaatgtgataatagaactgattcagctggtgataggaactagttttcattatttttttcaggctcctagtcttcatgacacagaaacagatctgaagggccaaaaattaatagcacaaagctaggagtgacactattcagattttgctgaaataacaatgactttatatttattcatttgtataataaaacatttcaaatccatcaaaagaaaattctgggaagcctcctatttaagaaatacagttttttgaagtgagcaaattttttgagatggcctttgatactgtgttcagtttctccttctttgtttgaaaacctggcatttgtcatctgtcataatgtgtttactttgagtataatgttttaaaggtattattttgtcttctgaaaactcctagaaggtttgttttccttacaagcataattatatctagtttcttccatcagagcttcatattttaataatatgttgccatgtgggtacagctataaccataataatgaacatggggttcaaagatcactagatatatagatggcatgaaccattagcaagaaatattctacaccat

SEQ ID NO: 52687 - DNA, 1376 bp, Bovine  19866881144712
ttgttgatgctgcgggaagcatcaagatgagagtctaaatgacacccaccatagactggtaaagttaagtaaacactagttactcaaaaatatcagggacttgactttctgggtttaatgtcctgacaaattcatcattccttcgaaatgttaagaccagagaagcatttcactggcactgtgctaattcttgcttaattcttcaaaactttgttggacatggtcaggcctcaaggtagatgcactggaggagaactttggggaaatgtgccccttagccactccagcagatgtggaaagcgggaagagagccagtgggcaatctcaccctccccacatatacatattcatctcttctctggtcaccatgcccagggaccttgtcagtagaggttcattgtcagaaaacataagtcacactcactgtaaattctatcatcacagaatcactgttctacctctggctcatgtgaggacagcacagtaatctcagtacagtgcttctcaaactacaaagtgcagatgaatcaccaagggactttgtggtaatgtggactgagatttagtagacctgggctacagcccaaacttctgcatttctaacaaatttcagcgcaacactgatgctgctgatttgcaaaccacacttgagtagcaaggtcctagtacagttgctttcccaaatctgaagcacattttaccttgaggtctccttgtagttggctatctatcaggagaactaaccaagacagaaaacttagaacctctgtgttgggagaaatccatcatgaatacaggaattaaataagttcactgattttcactgcctggaccctggacctttgctcctgcccagatggatttgccagattcttcttgtttagctgaatgacgaattttggctcagtcttcaccagactaatccaatgccattcagtcagcaattcaaatgttaatggtgtagcacctgtaaacataaaaatgcaggctcctgggctctaaccctgagactctgattcattagttctggagcagcctcaagaataaatagacattctaggtgactctaacacactctgaggtctgggggaaggaaatgcatgtcctcttcgatggactggagtaatctatatcctgtggtgttaatgcctttccatcaaggaagacagcaaagaaatgaaggacagaaagacacatgacctgatcatctcacactatgatagaagaaatgatttcctccccaagttggacacttgcttaattaaggtcatttatggttaattccagtacattttatccttttttttagagaagttcactaaaaatgtgaactattattccatacaaaattcttctaatgtcggtatgattacaga

SEQ ID NO: 52688 - DNA, 824 bp, Bovine  19866881146589
tgatgtacatgttttatttaatggtggattcttgttatgacatttcccttcaggaatgaaagaggaagagataagttattgtcgatgcagccacaagcaaattcaaccatcttcctcggcactgaagagaaatgtcaaaaaagattaatcatgcattaaagatgcatggacatgttagccctcttatatattgaaggactgggttgtgtttaaacacttatagtccatcatgagatagtcagggacttggcagccttgaaaaaatatttatatcagtagctctatgacctcaactgtctcaatacaaagatagaagaaaatatttcattgatagttcatctgaattatggttgttaaattttaaggctattgagatttgtaaaagagtatcttcacatagttgaatttatttcttcatcattttatgtttttagaacatcacatttgaagaaggccttgtgtgtttaggtcaatttctcttccaggatgacagttaagaagtcacaaaatgattcctaaaacaggaagggaaggaaaacatatccaatctaaacagaagttcagttcagttcagttgctcagtcgtgtccagctctttgcgatcccatggattgcagcacaccaggcttccctgtccatcgccaaatcccggagcttgctcaaactcatgtccaccgagtccgtggtgccatccaaccatctcatcctctgtcatccccttctcctcccaccttcaatctttcccagcacatatcaagaattgagtacccaaaaacattatgctaaggaaataagccagttgcaaaaggacaaatattgcattt

SEQ ID NO: 52689 - DNA, 1702 bp, Bovine  19866881170211
tcatttcccttggctcctccagatcttttccacctgctctgtgcctagaaaactaacctatctgggcttcaggcccataccccattgccccgggattctagccaatggggagccctgcaggttatctggaaacctggggttttccttctcctgaagcacagtctcctggaggcagctgttcttgaggcagtcttattcccgtgactcttccttctggcctccaagatccactctctcctctcgtctcctaggatgtgtgtcttggtattatcacagctctgctatcccactatcacattcccatctcttgtaccagcactccacccacacctttgagggagtctccttattaaaccctctttcaatgatcccaatctgagaataccatctgtttcctgatggatctctgacaaatgctacacaccaatgcattcagattgaggcaggttttcctgcctatggattaagaaaaggctttcagcttttaaaactttctggacctaataatataagatattgtaaacccatccattttactgtttcttcggtttaatatatactgctacttctacctggaatgcccttttctccttgtccaactagctaacttcaatttagtccttatacgccatgtgaacttccagtgaacttcaagggtgaactagccattgaccaatgccctgtagacaacacctcatccaatagtcctggacacttgtaaagtccctggaatagccttggaaaacttatgtgagttggggcttgaagggaaaaccccactgaaggaggtgctggacttacaagtactgttactgttacatacattaaacacatgatgaacaaaagacttaacatttcttaatattattgcatgattctaaaaacactgggtgagcgcagtcataaacagttaaaatttgctgattttaaatttcccattattcaccctcttgtgccaaagactcatggacaaaacacaaatttttttaaaaatactcgcccttagcatgtgcaatgtactctgacattttctagcctattgtagtcaatatcactttttaagaatattgatcacaccctagaaacatgtcatacaatgcacagtgtgaaagacaccaaacaaaacaatatgcactgacaaatgcttccaaactttgtcaaacaaccaaaaaatgttaactaaaattgtaaccacactttagttttttgccatttctacttccaggttgttgcccccatcttcagagtcccttggactgcaaggagatccaaccagtccatcctaaaggaaatcagtcctgaatattcactggaaggaccaatgctgaagcttcaatactttggccacctgatgccaagaactgattcatgggaaaagaccatgatgctgagaaagattgaggcgggaggataaggggacaacagaggataagatggttggatggcatcaccgacttaatggacatgagtttgagcaagctctgggagttggtgatggacagggaagcctggcatgctgcagcccatggggtcacaaagagtcagacatgactgagcgactgagctaaactgactcccatttttagtgatttgctctcctgaacagagcccaggaattcctgtcctaaagttggatgacatctggctagaccacatgaacgtgtgctgagacagaaaccagagcagcaggcaatcagggagt

SEQ ID NO: 52690 - DNA, 1284 bp, Bovine  19866881209942
ccctgaaaccttcccctccctgcccccgtctgtggaaaaactgtcttccatgaactggtccctgatgctaaaaaggttgaggactgctgtcttaagagtatacagattcttctcttccttcctactaacagaacttgacataaatgcttgctaccagacttttatccaattgataatcattactattaaaacaacctgcaaccctcatctgcttccttactcgttatatactttatttatctttctccttagcatgaaccactggataatataccataaaatccatctgttattagctgctttccccaactagaatgtaaactccacaagagcaggaattactttctattttgttctatgccatttctcctacacctacaatagtacccaataaaataataaacacttaaatttattgaatgaatgaagcgtataaagtgtagtgcgtaagtcattgttaagagtgggggaataggaaaaagaaagaaacttggactgacagcctaaagactgtggagaaaattgagacccatccatgatgaacaaactatgatggacaacaggcaaagggaagaccactgataacacttgcgacgggggcagagataagggaaaggagaaatgaggatgtgtggcatctccactgaaactgtataaaaaatatttctatgacggtctaagcaaaagcacttcttaatcgtttaattggttcagcactatgtaaagggaagaacaaaacaagtcagcagcatctaagactcacaactcagtataacaaaccaacatggaacaaagctctggcaacatactgttctcttgcttctggatccatcttttcatcattctttttaatcaagttccagaattttcttagcttaggtgtcttttttaattctaattccaatcgtgcctgaaagaatgatgtggcattaaatcagccataaccccaatgtaagactataatatagagcaatgggataaaaccagatagaaacgtgacaaaagctggaacctaagaaactaatacccatactttaaaaaactagttcaattccattatctgtcaatagaaaaaaaaaaacaagacaaaagaaatttctcgttaagattttaagctcagtaataaattttctttcttatttctaaattttctttcttatttttaaaattcaggacttcagtttgaaaaatatgggcattaacatttaaagttcaaaagtcagtctgaaacaatgcatataaaacagctatcataataaggaaaggtccataccaccactcttt

SEQ ID NO: 52691 - DNA, 1522 bp, Bovine  19866881273683
ttcatcggcaggcagattctttaccactgagccccagggaagcccctggaacttttaaaatgttaattgtattatgaatcattctcattttatactgactcaaaagcattaattaaacatcatttggtatattccactctgatgtgagcataaaaatattgacatatgtatatagcttctaccttcgaggagtttaaaagctggaaagtgttttctcctcaaaactttcatcactgtactgaattataatccaatactgctgtttctcttgaacattaaacatacaaacattcattggaaacatttcagttttatgggtcatttgttcaataattgttggttaggtgtaagatactacttcagctactgccttgaagtagcttacattggtaaggcaaaaaaaagtagtatgtgaataattatgatgcaaaatagaagcaattaaatgacataattgtttaagcaacattgtctaattctcaaatttccaagaagatgaagagagccacccaaaatataaaaagtttcttcaagataatctattattgaattgcagatctgggaatttccttcccaaggagctcagttctcagtagtattatacttgctcctaaaggtgatgtaccatttgcatagctaattaaagcaggaaacatactgaaatgtcttaataaaatgctacccattagtggagaagggcagctactgtcaataaagtgattttgtgaacagtaagtaattcttgccacacaatcctgacataatggcttcatttactgcttgcaatcactccttctgtgctggcttttcaagttagaaactggtagatattcaatataaggattatcatcaaagtgtaattgctgaggaaaacccaagcagtcaaacaataatgaagtgtatccattcaaaaccaaggaaaccaatattaatcataaatacaatatgaaaactatagcatctgaaacagtgtgtagtgtttagtatagaacttgaaagcataaacttggggattggacagacagagttttaattctgcctcttccattcattttctttttattttaagaaagttgttttggctgtgctgggtctttattgctccacaggcttttctctagttgtggtgaatgggggctactctttagctgtggtgcacgggcttctgactgcagtggcttctcttgttgcacagcacgggctctagaacacaagctgaatagttgcggcacacgggcttagttgccttgtggcatgtgggatcttccccaaccagtgattgaacccgtgtctcctgcactgacaggcagattctttaccactgagccatttgttagctgcatagccaaagatttccctctctcatctgtattaacatcacaataaaagatggtagcaaatgctcttttctttcatattccccctttatgactcctaaaacagagaataactgtttctttaaaaacatgagtatttatcttgctttgtcttatagataggtgctttaggcttatctattgcc

SEQ ID NO: 52692 - DNA, 1239 bp, Bovine  19866881467189
tggtgggctacagtccatggggatgcaaagagttgaacatggctgactgactaataatttcattttcccttcatcaacagataggagtatggaggatgtgttcctcctcagtatctgatgtccctacagccattaacattgccccttcccccaaaactgagaaatccctccctccttgccgtgccttagtgctgacatacagagtttacattgagacttggcacagaggaaaatttaccatgaagatcattgtgaaggtgaagtgtcagagtccctcatgttcacagcatcttccaagctcttgggagggtccctaacatgtgtagcaatatcatgtacttctgcaaactttttaaaaatgtatgtccctattctcttacttaaaaaggatccctccacacaaatataagcttcccatcccattagaatttccagatttagcaaataaaacttcaagatcacagttaagtttgaattgaagataagctattgataatttttgattattccaaatattgcatggaacagagttatactaaaacactatttgttgttcatctgaaattttgcctagcagccagttttgtctatcagctgcccttcctccctcaaaactttgatcctctgctgtttggaccaaaaatgataagacaaaccttgcttttcccaaatcggataaagaattgtttagtttatgttgtaaactcttctccaactataatttgagactttgaaagtcagtcctgaccaatcttatgcaaccttattttttggcacatttttttgctacagaaacacagattaaaataatttcccaactttgtgggaaaatgagaaactctcctgttgtctggcgagagacaagagaactgtgaaatgtcactgttgggctttgagttgggatccagagtggagcatgtgtttttggaaaggaagctctgtaaatggctgcagaaagcagtagctagtgggggaggagagaatcctggctcaagaagatttgggtcacaataaaaagtactaggggctttcctggcggctcagcaataaagaatccacttgccaatgcagggaatgcaggttggatccctgggtcgggaagatcacctggagaggaagtggcaacccactccagtactcttgcctcggaaaccctgtggacagaggagcccggcaggctaaaatccttggggccacaaaagagtcagacaaaacttagcaactaaacgacaaggaagt

SEQ ID NO: 52693 - DNA, 873 bp, Bovine  19866881547994
acccctgatgctgggaaagattgagggcaggaggagaaggggatgacagaggatgagatggttggacagcattcatcatgatggacataagtttgagtaagctctgggagttggcgatggacagggatgcttggcgtgctgcagtccatggggttgcaaagagtcagacacgactgggcgactgaactgaactgagaggcatggaagagtctatgtattcaatcactcagttgtatccaacttactggggctccatggactgtgtagcctgccaggttcttctgtccatggaatttataatacaactttataaaatgaagcaaatttgttcagagcaagcatctaagtattgttctattatccattcatttcaaatatgtaataaaaaacagctatagttaaaataacctgaaatatttgttagcaaagaacaagtaaggtagatgccattcagaattctagacaatagaccatttatgacctgattgaccatcaataaagaagttagagatatatgagattccttttcaaaattcaattaatggttgagaatactcagcagagttgatcaggaatctcaaagctggtatgatttctgaataaatctggtgtatatcaattgagtagaaactatcaatatccactgcacaatggagattacattgtccagtgatacatgttccatcaatgccaataggagattaggccaaatgatgatacaatattttagaaagtcattactattgttttaaaaaatttcaaccgaattatctgttttaaccaaactagctagagaagtagctggtataaatagtcagctgcaatttttgttttcttaaaattctgctgtgtgtatagttcatcggaaaggaa

SEQ ID NO: 52694 - DNA, 829 bp, Bovine  19866881937190
cttgcattggcaggcagattctttacccactgaacccaccaggaagccctagtttaccatgtactgccagttaattagcaggcagatctagacactattggctttttttaaaaatcacaattgcactctgttagtcccgatgatccattatgaaatcttactatttctcacaagcatcggatttctctttcatgttttttaaatcctgcaatattcttttaaggtaagaaatatttgatacttttattccaaaaggactaaccaccttaaatcaaatattgagaaaaaattattattttagaacaaagatctgataagaacttttgatacaaaagttacattcacattgagaataaaaattgtcccaaacctggtctaaggcagaactttcttacatgatataattcacagcctcctctgggatgtaacaggtattgctgttaaaatgcttgagcaattttctgatagagctaaataagattaaggacctctgggaagccagggttacccacccagctgactggctagcctaataatctttaaccagacattatttttcccttgtatttggtttaataatgattaaccactcacttttcttacactgacagagtccttaaagggaatcttgaatcagcacattgaaaggtctcatcccttgtgactagctcgaaatagttttggcccagtctttgaactcatttgcttaagaagttgttttaacatcatttaggaagaaacatattttttttactgctttgtgtggctacaaattttcattgaaaggtagtaaatatatataaatttaaatttaaattaacggaaaatt

SEQ ID NO: 52695 - DNA, 1193 bp, Bovine  19866880506869
taaaaatttaccctgcaatgcaggagatctggggttcagtccctgggttgggaagatcctctggagaagagaatggcaactcatttcagtattcttgcctggagaatcccatggacagaggagcctgttgggctatagtccgtgggagcacacagttaaacacgactaacactttcactttcatgaataaacttttttgtttattttcacataacttatgaccattaccaagtcataaattaggaaaactcgacagtcacaaaattagtaagttctcaagtttgggtaaataattgaaaaatcattgatcctgaaattgtcaacacagcagcagctgtgtaagggttaacccgtttcccatgctttttctccatgaagatgaactaacaaggttttgttctcttctaaaaaagattatttcagagcgtaggatgctttattatgattatacactattagtgttctcaattctataaatatatgctttgaaatatagcagtgaggtagactttcagcaccttatcaaccaagaaaggaagtatgtacctaaattaccatcaccacactgacaatttgcaactttaaattattcacaaagttcaaaagaagttgatcccaactttatggaaaatttaatatgaaaagtaatgtttttatcttatcgcaaggaaatgtttccagttctaatactgaacacatactgaagaatgaaaatagcaaaatcccagagtgaaaaaaaaaaaaaaaatacaagtctcttttaacatttctgctctcagaagtgagcaggattaaaatgtatttccccaacaaccgttatttctcattaaaggaggggcacacacatgtgtatattaaagaaactatgagatcccccccacatacacacaccctttttcaacccctctgactggagaatgctcaagcaaagttatgactattccagttggtcagttctctagggaaatgcatgcaggcaaacactcatgcacacaatactagtgatatatgtctcaacctgcagtggacactggaaagtcctctgtatcaagtttccttaagataatcaaggccaggacttgcctggtggtccggtggttaagatttgcctaccaagcaggtggtcctgggttcaatccctgattagggagataagatcccacatgcctcagggccaaaaaactaaaatgtaa

SEQ ID NO: 52696 - DNA, 1352 bp, Bovine  19866880510613
tcttgtgattttaaaaatgatgaaaacgttcatctaaataataaacagcacctagaacctcccagattttctcaaacgtatctcttttaggaacagaaaaccccaggcaccgggaaaggaaaacattccaaaataacctgaagggcttgatgcttattaaatagcaagatggttcagtcgaaaaagctaatgatgccaaggagcgtcagattttctccagagcttcaaggtgaagacaaatagagctctcagcagcattacacataatgaaaaccatcaacaatttcctgcttcttctgtcttgcgctgatacttctgtcgtgcagattacccgaatttgattgcaggatttttctcccttgttgttgccaagaactataaacaccatgggatgtaataaagtggtgctctgggtcttttattgtcattattattctaactcagttttagaaattagatgtgactttactggctaagagcagagctcgccatcttttcacataaggtgtgccagtcagacacccccagtcatgtcacctcttattcatcagttttgcaaaggtgccctggggaaagagccatggcaagcagagagacacctgtaaaatgcattaaaaactcttctgagaatgatttttctctgggactgagccacatttactaggtgacaaacagccttctgggcattcattttatcagtcaagtatgctcgaaagctcagtattctcccacaactctcactaactgtacctccaccctgacatctttttattttaaacaatgtcagaattagctgaatggtcctagtcctaaggaaagggccaatgctgtacttgaaaagcactaaggtgtccccaagagatatataacccactctctaaccaggcatcctaaattgaattcaaactctgtcctgaattagctaaatattttgtataagttactaagccttgatttaattctctcctgtcaaaaagagcttataatacttccgagggtgacggtgagtataaaagagacaatgtcttttaaagtacttacataatgtttgttacttaatgagagcctagaagagtggttggtaagtagatatttgtatctgtatataaaacgtaggaacattagcaaaaggaaaaagaatgtctttgccatcaaaaccaagagttatatggccatgtaagtttaaaaaaatatacaggtttcaacatagggaaacagatttctttaccgaagatttccttaaacttgtattatactaacacacattaggaacccactagaaaaagctataattaaaaaaaaaaaaaaaaatggagcttcacggatgccaaccagtcagctaaaagagacac

SEQ ID NO: 52697 - DNA, 2559 bp, Bovine  19866880526459
tgtccgactctgtgcgaccccatagacggcagcccaccaggctcccctgtctctgggattctccaggcaagaacactggagtgggttgccatttccttctccaaagcatgaaagtgaaaagtgaaagtgaagtcactcagtcgtttctgacttagcgaccccacagattgcagcctagcaggctcctccatccatgggattttccaagcaagagtactggagtggggtgccattgccttctccgagcacctctatagccctcccttatcactgcatccttgtaatctgagatggtgtagagaacatcaaagggatcactggcctcaaagagctgagaggctagtggactgcaagagataggatttgaatgaggtcacagagtaagcagatcttctatctggagatcatgtgttgaacacagataataacaacaatgatgcttgcaagtgtcatatatcaagcaggttgtgctacctaaatggaaaccagtgagttccattcctatggaaattttctactttcagtgaaattgaagcttgatcccaacatgctggtatgatgtatacagtgagtaaagtgaagtcgctcagtcatgtccaactctttgcaaccctgtggactgtagcctatcagactcctccgtcgatgggattttccaggcaagagtgctgtagtggattgccatttccttctccaggggatcttcccgacctagggatcgaacccaggtctcccgcattgcaggcagacactttactgtctgaaccaccagggaagcctatcccattttaagtggacttaattatccaattgtgcctaccagtgcttcatgaaggttaggaagtcaataactcatggttgaatgaataatgtagcataataaagagaggtaaatagtttctgttatttcctaaagaaggaaatgtttttagggtttttctaaacttcaaaagtcagagtgagctgaagtcataagcttttagggtttcccaggtggcactagtggtaaagaacccacctaccaacgcaggatgtgtaagagaccagggtttgatccctgggtcgggaagaccccctagaggagggcgtggcaacccaccccaattttcttgcttggagaatcccatggatagaggagtctggtaggctacagtccatagggtcgtagagttggacatgactgaagcgagttagcactcacacgcaaatgtttgtttgtttttttttttaactttacatggcattttggttttctttatagattacattgttttacatgaagctttaaatatttttaaaaataagtttaaaaacagaaaaaaaaacccatttgaaaaagcaatagtgagcaattgagaatttgctgacagttgtatatacaggaaaggatttaaatcaagatcactaacgaataatatggtaaattcttatcagatctgtctggtcttgggagagtctctctttagccacactaaccattttcatgacccttgctgcctcccaccgcattttactttgaagagctgcttcctcttttaccttcgaacctggaaactaacctgagatgctactgttccccttaaaaagcatatcaaaatatcttacgcagtgaagctgttttccctacatttggatggcttcctcagttaccaggaaaaaaatcccttaaaactattacatcagcagaggtggctttgtctaggtttatatgcataggtggttacagctatatactagttgatgtctcctggttataaaactttacagcactgaaatattcaccttccacatcacactataattgccttttgagatattaatatttctctacctttgttgtttcttaattctccttaatatttataacaatctctccctgcctttccaaacctctgattctcttccttctgtagtaaaatgaatctatttccattaatttctctggatttctaattactttgtggttttaaatgcaaccctagatgttttaagaatttgcatcaaaagagtattgggaaagtatccaattcagggtagttatttttgtaatccatggggtgcatcttcctgcatctcctgaatcttcatatttcctccaccacattaacttggtatgccacttcaactctgtcctgttagcttctatttttttttttttttctttcaattagtgacagggagcagtgggtggtgaaatgctgggaaaacactcatggggtatgcatcacactgctctaacacagcagtgcaaagtggaaactgagaactaagcgagttaggtcaaagtagaaaataaaacaggtactgaatgaatgcagattcatgggtgacagaaggtacgggtttgtgcactaaagtagaggagcaagtgcctgagagactaaaaataataaatggaagaagttagaaggactaacatctcttccttaaatggctcttacagcaacagttattcttaaaatatctcctaaatgtctgtgttgcatttgcattaaatagagtcgtgactataagttgtatgattttcacatttgatatatgacactacctccagaaatt

SEQ ID NO: 52698 - DNA, 2653 bp, Bovine  19866880589947
aggatagcggatgacagaggatgagatggttggatggcatcactgatttgatggatgtgagtttaagcaagttccaggagttgctgatggacagggaagcctggtgtgctgcagtccatggggtcgcaaagagtcagacatgactcagcaactgaactgaacttaaaattggcagctgcagcagcacatgatttaaatccttgtagaagtagatggcaagttccagtgtatagttgacagaggtaaactggcggaaaagtactagaggatgttggagaatgggagattgatcaatgtgattagaccacttgtgtttgctacctggctcttacgagaatttgtctcctatcctcccacagagactgggagttagaggcttgggttctgactttgatgattacatttcagtaggagaattggctccctgggactttagaaagacttccttgggttgtgaaacaggaaggtgggagaagatttccatctcaaggaatggagaaagactttagaattctaaattgtctacagtaaattctctaggaaaagggatttcagggtcttatataggcaggaagaaacttaaagtttggtctgaggggaatattaagtctctcattcagtggatctgtaagcatcactgtataactgactgcaacttaaacataaggaaaactcactcatctgggttctctcttcattggttttcttagctggggcagtttattcttgtctgccaggttgaaatcctgtttgtccctttaaagcctagtcataggactttgtggcatagtggtaaagaatctgcctgccagtgcaggagacagatgctgtttgatccctgggttgggagatcccctggaggagaaaatggcagcctgctcccgtattcttgccttgaaatttccatgaacagagaagcctggtgggctacagtccatggggtcacaaagaatcagatgcaactgagcatgcacataagactttaagctacagcataaataaatacttttcatgctgttttggtcagcttgggaataggctctttcccttggacagatggcctctagggttcctctattaggaaagatcttactttttcacaaattaaagccaaaggaactgtatttttctgcaaatatgatattgacagaatctaacatctgctttataacagacagctgcaaacagtagctccacactaaatttaacctacccactaaatcttagctgtgttcctgaggaaacatgaataaaaccattgccttagctcatgcccaaagatgggaagtctagtaaagatgccaaaaatattttagtgttatttttatctttgacatttgaaagcaaaccacatttactgatgttttaacatctttactaattgccttcagtgtgctaaaaatctgacttttagcaattatctttcgtttagaaggtatttgtgctaattactgaattcagagtaacctatacaagaataaaatgaggctctatattattccaatcacatgccttcctattcttgtacaagtttgctcaagttccttaacttctattaagtttctccctgataaaatggaaataatggcagttcccacatagggttgttatgatgtttggggattggtgtatgttaaattcttgaaacatggtaagtgtccaaaaatgtatcattattgatatgaaatgttcatgtgcagtttgattatcagaagggcatgctcttgttttacaactgcaaggcaattttgaatatacccaaaggttttctgagctcagatcttgtcagtgaattttctgtattctttctcactttcttagaagaaaaaagaaatattttgaagctgccagtaccaagccatgacactaagttattcatttaagagtggaaggatcatatctatgacctcaaaactccaaagtcagaactcttcaagaggatacagagatgatgtgtatacttgatgcaggattaagcagcactaatacttggctaaatttttggtgaagtgaagtcgctcagttttgtctgattctttgcgacccgacggatggtagcctaccaggctccaccgtccataggattttccaggcaagaatactggagggggctgccatttccttctccagcggaccttcccaacgcagggattgaacctgtgtctcctgcattgcagacagacgctttactgtctgagccaccagggggtagtcagtgtcaaaccttgaatatctgtgatgggatgaagccaaagatgatattgggataactctagaagatttagtcattcatttgtgcatgcacaacatgcatttattttaaaaatatgtatgaagtgctttctattgctatctaacaagccctggacagttgttagaaataaacaggaataataataaactgattcttatttaaccctgctagtaccaagatatggttcaagtgttcatgttttaaaaacccatttactccttaatacttctcatgaagtaagtgttattgctgtcctcattttatagatgaaaacattaagacagaagttaaataacttatgcatggtaacattaagtagggaagtcaggtagtttggctccaaaacccatgcttttgagtaccactccatcctgttcttctcaagtaacagtaagcaaa

SEQ ID NO: 52699 - DNA, 2799 bp, Bovine  19866880604568
tcttgtgcgtctatgatattgtaccacagtgagaggagaaagtaaggtaaaatgtatgaaggcctagtgtgtcttataaggcattcttaaatgttccctttatatgctgcagtttcattgtaattaccttccttttatattttggtccattcacgttccatctttttgcagagcatacttgagacttagaaaatggtagcattgtgctatcagctaagagaggaaaatctgactgctggaagaaaaatagatatgtgtgtgtatatatgtacatggatatataaaagtatttactgaaaatgaaatatttttctctgtgaacaattttatagtgcataaacatttactactacaaatagggaattcttaatgttatgcataagtttacctgagggcattagcttctaatatataggcaaattttgctttttgtatttgcacttcactctgtttataaaataccttcctaattctgactgtcctttgtacctgccaagaagcacatttcttgagctggtgaagatacattatttactctgagataattcattactgatagtgttgccaggagtctcctatatcctcaaaatgtcttatattttaaaagcagcagcttgttctaggcagagagtaaatggactttcaatttaagctttcctttttcataaatggccaaatgcatctgctgttttggtggttaaacttgaaagcacacttttatattaactttagggggtttttttaaagttgatttttactttaggagcttaccttttacagtttatatcaccagtccgtaaaactcagcagaggcatagatagcttgcttattcacattaataaaaagaaatacttctgcgtatttgccagcagattaaaattggaagctgttgattaaacacatatttcagtgcatctcagctgtgatgttttcttatgggaatcctttctcaccaaagaatactctcacacatacttatgtggcttccggaatgaattagcacttcttgatcaaattaactaaacgtgttttcaaataccaccttacatcatgatgatgtgctttgttggtgaagcatagtgagactcagaaagaagaactggggacttgggaactggaggaagagattaccttcatttcaggagagacttcacaccaaaaaccccagcagaggtccagggctcctggtctcatagcttgagaagtcaggtaaccagagagaaggaagaacagtgaaatagcagtaccctgaacaaaggcatggggtggggtggattttctaggagctcttttttaagatgctgttatggatgctgctgctgctgctgctaagtcgcatcagtcgtgtccgactctgtgtgaccccatagacggcagcccaccaggctcccccgtccctgggattctccaggcaagaacactggagtgggttgccatttccttctccaatgcacgaaagtaaaaagcgaaagtgaagtcgctcagtcgtgtcccactcctagcagcctaccaggctcctctgtccatgggattttccaggcaaaagtactggagttgggtgccatcgcctttgactaatacaaagtagatgacacttgtactgggtaaaggagatcaacattttttatttcaaacaattccaaacatttagagaagttgcaaatgcaatataaagaaattatttttattttcctgagccatttgagggtacttggttaatctgataactgatcacacccaaatactttcacatgtatttcctataaacaaggacattctcctacataaccacaaaagagccatcaaaatcagaaaattaacactgacatattacaagctcctaatcaagggaccaacttaagtttcaccaactgttcaaataatgttctttatagcaaaaggatccagtccaggccatgtgccatattttgttgtcatgcttttagtctgcaataattcttccttccttgattttcatgaccttgaagcttctgaaattattttgcaaaatgtccctcagtttggatctttctgacattttttcataatctgtttcaggttttgcatttttggcaataatactgcagaagtgatgctgtgttctcaccatatactagctggcaacatgtgattttgatttgccccattacttatagtgttctcttgggtctcttgattaagctggtgtctgctacacttcatcatataaggaactgctgtcccctttgtaattaatagtacctctgggggtggtactttggaattatggaaatatcctgttccttaatatccaattttttcacctacttatttttatagattcatctgtagattaagggtttcattctttactcactgagttataatctattattgtcattatttattttgctgagggtcaatgagaccccctttaagttggcttccatgatctttcattaaacttccatcatgttttgatcatttcatttttttttgactgaagaagatattctaggttcaccttgttctttccccgtcctaacactgggattatccatttctccaaggaacccaggcctctctcagtaaagaaaggtgtttagatgccaaaatccatgttctagatgggctcattgcttctgtggtattgctgctcccaggtgctttcaattgtgagagctaagaaatgtatgtattctgtatttacatgtctgtatatatatctatatctttatatctatatctatatatatatatctgtctatctgtctatctatccatcttcctacctatctgcttacctacctacttatgta

SEQ ID NO: 52700 - DNA, 886 bp, Bovine  19866880605372
acatttataatttatgggaacaatttgacccgataaaattcttggtgcccttatccactataatttcatctgaacacagtctatgttaatatcagtttagactttaacctccctatttcacttacttgttgctgttttaaatgcagccctgcccagtttctgggcaaggcatctgatttaaagattattagccaggactttctttttcttggattaataagtcatttatagagctaaaacacttttgagttaagttagttctcctgagaacttccaggtttaataactgcctaactatacgcaggactttatataagatggaaaggatgtatgtatgtatgatacagtgcctgaccttagaagccttctatatgtctgtcaaattatatcattacatccaacaaagattcaatgagcattaactacaaataggacaaaattgcatgagatggtctgtccctgcttttaagatgattaggatttttctccaaaaagtttgaaatttctagtgaagtaataaaattcatagaatattacaagtctttgtggttctaaatgaatatagtaatgtacacttttgtctcatcttctcaactggaaagtcttttaagtgaatgactgtgtgacataccttttttatatttcaagtgtcaagcctaatccagacagatattcccaaggagcctacacaactgctgtgggatacagacattaaacagtgttccttttccccccaatagagtgtgataagtgctaaaatagagatgttatcagataccaaagaaggataaggaaagaataactcatctggaagaagtttaagaaatgctagttgaataaagaacaaaaatgctaaagggaagtagctgaaatttaagagcttaaa

SEQ ID NO: 52701 - DNA, 1401 bp, Bovine  19866880637038
aatcccccgcattgcaacctgagagtcccccctcttgccacaactacagaaaagcccatggagcaaccaaggccaagcacagagaataaataaataaaatttatttttttaagtgaaaaataaaattattggcttaaaaaaaaagtcaagtttcaatgaaagtagaaacgatagctataaaaagctactcacagcaaaaatcagtatttcacaagagtggatgcctgtccaaacatttttatgttcccaattctagagatttctaaaaatcttataagtattccttttgaagacatcaaggatacaatgtacacagggtttaagggtctcttgtaataccacatatttcacttagattcaataaaccctccaagttaatgaaatggaaagaaaccacacttcttacataaaacaggagttaaatgcatttatgtaagttaggaaaaaattgcatgtaagtgtccatcaactatgaagattgtatctccctaagcctcaagacagctcttatgaaatctgagcttcacaactgccagcataaactcccctgggcagaagaaaagccacagattagattgtggtttacctgagttttcccttgagaaatgttagaccatatttctaatgaattaccaaagctaaagaagcaacagttttacatagctgctccctctctgtgttaatgtgggcatgctggcaggataaagaaaatcagatgaagatatatatttcttaatcctaaactgaggtatctattttactgaaaacacaactctttgtggtggaagtttaactaacggcaaaaatgtattcaaccttttctcaagaaattaaatgagaaacactagtgactcaatcaaactcatgttcactcaaagccaaggcaaattttcaaaatcactacaaaaataagattctggagcatttcttgtagacaaatcccagcaaaaaaattcagaagcaactaggtttgctattgataatctcaatctctcaatgtttccctttatcaaagaagttgcagactgtatggtatttccaaccccaatagtgaaaagcctttttctgtgggaaattataagcaatgggttcccaagaaattttaaacttcccattctctgtgctacctctatatccaatctctaggccatctctttgtttgaggctctgcagcttccaaaccacttacaagtcaaagaagacgactgtgaagactaaatgagatgatgtatgaaacctgcctaccacagtgttcagctccgattagattctagataaatagcaaagttcaatctcttacccagttcccacccagtattttcatttccacattgctttataaagtactttgatgcaaagttttgtttttgaaaattacttcctccacagcaggaaactttg

SEQ ID NO: 52702 - DNA, 2326 bp, Bovine  19866880775873
tgcagcctcgggacactgtgtgtccattttgggtttattttcctggaaggagccagtatgtgtttgggaacaatgagttaatgcaattcaactaaaagcacattggggagaatttaatataatataaagcagaatgaataagggaattgtttagaattaggaaaattgtgggccctgaaccaatgtgacaagggagggtactctgtgtgaagcagatctttcagtttaggaatctggaatctcaccaaaatggaaaagttgatgaatagctgtgattaaacaatgaagttagacaataaatttaggaatatattaacaaattgggtccagtgtaagagttaaaagtacatccttctctgatccctttacactgtagtgaaacagtagtgagagcttagacagcttatacatgcaggttcagtcatgtctgactctctgagaccccatggacagtagcccgccaggcttctccatccatgggacttcccaggcaagaacactggagtgggttgccatttccttctccaggtgatctacctgactcagggatcaaacccacgtctcctgcgtctcctacactgcaggcggattctttaccactgtgccacctgggaagccaagacaccttatacttaaccagcttttcttgacttactataaagttaatgcgtaaggttcccagggagagcctttggtagtcctgtgatctccaccaatttgtcggatgcctccaaggacaagctgctccaaggaagagcaaagagtcatataatggatggagtttattgaactccacacaagcactagaaagcaacctcgtcttacatggataccttaaaactgccccataaccagaattttctatgggaaggaagagatgaagggccatcgacctacatggcttgtttttttctgtttgttttttatcagcattagatacaggctaagagctactaccaattcttctataaatatacaaacattattaagacagaactttacaaaccggctctaaatgtcaaagttgttattagtcagcaacagtgttcttcctgcaaagtgaatttattctttcaaagccatgaacacaaagttcatatttaaaggcaaacccaaacaaccatcacaaaaaaacaacagatttttaaataaattcaattgttatgaggcatttgcatctgttgactcagtagtagcaaaataatggacttcttccagatgaatgagctacagaaaacaagttctgttcacagcatatgcaggaaatcattgtgcacagagtaaagaaaagaagaaaaaagaaactgttcttgcaaactaatgtatgcaaaggagaaactatacgtggatccctgatgttccaaaataaagatattcatcctaggcagctatacagagaagcatacttccttaaacttaacacaaaggcagcatcaaaagaaggaaagaggaaattgtgttttcatacacaccgaggaaaccagaattgaaagagacacgtgtaccccaatgttcatcacagcactgtttataatagccaggacatggaagcaacctagatgtccatcagcagacgaatggataagaaagctatagtacatatatacaatggagtattactcagccattaaaaagaatacatttgaatcagttctaatgaggtggatgaaactggagcctattatacagagtgaagtaagtcagaaagaaaaacaccaatacagtattataatgcatatatagggaatttagaaagatggtaatgatgaccctgtatgtgagacagcaaaagagacacagatgtatagaacagtcttttggactccatgggggagggcaagggtgggatgatttgggagaatggcagtgaaacatgtatattatcgtgtgtgaaatgtatcaccagtccagattcgatgcatgagacagggtgcttggggctggtgcactgggatgacccagagggatgggatggggagggaggtaagaggcagggttcaggatggggaacacatgtacactcgtggtggattcatgtcaatgtatggcaaaaccaatacaatattgtaaagtaattagcctcaaattaaaataaataaatttatattttaaaaaatgaagcatgcttatttggtaatctacccagtttttccctctcttctcatggtaaatgactttggacttaactttctagaccccgcaaattatttgggagaattctggaaaaaggccttgtcatggaaactttctcagagttgattctagatgaagactcaggctaaactccaatacttggccacctcatggaagagtgactcatggaaaa

SEQ ID NO: 52703 - DNA, 1563 bp, Bovine  19866880776609
gttgccatttccttctccaatgcatgaaagtgaaaagtgaagtcgctcagtcgtgtccgactcttagggaccccatggactgcagcctaccaagctcctccatccatgggattttccaggcaagagtactggagtggggtgccattgccttctccggagctcttgtctaacactcagataatactcagaattgaattgtctgaggagacatatgtgctgacaaagcaagagattttattgggaaagggttcccagtggagagcagtagggtaatggaactcaggagaactactctgccgtgtggctcacagccttggattttatggtgatgggattagttttggggttgtctttagccaatcattctactcagagtccttcctggtggtgcatgccttgttcagccaagatgttgccagggagaaggattctgggaggtggttggacacgtggtgtctccttttgatctttccggaactcttccggttggtggtggcttgttagtcccgtgttctttaccaggacctcctgtcatgaaacacaactcatgcaaacagttactatggtgcctggccagggtaggcggtttcagtcctgtgcttcccctaacaccatctctttatataattagcattttcattttcctggttagttagggaagtgagtactgaccaggagggtttctaacagtacaggatgactctaggagcaatctttctgcctcttttcagactctagagaaagagaacttctaagaggcttgccaaattaacagtgatgtgttaaggaagatttagaaaacaactgagttggcacttgagttggagacatctttacatttaaaaatatttccatcattagccaataagctgctggatagtcttatctaatagtattactaacaattatctttaggtacacaggctctatcagaaatgtgccaggaattttgcatatattctttcctgtcctcaagtagggataagattcattttacatagagagattaatgtccacagagggtatgaaatttgcacccaattatgcagtggctgagccaggcctggaggtgaagtttgtttattgctccagttcttcattggctatctattttgtgtttgggaataaaggtggtggttttgaaatgatctttgcttgctctaggcatgttttaggagcaaacctacttctgtgacacatgttaagaatttagaaaacagttcaaagattttacttaatttggaaaacagatgaaagtcttgtttgctattattgacttcatatttaacatcagttcagttcagtcactcagtcatgtctgactccttgcgaccccatgaattgcagcacgccaggccttcctgtccatcaccaacccctggagtccactcaaactcacatctatcaagtcagtgatgccctccagccatctcatcctctgtcgtccccttctccccctgtccccaatccctcccagcatcagagtcttttccaatgagtcaactcttcacatgaggtggccaaagtattggagtttcagcctgagtcttcatctagaatcaa

SEQ ID NO: 52704 - DNA, 3908 bp, Bovine  19866880806801
agaactgtttattcctttatattaacttttgttaacactgtgacaaactgtttttgagcactgatcatgtctgtgtacaaatttgtgtgtatggatatgtgtgtattggcacttgagaacttgataaaaagcaataaagagcagtaagttacatgccctaaaacatttatttgaaaaacaaatcagcacattcatcagattgaaaatggtgaatttaaaacctacactttttctgaaatgctctccctatttgggctcaacaaaaatacttttatttatttatttattttaattttattttatttttaaactttacaatattgtattagttttgccaaatatcgaaatgaatccgccacaggtatacatgtgttccccatcctacttttaaatcattgtaattttatttttaacacagtagccactctataaaattaatcttttatttttataaatatctgatggaaatgtttttagttattggctgtctttgctactgagcctttaacaagtcttttcattcttcatgttttgggggtgaagggggggtcacacctatcaattcaagagaaggtcagtaggctggatccagaatatttatttgctccaagtatctgaaatctaaaggtaggatagcatcgaataccacagaaatcctgccatgggggtgagtcagcatcacttttcttgaccactgaactgacagcaaacagagatcagaaatgactccctatgtggtaatttgttcgtgttctctcctgcttctaatatgtgttggtttgaaagcacatttgtaaaggacatgaaggaaaagcacacaacagttcaaaaacttacagctggctggctgataatctctttcccttgtatttttaaatatgtaggtaagccaaaatactgagtttccccagaaaatactcaaaacgtcggaagcagcataaacagcaccaccttcaacctaccagcaaacaccagctgtcacgtacccacgatcacacaactgtctgcccgcctccctttgataactgccacaaacacatctttcaagacaatgctgtcagaaagctgagagctgcctttgtgctccttcccactggctgctaagagaacaaaaacgtatactcctatttcgtttgcttttcccttttcagaaaggcttcaagaaaaagtccaagtatggaacaacattcaccattaagacccaaagagcaatacaaagtaagaattgccctcagattaaacaaagatcctccatgttttgttttgtacaaatcgtatcttaaaatctgaaaaaaaaaagtctgtttcaacttcaagaaaaaatatggtctactaattatagagaaaggggggaacaataaaaatagcgacaaactgaaggagcttggggtcgcctaattcaacacacgtcctcttgtgtagagagtcttagcacacagtaagcacacaataaatccacagtggatctatggaacgtgcagccaagagcactgaggcccagacttatccagggtcacgtagccacgaagcatcagtcagtctctaacattcagtccattgctggctccatcatgtaagccaagattcatctttctcggcagccttactttccccaggtctaaaatgtgataagcaatttgaagatttatatggcccaacatatgggtttactcttattgcttgcctctcaccaatgacgaagaaggtacttgtcatttcttacaagaaaacaaataaatattggaatgaatgacttcaagcctatttaacaagatgactaccctaaattcctcataaatcacatatacatcacagcacacaaatattctactgtagttatctaacatgggctgtgccccctttatctatatatgtctgtgtccaagctttataactggagctacagtgaagctcgcagagaaattacagagaatccctctaatgaatttatagtctggtcttcaattgtgaaaaactaccgaaggaaaagaaattcaccagtctcctctatcaatttaccttgacttgacatctctctaaatacattagaaaaatggatctttcagcttctggtccatgtgaaatatggttccacccctccatccctccttctctcctcattccttccatttacctatctactcagtgtttagttgtggagctcctactccatgtcatgaacactattagattttaggaccttgttatggaaaatccatggacacaggaacctggctggctacagtccataaggttgcacagagtaggacatgactgaagcaacttagcatagcattcaaagtgtggattagcagcagcagcatcagaaccaaacagaacctgccttttaacaagacccccagtgaaccatgctcaaattaaaattgaggaagtaccatgaagacatggtccccatccttgagatttacaaaacctgtcaggaaacagacagggccagagcctgcctgaacagagcagctggacacaatttttttttttttttatgaagcggatagctcaatacactgtttaaaaaaaaaaaaagtatttattgaattagttaccatattgcttctgttttatcatttggttttttggtgctgaagcatatgggaccatgggttgaacctgcatgcccttaacttgaaggtgaagtcctgaccactagactgccaggcaaggccctagacactttttaaaaggtactgatccccatatggctgaagggtggtgggcacgtgacgtggcaaatagaggcattttcatgcaaattagaaaaaggagcctcttcctccaggcagtctcatccacatgcctggactcagggctgcaggaagcagcatgcaggccagattcaagtaactgagtgacttgtgcaactagaagtattgtacagtgtgtccctgagatagtcatttttttgtctttcttcctcccttccttctcttctctttctctccctgtcttgttctctttctgtctttcaagagagactgacagcccccattcccagcagacccaaaggaatagattgtatattattccaggaagaatgaagattaactatagacaaaagaagatactataggaactgcccaacttacacaatgatcaggttttcaggtttgtttacaggaagatgatacaagaagcaatggaagaaatgtaagaagttaaaaaaaaacagagcagagatatttaagggaaacccctcagagtgtctaagcaagaggtaatgaagccctggaagactgtgaaggtcaccaaggagcaagactggaaggctctctggacgaatgagtgggagtgggaagtggaagagtggatatttctaatccaggaaaccacatgtacaatgagtcaagagtacaagccatgatctcccaccagggcagataatcccttctgctgggagtatcaggttgaatgtgtcaagcagaagcctgcaataaagatggaaatccaggagcctgtgctgctctgcgtgggagagggcatatgagtgtccaagaggagcccctccctgaggtcggaggtcctgcagaggcactccaacacactgaacacccacgcaatgaatcaacggcacaaagcaatagctagacttccattttcctcatgcattcaacccttcctcctgcaatcacggccacaaaatggcctgtttatgtaaataatctgggaactgctgaatggcagaaaaagagagcagagagcacacagcaaatggccagagtcagtctgggtttggaattctggatgtttcactttctaaatacgaccttgggcaaagtgcttctctctaactgtcttcctgcctgtgcaatggagggtagcagtctgatgttcctgtctggttgtcaaagataggatgaccacatttccccgtgtttccaggacagtctttt

SEQ ID NO: 52705 - DNA, 1154 bp, Bovine  19866880889283
tgatttgctttaagaattgaatgagctggtactcagattattctaagtcacttttccttagaatattaggtttcttcatttgtttgtattttaaggcattcattttggggaagttaagatgtaacatagtttttctaagaaagtatttgttttattcaattttcagcctttgatgaaatgccaggaaatcaagtagcacaggcggactggagttaaccacaatggaataacatccactacagtcctactgggattaaccaaatcatctcacaattaagtgggtcagttaattatgcacagtcagtgaaaatgatagcaacactcctacctccaagaacttcactttagttgactcctgactgattgaacacacacttcttattttgttaatcagaattaataaaaaaatagatatattgctttacctgaaattttcacttctgttaaactctttgaaaagtattcacaatgtattatgaacaaaatatttagaatcttttcagttaaaatgacttacagagaaaaattcatcatccaggacggactagaagaaatgattcctagtgagaatgcatatgttcaagtacagtgacattgttctacaataacagtatgaagaaagtcaagcactaagctatgcacaaaggaaatataataacacaaagccttctttatgttactatgtatcatctgttttaaggtaactaataagatgaacaaaatacagtcaggtggcagcctagcaactttcaaaatagtattaaaggttaacaatgaagtttgctaaaggaaagctacaagacattattggttatgctccaaaagtgggaccattgtttatgaatataactagcaactgcatgttataattggtgacaattaccaccagttttcaactaagaattctcagctgcagtctcttttagcttctctgccagaaattgactgattggacctcaaagtccataaacacagatctgtatccaagcaggcatgtagtcctttccctctgtaattatggcatctttcctttaatagaggaacaaaaaaattaacaatgcttggtctccagagggaggaggctgctaaaattctgaatacagcatgcttttcaccttcagagttctagaccgagactgacagctttaaaaata

SEQ ID NO: 52706 - DNA, 982 bp, Bovine  19866880910795
aaaagttttatattagatcctagcatcaaattcctctaactgcatgagtcaactacactggcttttaacatctaaaaaatttgtaccacattcaaatctctctctcatattattcagaaaataaattacaggaaaagcactaaaatggtttcctcttaacctaattatgaaaagtgacttactatggcacacttaatacacttagtcacatgttaaaatgagcacagaaaaggaagtcaacaaggagagaagagctgtaatagccggtatcacaaagtatcaaggaaagcacttgaaaatgattcataaagctttcaaagcagacaaatggttccatatatgccattacccataagagcaactatttccacttctgacagcttggaggtacaggaagctgctcattgaggatgtcggcaattatttgtttgattctgtggtacctgctccactaaaccaatcaaagagaaacccaaggtagttgcagttagaaatcaattctttttgctgcttcattttaaatgtgttattggctaaggtgttggtattgaatgatgctgtagctaggtgtttcactgcatttagattcttgaattaaaattctgcttctaagtcactacaattacatacctcagtttacttgcatattctgaaatgttatgccttatcaggactctctgtccccctaaattggggatttcctcagacctcacattttgtaattgggaaagtgacttctctgataatttaactagttgttagtaatgaaagctaaacagagaactggagcttacaggtgatttacatccaggacataattaattgtccatgagagaattattttctataatgtttatttaacatgtaccatactcccttgtatgtttaaatattctttttgttatcatattatatctttccagtctgtgcttaggggccattggtactattttccagtgctccaccacagcaactaacgtta

SEQ ID NO: 52707 - DNA, 1489 bp, Bovine  19866881090632
aggctgcatatggctcttgaaagttgtttggcatgtaagttgttttaaggtttttataaattttgttttttgatgccattagcagaggcaggcagtcttgtgtcccttcaggtcttgttgtgcaccaaccctccccttgcacgcttatttaactgcctggccagataggtataagagtgttatactttgaatcaataatccacatgttgaaaatttcattaaagcattctccaggatatgaataaattttctagtgaaaatgagatgtttattttaaatagtgtatattatttttttaattaattatttttgaattaattttttcaagcttggccatttagagttgtacaacatataatatagttatactttctttgttataggaattttttggtaaataactagaaagttctcactgttgaaaatttctttatacaattcatattcattctgtgtcttattagaattgaaagttccttttctttggttctggttttagtaagatcacttatattcaagcattaaaacaacttaatttccataattcttttccctgtgagggagttttgcattttatctatctaagagtcattttcagaatagtgtgtatttatctttttaatgtttgcagttaaatggagccaaagaatatatatctttattgtctaattaaatgttgtttcaaacaaggcagagctcaatgttgatagtaatatttctctgtggtttaaaaaaccatttcttatgactaaacagatctttattagatttcttaaagagttaatttcataccaaagtgtcttatgtcttagcttggccccctaaaggccataaacaccctagaaaattccattatttcacaaaagaatatattttggcagagtttccctgggcttctaataccagagagctaaactataaaaaatttaagtatatataagttctttgtaacataaccattaaggttaaaatatgtgccccattcttatggggctgttacatatcctgcttagcttctttctctaacttatgagcttcctttttctataatgctaattttactgcatcatgaacacagtttatgcccccaaagtatattaatatctatggaaaagtataagtctgggatttttatcttaaattcagtctttcagaaatcatttcttggttctgattcagccatatttagtttttaacttcactaaaagcagtaagcttctcacacctactcttcccacccccattccacttgtcagatgaaatcatcacacactgattttatgaaatctctttctaccccactgttttcttcattgtacaaaataaaattacattctgagttgaaggagaaacttggtacagattttccatgttttgtagccttaggtagttctttttcattgttaactggtagtaacctgaattatgaaaaatgtgtgctttttaacagttatggaaaatgctaagcgggaagatgcttccatgcaat

SEQ ID NO: 52708 - DNA, 1094 bp, Bovine  19866881097886
tagtatactacatgagggctttttgaaaatatgagtaatataagctttaattagcttttctttaaaaagtctatgtcatcaaagtgaaattatgtgaccaagatgtggttacttcctatgaaagaaaaaaaaaaaaaatcccttttacagaatcaggaagcttcaccctcagatagggcatgactctgctcaggacttcctccttatccccagaaaatgcagattatatgatactcttctatatgtctaaggctcttcattcttaagccgcctgtagtgagtcctggtgtctaggataacataggtctcaggcagagccagtctaccaagaagaaaaataaaataagcaaatttggcacttcagcctttaatcaagcactcttatcttgttctctgttctccacatgtgtggctgaatgtttattctctcctcagcaaaagatagtcttaaaaactgagtaatacatcaaggtatcattgaaattccaggatgaatttaattccatggttaaattcttctggttaaatttgcattttaattattatctttgaatttttcccactgcaggtatgaatttcgagtattaattttagtcaatagtaacccgtccataaccaacactttctgaatcaaaaagcaaaatgaatgttagaaaaataatgggagagacatacgttttaggtgctacttgtcattaatatactatttactccaaattataaatatttggagtatccaaatataaattataagtatgtataatgaaattatatgtatttatgaggttttattttcctctttcataaaatagagtaatagtttaagcctcttccacagaattttgtaataaaattcaggaatcacagaaacttttgtcagtctccttattttatccttcccaagttaatgatttcttcctttgtactgcattccccctctttagttgaagatcttctctccgctcttaaattatctttagcaattgaagtgtcaagctcaattttcacattccaatcatagatagcactcttaagcaaagaaaaacaaaaaataaacaggattcatgaataacacacccacattattccaacac

SEQ ID NO: 52709 - DNA, 1245 bp, Bovine  19866881113909
atttaatggttctgctgcatcgtcagtgatatggcttcttattcctgctataattctacagctttttattttattgttttgtaatgttttcaagtttaaattaaatcatttcatagcaatatagtttttaaaacaaaagcatatatttaatgaaaaaaaatgaatgcatcatgtttgttagtcaattttaatattgtaggtttgacttaaaatgtttgtggacatttaccatccaccaggggcacaatagtgaatcacgttgacactcaaaaccagagaacacatctgcttaagaagcctccccatcctaaaatttaatcattattttaggactgtgatcaaagacaatgatttaatacatatagctacaaaggtcagtttgcttatcactccagaaatatgacttttcatttcagttatataattgttttcatcagtattaattttgctcattatgactttagattttcttgtatgtatacatagaatgaatcaatggctattaatgcattagcaaaaggggaattgctcagttacatagattttatgtcaatgtcatcagtttgcttgaaatagaaaccagtagattctaacaatggttccattttttaaaatccaattcatggaagaaagtaaagctttcagaagttaaatctgtcaaaagtgacattattaaaaagagatatgactttatttagtagttaaaatggtgttaaaagagtttcttgtgtgttgataatatgaatagagatttcagtagctcagaacattatagtgaaaaaagggttattaataaattaaagtgtttatggaacagaaatcaccttgaaattgtttgaggtgtataatgcatccaagtaagtggaaatgcactaccaatcttcatacaagcaaaacgttaaaatctgtaagtcacgttatgtatgtaactggacttcaaattgtttcctgagaaagccatattgtataaatacttcagcatgactttgtttctctctccatcatcaggaaaattttagaaatactaaatctttggagaatatttaaatttcagtctaaatgttctacaatagtgtagaccattactacaaaataaaatttggttacattttaaaaacaagttaaaggtctttaataaaagtactcaacagatggagcaccaaaaatttaactttatcaagttgaattttgaagacaaagcttgcaaacagagcaattaaatacatcccggacagcaagagagga

SEQ ID NO: 52710 - DNA, 1648 bp, Bovine  19866881164559
tccctgctacttttgttggccttcccatccttgcagatcttgttactcacttaggatagagtcatctgcttttagacaagtgtttcttgttcacagtgtaagccagtgtgcacctgttcttaaaatactcccttgtcttagtctagatgtcccagtatggcaaatatatctcatatttgtataatttaattgaagatgacagttttgggtgggtctcatggagttgggaatacatttaaaaaaaaaaaaaaaaaccttttctccattatctttaactgaaagaccaaaacagtttttaaaaggttgaattgacatgattaaagctctctcctaataattgtcattgatataaattacagagatgttcaaaatatagaatcagcagaatttgctgatacacagaatatagaatccaaggaaatgagaggaatcaaagactatcattacattttcttgacttgagatactaggatgacgatggtgtcagtcttttgatgttaaagataggaaaaccaggctgccatggagagtgtattagaggttctctcctgatgtattatcactgaggaaagcctgatatatccaaggggaaatttcaaatatccttttacatatgagtctggagcttggggaagaggtggattagcctaaagtagattagcctaaatacagtaattacagcctgaaagatggataaatggaggttatataaatagtgaagaatagaagccaagctctgagatattcttatttataaatcaagtactggagaaagaggaaagcaggctgaggttggagggaaaacaaagagagtacagtgtctctaaagggaagaggtagtatggtttcaaggagaggatagtcaatagtattaaatgagtctgaaaggtggagtagaatgaagaaagggagttggatttggcaacatggaactcactagtgaccctgacaaaagcagtttcagtgtgtttttggtaagaagccagattgcaggagcttgaattaatgagatagatggaagtgaggaagcagagggaaagtagataacatttttaagaggtttatctgtgattggcagttgataaataggtggtaagttgtgacatcaagctttgctgtttatttggttttaatatgaaagttactagagcatgtttgtgttctactagaaatgacacatagaggggaagagattaatcatgcaagagagggatggatgaatggcattgtgtagtctttgaaagacaagagggaatttgatccagagcaaaattctgtcagtggacagaagcacagtcagatcatttgctgaaagaggatagaagagaaaatatggatgttactgttagaagtttcttaaatgtgatgatggtaagatgaaatttctttttgatggcttctgcttctctgtgaaatttgagaggaggtcatcaggttgctgagggagaaccattctgtgagccttgaaacaataaagatgttagaaaccctctcatggttacaacctcaaaccaactgccctgttaaacttgttatatttaaatgattattttatattcagtgatttttctggaaaatagttaataaaactataaagcaagactaaatgcttactgacacattgctatgagttagtgcctcctagtgt

SEQ ID NO: 52711 - DNA, 1647 bp, Bovine  19866881186277
ctcttcattaatgaagccccacctaatgactcacctgaacacagaagcatcacagcactcctacttcatggacacttagctaaagaatcactttagcaaagtgctttgcccatggtaatctagggaataaaatttcacttccatgaaaagaaaaggcacagttctccattttaaggtttcatgtggagaaaggaaattgatggtaatttgcaaaaatactgctggaaagtatcatactttgcagcatatgcttacctgttccaatccaccctctcaatatacagagcaagagctgaaagtcaatgtggatcattgctattaacacaggtagtaatcctgggtgagcttggaattgtctacttagaacaacctggtttaatgataagacatcttagcaaattctgattgtttccggtaagtatatttgcatttaaaacactgtaaatgccctaagtcatatatgttgaaaacagagctgaagtatcagttattaatgcctgagaatttcaaggaaacacaacagtgtttccaaggaaaaggatctggaaacatcagtattccacagatgtacggaatatgtgacactagatgagttgtttactcccagctctgtcattctctggccatgagatctcaaggggatttctttgggcttcagtttcattggctatagactaaagtagtttggaagcctctgtttccaacattctttccagcacccgagttccatgcctgcatgcttccctagtgtagagattaccaacatacgacacatcttccaggctcctctgcattcttgaggcacatcaacaccatcactcttccattcccaccaagtccttatgttccaccaagaagcttcctatactggcatctttttgcttctttatcacacccctctggagggtttctgcgttctccttgacctgctcccctctagtttcacttgagagacaaggagctgctaggaaggggagggacacactgtaagaattagaatgctctcttttctcttctcaaccctctcctccatcctccaaaaggtagtccatctccccaggacaaatgatccatataaactgcaaaaatataacaccagtcagtcaatacttctgtttttagcacagtgaattcttcagtcaaaccattcaaactagagctgaaagatgatttcccacttagggtaggttagtcaattccctcatgatactcctgagcgagttttcaggagaaccaattttaaataagtttggcttcaacagtcacagtggatcacctgacctttacctgctactgctgcctgcaggctgacattcctccaagtggcacacagatgggctttgtgcaaccctaggcaatccatggaggtagcaaatgctccatttcaggaagaatgatggagtgaaatcaggatgcaccactcggcaccagccaaccgcccacagaggtggaataattcatcacagccaattacagtgattgttccatcaggataaagaaaagcatgtgccaatgaactttctaacaggattaatactgcccgggaatcttccttctctttaattcatatgaactcctgtttagtccataggaacaaacattccagaagaatcaaacacggatataaaaaggacaaacttatttcaa

SEQ ID NO: 52712 - DNA, 861 bp, Bovine  19866881210691
catgctacatagcacatttatgttttaaattatacctttaatagtataaatgtatttataaaattcaaattgatttggtgacatcctgaaccccctctagagacactccatccatctgaatcataaatttataagaaaagagttacccataaaaatactgaaataaataaaatatagtttctaattagtctggtgagggtaaatatactaaagttcccattctccactagctattttgaatgtagcttaacacctggtttgctctatttccccctaaacaaatgtattagttactatgttagcatagtcagagactttccaagaaatttagcttcataataccaactaaaatagttctcttgagagaatgagccataaaatcacttttgtaaaagcatacaagttattttttgtacaattaaatttatctagaacctacagggcaaggggtaactcaaatttgtttttttttaaattttttttggcatcaaaaccaacacaagaggtgacaagtcaaggccttaaaataatcatgttgatatttcaatgacagccttatccataggagaatacattttattttccaaatccactaatgtaaattcagcctttaccaaattaagaacattttaatctcctcacagtacactctgactgaagatttaggcaccttccaaatagtagtgattagtattcaaacattcttgcctttcagaaaatgcttttgaacaaattgatgtgtaaattgaacaaactatcagctccatctcattattaaagaacagcaattttggcacttcctctgccaggtcctttgttttagtaaaaaatgtcttacattttgtgatagactccactagt

SEQ ID NO: 52713 - DNA, 1012 bp, Bovine  19866881292329
actgtagataacctgaagacagcagtctaacactagcttttgtaacctggcttcaccccattttgtgtctgttaaggtaaatgaacctaaaggaatgggtatcttctaagtgggataaagtcactttggaggaaaaaaaatgtgcaatagaaataatatatgtaggatgtttttacaaacagtttatattacctcataaatatgctccctaagaatctattaacatctttatatttatagataacatcaagggaagatgaactactaggtcccctcataggtgtgataaatgataactcgagcaatgatgagaatgcaagacagactttagtcatttatttccagctttactgcttagagatttcagtcaacaatcttactaatgtcccttggtgattaaaaatgtctgcaggggactaaagatgatttgaggcttgagagttcagaatactgattcttgtttaaccgtatttcttgctcctttcttgtatttcgtaacagatttgacatggaacattgtatacaactgggatgccacatgcaggcacaatttcaaaattattagagtagaaaaaaattttccagtgagtagtaattctctccagatgagtagtgaatttttattttgtaaaagactaatttataagaaaaaacactgcctagtaaaatttccactcttaaaaatgcaccaaattttttgtatatcaggcttcccaagttataaaaggaaacatcataattttgtgacttgtttttagggctactaattggcccagaataagctgcaggaaatgaagagtgtgttcaatatctctacatcatattatcatttactcctgaatcatttcttctcaggtgagcaatctgctgactatagcttatttttgcatccaatttcaggcctggctaagcatccagaagaagaataaacatacttctgactcctagtgttgtcatgtgtgggtatatgtgtatatgtgtttgtacatgtgggtatatgtagacgtatatg

SEQ ID NO: 52714 - DNA, 821 bp, Bovine  19866881317660
aactttcctgaccaaccttcctgatgtaatcccttcctaattttatctgcctcttataattgcagaatgaatgacacattcattcatttaaaaatatccattgtgtttctacaacatgttagttgctatggtagagcaacaaagaagcctagtccctgccctcatggagttgactgcctactgggggagacaagcactaaacatataaactcataaacagctatctaattttgacaagttattaattatgccatttggtacctgttattttgaaaactgaaagtaaagtcgctcagtcgtgtctgactctttgcgaccccatagactgtagcctaccaggctcctctgcccatgggattttccaggcaagagtattggagtgggttgccatttccttctccagcagatcttcccaacccagggattgaacccaggtctccggcattgtaggcagacgctttaccatctgagccaccttacttgactttatatgcctttctagataacctgctcctatgggtctcctgggtagagtacttaataaaatatttataattaatttttaataaattcacatattcactcccaaactagttggtaaccaaaacaggaatcaaaacatttactctcagaactctgattctctaacggaaaattttcagcattctgcattatttctcaggcttttgaatgtttctttaagtataaaaatgcaatgtaacagaagtcttcacacatctgtgttgtacaagatttggcaaataccttaaagcttttatatctcacttaagtagtcacttgcactccaatacgttagacca

SEQ ID NO: 52715 - DNA, 932 bp, Bovine  19866881403132
caataaatgattgtgagtcatttacacaggtttaaatatgaataattaagaattttcttatactacatgaattgcatggagatatagatatagttggcagtttaaatattccctgagtggttcctttatgaattaggacagtgacaacattttcactttgaaatggagaggaacaaacctcacattcagccattgtctttcactcattttgagtttgtggcttcgcatgtttagtattttgtaagaataaaaacaatgtatgagaaaagagcttaacagggaggaaaattaaagaaatatttgctactagtaagttagttcctttctgtaacaaatgtatacatatattttttaatatatgtatttgtttgtctgcactgagtcttagtactgtcatgcaggatctttgatcttcattgcagcatgcaggatctttagttgcggtatctagttccctgaccagggattgaacctgggccccctgcattgggagcatggagtcttagccattgaaccaccagggaagtccctaggtatatattttaacaagctttctcaatttaaactcaccatataaaacttggaggatatcatcagttcagttatcaatcgtgtccgactctttgcgaccccatgaattgcagcacgccaggcctccctgtccatcaccaactcccagagttggcaaagtaatggaaactgattatttctggactatatcccagggtgttacttactaacattttcctaggaaaatccgttttgacttaagcctaaactctggatcagatatgtctaaacgctatgaatatatggattctttgccagagtaggactttttagaagttgttcatacataaaatgtcccatctttcatacataaacctgaactgaaactgaacctgcaggctattcatgacaattcatgcagt

SEQ ID NO: 52716 - DNA, 732 bp, Bovine  19866881695559
aatgcttctatgcattcccatgctcactcatcataaaagtcctagttcctaagacaacttagaagaccttctccaccatgtccctgttccttaccatctttttggtccattcctctgtccacaccattctagccatattgacctcccttctcctcctttaatacaccaaggaagttcctgtttcaaggcctttgcacccgctcttctccctgcctgtgatgttcatcttctatgtatttgtctgacttgctttctgacctctactcagtctttattcaaatgttattttttagtgaccactttctgatttaatcttacaacacatggtccactccccccatcagcactctctgctctgacttcttgcttcattttttcaccatagcacttactaccatgaggtatgctaaatatttttcttttttaaaaattgtttatctcgtttttataaatacgagttctgtgcagtgaatagctgtgtctcttttgttcaaagttcagtcacagcccctagatctgtgcctgtgccataaatatctgtggaatggatcctttcttggttttgaaagaaaaccaattaaatgtcaaagatgagaatagtgacaaatgcttataatgaaatgttgctaaaattgtcagtgctcagatttatatttggggaaatgaaccgttcttttaaaaaaatatatagctgtacctcttataaatatggaagagatgaattctgaataa

SEQ ID NO: 52717 - DNA, 1362 bp, Bovine  19866880210483
aatcaccagagaggggattaactgactagagagctagcttactccttggaacgaaagttatgaccaacctggacagcatattaaaaagcagaaacattactttgtcaacaaaggtctgtctagtcaaggctgtgtttttccagtggtcatgtatggatgtgagagttgaactataaagaaagctgagtgctgaagaattgatgcttttgaactgtggtgttggagaagactcttgaaagtcccttggactgcaaggagatccaaccagtccatcctaaaggagatcagtcctgggtgttcattggaaggactgatgttgaagctgaaactgcaatactttggccacctgatgtgaagggctgactcatttgaaaagaccctgatgctgggaaaagattgagggcaggaggagaaggggatgacagaggatgagatggttggatggcatcaccgactcaatggatatgagtttgggtaaactccaggagttggtgatgaacagggaggcctggcgtgctgcagttcatggggtcgcaaagagtcggacacgactgactgactgaactgaactgaactgaaagagagctagctggactctaagctatggaattgggcctctactcattttgcacttcatacttggcttgatgtggcattgcaaaaatagttgtgaatacttacagtggataattatattattcttcaatcataatatacttgaaaaacttgcatgtagacatatgcatggtattgctaaagattaaactctggttaatatgaccacgaaaataaaaatctaaattgtttccatttggtcttatctgaaaggataattattcacgcagagtttttttttattacaataattaaagtgatgatctatgataatatttatagagccttgcattttgatgacatccaagtgtgagaaattctaatataatttcatggactaaaaccacgcttaagggagatgccattaaatatacaaataggctcggatgtaaattatgcatgactagtttcatcttcctcaaattcatatctgattttgtatataggctttcatgtctgagatgaggccgaatgtggaaaaaaggggtctttcctaaaaaatattctattattttcaaaaataatgcactggtaatgcagatagttaaaataatgaaacctctgaaatagcaactgtgtggcacattactttgagagccagtttctaaaagaggcaagcctaggaaaataccctaggttaatttctacatggacaaagattggtagcttcattttctggtcctaagtatttcggaaggcagtaaatattggactacttggggagaagctataagggccttaacacag

SEQ ID NO: 52718 - DNA, 1489 bp, Bovine  19866880370142
gttaatgttaaatattttcttctttttcctattcttttcctacaagtttctggaggttaactttacaattgcttttagtctttaggtaatagtgggttggcaaaaaaaaggcccatttgggtttttcattaggatgttatggaaaaactcttaaggaatttttggccaacacaatagaatatttattaggattgtgactgattttgagctagtgttaaaacacaatttttaatttttaaaattgtgataaaatatgcataacacagaattcatcattttaaccattttaaaaggtacagttcggtggcatcaaacacattcacattttttgtgcaaccctcaccaccatcgatcttgagaaattttttcatcttctccaactgacacttggtacccattaaataataactctctatgccctccttccctcagccacggcaaccactatgctactttctatctctatgaacttgactgctctaggattggcttaagatacgatttttttgaaagttaagattataactctcatacaaatataaaaagattatatgtcagaggttttacttacctcattaattaatgaggaaaccagtaagatgttacagttagatcacagaagaactcaacaaagcacacagataggcaactaagaatgctggaatgaatttagaaaaagatagaaaacggtgcaaccacaggaaggcaatcaactgtatttcactggacacaattcatttccattcctaaaattgtttacattattcctcattttctacaacttccataatatgtgaaacagtccaaaaacaatggaaggaaaagaatgctgttgctgtttactcgccaagtcgtgtccaaggcttttgcaaccgcgtggactgtatgtggcctgccaggctcctctgtccatgggatttcccaggcaggaatactggaatgggttgccattcccttctccaggggatcttcccaacccagggattgaacccatgtcttctgcattggcaggcagattctttagcactgacccgcccgggaagcccccgtaaggaaaagataaccaggaagaatattcaataactacacacataaacattaatgaatattgacaatatagcactgagtgggggggaaaatggcggtggactgtcccaggtattcacgtcttgtttgccaactccagtgcctcctggagatggacgttctgtgaacattgtgatttgccagctggttcagtgttaggccttatcaacagagggcgctggagagacaccgcaaggcccagcagaggaggtggctgccctttctggatcttccggtttctgtcacgtctcctatggagacccagtggcactcactctccagcaaatcccaccactaccccagtggacagcttccagctgaccaccccgatctgcgggccacaccccagctcggagctgcggctctccagtaaattctgccagctggtaactgcaacctcgcc

SEQ ID NO: 52719 - DNA, 1771 bp, Bovine  19866880393836
gaccctgatgctgggaaagattgagggcaggaggaaaagggggcagcagaagatgggacggttagatagcattaccaactcaatggacatgaacttgagcaaactccagaagatagtgaaggacagggaagcctggcatgctgcagtccatggggtcacaaagggtcagacatgacttagcaactgaacaacaacaataggacttagtaagtaactcacacagtggaaagcccaacacaagtaacccttcatcacttggcacacattcagctcttggtggtggtgtgactaagtcgtgtccaactcttgggagcacatggactgtagcctgccaggttctcctgtccatggggattctccaggcaaaaacactggagtggcttgccatttccttctccaggggatattcccaacccaggaatcaaacccgggccttctgcattgcaggcagattcgttacttagtgagctacaagggaagcccacattcagctcttaaataggctaattacttacatagatagctttagtgctgtgattttttgattaacgtgcacagttcttttggttgtctcttagatatccagaagagaagatgtagttaagagtgggttaacgttgaccagcagtgactctcaaatgacaagtctctaatactgaggcaaaactagtggcaaaagaaacaggcttacttgaaaatgcttcactacataataaaatgaaagaacctgaatcatttaagattaggatagagaaatctggaggtgatttaacataactgttttaatatgtaaataaattccactttccagctctttgtttaaggctacatgtgtgcccatttgtctggttaacatttcttttgactttctggcatgtaatgtatgggacttcctaggtggcgtggtggtaaagaatctgcctgctcatgcaggagacgcaagagatgtggtttcagtccctgggtagggaagatcccttggagtaagaaatggcaacccgctccactgttcttatctgggaacttccatggacagaaggctatagtccatggggtcgcaaagagtcaagacacgactgagcaggcacgcacacatgtaatgtacacagctcacactgcatctttattttgtggaattgttttatctcagacacatctcctacagtctcttcggaacctcagtacttgaatgtttttcctcttaaaatccagacctgaggcatttccctcctagtaatctgaaaatcttatcagctcaacaagatttctgggagtgagctgggtttagtgaaggaagagataatgaatttactgaccagaagccccaaattcgatgcttttcatcttgctgtgttgtctcaaacttgtgacatggtttagcatgtcaaaatgattaggacacaaaactaaaactttcttagtgtctgtatgttggtagattaagacatggctacacattatgttctgtttattcagaaggtctccaatttcacatagctgaagcaactgaatttccatgtatttctagtattagtcgtgccgtgtagtgcttattttctttgtaattatcaccatgttgttgaaagggagaaagggtagagtttctgtttagattaacataaaactctagaaattagaacttttgttatttgtgattgcaaacatttttgttggaattaaaatcttccaggagggctcccaaacaatattctgtcctggaatactaatgtctgtactatgaatttctcatgtagaacagagttttataacc

SEQ ID NO: 52720 - DNA, 2029 bp, Bovine  19866880400884
cctcaaaggaatccatgatcccttcccctaccaccaacatgtaaggactattgattcttattcatatctctgtatcactgtgatggagtatttgaaccaggttcagtcttatgactagcaatgaacgttctctagtttcttagatctgccatctagtctaagtttgaaagactaagccagatccagatccatggttgttgataatcctaacagtagtagatgaatgatccttgtctctttttatagcatgttgctttagtgtatgtaactgcacgtatctatgactatgcttggatattcatttaagtgatctataattgcctaattttaaacaccttttttttttccttttcattctgggtggttacaaagcagtaagcatagctgaccctgctgctcttggcttcatcatttctccatggtctctgctgctgctgccatccggcagtgtgtcatttacagatgaaaatatttccaatcaggatcttcgtgcattcactgcaccagaggttcttcagagtcagtcactcacttctctcttccgatgttgaaaaggtaacattaagtattttttttttttttttggcttgattttgttttggtgggcgtcggaaaaatagacactgaactaccctacatcaaccctctgaaaaacactcattgaattttaaataatcatgaaattacttatagtatatggaatctaaaaaatacaacaaactagtgaataaaacaaaaaagaaacagactcacagatacagagaacaagctagtggttaccagtgtggagagggaagtggggagggataagaaaaggggagaggagggagaagtacaaactattaggtacaaaatgagttgtaagggtataccgtacagcatggggaatatagccagatatttatagtaactataggtggagcataccttgaaaatctgtgaatcactgtgttgtacacctataacttatagcatatggtgtagtattatagtataagtgaaagccgtctcagtcgtggctctttgtgaccccatggactatactatccatggaattctctagaccaggatactggaatgggtagccttcttctccaggggatcttcccaaccaagggatcaaacccaggtctcctgtgctgcaggtggattctttaccagctgagccaccagggaagcccaagaatactggagtgggcagcctctcccttctccaggggatcttcctgacccagaaattgaaccggggtctcctatactgtaggcagattctttaccaggtaagctacttcagtttagttcagttgctcagttgtgtctgactccttgtgactccatggactgcagcatgccaggcctcgcttactcaaactcaagtctatcgagttggtgatgccatccaaccttctcatccctgttgtccccttctcctcccaccttcaatctttcccagcatcagggtcttttcaaatgagtcagctcttcacatcagatgggcaaagtattgggagcttcagtttcaacatcagtccttgcactgaataggtgagctcctaaggaagccctatattctgcaaaggtatatttgaagtccacctccagacaaatttggctaggctagataaaagcaattaaggaagagatttcaaacattacaatcaactttgagtcatttcttacacttaacagggttcttagtctgagacacactcagtagataagcaatacagaactccataaatgaataatcactgacattgtacaacatacactattggtagccatctccagcataggagggcatctttccactctcccatttattagtggaaagaaccctgaagactgaggttccagtgttggatctgtcggtattttatgatttgtttctctattgttgataatgtatttattatttatgcaccatttctttctaaaaacaaaataggtataggagatcgtaaatggcgaaccaacaaaatattgtgaacactgtattagttgtcaattgttatattttaaaaaatta

SEQ ID NO: 52721 - DNA, 2826 bp, Bovine  19866880491382
gcagggttgaggcggggggcggggggtgggggggcagaatctaagcaacagatttacatgggaaattataacattataaacttttaataaacaaaaagcatgttacttacgatgttccctgctgagaattactgtgagtttttgaagatgtatcatattgttctgtggaggagggaaaaatgatcagacgagcacaatgacaaatgcatgagattgttagttataaatcccctctttttttttttttttcctgctatttccccaccaccttttcacctaaaaacacttggtacacctaaattttgtcaacagagagctattataaaataacatttatgttacatcttgagagagggcttgctcagaactggaaaaccctgagagtgctgcccggccagccgaccccacataagactctcttcagggtccactgacgggggctcctgtggaagcaccgtgacgccaccccacctggtttgatgtcacacatccatcagcgatttgctagcactctctttcacagcctctgtccttggccgcctgtgctcccacctggccccccatcattcaacacccccgattcattcgttcaactgctggtcacaaactgcctctcacagacaccaagatgctcaagacatttgcccctgtcctcgatgagtgtacagctgaccgagggacagcaaacaggaacagcaactacagccctaggctgtgagagatccgcacacaaacccatcacctagatgaaacgtccggggaatctagaggttcgtcacaccactgggcacgacgaaagcaggcaaatcagaaaagaaacgaaattaggtgtgtgtgttgcaaaggatgggtgagatttttgacagaaatgactgcaggcaagagggagatgagggtgaagaaggccctcaggcagaagagacgatgtgagggaaggcaggaaacgtgggagcaattgagatggtgcagatgagaaaggggaaggttggggtgcagagtgtgtggagggcaatgtgagaggccctggggaggtcagagggctccgagtgccatgatgggacattaatactttgagacgccaccagggcacgatacagccaccaggcacgatacaacaatttctcagaaagagtaacctgctggtgctacctgacgtaacccagaaaggaacaggaaatgttaagtgtagagactgaagaagcagctgggagaccgtgtctgtgtctggaactgacgcagaagctgagtggcaacatgggtgcctttcagacagcgggcggtacagtaaccacgaatgacccaggagacccttgaataactgcagttcagggcttcatcctcatgggggcagcagctcttacccggtatttttagattcttttcccttctggctagcaaattagggctgggattacaaattaaaggggctaaagtccacgcacaggggctcccacacaaacatcctgaccaggtcctaagctccatgaggctctggtaatcctcaagcagctgtgttttttttgaacatgtggacataaatcctgggacatacagggatgtatatatgggatatacttcagtctctgtgtgcatgcatcctaagtcgcttcagtcatgtctcaatctttgcaaccccatggactgtagcccaccaggctcctctgttcatgggattctccaggcaagaatactggagtgggttgctgtgcctcttctgggggatcttcctgatccagggattgaactccagtctcttatgtctcctacattggcaggagggttctttactgctagcgctacctgggaagccccagtttgattggataggtgtccttataagaagacaagataccagcatgctctctctccacacacgcacaaaagaaagaccacatcaggacacagagagaaaatggctctctgagagtcaggaagagagctctctccaggaatcaaccctaccagcaccttgattctgggcttataggctccagaactatgagtctggtgtttaagccaccagtctgtgtaacaatattaggaatactcagattttaaaaaacaaatgaagaaaaaaaaactgtattcgaaagttgactgccatgctaggtacatttgcataggctttctcttttaattctaacagtaagtgagcagcaaggctgggaacgaaactcaggtctgagagtcatagtttgtgtgtcagctcatttattcattattttgctgctgtttttaactatctcccctctccagagcaaaaggtaaaattacaaaattgaggtacaactagagagagagagagatatatatatatatagagagagagtgtgtgtgagtatgtgtgtgtgttgggggctggaggagttcatgaattgttctatgttacacatactcctcactctgcttcaaacccctgaaatcattcaggaattctcccaaaagccttttttcccgtcttaagtgccagcagagacctggaccaagacagctgaacttgtgcaggttccaggtgaaatacatcaaaggtcagttggaagcacagtagcctttaacctccggccactgacctttccgctgttgatcaacaggcagcagctatcaggccagatcacaggggtgtccgctgtcttttgggaagaagcaatagcagcatctgtactgctgagagctggttagggtctggtggaaagaaatctgttcatcacctgttcctgttctccccaccccaacacaggcaaattcttactgctctgcaatgtttgtgggccccttcagagtcactggttccagtaattcatactggccttcctcttcttcctggcc

SEQ ID NO: 52722 - DNA, 2770 bp, Bovine  19866880611659
ccccccaaaaccccaccccgagccctcatcactgtcagccaccatcagcgccgagagctcagtgccggaatggcacgagggccacgcctggcttcccggattcagtttcgctgggctctttttattaatgttaaaaaaacatcaggctgcctctcaatatgatgcttcaagaaaaacgactcacaccctttcttgcctcctaagccctactgagaaacttggcttcagagacacgagcatgagtttcctggccgctgctgtgagaagagctctatctgcctgcctctgcctgtgtgcctgccctaacagactcagcccctgtcccgtgtcctctgctgggtgcttctgggacatgctgcacagcgatggctcgctttcctaattcctaggactggaagggttttactgctatgggacatccatcctgcactgccttggatggttacagtaataatggagatggcaacagctagcctctacagtgtaattcccattcattccacattgtgctaagcactttgcatgaattgtcccatttattctcaaaatggacctcatcaggttggtactattatctccattgtaagatgagaaaactaaggtgtagagaaattaggactggagtttgcccaaggtcatatagctcccaaatctgagtccagactagaattaggtgtgtttggatactttttatctttcaaatatgtaaagataatgccacttctgttattatgctgctaactctctctgatgaatagcagtctttaataaacattcctgtatgtcagcaacagctactctgaaggcacttcaccttaatgctactacttaatactactgctattgttagcaattacagggactcaaatgattaggtagctgtagtggaatgtattgtgtgtatgtgtgtttggttgcttacttcagatatctttggagaaaccaccgtgtttccatcgttagtccttgtgatggggtttagtgtgaacttctcaccccctcactccaagctggcacttggtacttgacaattagaatagtccataccactggatctgctggagaaggaaatggcaacccactccagtattcctgcctggagaatcccagggaccagaggagcctggtaggctacagtccatggagtcgaaaagagtcagacacgactgagtgacttgacttcacttcaatttcagatagtgtaagtactgtgaaaagataagcatggccaacactgttcttttcctccccagtgctcattcccattttttgttgctaagagaaccttgattatgcatgcgattaaactgggcgcagccttaggtgacagatcatgtttgttctcagccagtgataacaatttgtatcttgatttacctgtttcctctgaagctggaggaggccatgtgacctcgttttggttttcaggtagtaaaggtttggggaaggactttcctgatgtggctgacatagccacaccttcctcctcccatcttcctcctgcttggcatgttgaaaagatgtctggttatgaccagcaacctttttgtacaaagagatgatgtgcctaaagacagcacactaaatgtggccgagcaggaagagccagagttccaaatggcctcattgtatggctaaaattataccactagccaccttcctttagacttgctattgttgctgttgttcaatctctaagttgtgtttgactgtggattgcagcaccccaggcttcgctgtccttcactatctcccggactttgcttagattcatatccattgagctggtgatgctatctaaccgccttgttctctgccgccctcttccccttttgccttcaatctttcccagcatcaaggtctggagaaattgttgtttagtcgccaaatcatgtctgactctttgcaaccccatggatggtagctcgcaccaggctcctctgcccatgggattttccaggcaagaatactggagtgggttgccatttccttctccaggggatattcccaacctagggattgaacccacatctcctgcattggcgggtgggttctttagcaataagccaccaggggagtccagaaatattagaagccactgttaattaaacaattattacttgcagctagacacattctgaacccatatagaatataatgaaatagcgcatgggttggctgcaggcacatcagtgctacatttgcagctgcattcagggagggctcttggagaacgtgttatttgagctgaacgatgggagggagctaacaggctgtgggatgtggacttgagtttggggcctgaaccttgttcaaggcggtgtccgccttgaaacagagggtttgaaatggagaagaggtcgttggggaaatcgtgttacattatgaatgtcctgagggcttcatgtggcactggagagctaaaggaactgtaggcgatcatgtcagttgggggccctgagagtatgaactgcttggggtagagttctggagaattcagatgaaaacagtgtatgacccatgactcaccgctgacacattgccagttaccaagaggctgttattcctggagggtatgtgtggaaaaggggaaggcaagctgaccagggaccagaccagaccagacatcctcaggcctctgggcagttgttttcctcatattctctggaaactgggtcatggtcatggggctttgagacctacttagcagctgtttgtccagtagaaaagcttctctaatgtatggattgtcttgaacatgtactttggt

SEQ ID NO: 52723 - DNA, 2520 bp, Bovine  19866880623872
tctttgcctgaagtgaactcttagttttttgaatgttgagtttcaagtcagctttcactcctctttcaccctcatcaataagctctctggtttctctttttactttcttgccattagagtggttcagttcagttcagttcagtcgcttagtcgtgtccaactctttgcgaccccatgaatcgcagcatgccaggcctccctgtccctcaccaactcccggagtttactcaaactcatgtccatcgagtcggtgatgccatccagccatctcatcctctgtcgtccccttctcctcgtggccccaatccctcccagcatcagggtcttttccaatgagtcaactcttcacatgaggtggccaaagtactggagtttcaggtatcacctgcatatctgaagttgttgatatttctccaggcagtcttgattctaattgtaatccatccatcctggcatttctcataatgtgctctgcgtataagttaaataagcagggtggcagtatacagccttgacatactgctttcccaatttggaaccagtccgttgttccatgtccggttctaactgttgcttcttgacccacatacaggtttctcaggagacagataaagtgatctggtattctcatctcttcaagaatattccacagtttgttttgatccacacagttaaaggctttcatgtagtcaatgaagcagaagtaggtttttttctggaattctcttgcttttgctgtgatccaaaatgttggcaatttgatctctggctctttgccttttctaaatccaccttgtacatctggaagagctcagttcacatactgctgaagcctcacttgaaggattttaagcctaaccttattagcatgtgaaatgagtacagtagtacagtagttcgaatgttctttggctttgcccttctttgggattagaatgaaaacgatcttttccagtcctgtggccactgctgagttttccagatttgctgagtattgagtacagcacgtaaacagcatcatcttttagaattttaaatagctcagctgaaattccatcacctccactagctttattcatagtaatgcttcctaaagcccacttgacttcacactccaggatgtctggctgtaggtgagtgaccacaccatcgtggttatctgggtcattaagatcttttttgtatagttcttctgtgtattcttaacatctcttcttaatctcttctgcttctgttaggtccttactgtttctgttctttattttgcccatccttgcatgaaatgttcccttgatgtctccagttttcttgagagatctctagtctttcccatttgattgttttcctctatttctttgtactgttcatttaagaacacctacttatctctccttgctatcctctcaaactctacattcagttggttatatctttccttttctctcttgcctttcacttctcttctttcctaagctatttgtaaagcctccttagacaaccgcttcgccttcttgcatttctgtctctttaggatagttttggtcactatttaaaaacatgtcacaagtgcacaggtaaacagtcattactttaggttttcctttttctttttccttatctctgtacattcataccccctatgtaagaaatgaaaaaacaaaatgaatgtgaagatgggtaaatggagccagcaataattatcatgttgtctttgtaacatgaggatgaacgataccagtaaacattggcaataattaataggaaaaaactgaacattatataagatagtttttttttatagtaggctattttgatattgatttctctttatcatagtctaccaaaatgaatggctgtgaagaacattgtgaagaaaaaggtaaaagtgaaaggtaagaaaataattttcaagtatctataacaatttcattctttttttagaagcactctgaagatttccatttagatgttgatttttaagttaatttatcttctcctataaaatgagacttgggtaaattatgaaactacagtttaaaattttaaatgttttaaaaatgttgttataaggcggttccagtgacatgtgacaatgtgtttattataacattgctcaaaaaaaaagcaatatattctcttcatcatcagaaagaattcaagaagggtctacaagaagatacagtgataatagtatcttctcctggtatatttataggcaacttatttttctacacctcataaatttcattctttaataaaaccatagcaggtaagaaaataaaataagtaaaataaaaccaaagcaggtaagaaacattttaaccccccacaaatgtttttcctgttgaaaacagtttctaatgtaagattttttattttgtaacactaaaggatgtatcaggaaaaattatatatattgttggccagcaaagtgattatatgtgaattttgcttcatattaaatgataaccaagcagtcgaagggagttatatacaaatgacaggaatttttcactaagt

SEQ ID NO: 52724 - DNA, 1877 bp, Bovine  19866880664092
acagaattatgggtaacctcaaatagaaaccaagtttcattctaggctaatctgacaactgtcaagacttttaaaagcccacaaattaaactcacgtgaagtaaatctaatgatttccacttaatcctcagaaaaacaggactgttaaaatatgtttgtaagatgtttgtaagaataggtccctgtcatgagggttaaaacaaaactcctacattaccagcaatatgatagaaattatcaaattcaatcttttatgactttccatctagagctttttgtcttccaggcggtttcaactcaaaaacaaaaattaagtttaactggtttactctgaagtttactgaaaccaagtgacacagaccacactgcttattcgtctctacatcttcaggtagcagagcctcattgtgaaacatactgggtttcctcctaccctttaagtatcctaatgtttgtaaatcttgctgcctgattttttccatgtggtacaaagtttgtattcacacagccttttttttttccaatggagcactagcacaagtatgcctgactctaagagggagttgagagagaaaggcagctatacagactataaaagaataacagaaaaatgtaattactaaaaatgtaaaggttatgtgaaaattactcagaaaaaaacataaaatgagagttttagctcctgttttacagtctagaactttgaatcaataagtatttttaatcaaaaaaacaaaaccaaaatcctattttcaaatggtctattaactcagcaagaagctattttcctttaaaaaaaaaaaaaaaaaccttaaaatcctaagatcatgaactcaaatttttatcagtgttttagtagctaaagttaccaccttactaggcaggtcatctcacttagaaatactgaaggtaaaaaaacatatatattattttgtcaatcatgagacaaaaatatataacgcctacaaagctggataggagacaggtttcatactttcacacaaaacaatgggaactggttaattttataccactttccataaattcacatcctgagaaaatcaggtacacctgtatttttaaagcaaagagaatggggagaggaaaatcatttagcaagttacccagatgcacagctacccaggatgaaagccacaggacagtctcagctcttgcaccaccagcaaaacatatgccccacatcaaaatttaattacactgcacaacactttgtgaattgagcttcatatttttatcgactgctctgcttttgacaggacagtttcctgaaggaaagttccaagaattgaaaagttccaacacccacataccagaaagcgtttcctgaattttgttacaggaactgacttctgctgtaattttaacatttactttccagaggagtttcatttaaaaatttttgttgcagattctttgctcaacacctagacaatgctcttgcttaaaagggtggggggggggtggtggagaaaaaacaaacttttatttcaatttcaaaagttgggatgtgattgactgactcacttgtacaactgactcagttgtaactttttccctggtaccaaaaacaactgccacctgacaggggacgggggtgggggcgtggagttagcaattttgggagggagcccagagtagacatgaaagggttgattaggtaaccaggtccttaagaagtaattcttgggaaagctcggcttgagcaaacgttggaggttgcttcttggtatctcccttttcgtgttttaaacataggtgcatttggacatttgaactagtagagtttgtaattgatacgtaaattcataaaagtagacatcttccttctgtaccaacctctagtctgtttcaatggg

SEQ ID NO: 52725 - DNA, 1687 bp, Bovine  19866880761727
ctagagagaggggagataaggaatgagagcaatgatttcttaacttgggtacatttgaacagactttatctctagtggataaaatgagagttaacttttactccttggaagggaaaaaaaaaagaggtagacctataaattctcaggttgctgcttcagagggagatacctgacagaagaagtgtgaaggcttatgctgtgccttttgtaagtactctgtatgttatcttatttcttatcctcaaattacatgaattagggctaattcatgttataggttatttaactcctattagtttgtcgacttagttgctgctgttcagtctcccagttgtgtccgaccctgtgtaaccccacgggctgcagcacgccaggcttccctgtccttcaccatctcatggaatgtgctcaaactcatgtccattgagttgatgataccatccaatggtctcatcccctgtctcccccttctcttcctgccctcaatcttccccagcattagagtcttttctcagcatcagggtcttttccccatagtgggcttttcagcttagtgtcagctacaaattggcacttgccacgggcatttgccatctgcctgtgaccttcaacatgccctgagtgagttcagagtgaagaggcattctgtgcttcagggaattaaatttagatattttcaggaactgttttcatgatcccagtctttgcatcttctgatatctagaaaagcactaaatcccttcatgatgacatcagatgctcctcatgtgactcatcatgtcatcatgctgctcagaggatatcaagtgactagcagaaaacctcttgtaaagtaagtggttgactgcattgcactctcccttcaccaaaatcttatatatggaccttctcccactgcctctttgagcagtctttcagagctctttgaggtgctgtgtcctgggctgcagtcctcattttgccctcaaataaaacttaactcataactctcatgttgtgcatctttttagtcaacattagtcaaggattttgaggtcctaaaacctatgaaacaaatgaaatttgatggtggaagaaaagatcagcttttgggtaaccaggaggctggatgatagcaataccttcttggaggtatttgagactaaattagtaatctattgccccatgaacaactactccaagatttagcggcttgaaacatagtcattagttagcttatagttagggtatgggatcagcttggttttcctactggtcttagctgggcttactcatgagtctctggtcacctgctagataagttagtgagtcagctgggaaattggttggtctcagacggcctccttcacatgtccagtagttggctagctgttagctagagtatctctgtgtcctcctccactggcctcttatcctctagcacattacagcaagcctgtaaagagacagttttgggtttttaggtgcagcaagggagccagcacctgacttttaagcctctgctatacctcttgtttgcttacgtcccacttggcagctcatgtggccaaatgattcaaagagtggagaaatcaagtctttcttatgggaggctccaaattgccactgggtggggaggggtttgatgcagtttttaccatctgctacagctgtgaaggctgcagatttaagaaagaaagagaggggt

SEQ ID NO: 52726 - DNA, 1056 bp, Bovine  19866880855422
cagaaggaggattatattttaaaatttgattcaatgaagaaatggacaaaaggttattgtaaccaatattttacatctttttctacttatgtttggcaaataaattccccaaatcctagaatcagaagggagagaagagaaagtgaattactttatattataaacatcgaatacactcacaggttatgtgacccatgtaagataatactcccagctaaagaattaactaggatgaaacccaggagatcaatcaacgatgaaaccactacaactgagttaatcactcgttgacattctataatagtgtaaagtacttttcctcagtctcaccgaaagagcagggtcaatttctggtagcaccccaggtggaggtctacagaggagcaaggatacttctggagacgttcccctgagagtggatatgacctcctgggggaaccatgaatgagaaatgaagacacggttaaaccatttcattccgaaagaccgatctgcctcattaaaaatgctgcactccacaggctgggggctcacctgttgagacaatcctttcaaagaggctccattcacttttaagataacatctcccacatcaatttgtccactttctgcagccggctgtccaggaaagagctttttaacccttactatgctggtgttcatttgctcgggtataacattatcctctcgagaaaaactgaatcctaggcctgagctatttttcagcaatttcacctcaaatgtattctctggaaaaaaaggtatcaaaaaatgtgaatattcttaacaggctctctctatgcatgtataaacatatacagttttgaatacattattaaaaagcccatttccaccatgctcacagctttatatgcacttattgcacgcttattctatactcaaatcccactttacaatctgttattaagaaaatttaacttcttgaactgagctgcatgaactaataggctgcctgatcagaaaagtggggttctgaaaaaaagattctaaaaaggaaactatgtcttaattccatgttttataaactgcagaatg

SEQ ID NO: 52727 - DNA, 3600 bp, Bovine  19866880887639
ctattcattgcggaacgcaggcttctcattgcggtggcttctctcgttgtgtagccccggctctggctgtgtgggcttcagtagttgttctgcacaagctcagtagctgtggctcacaggcttagttgctccatggcatgcaggatattcctggaccaggaatcaaacctgtgtcctcttcattggcaggcagattcttatccagtgcaccaccatggaagtccctttagctggatacatttaaagagatgagaaagcacttagaagccttgtaaggcatatactctgagaaaaatagattctttcccagttttcaacagggagaatggagcttctttttgaaaactgtatttgactcatctggaaacacacagtgtgactatgtttttacagcacacagccacacacttgagggtgcctgatgatgtcactccagcacagcctggagacacatagacacatagacctggagggaaatctgtgacatgtgtgtgatattgacatatttcagcacaacctggggacacctcatttataccctggggacctagtgtgacaggtgtgggatgctgtcatcatgtcatatgtgacaggtacgaggtctccagatttcctaggccataaaaactatctacaccttcagtaagctaccgcctgactgccataaccatgagcaaggacatccactggccttgctgacatttgttgatttttgtaatatgctaaatactttaaatacattaactggtttaattcttatttaatcctgtttattattacttactgagtgatagtcgctcagtcgtgtccgactctttgcgacccattgactgtagcctgccaggctcctctatccatggaatactggagttgccatttccttctccagaggatcttcccaacccaggtgtcccacattgcaggcagattctatgccatctgagccaccagggaagcccgttattacttactaatattacattaatagacagtaagcaacctatccaggatcatcctgctagtaaaactaaggttggcctgccttcattctttccttttacgccttaattccttcatcatctaaatcctatgattgatttgctattgactacaagcacgtgtatgttttgtgtacctaccaggatattttgctcatctgacagcaagtcttctgcctaaagttctctgtgtcctcagagtttaaagagagtgtcatagaagcaacagatgcacactcattattcactgttgtttgttgatgctccagtatttccagaatgaaaaagcaattggaaggctggctatttaaattattttgtcccacctgagttttttttaataaaacagttcgtatgataataatgaggaaaattcttagaacattcctatcccagaatgcttttctctttacattgcttctgtagataaaatacattttaccctaagctattttgatttccgttgtgatacaaatgtgtttgtaagtactgcaaggggaaatatagacagtattcattttagctgcatgtatttctgaagtgagggtctgcgaagagttgatatctgcctgtggaaaagaataaagctaatgaaaaaataaattttagttttctaccttcggaaactacattagcaaataacaacaaaggctcaggaaagaattaaaattcattacaaaaagtctcttatgcttgccttaatgtgtttcttttcctagtataattcctgttctgctaagattttccaattttcatagtctacacaggctgttctcattttgataacattcccagttgagtttcatataacctccgctgtatcatacacccttaaaacttcccaccctttcattcatatgcctgccagtctcttttgaaatttacttaaatgagtgttaaaaaaatcctacctgtgtgagtcagtgaaagtgaaagctggtcacttgtgtccaactctgatatcccatgggactatacagtccatggaattctccaggccagaacactggaatgggtagcctttcccttctccaggggatcttcccaacccagggatcgaacccaggtctcctgcattgcagggagattctctaccagctgagccacaagggaagcccaagaataccggagtgggtagcctatcccttctccagaggatcttcccgacccaggaatcgaactggggtctcctgtgttgcaggtggattctttaccaactgagctattagggaagtgtacacttaaagtacatacactaaagaaatctgtgtactgatttgccaagggtgccaatgaaattaatatatgtgctgcttaaaaacgtgtaatattcacttttcaaaagagaaacaagctattctgtctttctatagtatttttataggcacatcaggaaccagatagtcatttaaaaaatttcattattcacatctttggtaagtataattgagtggagcacaagaaagatatcattaccctaaatcaaataaaaaattgactaataatgtatataaagtacttggcatatgatattataattcaacaaatggtgacagtgatagttttcgctgttgtgattgtccttactaatggccgtggccgttaagtgatcagcagaattgaatatatcttcaggtaaagattgaagtatttgaatctctttcacaccgaggcttccagtttaacattagaagattatttccacatgttgaacattgccttctacgtttacttctttaaaaatgcaagtcttcttggagtgtactacattcagtatactaccttgtctaccaaaaaatgttaggaggctgcaaataagaaaagattgactgtcttaagaattgcaatttgagaggcacagattcagagaactttgaaagacagttcagggaagaaaaggggcagaggtttataaaaagaaaaagctacaaagctgtgaaaagttgcccgacgagaactgtgattgactgatgcgaataagaaaaattattcttaaggattcacgaattgtgttaggatagggtctgataagtagatagactattatgcgttattttagggtctggaaaggatcttgcagggcttccctggtggctcggtgataaagaatctgcttcccaatgcaggaggcatgagttcaatccctggatcggaaagatccccctggagaaggaaatggcaacccactgcattattcttgcctgggaaatcccatggacagaggagcctggtgggctgcagtacatggggttgcaaaggagtcagacacgactggacgactaagtatcttgagtttctggcagatgttctggatgcatttgttaagacagttagtggtcaaaggtcagattctgtccagactgagatgtgcaaaagtcagagttctcgtggcctccaagctccatcttcgagagtcctcttagcaactccatgttgcttttgcttttatacctaacacttcactcattcaggtataattcataaaatacctgtattttgcaggttactctgctggtaagagcaatatacctgtgaacattacagttaaggttcttgccctgagggctcacattctaatattagagccagagaccaataaata

SEQ ID NO: 52728 - DNA, 1582 bp, Bovine  19866880968830
ttttatctttaccaatcttttctaaaggctagatcaatcaatcctatttatcaaaaagtagcaatggtagaatatttgtaaggatttacatctaagaagttttcacaaatttaaaaatacatctcttttactggctttggaagggtagccttaactattaacataaatctttttctaaatgaaaatttatttctttatcataatttctttgtgcttttatcagttttactggttttgttttccttctccctttgacagtggtaaaataattgaaacatcaattccacaaattaaaaacaatatgaaaaatactgctattcatatacatttaacaactgatctctacagcatatacatttatgaacacaaaaattagatatataacaatttaccatacaacatgatcttacctaattactctataggactcaaatcaaatagactgtaccatcaaattgaagatcacattttaaatcaattcatttccataaaatttgtgtggtcataagcagtaaaaccaaattgcttaataatcacttagcattttgtaatacacctgacttgaattccaagttcatagattttgatgagagagtcttcaatgaaaatgaaataatgtttcatacaagaatactcattgagatttgagaaaaacccctaaaacttcaaatcacttgtgtttcatcttctagtttatttcctcttatatcccttcttaggaatctgacttagtggcatcagataacatccaggataacaagttttcactgattttttatagaaagtcttggaagtaaagatgtgaggacccaaggaagaagttctaactgtatcttggtcataagggtggctcctgtatctcctaacatgatgctgtacaacagaattgtactcactcactcattccatcacaattctgaatgccaggaaatacgtgccaagttctgcaccaccactggggtaaactagtggaataacctggttccttctcctcaggaggctataggccaccgagggaaatgggtcataaaggagattacaatgaacataccatgaatgtctggtaaggaaccgccattcacttgaaagcaaatgtgatgaggtaatctagtgtgtcatgtgtgcgtgtatgggtgtgcatctgatcaatttaaatgtgcaataacaattcttatcttctgggtcatttcaccaagttctatttccctttttggcttcttgacgtacctatagtagtaaggggcaactgattcacattttctggattaggcagtaccatgactctaattacatttattttcttatgtttaagagcaataaattattctctttagaacatgttaaattcccagttttaaagaaaaacatgtaacaacataagcctttctgactttttatcttgacctattctaaccattattatattttgaataattctagatatactaagttttattttaatttttagctgtgtgtcctcagtgttctttggaaggaatgatgcgaaagctgaaactccagcacttttggcttcttcttggcctcatgtgaaagagttgactcattggaaaagactctgatg

SEQ ID NO: 52729 - DNA, 963 bp, Bovine  19866881010646
ctgtggtgttggagaagactcttgagagttccttagactacaaggagatcaaaccagtcaatcctgaaggaaatcagtcctgaatattcactggaaggactgaggctgaagctggagctccaatactttggccacctgatttgaagagttgactcattagaaaagaccctgtcgctgggaaagattgaaagcaggaagagaaggggacaatagaggacaagatgactgagtggcatcaccatctcaatagacattgagtttgagccaactcctggagatggtgaaagacagggaagcctggcgtgccacagtccatggcgtcacagagtcggacatgactgagcaactgaactgactgactgactgatctgttacctggcagtcattttcacaaaaatgaacaaagtgagtctgtttcttccaggaaaacaacggacagtatttattgccagtgataaaatttgagttttgaagcatcttggacaacttgacacttgtcatggtgagcttgacagcttcccaatacttaaagtcgtccctgatgaggtaaggacagtaacgactgtggctttagaagacctgcctaacctagtgaccaaaattttctaaatagtacaaaatcatgcatgggtaaaagatccactgaaagtgcaggaaagaccaatggattttaatatatgaaagtttaaaaacagttcaatgaaatgactccagattctacactgcaactaacctttaggaaactatgattgtagagttttgatataatatcaaaaaaggtattaaagtactcctcttcctatgtgaggctacattttctcattttcttcatagatttcaaccaaaataacactgccacacactgaattcagaaacagatatgagaatccagctgtcttctattaagctagacagtaaagagatttgcataccgctatttctctactaaagtttttaatttgg

SEQ ID NO: 52730 - DNA, 914 bp, Bovine  19866881010885
tctgtacatatcatatgattaagttaagcgccagagcagaacgtacagagaccaaaggcagaacaaaaccatggctaggaattaagcgataatagagaacagggagaaccagaaacgattaagatgcagcccaaatacaccagagcaagatgatccttgtttgggtgaagatggtaatgagatttttctactaaatggttagagcccataagggcatcagacccttgagttacacataacattcactttcactctaagcgtgcaggggagagaaattatcgcaggcagaaaagcagctgtggggagagggaaggaacataagacaattttccctcccacttccctttccctctctaactccccacgttctccttctgtacacactgtcatgcatgtgtgcgtgtacacacacacacacacacacacacacacacacacacacactgaaatctgaaagcctcctgcagtttgtttctgatatttattgaaaataattagagaaaattagctgagacattaaattcaacataccatagcaaggaaccatgtcaagagaatttcctataagctaaagctcacctatcaaaataatttaggtagcggatagctttttaattaattttaaaagttagttgcttcaatacataatttgagactccctgggaaggcttgtgatccataaaatatttcttttgtcaatcaagttattaaatctaccattagattttccctcatttgaatactttcaacttttaaagagtctcctatgagtttcagcaacgagatagactcagcagtacagacacccctcgtgttaccaaaaaacaaaacgctggataaaatataacccccggggacttctctcgtggtccagtggttaagactcagtgcctccacatggggcaactaagctc

SEQ ID NO: 52731 - DNA, 1364 bp, Bovine  19866881049050
aaaataaatacatagagatagatagataaatctaaggcaatatttgcctttttaattcttattctctcggaagtatactgtgtcattttccagaggctacaacgaagtaaatacagaaaaataaaggaatccaaatgtcttctattaaggaagatattaataagatttgcaaaaatataaaataatgccactcttctcattatattttgtttgtttcagaaagtatacttacttcttcaataaaacatatcttatttgtgttaatatatgatggacttattactgttatatttaaaagctgaagtttcaatattttggccaccaaatgtgaagagccaattcattggaaaaaatcttgatacagggaaagattgagggcagaaggagaaggggatgacagcgggtgagatggttggatggcatcaccaactctggacatgactttgagcaaacttcaggagatatgaaggacagggaagcctggcgtgctgcagtccatggggtcgccaagagttggacatgacttagcgactgagcaaaaacaacaacaataatggatttattcacacatgtatataatttctcagtttaatttctaacaaacattgagagatattaataaaaggcttataaataaagctttttaggattgtaatacttcttaagagtgtataggagtcctgggatcaaaacgcttattaagcaccactgcggcagttccaagatgggaatttatttcacatgcttgtgtaccagcccaccttaatcattaggccttttctttcttcaggctggcaagcgaccccctggcccagccctgtggtgggtgaatggcaacggagatgaggtaatgtggaacttcagccaactgagtgaactcagtcaacaaacagccaacgtcttcgcagggccatgtggtctgcagcgtggggaccgtgtgacagtggtgctgccccgagtgcctgagtggtggctggtgatccttggctgcatgcgggcaggttggtgattgaccatctgagcggggcaccatctcccttgtgaaggaaagtggtggcagagaaatgcaatcattcctcccaaaggatgccccctccacctatcatgtggtccctcatcatatagagacaccactgttctcccatttatttaagcaaactatgccctaagcagtatactaattggttgctaatacagagtaaacaaaacagagtctatgggactcacagatctctggagaaagacagctgctttaaattattaattgcatatacaactattgaatcacagttttgataagtggcattgaggttctataagaacctatacaaaatatttgtcaaactattacctatagggcaaat

SEQ ID NO: 52732 - DNA, 2552 bp, Bovine  19866881193480
ggatgtgaactcagtgcttgatttctctgaaaatgggggttgccgagttaacatatatataacagtctttgaacatgtgcctggcacataataattgcttaataaacattactcattagtatcaaaacagattagagagagattccattgaaagaaataccaaaaaatgagctggagttttcagtctttctggcagttcaaggatggaaatttcataaaggagagtgtatgctgcatttacaagtatactagccactagcctgagatgggcttaccctacagatgcagaaagaaaattcaagttctttgatcttcaaatatctactacaaaggaaaaatttaagagaggaaaaaggcaatgtttgctgtttttggtaagtaaacatgctgaaactcccttaaaattcagataaggaaaagagacaattctggaacccttccatattctaagggctttcatttcttaggaagagtggaaagacagcaataggaagaaacccaagattcaatttctgtcacaatatcacatttctatcaatatattcctaaacatcttttctaacatctcagattattacatttggatgaagcagagcttttctaagagtaatgctagtggtgagaaagatgtctgcagctaaattttagaaaactgaatttcacagcaagtaagttgttcctgctgttcagtcgctacacacgctaagtcgcttcagtcatgtctgactctttgtgaccctatggaccgcagcccaccaggctcctctgtccatgggattctccaggcaagaacactgcagtgggtagctatgctgtcctccaggggatgttcctgacctagggattgaatccgcatcccttctgtctcctgcactggcaggcagattcttaccactagaatcacctgctaagtcatgttcagatccctgggatttcacggactgtagcacaccaggctcttctgtcctccactgttttctggagtttgctcaaattcacatcaattgagtctgcaatgctatctaaccatctcatcctctgccaccctctttctcctttggccttcaatctttcctagcatcagatgctgggtctttcccagtatctagcttcagcttcacctaccaccactttccctacaagggcttccctcatagctcagtcggtaagagagtctgctggcagtgcaggagacctgggttcgattcctgggtcggaaggatcccctgggagaaggaaatggcaacccactccagtattcctgcctggagaatccccatggacagaggcgcctggcagactacaccccatggggtcacaagagtcggacacgacttagtgactaaaccaccaccaccgccaccaacttcagcttcagcatcagtccttccaatgagtattcaggattgatttcctttaggatggactggtttgatttccttgcagtccaaggactctcaagagtcttctccaacataattcaaaagcatcaattcttcagcactcagccttttttatggtccgactctcatatccatatgtgactactggaagaatcatagctttgactacacagacctttgtcagcaaagtgatgtgtccgctttttaatatgctgtctacatttgtcatagcttttcttccgaggagcaagtgtcttttatggctgtagtcactgtctgcagtgattttggagcccaagaaaagaaaatctgtcactgcttccaccttctcttttatttgctatgaaatgatggaaccagctgccatgatcttagctttattaaatgctgagtttcaagccagctttttcactttcctctttcaccctcatcaaggctctgttttaaattctctttcaatgttcctgcttaggtcatggagaaagttccagtttagtagtagttagtttgttttatttgctaatctccccctttcaacaaatacagacatgtcctaagcatggagcactgctggcataggcaggccactctattatagcttgtacttaatgacattattatgttttcaggtttcaaaatgatattgacttttccacttagtctctattggcaggacattttactggttttccatttaagaaaataatacagatttaagatttcattttttaaacaaattcaaacataaaaatgagatatttaaaaatattaagtaaagagcattaggatatgacaaagattatgatggtagtactcaaatgaatacagcacaggaaacacaagcttaaacaaattctgttcttaaggaaaaattgacgacttagatggttcagttaatgggctcattaacacttatgggttatctgtgtaggagaacagagcaaaaactttctagaacctctttctccagatttcatgactcataactaaagttcagaacctcctgtctaaacagtcaacattgctgacattatgaaacaaactatgctgctgctgctgctaagtcgcttcagtcatgtccgactctgtgtgaccccatagatggcagcccaccaggctcccccgtacccgggattctccaggcaagaa

SEQ ID NO: 52733 - DNA, 1579 bp, Bovine  19866881211365
ctactaagttgcttcagtcgtgtccgactctgtgtgaccccatagaaggcagcccaccaggatcccatccctggaattctccaggcaagagtactagagtgggttgccatttccttctccagtgcgtgaaagtgtaaagtgaaagtgaagtcgctcagtcgtgtccgactctttgagaccccatggactgcagcctaccagtctccgccatccctgggatttcccaggcaagagtactggagtagggtgccaaacagcacaatcatgtggaatcaaacagcacaatcatggtttcttacgaatgttttgcttgttcagatgcttcttaccttgcctgaaatctgattcagaggaaataatagatggactttcactggatgtactaaagagatcactgtggtaagttttgtatctttgaactggttctgaaaggattaaaacaaaaacattagaaagcaatctcattagctgttccacaatcatataaagcactacatttattcttgtgagaccagaacatctattgcttttaaacttactaatcactggatagtcatttaaaaatgtgactacaattttgaggtggtttggcatcctggttagggtcctggactctgaaaccatattgcctgggtttgaatctcaggtctactactcaccaagtgcatgatatggggacggtatttaactttcctgtgactcttcttcaattgaaaagagggtataagggaaatgcacatctcctaaggttattgtagcattaaccgaactcatatgcaaagctcttagaacagagcagatgctatataaacatcattctgtttcaggtgctattagggatagaaaaatccagacacccagccccaagctcaaataatttaaaatgcagaagtacaacactgctatatttaaaatgggtaaccaacaaggatgtactgtgtagcacaaggaattctgctcaatggtatgtggtagcctggatgggaagacagactgggggagaatggatacatataaatgtatggctgagtccctttgctgtctgcctgaaactatcacaatactgttaatcaccattgttaattggctatacaccaatacaagttttgttttgttttttttttaaatgtagaaatacaaaatactcaagatgggacatttagttccaccagaatgagatcagtaagcactgggagtgggtggggggtctgtgcagggttgtgcggtgtatgctctgtacgaggagggaagcactccactgaaatctaaattctaccttctcaatgtctctgcctcagcccctcatcttcacacttctgtgatcactagcatagatgataattccatgataagtctcatgcctggactacttttaactgtcctagattcccctttctgcagtcttgcttgtctcatattataacgcacattacagagagtgaactttccacgaacgaaaatctgagcacattgctgtatttcttaaacttcttcaaactagagtttttaacatatagttcaatgtctccttagtattcaaagcctttcataagttgatccacgactacatttacagcag

SEQ ID NO: 52734 - DNA, 1169 bp, Bovine  19866881218208
ggttgaaaaaagtttactaatgttgtcaataaaggaaacaaggaggaaaaaggaaataaaatataggcaagctgaaaacaaggaatgtggacctgtgaaataatgtaagaacaattataaagcaccaccaaagaacagaaattgaaattaaaatttactctcttacagccactttgcagaaatagttatgaaacagtaaattcatgaaattgttgttgcatggcatagattcacgtgactgaggttctctactctgtctaccgaataggtttattgcaactttcagcttttctttgtgaggtaaaactatattgcctccatccttgtgggtcttctctttggccttgttggttttaccgtcctataggttacaatgccaggtttggcatttggtcaagttaccttgggaaaatccctcaaaacttttccatggaagttctgtacaacaaaagaaaaagttctttgttgctccttgaaaataacattcttcttacataatcatttaactatgttcataaaattcaagtagtattagataaagctattatttgacatcttctataatcctttcaaatcatgttcctcttataccagaggaatttgttttattttgttttttattttaccatgtcacttcctgtggtagcatggaatccttttttttttaagtgctggtcaatatttgtcttttcaattccagagctcttttaattatagttttatttgacacttacattcactgtatacaaagctggacaaagtaggagtcacgtatattatacctgcttcaccaggtaaacattgttataagaacaatacacaatatcctgtccgtcaaatccatggccatttatcctcctactcctcccggcatgacgtctaccctttgcctcagcatgacctcccatttttccagcccatcatttccatcctgattctacaagcctagtctctgtggtgccatttaattatttcattcattcatctcttgatttttatttttaataagctctcttaaaataccttctagcacaagggaataattcattttgtgaaatacctgccctcaagttaacaaagaagtaaaaaagaagccctcacatacggttgatcatctgttaccttggatcccacaccactcctcggatatttcccatggtctgctttct

SEQ ID NO: 52735 - DNA, 1484 bp, Bovine  19866881310931
tagctcacccaggctcctctgtccatggaattctccaggccaagaatactgggggggggattgccattcccttctcccagagggaacttaccaaccccaggggattgaattctggtctcctgacttgcaggcagatactttacggtttaagctacagggaagttataaaaaccaatatgttaaagataatagtgagcctaagatttccatcttataacttttttttctgcttaatattattttaagcttcttaatgctgagccatttttgttgttcttaacacatttatactattcaagcagtaaaaacatgttgtatttgctatcatgttagccgaactgtttgcttgtgaggacagatatgtgaagtgcatgttattgtgtgtgtgtatgtgtaacttaaaactgtgtatcatatgaaagtgataggtgaaggtcactcagtcgtgtccgactctttgtgaccccatggactatacagtccatggaattctccaggtcagaatactggagtgggtagcctctcccttctccaggggatcttcacaacccagggatcaaacccaggtctcccgcatagcaggcggattctttaccagctgagtcacaagtatatcatatagtgcttgggaattgacttcctgatactgtttgtctctgggcctctttctgacttgaactttcacaagaaacctatgtaacagcccatcttaaaagtaatgtgacttgtgccacagtaggaggtatggagtaaataattaaagctgctttcataaaaagcattccacagcaggaaaggaatgaagaatcttctttgtgaagaaaagcactaaatcacacagtgagaaattaggaaaacaaaaaccaacagagagcaagccatcataaatagtgccttgaggaagtgaacaatgttttaaaaacaggactcaagcttaggaagctgaaaacatttcagtggatttttgggttgccagcaattttaggatcaactcccttgacatattggcatcatatttatgttgcctgtaaggaagttagtaatagaggagcccatggctatcagaagccttcacactgtatcaagtcacttagtcatatattgggctccctagtggtgctagtggtaaagaatccatttgccaatgcaggagacaagagtcacaggttcgatccctggatcaggaagatcccctagaggaggaaacaacaacccacgtcagtattcttgtctggagaatccatggggtcgcaaggaatcggacacgactgagcaactaacactttcacttcagcagtcatatattacttgatatataaatggaggggcttccctgatggctctgtgttagagtccgcctgcaatgcaggagacacgatctgatccctggatagggggagatcccctggagaaggaaatggtgacccactccagttttctttcccaaggacagtggagcctggtgggcctgcagtccatgggat

SEQ ID NO: 52736 - DNA, 1025 bp, Bovine  19866881320741
atggggttttaattctggctttatcattcaatcccatgagtttgggcaagccacttaatttctgtttctcacttcccttcatctacgaaaatgtggatataatttgctatgccttcttcttagagatgataggataaataaactaacccatttgaaccatcataagctcttctgaacaagtagcagcataaaattctaaattttgcctctttttttttttgcttctgctttatttttctcggcatataattatgtactgagggagaatttaagttccttttgaaagaaaaatcataaaaacagaaatcaaaagatctcctagaaaagttttagattctataataaaaaatcaagttattcagaacaagtagtcattgtaggtagatttttctatttcttaaggatgttttgagttcagagaatttatagacaacattagattacacacaattataagtattcaaatttaaaatgaaaccacaagcattttcctttcagagagcatgtagtttgctaaaaagtaaagagcaaacaataaactttgaagagatattaataaaagattttaagatcataaggagtattcataatataacatattttacttattaaatttaaaaaaccttccttgtaaagtacactgttttaactgtttttgttatttatgattaacattatccttaatgggatagcatcattcatctttcccctcacacacagactcaaattcacagcacctcttagaagctaacttcaaaatgacatttcagtattaaaagaggctccctgattccccatctgtcctcacaaatgtgatcaggtacgaaaaaaaaaaagaaacatgatattatcaacatgcctgagttctggagcaccatcgtgctgatctgatcaaggtgtaggtttctaccttaagctcacctggcaggaaatgcttgatttctttctgcttagtgcagctgttacatttagtgcgctggcagtattaaataacaaagtaggggcccacagcctgctagttcagg

SEQ ID NO: 52737 - DNA, 1620 bp, Bovine  19866881330166
tagatgttgttaaaaaacagcacactgaaaatgttacacttgtctgcacacactcttggcttgttcacgtttttcaggtgtatttttatttacaaagtgagcggatgtatagcatgatggagttacaaacatatttggtatctctatgttcatgggaaaagtatataaatatattacaggaagttctagatagtaaacattagaaattgatatagggaatgtttgctaccttttttttttctatgccaatattactgtcatttaaagcttaaatactggcttcaagtatcccctataaaatagctctagtttttaaaaaaatactggaaaataattttgctataaacaagattggtacatgaaaaatagactcgatatgtctataatcaaatgctgccttattcatccctaagatctgcattattcagttagtgttaaaaaaatctctgatacttatcacaggttgcagcagctgtaaaaatacagcaggtcaccattatttactgttattaagaacgcccctctaaggtagaggagaataagtataatgaggttttatggacttgctgtcctgtgacctttaagtagagagcaaagaaatggacagatatccagaaggctgttcttctcatgtcatttcagaggctggggctgctctttttgctcttcttcagcttgaagacgtgtcaggacataaaggatgacttgatagcagaaaatatattgatcctagaacaacaacaaaaaaaggagacagggagagcagacttcagctgtatagtgtgaatatatgatatatagcttcaccaatgttggaagcgatgtttgagtaattttgaaaatatggaaaagctgtgttataaggttgaaagtaaaagcaggatgcagaattgtgcagtgtcatgaaaatgacgagaaagagaaacccgactgacaaagtgtggaaggaagcagccttggggtggtgggtgagtgctaactgaagttatctccgatgggtgggccacctctattttttgtgctttggtgatacttacggtcctctggtttctaaccctgcaccctcctccccaaaccacgtcttgttctagcacagcagctggagtggtcctttaagatgggcgttaacttatgtcattccatactgacaatcccgtgatggctccatctcactcagggggagccccaagctctggccccgtcacctcctctcacccctcccctcctgctccctctgcctcagccactggttgtgactactcttgaacacagaagacgaactcctatcatggacctcttcgaaggcggttctgtccgcctgaaaggttctttctcccagacatccgtatgaccacctgcttcatgtccttcacatctctgctcaaggggttacatcctcagtggtaccactctatgtaaagtattacccaacctgccatgactcatcctctacccaactctttttccttctaaagcacttaccactttcaaatatcttataacttatagcataaccgagtacagtaaatggatctattatctgccttgctcatcaccacccaccagaagatcttttattctggcagaagatctttgttattcaagttatttactgacatg

SEQ ID NO: 52738 - DNA, 2283 bp, Bovine  19866881380771
aagggtgcttcccaggtggctcaatggtaaaggatctgcctgccgatgcaggagacacaggtttgattcctgggttgggaagatcccctggagaaggaaatggcaatccattccagtactgttgcctgggaaatcccgtggaccgaggaacgtggtgggctacagtccatggggtcacaagagtcggactcaacttagcaactaaacaacaacgagaaggaatgaaacctttttgctcttacagagttcacatcagaaatagagcaaagcacattacattcttctctcattgtagtaaaatccctattcaatctcctaggtgactctctgttgctgtatatcatgacttttaaggatataatgtgaataatatgatacttattattagtagtggtagtctttctaataatcattctatcatgccttaataaaccagactcacatgtgctccaggcaaatgagttcagtttcaaaagcgctttcattatttttactgagagcaattcaccaaaacctccgccctcttttccagaatcgactcttcattgttgtttctcttttgatttacagtgaatgaaaagctgctctaacattatggagttctgttctttacagaaaactagctctgctgacggataaagtacatatatattaattagtagcatatgaagatataattatttgaaagcagacaatatgaaattcgatgaagtagataataaaggaggatatttattcaccataaaacatttctctggatcaagccatgtactgggcactggggagacaagatacagacacaatccttgctctcaggaactgacaatctggttagattaaatagaaattgcttccctgccaccccaattctaatgtttatcattctaatttgggcatttatcacttcctgcttagaataccacaatggtctcgaaaaagaggctaaattgatttagcctttggtaaatccccctatttgatccttcctggattgcctattcattctacctctcccttttaaataataataataatattaatgtaggattgtgtaatcctgctcaaaaagcttaagaattgatgcctttggaataaagttctaattttttaacacttctaaaatctgatgccaatctactcaccagtcctaactgctgtattatccccatactataagttaaactatacagcaaatcattccctatatatgacacattctttcccatatttccatattcctaccttggataacagtgttcctttgtttagaattccctctgttgaaatcctacccatctaaggttaagttcatgttccacttctaccataaagcctacccagaattcctctagccagaactactcacgcaggcacccccaaaccactcttacttctgtgtgcctgcatgtgtgtgtgtgtgtgtgtgtgtgatctaaatgctttgacttctttgtatcactcttacggcaccaaatactaccttgtattgttatgtttctttctttcttcctcacaaacatattaaacacccccacataactcttggcatgtgtcatatacattgagcgattagttaataactgtgaggagttgaacaaatacagtgagaggaacaagtgcaccagacatgagagtaaatatgttggtggggacaaatgtcatgggaagctctgtaaaaaaataaaagaagtggagcttaatattgaagaaaggaattttattcacaattgtgtcaatgtattgtttccttacaagaatgttccagcttctcacataagcatttcattcatttgtaagatatgctgctgctgctgctgctaagtcgcttcagtcgtgtcggactctgtgcaaccccacagacagcagcccactaggctcctctgtccctgagggaggtacaaaaaagtatggaagtcactaggtgaaattattgtgaaaatgtcaggaaagaggaaatttagaatacctgaaagaaaatatgtccatggtagcagcattatttgcagtccaggcaattaagtgaccagattgtatatgctaaaatagctgtttacttttgttttctgtattaaggtgtcaggacttccctggtggctcagatagtaaagaatctgcctacagtgtggagacccgtgtctgacccctgggttgggaagatcccctggaggagggcatggcaacccactccagtattcttgcctagagaatccccatggacagagaaacctggtgggctacagtccatgtggtgacaaagagtcggatacaaactagcagctaaca

SEQ ID NO: 52739 - DNA, 1324 bp, Bovine  19866881426406
caagttctagtgtttgataaatttgaacagagcgaactaccttgagattttactccttccccttgtgtgctcactacccatcccccaacgtctttgttagtcttttgacttttctaaatgcaggtgaaatccccactgaaatggtaaaatcaaacttgattgtgtttttgctttgattttaggctagcgtgagaaacaccaacggcaacaccatctcagatctctgttatggcgactcaggcaagaagctgttgaattagacccatttcctgtagatgagaaaccatacaagcagtggtgagttgcaaacttaaacacattccttagcaggaaacatgtgatctacataagcaatttaaatattgcatatgatttagtgtgtggatctgaagaaatactgctcccaaatcatgtcaactaaagaggtgaaaatcagtgtttaactgatggtgtggtgctattaataccacgtgaaggagcttgaggcctttaggggcataagtgcgtcatccagcaccataatgctaccgccctggatggtactagtctaagtgagatgactgcagtgagcaatttcctggggctgcgtaacagttgggtatttacataacagtatttttcagtggcatttattatctgcaacataattctacattttactgcttcatcttctctaggagaatactggttctgatctaaattctaacacttaattcctttcaggaacatatatgctcgtatatggggcttcccaggtggtgctagtggtaaagaaccccctgctaatgcaggagacacgagagatgctgaagacacaggagacgctggttcgatctctgggtcgggaagatcccctggaggaggccatagcaacccactccagtattcttgcctggagaatcccatggacagaggagcctggtgggctacagtccatatagggttgcaaagagtcagacacgactgaagtgacttagcatacacacagcatgcgtgtacatatatatgtgtatataagatatatgtgatatatattaacataacatttagatctttagacataagggaagagaaaccacatcatagttttataaaactcgatttgtggacattttagcctacaaattctttgcttaataaagacagtattaaaaatagatccagctgctttgttatttggaatcattttaaaatcttattattttataaaaatatcagctcacataggcaaaatatattttttaatacttgatgcttcatagttgccaatgtcaataatcaatagactccagggagagaaccaggtatatctgtcaaacaacat

SEQ ID NO: 52740 - DNA, 729 bp, Bovine  19866881560478
ttcttgccatttcctcttccaggggatcttttctgacccaggggtcaaacctgtgtctcttatgtctacctgcactggcccggaggcttctttaccagtatcgccacctgggaagcccacagtctattacatttcaaacttgaatgagaacctgcagtgatttaatttgattcacattttcagggttgatacttatttctggtccaagttcccaaacggtctaatagaaaatcaagtagaatatctatatttgttgccagaaagaatagcaccattgccatagcgttttgggtaataaagaatctatatgggttggtttactaagcattctaatagtaaacgtgttctgtaattctaagacaggtatgttctgtctcatttgcaatttatccttttcaaatgaaactccgtaaagagttattcgataaatgttaaattctattggaagtcaaatgttcataattccataaaatcatctgccttgatccataatagctaaaatatagcctcaaactactgcacccgtttaaacagtgctacagcatgttttgagtcatgaaaaactatttaaggaacagcttctgacaatttttgtttacagatcagaaaaatcatggaaaaagttgcatctgtttgtccttgaaatttctgtatcagcttctcacatctcaggagaatacgtcccctatacgtgaaatatttcagaacataatctagtcagccaccaca

SEQ ID NO: 52741 - DNA, 911 bp, Bovine  19866881852901
aacttctggcaggcaaaatctagaaaattacttttcaaaaataactttaaatcagcacttctgaattcctagttacaagcaggagaaagctttattgtaccagaattaatgtggttttaaaattttaatcacacttgagagatgaaagtagtttggggaaaaaagaatctttggagtttattgctttgaaatggaactcattttaactaactttgttccctagttagcagattaggctttgatagatgtttcttggcttgtatttcctgaagatgaattggccagaattaagctacgtaaatcttatccaaggaatatatattaacaatagcatatgtgcagtgtttttactcaaatactacagcttccaaaaactatctagttggtgtcattctgtagacacttaccttgaacagaagggagattctttagtcaaacttgacttttgattacctgtgtacagacggatcagctttcccgtagcagcgagcaaaagcctgatcgaagccaggctatccgagaccgattgagaggaaaaggattaccaacaggtaagagtgtgttaacagaaaatttttagactttaaatttgttactatttcctttacaaaatcttagttaacctagcttgaaaatctggtacttatgatcataatcataagtgtgcaaagtggaggcattgaacaggtaggaacactggatgtattaatatataaatccttgatcattttgcagaaaatgttaatacagtcaggacacccacagtatatcatttctttcccaatattgttattatagcaataatatctttatttactttatcatgatatttttttattaaaaatacattttaaaggatgataaaacacacaaatttatgaacataaatgttactaaagcaaaagtttcag

SEQ ID NO: 52742 - DNA, 633 bp, Bovine  19866881854597
tccctcccccgccaccccgccccggatgagacaactccgtctctagcggccctttgcctaatcctagatccacttggagaggtagtgtaggctggctcccgtgccagtggagaaagttcagggatgcctctgggactgttcctgcagaggatgagagcgttccaagtacgaaaataccaaccccaggctcataggagcgcactccatcaaagcagacacagtcaccagaagggaattttgcttaattggtgtaatggcttatcagcttccctggtggttcagatggtaaagaatctgcctgcaatgcagcaggcctgggttcgatccctgggttgggaagatcccctggaggagggaatggccacccactgcagtattcttacctggagactcccatggacagaggaacctagcggggtatggtccatggggtcacaaagagttggacacgactgagcacctaaccctttctaccagccgacagaatattacctgcttctaagttgctgcatgtcagtataaagcagattattccagtaagtgccagcacagttgttaaagctggtgtcaaagttgatccttggttctgggctgttctcttagtcaccagtggcacaagccagagttaaccag

SEQ ID NO: 52743 - DNA, 1304 bp, Bovine  19866880652268
cctacttgctccttatcatctcacttgtccttgtgattcgtgtcccaagattgccttgggagcttgaggattatatgcctggaaaagtcggggagagtgtcctagaggaattcttggccagcaatcagaggatgcctccttccttgccaggaccttcatttattaattgattcattttataggcagtgagtgaaagattcagaactccaagagacacatgagtcaagggtttatcacccatgtcccttttaatttgacttgagactataacaagtcagctaacggcacaagtttttcagttctcaccctgaagtttatttccttgagtgtttaaagaatgtaagcagtacctagaggtgcactgcccactttagcgtccatgggctgagttctgtttccatcacgagcacctgagatgactagcaggggtgatggccagctgccgcttttcctttcacaggcggcccctgacgtgctgcctccatttttcagccacgggattatcaagtagcaagcgtagcaaaatcttgacacgaagtcttgaggactggaacatcttcctttccttgttaggatgtaacttaccacgctgggcagaagcctgcttttgtagtggcagtcagctctgacgattttttcccagaagaagaaaccccaccccacaaaggaccaaagtgtaggcctgctggcagaactgtccacaggtccccagacatgttccattgcttcagttctttacctaaagtcagttacagatgggttcaattcttaagaggagtgaatcctagtaactggcctgaattcaagacaaattaaagaaaatgagccagtgtgagcttgggttattggcaccagtgcaggaccatgccctacaatgacatcaagtccaaccaaggctgctggaccggactttgaatccagcaactcagagaatcccacttgcaagtgcttccttggtgtctaatgtgtacactactaccttattggattcatctaatttctaacatgtaatcctgggatgcaacatttttctttaactcaggttaactggggtctccacagcctctcacagggacactactgacacctcaatcggcattatttgatagatacctgatactggagtggtcagaacgttttctctatccactgcacctgctatccattaaagctagatcagacaatgtagtatatttcactttagcacaactctacaggaatccaagccaagccagttagctgaaccagtatagactggtggagtacactgatgatgacaggcaggcagtcacactgacaccctg

SEQ ID NO: 52744 - DNA, 2058 bp, Bovine  19866880734295
aaagaaaaatgaaacccagaattctaagcaaagtgaaaacacagcgaagtccactagtgactggtactagtattaccggtaacaagcttgggggctggggacacagagaagaagcagggtacattttgagagtgctgtcacgggtaggggagccacttaccatatcactgacgggcttgaccgtgtgatcaaagcccacgcagttctcatccaccatgcgcagagccttctggaaggcctcctcaaaagaacgcccaatgcccatgacttcacctggaggaatatgatgtgaggattgagggccagggggcactggtgttgcccagaatgtcggtagtttaccgtcaaatctctctgggacgttctcaagcccacaatggtggatttatgttgtttcattgagaatcttacacttgcagctttttctccctaccattttcatgtggatattgaacaatcacagaggcccaatcactgatggttatccatttatttggtttcctttattcacattgtgatgatgtaacctgggatctggctcatcctttaaaactttttaaaagtctgggtagtaagatgatcccattattctttgaattcactcagggttaatcatatttccaacaatcactctagagtacttcttccaaatgttttatacaagattatagtttacgtaaacatttatcctgcttttcccctcattgtaagcttttctcacattagtgtgtgactttgttaccagcagtttaactcttgtgtgatttccataaagtgactgctcactcactgaaggacacttagctttgaagtgttcatcactgtaaataaggcggtaatgctatctgggatttagtttatctcctgaggatatattttcagaagtgcataggcaataggcaaggtatgttttttggcccttgataagtattaattgctttgtagaagtctgtgctttataatacaaagtattgggttggccaaaatgtttgtttagctttttccataagctattatgaaaaacctgaacgaagcttttggccaacccaaatataaatttaaccaatcttttaagaagtgggtatagtcatttaaaacaacttttgccaacaagtaaaaataattctctcattttaactagatttcttctaactactactaagaggaaacttccctcctatacccaggcctgcttattgatttcctcatcaatgaagtttgttcatgtcctctgacaatctaccctagagtcttcaaatatctcttaccaaatgtatttttctatttacaattctagtatttgtttctttacaaaaattttcaaaaacatcaagatggtactggtagtgttaaggaaaaagatgagcgattttgttcaatttctttgtaatgtggttatatgataaaagtttttatcctggggaaaagagaaacccaatgcactcacatgcaagcctagaaaaaatcctagaatcatataaatccccaaattaatgtctgtgtgataagattataggtgattactcttctttggtaaaactaccttttctaatttctcaatgattcatgcatcttacttgtataataaaagttacaaagagttaccaaagaagatcaaattccaagaatactcagatataaaatacttaaatctctcatttaggaatcaatctttgtcctattttcaatccacttctcttggctacaatttatggcttcgttcccatgtttattataattttcacataacagaaattcatctccagaaggaacaacttggcagtcttgtaagatttctaaaaatcaagtaatatctgagcttagacttacaagtttaaaggctactactgctgttaatggaaatttggagcacagtaaaaagctgttatccttagctggtggcagcttggtacatgcacatgcttgttttagtagaaatgttgtggacgacaaactaagggaacttaaagaaagggtcactgtaaggcagcatactaactcaattacagcattcttaacattgcctagaagctgaccatcaaatccattcattactaa

SEQ ID NO: 52745 - DNA, 1616 bp, Bovine  19866880746324
ctggagcccattctgtgcacagaaggttttgatttctcagcccttcaggcttcagagatactggtcttgcgtctgcgaggtctctcgtctctggtcttgaggccccagtcccttccggattcaaggcaatgttgcctccaaacaaggcccaggtgctgctacggaacacagcgtcccctgggcggccccctcagggcccctcacaaactgaagactcccttttctataacctacaacctcagcctcgccaacaatcactccgctccacccagccatcttgctctcctcccccacggtcccactctgcggggtcccatctctactcttctgattcaaattcggactttgtcctacatccctactcttcttctctctcaaattcccccactttctttcatcagaattgcctctctctctcccctccctgttcttcctcaccttcccgccggctatacccctctgctaccctcactcactcctcgccctctcagccacagaattcctctttcccccactccccttgccagtcacctttccacctcgaagatctacctacctccactctcacgtccccgagccccagcccaccttctcgtggggtccactctaacagccaggcatggcacttgcatcagtacaggaacaccaggtcccctggggcggagggggtatgcgtggcaagcgggaaggaccctgcagagttcaaggacccaggagccctggcccaagccctggtgctccatctggggcaccgtcgtatcgcccacgacttgcagctactgcttttgcagcgcctgtggctaggccaaaccgacaaggccccggtcgtggaataccctgtatgcctggtgtgtctccggctccgcaccccctcttgccccatccccaggtacaggactggacccaggctgcttgctttcccccagctgctgccctgtgcccagggcaaggaatctggaccactccgcatgggcattggctttggcctccgcctgcctcagggccaggccaaggctctacatctgctgccaaaaagaaggccggaggaagcagggcctcaggccaaggctgctcaggccagtgggtgtcaagcccaggtagctcaagccccagcagctccagccaaggcagatctaggggcagggcaccctgtcccagaacgggagcttcaggtctgtagaccgtcagtcactaaactccacacgccattcagagtctctaactcaggcaccaaagcaggctacggtccacttgaagcccaggccttcctctgccccaaagagacctgcctctctagggcccattccccaaaagtcaccactctagttccagagccacggaggccccctggagcacctcttctgaatcccaccagccctgctcggctccagacctcagggagcccccgagacactctgaagggctggctggctggaggtcaggtgtgttctccagtcctgaaccctgggagccccttgtggagtctgctttctcctggctgaagaggaccaagggcatctgaggccccactcagccttctgtgtaaccaattaaaaaaaaaaaaaaaagcctgaccctgcaaaacttgtgtttgcatcttgctgagcagatactgt

SEQ ID NO: 52746 - DNA, 3404 bp, Bovine  19866881067975
tggttggaagtgatggggtaacccgggagagcttcgcggaggaggtgaggcttgaacggattatggcaaactgggcggcgggctggctgttctggcgggggagagtgcagctcgtgccaaggtttgcgggcggcgagcgctgagggattgtacagctctggggagcggtgaggaacggaagcactaaagggtctgcgcgcgccctgggcgccgcgcctccacccacgccctgcgcggggcccgcgccagcctctcctccacgcgctcgcctctccccagctctccgcgcgagacccagcccacagtccacgcgcgtcaagggagcgagggtggggtggctttcttccctcaatctctccgagaagcatggggcctcagcttcctctgtgagttatggggaggcaaactgaatcggctagaggggaagccacctgccaaggtcaccttgttcgtctgtgtcataatcagggtgcagatcacgtcctagctcaggtccccgggcaagtctcgcctggcaccgtcggggttttgttgttgttgttgtttgtttgtttgtttgtttttgaagctccgcaccgggcctgggacttggccaactctgagagccttggagcagagacgcgggggccaccgctccctccagggctcggatgctgtagcctcgcccggagcggccggctccagcgagctggaaaatgggcagacaccgcgggagcctgtgcgggacaggggccgctaggcacgcctcagccaatgacgacaacaggggaatgtgataacaacaatggcttcctccgggatttcctttcctgggcagcccctgctaggctcagggacagcagcccccgggtgcccgggagggggcgcagacgctggcatgtgctccaccggccacccggcagggagcgagaaggctggaagggaaaggggcgttggagcagatggatcactgggctgtctttcccctcagctccctggccttagaacatactgcctggggaagctgagtgcaacgggttgggagaataccaacagtttcttttgcttggaaatttatgcaagataagcttggctttgaaaaagacagcttgcacctgtttctcaagaaaccatcaagtggccctgtgaaaatctttgcaaagtgtcctcttgaatgccaggtctgaggaagacattctgcacctggacaggagatgggaagactgtgcaggagttaggacagcttagggctggtgccctgtatggaacacttcattcaaccttcactgaacagtaatttcctgccatgcaccttgctctcccacctggggattcctggtgaaaaagatggacgtgttttctcccctcctagctttgacttgatttctcttctgcagttttgggttactgatgtacccactcttgatgctcttcttcctcagatactaattttccctaaggtgtgtccttaggctattcttagtcccaaaggagatgaggcagggagccctggaggttctcaaaagaacaggtcagtgccagcttccagagcacacagtgacagagcagctcaaaagggggcttcagggggccggaccagttcacattgggagaaaaggggagcaaggcccagtgctgaggtcagcatgtaggctgagccagagatcttgggcaagatttggagtccaagcctgtggacaagggttaatgtgtgaaagggccatgtcaggctgaagggtacatacagaagtgttacccccagaaagcctttcctgatcccgccatcccctgtcccaggtgggttacctgctcttccctggtgatctcaaggtcccacagtgctttaggtgctgggaccactcaccacacgataacaaaatcatttgtttttctgtctcttcactagagcaggagctgcctgaagacaggtgttgtctttctcaccactgtgtccccagcttgatacacaatcccccgtaaagccatcccagaaaggaagacctgattgtcagagtggaagcaggaaggaggaagcaggatttagttggagacatagaggaagaaggaaggctgcagcttaaacgtcacctcctcaaagaagccttccctgattcccccaaaccaggctagtgcaggttatacattctcattgcacacttctttttcttccttagcacttatcataccataattaaattattattcagggattatttatttcttcacttggctttcaggatgccataatctagttttcctcttatgtcattgactgcttattttcagtctttgctggttcctcctcatcttcccaaccttttaatgctggaatagtccaggacttggtcaccctcttctcttacctttctacactcagtcccatggagatatcatccagtctacaggttctaaagactacctggaaacagcaagaaatgattgttgaagctggggtataggtacatggaggatcgatcattggactactctgtttttatatgtgtttgaaactttctattaagaaaaaactttaaaaaataagtggcatcttacatgacgattcccagatctctctcacttgaactctgatctcatatacccagatcaatttgacttctcctctttaatgtctaaaagcgtctcaagattcatctaaaaccaagctcctgatcatcaacccatcccaaacattcccttctagcagtcctcctggggcagaacatgggaactccatccttccacttgcacagaccagaaaccttagaatcatccttgacttctctatttattctccacatccaatctgtcagcaaatcctgttcccatccttgtccaaaccacctttgtctgccttcttgattattgcagtagccttctagttgtcttcctttttctgcttttgttgccctgtcatctagcctcaatccaggctaggcaactagacctgtttcctcactctccatctcactcagtatcagccaaagggcttccactggcccacaaagccctatgcagtccaactcctctgatctcatttcatactactcccatctcaatccccagccaccctggcctttgtgcatgtgggtcctacagcacaccaggtacactctgccagatgtcttcacaactcaccggaggacctgcttcaggtcctaacttgaatatcacttttacaggccttctctgtttttctttttaaaaattgtattcttccctcaaaaattttccatctccatcccctgctttatgtttctctatagtgatgattaccacccaacatactgaatattttacttgtttactgtctatctcctctcaccagaatttaagctacatgatgtcagaaatttttgtccattttgtatgctgctatatccccggtacctagaagagtatcggcacctgatagcacctaataaata

SEQ ID NO: 52747 - DNA, 1056 bp, Bovine  19866881433106
tagcttgtccgccctctcccccattaggagttagagactccaacagacaagcgcatcttcgtggtggcagcagccctatgggctggctactcagtggatcgcctgtatgaactcactcgcatcgaccgctggttcctgcaccggatgaagcggatcatagcacacacccagctgctagagcaacaccgtggacaacctttgcccccagacctgctgcatcaggccaagcgccttggcttctcagacaagcagattgccctcgcggtcctcaggtcagggatggtgggaggatctcaggctgagaacctggggcagagaacctttgtactccgaaagggccctcaggaggaaaagtgtgtgtgtgtgtgtgttggggggggtgttggaggccactgcccttcatccctgggattttcctctctgattcctcccttggatctctgccctctgctggggccattccccactcccatggtctatatttctgacccttctttagcacagagctggctgttcgcaagctgcgtcaggaactagggatctgcccagcagtgaagcagattgacacggttgcagctgagtggccggcccagacaaattacttgtacctgacatactggggcaccacccatgacctcacctttcgaacaccccatgtcctagtccttggctctggcgtctaccgtatcggctccagcgtcgagtttgactggtgtgccgtgggctgtatccagcagctgcgaaaggtctccaagctcatctttcatatgggtctctctgctgtactgatcagcttccgcagccgccttccccccatacttgatcctggcactttctattcattactgtgcctcacatctgtcatagggctttaatggggttgggggtcccttaggccgtcctgtgccctacacgtggttcctctccagaactccgtgtctacttttccagtaccttccctcccaaggcaggcgtcctgtatagcaatttcagacagccaaggcagtactctctgaagtagggacttgggcttcctttcctcatgctatccaccca

SEQ ID NO: 52748 - DNA, 1446 bp, Bovine  19866881646139
cagaatactggagtgggtagcctattccttttccggggatcttcccaacccaggaatcgaaccgggtctcctgcattgcaggcagattctttaccaactgagctatcagggaaacccgtacctaaggtgacatagctaattagtggccgatttgaattcagatctgtctgaccctaaaacccatacctttgatcacattctatggcctcaccctgctgccccaactcccacatggacatttgctgattcccacatgccttcagtctgggtctctcccagggaaggcaccactgtatcctgggtcacatttgtggccgaggcaccttcttgactccaaggcaacttccagggtggggcttggggggaagttactggggagatatttttggattgcagaggctccaccagaccacagagtaggctccctgcctgctggcctgtcaggttgcctcagccacgtggacatgcttgtggccactggagtcttgtgacagcaccagcacccagaggagcttgtctcatagcttgtggttattgggaaggctccctggggtggaaggggttaagtctctcctcccactaggaaggctccaagtcaggccctctatccctgcctcctgggcactgacacccacactggtggctgctctgcaccaggaagacctgggcctccagcaagggcacagctcatggcaagcctgggtcgcttcctgctgctctggtctctgcaggccctcctctgggcttggacaagaggtgaatttggggaaatagagaaaaagagggcaaaggattgttggatcaaaacctctggaatccccagccagagcagctcagtcattgaaaacccacagactgccaggaagaagctggctctgggaagatttatttgctctgcgactctgccaagtgagatgccaggtcacaggtggagccctcccgcaacccggatcagcccagggagaagggtagcccgatgccaggctggccgcagaggagaaggcaacaggagccagtgatgccagcctggggcggggtgtgagctggtgcccgctgccacagggcactcatacaatgccatcaaaaccctgcagaccgcacttcttgccggccacctggcagccgaacctcagtgcctcctgcatgctcttccctagagagagggacaagtggccaggtcagccgggtcttcggggcaggggcaggccccagccctgtgcctcctgctggggtactcaccctgggacaggctgaagatgaccgccgcgttgaaggtgtctccggcccccagagtgtccaccacgcggggcggtgggaaagcatcggagtggagcagccgtccatcaggccccagcgcgtcggcgccctcctccgcccaggcacagaccagcgtggccctgcgacaccctcctctcagcgagctgttagcccagccctggccccagc

SEQ ID NO: 52749 - DNA, 3220 bp, Bovine  19866880449923
tcaaagctatcgtttttccagtagtcatgtatggatgtgaaagctggaccataaagaaggctgagcaccaaagaattggtgcttttcaactgtggtgttggagaagactcttgagagtcccttggactacaaggagatcaaaccagttaatcctaaaggaaatcagtcctgaatattcattgcaaggactgatgctgaagctgaagctccaatactttggccacctgatgcaaagaattgactcattggaaaagaccctgatgttgggaaagattgagagcaggaggagaagggggtgacagaagatgagatggtcaaatgccatcactgactcaacggacatgcatttgagcaaactcctggagatggtgaaggacagggaagcctggcgtgctgcagtccatggggtcgaaaggagtcagacatgacttagcaactgaagaagaacaataacaagcagaaacatagaagcaaatgtgaacagacagaatgaaaatgtgtgtgacaagaaaacctattaattaaggtatctgggtcaattaaatctactttcagaggagaatgaaacatatttctgggtcctgaggaaccattatatcttactttagggtctgttcctaatctgactgattacctgtttttcaggaggtggattactatttccctctcttttgctgcatattcttaatgtttgttcatattaataatgtgaatttgctaatgatcacatcacattccagaggcacctttaggaattttttggatgagtgtttgttttatgtccccatctggcatgaagcttcttaaggacaagaacttatttcttacatggacattagcaaccaatggcatactgtgatatcatggtaatattttagttatttaccgaaatttttcctttcctcttatacctttctcacactagatctcacatttttctctagctttcaacctctataaatcaaacttttcttcttctaaccatgtcattgtagctttcaaaatttcttctctcaaattttacatattttacatttagagtttttatacaccacttgaggttttcttaaactatgttttaaaggggaatttggatttcttaggatctgttttgttttgttgttttttttttttaaatttctgggaagtcataagtggaataacaagcattttatgttgctttcttcaaggacataatattcttaagaagcattatgaaaaattaagattttgcctttgactatgtgggcaattttgcctcagattccatcatgaaatgccatcatatagtgttaattcctggcaggctcttctcttgagaaaatgatcattatgtattaaaagaaagacacacttcatatattttatatatatatatatacatatttttttttctgtgtcttctgtgagacatgcttaccttgaaagaaagaaaccaaagctttctttctattttgcagttgagctgtgctgggacaaaatcacggtattttagctaaatatttctgtaatatttttctgattataagctatatcttctcattatggaatatttggaaaatatgaaaactatgcaatggaaaataaaaatcacttgaacttagttataaatagcattgacatttcagggaatttcctttcagtctctctcagtgtgtataaatatagcttacctcacttgtgcattcacttctctgttttgccattttgcatagccttatattaatagtgtttccatatcattaaaatcatcaaaagtatcatctctaaagaatgtacaatgctacattgatggtcattttctttggtagcagttttattgagatgtattttaaatacttatattcatataattcacccatttaaattatacaattcaatggtttttagtgtggttacagagttgtgcaaccatgaccacaactaattctagaatagtttcactactccatcaaaagaaaaaataccttttagttatagcctccaattcccctagctctcccatcctagataaccattgacctgctttgtgtatagatacgtctcttggatattttttttataaatagaaccatatattgtgtgatctttctaactggcttccttcagctttcatactgtgttcaatattcatccagtttgtagtgtgtattagcacttcattcctttttatggccaaacaatatcccattgtagtggctatgtttttaaggtaagtcttcataaaacaaggatattgattctaggcttgtcacaatttgtttatggagttttacgcagtgaaaaggatcacttgtttaaactttaaagtaagatacattgatttttttttctatttttagatctcctttcttccccattcattcagcaaagtatttacttacagagtataaaatatcaggctttgtacaaactttgtgaaaataatgcaaacaaaaccgacacagctgctgcctttacaatcctgtgaggagcccagctgtaacagacagacctccaaacaaagatagactcaaaatttaaactgagataagaaggagcaccaacttccagccgcagtttacaggaccctgtgaagtgaaagtccctcagttgtttgcaattctttgcaaccccatggactgcagactaccaggctcctctgtccatgggttctccagagaagaatgctagagtggggaaccattcctttctccagaggatcttccccacccagggttcaaacccaggtctcctgcctgccccacgtctcctgcattgccggcagattatttactgtctaaaccaccaaggaaggcttcatcaggaccgtgaaagtcaaagtgaaagggaaactcactcagttgtgtcccactctttgcgatctcatggactgtacagtccaaggaattctccaggccagaatactggagtgggtagcctttcccttctccaggggatcttcccaactcagggatcgaacccaggttttccacattgcaggtggattatttaccagctgagccacaagggaagcccatcaggggccatgctgctgctgctgctgctgctgctaagtcccttcagtcgtgtttgactctgtgcgaccccatagatggcagcccaccaggctcccccatccctgggattctccaggcacgaatactggagtgggttgccatttccttctccaatgcatgaaaggaaaagcgaaagtgaagtcgctcagtcgtgtccgact

SEQ ID NO: 52750 - DNA, 1957 bp, Bovine  19866880531114
ctattcatttcaaatgcaggttattattaaaccaattatctgcttggcctgttgacattctgagtgcattattctctcttgtaacctcagcatactgtcttgaaaatgccttttctaagtatctgaaattgtaaaaagcaggatggatttagccaggcttaggctatggtttttcctgtggtcatgtatggatgtgagagttggactgtgaagaaggctgagcgtcgaagaattgatgcttttgaactgtggtgttggagaagactcttgagagtcccttggactgcaaggagatccaaccagtccattctgaaggagatcagccctgggatttctttggagggaatgatgctaaagctgaaactccagtactttggccacctcatgcgaagagttgactcattggaaaagactctgatgctgggagggattgagggcaagaggagaaggaaacgacagaggatgaaatggctggatggcatcatcaactcaatggacatgagtttgggtaaactctgggagatggtgatggacagggaggcctggcgtgctgtgattcatggggtcacaaagagtcagacacgacttgagcgactgaactgaaataagcttgagtagacttccaaaatcgatttgagatgtgtcatgttctaccacattgctaaatctgtcctgtgttggtcttacttttctgcgtgtgatactcttctgcattgtcttccctttagaaactgttctgcttgtaaagagtattcataaaaccattttaattgcttttggcatgccatattcatgtacagctgattcttccaaatatatatttgattgcagcattttttgctttaggttaccatgaaaatttcctatgattaaacaatgggtgaataaaaacaaagttgtgggttgttttgcatataggttagacaaaataaacttttaccaataaaatcgctcaattttcgtttagtttctagactaaaaacatctgaatgtttaggcttcctttataaacacagctcatatttgtatcattgaagcaaactaactatgctttgattaaaattttgatgaaatggatctggaaagttctcatcacaagaaaacaaaattttgggaaaaagttttatattcacagtaacagctatttcaaagcagaagtagaaggccatatattgaaactcaaatggataaaaaaggaagtagtaagataaaatgacttagattaacaaaaattaataatgtcaaaaattaaatcatttatttggaacatgaaagaaaaccatgttgcctctctttaggatgaagccaaaagtctttgtctctttatttcatcccatctatatacctccacactgtcattccagtcttgctattttgattattggagtaaacaaagaaatctgggagtataacaacttagttttcaccaagaattgtctatctttagattttaggcaatttattgtctacctgtaaatttacaatttctatagataatttaagtgtagatcagtaaattagatttaagagataatttgtcatgctaagaaaatttaatttgtgttaaaatatgaaaaaataatcttatttgagaagtagatcaaataatagatcattccatctatgtatggaaaacagactttaaatattctttatatttatctttaattgaacactatactcacgaaatacaaaaattagaagatgtattttccccaaaaagtgccaaaacaatttcttacccgtaactcacatcttttaattgactgttagaaaatttcattgaaaaatgatattcaggtgaagtcatacaaccttactcaaataatgtttccaatgtttgtatctaagtcttaagctagctttcttatattaatgagctagcagttttatggctgaaaataactctttattttttatcatttatggaacatttttcagatcttgaatcatgaat

SEQ ID NO: 52751 - DNA, 1558 bp, Bovine  19866880570640
agtttgaatttccattttttggattctctgtccagctgttgcataatggaaatttacttttagaatatattcagagaatataagtccttctaagtgcttctataacaagtgtctctataaaactgaatagcaattgtagccttgaaaaatattagaaatgcatatctttggtatattgcaattataaagggaagatctgcattacttcttaattgtagttattttctaaaatgagtttgagtttcacatgtgtttgcttaatggagctaatcttccttttgtggtaaaaagtacttgaacagtgtctgtgtgtgggtttttttttttcttttcaaaggaagtacattctaaccattgcttaatatctggcagtcattgaagcaaaagaaaaaaaaacatttaatattctttgcatgattttccatccaaataataatatcaaaatacccagacactggttatgaaaatatagaaattgtggcaacagccaattagttcccagaaagtcttacactttcataattttttccataataatcaggcattggaaaatcttctggtacacacacaagtcatagtaaggctaataggtcaaatgaacctaaactctcttcctatttccgacaaagtataaaacagcatttccagaacaagaacaacacaaaagcaatcaaaatcaatgtacagtcaataaatacacagtcactgtgaaacaaagatgctatcttatttatatttgcctcaaggacatattaagtgccccaaatatttcagcatccaatgtatctctggcctgaggaagcatgcaggaggggaaaatcagactgttttccaatttttttcaaaaggctttctacttgcttccaggtctgatctatcatttctacagtgtcatgtcttagaaatggacacccgttggcaacacgtttcctcctgactctgtgctgtggagatgaataggaaaaggaaaattttaggattgagaagctgatctgtttcaaaagttttcttccttagagtaactttgtaaaactaaataataagtgtcctcttctgaaaatatgttacattcatattaatgaaagtgaaaagttgcagtccttcagtcctggggatattccagggttgggaaggtcccctggagaaggagatgtcaacccactccagtattcttgcccagagaatcccatgaacaggggagcctggtgggctatattccatgggatcataaagagacagacatgactgaagtgacttaagacacacaacacacagattaagaaagtgaaatatagaaaggataaacaaattgctcacaaccacatggtttataggagaattccatagctcagttggtaaagcatctgcatgcaatgcaggagactccggttcgattcctgggttgggaagatctgctggagaagggaaaaactaggcactccagtattctggcctggagaactccatgggatgtacagtgacttccctgggggctcagacggtaaagtatctgcctacaaggtgggagacccgggttcaatccctgggtcaggaagat

SEQ ID NO: 52752 - DNA, 1139 bp, Bovine  19866880623187
ctctttgagaccccatgggactgcagcatgcagttaaaatgatgttaagaagtgattaaaattgaaatataagtgcttcactattacaagtgtacatgtgcctctgtagtgattctgcaataataggcaaactgtattttgagaaaaatatattttcactaagtagtaatatgctttgattcttttctgtgcaattcaaaatgagtcaaaaagatgaaattactgaatgttaggtttctttctttatgcaagatttatgaactgaaactgtcacccagtaagtttacattatcaccatttataataaaatgccaaattcagtcacaagaaaaaaaaaataactgagactatgtgatcacaaaacatatcattctggactttgattaatatgaaagtggttcggaattcattaaaatgaatttcctttagacacgttcagttcaccctctgtgagatttatttgtttgcaaattgggctatttggccaatgataagacatcaaggaatgaatgagagaactgttttcattagctccagtgaaagttcagccacattctttgtaggggttgagttgttttccacctctaaattccagtcactcctcattgatcttagaaaaaaagatgtttatgtagtgacaatataactattttataaaatgtaacagattttccagattttcattatttactctgaattttttttctttggtaaatcttttggctttgctgtgtttttttccgaaggcctgtataatagaaaaacaactgaacaaactggaataaagctttatttttaattggggtatgattgatttaaaattatattcacttcagatgtacaatgtaatgatatgatatatgtacatattgcaaaatgatcatcattatataagtgtggttagcatcattctccatatatagtgacaaatgaatttctttcctgtcatgagtattttaaaaagttactcttttagcaagtttcaaacacgtatcttgatattattaactatagccaccatgttgtacattatttgcccatgattatttattttataactggaaagttggactataagtaattttttaattcaagtatacaataagctgaataaactgaatcttcactgagttttatgt

SEQ ID NO: 52753 - DNA, 2453 bp, Bovine  19866880683932
tacccatagtagtagatataatgttcatgtgaataaattcacccattcccagttttcccaatagccagtccctcctgttatgaagcttgcaaaagcctctcattcccatccatcatagggcagacagaaggtgtaagaactttaatctcacagaatgaaaaccacaatcagaaagccaaccaaaaatgatcatatggatcattgccttgtgtaactcagtgaagctctgcgacatgctgtgcagggccacccaagatggatgggtcatggtggagagttctgacaaaacgtggtccactgaagaagggaatggtaaaccacttcagtattcttgcctcgagaacctcatgaacagtatgagaagacaaaaaaacaaaaacaaaaaacaaaaaaatgacagcagaagatgagccccccaggtgggtaggtgtctcatatactactgggaaagagtgaaaaagtagctccagacagaatgaagagactaggccaaagcagaaatgacccttagttgtggatgtgcctagtggtgaagtaaagtttgatgctgtaaagaacaatattgcatagaaacctggaatgctaggtccatgaatcaaggtaaattggatgtagtcaagcaggagatggaatagtgaacatcaacattttagaaattagtgaacagagtcttagagggctcattaaaagctatgcattttagttcaggataattagaattagctgcagttttttgtttgtttgtttgtttgtttgtttatgaaagatgacacttaaaggaaaataaaatatttttcaaaagccattcattcagattgtgctccaatcttcaaatctcactgcaaagaggcctgtatttcctcctctatttaatacagtaatctatccttacccatactccaatcctctcaaatgccctaaatccattgcattttttttctgcctcccaccaatcaaattacttatcctgtttgtggtcagctgtgagtccctggtcattaatacaggacccacagagcagagagctgttttggtgttttctgctgcattaaaaatagcttcataggagcacttagtacatgggagaaaatctacttgataattatttactcaggacatgaatttccctcttggctgaattgcttattaaacttttaaactttctcacaaattcacactagacagattaaacttaattgaatagagcataaaataagctgtttcttttttccttcctttagatttttttccagtgaaaaatcttagtattatttttaagctttgtagcagacttggtcacattctcagcagagaggtcatggaccagatattttcatccaagaagatgttttctttagatcagactcaagaggtacaatattggcaagtcagcatgtgcaatatttttctgggcctgttctcacatatatccatttctgttcacagtccacagcatgaacttcacattaatgggaggtacgttttaagttcacatagagacccctcaaatatgtactcaaacttaacctgcttaaagattctacagcagaaattcaactattttttaactcctaagatatcagagctgccatggaccagaaaatggcagacttgcatttttaaaaggacattggccttttttccatagagtctgaagtcttgaccagtagagggcagctgcaactcttcaaaactggctccatgtcctgaccatcaggagacacatacttcactcatcatttatacagaagttatgactgctttcagtatatgtaaatcttacaaattattgatttttatacatgagtaatacaagtaaacagattagtaaaaacataaaaagaaaaccactgatatcaccctgagataacataacagctattaatattgattgatgtattccaattatatattcatataaacttcattgattttccaaaaatagaatgctagagtgaacactaatatcttttaaaaacagaataaatatgcacattgatggggtgatgtcaaagagacagaggacccagttgagagagctctcagtgttcaaagctgaacacttttgggcagtaaaatgaagtagtattggagtacaatccaaggtatgaaataaacatttgagtctccatattgatatcaatattgactaagtagattaatgaatatagaaaagagacaaatctttgtagaagaatcctaaaaattgggaataatttctcacttaagtgtaggctgtgcatgactttcttttaatgagtacagtgtaagaagaaaggaaaaacctgacatactatgttagataggtatcaaggtcaaaaataaaaaaagaatgttgatagtatgtatccttgatatgtttgatgcactttacctctgtggtggtccttctagaacttaataacttagaagaaatggagatctggaaagaccaaagacaaatttcaaattgc

SEQ ID NO: 52754 - DNA, 2445 bp, Bovine  19866880708265
ttttgcctattaatagtttttggtaaaatagaaaaatagtatccacaggggaaaaaaaaggaaatagcattggatccaggagtgattccataggtgcaccatttgtgttgtcacacagctcccgtgaccagtagaactctattctactgttaccatcttgaaattcttaagaattattttcttaaacttgtgtcttttatgtgaactttgcctgggctatggagaacacagctgtttttctttttccccaattttccactgcctttaaaacattatacagcccatcctggttggaccaactacacacatacctatagtcattgatccctgggagacataacttgctctatttctttatcatcatcagaccaggcaaccagtttaaatatcagttgagcacctacaactccaaaagttttgaggtaagagatggacttccagggtgggtaccaggatggtaaactgcaaggaaaatatttttcttcatgtaaattgtgataaacctgctttacaattgtaaactttttctaaaattgtgttgctaaatacttacgtctttaaaaccaaggctgccaactaagggtcagtgggtcaaattcagcctacaattatgtttgaccagcaaacataatttgtttgaccataatagagatttacaaaatatgaatgtgagtgcttttaactggggcccagattccaggaagccaatggcttaaaccatttaattgtcttttgcaagccagttacacaaaagcggtttaccccttctggtttttgagagcactaaccgtggttttcaaactttagcataccccagtcgagaccacttaatagggctcgttcaagcagattgctaaccccgtccccagagtttctgaaacagaaggccttggttaggacctgctgcgtttttgtttagttgttaagtcatgtccgactcttttgagaccccatggtctacagccccccgggctcctctgtccatgggacttccccaggcaagaatactggagtggattgccattcctgctccagggcatcttcctgacccagggaaccaacccatgtcttctgtatccgcaggtggattctttacagctgagccatcatgggagccaggtattaatttctcacaaatttccaggggctgctgaggcctctaacccagaaaacagactgagaaccactattttaaaatagcaattccatttctgctacttgctcttaactataatgaacttcagctgactcagtcatgaatgaaaatgtaaataaagcatatatactttaattattcaagctaattgcataaaaagtatagctatgagagcatacactagctgaagcaattaaagagtttgccattttttttttctctcctaaagggaaaatgatcttgctgttgcctagtcatatcacaatctcatttccacgttctccaattttttttttaccaacataagctgctgctttctcccaaatagtcaaacagtttttaaaatcactcagttcaaaatgctgtaaagtttggtcaccctctgtaaatatcaaaagcaatgagcaagtgcaacaagatggttgggactcctgatgatccattcacattggacagactcttatccaactgtcaaggagttatacatgccctgagcccacaatgccaagattttcccagatatttaagaaagtagcagtatcctacagatagatgcagttctaagctgggagccgtgtgactctaaatgttctaatggaatgtagagttcaccctgaattcattttcctccttggtctcctctttgagacttgaatgtcatgtcattcaaacaaggttgctctgtgatcatgatcagccatcagcttcaaacctacaccttttagaggatacatgatatggcggtgtggtgactgaactggtttttctgaagctaataccttccaaaaccctctttatgtcagctttccagttgtttaataactttgcttgggtaatggaatgggagattactgaaaaaaaattagcatctcaattttactttttgtttccatttctttttttgtgtgtggtgagtcaaggggaattattaatatgcttttatttgatgcaccagtggaattttctcaaagacttgtttttaatgggttcattaattttatttattcttttaaccatcatcagccataactacagttcatttagtttctatatattggatcatccattttccataataaagggagattttgagaatatgaataagttacatccacaatcctttaattatgtacatgcctctctaatcccctagatggcaaatatcttgagctggggactatgtctcatttatctttgttccctacagcaataaacatatagttgctgtgtattatggtagatattcaatacaggtaggtttaatattaatagaaagactcttccaaccc

SEQ ID NO: 52755 - DNA, 1328 bp, Bovine  19866880805466
gatgttaattatattggatgaagacccaacttaatgcccttattttaaattaattacatatataaagaccttatatccaaataaggtcacactctggtgtcctagaagctaggacttcaagggataaagatttaaagaacattgtcaactcacgtttgttgttgtttttgagtcgccaagtcaggtccagctcttttgtaatctcatggagtgtagctcccaggctcctctgtccatgggatgtcccaggcaagaatactggaatgggttgccattgccttcttcaggggatcttcccaccccaaggatcaaacctgtgtctcctgcttgtcaggtgggttttttttaccactgagccaccaggaaagccccattaaactcttaagaccttgcatagaggagttgaaaagggagagcaactaagctcttcaaacatacataatggttggagataattaactcttgttcatatagattcaacacctatgaagggaaataaaacagtaaaaatagaaagaatataattctgacagtggttatgacacagtggattggctctgacaaagttatgaaatggaaaaattttacatcgagacatctttctctgctgttaagaatgatttttttttttttaattctactgcccattttgacattttaaagtaagttacagtttaatttctccaggagttggatactaggctatgggaccactgatactattaatgttttgttccaaataaggataatggtcatttttatccactctttaggccgttaagtcaggatatgattgcataaaattccatgaataacttgatcactatgaaatgaaatgtgcctcactatgtttgcatttagttagttacatcagctgctgttcttttctcaacaacaataaaatactcagccttgatattcccatagagaatagaactaattcttttgacctggagctgtaactaatggtgaagttgtagaaaaatcacacccatgttaaaacagatgcattgctcttacctctaaagagacaaatgctggaagcattattaaaaatgaagtcatggtttaatatttttcagctcaagaattaagtgctaatttatttcttccctgaatttgttgaaaactgtttttattgcttgaggaactactcaggaaatcaggattctggattttgacttaagagtccaccattttgtattatggtctttagattttagcttcattgtgttttcccacaactgtctatctttctgaacaaaataagccatcaacaggagccttaaccatctaaactttaaccacataaggaaaaacagactcaa

SEQ ID NO: 52756 - DNA, 678 bp, Bovine  19866880914468
tactggagtgggttgccattgccatatataagcaaatttagaaaattctgtaattacttgatttttcctctggttggagacttaaagagattcaattcagtgaaaaaactgtgaaaaggagaaaattgttgaattactcacatcttagctatgagtacaaatttaaagcagaacttcaaaaagcaagttgttttatttaatgtataagaattaaaacaacagaagttaaactaaatgccagtaaaatatatcacaatctaagtatctcaaaactgaccatttgtagatttcaaaatgtaaaataattataataataagtaatttcaattttattgcatatattttgtgcaaaagtaattattattaataagaaaaaatgaaacaatttatcaagtaataacttattccaactgaaatggatatcatgtatctaaagtgaattttaattcagtaatttcaattttattgcatatattttgtgcaaaagtaattactaataataagaaaaaatgatgaaacaatttatcaagtaataacttattccagctgaaatggatatcatgtgtctaaagtgaattttaattcaagctatgcatttacttaatttattttacaaaggtgaagccaatactttccttttttattattattattattattttttactttacaatattg

SEQ ID NO: 52757 - DNA, 1439 bp, Bovine  19866880951582
tttttattgggggcataaaaatcataaatcaaaaaaagatggagagttaaattgttgatttctgaaaagagaatcctaatttctattcagattcaatattctgtctcatgtaaacttatcaagtatgcatgtccttgaaaacatgagactttaataaagtcatgttctttatagaaatctaaatagatttctttccttatctgacgcccatggagacgttttttgagagaagaaatgttttatttcagggagtaaatatttcctgcaaattttgatgatcactttaactgcactccaacacaaacaacatttattgcatgactgatgtttcacctcctttccttgatttaaattttgagttcatcatagttcctagagctcgaactaacataaagataactggtctaatcccgtaattttcaaatgaagtccagggaggaaaatggacttgccaaaggttatatatctagttagtgataaaagatgaacccaattctttttcttagttcaaatctcttacctatccatcaactcaactactttatttactaggcaatatggacacattttctgagccctgctagttttcgaaagacatgtaagaatgtttgagactggagtggggatattgttgacttaaaaacatttaagaaaaatgcaagcctgaaatccataaatatattattaaataactacacggcattaatttaggtcaaatactagttacagcaagagttacaattttgcatagtcatgtaaatttttttaaattttacctatttattgttacatagaatcaggcctacaatccaatataaagcaatcctgattctgttgtgcaggttgattaaagtgggttttttaaagcaatactatcaaaaatattcatgtgtacaaacacatagacacacacaccacatataattttccaggtttttttaactagtgatctagttaaaaaaatctaattcaagttttaaactctatataaaaattccaggtaattaaaagtcatcaagtttgggggttttatgtcctggttatctggtctgccattctagggtattgggcacataaactattttatctcaaaggttcctatggtcctaaattctcttaattctgttatgatccttctcttatgaagatcagtcttcaagaaggaaaatcttttctaaatccctgtaggggacacaggggcaggttggctattgtttttaatgtcctgagttccttcctcttcattgcctcatgcatttgctgatgtcaggcctttgactgtcaaacataaactgcaactgccacagattttccaaatgttaacatgttaggcaaatgcatcctttgtgggagcagcaactgctgtgggaagggaaatcttggaagcacattccagttgcagcctgatttaattgaggtagtaaacatcatgggaacga

SEQ ID NO: 52758 - DNA, 1027 bp, Bovine  19866880993333
cttgtaggtaactgtttgctggacctacccacgaaaaccagattcccgggcccgaggagctcccaggccagacctacgatgccagccagcagtgcaacctgatccttcggggccagagtactcggtgtgtcccggcatggacgtgtgtgcccgcctctggtgtgccgtggtgcgccagggccagatggtgtgtctgaccaagaagctgccggccgtggaaggaacaccatgtgggaaagggaggatctgcctgcagggcaagtgtgtggacaaaaccaagaaaaaatattattcggtaagtgcttttcttgtcacgcaaggcctggagcctcaagggctgaagtacattcctgtgacatgtggaggggactgtccccagaaggctctgtttcctagttaaaatatttttccttgagggatctatttaccgcttcctcttttacctggaggagtcatcctcagctgttaattactggagaaaatgccagtctcgggttataccagtaataaataagtagagagcccagattctgtctcattgagaccacaagtagggcccccaagtcaccacttgggagtttgctttcaaactgctcttcaagttatcagaatacatttgtttaaattcaggaagggaatcacagtagagctgacagatgatcctcaggaatacttggtcagctccaaaatgttcctggtccccctcatggtgtgcctgctacatgcatagttgctcagtcctgtccgactctttgcaaacccacggactacaacccgctaggctcctctgtctgtgggattctccaggcaagaatactggagtgggttgccatctccattcctcaggcgatcttcccaacccagggatcaaacctgggcctcccaccttgcagacggatcctttaaccatctgaggcaacggcaagtcatccaacttcagtaactaaagtagccacatctgctgtaggaaggcacccgacctccctgccctgtataaccagtccagcttcacgtcagctcccaccac

SEQ ID NO: 52759 - DNA, 1633 bp, Bovine  19866881012893
acagtggagttttcctgataatttgcccattaggttataaaatatttcttaacagttattttctactttgcagaggagtctaagaacgtgcagttgttccattttcttgctagacttcaacttgttcctttcttacaactctgtcatcttccacgtcacacttactaccaaccagaattttggaacaccatcagtgtctttaacttaaagaatctgttctctctgatcttgtgtatcattaaatgtgaactgtgctgtgtaggaataaaataaagcaaagccttgtccatgtttcatgtacaaatctatcatcactgtaaatggcctatttctatattatccaagatttcaagcgtatactgttttgcatctactttaacttgctttctataataatcttctatggtaggattatattttcaacaaaaattccttgaataaagtgtacagtgagagtcaattttccaatgtcccctgaaccaagaactgctagcttatactcacacatagtgcaaacttgtaagagccagtacctgtcacaccatccccggggccctgcacccaagagccttgagctccctctgtgtcgatgcttctgtcaccaagtctgtcctgttgctgcagctgccagggctggtttgtttagaagcctgactctgggcaagttttgccctctcttctcaatttcaggatcagcttgtccagctcagtaaagatttctacttagatgttgattaagattaaaatgaaattatatggttatttggaaggggaagttgacatttttaatgtttagtcatttaagaatatatttctctattccaatcacttatgctctttaaaacaattttatagcttatttcatctagtccttatacatttcattaaaatgaattcttaggcattttataatatgtatgttgatattattgtacataggacttttttcatcacgacctacgacgtgtggaatcttaactccccaaccagggatcaaacccgggccttcgacagtgaaaggtataaatttgttagttttaaagaaagtatacttcctgttcatattatattgggaaataggagtgagcaatatggttttttgattttgtttttagtattacttagtttttatttcagtaaatatgtgggaatccatcaaatatttgtttgaagaaagaaacttttgatatgcaacccctttccctcaacatattagattttttaaaatattttaattttattagagtatagttgatttacaatactgtattagtttcaggtgtacagcaaaatgattcatttatacatatattcattctttttcagagtcttttctcatataggttatcacagaatataggatagggttccctgggctgcacagcaggtctccatcagtcatctgtcttatatatagcagtgtgtgtgtgtgtgtgtgtgtgtgtgtgtgtgtgctcatcccacatgcaataagtcttatagaagaattattttctataaaaccacttagctaattaactgacaacactttcctaatttacacttgatatgctgagtaggttaattcttataaaagatcagtagagtcatgggcaataactaattatcagaaatgtataagttacatagtcca

SEQ ID NO: 52760 - DNA, 1270 bp, Bovine  19866881080876
cattggcaggaggattctttaccactgagtcagtgactcagtagttagttgctcagcctatagctctctagactcctctgtccatgggattctccaggcaagaatattggagtggattgccattcccttctccagcagaccttcctggcccagggatcgaatcccggtctcctgcatcgcaggcagattctttaccgtctgagctaaagggaaatcactaggaaggcccttaaactaacgggcgatgacaaaggcacagtcattactgtgccaaagtaattcaaagtaattcatgagatctgcttgtgaaagtgtgagaagcattagtatactgtttagcagatgttatgccagggaaatttcgattaaaaattctctgtatttgaggatgaagattagcttttttaaacaggttactgtggacttaaaattcatgtcttacttgcaaactctgttaaagaacatatttactgtgaaaaatcaagaggctaccatagtggactttgaatttcgtaagaccttaaaaaccaaatgttaagatcgtattacgacctctactgtctatacttccaaaggattaagagaatggcttttaataccagttttcctccaaagttgtgtgttcagtaagtggctgcaaattagttctttaaatatgaatttttaaaagatgtctatagcttttccttagcagcctgtgtcttgggtgtgcttgagttgtatctgctttggcagtggccctttctcatcacctggcactggggactcagggatccagaggacacggctattatttttggcttcaagattattaagcatttgagaaaggaaatttaataacttgcttttgctaagcaatttctctgccagtgcttacctttatttttgaggatcatactcctaagccaatttgcctagagctaggctgtataaacactacagaaagttacaagtatcttggccaggctggggttgtgggtctcccataagacatgacttcttcctttctgaatcacaaatttgcaggcccagttactttacagtgtgcaaactgaattgtcagtcataacctaattgctgtgcatttcttgttggaactaaatcagaaagcactcaatattaataaatttaaatttggcagtggtagagtgctacacatgtctagttacttatggctaataattttaaaaacaagtgatacaaattaaattgtactctaagaactcatttctccagcattgctggaggtgggaaggagacaggtaagcaa

SEQ ID NO: 52761 - DNA, 1811 bp, Bovine  19866881088357
caaagttcctatttaacttctaagaccgtaacttttgaggaggtaaagcttcttaaggtaggccagaaaaagcattaaaatgtactatccagccaaatagaactttgggaggaaaacatcaagttaaaagaaaaacatcaacagcaagtcaataggaaggaatggtagtaaaacctcactaagctttgtttagaagataaagtgagatgaggccctttggactccaggaagagcattatcttccttgctgcataaaaaagagccttgtgtaaagcagagaatgcttagtgggttgatgatggtagaagactgtcaacagatttctgaagcatcaagaatgctttccagatcttcaaaagtactgtttgacgaatctttttttttccactgaaaatcacagactgtaacactgtaactaaacatcagctggaaagtatttaatatgcgtgggtgcctgtggcatgggtcgacattgcttttcctcaagtcaaaacaactcatcacctccccacggatatgtcactgacaccctttcaacctccccggcagatgacttgtgaaaagaaatggacaaggtaattggaaattgacttacaacaaaggaggcttcaggaggtgggccctctttatttaagctcatgtatgtctcgtgctcagtcgtgtctgactgcttgccaccctttgagctgtagcttgccaggctcctctgtctgtgggatttttcaggcaagaatactggagtgggttgccaattccttctccaggggatcttgctgacccagggatcgaacccgtgtctcctgtgtctcctgcactgcaggtggattctttacccactgaaccataacatatttgcttgactattaaaaagaaaaaacatatttagttctgtggttttccgttagaggtcagttggagacgagctgttcttgcttaaaaaaaaaaaaaaaaaagctttattcagatttgcctttacttatgactttaatgttctcaacatcaggatttgttgctgcattagttgctgataacactgaaatctacagtcaatcgatttcatctatatgttgacgtgtcgtttggcgataaaatagatatagacagcactaccaaatggcagactggtgccagggaacaagaataaaaaaatcaaaatacagtttgatcctgagtctcacgatatgaaatatttaagatctgagtaacagtggattggatatacatctttcatctaaaaaatgtgtacaatttggggaggggttagcaaggaaattgatcactcttttaataccatttatattgacctctaaaagtgttcagtctattgctgacttttcttaatctctattacttttattctcaaccatctctttacatattttaaaatttatcttagcctgaaatcctatctggacttcactgccaacattttgtctatttattttgctccataaaattgccaagttctttttcccttttctttccccatctcttttccttccttctttccttttgtcttaacattctgtgtaaagacaatgaaaatgtgtgcataccgcaaatttgttttcactatccatgttaaattaaatgctttcagtaaggtgaaaagtttaaaaagtaagactcagtgatttgtgatgaacaaataaaaggaataatgtggtcatatcccatggccataaagtacacttttgggtgatggaaagtatgccaagtctccaagaaatggagcagaaaaatttttcttttttgtatctgactggtgccactgtctatctttcatattaatgattaatgaaaattatcag

SEQ ID NO: 52762 - DNA, 719 bp, Bovine  19866881176481
cacgactgagtgtgcacacacactcacacacatacatcaatcaggtgcatctgtattcctgatgtatgtgctgtgttgtctgtaactggagaggaatatacaagccaagtcaacaagaagcatttcttaaaacaaatcgcatgccatggtaatgtaaaaaaaactaaacgtgatttttgatatgataaaaaatgtatggctggagaatttattctgtattaaaatattcattcctaatcttgttgctagtgatattataattattcatctaatggtgttggaccatctaggtcaaaaagcctgcaagtccaattatattctgcatttcagtatatttcaaagctgccggcaccttagaaaagatcccatctaatgttttgctttataaatgagggatctgggactctgaaactttagatttacgcagttttccatgactggggaatgccaaagtaaaggctatagtttaggtcataaaaataggatgcacaggctatttgttaaaaaaaaaaaaaaaagagagagagagagagaaagaaggaagggaaaaaattcagaaccaaaaaaagaaagaaaattattttttaaaaaatagcttacgtactatatgctatgtattcttcccacatcaacttataagactcttataatgctagatttagcttctaggttttttatgtatttacagcaaataaacacgtatttgctgtcacacaaaa

SEQ ID NO: 52763 - DNA, 2079 bp, Bovine  19866881213420
gagtatgtgtaaatatatgcactttattataaaattaatttatagcaaaagaagtttaaatgatttaataagtttggagaccagtacagatgtcttcttagacatagaaatcttgctggatttcttgaaatatttctaaatgatttttgactaaaaattttagaaatttcctgaaaaaataattcataaactagaataaagcacatagaatgagttttcatatatttgtttctttatattttgtcccttttttctttatattttaatgaacctatatggtcaaaaatcagaattcaaaatactttgataagaatcaagattcatgttttgttaactacaatagtaaaattttcatcataacctatgaatgaataaatagtattgaagtttaaaaaagtggaaaatgtggaagcagttacagattttattttcttggactccaaaatcactgcagatggtgactgcagtcatgaaattaaaagacacttgctccttggaaggacagctatgacaaatcctgacaatgcattaaaaagaagagccatcactttgccaacaaaagtctgtatagtcaaagctatggtttctccagggacttccctggtggctcagacattaaggagtctgcctgtaatgcgggagatcccggttcaatctctggctcaggaagatcccctggagaaggaaacagcaatccactccattgttcttgcctggaaaatacaaatgatggaggagcctggcaggctacagtccatggggtcgcaaagagttgggcatgactgagtgactttgcttcacttcttcatggtttctccagtagtcatgtactgatgttggagttggaagataagaaggctgaatgctgaagaatgctgacgaattaatgcttttgaatcacaatgctgggagaagactcttgagcatcctttggatagcaaggagatagaaccagtccattctaaaagagatcaaccctgaatattctttggaaggactgatgctgaagcagaggctccagtactttggccacctgatatgaagagtcaacttattggaaaaaacccttgatgctgggaaagattgaaggcaaaaggagaagaggggtagcaggggatgagatggttagatagcatcaccaactcagtggacattaatttgagcaaattccaggatatagtgaaggatagtggagcttggcatgctgcaatccaaggggttgcaaagagttgcaaagagttggacttagtgcatgaacaacaacaacaatcaaagttaaaatgtaaacttggaaattattattaggatttggataacatttcctgcattgctgacataataagcatatttgtgtgagaaaattcagaactcatcagctccatcaaagataaagtcatatttagtttctccacacgtcaacaaaataaagatatagcttcctaatgattccaatctattatttgttatcactagattcatgctttaaaaatgagaaatgttgacttcaggattccaatttcccaaaaaagctgcagtaaggaggctgcttctttagtttattgttacttgaggccactggagcttgctataacccgcttatgagcactgaggttggtacacaggcatgcatgctcagctgtggccgactgtgaccccatgggcagtagcccaccaggctcctctgtccgtgaagttttccagggaagaatcctggagtgggtttctatttccttctccaggggatctatctgacccagggattgtacctgtgtctcttgcatttcctgcattgatggtgagttccttatcactgtgccacctgggaagctatacagagctagagctatggattctttaataggcatacaaattttgtcatctgcctaaatgcttcttgcatagagagaagacaggatgtgttttccataaaatatgttcagttcacacctaccctttactattatacatttgattaaagacttaatattattttatatataaaacatacttggcatcactgattggaagaatttttccattcttgagaacctttgaatctgcatggggtcaaataattct

SEQ ID NO: 52764 - DNA, 1015 bp, Bovine  19866881258592
tttttgtgtctaaatatttatttctagtccctgtgatgtgtacatatgatttttgcataagcattcattgtcacaatgctgtatgataagaaaaataaatttaaagttgctatgcctcagtttcattttcaattatacaagatgatagtacctattttaattatcttagggttcattatgaggataaaacaaattacaaaaaagcatgtaaagaaaacaaagaccaatgcattaacaaaattttatgcatgactcgcaaaactgtatctaatgagtttggggactgaatgtgatcatgtttttaccaccagaactctgattgtcatgggtaatgtaatccaaatattttagttctcagagagagtcaggaataaataggacaaatgctgcatgttaattctggccatggagtctaaagcataacagagatttgaatgaggaaatctggtttggtgtcaagtccaataaaatgaagagatgtttgttgatgggatgtgttccctgctgagagagtagtttgactttagacaaaataatattcagctttagtaactctttggatttgttactgctcctggattcactctaatttgaaccttgtaggggtcatttgtgtctctgtcatctctaatgctctgcacttcagtgaatcatacggtcatgccgccaggatgaccacccagaagtcctgtttatgtaggacttggcttttgcagagaagttcatcttaagtcctgaacagttgagttgggagttcccacaatggtctcctgtttgtttctgggcatgggtggaaaatggtcatctacaaggactgataaccacctggaagttcatctgttggaattctgctcttctcactgcatacactggactgtgctgtcctgggcatacattttcgagagtactgtcttggtgggaaacgatatacgtcaggcaagcccccctgcttttgaataaagaagttgaaatgtaaagattccatttgataaaaaaatccatcagccaattacac

SEQ ID NO: 52765 - DNA, 1462 bp, Bovine  19866881279663
atcaagaaaaagggagtgggtcttaaatttgacatcaaagggatttgatatgtcctggaaaggaagccaaaaccactgatgtgacactgagatgataaagtgtgggaaaaggaaatgctttccttagagacctacaaatgagttttaagtgggtcattaaattgggattggcctttcacaaatcagtttttattagtgcccactctatctgatcctgtccttggcatccccatccctaaatttcaaaacatacatttgacatgcttagaatcttcccaataaatgcagatttccatgaaaagtaactcaggagaattaaagagaaagctcagtcacatcttcacaaaaccagttgcttgattgttaaacccacccaggttattcttagatcctgggaagaaggagtgttgcttattttcatggatacagtacattgtactttgtgtccatcacatacctctccttgattaagaacggttacattcatttggaaaatgtgagcttgaaattgaccgcacagtccctttggcttcctaatttctctcagcttgtatatagtatggtagtccaatttcctttcatctaggtcaatttatcttcctataacaccaaaataaatggttttctactaaagtctcaaaagtgctaatgtgttcattttctgctttgcagctgtaattaatttaagccagagagaactgttatagtgtttatattagaaatgatgtttctcatgtgctgtctccattttttaaagaaaggagattaaatcaattttatctcatctgaaaatgttcttgttctaaacctctgaagctcatgatgaatcactactcaaattatactttataaattaaatcaattcaatccaaattttgctcccctatatactttatccaatttggtattaagttgaattttgctatttttcctatttaagctcataaagttaggatataatttatgaacttttaaatttatattaattaatacaatgtgttacttaattctatgtggatgtccataatctatttctaaacacatttcttaatattgttggaaatactgagtcccacattgtttttcctgctgaaaacattgtcttctgggagattttaattgctttgagaaatcttttagatatttaaaatgttgcaaactcaaagtaatctctgctctgattggaaatagtcttggtcactcaaaataactcatatgtaaaaaaagtatccggagaaggcaatggcaacccactccagtactcttgcctggaaaatcccatggatggaggagtctggtgggctgcagtccatggggtcaccaagagtcggatatgactaagagtcttcactttcactttcatgcattggataaggaaatggcaacccactctagcgttcttgcctggagaatcccagggatggaggagcctggtgggctaccatctatggggtcgcacaga

SEQ ID NO: 52766 - DNA, 1565 bp, Bovine  19866881321612
ccttggcgttagcagtcaaattggcgaaggatattatcaacaaatttctctgctgacagtagatgtactcaatttgagccaaattttggcagtcggttactgctgcacacaaccctggggtcagtccctgccctcgtgttcttacgcaggattgctgtggaactcagctttgatgcaactgtagctgagcatgaaatctgtggaggctttggcatggaaatcactgacagcagaacttggctcaggatttgtttaatcagagcacctctcattggaccacaggaaagagggagggagaaaataaagaatggagccgtctgcctattttggggttgcctggcaggacaaaaagcttggagtcctatgaacaaaacagtgtattaaaggagatgttaggacttgacattaaaacacagaaaatctatatgacaaatttaattcctgaccataacagcaaaaagtatgtagggcaacaaatcagtaattttattcatttcttgtgtatttctaaagctttgacaaacctagagtgtgtatttaaaagctgagatatcactttgccgacaaaggtccatatattcaaagctttggttttttccagtagtcatgtatggatgtgaaagttggaccatcaagaaggctgagcaccctaagaattgatgcttctgaatggtggtgctggagaagactcttgagagtcccttggactgcaaagagatgaaacaagtcaatcctaaaggaaatcaaccctgaatattcattggaaggactgatgctgaagttgaagatccaatactttggccccctgatatgaggagctgactcattggaaaagaccctgaagctgggaaagattgaaagcaaaaggagaaagggttggtagaggatgagatggttagacagcatcactgactcaattcagttcagttcagtctctcagttgtgtctgactctttgagaccccatgaaccgcagcacaccagacctccctgtccatcaccagctcccggagtttacccaaactcatgttcattgagtcggtgatgtcattcaaccatctcatcctctgttgtccccttctcctcctgccttcaatctttcccaacatcaggatctttcaaatgagtcggggggtgacatcaggtagccaaaataccggagttttagcttcagcatcaatccttccaatgaacacccaggatggatttcctttaggatggactggttggatctccttgcacttactcaatggacatgaattttagcaaacttcagaagatagtgaagaacagggaaacctggcatgctgcagtccatggatggaaaacgtcagacatgatttagcaattgaacagtatgtatttctagaatataatttatccctaggttcccttctcaacactaatgtcaacaaatgactgatttatttcatccagtggaaagtctctcatatcctttacttttgcactcaaactgtccttagctttacatttgatttgttttccttcttattgcagatgtaaagatgcttttctcttaaatgcgaactgttctttcccaaatct

SEQ ID NO: 52767 - DNA, 1279 bp, Bovine  19866881343597
aaatgaaagagtgacgcaagctaacatttgcatgaaaccaggaagttgctaagttcacttctttcttttctcttctagtcatctcttatatggctacctatttacgtggccaagaaaatggaagtccctgaccttcaaataccagtattaagtgtttgtaacttgcagaacatagagttaaatatagattttccagcagtggctggtggggagtaggggggtggggaatgctttctgatctcatggggcttatagttgagcacagaagatggaaaattaacaagtattcaaaataatatgttgtgaggactatgacataatcccacagttgccttgcaaattctagattctaaataaggtctgtttctacatattcttgagcatgtgtgatccagatggattatgggaacatctcgtctcgtgtaatttttcagttttccccagaatgttcaccaaaagtgaccgctctgatgacatccagctttaatttccctagggggcgtccagtctctgtgtgaaaaagcagttaaaatgaactcatgtacaactgggaagagaagagtcaagtgctagtttaattgccacagaaaagtagatgtgcaaaaatcgctcattatttgcacttcatctatcctgtctttcaggacatctgcttggcctctcccatgacgattccaagttctgtgaagaaaatttcggctccacggaagataagcgcttaatgtcttccatcctcaccagcattgacgcatccaaaccctggtccaaatgcacctcagccaccatcacagaatttctggatgatggtcacggtaggtacagctccacaggctcagagacaacacctcattgcatcctcctggtgttcaccttgtcctctaagacaatggttgctgagacagtgtcagaaaaagaaacaagggggtctgtctactggtatggaatgccaacatccttggtggcattatagctatggtattttttgcttttgaattgccaagttcaaagagaagcagtgtgggagaccacacagaaggcctcgctagtgccctgaaagcctggcttttattccctctttcaccacaccagcctcctgtgagaatgttggcatatatctcatttccctgttattaataggactctcagaattatttgttacatgcttattataaagatatggttagaatataagtaacaattctgtcagattctctttatggcagcataaaaccaagaaaggaagctccatagatctacattcactacaagactggcttca

SEQ ID NO: 52768 - DNA, 1035 bp, Bovine  19866881353528
aaatagctatgactacaaacatctaaatcatttaaattcgatttgtttactctcatttataaattcctaaagatgctgagaggaaatgatactaatgttaagaagggtttctaaagcagcagaagacattattttgctttattatcattgatatcatttggaggttgtgatatatcaacaactccttgccaagtttgtcagtgaaagtgtatggacctgattctgaattgtcttagcttctactggaagcttccaggctacctatatactctagttttaaacttagaccttagttccttgaataaatgtgtttcttagctgaggtttgggaagattaggaacccaaagacctgttaacataactacaagtgatgaacactactagccacggaagattaaatttaaaatgtccttagaaaggaaagggacagtatcagaataagaatacatgaggaatatacacatatacacctgtttcacacagaaagctttcagtaaaaaaaaaaaaatacaaaagcaaccagtgccatatattatgtaaacttacaaagtgtactttatacacaaacatgaagcataaattaaaaagtaggtcaacagcaaaacatcttaaatatagaagaatttgcacatatttttgttaaataagaataaataattttatcacacaaattcacataccagttgcaaaaacaataaattacttttttttatcagtgctgcattttttttttgtctgtgattaatcccttcattcttaatgtgctaaaactgtttccacaggaaggcagaggaaattgaattggttgaataaattaaaacaatgtccttaagcctctaaacaacaaggtagggcttcatttgacattttctgttccagaagaaataaatgttgtattgttcagggatcccttttatctactgaaacaatctggagtgtttagttttgtgagtgtgattagattcttactaacctgagcattttcaaacaaactcttttaaactcttctctttttaggaagggcttccagcatc

SEQ ID NO: 52769 - DNA, 1362 bp, Bovine  19866881373086
cttccctgtcctcccactttagcatctctaatgaacttgctctttttctcttgagatatttaacaacttattaaaagtatttagtatttatttagtatctgaagtagggaacaatatgaatttttatttttgctcaaaaattgagactttgctcacaaaaaaatactttgtaaacagtaaatgggaaatgtaccactgatttttattgttttcctgtagtcttgattctctttttgattatctttgtgaaagtttaggttcctcttttgttctgtcatttgctaatggtcaattacccatcagagactgccaaacttttctttcatacattgtatgttggagaaaatgacttgaatcattgatgttcctgattttacagctattagttaataattgtaatagctgttattcacatgagctgagaattataaaatagttggatgtatttaacctccatgtctaaaatgtcttccaatcattgcctttgtgcttaattaaattcagttgtatttcagttttttagccaactatattgaagttcagattgaaatctgtttctatttttatttgatgccgagagagcaagctatcagcatatggcaaatttaaaggcaaatatgtctaccaatacacatacgtggttttgcaagatgtaccaaacagtgcacattcctccagaggagaggaaagagagttcacaaaagtgacttttattgcaagaggaatacaagtgagttgaaatcctttcatgataacaaaagcctcacaaagaaggactggacttggtccatgttttaggaatttgcacatataaagagttagttatcttctcctctggctctttaacgtgtagtgcaaaaatatttgctgtcaggaaaaaaaaaaatgttggaatgcatagatttcactgacagaaagagctcaagaaacccctctcctctttgtctttatatttctgacttttattcagtattttcaatataacaaagtcattggtttttattccctagtccaccctgcccctcaccatattgtttgaatccagcaagtattttgttcctttgggatgcaattcactcttaagacatgctgtgagagttcttcttgcctaaattcataacactaagcagtttgcttttacatagctgataggctactctttcctattttcccccctgaaaatgtcatgaagttttaggcaaaaaagcatatgaggtaataggacacatatgccaataagatattaatttctaaaaaatgcatcccaaacatttgagagtgttacaggaacactttctcagttaactccccaaagggtgtaacaaaaactaaatgtgtctgtaaaaagtcgtttacaaagca

SEQ ID NO: 52770 - DNA, 783 bp, Bovine  19866881377817
ttttctctgttaataagcatgtggtctctaatgtgagtgtcccttgaaaataacttatgcttttatctgtatcttgccattctaaggctcaaagatacgggatgatttcaggctgacgtaaggtgtcctagcttaatgatgagaggaatcacatttgagaatgccgtttctttggctgtccgcagcctttagtatgcccgtcacgtctctcctgaagagtgtccggacatcccgcacattgttcttccatttcaatccctctccagcttctgaagggaagtcacatgggtctctcactgtgccctggatccagctcctgtggcactggctgcctgttcctctggtgctgaaacggtcttcacattgcccatgattctccttgtcctggggagagcattcctctcccagccagctgacaggctttcttcatggagaacagagcattcatcctcactccaaggagtctgtctctctcagttgacccgcaagcagtcctttctgactgactctgggagatcttataaaattcatttttcctttcagctcttgccaaagtggacctccaatttgttcatgcccagagtggctgtcttttctaataaccatatacctatattttcagcaacaagttatcacatggataaattagaaattcagaggccaaagagtctgccaaaagattcatttaaaaagaccagagcatctttatcttaaaataaattgctttgctttcataattgatatttaacacacaggcatcgccattatgtataaaagaaaaaa

SEQ ID NO: 52771 - DNA, 1310 bp, Bovine  19866881394268
ccaaaacatcataggttcagaacccttgaacaaagcaaacaaatgagcaaaaacaaaacacactataaaggcttgctggtaagaggtataccagtgttgaatgtgttgaagactttgctgtgtgttctgtatggctacgacacattgtgagatatcagacagaagccagagagagagaaagcagttgtgaaaatataacttgaaaatatggtgaagcaggtatttttttgtttgtttttacttttaaattctaacaggaggaaattaattttcagacctttgaatactgatacacacacaaacacttcttctacctcctcatgatacattaatttgtctggctgcctgaaaaaatacaggcagttagtgatttaaataaatggacccctgcatatatttaaatgactaggtacattgagacccttttttcttttcagaatttctcagaagatgcttgctgtcaaaatgttttttgacaaaaattatatctcccgtagtctgaacatataactaactctttttaaagcagcagcaagttcttaatttccagtaaaacatccacagctctttctggaaactggaaagagtggaaatagctgcagacctactttggtcaaatacttttttttaatagaaatatatatatatatattttgatagaaccaagtgatataaagtgacataccaaggaagaatgtatttacaaacaataaaaataagctgctgtgtaaataatatgcatgaaaatgattatgatgcctttgaagacattctataagaggtaggtgaagagggagagcctgctcggccatcttcgaatgtcccctgattctacattcatccgtgtttctgcaatctcctcggcccaggggatgttcaataactcgcaagtgttgccacgtttcaaggtcaccactgtcccacgaagcagtgcacaccttcattttggtcgctgagggcagattctgcccataatcggactcctcgttgacgatgacacggcagggtgtgactttctgcgctttaggtggaccctgtgttcaccacgcctgcatccgcgagccatcctttcagccgtccctggagacggtcataaccacagggctaacacttcttctgaaaacactgcttaaacgcggaaggcctctgggagaggagacatcccttcgccagcttccgattcccgtcctggcactgcaccgtcctggtgtgccagcccgtgtcacaggttcgcgaacaggcaagccaggggcccgtcacccactgcagctgcgggggtgggcgagcccactttattgctgccctggctg

SEQ ID NO: 52772 - DNA, 3016 bp, Bovine  19866881519162
tacacagaactccaaatgcattttcattttctttttgaaaccagaactgtcctttatttaatcattcagtgaacatatatgtatatcttctaggtacaagttacatagtgtaaaacaaactctgtacccagctctgatagacttaatggtcaaattagagaatttgaaatagtcaaaagagaatagaaaagcttagaatcaagaaattttagatagtaaaagaaatgcactatgctttttctaggtacagaacactaaggaagaggtcaagaacttgcttacttttcttttcatgactttcccaaagcctaatttttatatttagttatcagtctaggggacaatcaacattccaaaaggattagttcctagcaagaggaaacagactccacaatagtgtatttcgagggatcactgagcatctgtgggtcaccagtcacaggatttttttcctgtccttaaggcttgaagcaaatactgctcagtaatatgaacagaaaagattcactctagaaataatttccttttatgctttgttcttcgccacatgcaatttaagcaaaccattctttaagtcacactgggatgaaatccaaatgaaccacagcatggatgagactcatgcaaatgaagagaaagaggaggaacccattaagtaccaaaacaataacaaggatacagagaagctaggcaagactggattctctggtttcagggtgaccatgacccagatgaacaagatccaattattaaacaagagtaggtagcttaatatcactgcctgttgtgtattattaggaaacatctgtatgaagcagcaggcttccccagtggctcagcagtaaagaatccccctacaatacaggagatgttcaggaggcacaggttctgtctctgggtggggaagatcccctagaggagggcatggcaattcactccattattcttacctggagaatcccatgaagaggcttgggggctacagtccatggggtcacaaagagtcaggcatgactgaatcaactgaacacacacacatatgaaagatgtgctgcctttgaattttctgttgttgtttacaattttaaaaaaaagctattatctttaagaaagtaactgcaaaagaaacaaatttcattctttaagatttaggagggcccaaatatctcacatcagtgatattggtagtaccaatgcaaaggtatcttcctattttttaagaaggtctgatgcaatgaatggtagtccaagacacaaagctgagagtctacagcaactgaggctgagagcaattaagatacattaatcatcagtctgaaagggagagaaagtgcctaacattggggaagataatataaccatagcttaacttgactaggtattgtcatgttgctctgcagaatgggtacagcagtcttcacttccactagaaatacatgaaagttcccttaattccatgtgggtgaggacagatggatacttctgacccaccagacatgagtagaagcgctataccatttacttgcctttgcaaagcccattccttcatcccaactccatctcatccccaatctctacccagagagctcttttcccgtgtgcctggtgatcagcaatagttaatgggttgtgctctgacagcctgggtttctgagtctagtggacagagggataccttcgacattgtaaacccttgtgcatcctgagcaataaataaacttttgtgtttttagccaccaggactttggtgtgattcatcttcatagcttttactagtttacccagacagattccaaaaccatcccaatatttgacattagctggatctgtaaagtttcccagttttagatatataaatgtatattccaatattatcctaatgtgcttttctctgatatcaaatattctaatactctgtgtctctcatacaactgtaagattttgtgtttcctctacaactttcctgttcatggatactgccattttatatttcatgagttattcaagttttttgttaaccccttttcagtttcagccattgcaaatattttcttccactctggaagttaatcctcaacttcatctgtgattttgccattgatgttttacttaagaaagaaagtgaactgaaagtcactcggtcctgtccaactctttgcaaccccatggactatagagtccatggaattatccaggccagaatactggagttgggtagcctttcccttctccaagggatcttcccaacccagggatcgaacccaggtctcctgcactacaggcagattccttaccagctgagccacaagggaagcccaagaatactggagtgggtagcctatcccttctccagtggatcttcctgacccaggaatcaaactggagtctcctgcatttcaggcagattctttaccaaatgatctttcatcctttccaattggtaagcttctaataacattatagtttctttcttctcatatgtagttctttattagtcaaaaatttcattttcttccatgggggatgtaatgttctccgcaccatgtgttaaacaatctgccctttacaaatgatctgtagagccagatagtagttgttgttgtttagtcactgagctgtgtccaactcttttgtgaccccattgactatagcccgccacctcctctgtctatggcattctccaggcaagaatactggctgctgctgctgctaagtctcttcagtcatgtccgactctgtgcgaccccatagacggcagcccaccaggctcccctgtccctgggattctccaggcaagaacactggagtgggttgccatttccttctccaatgcatgtaagtgaaaagtgaaagtactggagtgggttgtcatttcttactccagggggtcttccagagacagggactgaatcctagtttcctacatttcctgcactgcaggtggattttttacaattgagccaccatggattctttaccactgagtcagattacttgtatactaacttctcatata

SEQ ID NO: 52773 - DNA, 2170 bp, Bovine  19866881547613
tactggagtggggtgccattgccttctcccatggatagtgctgttgctgctgctgctgctaagtcacgtcagtcgtgtccgactctgtgccaccccagagacggcagacagcccgccaggctcccctgtccctgggattttccaggcaagagtactggagtggggtgccattgccttctccttcttctctatacaatgtatagagccagctcattcacaaacttgcaaagataaagtgaaaaaatgacagctaatcgtgtccaaccctaatttctgtcattagtgttgttgaccggttgaccaggctggctgctttatagtaaatacactgtcctttcatttcttttcctccacagtagctgctcccatgatttccactgcttgaatccactgccaggagatgacctgctccctgcaaaaagtcagggctggctgatacaaactcccacacctcagcctgtccctacatttctgcccatgctctctcctccacatctcagaggtactttcacttgcccatgctgacccctcttcctggtctccctcatccagataattcttccttctgcctttgaacatctgcaggtcacctatcccattgctaaaagcacctttctttgatcctgctgcctcctcagactaaacttcttatgtctttgccttccatcagacttcctggaagggaaccttgtctctacattcccaacaccccttttcttgtttagccctttaaagtgggctgggatcctcacctgttataccagtggttctcagccttggctgcataaagcaatcggctggggcacagcatgctcttgaagtggagtgggagaaacttgataacccgacacaatttaagaaaaagagaaagaggggtagggatgccttcctaaaaattttaaaacttctaggtaaattgttgttgttcagttgctcagtcatgtctgattctttgcaaccccatgaactgcatgcatgccaggcttccttgtccttcaccatctcccagagtttgcttaaattcatgtccattgagttggtgatgccatccaaccatctcatcatctgtcatccccttctcctcctgtcttcaatctttcccagcatcagagtcctttccaatgagtcggctcttcgcattaggtggcccaattattggagcttcagcttcagcatcagtgcttccaatgaatattcaggactgatttcctttaggatggactggttggatctccttgcagtccagggaactcttaagagtcttctccagtaccataattcaaaagcatcaattcttccagtgctcagccttcttcatggtccaaatcccacttctgtacatgactactggaaaaaccactgctatgactatacggacctttgtccacttacatatgtatatgtgttgtgcctgcaagctaagttgtttgagttgatgcagtggattatagcctgtccatgggattctccaagcaagagtgttggagtgagttacctcaccctcctccaggggatcttttcaatccagggatcaaatccacctctcctacactggcaagctggttgtactagtacaagtaccactagttactccctgggaggctcacatatatgcatatattactctaatattaggaaagctctgataattgctgcaactgagctataaacaaaagctgagaaaggaaaaagaagggaacaatcaattctgcctctggatctttatacaggctttattgtaaatggagaattgaattggtcctcaaaggatggatagattttatttggattcaaccagcttttgttgagcatttcataagatgctattcatagtcataaatcatttaagagttaattctttcaacaatgtgcatgcatctgatcctattatcatttgacagataaggacatgcatacaaagagaaacagagataaacttctcccagtaacagctgacaaatggctgagagggaagctgtcctattaagtggtctctaagataaaaatattacaatgaatttatgaaaacattcaatatatttctaataggcaaagagggattcagaggtttgaaaagtggcccttttcctaagaatcctaatgtaggaaacagaaaagaagtagagattgttctacagtgtgagagttttaagatatgggtcattaagtg

SEQ ID NO: 52774 - DNA, 1241 bp, Bovine  19866881650644
attgatacctgtgaccatggatggatatattgcctcccctctgttacatgctttgatatattcagcagcaagaaatgctctactcttaatgtgtgttccacaaacccatatgggaagactagtagcttctagtcagtcgtttaaagctgtggagtgaaatatgacttggcatcaagcttcttgccatttgtgttcattccttatctccattcctgcaccttacttcccttaaccaatcaactctgttgctttgggctttcccattatattctatggcttccccagtgactcagatggtaaagaaccttcctgcagtgagggagaccaggttcaatccctgggttgagaaggtctcctgaaggaggaaatggcaacccactccagtattctagactggagaatttcatagacagaggaacctagcaggctacagtccatggggtcgcaaagaatcggacactactgagcgactaacacacacttttcattctgtatcagtgtcttaagtctgccataaagacataccattatatgagtggcttaaaagagcaggaatttattttctcatggttctggaggccaaaagcctgaaatcaagatattggcaaggtcatattcattccaaaagctgtaacggtgaatccttccttgattcttccagcttcttgtgggtcctgacattccttggcttgtggtaacataactttaatctctgcctctatctctgcacagtcttaattctgaatgtttctgtgtcttgtcttcatttcataaggtcgcctgtctttggatttggtgctcaagctcagtctagattaatttcatatcaagatccttagctaattcaatttgaaaagattttgttttcctaataagaccatatgggtatctggtagacttgaatttgggagggtgaatattgaactcttcagcatgttattaatcactttcttctcagttatttagaattaattcagcagaattctcagacaccagtgagtagctctttgtgaaaaaatcaacaatccatctttggcaaaggactgtacagaagtaccaatttcacttttctacttatcaggagaaatgaacacttttatttctgccacccacaccactgttgggatattaagctatgcctgtggctagtatttggatttcacatcctgagaattcttattgcatgatggaatgtgccagttggcaggcctgcagaactgtagctcctagtgcaacagctg

SEQ ID NO: 52775 - DNA, 5390 bp, Bovine  19866880181473
atatgagagttggactgtgaagagagctgagtgctgaagaactgatgcttttgagctgtggtgttgaagaagactcttgagagtcccttggactgcaaggagatccaaccagtcccattctaaaggagatcagtcctgggtgttctttggaaggaatgatgctaaagctgaaactccagtactttggccacctcatgcgaagagttgactcattagaaaagactctgatgctaggagggattgggggcaggaggagaaggggacgacagaggatgagatggctggatggcatcaccaacttgatggacgtgagtttgagtgaactctgggagttggtgatggacagggaggcttggcatgctgcaattcatggggtggcaaagagtcagacatgactgagcgactgaactgaaactgagcccgggtcatcattcagatcccttaatgtctctaaaactcatgtttgtgtagttaggatgggagcaaaaaggcatttagatggaaatccagctgagagacaattactgtagtcaaataacaaatgcatgtgaagtacagccatgggccagacattatataggcgttgaggagcaggaagaataaatagcagggaaatgggccttccagactgctgggcacctggaggcaaggatcttcttgtccaggagaagcttggatagttgtctttgttttcttccttctcgtctcaccctacttctccctctggatatggccttgctgatgctggtttcgactcaagaaccaaaaggatggatgatatctggaaaaatttcctatcaaagccgtgaattacttgcatatgctcttgaatagtgatgcaagtcccaggtataaaaggattagacttgggccgcatcatgcccctcagcccctcaggcacttgggacaccaagggaagctgctaaaaaacagcttcatctgcttctgctctgggtggctgccccactgctctggcattcttggccagagaaatcaggcatgtaaccttgaagatgaagtaaatgtggtttctgtaaacttaaacctccctgtatgcttcatcagtctttggctttcagtgaaattatagtctaataggaagacagacatatgaacaaatacatcacaatatgacaagtgttttttttttttttttatgtaactttcaattaatttatttttggccccaccatgcagtgtgtgggatcttagtttcccaatcgtggatggaacccagaccctcttcaggggaagcaccaagttttaaccactgaactaccgggaaagtacttggcaaatggttcttatttctatagactggcagggtggtgctagagaactgaaagaaaataattttctttgctgaatttggctttgccttacttttagggtcccaaccgatgaacttctgtttcctcttaaaaacatcacactgagtcctgacaagtggaggtgccctggttgccaaggagggaaagttcttccagaagctgtgcagggactggaaacaagggaaatgtggttcttcttgttccctgaaaaagtagccctggattttccagcctagaggaacattgcctaatctgcatgggtgcttctcctctttctctgtcctgacccttctttggctgcttgtccgaggaaagctgattgatgaaaataaactttctttgtcttctgtggatgctcacccaaatgtgaagcaccaaactagagaggctgcaagcctgggctctgccattatttagaaatgaaaattaaggcaagccatttatccttttgggtgtcatttgctcatcagttaaaaagagaccctctgctctgtttattcaaaaggctaatatgaggatgaaatacaatttaggaagatatttttgcaacatagagggtcactaaatacaatgcaccatttgattatcaatcctttctatagctttttctagcctctagtatctactagccatttttagcttcatcagctgccttaaagcattctccttaaattctttcaattttggtcaaacccctgattggcaaccataattcacattcttgctgagggacacttgaagtcggctttcactcctaaccagatctccaaagccggatttatatttctttttaaaaaagggaaatgaaaacctctatagaaaggttgtctggcaaccagataaaagaagaaatttctttcaggctttccaagaagacagaatgggagtcttgaaatataaattactttttaatggtgtcttgaaaaggtgttattctcaaccatctgcctctcttacccctgctcctgactacggcctgtgcaagcaattaaaccgttgtgtgtccttaaattgaataaaagtagagatattttaggagatggaagaaatctttagaggtttcctggtttatccatttatttcttgaagtaaggaagtggaatttagaacaggtaaaagatttccacttgatctctagcttttcagtgctgagccaaggtcaaatgcaggggttcctgactccccagttcagggtctcacccgttagggtaaagataagatgcgagcatgaataactacaaatggagtcagagaatggtattctagcataatactaggcctcaaagtccaaactaatggtaagggtgacaaatagtccaaggccctaggccaaggggacatcgttttgcattttggttggaggtcatagatgccacttcagatgtctaccttggaggtcaaacatctgttctgttgaattccaactgtgcctatttcccagaggaaagacaattggttggcatcctttcttctagctcagaatgttccagttactatgacttttctgctctgatttaagtcctcgtggtctgctctagtggaaagcttggtggcttttctggagtgtcaggttatggagaataagggtacctgggagtagggagaacgtatgtctggtcacatcccatgatactgaactccccatgcctggccaaactcccttggtgttaatacaaatcagctccacttaagttacataggccaatgcttggggcttagaaatacttgttttacatgacctaactgtgatagaacattcctccttctctggatctttttcatagaaatgagtttctttttttttttttttaattttaaagatatttttttaatgtggaccatttttaaagtctttattgaatttgttacaatatcatttctgttttatgttttggtttttttgccctggaggcatgtgggatcttcgcaccctgaccagagtttgaacccacgctgtctgctttggaaggtgaagtcttaaccactggactgccagggaagtcccctagaaatgagtttctataagaaactcatagtccagagggagtggagtctacctgaggtcatggcttgcccctgtctctacttctgcttctctgttccaggcctgggtaccatagtacagggctcttggtcctctgcagtgcacaatgcaccacatagaaacttatcctgctggctccccgggcctctctgtgaacttgcggttactggagtcttctctggagccctgagggtcatgccctgtgttagattttcagggagttatgtatagttaattatatgccaggtgggggttgggcagtactccccagtaactgaagtgctaagaagttctatgtaagagggattctaggcatgcagaatcatggagtcctaaagctggaagggtattaggatgacctgtgccactggagatggctttgctgtgagaacgtcaaggatctggctgcagcacagggtcagtgagcgtgcaaagacttggcagaggaaaacacgtgtgttcgtggagacctttcaattaggaactgggcgagaaggcagaggaagagatggggagggttccctgtagccctgagagatgaagtggcttgaccaaggacacattggtagttcttttttctgtgcacccgtcaggtagacctgctttctcgaagagccgatttgagggggtgaggagaactactcttcattagatgagaggagagaagccagatatttgcagctggagttggctatgtgactcctgccacctgctgctgctaatttgttcctgggtcgaccatctgaccttctgcccacgaaatgagacagtgaaacactccttctgccaacagagtaagtgaaagggttttcctcccactgttcaatcataaaagtggcgtgtctgtgcctggtggtgcttgaaggtgccaactattcatgtcatctgcagtctggatcctggaccagttgaggcctaggcataggagtccgaaagggctcagagcacccgccttattcccatccaaagagaatagtcttccccatctgaatggagccaatgacagctattcagatgctaggacacctccctgtatcggcagatgggacataaagggaacagagaagatggggaagagagaaggcataaatccttattctaagatctggttcaggacgaggaggagaaaatggctcctctacatccattttttcctttctttgtgaaatgacctccctgtaccttcaactgtggttcttacctgttgtcctgggggctgtcttcctctcaggttgtttccccagcccacccagtgccaaacacagggtaagtttctcagcaaatccatgttgagatctggggttacatcttggtgaaacaggaaccatccacttctgccggtggttgtcctaggttgggtcttccctgagacaaggattcgggggccacaagtttatttgggaaatgaatccaggaaacaccagtggaggaagaggaaagtgagacagggaagggaggcagtcagtaaagaggtgttatcaagcgcccacttgggcaactagagtttacgtccctgaggaactctactgccagcgtacaaaagttctggagttctcgcagttggagtgagggagctgggtgtctgtttaccacactccattggccatcctttgaggctgcttctctagccctcccaggctgcgtgcagcacgtgaaacgtaatttgtgctttttgaggaaagcccagtctagcaggcaggtgtgagcctctcaccaagccctggtggtttgtctgtgtgttttttgttgcctttctcacaagaggctgtctaagctccactcttgggtagaatgtactgcggcagcctccaacagctcaaccacttgtgctgacaacactccctctaagaactgtcaacctctgagacatacaggaaaatgacagctttgcaccaagctccataaccaattccttaactggacgaggtcacacagaaattgtcaagatagactggcaggtactacagtcctttagaagcaccatgaaatgccagctgctgccaagctgctgactt

SEQ ID NO: 52776 - DNA, 2443 bp, Bovine  19866880236965
tccatgaaactggatgcttggggctggtgcactgggacgacccagagggatggtacggggagggaggagggaggagggttccaggatgggaaacaccctgtatacctgtcacagattcatgttgataaatggcaaaaccaatacaatattgtaaagttaaaaaataaaattaaattaaaaataaataaataaaggttataaagaaaaaaaataaaaatcaagattaagaccctcatgtagaaataatattcttaaacctgaatcacaaagcatctgggggaaagaatgatagcaacagcaaaaaacaacagtaacagagagatagctgcctctttctttggatgacagaaaccctgtgtctccaatactgacatcagataatagagaatatgacaaatgcctgctaccttgtttcatgaaaagagtaagtacatgctaatttgatgagtataattgtaacataaattaatcggttttatgatttcttctattttcttctcagaagttgaaattgggatgcctgctagtctcagttcttgctgatgttgtggtcccttctcccgtctccatgggtaatttaatgggaagtcagaggagtgagcagtagaagtttgggttatataccattttaaattggtctggtcacattcaaatcttggctgtctataataaaatatagtttcattccaacctcataaaccttctttcttccttttgttcttcaaatgtataaacactttatagacagagatatacttgctttcattgcgattattttgatttacttaatatttttcaatatcattgttaatattgttttaaacagttcttgaaaacaagaaacaatgcagaatcttctcaatacaagaaaaaaactaaaattaaattaaaaacatagattatatctggtttacccattgtaatattagtacctaaaacttttgaaaaaattagttactaagaagctcttaaatttagcattaatcataaaatgcttaacatagttatttagacaaaatgtcacttaattaatattttttttaaaactcttacattcttactttcagcaagaaatgaaaactggagaagaagggataactttaccatataagcgttttaacctaaatataacaaatttttatttttaaggctttcctagtacaagagactgagaaggcaatggcatgccactccagtactcttgcctggaaaatccatggatggaggagcctggtaggctgcagtccatggggtcgctaagagtcgggaacatgactgagcgacttcactttcacttttcactttcatgcattggagaaggaaatggcaacccactccagtgttcttgcctggagaatcccagggacgggggtgcctgatgggctgccgtctatggggttgcacagagtcggacacaactgaagcaacttagcagcagcagcagcagcatgagtataccacctttcaatgagttctctgaatctatcgagtgaattattgaaacagagggtggttttgggaatgcactgaactgcaactggtgtcagaagtgaggtcttgtggaggactccaacttcttgtatggctaactctcacagctggccaaaatttctcaaacaaaccatataaatatgaagactgcttacctgagatcctttcttgctacctggcaagttaattatgagagttttccctctgattccacatacaggcctggaaggaaaaagaaactggatgaatactaacttagcatgatggttggtttaaatactttcaacaacaaagaccaatcattgtttttatatgtgaacaacttttttaggagtaaaactgttacagctaaatatttaccaagtattatacaaattgggcactctctctggctgaggtttttataacaatggatagtgtggtggattagaaaaatgcactgaacatgatatcagaataaattagccactttaaagaaataatggccatattatcttctttctctaacttcagctttttcatatctcttacagttctaagaattcaatgagatagcatactaaaaatgactaatatagtaatgtctatgttcaaagtctaacacataaggcactctggcattgagtgagatgtttaaactcttgcttctcaggaagtctataagttttaaagtaagaatagacttttagactcagtgggagaagaagagggtgggatgatttgagagaatagcaccgaaacatatacattaccatacgtaaaatagataaccagtgggaagtttgatgtataacatagggcacccaaagctggtgctctgtgtcaacctggagggataaggtcgggagggaggtagcaaaaggagttcaggatgggagaggacacatatatacctacggccgattcatactgatatatgtcaaaaactatcacaatattggaaagtaattat

SEQ ID NO: 52777 - DNA, 2515 bp, Bovine  19866880359186
ttttaagggcttgggttgtggttttgctccttaggaagatttacctcctgccttgggaaagaggagatgagggcagggaatgaagggcatgaactctttcccctgatgcttcccaaaggcagatatttctctggtaggaaagctgtgaaggaggttcaaggtcagaatgttgagagagaaatcattctgctataagcaatgtttgctgctctttcaccagccactcactcttgcttcttggcttctacctttgctcaaaatccccctgactttcttcatcccctctcttctttgcttgggaacttgtccctcacagccattcctcctctttttttttttttttaattaattgtgtgtgtgctgtgttccatcgtgtctgactccttgcaagcctaccaagcttctctgtcaatggaattttccaggcaaggatactggagcaggttgccacttcctacaccaggggatcttcctgacccagggatcgaacccacatctctgtgtctcctgcattggcaggtggattctttaccactgtgccatctgggaagcccttaaatgtaattcatgagttaattcatttggctgcgtcaggtctcgtgtcacgtggcatctctggttgctgcccatggactctggctgtggcgcacaggctccgtagttgctgtgcatgggctttgtttttccactgcgtgtgaggtctttgttccccaaccaggaatattccccatgtcccctgcattggaaggtggattcttaaccattggacaatcaggggacaatcactgcccctccttcttgagattctagtctttgtctccagagtcagtctactttcttgagaagtacgtgtcatgcactgcttgccagtgctcccccagtgtagcagagtccagcctacagtggctgcatgataagtatctgttaattgggatgaaaacgtgggggctgtagtggaacttcagggttctgtttcttcagctctctttctttattcttctctggaaagactgagtatttttggcattgtcatctctctacctggaagaagaaaacaactagtgtgcttagagagtcatctgttcacacagtaggagtcaaatgttcactggcccactaaatcccccaattgaacatctcatgagagataaagggcaaagatcctgggttatttgggcatcctgatttcagagactgatgaaatcaatagttatgtctaaaacttctcttagtttggagttttggttcctcttgtcccttaaaggttaaatgccctgcacaaagctgctgacagtataatgagatgtccactgagggctgcctgatgacccctttgcattgttggttaaagctggctcagtttcagaggtgtggttagagacatatttactgaggatttgtgaaatctgtctccagggtcaactctggggatctgtctattaacaaggctggacccatttcctgaccccttttcatcttcttgccaaaaaatctccaaaggttcaagaagaattgagttcatttcccttgaattccttcctgttcattattttaatgtcaacctcatcttgatttctcactcacaggctgactagcaatgaggaagaaaatattgatcatttcccaagaagatgctttaagaatgtctccagggcattgaacatgcagcttttggccagggttaatagttcagaaaatcttgcaggcatctagatatttagttgcatagaatcttccaccctgtgacctaaagtagatgactcaactcttttgcccactgacagattcagattcagcccctactggtgccaggctcagtctactgttgacatctttttatcataaacgtctgcttcttttctgggttcggtgcacttttgcttccatcagtccagtcctgctattcttctctggagaccctcccagccactaaagtcctctgtccccacaaagacgtgtcagggcctggagttcaggtccctggggcagccctcagacagtgattgacaggtgtggagtatgaaaaaccagcttttttgcttggattgaaacaaactcaggcataatttatgctcctgagtttcttgtgggatcagactggagtacctctccacagacctgtgcctgaaattgctgcctgtcttagtttccttctcttcccatcctgctctctcattgccttacctgcttctcctgggagcatttcacactgaatcacttgcccacaaacactcatctcagtctctgcttctgggaaacctgacccaggacaataaaattgcattgaattctcacagccgttctgtgagaattaaatttttaaacatttactttcatgattctcacttatagatgaagaaaccgagatccctagagtttaagtccaggtccatacaactaatataaggtgcagcgctgggattaaatccagatcttctgacttcaaatcttggatatggtttttattgagaagaattttggtttgagggaagacaggtttgcaggaaaaaacaaa

SEQ ID NO: 52778 - DNA, 703 bp, Bovine  19866880400716
tgttgggaaaactgtgacatgctaatgaaaaaggcaatagaaagctccacctgcaatctagagacaggagagatacagaaacatcctggtaagggtttaaaaataggtctaaccagtagtctgaccaagttgtgctttctggttgctagaaaagtatcttttcctgggacaacaagggctacttttcagactctaccagagtgggtgctgtgagagtaggtgatcctttctctgactgtgagttttccaaggagacttaagatcttcagggaaggcactgggaaggagatgatccagataagcagatgtaagaagtattcgattactagaagtcctgcattaatacgtttataagccaatgtcttataagtttggaaaatgtccttccacactctggatctagagcagcacttaatgtactgacacaagcgggttccaaacctcaaggccaagaactcagatgctgcattaagatgtcctcactagaggctaccccatggacagccagctagcttcattaatgcttcctcacactaatctggatcttgatttttaaaataacatcttacgtcttaaattttacaaggctgtctctttacttaagatccttattagattcattttcttttgggactgtctaatgttacagtcagtgaagatggattcatctgacttaccaagatcttcctcttattgtatttga

SEQ ID NO: 52779 - DNA, 2028 bp, Bovine  19866880410158
aatagaaatcaaagtaaaagcaatttatagaatccccaaatcccaccagctccttctggtccaatttcaaccagggtctttcccagagagtcctcttggcttctggtcgacatcttttttcccaggcatgaggcgttgacccaccagtcctttttcttttcttctgaccaaagaaatgtgacggttcacctgctttttgaaaagttgtcttttcttgagtttcagatgaagcacacatgttgttcccaagtgacttgcaaggctgtatgattgatttaaaccacaatgaacaattttctagcccagaaggccttggcaaggagcccttcccagctctaaagtctctgatgatgactcacttagaacccttccctgccactcaccagggaaattatctgataatacagttagtgatgagaaaaacaacccatcttgttgtctgaggcagctgctgctaagttgcttcagtcgtgtccgactctgtgcaaccccatagacagcagcccaccaggctcccctgccctgggattctccaggcaagaacactggagtgggttgccatttccttctccagtgcatgaaagtgaaaagtgaaagtgaagacactaatagctaggctcatttctgtgaggttcttttcttagatcttgtcctcatatttattcactgctgtgttccttctctgaagccctcaaacataggtagaactgtttttcccaggtttcatagcagttctcggtgaaagaggttggtatgattcacattaccagaagtgattctcctggaagagttggctcactgtccttgatcaaaatctgtgcgggaagtcacctagttccacattaccagaagcacaggaagtctcagatctttttggggtcaagacttcaggtttgcttttgtcgaatttgaggagctttggagatctctccggtaagataattgaaaagtggttggataaacaaatctagacttcaggaagaagaatctccatggagaaatatttttggcacagcagtgtagagataacacttcaagtgacaaaatgaatgagatcactcaggagaaagtctagatagagaaaagaagaggggctgggaatgcacttttaggagctgtagcgtttggaagttagctagaggaggaggtaggagtgaaatactgggaagaggttgttgaaagggtaggcaaatgcccatgagagagtatggtgtcagagacgcagaggaaaaagagaatttaaagaagtagagaacgatcaagtatgatttatttaatggaaagtctgacaatataagacctaaaaagttcctgggcatttgagcctcacaaatatcccggagacacttgatggatggcggtacttgggaagtagagtgggcggacagcctcagaaagagtgatgcagggctgtgggaggcctgcccggcagccatcaccctggtggctttcaatctctaatctgatcatgagctctgtgctatctcaatctgaaagacttatttgaagcctgagctctgtcctttttggcaaataacttgggtaatacctgtcaagggcaagaaaggatggtggtgcctatgcttcttcctaatactcatcagttcttgggggagcaaacctgtagttcatgttctcaaccagagcacagctgcacctcctaagtcgagcctgccttgctcagcgcacagaactccttctgacactggatgtctctccagaatcaggaggcagagaaaatgtcgatttctcatgctagagatgtgtgtttttttacagcaagcctgtactgtttgaactctcaggatagctgcctttactttattggtccagaagaaaatttaggctaaaggagaacctatttctatttgtcagtatttcagaatcgtaacagttacgtacagtacaaacctcattatggtctccttatattcctaggaaacattaaacattggcaatgtgtttgtatatgtatgctgagtttgatgactagacacactgatggtttctagatggttttctttgttt

SEQ ID NO: 52780 - DNA, 1862 bp, Bovine  19866880442596
ttctctcttgcggctgagagtagcacaggtgtgatacttggatctggcctcctaactgggaccagatgttcttaatggatttaggatgaattgtaattgctaagaagcaagaaggagggtgggcattttaggaactaacagcttggctaggcacctccatggcccagtttctgatacctcaaaattatggtagccctttaggaatagagctcatgccaagaaaagtgagggaaggaaataaccttgaagtaactgagctgatcttgaattggtgagattgtgttttctgataccatgtagaatgaaactcaagacagttaaagaaaaatcttaaaattatgttttggacatctgagatgtatggcctgaaattattttactttctgcataaacaattctctgggctaaccatcaaatgttgacctcacatgaatgttgcatattaatgtgtataaaaggccaccagggtcagaggagaaggttgccattttgctttcactaacctacgcagttgttctctgccatcttgaactgaatattctgtcttaccatatttatttgccttgtcagtataacaagggccgtggagggaaggagggcttccatggtggctcagtggtaaagagtctgcttgtgatgcaggagacatgggttcgatccctgggtcaggaagatcgcctggaggagggcctggcaacccactccagcaaccccctccagtattcttgcctggagtattccatgggcagaggagcctggtgggctaccatctatagcattgcaaagagttggacacgactaaagtgactgagcatgcatgtacatggagggaaggaggtgggtgaaggagagaaaatagggcatccctaatgattgctaaaggaactctgaggacatcaactcatgctttcaacacacattaattaaatgcttgcatgtgtcaggctctatttcaggtacttgagacacagcagagaacaaaatagatgatcagctctgtccttgtgaatcttatattctagcagaggaagaggataataaatgataagtaagtaataaacaagtaaactgcattgcaggttagaaagaggtgagtgcttagaaaaggaaaaaagtagatcaggatgcaaaggattaggaagtggggggcagagggtagagcaggcagagatattaaataaggagcaggagagaccttatctgagtaaagactgaaggaagggaggaaggtccctgagcatcaggttgagggaacaactagatgaatagccttgcatgctgctgtttgtttaaagacaaggacaaggagaaggccaatgtgcccagagccagttgtcgggggacagtgggggtagtggagtcagggagttaatagggactggatcatgaaggattttataggctttcactctgaatgaaatgggagatacattcatttcctgtggctgctgtatagcaaacgaccacaaacttgataactgaaaacatcagaaatttattttctcacagttccagtcaaagcgtcagcatggctgcgctccccgaagctctagggaaggatgtgctccttgcctcgtccagtcctggggctacatcgctccagtctttgccttgtgggccatattactttctcttttgcttgctggcaaatctttctctgcttccctcttataagaacacatgtgattatatttaggacttgcctagataagacaggatcatctctccatctcaagatccttaagtatatcaacaaaggctctccccttttccaaataagactctcacaggttgctgagattagggcgtggatattctttgggggaccattttgcagtgaaccacagggatcattgtgggtt

SEQ ID NO: 52781 - DNA, 1315 bp, Bovine  19866880486972
tgatgcttttgaactgtggtgttgaagaagactcttgagagtcccttggactgcaaggagatccaaccagtccattctgaaggagatcagtcctgggatttctttggaaggaatgatgctaaagctgaaactccagtactttggccacctcatgcgaagagttgactcaatggaaaagactctgatgctaggagggattgggggcaggaggagaaggggatgacagaggataagatggctggatggaatcactgactcgatggacgtgagtctgagtgaactccgggagttgttgatggacagggaggcctggcgtgcttcgattcatggggtcgcaaagagtcggacacgactgagcgactgatctgatctgatctgatactctgtacacaaaattgcagcattatttgtggtgctaacaagactgtaaagagcacagatgtccatcacaggagctatggttgaataaattacgttacatgcgtaccatgaaatatgcagctattaaagaatatgtctattatttatatctattgatccagagatagttccataatgtgtccagtaaaatctcactttggggagtatttttcaatctatgtctattgatccagataaagtttcaataatgtgtacagtacaattccactttgggaggtatttttctcagcatatttaacagttaccttaggaagtgggataggacagagcagactgttaattttctccatatttatttctgaattggttgactttttatataagtttgtattgcctccacaatttaaaaacctaagttaaaaataagtataaactcaaatgtcataatcagcctagaaaatgcattttagatcttcagctccatacaaaaaattatataaataatacagcttttcagatcaaatgggaaagactcagatttatatttctagagacctcttacatatacaggcattgtaatttacagttttcagcaattacaggataaacattcattttctttattgggtgtttctggcaatagagaacagaagggatagtttgctcattcttcgctgaacgatataacttactagtgaagcgtaatattttaaaatcagggtatgatctacaatcttcatttctaatccttcagtttcaccctcaagtagagaaaaaagtccacaactcaggagggaaatgggggggctgatggtattgacaaatttaaaaattcctttattttttgatagaggattaggcagaccttcgttgggcttctcatccctctttctatgctctaagctgtgtggagctcaaagaggtaaagcggaaa

SEQ ID NO: 52782 - DNA, 2500 bp, Bovine  19866880497186
gcaccccactccgtactcttgcctggaaaatcccatggatggaggagcctggtgggctacagtccatggggtcgtgaagagtcaggcacgactgagcgacttcactttcacttttcactttcatgcattggagaaggaaatggcaacctactccagtgttcttgcctggagaatcccagggaccggggagcctggtgggctgccgtctatggggttgcacagagtcggacgtgactgaagcgacttagcagcagcagcagcagcaaatgaggtcaggtgtggtctgggcaagactttattgacattatttattaaagaaaaattgagaaaagaattttgaacttcatattagatcatgaatagaggcaataaaatgaaagttaccaaagaaaactagtttatccttcttattttccccatgagcactgaagtagggactacacttgtccctactttgctttcattatggagatgaattccctgaatagatttttcctggtagggtgagaactttggtctcttcagagaatagacacttaggattcaggaaaaaacaccaagctctctacttatttatctgcctgtgtccctggacagtcctcttgcccttctccaactctcctttgaaactaaaatattgaagaggaaaaaaaagggccatccacagccttgctctgtgtgactgagcaaacctattccgttcttactctgtattcaagacatacacgctcctcctcctgtagtatttgctgatgtactttgcactccagctgctgcaatatttaaatcagtgattcagtacacagaccacacgatgtgccactacactccaacaagcaaggtctgtctctcggtggggacagaggatctaagcatctgtcattctcctcctgtcgcttataattaaccacaatacccctttacacacacaaatatttatatgcaaaaataaaactctcttgtgctttaagccaatctctcttctcctcggtgagctttgaaagttgccaaaatggatgttttacttaattcaagactctataagaaattctttggtgtgaagaacttacagcacataattatatttgcagaaaataattttaaaatcttggagttagaagtaggatacatgaaaacttccagaatgtaagctccatgagggagtggtctctgtctatctcattgacataccccgagtgttagaagagtccctggtataaagtgtgagctcagtgaatatattttgagtgttgaatgaatgaatgtatagaaaccccaattgtgaaacatgatcctgctatttaggatgaagaatttaagactagaacttctaagcaaacattgtggaacttgaaaatactttgatattaagtgagagtagggcagagtgaaaaataatcacccacttatttattaattgacccaatgaattatttaactgttgccaagcatgataaaactaagtactgaaacttctataaaaaataaagaatggtccttcccctcagggaactcttggcttgtgtgtgattctcaaaggatggctcatgaatctcctatgtgtatgtgttaaaagtgcagagccccaggtcctaccccaaactatctgaatcagaatcaatgaggatgatcctaggaatctgtattttcaacttgctggccaggcactcacaagcactgtttgagacgctggtctagtggaactggaggcttcccaggtggcacgagcggtgaagaacccgcctgtcaactcaggagacataagagacgcaggtttgatccctgggtcaggaaggtcccctggaggtaggcacaacaacccactgcaggattcttgcctggagaatcccatggacagaggagcctggcgggctacagtccatagggtcacaaggagtcagacacgacggaagtgacttagctcacacacacgtgcactagtggaacttgtgctatttgcctgtttctcagcaattaccatttaggtaatataaatcatcacagccaagcgtctcttagtgaaccaatagaatgtaataatattaaaataaaatgaccactttagattagttgtccagtatcttattgattgggcttccctggaggctcaggggtagggaatctgcctgccaagcaagagatgtgagttcagtccctgagttgggaatatcctccagagaaggaaatggcaacccattccaatattcttgcctgggaaatcctatgggcagaggagcctggtgggctgcagtccttggggttgcaaaagagtcagacacgactgagcgactgaacaacaatcctattgattggagcttacaaaattgtcctctgtaaaactaatctttactgggactgcaatttgagttgtgctaaaaaggcaagcaggtagcacttatagactttcagaaacaggcctaaactgaatttcctgcacattcactaagtttctaaacttctgcaaattgcgttgaaactgcctcaggcctcatcaatttca

SEQ ID NO: 52783 - DNA, 3552 bp, Bovine  19866880509842
ctacacactggtctaccgttctagagacagctcagagtaagacgcaggccctgttctcaagctgttgggtcttttgaaggggagtcagaccccctcccccagtgggaaaactacagtgtgggtgtcagtgctgtgattgtggtaagggaagggaccacccacccccccgcaacatggccaggtgttctcagcaggaccaaaaaagccttggtaagtctctggcactagatgagcccctagagccttggcacagccctggggagcagcccccagatggctgaaattgagtctctcacaagctcaggtgagaaggtaagagctcgattaagctggtgtttgaaacaacatggaaacaagctatttctggctcactgggttatgcactaagatttatctccaccaggcaacgttttgttccaggaagctatgagatctagaggcagaacttgggaagatcaccaaaagcagaaggtggatttagagtatcctagggattgggggcaggaggagaaggggacgacagaggatgagatggctggatggcatcaccgactcgttggacatgcgtttgagtgaactccgggagggagttcatgaggttaatgccatgaactccatgatggacagggaggcctggcgtgctgtgattcatggggtcgcaaagagtcggacgtgactgagcaactgaactgaactgaactgaaggattaaaagcaattcctttgcctcctgacccaccatcttttccccatcagccaagattctgacagctgtttggtgttggtgaggtcatcgctgggcaccctgaactggccaatcctttttgaaactcccccaaggacagagtccacagtgccccagataactggttctgagttttattatctcaatggccaaaaatgtgctttgtcctacccacatcactgttacttgaattaaaattcattttcttttacctgggctttggaggactaggacaaccatggtttatcaacctaaatcatgaaaagatgctttctaagctgtgaagactcataaaaataggaagtcgttttatttctatcatatgtaagatcacacagcaggtgaggtggaattaaattttcctgaataaccagtctgtgtcaggaacagggctaagctcatgacatatgttatctccctgtaagcctagctccacactgtcaggtcagcatgatgtttctcattttacagatggaaaatggaggcacagagaggtcaggtaactttcccatggtcacacagctagttctagctaggactagaactcacgcttgtgcgattctttcaactcttctacaatcctagaagattgtaattagctcatccatagccttttcctttccaatttatttaatttttagccccctttataatgaacacttcatcttacatttgacagtttttgaagatcaagaagtgttgttgaaggatacagagagatggacttattttacaggctaatgtattgtaacctctgtgaagaattttttcttgagatcccaccagtactggggtcttacaacagttgtggccaatttaagcctgggggagtcacatgagaagtacttaaaacaagagcgaagacacatattatgcattttcttgtgtcacaataagaagaggttgaaactcttatgaaaggtttaaaatgatattaacatagagttacatgagggtagtagagacaatggcagtggagaaaaaaattatctatccatcactctgttcattcattcaaatgccagattatctctgtgttgaagactggagctaggcactttggcagacacaaagtatgtatatgtgtgtattatgttttggggaagggggaattattgcatatgtttgttatggttagttgtctttatttttttttggtcatgctgtgcagcctacagaatcccagttccccgaccagggatcaaacccaagtcctcttcagtgagagcacggagtcctagccattggcctgccagggaatttcctgttatggctaattatgcctctttaccttaattaggctaagtttatcctgtgctttttatttgtctaatcatgagaaaaacatcaaattccagtaaaggagcatcttatggtatatctgaccactattcctcaaaactcaaagtcctcaaaaacaagaaagtctgagaaattgccccagtcagaaggacgctttagtcgtgtccaactctttaagatcctgtggaccatagcctcccaggctcctctgtccatggcattctccaggcaagagtactggagtgggttgccatttccttctccaaaaggtaacatggtatcctggatgaatcctagaaacgaaaaaggacattgggtgaaaactaaggaaatctgaataaactatggacttcagttaataataatgttaagaaaaaaaatcccccctcagttccagttaggtactattgtctttcctcatcaagggtggggcccaaacgttgagataaagagagattctgaggtcacaggaggggagcagatgagcacgaacccacagaggggaccttggccttgcttggcctccagccatcatttcagccttcaacccatcatctctcagaagaatcctcaggccagtgaaaatctcaggtgcttgaccagatgagggtctcccacgggacccaaactcatcccagaccaattgttttaggccatttcttaagacaagccctcgtgtctcattcaccacctctcacatggccatagattgtacctggcaagattttgaaacaatccccttcaccttgttacgctctcctcttaattagcagagggacaaatgccgttattggaagcaacctctctgcagcactcttccctctgtttggcaaattaaaagcatttggatgaaacccttttgtggtcccaatcaatagctcaagccgtaattattcagtggtgcttgcagttttctgtgctgacagccggctgggtgtgctgatctgtaattgtttcatatgcttatgtggctttctcatcccatgtttgtggtctgcagcagatgaatcgatagcatctttggggaaacaaggggatggacttgccagcatctgaatccctcaggcctctccatggttttaggaatcaggtgggccctcttacttccttgttaacccacctgatacaaagccgagcagtacatttgggagaccaaaaataaataaataaataactccaactttattggataatcatgtagtatcaggctttaggttgaggataatggttgtgtgctaagggatggtaaataataaaattttattagattccactaatttcagaattaccgatcatttggatgggatgtggattagtgctcaagcagatcttttcctaaaggaaaatgtaaacaaaactgcaggggttgatgcttaaggtatttcagaggattaattattttcaatatcacctgtcttttaaaagtgcaaacagtcacattcaaagagctgttttattccttccaaatccttctggagtctactagtgagagactaaactcccatc

SEQ ID NO: 52784 - DNA, 1655 bp, Bovine  19866880586765
attttattctgtgtgaagagatcctataaagccatttctataccatctctgcatctttcctgctatagcttatgagaaaacattggtgttccttgtctccttccagggaacaagagagaatcctagcatatatgctatctacccccaaggtccccaaatcttctggtgtttatgttgccccacctttggcttagttaggagtaggggcaggacagagtccctgcttagggccatccattacatctaaccatcttgtcaggaaaaatgtgtgaaagactttggaaacagacaaaattgattgctgggtgtcctgcttataccacccttctgattcatctttcttcgtctaaagctattttacaaccctgtcaagatgtggaatactggtagtaatgcaagtgattcttgcccatagaaatgcaaactgtgtccagcagagaggcaattgatcgctgccctacaatacctttgtatctttctgtatttatttcggcattctttttgaaatttttattgaaatatagttggtttacaatgttgtgttagtttcagttgtaaagtgattcggttatatctcagcattcttgatgatctatatgtgttttcttgaatcctcccctgaactagttgcaacatctgactagtttcatcattaataatgacatatgttcattttatatttgtgtaagggtcatgattttaccttttgtgaaaaaatatcctttgacaatctttactctattcttcttctcccaactgctttctcttcttctgttgttctgaacaatcacaggttaagccagaagtaactggcactctcctctgtatatagagggaacaactggggcttgaggaaggcaaaacttacccttggattcctgattcctgtcctggtactccacataggtggcggtaccacctgtatgagttctttaggaagtgcactgaagtatttggacaaggaaagggtctgttctgagagagataatgtcgtgcagtgtgcagaacagtcccctcaaatgaggatacgttgccccacatgccagagcacctccagggagaaatgtacaagatgctgctcatggatatggtggtcttaatgactgccccccaagaatcctgctgggacttgtctattcatttaccaaatgactaaaccagagctactttagtggtagtatttccccccagcatgcagaaatgtttacggccttcaataaagactgttctctatcgagaactgagctgggcgtatactgttgtaaacgtcaggcatcctccaagtaagatttatattcttattttgcttaatactcacactttaatgaggcaataaaaacaagtgagattgtctcattgcaaaggatcctacttagttaattatcaggccccatgccacaaatcactgtgttgggtttcttatacccaaagaagtctgctttttatccctctcctcacgtgagtcacatgagcctgtattgacaagttgagcctgagttagaggtggtggggaaggaagagtaggagagttaccttccctataatgtgggacccccaagcgtccagccctgtatacatcaatttgggaggcagtgaagtgaacaggtgatgtccagattctagggtcagatcttaaatcccagctctgccatcta

SEQ ID NO: 52785 - DNA, 2192 bp, Bovine  19866880592427
ccctctcatctgattagcattagttcttactgcttctgccttttaaaattcctcacataatctggagaaaactttaattcaaaaagatacacgcacctccaggttcatagcagcattatttataagccaagacatggaaacaacctaatgtccattgacagatgaatggataaagaaaatgtggcgtgtgtgtgtgtgtgtgtgtgtgtgtgtgtgtgtgtatacagcttctgctcaggttcattcaggaggaagttatcattatctcatttttatggatacggacattgaagctcattaagaataaagtaattgtccaccccagtgccacagggtaagtggcaaaactggaactggaattcacattggttttaatccaaagtcttttgctagcacgccatgaaactggaggtgtttttggaagtgatgatcctacggtgcatagcaggtagtcgtgtgcactactcagaacacttatcccagggatgtggatgtcagaggaagacatctcctgtgtgaatcccacatttggggaattctgggaaaattgctgtccccttgacctacattccctctgttgaagaggtagtatctaggctgaaccagaagaatcaggacacagactacaaaggaggaggactcctgaccaaaagaagcaataacaattgatgttccagtctgtggcttcttggaacccagctgccccaacagcttgatgggacacacagacagagcatctctgtgaagccagcctctctggagccaaccaggttagaacaacttaacaaacaggagaaccaattcagaggtatggggctgaagaaggccagatccataggaattatgctcaaggtcatctttgacaaataacaactgcactatgattttgcaaccctgtaatttccattacactatatgaatatgcttgggggccagagaaagggagattgataacttcatttagaacaaatcaattggattccactgatagactcatgaatcatccaagagacaaacaaggggtgtcaaggaacactgagtcctctcccctggcaatttttataagcctcatcaatttctgtccaactgaacacttccatttgggttattaacataaaggttctagaatacatgaagttaaattctttctaaagttctggcaccttggtcaacacccatttttgtcattatgcctttgatttaactaacatgaataaagaaaatgtatgcccatccgaatgtgggctggttaatcatgacacttaaaaaaagtcataacagcaaccattagcatagcctccaaaaatagcatcctgggaagagggaggcttaaatggtccaggtgcccttgtccaaagattgttagagccatcttagcttcacaccattacacaaaatcaagtatttcttgttctgatccatacgtactgactgagtctggagctgggggacttatgctaaaacctcccttaatatatccacatattccatgatttacagtacataaaggctaagaaatcactgaatgaagtctcagatcctgggtttcagttataaacaacacggctggtagacttagcagatgatgggatttggtacaagaggagagtgtaagatgccccgagataactccattttgttttccctggtagttaaattaattaatattccataatagatctaccacatgattcagcttctgggtacatatctaaaggaaatgaaaacaggattttgaagagatatatgcactctctcatttactgtaatatttcacaacagccaaggtatagaaacaatgtaacggtgcaccaacggatgaatggataccatatatgtggtatacatacaaaatggaatattattctgccaggagaaaggagggtatcctgccatttgtgacaacacgaatggaccttgagcacatcatgcaaaatgagatgtcagacagagaaaaacaagtactaaatgatatcatatccatttatatgtggaattttaaaaaacagagagtaaaatgctagttaccagggcatggggctgtggggataagattgatgttatttaaggatacaaatttccaacaagtaataaataagacaaagagatctaatgaatacagacattattgtactataattatatactggaatatatattactacaattctcatcattttataatatataaa

SEQ ID NO: 52786 - DNA, 1557 bp, Bovine  19866880605680
acggcagcccaccaggccatgccgtccccgggattctccaggcaagaacactggagtgggttgccatttccttctccaatgcatgaaagtgaaaagtgagagtgaagtcgctcagtcgtgtccgactcttcgcgaccccatggactgcagcctaccaggctcctccgtccatgggatttcccaggcaagagtactggaatggggtgccacttcctctggtaaactccaattgttgccgttcttaaactcagtaacatgatgggtaattctacagagtagccactggatggcaggcttcaaccttcaaaagatctccagtgcttcaggtctgctgcctgcgaggttggcgagcaatgaaatgacaagctgtgggcagaggcatctcttccttttatgaatactcccaggcacagtttgagcagctttcacttcacattaggaagctgatctgtttgggcatttggtttaagaagaataattccctaatctcttgtccggtgacgtgcttttacattttagcttctgcctttataggaaaaaaagatgtctacccagaagattcatgacaaggggatgtatatacaggcaggataatcacctgcatgttaagagaaatgttgttttccaggggttccagagagtatagagtttacccactggcaaaataaatgtggatatatattactggaacacacacactaaccagaaaaaaaaaatcatgttaacaatactgtttcaaatttcaaccataattataatgttcaccatcaaccctgctttttctttctgacttcaaacaactgtcgcctactcaaaaatgagaaaataaaggttcaagaacatttagttgaaggtgtccaagtcacatcttcaaaaagcagaaaataaaaatctcatccaacttgttcggaaagagagttgtgtacttgttcccatgagaaatctaccagctggggagggggctgcctcggaggggagggggctgctgcggaggggaggcaggaacaagtgaggacaaggatctccactggggacagtggttacacaaacaaatcatctaggttctcctgaacaaaatgaggaggtaatttagttgcagctggatcaagaagatttcagagcaataagaatcaggtaaggcaatggagagagttaatagaggacaatttagactcacaataaagatataatttccttagggccttccaaataacaataacttccagaaggtcgttagcatacactcttggagattgcttcagctcatcctgttcataaagacacacaaatgggtccacgcacaagagccagtaattagattctgccactccctgtcccgagcagtcctggactgtgaccattaaccctctgctccagacgcaggagaagtgatctgggaatgtcgtgtgcacaggccatggttattcccgacagcagcaattaccctccctcccaggatgtgtctgcctcagggggacccagggcacttggcacattaaagagcatttataaacagtaggttagaagagctcacaggaagatgaaccatgtaatgag

SEQ ID NO: 52787 - DNA, 1620 bp, Bovine  19866880610668
ccccttcctgggcataaatgttcccctgcctctttctatgaattcatttatcttttcctttttggggaagctaggtcaatggcaccccactccagtactcttgcctggaaaatcccatggatggaggagcctggtaggctgcagtctatggggtcgctgagtcggacatgactgagcaacttcactttcacctttcactttcatgcattggagaaggaaatggcaacccacttcagtgttcttgcctggagaatcccagggatggtggagcctggcgggctgccatctatggggtcgcacagggttggacacgactgaagcgacttggcagtagcaggtcagaccacattcttttaggaagtccactgtgatagtaccacctctctctgctctactctgaacactcccctgtcagcatcagcagtgcttatattctcttcatggttcatactggctgccacatagcacagactgaatacgtgttgagcgtatgaataagtagattctgttgattctgtctctgagccatctctcaaatatgtccccatctccctgttccccactgtcatagccccaggtaaggctctcatcactgctcccatggaccatccaaataattcccaaaaagcttcccctgccttccatcttccctctacgcagactccccagtgccactaagtgaactttctgagagaaatctgatcatgtctcctatttgtcatggttctccagcacctttgggataaagtcaaaagttcttagtgtgacttttaaagctcttcacaatcaagtcacaaacaattattcttgtctctattacttttcactgctgatatacgcgtatctgagttaacccttcaagcccaggacgtatgccttgtcaatactactctgtttgccaggggcatccttccttcttttctacctgctgaacttctgcttatgttttggggtctatcatacatactaccaccaaagcctgcatggttgcccccatgcagtcccagagataaacctgccctcctgtgaacccccagcaatttagggtcttgggaacagggcacactgagcacagggcactttaattactagccggtcagtcttgctgctgctttgtgaccctcttgaaagcaggctgaaatgcctcttacatccacagccccaatagagcacttagctccaaggatgctctcagtgaataagtgaatgaagcagactgttcacaccatgtaacttttcattcacttgaaaccatacactttcagaactaaaaaagatattataaaatgttttttctaacttgctcatttttcacatgaataaactctagcctacagggttttaagggacttgcccaagatcgtaaagaggcatcagaggcattggccctggtcacctgattcatgccaccttctactttattgtatatataaagttatggtgccaaaagacagagtaagccccacaaagaaaaagattgagtagattctttcgtttgcatttctctatacaggggactcggagaaggcaatggccccccactccagtactcttgcctggaaaatcccatggacagaggagcctggtaggctgcagttcatggggggtcgtgaagagtcg

SEQ ID NO: 52788 - DNA, 1082 bp, Bovine  19866880614277
tcttagaagatcttttgggggatagacagctattaatttaaattttaaggttagatcaagaaagagaactagccaaagattaaacgacttgccaggggatgggagttggaggtattgaattcctctgagctaggctctgtgagagagagtaaagcaagtcagatgggataatttccccctctctggcattcccagtgtaatggggctcagagctagagctctggtctaccctatctcctccagtggtttgtttctccactactcatcttcgtcccagcagaactgtgtcatcctgatttatcttagtgtaccttgggactgcccctggaaggctactgcttattcttacaagctacacactgaggtccgtgttctataatggatggaatgaaaaacaacaaaacaaacaactctttatgttaaatctgatttgaattctccttaaaaaaaaataaagcaactggcgtgatattttgacagctttttgacagtgcccacatttgatttgatgagatgcatgctcctatttgagttatgtccaaaagagggcagacagatggaaggtttttacaaaagggaaaaaaaaagtcctggttagtgtaagcctggaattcctaatttgcttttttttcttttaaaaagcaatagataggtcttaacagatggcctaactcttcagttagatgcattctttgaaaaattacaagcagtaaatgccttttacagatgtagagttcaaatacatgaaaatcatagcaaaccacacagcctagagaaacaaactttctggaaaaggaggtttagagaaatgaatacatactcagctatagaacaatctgctgcagccctccggcataacttttcaaactgtgagtcatgacccatcaataggttatgaaatcaatttaatgtgttgtgaccagaagttgaaacaaaagtcatggtgggaacaggaaatattcagagtgcatcacgtgtagtaagaataaaggctgtttcatgctggtttgtcccattacacactgtttcctgaattatgtattttttactataggtcaggctaaaaatttttttcaaagatg

SEQ ID NO: 52789 - DNA, 2088 bp, Bovine  19866880658118
tgattctcccccagaaatgcctgtttatattgtatggcgctcagcttatttacacataatggtatctaatgatgctgagaaatagcggacaagatgattgtgaagatcctaatgcagatgaaaacggaatgaggatgaactagcattgttggcagagcgggattcctgggctgcacaaatgcccgcagagcagccagcccctcagcctgagtgctctagtcccttgaagctttagatggtttcagacaattgcctacactcagcattatcctatgacaatttgtttggtcacaattatctttaatctcctgaggcattaatgcttactgtgaagcattaacacatcctgatcttattcaaacacttaggactttcttgctggtctcagatgcagagagaaaagccagagaggatgaggaaagctcgtggagagcagatccctcactgagggctcttcagctgaagacctcttcagccagagctggccctgaaagggctacctgggcaagtggttgactttttgtgaggtggacctgagtgagttaccatgacaaccaaggaagcccatgcccgggactcagcctgcctgggcccctctccaggcctcagtcttcctacatgtggaaaggagaagactgtccctatctcagaagtttcttctccagggatggttgggggtgtgggcagctggtgggttttgtgaaaaatacttttaatgtattctggtatctctttccatgtaattcagtaaatgtttactgaataccagccaggcagtgtgcaagacatcaggggatccccaggacaaagtttcaccagaggcaaggcactgacagattgtgggaaggagggaatggaaggcaagcgcacagagaaacacaaagaaggagaactctgttatgagtctggagcaaagaaagctgtgtgaggcaatggaagagaaaaagatcagctttgattcgagtcaggtggcatttaaattgtaccttaaaagcagaacttaaaaaaaaattatagatgtttccaatcatacttgaaattaaacagcatagtataacggattcccatgggcacatcatccaacctcaatccccaacacatgcttccacgtaagaccccacccacttttccagtataacccccaccgggtcatttccattaaaatcccagagagcagagcatttcataggaatctatctcaataagactattttaatgcaagcacaatacaattattatatttaaaacaactttcttaatatcatcaaatattcaatcaacacccaattgtctcataaatatattttacagttggtttgttcaaatcaggatcaatgctagtctgataggtctcttaagtgttctttcctatcttttttccttgcaatttggtgattttgttaaagaatctacatcatttgtcctccagagattccccacatctgaattttgctgattacttctctagaatgttaatgttccttttttccctgtatggttgtgtacattggcagttcaatccagagcttcatctgacttgggttcagtgttcttggtaagacttctttttaagtaaggttgggcacttccatcagagggtcataaagcctgatgatctctttttgtgatgtcagcagatgctaagaatcttcacctagacatgaaagctctatgtgggggattgacacagatgattgctttgttattattttataacttggacatgtgtctcatgaaatttctagtgtgtgtgttctgtggcattagaaaaaaagaatacaggcattttaataggccatagggctttgtgaagggcagtgaccagtcaaatccatgggataaagcacagtacctagaagattgaagctgggctttaacagctaaaacttcaacaattttagtttctgaaacccagaggccaagtaaacggtggcataactgaggcctacacccgtgagcctacactttggggcccttactgttgttaaatagatgcttcggcctcccaccagagtcatgtcagaggaagccaagcagccgtagtcaggagatatgtgagagagccctcatctgctgtgtttataataa

SEQ ID NO: 52790 - DNA, 915 bp, Bovine  19866880713939
tattaaattaggatttaatgccaactaaaggaaaattaattgatgactataatctcaaaaaaaaagaatatctgcatcttaaaaaactggactcttcttggggttataattgattactttcagcagtaatatgatattttctaagtttcaacataatatgcaaaaaaataaaataaaaaaggataaagaacttgaaagaaactgtggccaagatttagacaggatgctgagactttgggaggtgggggcagaattaagtggtatgactataaagtttcttaggtttctcagtctattgtagtgattactggtgtggaattaattttctttgcaccactttggtgactttcttacctagagagcatgcccagaggtgtaacattaagtgatcccatcagcattgccagggccatccctggtgcttcccgttctattacttcttttgtggcctgtaattaaagattaaatagcagactgagtgaaattaaccaaaaataaggaaggcagagtagcaaaattaacttaaaaaataattatagatcatgctatctattaatataaaccatactttgtagtgctccaattttttttttaaggcttaaagattcaattctttgggaccactgaatgaaagctgaaaaccaggacattgagggaacttttatattagtagatctttcttatcccttataactcagaagtgtttgacagcaatatcatcttgcttaaccttaattttaaaattaagcctcagattgttaaaatggctcaacagattttcacagaacaagaaatctgggtatttttctttgtctattactcttgaaataattagtccctaaaaatctgagaaccccttgtatctctcctagctcgatgattttatgatataatacagggaactcaccaaatcat

SEQ ID NO: 52791 - DNA, 1642 bp, Bovine  19866880716142
aagtgaagtcgctcgttgtgtccgactctttgtgatcccatggactgcagcctaccaggctcctccatccatgggattttccaggcaagagtactggagtggggtgctattgccttctccgaaaaggggtaataattgtacctaactcctagtgttgttttgatgattaaatgggtggatatttacaaatcagtaggcacatggtaaggaacctgtaaatgttggctgtgattatcatgcagtgcatgattcctttgacatttgcttccttagcctctgaatagcaaatcttgcagtggagtcttaagaaatattaattgatgaagctagtattgaaaaaaaatcactagtttcttagatctctgaaaggacttggcctttcacatcaatgtgggtcaaatagtttcttttttcttttttccttcatttcttctagtaaggagacttcgtgtattccggaaactggtgaactttctgagagtctgagcaggaaataaattatggtgatcatactgattaccagcctgcttcttggaccttttgccagaaccctgccaatacccccttggggattgtaaagttattagaaacaaagatataattagcatctgaaataggcaaggataaaaagagtcaaactttgtgatctacaaatgaccaagaggctaaaaccactgaagagaaaattaaaaaagcaaaagccaaattcttctaactcagccttcactttggcttagtgaaattctagcttgaagcttgctgatgaggatcagggcatgatgtgcttagagcatctctaaattagatctctcagtttagatgtgatttccaaatgagatattttccaggaatctcttaacattgctgtgttgtcagtggtccatcaaaaaatatgtattgagcacttatagtatatgggtcttaggggacttacattctaagggtagagacaaatgagcaattataataggaagagagattatataacttaaagagagctcagtttaattaacagggttcaaaaggcagtccatgggttactggccaagtatttaataaagacaaagagaaggaaaagaggtagggagtgaggaaagaaggaataacagaggagagactgattgattatgagaaactccagagatatgttagctttttagaaactcaatttaactgaagatgaatgagagcctaagagattaaaactagtgattaaaacaaaattttgatatccatgtatttcatttatcaagaacacattgatacatctgacactgatggtcagagtgacaaagtgaatgactgcattgtctgcttgtattagtttcatattgccatgtaacgaattatcacgaactttcttaaaacaacaggcttcccaggtgagctcagtgataaagaatctgcctgccaatgcaggagacctgggatcgatccctgggttgggaagatgccctggagaagtaaatggcaacccactccagtattcgtgcctgtagaatcctcgtggacagaggagcctggcgggccacggtccatggtgtcgcaaagagtcggacacaactgagcatgtacaccaagaatgggtattgtgtctacccctgctgccattatcttagtgtctcaccagtttgtgcttaga

SEQ ID NO: 52792 - DNA, 680 bp, Bovine  19866880749746
ggtccctttataaggtgactgattgtcttctgaaaggtgctccagagagaaggcgatgtcactttttatccaagcatagacagttttattgaacaccaactgctaagtaaggtaccgttatttattttactacacccattggtttcagcaactttgagcctcgaatggcttcatgtttcttttccctctttcaatatcctagacgcagaggccagtgagctcctcccatcccctctcacacctctcccgcccctccccaccaggacgacctctccaggcctcaggcctccgcgggcctgtgatgtggccccgcagcgtccggaaggcaccgtgtttgaacagggatgaggcagacctccttaagctgcttattctaagttgggaattgttcctcctagtcaattgatactgaaaataattacttcttagaatctttgaaaaccaaatgtgtaaagagaaattaaaatctaattaaatggatgtaggcaattctgtctgagctgacaatgcttaagccactgcagtttgtcaaaggttacattatctccctgtccctgggcactgcaggctctgcctggctctgagcccggcattccctctccaacacccttccgtctgccctgtcttggacctgagtcctctttgttctcgggcagagacggggcgacgaggccatccat

SEQ ID NO: 52793 - DNA, 836 bp, Bovine  19866880751108
aaactgaggaagcaggaactgctagagatactaaaacctctagaagacaagaacaacctgttgttccagaagttgatgtctaacttggaggaaaaacaaagaaggtatgtgttcccttttcaggatttcctagaaggggaaaggcaggagaactggatttagtgatgattatttacatttttaaaaaggtttagtagctatagtagattaacaagaaagtaaccacaaaatcagagtggcaaggaatccttttttcttttagtagaattaaatatgactcagctcatctcacagggctacagttacaacatttcttcccaaggaaaagataagaggcttcagtatcctccgtgtattagggtcacacagacagctgcccattcatgtttgtggaatcaccttaggaggcatgactgttcttcaaatgccaagcaggggaatggcaaatcgtttctgagcatcaaactcctctggattagggtctggccttactcttaataaatgcactaggcaatcgaggtcttaactcacttactgttcttggaatctaccaactttctttttccttcctagtcctagggaatctcactttaatgtgtctaccttagcaaaaacacctcatggagcttggacttttggaaagcaaaagtcaggcagaaagctgtgagaacaacagccaggcagaaaattgtggtcaatcaacagcttcttccaacccagaaacttagccctctcagggcaagggaacacaaaggcttgcttctccacttataattagagaggggaaagtacaaagagggaaaagtacaaagaatataagcacaagttaattaatg

SEQ ID NO: 52794 - DNA, 1614 bp, Bovine  19866880812473
tcctcaactgtgcctttcctttatttctcaacagctgtgaaaaccccttctctgctgggctggcgacagcccacaggagatgccctgggtctgggccttgagtcagggcttgttggggtggatcttcatgagacttccattccagcagacccagggaggtctgagctgcttgctgttgttgttcagttgctaagtcatgtccgactctttgtgaccccatggactgcagcacacaggctttcctggtcttcactatctcccggagattgctcaaactcatgtccattgagtcggtgatgccatccaaccatctcatcctctgtcgcccccttcttctcttgtcctcagtctttcccagcatcagggtctttttcaatgagtcagctcttcacatcaggtggccaaagtcctggagcttcagcttcagcatcagtcctcctaatgaatattcagggttgatttcctttaggattgactggtgtaatctccttgctgtccaatgacatcttgtccagagagaacagtgaagacagcttttgcccaccaacccagtggtgagttagggagttcaccatttctggggcagagcacacaatcaagtttcatatcacagttggaaattcatggagggaattcatggaatgagacaaggggctggaaacagcacttttcttaaattacacttttcttaaagataaatagatgtttcaaagcagtccattgatgggggtgtttgtgtggctctgatgaaaacagttgtgcttctcgcctctgggagagccgagctgatccacctgagaggtgcttttccaagtttttgatcatgcatgatgcgatttgtgaggaaataagtttactttcttttcattgtggacttctgggttctgcaatgagctcagagaccacgtttatcagattcaggcttgcttgctgaactccagattcattcgtttattcaagcatgtattcaataaatgtatattgagtcccatctgcacctcagacactctgctcggtatcaaattaatgagacttgactatgcacacgtgacattcacagactcacgttgcaggggactcacagtgcagcaaccagaaaagctttccagggcaaacacttgagttgggttttgaaggaccagtgccagttagccagacagatgggggcaaaggaggggaaccaaggctggctgacatcaaggcccagactctaagtggcaggcatatggcctccaaggatctgtattgacagggaacatctcaagaggggactcaccaagagaagctcttttcctgaagcccacacccccttgaacagcgctaagacttctcttacacaaatgggaagtaagtgaaagtgaagtcgctcagttgtgtcctactctttgcgaccccatggactgcagcctaccaggctcctccgtccatgggattttcaggcaagagtattgcagtggggtgccattgccttctccacaaatgggactgctgctaagtcgcttcagtcatgtctgactctgtgcgaccccatagatggcagcccaccaggctccgctgtccctgggattctccaggcaagaacactggagtgggttgccatttccttctccagtg

SEQ ID NO: 52795 - DNA, 747 bp, Bovine  19866880815227
cttacctctaaggttgttatgattcaacaatcaaacgaatatagaccactaagcgtaagtactaaatattcaaaaaggagctttttatattactgttacaggacagttatttatattacattatttatgtaatatattacataaattatataaacagtaatatataaattactgttatttatattacaggacatctcaatgtcctgagttctgaaataagagattaattgcactgtagtgagagtatagcattgactttattcatctctcttctgttttccacttcagaccctttttttcccaacctagttacttcaccactccttatagaaaatagatttcagccatcttactaccccaactgtcttcctgtataaattccagtttgtaggtaattttcaaaaagtgtgactcccaagtttaactccaagctcactttcccaaagtacaatgggacttttatttcccttgaactagaaaacttgataactgattcagtctcagatcccattaacttttcagcagccattccgctcaggatgagaaagggcccttctagcccaagggctaagaaaaggtaatttatttggaagaaaccaccaaactccacccatttaagtttttattaaacagagagaaaatgagatcttgagggatacaatgcatttgtgattatcagattctttgaaaaggttatggtgtttactatatgatgtaaaatagtgatcttcatctttgccattaaaa

SEQ ID NO: 52796 - DNA, 2041 bp, Bovine  19866880860664
ttccttgaggagcttccttttgcagccttgggggtcacacccctgtagaggtgaggcagtggattttcaggggactgtttgtgaattatgctaaacttacaggcagtctagtgtgaaatgtattctaggctacaggtcaagcatcttcaaggacagacatctccattagttttcctgtttcttgatgcaaatggaatagtttgggaggttcctgacatgaagccagggaaaaataccacgtgacaatgaaggcagagatcaaagtgatgcttctaaagctaagggatgctaaacattgccagaagccaagagaagccagggcagcagcacagaacgatttctttcttggacctcagaaggaaggaatcattttgatcctgagagatttgtgagtgagtatatttctgctgtttaagctaccctgtttatgatgctttgttatggcagccctagcaaaccaatacaacactcaaatctttttcagtgatggtgataaactagatcttgccgattcaaagcaaacttggaagtcttcaggtgaattaggcttttttgaataaatactcaagtaattcctattttcctctccttctcttctctcctgtctttctcaccaggccgtggccctacatggaggcatctgttctctcaggattctgctatgtctgtttttccctttgttacattggctgtaaaatgttctgtgtctgttgctgaagtgtctattccccatgctttccctgtattgggtcactggatccaacccatttactcaactttaataccctcatcttaaatgtgaggcttggctagggtcagcctcacctgcacctgtcttgagtgatgtaggggcaggatgggataaggtaagggaacactttggatgttgtcctgaacctatatctgaggccggaatctaccagggcaggagatggtggtcccaggacacacctctgccatcccagacctgtcgtacttccactttgccactgctttgaccacccacgtgtcaggggaccttctgtgaggccaaggtgtctgagctttgtggtatcattgcagtaaaaactggaaacattctgaaatactatcagtgggatgaaggttaaataagtgaagattatttgcattatggaatactatgctgccattaaaaagtgccagggatctctctttaccctgaaacaaaaagaactccaagacatactgtgttctagaacaacatgtgtggtatggctccatttttgtgaaaacaaaaaactatatacatgtatagggatacaaaagcatagaaaaccctggatggacacaaatcttaacacaaagtgttaagagcgttgcccaaaagagacatgaattgggagagaagagcaggtatgtgagagaggaggctactttttcctccatgtctttttgtatgatatgacatattaacagaataacattttgacaagtaaaaaataaacaaaccaacccttcccaaagagcatgaactgttctgcgactggcctacctgtcccttttctcgatgattaaccctttcactcttttttcagtctgaaaaggctcaggcatacttgttggcttaactgcacttctctttcactcaggtattgccagcacaaaacgtgaacgaataaataaaggaacagggaatacagatcccaattgccctggagaccacagccggtgctgtcacagagggcttcggcaatccaaaaggaatagaggtgaaccaagtagcaagggggaatcaatatcttattcatgttaaacctgccctaacgccctccattctgtgattcgccccacagacaatcgatctgtttctcttctggtggaacatgggaactctaaaaaatttcatttatatctatattaatttttaagaagagaacttcactttctggtgcaatttcctttctctgtaaaacccatggattaatagcagagtttcagagcgcttggtgtttgactcagctctgcatgctaagtaaacattctctgaggaatagttcttgggtcaggacaaggataataa

SEQ ID NO: 52797 - DNA, 1607 bp, Bovine  19866880862371
tttttttacctctagttgttgttgaatatttattacatacctactttccttaaagattgaagcagtggaatctattttttcagattttaaaaataatacctgctgtattaacttttgctgaattatattgtgtaacaaaagaccccaatatttcactggcttataacagcaaaggtttatttttcactcttgctgcatgttacctgaagcttggcagtggctctgctcttgctccatgtatcttctgagatttctgagatccaggctggggagcaactcctatttgggccactctgttcttataacagggggaaaaaaagaaagagatttggcagaagtatgttctggctcttaaatctgctttggatgtttgtttatatgccattggccaaagccaaagtcagtggggcaagagatgtttactccagtaaaagtactgtgttacataggaacaagtagagatgatattccttttgacgaaaggtagactgaataattgcaaattttaataaaactgattagcccgtgctaactgaacataactgcagagacatatagcatttgtagtagaattctgccttctgccttccaagatcatcagtgatgatattttggtatatatccaggattgaagccttcttgttgtcctgactttatggtttctttgaaaataatagtcttgactaaattataaataagatctttgtctttttagccatttactcataataacagaagagccctcgatctggctacatttagttcttgctttgccaggtagttctagacttactataatgttcaatttacatttctaaatataaaatatctttaatacaagtttgggtctgatttgtggcttataatattatcactttttcactctgagagaaggtaaaattctgtattgtgggattttataaaggatatagttaagggagacagtgctagaaataataaaagtcaataaaaagttcttatgcagctgaattattttacctaatatgattgacattggggcgtaaagagggttaaccagactccctgttagaatgagaatacctgtgacgagggtttatttagtcctttatagatattttacattcagagcgattcttaagtggttcagatttttatgaaggggatctattagaagggaaaaatggaggcaattttgtataaattgagggagggcatgacttatttgtgagtttggacacagaagggttcttagaagaaggaggaggtgaaagaggcctgggaaaaaattgtgtaacttgtaatatgcctaggtgcaacttggcagagggtggcatgccaatgaaaatcaaatttataagacagcttggtgctgttggtatcatggaaggagtgactggaatgaagcacatctgagttcattttctgttcttattatgtaactgaaatgatgcgtgctttggacaacttaagtcttttttacaaaatagagataattgatttattgcctctaccatgttttaatttgtccctctgttccttgagctgtcacttcctcttttatccaatgtaaatttcatggtccttcattatctgtagcatgcattcacaactcctttcataaacag

SEQ ID NO: 52798 - DNA, 1992 bp, Bovine  19866880916449
ctgattgttttactacactctatactttggaggtgattttcttctatttatggtggaaatatgatatcatggagttactattcatctcttcccagttccatatctagtgagcactcacagagacaaatcagggcttgagttacttttttttgtttgtttatctatttattttatttttttggccacatggcacatgaaatcttagttccctgaccaggcatcaaacttgagtcccctgaattaaaagccagagtcgtaattactagatcaccaagggagtcccttgtttatctatatttaagaaagtaatgagaccctgatgataatgcgaagtagcgtgtgttgtgtctacagctgattgtgagcagcagcctcaagttgtctacaggtgtaaaagattggcaaaacgcatcagaagcattttgtgagaatcaattggctatatagaatctacaacaaagtatagtgcatatttaatttttttttgggaaattgtactgtacacttttttatcagtaaaacttacactaaacttttgtgtatacatatatatgcacatatgttggaagcctggttattaaacaccaacatactactgcatacacatgtttttattattttctgagaagaaggtgcaaatatattgccccattatcacttaatacttcagaatgaatttcctaaaaaataaggatgtggccatacacaactgcaataagtcgttaaaactagaaacttcacattaataatactgctatgtaacctactgatcttattcaagatttactaattgtcccagtaatgttcttttttgctcaggaaataatccagaatcatccattgcattaagttctcatgtcattttatatcctttaacctggaatagttttccattaaaaaaaaactttttttttttcctgctactctgacatcttcaaagagcacaggccaattatttcatagaatgttcttcatttttatttggtgttttctcatgcttccatttggattttgcatatctggtaggaaaaccacaggagtgagattatgtcctttttagtattttacattggcactctattagagaaggaaatggcaacccactccagtattcttgcctggaaaattccatggacacaagagcctggtgaggctacagtccacagggtcacaaaaagttggacatgactgagtgactaacttggcagtatatgatgatatataaataaatgagcatggctgtgttccaataaaattttatttaccaaaacgaagggatgaatgtggcccatggaccttcatttccacacttgacctaggcttcagtgtatagcatttgatagggtggattgaaactgaacgacttctgcgagatttaagatttaaggatacagagtaaaagctcattaactgtaactatctggggactacgtccaggccacttcatttaggttagaattgtagaatatatagagagaatttctacaagtgtatcaggttcaagtttcctaagttatttttagtatctgggagtcagtatttccaaggatgccctttcatatgaaaaaggccaccagaggaccatgtcctttcttcttagctatccccatacttgggtgtgcatcacactcattggtgaggtttccctgtgtgtgttcctgggctcttctgcttcagcagaatctcggggatgggttgagttctagttttaaagcattttccaggtgttccagatgaacgactagcacaaagtgaagaattgagattcttagggacttatcttaatgaaaagatgagaataatctctaattactgcattgattttatgtaaacagattcttgtaaagggtttgcaatattttaaaagttaataagtagttaaattactctttcctaagcctgctctctaaacttgattgccactgctgagcttcttatcaaactattttttcatgcatagtgaaaaacaaagttcagaacagcctctgctgg

SEQ ID NO: 52799 - DNA, 1900 bp, Bovine  19866880998028
cacattatctttgtaggatgtattcttacaagtgcaatttatcctatggggataagattctttaaatttttcatagctcttttgggattatataattgcatttagattgaacttccaggagtgaacgccctccctgaatctgatggtttgtttgggggcttggtgagcatggagggactgtagtggagatgcgggtctgtttccatctttgcaatggaaacgatgccttctcccctactggctgccttggacatcactgccctgaaattcagccagcatctgggtctggggcattgagcttgattgtcctctggcctgtcctggccttacccaggtgccagctgctgaggtctcttgtgagctgtggcctcccctgctccccacgcgtgttcatgctcagttgtgtccaactctttgcaaccctgtggactgtagcccaccagtttcctctgcctatgggattctccaggcaagaatactggagtgggttgccatgccctcctccagggaatcttcctgacccagggatcgaacccgcatctcttacgtctctttcgcctgcattggcaggtagattctttaccactagtgccacttgggaagccctgtcctaattaagtgtgccacctccccccgacacccccagaatttctgtcgattccaccaccgtggcctaattgagcgctgaaagccctgagtgtgtcagctcctgctttatccccagagtgtcattaacacatgtttctaagcttctgggatgggtgagccaatttgaagatcaagcaagaaagaagagaaattagattaaatctttgctcaaaacttggaactaaacccagggcaagacctactagaaagtgccagggagaggctatgtctgacaccctggtgtgctgatgctactaatctctgctccctgtcagctgctcagctgcttgctgaaagggcatagagacctttcttattagagttttcattaaagaaactcctagaagacttcgaggaaatggtgaaatgacaggcagtggggctggggacccctcctgaactcatttatttccctcactcttttgttgtgaggattggagaagatcatgtagagtatttggcatgtagacattcagtaaataatagcagctggaagtagctaatatttattgcaggcctgtgcaccaggcactggttaggtattttacatatggtaagtgattttatccccatgacaacactggtactttttcctcagttttacagatgagggaaattggatgttgctgttttctcaggtttactgatgaggaaaatgaggcacaacaatataaagcaattggcccaaggtcacacagatagtcagggcaaggaaaggggttcaaggctaggcatccatctccagagccagggctggttctcacgaaacaatgtttcctagtgaagtgcaggctgcctttgaattctacagtagacactgcaatgcctcctcaacatccattttctcctgtttcttccttactgaaccccaatatttttgcagagtcatgaaagcccaagtgaaaataaaacaccacccagattccctagcaggcaggggggacatgtaacaccgtcctggccactgagatgtaagccagtgggacaggttcagttggcagtcccctccccccatttgctgcctgatcacaattgtgatgcctggaagcatctagaagccgtcttgtgagcaaaaggatgaaagccacatgccaagaagaaagacagggggatcctgggatgtcaacagcattgagaaaccagccagcagtcctggagtgctcgcatctgatccttcagggaaaatcatcccctttgtagtgaagccactctatgtctggtttctggtggctgcagtcagaagcaatcatag

SEQ ID NO: 52800 - DNA, 750 bp, Bovine  19866881056825
ctgtgtctgactctttgctaccctatggactgtagcctaccggctcctctgtccatgggattttccaggcaagagtactggagtgggttgccatttccttctccagaggatctttctgacccagggattgaacctgggtctcccacattgtaggcagatgctttaccatctgagccaccagggaagtccttcctgccattatcaaattcatttttcccatttttttatacctaggaatatctctttttctattcaggaagtcattctctcagcttgctagagagatacttcatgatttttttccctgaacatggaacccagaagaaaggcttggacttgtagttctcagctgtctttcaattttctttttttttattggtagatattagtatgtcctgaccgacagcaaaagcttgagaaaagttattgtgtgggaaaaaaagggagcctctgttagcatataaggcagcagcagtcacatcctggacgaacttacttgtaacttgaacaggatcctcagataagtagcaacaaaagatcatcacaattttttagagagggttggaaggtaactctgcaagttagaaacagtggcaaaggagcatgagaagaccatatacaccagggctggccactcattcgtcacctgccatcttacatggtcattatctttctcagtcactgaaatgcatagaaggcaatgaggcagaagagcagtggctcaggagtcacagcctagcaacagcattt

SEQ ID NO: 52801 - DNA, 1286 bp, Bovine  19866881085564
ctgggggaaaaggagcagtcataaaaagaaatgaggccatggacccgcccgaggtcaaagagagtcagcacatgctgtggccttttttggatagatgacctataccacaggccaggatagctgcttagcctcaaatgctctctgacccagtactgggggcttccttctaaatcacctgacagaaatgaccatgaactgaaaggtccaagccaacatctgggagctcaaaagggctatgaccacttaggggctgggacaaatattcagagccatagtctccccagtgaggggaagcaagagcagtgggcaatgcagtggaacagagacgatggcagtgagtcatgtgactcatctagggtgaggctgcccaccccccaacaagctgggtcactagccttctgacaaggaggcaatcagcgcaggtcccagactttcatcctgtaacttgttctttagagaagagacttctgccaagtggcctagcctcgagcaagttggccaactttattcagggttttggctagcccttcccagcactgggaggaaatgggagagactgaagaatgtggattaagcacctccagctgctgacatgttgctgacagtggcagataagatgggatgagtggcatgtgctgaatgcaagctctaatagcactcgactcgactgcattcagcaagctggagttcggggtacttgaaattatttatttagatccatcagccctgtttgggaagcctgattagtgtcagcagacgcctgtgagtagcccagggaaccacagagtaaatgtgtcagggctcacagttgcctagcccacgcgctgccgcccctgctccaggcagttctgaatgcacttcctcctcttcctcctgactgtggaagagtgaaaggggactgtcatagtgatccaggcaactctcgaacaatccaaaggccaggtttgttattaattcctgaacttcccaaaggagggaaatacataattctttatgaacatctaaaatggaggctggagggacttacctggtggtccagcgtttaagattttgccttccagtgcaaggagtgtgggtttgatccctggttggggagctaagatcctacatgtctctctgctgaaaaactagaacataaacaacagaaacaatattataataaattcaataaagactttaaaaatggtccacattgatttaaaataaaatggaggtcagagcaaagaacagcagcactctgacacagcagagcctcggtgagtagggaaagcaatcatgatgctggg

SEQ ID NO: 52802 - DNA, 735 bp, Bovine  19866881086438
aaaaaataattggtgaggaactggagaaagattggcatgaatgttaaaatgtggggctgctatgcccttttcagttgtgtccaactctttgtgacccatagactgtagctcacgtgggattttcccagcaagaatactggcatgggttgccacttcctcctccaggggatcttcctgactcaaagattgaacctgcatctcctgcatttgcaggcagattccttaccaccaagccacttagaaagccctaaaatggggaaagtggttattaaagatgtcagaatctataaaggaaataattgatgagccaggagaaatcacagaattgaacaatgcagaaatatgcaagagtagacatgaacaagacgttagacaatcaaagatgtgacaggctctgcctgctaaagccatgttgaagagagtgttccagtggggaagaacaactgggaaacagatcttacaactcacaggaggtcagcaaagttgtttaaagatgtgctatgtcagtagtcataaaaattgcactaaattacacaacatataattaaagctaaacattcagaatattaaggctctgtcacccttagacagatggtagttgattctgattataccttgggcactgaggacctaattagttttttcaagaagatgtacaggtgtcagtcaattctgggagtcagtgctgagcaggacagtttaatggagacactctaatacttgaaattgatgagg

SEQ ID NO: 52803 - DNA, 1049 bp, Bovine  19866881117732
cctgcctggaaaatcccatggacggaggagcctggtaggctgcagtccatggcgtcactaagagtcggacgcaacttcactttcacttttcactttcatgcattggagaaggaaatggcaacccactccagtgttcttgcatggagaatcacagggacgagtgggctgccgtctctggggtcgcacagagtcggacacgactgaagcgacttatcagcagtagcagcagctgtaaagttccaactaaaggaaacttgctctctcattttcctatggctaattgttctctaaacttcactccaaaaccatctttagtctagggcaaattttctccccattaaagatagacagtcaggaagcatgtatttgtctcagagcccagttatacctatgccccctagggatcactttagtacatcgtgggtggaaatggcaaagggcttcaagcttaataatcatgttaaatagtggcattaaacagtcaaagagaaaaatcccaggaccccaggcccacagatctctaagggatgaagggcccacttgggctgcctggcaggtagggctacgcagcctggattggcctcttctctcccgaactgctcttgcctcaggcttcccagcaaatattcactgcgggctggatgctaatgcatataacatccctggtgagcatgttatcagcgctccttctggtgagcacttagcagccactggagcagaaatccaggtacaaacaactgacaggcagcaaaataacaggaatcagccctctctgcttgttctaagctctctctcgaggtatcagggttgttgcatcacacagcagagggaacgcaggcttctaaattaaatgagacctaggttttaagtcttccgatcgtggacaagttgttttggtatctctcagttttctcctagatatagtaggatgataccatgtaactcctggagagttttgtcaaatcaacaggataccagatgtaagtgagtagtatagttactattcacaatatctattcccttccatagctcccctgccccccagttcc

SEQ ID NO: 52804 - DNA, 1100 bp, Bovine  19866881130900
taattgcattagaaagaaagatgagaatgtaatttggagacggaaagaaaaaagatttgaattcaaagggaaaaaaatgaactattcacaaacttaaagggggaattgggagaagccagtgacttcacagaggcacctggaagctaattcaactggcaaagtgcccctcccgaacccgtgtatttttatggaactccaggtttctagaagaaatgtttgtgaaatgctgcacccacagttaaaacagcaatggcagcagttgtgctgagtgaggccaaagcatctgataagaattagagacacctaagcaaagcaggtgagagcagcggagaataacctgctcctggatcagatgcaacgcttccaatattccattgctacaaatcccacctacagatctgaatgcaaatccagacaccttgacttactcaattgagcaaataacttctttgagccttggtttcttcatttataatagtattacctacctgagagggcaactgtgatcatcaaatgtggaaagcatttaaatgttctacctagcaaccagctctcaataaatcatggctagtaattataattattattgctacggttgtcaggaactatagcactatttgggtcaaggagagtaactttttgcttatcttgcagtttaaagacatattttcatctgttctctgcttcaacaatgcacaatcataacatcagtgtctctctttttgtccactgacatttccctaaaccggccaacaatgtggaagtgtctgctctttaaggttcacgatttctgtgtcagctatgagtctgctatccaagagacaagcctctgcttttaaatttgagggggtggggaataaaaggtaagagatgaagccctttatactgtcttatgtcttttgaagtttgctgtctgaagttgctttagctctttgcctctctctctccaaggacacacaagaaacacatgggatattctagtctggcttaataataaagaccttttgtgaggccagatacaaagcactgctactcctgaatgtgacgtttgtgctgcgtgttcaatgcctgtcctgttaaacatacctttgagcaccagt

SEQ ID NO: 52805 - DNA, 1494 bp, Bovine  19866881140849
tcttctcagttggaaaatgagggtaataataacaccagaaggttgttatgttatgtatctggcacatagtaagccctcaataaatatttgttcttactatttttattattatctttattataaaacgatatatctgtcctttgaggcagcacagtatagtggtaacgagaatggactgggaacatttaggctgcatctgccattcactgctgtgtgatcttgggcaagttaataatctttctgaccctcacttcccttatctgtaatataaggatgatgagggcatctacctcatagagttgttgtgaggattaaatgagacgataaatgtgaaatgctttgatgagaatctggcacaaaatgcttatacatttgttgttattattgttataattattattgcactaattttaatttttaggttgtacactgtttgggagtgaggggattctatagaaaagttgttacttttccacattagtgactttgttaagataacagaacaggctctgaagatacagtcctgtatttagttgggtgacatgtgaggtggcctgcaagcccgcgaagccgaggaccgaggaccgtggagagcctctgaaatggctcatctgaattaaatgggatgactttctcctccagattctgtgtgggaggcttatacatttgctttggtaatgagtttgctttttcagccaaagaagaggagagaataataggagagagaaggcgtgagaggcaatcatagaaacctggaggctcagatcctccaaaatggaaaaggagcctgcatttctgcagaaacaagagagaaacaatgaacaacctcaaagctcattatgatttaagtttgcgatagcagcaaatgatagccatgtgactactgaagcctgtttgaactgtaagcaggacaaagggggaaatgaagtgtattagcaggagtgtaaaagataacctcctcgcttacaggctgtgcagatgttagtgcacggatatgctgttaaaagctatgaaatctctctaaagtgatcatttccctttctatggcaaatgatcgaaaaatctttgttgtgtatttacttgaacaaaattcttagagccttttaagatgcttgctctctgttgtgaaaagaatgcaaactcaagagtgacggggttaacaggccagaagccatgatgaattggagggcacattgccttgcattgctcaaaagagtaaagtaggaattcatttaatatttttttcctgaaaagaagcatttctctttgtgttgtagaaggttgaggaatctgattgcccaacagcgtcagtttctttgcttctccccatgtctggtattatcagacatgattatcattaggatcatctttctttgacttttcccatctgagaagagcaaattatcttcagcatcgtattgtgagatggaagttagaatggaatagctagacattagtgtttgtctagattaatggcataaatggaaatttaat

SEQ ID NO: 52806 - DNA, 860 bp, Bovine  19866881150651
gctgcttattctaaatgactaaatttctgacatgcataaggccaagcacctaactagcatttccacccatttcggaggagaaagagagtgaaaacagcactaaaacaaaggttggaaagattttaattaacacaaatggctgtgcctagtctttaaatctatccaaagcaaatggagtgaaagccttctaatccttcagcacttcatctggccttgacctcagaaaaaagagcctccctcttgcatcatcaaactgacttcctttagctctttgttgttctgtggaggtctttgatcccagaattctctaagacaggaaaaaacagaagaaaaaaaaaagacagctaaaaccccaagtttcctggcactcactttgcaaatcccatgcaaatattaaattaaaatgtacattaacaaatgcattccaaaattctatacctactgtctattcaagcctttaaaatgactcgaaaaccaaagtaattctcacctcattagattcatttttgcaggtagttgctctgctcatagttgtagtgtccaaggtacctgatggggaaaattaggaaaatgagagctttctttgagtaaaaaaaccctagttttatttttagttgcaagtctgttagcattcagcccagtatcatatcattgtaggactgactctggtattaacgttgatacggattttttaattgatgttttataaaataacttcatcaagcaatatttttaaagtagaagtggcaaatctttttttttttttctcttgaaagctcacgttccacagggaaaaaaatcatttgaggattacatcaaataaaaacaattttattttgagagcctaaaaaggatacttc

SEQ ID NO: 52807 - DNA, 1109 bp, Bovine  19866881161403
aaattcttagcactttgtcaatcacgcatgcttgcttgctaagtcacttccattgtgtctgactctttgcaaccctatgaagccctctttgaacccgtccaggctcctctgtccatgggattctccaggcaagaatactggagtggcttgccatgccttcctccaggagatcttcctgatccagggattgaacccaaggttcttacatctcctgcattggcaggcaaattctttaccaccagcacctcctggaaagccctgtcagtcacacagtaagccctaataagttactactactattttactaccagaaggtggtagtttgggtaatttcagcaaatcatttaactctctatgctttattctcttcatctttaaaatgaatgggtagccatatggtcttgccacccagaattggaaagaaaaactaattagaaaaacgtttttaggtcttagctgttctaactgtgaaacactatcaacttctgctgttcatcttctgtatctaaaaactgataaggaaatctactctgcatatttttatgtatgtattaatttagttggaattccaaggccaatttaaactttcaatttggtgtatttatatttctattgtagttgttgaaagagaaatttcaatatttaaaatttattctcctcaatataactctgagttttcatgagtggttttgtttttttactgagaggggaaagttatcttaatataatgtctccattgttggccaagcctaaagaaatactagtagcctgccatactcttcctcttacataccagttaggtaagaaaagaaaatacatttcagaatgtgtaaaatacaaaggagattcaaatactagtcccataggtccttactattagatcccacttagagtggcaaggaactagaccagttaatgcagctgttgtgtaagagaagttcaacgtaactgaactctcagttattgaaccttaagcaggcattgtgttaggtgatagagaggcaaatgaatttaaaacaaaattattgccctcctagaatttacagtctgataagaaatgacaacacagcgtgataaatactataaaagtgacacgggactatcaagga

SEQ ID NO: 52808 - DNA, 1502 bp, Bovine  19866881213576
atcgcgtccaactctttgccatcccatggactataaccctccaggctactctgtccctgggatttcccgtgtttttcactttctaaaactgtgaaatctttctagtgctttgaaatttacataaactctatctggctagtatcactgtggaactgagcagggaccccatgggaaacttcccagaacacacacctccccttccacccacaccatgccccccacttgcctcttgtttgtagaaaaactactctcccaggactcccctgtgtcacaaatgattagaagaatgtgaacatgtagtagcaaaagttagcatctgggccaagagaactggtaacatttgaacaatagatcagtcatatagtagaggcacagactcttttgttcctctctgtaagacataaaaaactgtgtcaggagcatgttgttgagttgttttgcaaatattgaaacctccaccagatggagaagtaactgaataatgaccacatactcatagcccctagaccaactggatcctgattgttggtgatgttaacccctaagacatcaccatcaaccagtcagagattcctgcccaaggtgagcacacaacctgcagctttccccctcacattgcctttaaaaacgtttctgaaatccatccaggagtctgggtcttctgagcattagtcagccatgctccttgcttgaccttgaaataaccactgcactgtttttcactaccaccccatgatgtcaggagcttggctttaccccagaagtgggtgggcagacctatttggttcagcgacatttggagcactactatcagggactggtggtatagagggagagatatagttaatccttattatctataagttgtgtatttacaattttgcctacttgctaaaattgatatgtaacctccaaacccatattttgagcactttcagatatgttcagggcggttaaaaaaaaaaaaaaaaaaaagagttggtaaaatccaccttcccagctgatgtggaacaagggtacttgctggtttctagtttcaactctcatattttgaagaagtgtccttttgaggtctatttagtgctgcattttatgcatcttttgtttgtgtcattgatttatctgtttaaaattacccccaagcatagtattaaagtgctgtctaattttcctaagtgcaagaagactgtgatgtgccttcttgagaaaatatgtgtgttagataagctttattttggcatgaggtatgtggctcttggccctgagttcaatgttaatgagtcagcaatatatattaaatgaagtgtctttaaacagaaatatgcataaaacaaggttatacacaaggttgatgaaaatgttgtgacagagtctcacagcaacttaaatctgctttttccctagaagcaatgagcagtatttgctaaatagtaacttcataagtgacacagacagtaacgaaactgcctgcaatgcaacagacttaggtttgatccctgagt

SEQ ID NO: 52809 - DNA, 1149 bp, Bovine  19866881228892
tgtcctcttctgaatttagttttgtggtcggcaggctccctttgtgtttgcaagagggtcaacagcagcgaccagggtgacatgctttctccttcatgtctgatgaaggagagagcaaaacctctgccccaagagttgaatgaatgcacttcccttccatctgtttggaccctcttagaatacgtgcccacccatgaaccaaaagccagggtgaaatgccatgatggattggcctagcatgtggtggactcagtgtcaggaaggatttaatcgtataacctctgggcactttccagcccatacctagccctcagtaaaagttatttttcctaataatgaagagagtattattggggtcaattgcacttatacaccagactgtgtgtcaaatgtcctctctaacgtttatcttcagcccttcctttggcccaggggcacaatctctcttcccatcagaatggatgacaaggcagtacacgtgctgggatggtagtcctgggcttgtttggtacatgagaatcagctccatggttatgcggaggcagaaattaggacatgtgaccaggaaaggaatgtggagtgtgggctgggaaagagtaggaattgggaatcgggagcagaaacttcaaagtgctatcgattttacttttgctcttttctgtccttggtactgtttctaccttcacaaagactcattgcgacaagaagtgtggggagaggctgttacagcaattagagggacatttgaaacaactcatccatccaggcatccttagaaccccattccatctttatgtatttggcaactatcgaggaaagaccagaagtgaggctttcacacctatttagcacctggttaagcatcacttggcacctgccaaatgggtctctagtatttagggggaatttgcactgattactgtactaattaagcagaagtcattgctactcacaatcattaggctaaatcggtttctgggggaaagtcttgataagcagctgcccaactgaaatgggttcgaaggctccccgtgtacacaggcttgtgcactggcagctgttcacacgttgtcagcaccagcaggattcttctgagcaggttcttgatgaggctgaacgcagggaggtggggtctcaaaactagggaca

SEQ ID NO: 52810 - DNA, 972 bp, Bovine  19866881235487
gagtatgatggttatctaccttattttagttctcgtttaaagaaataaattcaatattgtttcttgatttgagattctactcaaaacttggctgctatgtgtctcattgtattctctgacctgacacctaaaagaaggttactgctcaggaccagctgataggaatgcttataaggaacagtttaaaaagtgcagcactgtgtaaatgctaaacaccaatgagaatgatacagtgtgggagggaaggtgtgttttcctttgccaaacgaagctgtgtacagttcgacctccaagaaagtcattttgttttgtgggtgtatgagcaagtgtgcaatacatttgaaccatcagaaaatatagatttttatcattttcagcttgaatttttatctcagcaacttgaagagtctttagatatcaagtcagtgacatatttaaatttgtcaaatgaagggcatttttgtgcaccaaatttttccttctatagctgagcttggatacatagatagatggaaacacagactttttctcatcattaaccaactttaaaggcaacccagtttaataggctgtagctgagtgctcccagctccatcagccgctctctgcttgaacgcaggcaaaagtaattcactctcagtgggaaacagaaagggcatgtactattttcctaagaaaccaaagtaaaagctgtgtgtctgacaggcagtgacattcccctcccacccccagtggctgctgggtagcaggtctgttgagagcatttcccattgttgtcactgaagtgtgtggatttatctcctggaggcactactccttgaacagtcttcctgttgtgactgccctccctgtaagatatcatcataattttgcattcagttgttacttcctggaagagagtcagagaccataagaaagagagagcaacttgtagccataccccaaatatgaaggacataaggatccaatcct

SEQ ID NO: 52811 - DNA, 837 bp, Bovine  19866881286043
actttttccttaatcatggctttctttcccccagtttttactagaataactctcttattctgccaagtaaatatcctgtatgcctaaaaatgtattttaccttcctacttgattgacagtttggcagatacagaattctagatcagactaaatccagttcaaaataattttccctaagaattttgtggcattgctctatgaacttctatcagccaatgttgctgatgccaactgatatttgttacaatgcagtcttcttgatttgctggtttgtttcactctgaaagcttttagggtcttcactttatcctgacctttctgagtatgattagatgactcttacgtgctgatctttttttttttcccacactgttcaacatttgaagagccttgtcagattgaagacttgtacctttcatcaactgttgttagttccctcacaattaaaacaaaagcaaacctatattgtatagtctaaattctgtagctaccattaggcatacgttgcacctatattgattattctttcatgttcttttttttctcatgttgtccaactatccttttgctttatagcatggaagttggctttgactttactatcaaaatctgctattgattttaaatttttaacataattttttattacacaagttaattctttgacaattcatttattacatcattctgttcttctcttgaatacaatgtcttctcagttttctgtgaggacatactcagattttctttttttagttatcttttgtttgctggggtttccctggtcgctcagatgataaagaatctgcctgcaatacagaagactcaggttcaatc

SEQ ID NO: 52812 - DNA, 794 bp, Bovine  19866881291187
tccccctgctttgtggttcccattgtcaggaatacaagaaagttctttctgatctggatctctgcttacctctccagctatacatcttaacataacttttcttgaaccagaagaagccgtaaagagctacttgcagttactcaaagacatcctattttctgtatctttgcagcttttgtatctctaactccacctgtctggaacagctctcaacacagccttgtcctggcaagttgggtaggaagcattctcatttcccccacatgcactaacacatcacccctgcctcctctacactcatcccagccccttgcactccaaggcctcttttctggtgtatcatccatattgaagggccttgaagaaggggttgtgtcttgttcaacattatccccggaacctgccacatttgggaacacagtgggtgctctatgaatgtttattgactgagtgactgagaaaataagtaaataaattaagatgcacatgaatcatagatctgagagcttcttcatcttgtggagtgaagaccttttagttcctcacagatttcctcctctcgcctatcatctacaaatgggttttctgtccttatgttattggtactatctttaggtcctataaaaatatctccaatttcctttactagctgtcttagagcaataagcttctcaagcttcccctgtctctaatgactgccatatggggacatgatacgctaatgctggtttcaagtgagctggagttatcattaaaacaaactgaacttcctccagctcacctcccatttttaa

SEQ ID NO: 52813 - DNA, 863 bp, Bovine  19866881296913
agaagcttaattatggttaaaaatctaacttatgtttcctccttcagtagtcatttattatctgtctttttaaactactatatgggaaacctgagcacaaaatggttgtttttctcctccatagttattggggtgggtaatgggcaattactggtggcactcggctgctaatggcaaaaatagtccatatttttaatacactgttgctggttttgagaatatttttttctcctaatttcaggttgggtgggactatatcagcatacaagatagtaccagatgaaatagaagaaatcaaggtatagtatggcatttttcacctctacaaaaacttagtatcttggagggaaggtgggcaacaaattgtcttttctttatactattgaatctttacttgtgttgggatatcatttaactcccagttattctgtttgaattaaaatatgcatatcagataatcatcatcagatttcatctaccatcatcaatacatggtaggaaaatcaaaaaaggaaccctttcttgtaaaactcattgaaaatttacttaagaaagcactgtatataagcattattgtgcataaagtatttctttatcattttaatttctttttcttactgtctctcaccagttgtaaataatattagtcttctaataaatttttctggctcctttgataacacagtaggccaatttcaatttaaaattaacagtacaataactgaaaaattgaccttactctttgaatattacagcatagtcacatttttctgtctttacatcttactaaattctgtggattattaatattcttgcataacgtgtggcctttctctaaaaagcagtttaaaatctaatgagaa

SEQ ID NO: 52814 - DNA, 508 bp, Bovine  19866881303786
gcaagaatactggagtgagttgccattcccttctccaggggaatcttcccaacccagggatcaaacctgcatctcctgcattggcaggaagattgttcactgttgagccaccagggaagaccactcatgaccttgctactgcttaaaaaagactcaactgtatttcaccaaggaaattttatgcaagccaaagcccttctcgttggcctatgggtacctgcggcctgtctgtgcaccaagctttttccataaggaattggttcccaagaactgcatctaaaaaataacttgctattgattatcttcctgtgttagagaagagccaaaagacatcaaaatcttatgaccaagagacataaaatgagcagatgctctttgctctgggtcattactttcttcagcctgcttaaggattctgtaaattaccaaaaataagtgatgcaaagacaaagtaaggttggggagtaaagctaaccataaaagggctactctacccagcacacccctg

SEQ ID NO: 52815 - DNA, 1099 bp, Bovine  19866881341416
ccctaaaattgattctgtgaaataggcttttaaaaaatgtcctcttcaaggagaaaatataaacaggggagggtttctagctcagaaaacacaggcctatttggagacccagtttgtttcacttgaccgcacaggaggtaataatgcccgttggcacagtgcagtctaaatctgtttccatccacattaatggaccagagctctcaaagattcttagaaacaatgacacaagcttcagttttgaatgacttggggagtgactcggctatgacatgtgcacaactcatgtgtctatggtggtgatggtgtgttagacaagcactgtaacacgaatttcttttttcatcttgtgtcatggttcctccagacttccctgatggctcagacagtaaagcgtctgcctacaatgtgggagacccaggttcagtccctgggttgggaagatctcctggagaaggaaatggcaatccactccagtatttttcctggaaaatcccatggatggaggagcctggtgggctacagtccatggggtcgcaaagagtcagacatgactgaacaacttcactcactcactctcctccaaactactaaaccagaatatcacaattcttttctttggctgtgctgcaagacatgtgggaccttcgttcccctgataagggatcgaacaggcatcccctgcagtggaagccatggaagcgcagagttttaaccattggaccgccagggaagtccctggggtatcacaattctgcatctaaaaactttcctatgactgtatgaaatctgtggattacaccaatttagacacacacacatatacattttaaattatccaagccttctattcactatcttcttggcaacccactccagtattcttgcctgggtaatgcatggacagaggagcctggtaggctacagtccatagggttgcaagagtcggactcaacttagcaactaaacctacctacctacctatgactgtaaacagtaaacagccccaggcagagcacttctctgcaacaggactcgtttgggggtcttgttggggaaaacatctatttctgctttattgactatgccaaagcctttg

SEQ ID NO: 52816 - DNA, 1185 bp, Bovine  19866881419799
ttgttgaagaagatttagggagggtagtcagtcttttgcaatgttatcctaaaagaagtttttgcagcatttggatcttcagaatttattattcaaaatatataatcacctatgaggtcaagaaccttgtctgataccatgtttatactgtccaagcacctagctagtgaaagatacatattcattccttaaaaatcctctgaaatgatttctccaactttgaggttttcttgctatcactgattgcttttcctgtctttccctgaaatatattaattactccctggcccatggattcccctcctcaacccctccagctcctggcagctttgttctctttgctcatctatttctgggccattccgttgcctactagagttagcctgtaataccatgcttgccagcaggggctgccatttgccataggatttgctaattttcaacattccctaaatctgagactccagattgtgtaaaatagtacagtgcctaatttatcaacttggcaggtttgaaatgctataaaatcagttacttaaaatgagtcaactcgtaatgtgctgcacagttttaatgagcagagttccactgctccattaagacaacaggagaccacattgagaaaacaagcagcaagattgtgaggttaagagaatagcaggaaaacctgcttcttgcccacaagatcccagtggggacaatatgttcaaccaacaaatgactttctccttggcaagtaaaaaagactcatctttcatatctgtccttcctctccatttgcatacaagatcagccctttattacctcctataaaaattactccagttgtcttaagtctttgttccctgcccctaggctctgcccactccaaaccatcctgtgcatttgtataataattttcctaaagtgatgcttgcttaaaaaccttcagtgatacccacaaccaagacagccctcttcaacaggatactccaggcccttataatccagtatcaggttacgttccaactttactttctattattcccagattctccactttgacaaggcaggggattttgttcttcaccacagattaagctcattgttgtcttaggagctttgtgctcataatctacacacctgaagtgcctgccttcttctcttaactccttagtcaatgctattgctagagtaatttcccag

SEQ ID NO: 52817 - DNA, 1204 bp, Bovine  19866881483480
tgaatctaggagcagaatcttagcctgtttagtgtggactttgcaccttcccacggagaaggcgatggcaccccactccagtactcttgcctggaaaatcccatggacgaaggagcctggtaggctgctgtccatggtgttgcaaagagtcggacatgactgagcgacttcactttcatgcattggagaaggaaatggcaacccactccagtgttcttgcctggagaatcccagggacgggggagcctggtgggttgccatctatggggtcacacagagtcggacatgactgaagtgacttagcagcagcatggtcaccaaagagtggaccatatagtggtcaggtgaaaagaaacactgggcacactggcagggaaggcctctaggaaagatttattattcattccacaaacctctacttagtgcacgccgctgccttcagccacagaacagatggcccgaggcaacaactcatgaggactcttccaaactggaggattccctgctccctgcaaatgacaaatcggtggcttctatacacacccatctgccgtgatctggagcccaaatattccctctgaatcaccagcttggggagcaaatcactaccaatttttctttctgtcaacaggagctgctgaataattatgcccaattgacacaggcagctccaattgccttcagaatttggcctgaagcccaattatatttctctaacttgtgccacagcacacgaacagtacaatttgtctcacttctttctcttcctttttagaatactcaaaaaaatttttggctcagtgaaaccaaccaagcatgttcttcaagaataattttaagcatgatctgtaagccaagttaatatgatatatactctgggagaaattcagttgaaagcacctagatatattatttttaaattatatgcacataagtatagtatactgtacacaaataattttaaaatgctgttgctaggttgagtacaaatcagccttgtaaatatgcacacacacacacacacacacacacggtcccaaattcaccaatgagctgtttcataaaaactatttcctaagctggttgttggaaatttagactgtatgtttacagaaataatgtcagaaatggtgggcaacttcccagagttatctccaaaaacctttctcctagaattcagagaactacgtaggacgatcaggtt

SEQ ID NO: 52818 - DNA, 747 bp, Bovine  19866881647514
tgtttttaaaatagtcttttaaaatagattcccatttttatcaactatctccattctttcataaacttctaaagattcttttctttcatgaaaatattgacaattgctgttttaaagtctttgtctgcttatttcactatctgcatctgtgaccttgcttctattttcttgtttttgtcttgattataggccatattttcttgtctcctcacataagttgttaaggaaggaaaaaaataaacaatgaaaatagagatgaaaaggatggttattttaatagcagttcaaattttttttattatacactgaatattatattttgattctataaatttgaagagaatatatacctttttccaactgttaggccagttgagtgaggtattgacatttcaatttaattaagaattgagctgggtttaattagggtcagtcttgattgtagttctagtaatattttagtaagatttaatcatttctcatttgttatccttgcgctactagatttttgactgagagactgtcaggcttcttctccacagtcctgaaagactacagaagtttcagttctgttctttggtggttttgagattggccctttgatctcttgcttcacactgcttcagattcaggcagtgttggagacctgccacgtgtttgcttatgtgagtctcctttttctagcaggttttctcccaactaccatgaaactaagggaaatttatctctgcaattcagtgtccttca

SEQ ID NO: 52819 - DNA, 1176 bp, Bovine  19866881675142
atcccagaatgcagtcaagcccatctgtttcctctcctatattaacttatttgttgcagtaaaactccagacagtcctcagagagatgcagttataggaaagaaaactgattatgagggaaagattttagggtcattgagatttattcccccgatatgcaaagtctgtgtaatgtgtgcagtagcctgagatcaccttggcataaagcgtggctcatgttggagtagctaattttgcagcctgcacatgtggggaatagtaaggaagggattcccatcacagaaggtttaacaatcaggagcttaagatattgcgatggaaatgaggccggttgtgcagcattttaactgagcattactctggagcttgtctccaagtattaaggctctcaaaaaatattgatttggatccaaatgaaaagaaggatttaacatttgccttgttttctgtgaaagtcaagataaatttacaccagcaaacttgaacctgagttagactgtgtgtgtgtgtgtgtgtgtgtgtgtgtgtgtgtatgagagagagagagagagagagatttagttgatgaagaaatctgacagtagaaggtaaataatgatagataattattgatttactccacattagttatattaatttatggtaattcttcattttacttgcaggattaaggggacaggggttttcatttctatttccttctatctgagaggtggtgttaggtggcctagtccccgtagagtggcaattcaaatgttataatagcctgcttcccagcacatagtttgtgggcagagttgctcccccgccactcctgtctcctagagagcctccagacccagcaggtgaccactgatggatggtccccacccagctctttattgaagtctcacattgtacacagaataggtgagatagctgatgcctcagtcagggtggacagctaacaggtcaatagaaactcaacctgaaattgctgtcacagcagcttgttacaacttttggctttgatgtacagctacaatactttgtaattcagcaaatgagatgcttcaggactgctctgttgggtgtagctgtaaccagacgtcaggtgatctggagcccagttccagcaagagcttgtgaccttgggggatttctcaatgcttctagactatttcttcatcgccagaa

SEQ ID NO: 52820 - DNA, 1025 bp, Bovine  19866881705373
tgaattgaatgcctgatgttcctgaggcagaggttggcaggccctacgctggggatgttgtaaatagagcgtccattggaatgtgctcatctttgactttcttcaccttccaagttccataattttatgcaaccaagaactagatgctatgagagttaaatagagggacaggtgacttcagttgtagaaatccaagttggggtaaataggttgtagcccaggaatgttaaaagccccacaaaggaaacagttggagtgtgggtttagcaaactgtcttcaaaagagagttgagagctttttagccatgatctcaaaactgggtcaagctagcacttgtgaaatattgtattattccgaggcacagagaaaccctggtaacgttccaaggtcatcaccttggaaggcaggatttacccccaggcagtatggttccggagtcatgtgagaaaaggctagaaaagtcagtgcaggatctgctcaaggagggaggcacttgaaaatcaaacaaaggggcttgggctttctttgtcaggtgaccacaacctcagtgatggagggacacagtaggacaagaacaagtttatagaaggatacacagtgggagggaaggggccttagtggttgagaagctgtcatccttgctaaactgtttataatcttttatctccacataaatctttttaacctctttctttgggtgatcccttcttccactaagatatgcatggtgtgtatgggtcctttggggagaggctgtggcaatgtggatgcaacttttgtagacaaaggctaagggatctttactaatttgtcagtaccccatattttaaatttctctttagaacatcttgagcacagacatgttattggagtcttggagctctcccattttcttttgtgatccccactgttttttaacataaattcgatttattcaatagatgactgggcttccctggggctcagtggtaaagaaatcacctaccaagaaggagatggggttggtcccgggtcaggaagatcc

SEQ ID NO: 52821 - DNA, 877 bp, Bovine  19866881822703
cctacaaatatctgtatagtcaaagctatagtttttctagtaatcatgtatggatgtgagagttggatcataaagaaagctgagcgtcaaagaattgatgcttttgaactgtgatgttggagaagactcttgagagtcccttggacttcaaaggagatccaaccagtccatcctaaaggaaatcagtcctgaatattcattggatgctgaagctgaagctccaatactttggccacctgatgcaaagaagtgactcatctgaaaagaccctgatgctgggaaagattgaaggcaggaggataaggggatgacagaggatgagatggttggatggcatcactgattcagtggacatgagtttgagccaactccaggaagtggtgaaggacagggaagcctggcatactgcagtccatggggtctcaaaaatcagacacaactgaacaacaaaaatatactctccaggtcatctgattctgtggggtctctgcatttttcagtgtggttgaactattttacaactctgtaaagtcgatggaactgtcagcaagacacttgattcttgtccataaataggcaaattaattttgtctggcagaggtgcaactgatctcccacatttttgctctactaagcaaattcattttagtattcctgattgcttctacctgtttctgttctttgaattactcattgaattggttgtaatatcttacttgtgccctctttaattaatgagttaaataaaatcattggcatgtgttcattctaaaaaacaaacaaattattaaacttacaaattttctttgtaagataagtatcagttcagttcagttcagtcgctcagtcgtagtctgactctttgcaaccccataaa

SEQ ID NO: 52822 - DNA, 514 bp, Bovine  19866882112603
tctctaatctattgtctaagattggtgtttttcaactaaacgcagagcctctagcgaagaagcctgaagccacaaaaccctgggacagcgcgaggagcagaagcctgttctttctcaaggggctctgccgcaggctcctaagcttcgctagtgaggatccttctgtaggtacagccttggagttgggaaatcctccggcaggtcgagtcgactaaaaaagcaagcgggaagatgaggcacgataggatacctcctccctcgctcaccgcgggctgtcacagtaattggcggttgtgccactcacgcagctttctaaggcacctccaggctccctggagccctttctctttctccttcgggaaagcgggctcggtagccccaaaagcctgccggagtcgctgacaaacgaccaggagccgggctcggcaggggattgcttctgtctggggctcggcggaacctgcgttcgtgtctcgcgcgcactcgcttccgcgttctcctagccaatccggcg

SEQ ID NO: 52823 - DNA, 1643 bp, Bovine  19866880210239
cagatgacacccccttatagcagaaagtgaagaagaattaaagagcctcttgatgaaagtgaaggaggagagtgaaaaagttggcttaaagctcaacattcagaaaactaagatcatggcatctggtcccatcacttcatggcagatagatggggaaacagtggctgactttatttttttaggggctccaaaatcactgcagatggtgattgcagccacgaaattaaaagatgcttactccttggaaggaaagttatgaccaacctagatagcatattaaaaggcagagacaatactttgttaacaaagttctgtctagtcaagggtatggtttttccagtaatcatgaatggatgtgagagttggactataaaaaagctgagcgccaaagaattgatgcttttgaactgtggtgttggagaagactcttgagagtcccttggactgcaaggagatccaaccagtccatcctaaaggagatcagtcctgggtgttcattggaaggactgaggttgaagctgaaactccaaatactttggccacctcatgcaaagagctgactcattggaaaagaccctgatgctgggaaaggttgagggcaggaggagaggaggatgacagaggatgagatggttggatggcatcactgactccatggacgtaagtttggataggccctgggagttgatgatggacagggaggcctggtgtgctgcggttcatgggttcgcacatagttggacacgactgagagactgaactgaactgaatgctcactgagcttgtttgtcttgggctcatgttgtgctaattatttgtgaaagctaccagttctttttcataagggctactgcagagacacattttccacttaattataaagaaattctcccagggatatttactttttgagggacatctgcatagtttgtataccatcacactccaaggaacggctttctatagcagatgtttagacatagaccccttaggagaggtgaacattttcagacgagagttgtcctttaccacgctttctccgacttattctccctttcaccccatcccacctccgttttgtattccctgtgctcctgtggaataataggagagcccagaagacattgcagcctttaattcaagccttcttctctaacctggaaatacagattccaaaaaatatatataattagccataaatccatgtaactgtctccctagtggcctcaagtcctacactgctcgtggtcgcagatttttacggatatttcattaacactggaagatggcactttttgctaatgatcgcctaacatttaataaacacagcccaagagttttacaacctgttaacttgtaagtggcagtaattaaccaaaaatgataaataattaaggtctaattacatggtatcagtcatttcattttccagcctgtgcagtaagtgagtttgaactgccaaacagggttctttctccatttctctgtagtcctctgagcagggcctggggagcactgtggccgcacacgcctttacgggggaatgagagggaaactggctcattagatcagtaattgggctgtttcccccgccaaggcacattcccgggaattgtttgcaagctgggttggaagaagaacaa

SEQ ID NO: 52824 - DNA, 2912 bp, Bovine  19866880266063
tgtgagcatatgtgactattcatctacagtcagtctcatctgtcctatgtagtgtgtcatctagccatgctcatacgcctagggtggaaattcctccttaacaatggatgagtggaaggtaattaaaattatttcatgttttgttgagtggcatatgaaatagtatatgcatgtcagaaacagaagcactataccaaatatactgaatctctttttacaactaatgcctttaacattagatttatcactaggtcactaaaattataaacatctaaggacaatgacttggagaaggcagtggcaccccactccagtactcttgcctggaaaatcccatggatggaggagcctggtaggctgcagtccatggggtcgctaagagtcggacacaactgagcgacttcactttcacttttcactttcatgcattggagaaggaaatggcaacccactccagtgttcttgcctggagaaccccagggacgggggagcctggtgggctgccttctatggggtcgcatagagtcagacacgaatgaagcgacttagtcatagtagtagtaagaggtcattttaacttttttttttacgatcaaagctttcagaatcggtgcctgctttacgctccggttccatctcagtttgaactgactgtgtctcggttgctccacagccacatgtactcaggggacaccaagtcagatagcactgtctaggctttcttcctcaagtgcggtctgcggaccacaccttgcacatcgctgggagcttgtgagaagggcagaatttcaggctccatcccagatttccttactcagaatctgcacgccttgggggatttattcatatattaaagcttgagaaagttccctcctttcccatagccaccagcaactttcataacagcctctcaactcagttccccaactcccttgaggtctatcctttgtctgtttttctggacaatttactaccagctttccctccccgtcacaatggactgctctcagagactgaagtcagcatgttcccttacacttctgagcatgtgcacaggatacttcttccaggaaactccatctcctcccctcctcataactgagcctcacatgaattcggctttgaggtcattttcttaggaagccttccctaagccatcctcctcacatcccctcagttcttctggctccttgtatttctctgttccttattttcaggaatgccccctgtccctcctgctaggtggatgggaagcttcatgatgacggggaccacctcagtccctctctgggatgctccatcccgagcatccagccaggatcagcacatcgtagcagcaggggttcagtacaattgtgttgggagggagagaagagggaaggcaggaaggcaggtttccccccatgtgagatggaaaccatattctctgttgagaaaattctcaatgtaacatgaaagtctgagccagagggtgggaaagaaaaagagaactgacacggactaaaagctactgtggcagagacttccttggtggacagtgaataagaagctgcctgccaatacaagggggcagaggttcagccctgggctgggaagatttcacatgccttggagcaactcaagccagtgcaccacagctactgaagcccgtgggccctcgcgcttttgctccgcgttgagagaagccacccccgagagaagcccatgccccgcaatgaagaggagcccctgcttgctgcaactagaaaaagcccatgcgcagcagcagagacccagtaccgccaaaaataattaactaaaacggaataaatataagctactggggctcctactctgccgaccaaaactgcctggagtcgggccatgtggggtctggacgagtcacttgacgtccccaagtttcagctccctggctacaaagtagggctcagaacgcccacaccagggggcagtggtgaacattcagcgaaaagatgcgcgtgaggggctctgcaaaccataaagtgctgcagaacgagaagccgtcgtggttcagttctcagacgtggaagccccttccccgctcctctccaggccccgagtttcattttccacttgagtttagaagtcaaatatttagctgcgttaatggggtattggatcttttcattatggccccgccactcggtgcgcgcagctttgccgagataataaaagatgtgagatctggtctcgcagctgcttaatgcagaaatgctacgggaacacacctggggtgcgacttcgaacggaatcagtgggtgaagtcagccgtgtccccagcagagataaaagcattaatatcctatttcaccctcagcccacactggcatgacgctgattaaaattattttctgcggtttgactttttttttaaaaagaaaatttgtaaaggggtctctgtatgtgtgtgtgtctgtgtgtgtctctgtgtgttagagacagagatggtgagacagagagacagaggatttaataggagttggatttgctacctctgcttgaagtctgggttcggatcgagttttaatggcatacatttcacagtcccttagctcagatggggccacagggaggttttgttaagtgctccgggcgtccctctgcgccgtgccctcccccaccagtcttctggtgtgcagcactagtgtgtgctcctggtgtgtggtgcaggcctgtcggttggcacctgctttatgtgatcaagaagagaaagcctctgttgcagagctgctgtgtcttgggagatgaagtgcaggtgaagggaaatgtgccaggtctcggggcaggggtacacacacagggatacctacgtgtacacacacggggatacctacgtgtacatacacggggatacctacgtgtacacacagttatacctacgtgggtgcggg

SEQ ID NO: 52825 - DNA, 1050 bp, Bovine  19866880617935
gatttctctgcaggtttcagagtaagcatggctcttcaaataccctgactccagacttccagcctccaaaactatgagaggaaaaattttctgttgcttccagccacccagtgagtggtcccttgttttgggagccctagctaactaatacagaggcttcccagatacgtgacatttgaataaattctgaatttccaaatggaaatacaggatttatttgcccaacagatgtggaccggatacttttttctttctttctttacttttcctagtatttataagtcaacctctttcacacagacattctgaggtccagcctccttcaaaagatgaaaagagccacaggccaccaagagctgaaactgtactccatgaaggccacaggaaggagcatgtgttcccaggctgccccatttcccggcactcacacctggccctctccactctttatatgtccagcctggcgtctgtgctaaatgcatgaactggctctaagattttttcagccagaagagagttcagaggagaagtctctgcagctctccccgggagcccctgtgcatggcgctggttgtcacctgtcctccagagccctggccacttgcctgtgccggcagcagtggggggatgaaccctatcctggtatctttaattaaatcaccactcctcagacatcctcttgctctgcaacttattaccataccctggatctttcacccctgctgctgaattccaatgtgatggatctcaagtcccctacgtgctccacaatttgttctttaagtggaaacgtttacattttgattacctaatacgtttctaccatcttccatccagcaggatgtcagggccctctgcacagcactcaggaaaggaaaccagtctagactgcaaccccttcattaagacaaagctcaggtcaaaccccaaacatccgagaaacctgccagggctgtataatgtgactatccccgcttaccagggaaaccgggtctgagtttctgcttcactacttattacctatttgggcaaactacttgacctctcaca

SEQ ID NO: 52826 - DNA, 2603 bp, Bovine  19866880689851
tgcttatatttctttgaattaaacccagtgatccaaggtcagatatgataagggagaaataattgatacagacacacagtgttaacaagtcgtattggttgggaaggatacaaaattcttagatgatagattatgtttcagacagaaggcagagaaatcgggatgattcctggctcagtatctgaagctgggttacagaaacaagggcgtactttagaaagatgcccggctggaaacctggagacacacttatcgtctccatcagcctcaagaagcaagccctgaaccgattgtggaattcacaatgaggaagagagcctacaaacgtgatcaagggtgagaggaatcacgtgtggaggcaagagaggcagaagcaacggagggaaactccaggaggatgttcatcttgcctctctgaaaatatgtctccacttgctttattaaaagccaccccagggctggtgggggaggtggggcgggggcagagagaagacgaatgagatggctcactgggaaaatttctccagctctcgccatctgggttttaaaagccattttagcaattgttcagagctgtcaaaagtctctgtcagatcaataggttactgtggaatttgcccagactgttggccaatcaaaatgtaaattccagataaatttattacataaaccaacttgtcttcctcaagccattttgaaagtcatgaaaagtaatttgacttttgcttctgactgtcatacaggagacacttttctgctggtgccaagcatttatttggcctcgaaactcattgtgggtccagtgacggcaaaggggagtgtagagtattatgtgcatttaacgtctttacatccgtatgcttcagaggcagttggcaggttcaatcatttgggtgcccctttatggaagaaattaatgtgaatgtgtgtggtgcctgcgtgcacaagcggtgttagactggtttgtgggatgtgtgattaaaaaatcatgagctcctctatttatgtctctcatgggcagcctcattttcctccagaacatgcaatgtgtgtctgggtacatgattatgtgaatgcttgttgcaacctatcttttccaaaaagagacataaatttttgcattgaaagaaaaaccaattataacctagccaggacagctccaggccccatggggaagtatgctttagagacatgccctaatttttcacattgaaaaaaaagtcgtaatgggaaaatcatgtcagcaagaggtacaaagctttcaacttgggaatgcctcaagtggagattttgcactgaatcatttttcctgtggccattatattccagatgcctaacttgcaagtgccctgagtttataagacgctttcacatctgtcatgccatgggaccttcacagctacccagcacagtaggtatgttggcccgtatttcacaggtgaagaaatgaagacccaggcgagggaagtggcttcagcaaagccacagagcaaggaaaggaccaagacatgcacccaggcgtgcagaatattctctactgtgccctcagatacactttctgccctctttaactttgccctgttcttttatgctatgctgtatctaggctcttgtattcattttctgtggctgctgtaaccaattatcacaaacttggtagctatagtcagcaagaatgtattctcttacagctctggaggacagagttctcaaatggatctcacttaacatcaaggtgtcatcagggctctgtttctcctggaggctctggggagaattcatttccttgattcttcctgtttctatcaacatttctcagcccctttcaatttcaattaaaattcaattaaatttaagaggggtccttttcatgccacagttttcttcctctgcttcctcttccatttttatggaatcttctgattacactggactcacacagataataggtgagggataatctccctgccttaaggttagccgattagcaacttgattccaagcacaacctttgtcatgcaacctaacatattcatacatttgaggattgggatatggacatttttaaggaacaatatttggcctgcctcagttctctggctttttagcttctaatgggttctcccagcagaagaacttgtcaggagatcaggaatggaagagagggaaagtcaggcatttatcctccttgttctctccttgctgtgctccacttctgctgaggccacatcattctgttatagcctgggctctgctcggcggaccttacctgtagctaagcctctgcctggccccaccctgctgcctgctcctgtttcatcagggccgggtgagaaaagctcccctttgctgtctcccccacctgccctacctccctcggtggcacccttaaccattcccacaactctgtcaacaatcctccaattaaatcatcttcagtccctccttgagccatggcgtcggctgcttgccaagcccctggctgatggatggaggagacgtcttccatggccaggtctttccctacatcacagttggctaactcaacgggatagcaactgtggtcacagaagagtgaaaggcgggttctctttcaacaataa

SEQ ID NO: 52827 - DNA, 976 bp, Bovine  19866880753704
accagtctcaagggcttcagtgttgcctttgcactactcccggacagacgctcgtcccgggtaggattgggtaagctgagaaactgacgctcagtgagtcaagtaacatgtccaaggtcacacatctcaggaagatcagagcaagcattagaaccctggcttatgacaatctaaagtcttcactatttcttctacactactgcattgcctttttcgtattttatttctcagatattcattattaaaatagccttgggaggcaggggacactatatccattttagagggagaaacaaaacattttagagggacaacagggttatccactgtcatgtaaagtttcgaggacacagctatgagtctaaaggcacggagtctgatgatggtccagctcactccagtgtgtatgggaggaccccaactcctttgtaactccctaacaccttttctgagagaggcagggaaaggagcagggagggtaagtaatttctctcatgctctgcagtgaaatatttctcagccctgcctctgtaagactttggagactggcccctggtgagctctgtttcaagatccaaagccttttcctggatccctgtagcatcctctccctggtggagtggagttttccatctactgagtgaaactgacttctgagtgacaacacccttccacctacaccctggatggggtccaggcttcaggttccaggcactgccatgaaattcacgagcctgcattgcctggggctgggcctgtttatgcctggtgtgggcaggtgtccacgctgaagccgtgactggggctgaagggtgcgttccacttctggtaagagcacacagagagacccactccatctttcaggcccttgctaagcagaaatgctccatcccaagaacacattagtcatggtgatgactactgctgactctaagcagtgcaagatatgacacacaacagcaggggggaggcgccc

SEQ ID NO: 52828 - DNA, 887 bp, Bovine  19866880780583
gacttattcttagcttcttgaaacctcttttcacattttactccatcttgtgtgataagcatcataagtcgatgagtccccagttttttcaggctttacatgcctggttcttttggcttttttttttttttttcaccatttgcatgattcagagacccccctcactatctggggtaactttctctgaaaatcccccaatttctcctaaattcccagttataacaagaatgaaacagtatggctcaaataagtctggttaccacagagtagagaggaagtatccttcttcatctaaaacattttgcttctattaatacaacttagaattacaataccttttccaggcaatcatagctcatgggttttaaaacccattagtctattcctaggtactaccaagtacactatgttttatccatctattcctgaaatgaccctttttttcttttaaattcaaggactttcctccacaagtattttcagagtgctaagtgtttggatgcctggtttagtggccacctacctttgaaagaactgcttttctggatttgcgtcattttcgtgatgaataaagcatggagaatcactctcagctggtagggatattcatagacttcccagattggagagaccttaaaagaccgtctcatgcctcctcctgtcacccagcacgatgatctctacaacactcctcttcagagagagggcagcagctgtcaccaatctacccagatctctaggctgtccctctgtgacccagtctcaggttggcatattcctgttgattaagagttttgagagccttggatgaatgcagtactgaaatgctaatttcaggaagtagtggaaataatttgcctgcactcagcgtcttgtgccgacagcat

SEQ ID NO: 52829 - DNA, 1877 bp, Bovine  19866880793042
agttctctgcactcttcatttatttcgtccccacatttttttgtgtgcttatgatacaaggcagaaaaaaaaaaaatcactctggggatccagaaatgaattatatgtaagtcctggcctcatgaagtttccagttaggtgagaaagaaatacaagaatgcactccaactccaaatggttgacaactaaagaggcataagcatagagagctatggaaacatcaaagaaagactgctcaagtggaatgcggagcgtctatacgatggtttcaaagaagaagaactttgggctaagtcctttgggaatgagtaggattccaacaggccaaagaccagttcagacttgctcaagaaagagttattcactgagtgtccctatttgtttccaaatgtatgaatatgtttgggtaagatatctggtatatcactagtatctgtaaaacaccgcagcctacgcctgatgtaactgactaaaattaccatctgtgactgtggagacacacaaactagggcttgaaccctagtcctaccactcactgtgtgacttcgggagaagtgatttcacccagtgaaagcccaggtaccccttctatataaggtgggagaagatacacaggtggtctctctgatggtgctgtaaggtttaaatgagaggatgcctaccaagtgctaagcactaggcccagcacacatgcagtactcaaaaatatactactcttactcgtccctgacaatcccttgcacattgtaataaaacagataaatgaataaatagaaaaataaataaattaatacacaatgagcaagtatttagcagtcttggcccagatactcctccacaccacaaggcccatgccaaagcataaccccccaaagcgctcaatgaaagaaaggcaagggtgagctcagcccagctcttacctgtatattttatatctggttgtaaatccttgacggtgtctttccacaaaggacaggtagctcctggagtggtggaaaggccccctgtctgaaataagccaatcaaattccttggagacatgttggtctgttgcagctggttcctggtgggagggctgcactgagattcggccccatacaaacaggaagtagaggagctcaacaaacctccagttcatgcttttctgccggcctttttcctctcattcttgctccattctgtggagtcctgggaagaaaggaatagaaaagagaaagaaagaggaagagagagggagaggaaaggtggggaggggaagcaaaaacatacagacaagagagagagagacaaaggaaaagattttttaatgcttttaacatactttcatcataatacttcacatcagaagactgggtcagggtttacgaagatcagtgcagtttctgcttaagagtgtggcatctacggacatctgggctcgcactcctgatttgctgttcacatgtggtgtggacatgtacgaacatgtacaaactgcttagcctcttatatatgcagtttcctcatctgtaaaacggaggccgggcttaagcatctgtaacttggcacctggcacatcgaaggtattcaaggtgtatgggttgacagcaagagtgaaatgaaaaactgcagaaacagtttcctccagccaggaggggacatggagatggaacttcagtatctgccccgcccgctgtcttcacaaacagcctgaatctcatagcagggactcagtaagcgggaacacatttctctcctctcccacagacatgcacccagtgaacacatgctttgctttcgcatcatcagttgacggactgcacaaagtcttgggatgcatcatgatcacggctatccaggatggataccttacacatgggagagtttatagagctcat

SEQ ID NO: 52830 - DNA, 1238 bp, Bovine  19866880845458
gaatatgggaaaaatatttgtggaaaatatgcaagactttggaagcaaagaatatgctttaaaatggacccttgctcagcttgttctcagatgatggcctagacaccagaacttttcttaatcttccaattaaactgactgctcagatcgctgtgccagaagcctgtcttccagacaatgggtaccaagtggctaatgagatggagaggagatcatgagaggaaacgccaggagtggatgcctgatggaacatttctgtctgtgatgttcgcgggagcaggggagggaacatgtaaaagatacaaggctcgacggagtcctcagagacagcaagggccagagatcacgggcaggtcatggctatgaaggaagaggttttgctcagcctgtggaggtagcagagttgaaggccgaggcagctggttaattgactgaaccggaggatatgatgactgctaaactaaagaagcaattctgtgaaagagccagagtactcagacagacccaaatgatccaatgtaagccatataacctctctgagcatcagactcttaatctgtgaagtgggaggcttgagcttaagtctgggcttcaagcagcattgtgtgctacgaatcttctgtaaaagagaatcttctgtaaaagagtaagaattatgatttttatatttctactaaatgtgtcctgtgcccagttacactgcctttttaaaacactattaaggttaaaaagatgatgaagtatacgttgatttatggtctccaggagacacttccaaaagtcctctgagctctagtgaagtgtagagcatagcacttgttagattataagatttcaataaaatgaccacaattattattatcaattatattgttttatgattttcttcaagatgctaaatgcaacatacttagaaaggcagtatattaaaatgtcatcagtcactaattttacagccaatttagtgaacccctattaagagtccaaggaagataaaagctctttcctagtacatggtcagtgccccaataatgcatttataaattagtaagaaccagctacatacaagtctccacctgactaacaactattaacaataatttgtggtttgtgtatagaaatacaaaacaaccaatcatctcatggtttcttcccatcagcccttagaggtaaataggagaaacacttgtttcccctttgcaggtggaaaaggtgaatgttagatagcctaagacatg

SEQ ID NO: 52831 - DNA, 2777 bp, Bovine  19866880886080
ttgtgtgtttaatcttatacccctcaccagatttaaaactcctaaaaggaagagatttttccctggtattttattcctgtgttctgaaggttagctaatttagtcccttaaaaattttctgtggaatcagaaaaacatggatttgaattctgggtcttgagctagttactgtctgtgcctcagtttcctcatgtgtaaagtagtttagttacacctgctatgaatataaactgttatgatgtgccaaaagtggtaagaacatagcatgtaagaggtaaatacttggtgattgttattactctgttttcccagaacaatgacaaagaaataaacagttggcaaattttcaatgatatctcaatggattttttaaaaatcagtaattcatgaacatttaatacaggaaataatttaaatatcaccactgtagataactgtggggtcatgcaaactagcttctagcacagactctgccagggaaggggacaaatattggaaagaaattcggcttgttgtgcctgcagattcagtgtctagacacttccccatgggttctggtgcctggaaaggagaatttgtctttaatgtgaagacgtgcttggaaagagctgcttagagttcagcttctgccatcgaatcacttaacaggtgactgaaaaaatgagatcaaaagatctaatgcacagtgtccttttggaagtgaaaggaaaaggaaaatataacccagccacattttgccagtttagatactggagggggtagcctttcccttctccaggggatcttccaatccaggaatcaaactgggatctcctgcattgcaggcagattctttatcaactgagctatcagggaagcccttagatagaacagacaccatattttctcaatttttacatattttttttcatttttaactgaagcatttctgaaatcagcatatgtctatgtgtctagagtcatatacataactctaatgctcctctccttttcccgaggagatcttgttatgttagtagtgtcttataattggaaatgtcttcaaatcgaggggaagcagtgttacctatctcatcctaactaaacagaccctcctaagaacgactgctgcttcacctggagtcaactgttgtgggttcaggaatctgctaagaggggaaatagaggaggagatgccttgatgtagtctcatattgtcctctgcagcaaggtccattgacttgtcttgggttattcctcagctcagaggtgggaaaatggcagacacatggatatgtcgcaaacacatattctttggatgccttttggcatcagcttactcttatgtatcaggacccatcgagctctgcaactgaaaacctccagcagtgttctttgcctacaagatgttacacagatgcattgcaaattgttatcagagctcaaaaaaagaggaaaagagaggattgttgaagccttgaaggcatatgacacagtaaacggtgcatttaatttcaacttaatgtgagagagagtgtgcactagattaaatatcatctgatcattaaaaacatatttatggaagtttagcaactttgtcagagatgtgtgactaataacatagagttgtgaggcttcgaaaacatatttgtcttaatcgactgatgttgagtatggattattgactgttaaatcaaaataaaagttttcacttgagattttgcatttcatttgtgacggatttgtctttatccagacactcatattggagacccagtttgcccattaaaaaggcccactctaatagaatcatagaatttccatgttgggaaagttcttagaaatccaatctccttccagctctttttggcgaaagtggtatcatctgttttgaattgcagctttattttctgaacaaatgtagtattaccacaccggggaaaatttgggaaagaaaatgggaaacaatgtcagctgtattccctttatccaaacaactccttctctttcactttctgtacatctgtgtgtgctttatacacagtgataattgtggtatacatgtacattatttttagtctccctttttcattcttgatatttagttttcatgatcactgtgttcagtaacataatactattctatggaatagctatgctgaaaaatactgaactattccccaatgttgagacatttaaattgcctctaattgatctagattgcctgagtatgagtcttgcttctacccagtgaacagcaatgaattacctaaaatttctctatctcagctttctcatctgtaaaatggggataatattagtatttcctcatagagtagttttgaggattaaatggtcaaacacatgttaaaagtattcatagtaaagagattaatgtttatgtctactggtatatcatgagagttagacaaatagaaaggaagtctcaaacattatttcttttgtacaagcatcctatttttttataaaataaaatttatataaaataaggattagtgaataaatggttaaaaaaccagaaaagcaaaaacaaaaaagtaagcatttcaaactggcacgtaatgagtgctccatcagtgttagctattatgttgataagtgagtcaactatgaatacactgatacatattccttcccaaaatgttgaaatatgtccttcaggggaattcccaagccattttcataaaaactcatgcagacagtgatacacacccttttaaaaaattttaaaaatcaaataatcaattacctccttagatcacttcactttggaatga

SEQ ID NO: 52832 - DNA, 1721 bp, Bovine  19866880901778
tcatactaagaaaagcctctttaaaaaaaaaaatactctaagcccctcatccataaaaggaaccccctgacattttttgcactaacctttttatactgagattgtgtatgacaattctcactagagagagaaagagaagaatagatttgagacagataaagccaagatgctgaccttgctccagctggaaatgttcctctcacctgttcttccctattcagatgctaatggacaagtgagtctattaagaaaaaggaaaatcagtgcctcatgaaacaagcagcccaaccagcgtagcccagaaggctcacagaattgctgcagttggccacattcatctctatctctgccgtagtctttgcctgcatgtaggagttctcaaactttagcaagcagcgtaattacttggaaggctcattaatcagagtcctggaccataaccacagagttcctaatttagttggtcttgggtggaacccaattttcatttcaaacaagatttcaggtgatgttgatgttgcttgtctgggaactacagattgaggacaatttccataggtcataaatcctccaaagcagagacagttcatgaattctcctgagaactatggaaaggctccttcatccttgagttgccttgatcttctgccagggctcctgatgggctgaggatattcatcaggcaaaaacgtgtgaagctgcagttggcatgggaagactagccctgggttagcatcgctagtccgtttgtgctgtcgacctgctttgcaacacgccatttttctctctctgggtctagagtcctcatatgctaaagaaacctgggggtggtgcttcagtcgctaagttgtgtccgattctgcagccccatggactgcagcccatcaggcttcatgggatttcccaggcaagaatactagagtgggctgccatttcattcttgaaaaaaaatctaagcactggataactagttgattagaaaatcctttattcaaaaataaatacataaatatttaaaaagaaattcttcattcaataattatttaattttattgtcatactgtgtgtaactatgatgttggataatttcttaaattctgcaagtctcaaaatttttcttttttttgttatccttctcccatcaccccctttcccttttgataatgagttttgttttctatgtctgaaagtctttttctgttttgtaaatatcagtaagttcatttgtatgtggaaaattctgaaggagatgggaataccagaccacctgacctgcctcttgagaaacctgtatgcaggtcaggaagcaacagttagaaatggacgtggaacaacagactggttccaaataggaaaaggagtacatcaaggctgtatattgtcaccctgcttatttaacttctatgcagagtacatcatgagaaacgctggactggaagaagcacaagctggaatcaagattcgaaggagaaatatcaataacctcagataagcagatgacaccacccttatggcagaaagtgaagaagaactaaaaagcctcttgatgaaagtgaaagaggagagtgaaaaagttggcttaaagctcaacattcagaaaacgaagatcatggcatctggtcccatcacttcatggcaaatagatggggaaacagtagggaacagtggctgactttatttttttggggctccaccaaaatcactgcaaatggtgactgcag

SEQ ID NO: 52833 - DNA, 1068 bp, Bovine  19866880920305
taaagaatctgcctgccgatgcaggaaacccagggaatgcaggttcaatccctgggtcaggaaaatccctggaggaaggaaatggccatccactcctgtattcttgcctgaaaaagtcccatggacagaggagcctggcaagctacaccgtccatggggtcgcaaagagtcggacgcatctgagtgactaagcacgcacatgcagtgtggggagatagccaggaccaggactcaggtattctaggctcccaaactgtctttccactgtaggattctgtgaagtatctatgcaatagtggcatacgttttaaggaataaagaacaattatattcctcccaagctttatgatttgagagggggctgatgcagtcaggaaggactttctggaagaggcaaggcttcagtgggacaaaatgggcagagaaaatgttctgcatggatacatacaggagcacatttcccagagtgttcggaaaatggactcattgtggttataggctctgcactgttgtacagaaaaggaaaacagagtgggaataaggttagatcctgttaagggagagattaattaagatatctggactcaagcctgtaaactcagatgcgcctgttagcacaggcatgcactgtgtttgaccccacacgggtaaagggtaagggagagagcatttgtcagtacttaaaaatggagagattttacacacaaaaaaatctaaatttccttctgacttctgagaaatcaggtggcctggcagcctagaaatatcattcctacccagaagcgtctgctgtcctagactgggtagtatgcctaccacttgtcactatgctgccttcttaaactctgaaccagaccactttcattctctcacatttatggtctggactcttttggcttctgaatttacattccctgaagaggtggtgatgcacaaaaaattcgtcatcattgatatgatgaaatcaatgtttagaggatgtttatttgctcatcaaacatttattgagcatctattgatatttcctgcaaggctctgcaagggaagaattgagttcaggagatgaat

SEQ ID NO: 52834 - DNA, 2015 bp, Bovine  19866881051077
cagcagagctctgtgtgggaggatgtttgatacataaaatcaaggttcaggcctccgtgtgggaagaggaggtgcgcgtgtcctttcgttcctctctggattgagaaaccaatcatcagtcttaaacgtcacctgctgaactggtctgccttgaactagagtgtttacgggaaacacaagaaactgttgctggaaaacgacctcatttttacttctgtggaaccaggccatcaggaagcgccagatgcctctgccataggaagctaggtttcagcacctccgtctgcaagcgttcttctcaaggcagtttcactttcattatgtcatttaaacctccacaaacactcttgagatacacagaattagaaatgaagattcttgcatgacagctaaggaaactgaggcgtgggcaaatgaaagggtacacttcacctgggaccattaaagatgatctgaaccaaggaaacttgtgatcttacgccctaattggtggtttcctttctgccccacatcccctaatggatgagtgacccattctcgtttgttcttgtatggaggcagcctggtaaatagcaggctgaagtgccagcataaaaaaggttttgaacagtggttgcaaaatagcaatctatgagtcacatcttccctgaagatactgtatttatgccatataatttttaaaatattttaaaattaggaggctccctacagaaacctgtgttttcttataagatctataaaccctgggctcacagtcctgtgtacatggtaacagcatgtcagatgccaaagaggcagcccctgggacggccatccgtgacccgtgctctgcagcctccccctggccaggtgtacccgtgaggtgcccgtctgcctcccacagacttttactttacagcttcttgtacaaatgacttgaaaagcacaatcacatcctgagttttcactgtatcttcgtgagaatatactacctcattctgtagttgtgaatctttcattgtaatatgaagctgtcggggaaattcactcatctgtaaataataggttatgtgttgttgttttttttcattttgatcctaactgaggtatcaaggagggctacctctagaagttaacccttgaattgggtcttgagaagtaggtaagagttaggtgggttgaggaaaaaaaggtaaaaaaattccaggtagaccatctgtactaagcagtgcttacaaggctgtcatataagaggaaattcaaaccagctacttttgcaggaggaaaaaaggagcaagaattaaggcctctgacataagtggtgtctgtgtcctagaggctctgtatgccatgcgagagagagtgtcaaaaattttatggacagtgaggaaatggttaagtgtattaagcagcaaagaatttcaccacaggctgattggtaatatgtacattttaactagattatctggcagtcatagaaaggatggatttaatggcaggcaaaccttgaagcagggaaaccgtattagaagctacttcgagattccaagtaagaagtcatgggggattcatttgagaaatcctgtaggatgtaagaccaggaaatcgagagatatgttattttgacatttattgagcactaatagtgtgcagaatgcgatgggagaaattagctatctagtccaactttctttgtaatgtttcagcctgttttactgcctctccagtaaacggtcctccagtctctgattggtcactaccaaatgatccaattcccactttaattattagaaaccacttccttatattgtttccttagattgagtccaaattgtcctcctacagcttctggttctgtcctctggagccacagtgacaaagcttaatccctattctgcacaacagcatttcaggtatgtgatgacaggaatcgtgtttctcaaaaaatctattttcagctaaaaagaatatccctcagttctctgcaagagtcggcattctccacctggctccagcacatagcacgttcaagttca

SEQ ID NO: 52835 - DNA, 1336 bp, Bovine  19866881085804
cctttcagactggatgggcttgttttcacagtcctgtctcctgtactatccatttaggcctctcaccaagctggatgttgtcctaggcattgtctagtttatcttacttacagtgtaagccacaaaaaggagaggggaaattgagtgaggattaaaaggaaggttcattcacgtactgatttggctagtatttatcggctgcctactatctttcaagacttgctgtagacccgtgctgccacagaactttctgtgatgctggataggctttccacgctgtccaatatggtggcccgtaaccacaagggactgctgagcacttgaaacatgggtagtgtaactgataaatgggtttttaaccttacttgagttttattcgtttttaaaatctgaacagttgtatgtggatagtggctactgtattgaatagcgcagatctagacatgagaaatgtagcatcaacatggtcctcttctcgtggagctgatgatctagtggggagagattgctaacagatgagtaaatacataggcaagcagaatataatttcatataatagtaaatatcatgcaagtaaaaactggggctaataggctagaaagaaatgtaggtcacagaactttagggtcatcaggaaaagaacctccggagagggtgatattagaactgagatttaaatggaaaggacccacccaagcacgtgattatgaggggaaattctatcgaaggcagagaacagtgatggtgtcactaggcggggtcagcctcaggaaatctacgggatggtgggactgaagcttttgcctgagaaagagagcatcataagatgagaataaggtagggagaggccagatcacaaaggcctcatacagggtgagcggcaagaaatgtagacatctcccctttgaaatctccctgcctaggaagtaagtagtctgaggactgcgctgaggagagtttggagattgacagagctcgtcgttatgtattctctctgggtttccatcgtgtccatttttaatcagtcatttcagtgaatgcttctaatcttaattcctagtcctgctctgagtgctgtgaactctagaaattccaaaatctaaagggaggaggggaggacctgaagagggaaaaatggctagaaaaggaggagggggatggatacctggggagaaggtaattgaaatgaagtctgatgaaaaaggatgaaagctatagtcagttaggatcagcaaatatttattgcatctcttgtctgggaaaggccttgaacaaaatggcttagggggtatggtgatgaaatctgccaggattagacaagatctgcaaatccata

SEQ ID NO: 52836 - DNA, 1549 bp, Bovine  19866881095656
tgaaggaaacaaaaagagttgctaccagtcatgggtttggccaacatataagaagctgccactgtgtgcccggggcatcgtgaggcacagagggtagggctgggttggtctctctccccagagatcttctagtctagtgggtgaagttgaaattgcaaaagatgagctgctagccaccaacgagactggccgcttgactcttgagccccaccgcctagtaaggtgtctggcatgtgaggggcattcactgatggtttaatgaataaatccttcaaccaaagcgtcctgcccctatgaagactggtacactgaaggacaagaggagttcagaggaggaagaagttccttccagatgagaaacagagactctttcatggagaagcctgactcatggagtctcagcaaaagaagagaacacagggatagaactttccagatggtcagcaatactggtgtcacgaggcaggaaagcgtaggtcacgctcacagaactcactctgatagctctatccttccttatcttacccgtttacctgggctccgctgactcctaattgatgtctttgccttcagtttccccagagctgatctatcctacccaggtctgctggccttatctttccaaagcacagttacaatcatggcactgcccttgtcagaagcataagctgactcccccactctcagttcagtgaagttcaagcccccaagccagcacctgagcctttgtgatctggccatagtgtttccgaatgaacttagttaccacagctctgtctcactcagggctgagatggacttcccctgccctccattatggataatcctttgttgcttccaagtctcagcttgtgctcttctttataaatgaaaacctttcccttaatatcatcaggcccagattttatccacacctcaaggtctaaatctagtacctctctttgtgaaactttgacctgaactcctaaggaagtcgtctgtgaactcctgtccctatgcccacatcactaacagctcatacctccctttttagctaaatgggcacacactttgtctttcccccagacaaagtaaaattgtcttgaatacaatttcttgacaataatttaaatttcaccagaacttagcccaagacagggaccagaggagtcctcagtgtaaatgcagtaatagagctctacattttttgtcagattctctgagattctcccctggctatgtgtgtgccactccatactctgttgaccagggctaactgatagaaaggcagagacccctgataaaggtgggccagttagattgctgctgtgggaatcagaatgaagagagtgatggaagacagttggagctgagtcttctcacggcaagacccaaggaaaaccacagacatctagctgctcaagtctttggaactcccctactttctttccgggtgtttcttttttctggaggttgatttttgctggctctcccatctatcactgtattggtttgccagggctgccagaaatgaagcaccacaaactgagcggcttagccaacagaaaca

SEQ ID NO: 52837 - DNA, 2405 bp, Bovine  19866881127914
acccgcttgcttgacaatatgtcctctcccagtatacctctggcactgaggcaggcacttttctccctctctctttcctccttttctttcctctatttccaccagttcctctttcctcctccacccagaccctaataacactgaccagctgtgcactagatatggggaatgtggctgggaccttcagcatggcatccccatcagtacagccttgcgtctgttattttccctaaacagataaggaatctggtgcagaaacagaccttcccgaaaagtatttttccagtactttctatcacgatacactccttattccttatatatcactgtctgatagtatctggcttatttatttgcacattaattatcagtattactataagaaggaaaattccatgaagataccaggactgtgcctgtattgggttctatcaggtgactgagcagcgcctagaacctgatactgagcaggtactcaatacataaagataagactgtggtctctgatgattggaaaaggcctccctaaagatgcagaacacattctgtctgtgctttgaaggactggcaggattagaaacagcattctgaacagaagaaatagcttgagaaaaagtttaaaggtaagaaccacagcgctttcctttgttcatgtgcgaacttttcagacacacacacgagggctccagaacatgcccatgggattgttttctaaaacactgagttgaagcttggtaacaagaaactcttaatggctttggataggtcggagagcaaaaatcactcgtttgaactaaagctggtaggatgaaagagagagtacattcgaacacaacttgaaatcctcacttggccacacacagcctacagcatgacggggaaatttagggcttgaaaggactacagtcctcaccgtttatgaagcctagtgcaaccgcctctgaaggctgtgttgccattcttgtcctcattcctatgaatataccattatccaacagctgctagagtggggtttttaaaaggctgagtcggatcatgtcactcttctcacatccctccaatgggatcccgtcaccccagaacaaaatcctaagtttcaccctagcctgcaagaccttactgttcttagaacatgtcaagcacatacccactcaggacctttggacatgctgtttgctcagcctggaaagctttctgccaaatgtgtgcatgtctcactctttgccttcaatcagttctttgtttaaaagttaccccttcagagaggcaaactctgattgttctacatgaaacagcacaatctggcacaatgccccatcagacgctgtgtggcttctattgtatttatatgtctgatactgcattttcacttattcacctgtttaccgtctaactccctaggtaacatgtatgttccacggggatagttctgttcggtttacttctgtttagaacaattcctggcacaaagtgggtatttaataaataagtgttgcatgaatgaatagaacccacactcctttattctgcagtcttagaaaaaatgtatactctcattttgccagtatttcacagccaggtgatgactgaggcagaacttaggtaccctacttcccaattcagtctgcttcctactgccccagtgatcttgaatgtaccttttctttatccattagatctccactctgccttccccgagaagcagtattatatggataatgagaaagtttcctgcaaagtaaaccaacacaagtggccgcgtgaggccttaaagaggcaatggtgaggacagttttaattgattagctggaaggatgactgcactccactcctcagggccagtgatcccatgcacttcgccatccaatgcaccccaagcccccaaggaccccgatggaacagctaactagggcactgattgtggaagccagaataaatccagttggaatgagacatccagcacattttgggaaacatctcaagaatagtctgcaagtgggatggtgaccagctgttctgcctctctgctcaggaagggcgaaactaccatgggattcagagactaggtggaggagagattatactgatttgagggagtcgtggtttttaagaggcagagaaggaagagcgggttgtggactcagcacgaggctcaccctctagctaccttttaaaagcaaatctggccgcaacatccctgtgcttgcaactcttcagtggctcctcgctatccctgggataaactgcaaactaactggcttgataccaaaaagcctccattaactgactgctagcatccttttcagcctcatttcttgccatgccttgagtcacactatactgtacaatatcacagacgttgtatttcgcacacaagtcccagtgctttctccctctgtgctttt

SEQ ID NO: 52838 - DNA, 836 bp, Bovine  19866881162665
taaatgagctaaacaaatcccttgctgggcctgtcacactgatgttccgcatgcaaatcgttcctaatgagcagggcacagggctggtcccctggtttgtaaatccatccatttcacaaaacattgtcctggtcccatatttctgtgacaatccattggcagatgagctgttaagtggaaacactgaccatttagaaccgcttttggaatgtgctgtctcacaacgagacacgctgcatgcagtgggctcaggactgaatgaatgacttgggttcatgtcctgactctgatcattttccctcttctgagcctctatttttttcctgcatgaaatgaggggcttaagctaggctggcattttcaaagggtgtgctgatatattcacagcttgcaaaacaattttttttttttaagattctaggataaaatattacagataaatcgggggttgagaagttcagtaagcttttttttttctttttggttttcattctaagccccccatgagacatctcagaatcattaatacattaacttgtattatgagtattgatccaacaggcatttaaaaaaaaatggaggattttgttgatcaaatcttctggaactgctaggccagatgatgttggagattcttccaaatccttacctgcctgtaactataaagaatcagtgtagagaaagaaagctgcaaaaagttgaaaagggtcatattaattgatttcaaggacacttattgggaacactatgccaggcattattcttttctattaataatttctctttcacatctgctggactcaaagaaggtaaaattggaagagaaaggagagtca

SEQ ID NO: 52839 - DNA, 1850 bp, Bovine  19866881225221
cctgagcaaacccttcagaaactcttccctcacctgtgctcggaagcccacgctccctgtcagtgcaccaaggccccgacaacataattttcccctaactcttgacacattacaatctagccacactgaatccatgtggaatctcccgaatagtttatactggtcaatgccgttctgttttggagctaccattcctctgctcttgttattcacttgtgtgtctggaaaatgatgtcatacaccccaaaattcatcccagatgttttaaacctggggaaagacagagatattgggccacgtctccctagagagcattttgtaatgccatttcttatttccatgtcagtttccttcactaggttgccatatgtttgagggaaggagccaagttctatttatgtgtgtatccctagtgtgcagcatgaaatagatgttcagctaatacttgttaattgaatgaatgtctgtgctggaggcagtgagaagctcttgaagactgctggggctaccaaggcttttgttaatgtctggacgactatatctcaattcctatttgcataactcttgaactgattatctggaaaccccatcctttctgaaacaactgctttcagggcctcccatatgagaaaaagattaaaacctgaaccagcttccctggtattcatcttcctcagcaaagctttaactgctgctggcttataaggtgggatttcctaattgtgtttaaatctcctatctactgctggccatagatgtgctaacaaatgaaagtttctgtgtgtgtggtggagggggggagaaagttttgcctcttatagcaaggaaatagtttgaggctatgttttaattaaaatgaatatctgcgctatcttaatgttattgccagttaagtgtagcagggtgatttagagttctataacacaattatactctggtaatgaagctctgcagaattatccttggaatttagaatgcagaagggagcagtagctctcatttgtaaccatgttacggcctttattgttacagtattttctgttttcctcaaagattaactcaatcgtatttaagtctctggctacattacagagagatagagaaactgggcaatggcaactgttttactgtccctgcagcccatcttaatgttttactgaggggacaaaatagtggggaaatttcatcagagcatcaccatttttattgttcttgccctagccctcctgactaagccctcaggctggcctacgcagttcctggctgattctcacttgaggttgtgtgatggtcagaacaaagtttagagagccagcggggatggctgcatttcaagaagaaggaaagcaagcccaggaggtggtgttgttcttggttctgaatccctcttgacatttccggtgtggtgagagctgctctgactcggaaagaggagtaacagtggttaaaagtgtgaattctggggacaaatccagaatccattatatctcagctgagggaccacagacaagtcattcagcttctctaagtcggtctcagtttattgatctgtaacatggggtgatagtagaaactgcttcagtgaatttttgtgagtgaaatgttatacacgaaacttggaagagtggctggtatatggtacgtgctccacaggtactagatgactcagttactggacagataactagcccttgaccagctagtttggagctctgtttttcccaaatggcatcatctgaagattggccaaaaccaagttattacacatgtatctcccctaaacttgcacttatttgaaaaattcaaaagcaaattttgattcattttaaccaatatttaacacctatttt

SEQ ID NO: 52840 - DNA, 1029 bp, Bovine  19866881288040
ctgtctgtaagatggaacccaaacctgcttccaagtatgtggtgtaaacactaataatatataaaaagagctttgcccagggtcagatacagagcaaagattcaatgactagttattgggattactgtagttacagtagttatgaatacatcaaatgtttgcttgattttctcaaatcttttctgattttctattgaaatgttttgtccatctatgtaagtgggcctccttttttccttaacattgtggccttttcttgttacttctgtttcacttctctttaaaaaatatgccatagaataattaatttttgtttataaaaatgaataaaatcatcttttatcttattagaaatgtacttttctatagtaaagtgaggttcgtaagactcccaccacctggattcttataaaaagtttattgatttattcaaagtcaccaagcaagatctgtaatccagaacactttcactatcctcccatattttgaatttaatgttatctttgtggtctttcttccagaatatttaaatttgaatttgacttaatatcctttggaatattgttaggaaactccctttctttaccctccttttcattctgccattagttggcatgttctcagtgaatgcaaattcacttttacatcagcaaaagcaaaattgaataaggaaggccatctgatatgtagtaaatcaaacaaaaccacaatgaatttcaaagccaagtataaatttaagatacagcatgatgtaaaggaaagagaaatgagctcaaatcaggcgatttggatagagtgtagactctgtactgactcacttcatgaccttgggaaagtcagttagcttctcttaggttccttatttttccttagtaaaattaagtgtagtgctagataatcatgaattaatcactgatttcaattaaacatattataattcccattggttaatctaaaaaaattaagcctgaactccatcaagtattgtaaaataattagaatttttaccaaaattaagttatatattca

SEQ ID NO: 52841 - DNA, 1809 bp, Bovine  19866881363068
tttttttctctgcatgaaaataaacaaaaggcattgtggacaaacttctgaaaatcagcaagaatctatgcaacatcttggacgcaggtattatccagatggcagcctcatctctggcaacaagcaaaatccaaggagccagaagcaccaacaacctctgcctcttgaatattcacaaacacatctgattccactcacgtcacacagaaaaccttaccagattgatttcatcttaagtatacttggtaacaattccagtccctcaacaacattctaacaaccgggactgcccttaatttcatttgcaactttaagtttcatcatcattttcatcaacgcctttataataagcagggtctttgtcaaggtaatgaattttgggggggaaacggaagttctgtttctaggtatctctgtgaaaaagaatgtctcagctgcaatcattttaatgtctccaccctaaggaaaaagaataaacttatggatacttcaaagaactttccagaaggaggaaactaggtggccccagaccttttccataggctacttcacctttccagccacccatcacactgccttcttcatagcaacagactgttcatcctttacggtccctcttcacagagtctttttcttctccatcctacacttgttagcttactaaagtcttactgactattctgaatttggatttacacaaagaagttaagcaactcttccaagtttactcaactagtcaaccaggagcaggaccatgtacgctgggaatccaggtcaacctgggctcactgttctattgtgtctgatgatgtaagtctcaatgatgagagtcaacatctgctgagcatttcctatgtatccggtactgctctaaaaatgtacccaggcaaactcttcatagcaactttaagaggcttttatcataacccactttacagacaggtatgtacatccttaaggatactgcctgaggttatacagctagtgagtgggctcacactcaggcagtctggttccagaaactgatccttaagcactaatcttacccagctccaaagccttaactgtaagctcatggttaaaatttgtatcaggctgatatttgtgtatactcctgtgtatgctttaacactaagccgtcctgaatgcagaaaagatactcaatatgtttttgattacctggagattcacttacttatcatatatttaatgataacctagtaggcacaagacattaccaaggtattacaggagctgacgaactatacaaagatatgatagcaatctcctgcagtcaaatgtggaaagaaaaccacacttattctgtgtgacctatagcatcaacattattcttcctgattccacggccaagtcaaattcataaaaccaatttttggaaccagtaggaacttatcaatatgttcttgttctaggaaagaacatttagctaaacagaagtcaaaagtactactattagcattttataaaagaaagtatgttctaaccagtgacagaaaacagaataaaagacagtccttcacatttagacaacaaattttagatctgcatttgaaagccatcaatctatacttttcgaccaaagaagaagagcacagaatgaaagaaaagcccaacaggcagagacttcagcgatagacggaagtcgggttgagaggtgtgggtgctggcattcacagatggagagagaggctgaaaatctcagagacatttcagaccacagagtttgtgattctatggctcttccttcaaggaattttaaaatgccataaaaatgtaattatagaaaga

SEQ ID NO: 52842 - DNA, 1029 bp, Bovine  19866881372454
aaaatgctgcttcccccacagaagcacaccgaatgtccctgactcagaaaggggtgccaaatatggggaccagtgctctacaggtgctcaaaatataattgttcaacaaacaaatagtgttctgctgagttaatgaccctgagttcttccctgtggctaatctattcttattactcagtggagcaaataaataaaacacttacatttccatctgaacctaaatttcagcatttactcatcaaaagctctgacccttggcttaatgttttcaacaggtcactaatgaaagcagatgaaaggttcctggtggatccatttggatagaagctctagggctctgctggttcttgtgcaatggctttattccttgcacatgatgcttttaaaagaatgaattaaaaggactgtgacaactgctgcttgtctctgacaatcatggaacccaaagaagaaggcaagggacagacatctgagggcttaagcaggtgctgagttaagcagtcacagactttaaaaagcatggtcactttggagatgataagcactgtctctcttgagactctcctcattccatccttgcattccagcaagatttcatgatgcttcatcaagcccgtttgatctcagagctacttttaacatatacagggcacagatttatacctatttgggaaatgagaaattaacatccatcaaggcagaaggaaacggcaacccactccagtattcttgcctggagaatccatcccatggacagaggagcctggtgggctatagtccatggggtcacaaagagttggacacgactaagtgactaaagaaaaataacaacaaagggaacaccagtaagtcatttcaatataatgtacatgattcacttagctctcaaaacaagcctctgaagaaggcttgattattcccattgaatgggagatgaagcagagaccagaaagattcagaaatttctcatcgtctcaaaactagtgtgttattttggtttcctttttttatttttctaactttaatcca

SEQ ID NO: 52843 - DNA, 873 bp, Bovine  19866880439910
cacatattgatgttccttatgcaagaaaggaactaagacaggtggattgccaaacctcagtcacctgcagacaaaatttaaaagggttcagaagactaatccagttatgtgggacagacttagtgaaccaccagggacgttataccattaccctttcatcccaatatacaactgtcagtttggacaatctacaggacaaagtggcatctgtctttcaggaaagtgtgtatgaatatacatgtggtgtgcgagattaagaagggggaaaaaacatagtgatctcatgatttaaaaattttttttcactttctttttttaatttaaatttatttattttagttagaggctaattactttacaatattatattggttttgccatacaaaaaaaatggtacaagaagcctgtgaggctttcaaaaataaaattttgaccacatcattgcaaataatcccaaagagttcttaaaaacaagtgtggtgttgaacgagatgcatgccatcatgcaggggatcctaaatgagctctgattctattgataaaagtgtatcaacatgggatgaaaatggagacataactgagggcaaatactcaaaaaagaacactatagaacagtacaaacagtgagggaaagttgagcctggaagcaagtgagacttgtgatgatgttaaaaacaacattcagggccttttcacttttgtttggaggaagtagcagcagaaagagataggttcactgattagggcagaaggggaaggttggggatacagatgacacagaaagcagaaccgctcagctcctctgcttgtctgctctgtcagggacaatgttcatcaggaggaaaaagcataactgtacaagagaaataagcc

SEQ ID NO: 52844 - DNA, 923 bp, Bovine  19866880579834
agattcagtggtaaaatttctttaaatacattttggccttcatttttcttttgcaaactttgctgtgggggtggcctgcccccttcagagtactgcgcaaccttcgcaagagaccatttatcactagtttccaccttggagcagatcttcctacctttccagtcttaattctgtgagaaatggctgcaaatcgatggttgagctctgagatttggggctctattactttcctgcagtggtcgccgcggtttgccatcaagtttgctgcttggtcacgcgtggagtccacctttgggcgtatgtcattcagttcagcctttaagcgctatattccatgagcaagagacagggcttgaagttagtaattcagtggaggttgaaagagaccgaaagagcaagaaagcaaaagagagtggggaggggagagagagaactagagagagggcagagagacagagaaggaaaaagaacacatgcagagaaaaccaagggaggaaaaagccaacttccataaacaggagtaaagtgaaaatgtgtgtgagctcaggaaaataggtcactgtccttgcttcagtttgatctaagtttatttaaagcatttccttagtctgaagaaggacaagggatgttttcctgatttttctatgttgccagcaacaattgttgtgtcttatatttagtcgtacctttcctcaatttcaaagctgtggaacaactttaacacatgctcaggaagaaagggagctgaagaacaattttctattccttccgaggacttatgaattcccttttgctttatcgtatcgattgtcacagaaaaataatggattttctaacagatagggattctgtgtcacagacagaggactgaggaaagctgagccgacagagggggtggagaggctagagtaaataactcagtt

SEQ ID NO: 52845 - DNA, 1912 bp, Bovine  19866880622237
agttggaaaacggatgcctgtggcttgggcttgggtggtaaggagaggtttttcagatttgggaatgttttcaaagggaatatagaaggttcatttctgtgttcaccaaaaacctgagcatggttgtataaaagcccattctcagcaaagttcggactcaggagaatttaggagtcctgtgaagtcagtgaaggatcccttaggaatgtaagattccttctcatcgaaaacttggccttctctacaccagtcttgctgtgaaacaggggcatcagtgctggtaacagagatcttattactctggtcaaaatccttctcctttgaaatctgtttcatcacacttaaccacacatttaataatggcagtcacttgaatgaagacaaagctaatgccatgagcaaactgaccggttttctattttggtattaggagaattagataatcgatggaggcatggcatatacaaatcagaacaaaatatctgaaggaaaataatcaatgtttttgtgtatattgtaatatagggccatgctagataaaggattagatttttcaccactgctactactactccagcaaaaattattgtaattattttaaattaaataatcatggagcatataaaaagtcaaagtgaaatttgattacaaatgctttttgaattctacttaaattttctaatgaaatagtttggtgtatggaaaaatatgacttctattaatgtattaccatattgtaagatctgatcttttggtctataacatttggaataatgtaatcattttgtgatttctcagaaaaatcaagattttctttttcaattttaatttaatttttattttatgttggagtagagtttatttacaatgttgtgtttcaggtatacagcagagtgattcagctgtatttagattcttttctcatatatgttattacaaaattttgaatagacttccctgtgctttaaagtaggtccttattgattatctgttttatatacagtagtatgtatgttaatcccaaattcctaatttattcctccccctgcctttcctctttgataagcacaggtttattgtaaaagtctgttgagtctgtttctattttgtaaatgagttcatttgtgtcatattttttaaattccacatttaagtgatatcatattgatagcttacagtgaatgatgtcggattcgtgatctccaaagaagaagattttgctttggggccagggaccaggcttgatcactcaagagcttttgtgtagcagagttttattaaagtataaaaaggaacagagagagcttctgacatagacatcagaagggggatggagagtgcccccctcactagtcttagcaagggaattatatacttttttaattagttattacagtaaatcaaaaataatgtctcaaggttgtaaagatcttactagacccactcccataatatgcactttaagataacaggattagttagaaggttttcaggaaggagaaacatgtcctcaagcaggatacgttattgttatataatccttactaagccatgtaggaaaaaacatttgtcctttcctcctccttgagaattcctgacccttatctcctccttgagagccccagacccctttctcctcctcagtgaccctggactttttctcaagctgcctaggaagtgactctctcaatatgatatttggtctttctctgtccaatttatttctcttagtatgataatctctaggtccatacatgttgctgcagatggcattagttcattctttttatggctgagctcaaaattctccaagacaggcctcagcaatatgtgaaccgtgaacttccagatgttcaagctgggtttagaaaaggcagaggatccagagaccaaattgccaacatccgctgga

SEQ ID NO: 52846 - DNA, 1345 bp, Bovine  19866880829057
gatgatattctttgcaagcagaaatagagacagagacatagagaacaaacatgtggataccaagggggaacaaagaggtgttggcatgatttgggagaatgaaactgacatatatacactatgtatagtcactatgtataaaatagacagctagttggaagctgttgtttagcataaggaactctactcagtgctctgtagtgacataaataggaaggaaatcaaaaaagggggatgtacatgtatatgtgtggctgattcactttgctgtacagcagaaactaacacaacattgtaaaccaactatactacaataaaaattaaaaaaaaataaagatatggataggtattttgtctaggtagaagtttcatagaactcatcagattctcaaaggtatctgtgatccaggaaaggtgatgaagcacttaacaattgggttccaatgttgttgggataaattgtaattccttaccagccaaggccttttgcaaggattggctcaccccaatccccactcctaaccctatctcccaccacttgatactgtaaatctcccaatggagccaggcccatgagggcttgagtgactgtcaccttctgttctttccttctctaagagctttgattctctaatagccacacaatttaaaattctattctcaagcacttttcataagtctaagcccaaaccaccacttaagactcccttaagcctcagaaaaaaactttatatttttccttcagattttagaaaaccttatatattattatctgcatttatcacacttaagatgtatttaattcatgatgtacacatttttttcctcaatatagttaaaatcattatagataagaactgcctcttacatgacttggtattgctctgtcatcaaggaaaatgataatcatatagtatgttctcaaccattctctggtgaagtcagtaaatacttattgagcccctcctgtgtgtcaggctggatttcttgaagtgaacacatctgccagaaattattgtacattcaagtgcagaagatagataaataagattaaataaatgtacaatatgttgagtgctaaggagaaaaatataaagccactaataggaatagtagatgcccaatatgcaactggagatcagtggagaaatagctcagaaagaatgaagggatggagccaaagcaaaaacaacacccagttgtgaatgggactggtgatagaagcaagattcgatgctgtaaagagcaatattgcataggaacctggaatgttaggtccatgaattaaggcaaattggaagtgctcaaataggagatggcaagagtaacatcattctagaaatca

SEQ ID NO: 52847 - DNA, 1044 bp, Bovine  19866880948807
taacagtggaattgcagtgcaagttacattgcaggcatgacttttccaaccatccccgacccacctgctgatgttatggaaaggcttccaaagaattagaaggtgaagaggcctagcatggaaaaacccagagtccttaaatcactatgtggaagaaagctatgcacagataggaatgcctgtgtatattttgaagtatacattttttttccttttcctttcttaagctaccagaattgcaggatccctttgttacagtaactggcattaaccccactgacacatatgtataactctgtgtgctccaaagaaatataagcattatttgatggtggaaagaagagaaaaaaatatactgaagaggaaagtattctgactctgtgttcaattttaaagcacagtataattagtaatattgtatgtttgttgcagttttttggaagaatgttgaaatctctggcaactgaaatacattaattttcaattctgtgtttttttttttaatctgcaagttttggtaacactgatatataccagtttatttgtttctttcaattctcaaatttaaatgtgcaagtttgccttccaggcataaattaagaaccattgtggaaagagattatatcaaaacttcacaaagatcatttcagttctttgtaaccttaaatgaagtaagccaataaagcattaaattaacatgttgtacaacttcctgaagttttaatatgcttttaaggggcaactctgatcttattacctctaaagctaaagtcaaaattggtgtctttcagtttataaaatggagataaaacatcattttacccaatttaacaaaatattctgtttctgaattataaaatacagattgcctaacaattcccaaataaatgtgcttacccagaaatgatttttttttctaattagtagccctggagtctttggaccataaatatgtttttctctcaaatgctttaaccatgacattttccttcagactagctcaactatttctacagaaattatacacttcattgattcagccaa

SEQ ID NO: 52848 - DNA, 794 bp, Bovine  19866881214122
caatgcatattttggattagatgctgaaataaagtaaatgttatggtaaattgacaaattcacactgctaatgttatgaaaaaatgatgtggcaaaagaaattaagatgtatttctcatttttgataagggcactctttcctatgctctattaatagattacgtttttaatctgaaaaactaaccactggggttagggaagcccaaaggtaggggaaactgcccactttcagaatgcagattagaactttgaaattgcacccagatttttttttccttttggttagtaggcctctgttgttagagtagtagttgcaaacacatataggtttgccagtaaccaactcacaatttgtgcaaagttgagtcttcgaaactgagcaaatttgctctcaatttcccgccagcgcttgctgagctggatctgagttgactccactgccattgctgccccatcctcagacaagccctcagcttgcctatgcactgcattcagctcctctttcttcttctgcaactcacgatcaatttcctattgagcaaaaccaatacagggcccagggcagttagctaaccacatgaatcaacctatcccagcacatacctgtcccagaaatttcacaggctgtcttcattttattttcactgttcataagttacaagtatggaagccaacactgtcatcttcaaggacccaaatattatttcagcttttatttgaatgctcagttttagacactctaattgagaaaatattgaaattgatctaacagatttctttgtcaattcctctag

SEQ ID NO: 52849 - DNA, 1099 bp, Bovine  19866881352996
tgaagactaatcaactgcatgcaggtcaactgaagtcagaaaccattcattcaggaagaaaactttaaaaaagaagagctaattcttggaaaagtaggctctaaaagcaactcaagagcgatgcacagattagccaggcagaaaatagactctgtgtcaccatcctcaccctgggaaaatgaagtggattaaaaccaaactaattggcttgttaatgtcattttgaggtcataaatatttcttgaaagccctagtgttcatcaaattttactcctgtcattcatttttcattctaaagtcagtctggtaaaccatggatgatgtgagcatcatcttgcacatcccagatggaaatgacttactatagtcaaaagtcatctagaactggcatatatttttatccctgattttgtttttttttttaatttctttaagaagagcatcttcactttgctattcacaaggaaaagctgacaaagcactcttttaatgcataaagtattgtgtggatctgcaaacaaaccaatttgtttgaaactcagggaagcaaacaatgcatatgaaacccacaaagcactactgtgtgtgtcttatagggaaatcataagagaaaatgaatcgaatgactcacaataggatatgtttggaaggagataaaccttttatatctatgagcataaagacgcataaagtattaaataattttaccttagtagtacttatttttgcatatgttaacatttaaactaccagaaacagctcctgaaattggttatgctaatgcctattgctactcattttaaaaggcaattccacttaaaaccaaacctcaggcctcaaaacaatagttaaggtcaaacgaagcataccaaagtcgatatacacaagatatgaaaagctccaaattatatttcaatgacttgtttaatttgtaaatcaacccaatcaacaaagcatatgtttaaaattctaaagacatttttggggtgggtatttctttaaaccaaatgtaacttcaatcccccaataataaatatctccccaaatgcaaagctgaatgtttcattagcctcctaaggggcatattagcatataaaag

SEQ ID NO: 52850 - DNA, 911 bp, Bovine  19866881394552
ttttgaaagtaaaagagtagaattcttttataatgccggaatgacacagtccttgaaaactgagtagaaatatgtgatacatttaattttaaattgtctttaaagattatatccattctatcattgttttgacattatgataatattgagtaaacacagtcttattcaaatttagtaaaacatcacagggaacttctctagaggtctctgtgagtaatgttagttgtctattcttcatacacacaattaatcagaattccttcactaagcagctctactatcttcagtaaaaatcaagcaactctcctctgccaaccccaatctcacatcttatttatgctcatttctacttctcttttggagaaggcaatggcaccccactccagtactcttgtctggaaaatcccatggatggaagagcctggtaggctgcagtccatggggtcgctaagagtcggacacgactgagtgacttcactttcacttttcactttatttcattggagaaggaaatggcaacccactcccggtgttcttgcctggagaatcccagggacgggggagcctggtgggctgccgtctctagggttgcacagagtcagacgcgactgaagcgacttagcagtagctacttctctttataatctccgtttcaggcccatatacttagggtattccctggtagctcagttggtaaagaatctgcctgcagtgcaggagacccggcttcaatccctgggttgggatgatctcctggagaaggaaatggcaatacactccagttttcttgcctggaaaatcccatggtcagaggagcctggcgggctacagtccgtggggtcgtaagagtcggatatggcttagtgactaaaccaccaccatctaacacttaaactttctaaaatagagca

SEQ ID NO: 52851 - DNA, 1295 bp, Bovine  19866880515423
cgtttttctccttcttagcacttaaaacctcattagtttttattcatgtgtgcttttactatataatatttatttccccattataatttaagaaccgtgaagatagtaatcatctcactattatgtaccaaacacccagcacaaagccaaacacataggtgcagcataaatatttgttaaaaagatgaatacattgactgaaaaatcgtcaaaagaaactccataagcagaactatagaggatgctataatgccagctctatggaggcaagcacattttgttttttaccataatattcatttgtctaagggcattttgacattttatatgtgtttaatatttgctgaaaaatacgggagaatttagaaggcaacactttaattttgaatagcagcatcaatgttgggatctacttccaagataaataaaattgaactattttttcttccatatgcatgagtagagacacttcattttttatgaaatccctgctcagtatattcactgtcttatcagccagtgaataaaaggggtaacaagaggttttttttttgggtcactgtataagataatgtaatcaagataatgaagaaggctgaaataactgaaaaatcaaggaacacagtaataaatggactaaccattataatgactttcatagaaaagaaagaaaagcactcatatttaaaactttgattgtaagtaacaaaaggaaaaatcagaatttttttaaaaagtatacacttgatggtgtaaagcttttatacagattggttttctgtcatttgatataatagttatcaaaccataaaactttactacagtagttctggcatttattttttctcaaagtctacgctttatcctaacttctcctatcccatgtatttctttctactctctccacgagatgatagaaaagacttctaaaataactgctgcattttggacaatttacaacagagggggctaaaaagtgaacatcatgagatgcaaaataatcatctatagactaggttttacctttcaaatagtaaacaactctcaatctgatcatattttagaaaggattaaaggaatacattttatataattatgtgcccctccaattctatatgtttcataaataaatataaataggggttggaaacaattcacataaaaacatgagctaagtaataatctttaaaaaagggaaatttaatcctaattaagctacacatatcttattgtgatgttcggtgctgtgctgcactcagttgggtccacctctttgcaaccccacggattataac

SEQ ID NO: 52852 - DNA, 1041 bp, Bovine  19866880584950
ataaatttccattattatgtcattttttagtttatgctcaagataaaagaaaattctaatttattatcttgctatttgaacatcaattttgtgtttttcaaagattttttttcttttttgatgtggacaatttttaaagtctttattaaatttgttacagtattgcttctactttatgatttgttctttttggctccaaggcatgtgagacattagctcccccaaccagggattgatcccacacccccatatgctgcaggctttgaaggcaacgtctccaccactggaccactagggaagtccctggattttgtatttttttctaatcagctatcaccacatagctatttattttctaaatatgacaggctatttcttagaattgtacattgaaataggactttttctggtatgttttttaaggcaagcagctagataacagatattatgaataatgcaaatatattttaaattaaactagaggttatttttcacgtatagaattttatgtaattgaaaatcacatatatgcatatatacatccatccctaatatatatagaaatgtatataaatacacacatagacatttatcaaaaacactgtacatgtcaatacacagacattctctaactgatttttcaattctatgaaaacttgattatctgtttttgtgagtggttttgcacttgaagtgtccacttgatctgtaaaaatttataatgagtttacagatcttgccctgaaaagtgaaaggttgagtacaaatgaagaaaagatgctctcaaaatgacaaatttagtaaatgactgaatttttaatactctatagtagaatgaaaacaagtatgagatacgtttaaatcttataatcaaagtgtttgaattttcagttaaactttaaaataacaaaccaaacaacttcatgcagcacatcctatggtgagaaaattgactccattagacagtgggagccacttaagattacccaattagatatggacaggtggtgagtatgtcattcacccagatggagaaattca

SEQ ID NO: 52853 - DNA, 1476 bp, Bovine  19866880600512
ttttgaaatctttattaaatcttcatctcatcacagagaccatatagcccaacagtgttttcttttaatggtatttgttatagtaatttgaggatgtattgatgttactattatgccaaatatttatatttttatatttaaatttattctgttaatttatttttttctgacttcactttcttaaaccttttcattggtgaatgactatcatgttaacagatttgctaaatactagatgaaaagcttcgcaggtggctcagtgggtagtgaacctgcctgcaatccagaatacaccagagatgtgggttcaattcctaagtcacgaagatcccctggaggagggcacagcaacacacttaagtattcttgcctgcagaatcccatggacagaggagcctgcatggttcttcagtccttggggtcgcagagtctgacatgactgaagcgactgagcacagcacacagagcacagaggaaaacaacacttaatgataaagtatttaccttttctttttgttttcttattggaacgcactgccttcactcagcccccagacttcctcctcaagtactgccaagctgtatattcaatatactttgtggtagtgccagttcttagccagtcatgtatgtgtgtgtttgtatttctaattagttatatttttgtatctatgtctttttaagttaagagtctgggttaatgattctccctacttaaatatctgtaatttatttcattttttgacattttattttatagatatattatttcattttttgccctcttattacatttatatttaactctcctaagattattgtattattttaatttcaagagcagtaaattaaattcttaggttttgaatttattggatgcccatcttagggccaatttcttcacttgttttggaattttgcagtctctcatttttggatatcacattttctgtcttattttcttcttcttggcacctttggggccctgtctagaattaggtttgataatggcatctcagattgtctaaaaagtagattagagaatcagagaggtagcaatcggatcgtggttcaaatcatgaccttaatcgtcttctctgcttcctttcctatgtaagaacactgatgttctgtagcagctttttggttaacatccatataaaatcaggaggataccaagtcaaaaccctagcaagtaaatgaaatggaacacctttcattacgcatttgagccatattccctattttcttggctaattctgattcaataggatatatattaagattttcacccaggctcaccactttggttttgggctcttctttttccttcttctattgttcttaatttttcaatatttttgttataatatctctttattttatatctctcattgctacatgctcagaaccaaggaaaggctaaaaaacatgaacttcaacaccaccatgactaaaataatatttatggtattt

SEQ ID NO: 52854 - DNA, 742 bp, Bovine  19866880699263
ctgagtaaaatataaataaagaaaataaggctgggctttctctcctccctccccaccccgcctccccacctgctttttcctctaccttcctcattgatatacctggtttacagatgcaaataaattcatttggtaattctataaatttggcaggccaggcctgggttttattctacattttaaaaagtgtttattttacacactaccccacctcactgttccataaaaggtaatcctattatcctatttactggcctcatttctggaaagactaacctggaataatgtttaatgctttaattttccaaaactctccaaacacaatctgttacttaaaatcttttatttgctaaagctaaagttaaggaaataaaaaaagtgcattaatgattctgaaaaagtgataggatgtaaagcatattggaaactttgctaatatggggcatcaaggaccagtttcagagattagcaccatgtttccaattctaattcctataaactactatgcagtaaacaaccagagctaaaattcccaaacctatgcaatcattctcactctttatgaaattaaaattttgccaaaagcagctgaggtaaccactagggtaacaaatgtgtagctgactagaggattaaatttgatgacaattcaaaaataactgacatcaagctacatatattatcacaaaacacagtaccagcattgtcagtttccagtgtgagttttaatactggaagggat

SEQ ID NO: 52855 - DNA, 2831 bp, Bovine  19866881181272
ttttttgttgtagttggcatgggctcagttggatccccccagcatatatatgttgaagtcctaaccctcagtacatcagaatgtgcctatatttggagatagcatgtttaaagaggtcatcaagtgaaaagaagatcattaggtaaagccctaatcttctgaatgatgtctttataggaggcatcagaagaaatcaactttaaagatattttgatctcagacttctactctccataattgtgagaaaatatagttctgctgcataagccacccagtctgaggtactctgttgtggccccctaggacactagtacatctgtaataaaaagcttgctattttgaggtttactggtaactactttcgatgtaattggtccaagtatctctgtgtactcctaaactatgaagtttcagtaactgcagtcagttgtatgcacaggatttgaaacctataagattatctattccatgaattagaagatttccatatctgacacaaaataagtttattctcttttgtaaatcaatgatacctacttttagagattatgtgaaaatgaagaaaggtatttgtagaaacaccatataatcaatagtcaatattatactgagctgatttgaaaaagataccttcctacttaccaagactacttaatcaataaatgaaaaatatcaatggaaatgttaacagattcttttatacaggaaattcattgtacgatagtgtagaaagctgaaagaagttgataccaaaaaatattatatataataatatgtccaaggaacaataagagactttagactttttttagactgagagtcatgtgataggtactattaggacctatagattaggtcatcagaagttaaattggggaggcataaatgaaaaaattagaaattatttgggagaaaatatgcttctaaggagaatacatgctgaaaggagtgcttaaaaaaagatttgtctgacaatgcaggctattcattccttaatattttagtttaatgcttgtaaatcaaggataatgaaatatgacttatggggaaattgagaggattaattacagatgctaatgtttgtaaagagctttaagaaaatgttgaattcaaagtcttattgcatctcagttcacagtatttgcattcttcctcttgtgaatttctattcatattttctgaagctactttagattgaactctaataaaagtagtttctgaaagcatttaatgaaaaagaggcacctgagaagagcaattggcagtgtctgaccacctcagtagaagaaaggccggattcccaaaatgaaaggtcattagtatgggtttctaagagaaaacagacagccttctactgttttcctcactagttatcctcttctgacctcttcactttttcattctcagattccagatactctcaggtcaatccatatgataaataataattaaccatagaggtaatccataaatgattaagggatcaaaactgctcactaaatagttgatataaatttgattacaatgaaagttccacattcttttggaatgaacaaataatttttacaaggcaattaaaaatgtaatatataaactgcccacgtgacaaatttctcatatacaaattacacaaaggccctagaaaatcagtaatctcttcatgaattttgtttcattgtcatatatcatttttactaagtgtcctctgggagtgcagaaacttacatcccagctctgttgcttaatcactgttactattagtaatgaaattcctttatgcaactaatatgaagatatagtatttgtcaggcactattcttggcatgtctgattgtgactggataagtgagactaaaataaaaatataaattttttcatctttatatgtatctcttattttttatatgtttctattgcatgtatgacaaaatgtattaaaactaaattccatacaatcattcttgcccccaataagtcatttttcttggaaatatcatctttcacatcatagactgtgctaaccaaactctctgaatgcatttagtctctctactcttgccttttcatcattagcttgtatcaaaaagtcatcctttatattccatctctaattcccactaatgtaattaatcaaggccctaaatcaggcataactatatcaagtcacttgtccactttgctttctttccttcatctctcatttgctcagtctgcatcacctgtgatttttgttaaatttaaagaacaatagtatggtgacattcagttctgagtttcacaaaaaattcctcattctgtgaccttgctcagatcagatcagtcgttcagttgtgtccgactctttgcgaccccatgaatcgcagcacgccaggcctccctgtccatcaccaactcccggacttcactcagactcatgtccattgagtcagtgatgccatccagccatctcatcctctgtcgttcccttctcctcctgccccaaatccctcccagcatcagagtcttttccaatgagtcaactcttcgcatgaggtggccaaagtactggagtttcagctttagcatcattccttccaaatgtcacttaaaaacattaagttttagtgtcatcaacttggaatggaagagattttaccaagatagcactattttctcccttaccataaacatttttgaagctgctcttttttaaacatctatactggattcatgatatatatttttttaatttactttttgcctcagctttttttttcccactactccatcactgtgttcttgatctaagaagcaggttaactagtttaagagctccttccccttaatcattt

SEQ ID NO: 52856 - DNA, 1096 bp, Bovine  19866881214184
gcagaggaagatgaatgtctcagctcaaggagagagagctaattcacccttcctctgcctttttgttttatccaagccctcagtggtttgaatgatgcccacccacactgaggaaggctatcttttttacttagtctactgattaggatgataatctcttctaggaacactcccacagacacatccagagttaatgtttccccagcaatctgggcatgccttagcctagtcaagacgatacataaaattaaccctcacagagcccaaggacattctctgagtttgaattgagatttgactgaaagccatgtatctagattgatgctttgttggtctttccactttactattgtaccagagtataagcagattgatggtgaggggatgctctctcttattccaacattcaaatttagtatgtgaaacttgctactttttcctaatcaagtctctaaaataagtagaaagttgtaagtataatttctttgaattgactatcaccttcacaacatgtgatatgagatgcctttgcccggtaggaaaatgtcaagaattcataatcattttcatgttcttgtcacctttgttatccatcaattgaggcattgtcatctcctcagcaatgtcaatccctctttttctagcaacactacaactgtaactttcccaacagacatcttagaaaattcacatacttgctgagttttagacagagtaacttgaaatcctgagtgtcaggaataagaaacattctaaaacataggggtggacaaaaaacacctgatatgctttaataacattgttttgaatagctgcacatcttaagaaaactgtggagactggcagaagcaggagtctaaaatgctgaatggagaccagctcctttggatcaggagctggattaggatccagctcctttggatcaatatctcctgctgatattgattcagctaaatagccagacacatatttcaaatcttcaaagacttgggaggtagatgaccctaaattattttaactaatgttcatttgacattcagtacatcttaacccttcttgcacttacaacaataaatccatacaacaaccatacatt

SEQ ID NO: 52857 - DNA, 1385 bp, Bovine  19866881487389
ctctgagcttaactctttgtttgtatataaaataaggaagggattcttgtaaaatgatttttactccctctggaaagaacaaagttattgggtaataggttatccttcagccagcatcagcacaactataaatctacagtgtatgaaatcaacaaaattcattacttgccattgaatatgaagcttagaaatctccatggagaaaaatatcaactatatgtacctgttctttgagacatttttctcattttgtaagcattttatgtgaaacaattttgtctattactgaatttatctttataggaatgctataggtttgctgctgctgctgctgctaagtcacttcagtcgtgtccaactctgtgtgaccccatagacggcagcctgctaggctcccctgtccctgggattctccaggcacgaacactggagtgggttgccatttccttctccaatgcatgaaagtgaaaagtgaaagggaagtcactcagtgtgtctgactcttagcgaccccatggactgcagcctaccaggcttctccgtccatgaaattttccaggcaagagtactggaatggggtgccattgccttctccgctataggtttgcaataagtattaaatgaaaaacaatcagaagagacatgaagcaaaatctcactttaatttgaaaacaggatatctgacaaacaatggttttattaggtaacaaggtacatcagaaaaagcttttaaattataatatattttgtgaatagaattagtatggtgctttgctccttatacttggatatttccctcacattatatctaaagaaaacagtatcaaaatataactcttcatattctaactcaaaagtattacttatttcatgaaactgcataaatgattcttaacaggatgactgttacttttgcattatggttgtgattctaatctacatagatgaaaatattattttaaaaatatgccatataaagccatctgatcatttataggcttcagaatgaaaagaagcagacatgacagtttctgtgagaatatagtctgtaaaccatataaaattatttggtccaaatgaaatgttatggttaatatatgaacaaaaatctactaatgtttgagtgttaatttatcagccatgatttgactacaaaggtaaaaactttagcaacataaactactggataggaaagaccttgataaatagtagagataagaaattcagaaataactgcaatataagaagtaattatgagaatgaagatgatggtaacattggataatgatgtctcttaaaataaatgtcattaaattctttaaaacttatgtacttttaaacttgtaggcagaaacatttttttaattaatttatttttaattgga

SEQ ID NO: 52858 - DNA, 1253 bp, Bovine  19866882032629
cataaacagcatgggtttgattgaatcaacttaaagaattacacagcagtcaatgggctcatcagcaggagtgaaaaattcacgtaccacctacaaacagcttgaaatctgtatccttcaattaggcgtagcaaacaatcttttagcacattccagaaaggtgactcttttcccagaaggaaagcgtgctgctacaccagagggatatgctattagttataactagtgcagctgtcatccagtttgatatatttaacaaatatcatatcttcattattaataactgtgtcttctgtactcaaaatttgattgtaaacatgaaaatgtacttctctttttatttaaaaatcttgaattatcaagatgcaatcttaaaatacaataatgtaaactaatacatgtacggaggcagtggtggtttaagataatcatgaactaactgaagtaattgttgtgtgtctgcttactctagcaagaagctgcgaatatatatatatatttacagctacagctaaataaagctaatagagacagataaaccagagatttctaaaaaagataataatactccaaatttctaattcactctccttttaataatcctgtagtctgactatgattaatagaattgtttggaggggaagagatttttaatataattttcaccacaaaatctgagcgaagacaatcatagattcagtgagaaaaaacagggtaaatcagtatgcatgaattttcaagtaaaaaataaaataaatcacaataatctgagcatttccatttcactagcacaaagctttatacattttgatttctagacttgtaaagaatgtgttcccttaatcatatctggtttaaaaagctatagaatttagatgcaaataaagaactgttagattcttctttcccaacgtcatctaaactgaatctattccagtctttatcctcatacatactcagtttcatgatgccatgagctggattgccatgagaaaactctgtcctagagtaagtgttcagttaatgttagaattaatatctttcagatttcatatcaaactaatttaggatcattaatttcatgattggtgttgtttagtcgctaagttgtgttcgactctttcacaaccccatggatcaaacatatatctcctaaattagcaggtggattctttactaaagtacctgggaagcccaatttcattattacaagtatataataactcattccaaactcctaggggccatatata

SEQ ID NO: 52859 - DNA, 2123 bp, Bovine  19866880388673
agggagagggggaggagaagaggaggggaaggggaagggggaagaaaagaagtggtggccccagaaaggatttttgtttaagtttccccaggcacactgagcattcccaagttatttgcagacagtttcatctggtttctgtttgaggagaagagagaatgggatgatccgtaaggagatgggcccggcagaggggggagaacgggacagggaaaaagatagggggagtgcgtttttcctaaagctggaaacatggaagttttctgatcctaccgtgagaaaacaaattctctgagagatcagggctcaccttttggaggtggataacacttttcaggacacgggaggaccatagagcaaattacttctcctcgagtgctaaatgattccctggtgccctggaaagagcccgtttacctccgaaaggtgaattgtttattgctggcaagtagaatattggctgtaatgctggctcatccatcctcttgcatccctgtgaggtattcagggtggaggtgatgctatccacctgtcactgcaggaagagggctgacagatgcctttctgactcctgttcctggggtttgaattgtcagggaaggaggggaagtgacttttccaaggtcttagagtgagtgagccactgacggaggtggaattagatttctgtcccagttacaatgcacttgttactgggagaaacaagtgtcttaactctgatatggagcctcatggagaaaggctggtaggagaaatacctcggccagctcttaggaagggagaggccaaaaggaggatgcttctgtggttgtcccaacctcattaggttttttcctcttagtgctttgggtctctgggctgtctgctcatttgtactgtctgtctcatgcattcctacccgtggttcccagtggtcaccatctcccatgcctccaaggtcaggtatatggctgagttcaggtaaacaagcatggggcgggggcgggggtggtgtgtgtgtgtgaaaaatgaggcctgagttggtgaggaggaagttaaaattgtgagatgccatttttggtgagccttaatgcagaagacagcagtgtgaaatcctgcttgatgttatggccagagatctgttgctttttttttttcctttttgatctattgctttttgctcccctaaatcttcaaaatcatagtgaactctgtgactcctgaaagcagatgctgtcacctagcccttcacagtttggatgatggagggaattgggaattccttctgttggggtgaatagggaatggatctaaggcgtcagggcacttgggttctgtttgtccttctggctgtggatttattataataaattaatggcttccaggtggtgtagtggtaaagaatctgccttccagggcaggagacacaagagatgcgggtttgattcctgggtcggaaagatcccctggagtaggaaatggcaacccactccagtgttcttgcctggaaaaattccatggacagaggaacctggtgggctgcatgactgaggtcacaacgagtcagacaaccaagcacaaaggggagagagaagccaaataaagtataaaaaagattctttgtggcgatgttgaggtttggtgatattaaaaacttctagtacatgattattattcaggttttatgtgccacaaattatgcatagtgtttctgttcatgtatgttatttcattttaaagtatatgacaatcttatgaggtggaagtaattaacaaataaggaaattgaggcacagggtgatgaaaaataacttgcctaacattagtaaatagttatttgcattatcacggaaatacagtgcatttccagtgattttttttctttttcttttttttttaatagaatagctgtgttcacagagagttttagaatcaaaggactatgttattcacgagagttctggataacttggatactgattcattgcaggctaagttgagtgaaagcttaccttttcacagattaacaaagggggggtgcgtgctttctaactatattaatcacatgatagtgttcatgggaatatttatcctgcttagcagaatagactttccaaagatgtagctgtggcatctgcatccag

SEQ ID NO: 52860 - DNA, 1251 bp, Bovine  19866880454922
gaaaaacaactgattaatactcttcacaggtaattatattttgagagagtcgtgaaatcacctgctaacgctttcttctccaggcaaaagagtctctcttaacctctatcttccttcctcagacctacattagactgttaattgcgctggtcttttgcccaacgagctctggaggttggccatgccctttcagacatgcaagacaaagatctaaatgagatatgaactttccttcctattttgtttcaattttacatttacttttttattaccaatatttaatgtagaaaatttggagaatgcaacaaaatcacacagaagaaaattactgttaactttatgcttggcagcctcctagcattttgtgtataagtatgttttgtgtgggtgtacaaaagttaggatcatatggaacacatcattttgtaacctacttattttactaaaaatatattatgaatattttccatatcattaaacattcttctcaaacataagtttaatagctgcataagagcttgttactgggaaagtccataatttatttaatcagtctctactgtataacatttaagcttttttcttttttatcactattattaataacaccatggtaaacatcatagtacagaaaattcagtgcatattttgcattatttccttgaacaaattctaagaaatggagttgctggatcaaaggatatgacaaaatctaaggcctttgtgatgtacggtaaacttttctcctggaaatgcctattaatttatggttcccacaagcatttttgatcctttccatttcctcatattctcagtaacaatgttttagcagtctttcagtctttgtcgattatcacattatacaatgacatctcatttttagattaatttaatttgtatctctttgatttactaatgattgaacatttttcatttgtataagcagggtgacagtatacagccttgatggactccttccgcaatatggaacaagtctgttattccatgttcagttctaactgttgcttcttgacctgcatactgatttctcaggagtctggtattcccatctctttaagaattttccatactttgttgagatccagacagtcaaaggctttggtgtagtcagtaaagcaagaagtggatgttttcctggaactctcttgctttttctatgatccaacgaatgttggcagttggtctcttgttcctctgctttttctaaatctacgttgaacatctggatag

SEQ ID NO: 52861 - DNA, 641 bp, Bovine  19866880477585
tcttccactgtctaacacaggagattctggttctgagggtcttgggctatgcatgtgtgccgcgacgaggcccggaccagtaaacaacacggcatggacagatctctgcccaaaaggagcaggatctgaaggtaccactataaagacaggtgttgggattcactgatacggaaggctgttcagctagagagttaaaaaaaatcccaccaacattaaataaataaatgaaaaggccaatacgtctaagccaaagtgacgctacctatttactgcttgaagccagcactctgccaaataggagacaaaatgattatttaaaagctcctttttttatctctgtggcaccatgcaagtctcaaatgaacctttcaccaggacaccagagatgttaacactcatcctccaagatccaatttcaaccagcggagctgttacctaatccagcaaccatcacatgtgatcaggttcctgctcccctgatgggagccccgcagcctccctcgcctcctcccctctttgctccccagcccaacagcttttactcaggtttaaagggaaaaaaaccctgtttatgccagtacatacaggattttaatactgagatttgtacacttccattaccaaaaataaaatcaactgca

SEQ ID NO: 52862 - DNA, 988 bp, Bovine  19866880479937
tgagtcgtattccctaagggcctgtcaatttgtaaactgaaagataaaaaagacaacctggaaattgcaaaggcaaggtgcccaggatgagagagccagggaaaatcattacccttagcaggaagaacacttggccaaaagatttggatcttatccactgacggaccttccccaagtcactttacctctgtgtctcagctactcatgcataataataatatgcaggacatatgcatcacatatctctggagaaggaaatggcaacccactccagtattcttgcctggaaaatcccattgacagaggaggctggcaggttacagtccatggggccgcaaaaaagttggacacgacttagcgactaaacaacaactaaagtactaaacaacaacgacttagcgactaaacatgttgtttagtcgcttatattaaagtcgtatatattaaaatatcacatatataatacgaataataataaccattgccctacttccttcatagatatgttgtagaactgcaacgctataatgaagatgagatttcttgtcacatataaagaactatgccaatgggaaacattttggtaattagcacactaccatgagtgtggcctgtgcctccagggcaagaaccaaatacaattcctctctgtggccctagcacttgtcaactgaatgaaagagaaagagaagtatgaggagatgggtagacatagttcacggtatgcggaagtcagcgcacaacaaaatctcataaaatgtaagctgacttttcaatttagtatcttaatcttctctacccttgacaacttcctcctctcttgacaagagaaaacgggttcactggttgatgtcagatctgtattcacagaagagctattctataccacctgcatctctgcccaccatccctcaccccaaggtcttccagtgcaacctgccttcactagtaggtgaaggaccacacccaaagcaggcttttgtgtttg

SEQ ID NO: 52863 - DNA, 1371 bp, Bovine  19866880609729
gagcccatatattagagtatgccacggatcatttcagcaaaaatcaaccagcactcttctgacctggggcaaaaaattccctcattgagatcctgaaaaataacattacatcatgttgcccgtgtcaagtttataaatgggccaaggggaggctggggtgtaacctgacactatcaaaacacaagccctcagagaagaaagaaggccattgttgcaggctgtcagccctcctcttgctggaggtaaagtgagatgcaagaaatgtaagtgggaggccatgcatagccttgttccctatctcctaagaaatcaggcagactccctgcaaaacggggctgtccccacttcctatgaggtatgtcgccttcctttctgatggtggatgagcttagtaagttttattcctaggccccaaagcaaagaagcatttaggtaagatagtgaagtccaggggccgctttttttttggtggggggaagggagcgcaggactcacatctctttaacagacaatccaggggaaacagagtcccagtgagtgtgtgtccacaaaagtaacacaaacatgtggatatggccagaagttagagaaaaaatactgaccccaagaaaggtcaagtgaatatccaatcataaagcaagaaatcctgaaatgtgaaaaaggaaaaaaaggcatttcaaagtgaaggacgggggttcggagcaggagacaataaagagacaaaaaaaaaaagaatgtggggaggattatagagctgagacagacacagaaccagccaaaagacaaagtgttggcacgaagattaaaaacagtttaatggataaaagaagcaaaggatttatggtgagagaaagctcagaaaatagaaagcgagacaaatgtaagccagcctgagtggagacagaattctgctggtcgaacatttcatttgattttctctttcctttcttcccagctcagcctggaagcgccgggaagcatgcaaatgtgctaccgcggcagaaggctgtggtcgtccaggacaacgggcctacgggccaccggtgaaccggagaaggcgaggacacggcgcccaaccgatcacttgtatttctgctggttttctgcttgcttccaccaaattgttgctaatcctatcatcactctaccaggaatttaacctcttacaaaagttctccccacccacccccagtgccttctgggcttaattcaccatcaattaagaaatcaggccacggggaccactgggttcccgattgctaaactctgcttttatgttaaccccaccccattttctttggaacacaacaggcaccccctcaactaaactgaaatggtgccccatggctcaagtgcaccgcccttcaaaag

SEQ ID NO: 52864 - DNA, 1556 bp, Bovine  19866880611348
tgactccaacctaactatttttgaatgcactgccccaactcctctctattaccatcaatttccccccaccactaccctggaacaggactgctctctgcctccaagaccaaacagtgactgtagtagagcattcaatattttaattatgttcaatattgaactgtcacacccggcgtgagctcaacaaattgaaaagactgcttttttaggccttgtgagaaaagacttgggtatgttttgcctttccccccctttaagagtttctaactcagtaccaggaacataccaggtgctgaatagaagcctcttctcagagccgcactgcaacctgccttcatgcctttctcgctggtaagattcttgctgctggcgcctaggtgcagctccttgggccctgctgtctctgcacatgaggccttgagctaaattaccttatttttcaatatttaggtttcatattctgttcaaggggctaaggatcttattatttattaaactcacaggagtcttatgtgactgcatgtttatgaaaggttctgagggcccgaatgaatgatgctatacatgtacacagccccactgcctcttacatacagatccacgggtgatgtgctcagagtcatacatataaaaacacgacttggcagtcacgacacacaccattttcttatgatccaaaaacatcttgctggcataattcataagaatttctttatatttaatgacccaaatatgccagtcatgtgcctctgagaagcaagttagaatgaacaaaatagcaattttgttctaaccccctccccccaaataatctctctgccttggattttgacctctctgaatgcgtgttctctgaagccgagaagagggcaaccagcccttgtgggaggtcatttcatggggaagtgaagagaagagtcttggaatacaaagggccttggcaatgtgagttataggcccaaaggcccagatttttaacagactgacagaattcatgctttcaggcgaagagttgatcctggtccggatttctgagtcagaggaacagcatcagataattcacagacttggaaagaaaacatcagccccccagttcagcttcttgtgtttaaggcctgagatcatgaagcaaaagcagacctctgtctacattgaatttatccatttattgagtttctactatgatccaggtattatttaggcactagaatatagcaggaaacaagttagatgaagtccccagtcatgatccccctataagtttcctctctatcttcaggaaaaatgaaaagatcccatagcaatcctctggagagggttccccaatgaccctgctgctgagaatctcaaagtcaaaggactcacagatcactaagccttcctaaggctccataaacaaccaactgcaaagaaaacaagtaacaattctgtgactgaaattgggcctctgccgtactgaaagattctccagcagaactaccaaagacaccatcatcatttctcactgcttttcctaaaagagatttaagagtagaaggctaagaacaggcacacaa

SEQ ID NO: 52865 - DNA, 1343 bp, Bovine  19866880699852
atacattagatggggttctggcaaaagttggtgtctatcaaattaggtgccagattcattaggatagaacatagagtagtcatttttgttcctaaaatgatttgttcccaaataccttgaatttgtgttttgaaagtccagattttcttaattagaaaatttgctgcaagtctgtcctaatttgatattccattagcctcctctcccatgatgttgcacgttgaccctgctgctgacttaggcttccccaggtggaattaaatgttacatcaagtcttgctgcccaggtcacaggctacagaattaacctgaagaactgggtgtaaatgtgaactctctcccattagaggttttgggataaaaagggcatatttggctttgcagattcctgtccctgtcacccattagggtggtttctgacatcagcattttacaaagtgagtgtgtccatttaaaggctagtttgcatcagagtgaaggaggaatttaggtgcagaaggaaaattgaagcgaaagtcttattttcccacccccatccaccccatgttcgttaatgagaccatcttccaatttcactgtgcccagagataaataaactcacaaaggcgggtttcctacttaatattcacccacagtggaagaagagggaaggaattgctccccggggttaacgtggcagaaagcgaggtcagctgtttcccaagacggtgcagcctctgaacgtcttacattaaaggcggaatgatacagctgaggcagccaaagtgatttatggaaaacccagttaggggaggtttgctcgcagtttctgttcttatggaggtttaacagcaatagcagatgatacaccatggtagaaagcaccttcagagacaagcatcctccagcatttccctgtgtgagactcgttctttttaaaaagtacttttgttcaccaaacttgaaactcataggctacagtgtcctggatttggcaagaagttgaggatcatagctgataaccctggggtagggtgatctgggactccacgccccctagtccattacatccctgagtcctgggcacactggagctgttgatcaccccatcggaggtgtgtgtgtatacatatgtgtctatatctgtgtgtttgtgaatggagggggagtgaaaaaatgacagttaaagagattcattttatttctttatttttaataaggcttttttaaggtcttacatatttttctttaccagaccaactctcataattacaatgctagttttggtatcagcctgaactaattcctgtctccaccatttgtgagttttctgtcccctctggcatcctgtgcactggtctgag

SEQ ID NO: 52866 - DNA, 1835 bp, Bovine  19866880793769
cccacatctccccatgcatttatccacacaccctatttgatcactttgattctattatcagctgatgcttctctttctcccaccagtctgcagacttctctcatttctggtcgagtctcccccagctgaaataggatccagtagagagtagatactcagcatatgtttgttgagtgaatgcttgaccaagagaccatcctgggtccttgtcggggtggcagtgttggtgaaattgtgcaggccagcaacactttgtgcaggctaagagatttttattttgacggagctgtaaggctgtcactaaacataagtggacatgactagtctggcacagtcagagtgccactggaaagcaagcagcctggaaagaaaaaagcaaagttggcttctgagattactctgtgtctgttaccccaaagaacatgagcccctgtgagggttccgatgaactggggacagccggggtcttctctctgtcctgccgggacttactgggcagtcagccctctgcagcagtgtcctcagcaaaacagatgcaatttgccagtgacgtaccatcactaaggggcctgagaaagggccacgctaacatccgcctggtggaacagttgagagatattttgtgggttggagagatgtcagctcattcagtggaggaggaaacaagatacctcttcagataaatatagtaagaatcacagtaaataaggcccagcctcagggaggcagatctttaaaggaaaattaagatccccatcatctgtctctctgtcaaccattgatgtatttagtgagcgcctcatggagctaaatgctttttgatgaggatagttgtgatgaccaccttacctccccacagggggagggctccttctgcgtgagagttcttggtgaggggttgtgggcggggctctatctctggcacacagaaagaaagaatggtccagggaaaccttctctcccctttcccaaatgtcctggttttaccaggatgtaaacacaagcagaggcaaataccgacaagcaaaagcccgactgaaaatcggagcctaatcgttcccatctgctccagtgctgcttcccctttctgcctgccaggatgtgtgctgcagacgctaagtagcacattattttcgataagttgcaatcatttacttgaaatctacttctcctttaagatgtccccctggaaacttgaatcggcatttgagaagcccttttcagggtggaatttgaatgcttgcactcaagttcaagaaaagttaagcctatttgatggacaggtgttttatgtttttgagatttcagccacatggaccctagtgggaagaggggacactgtggagcacagcctgggagctcagagccaccatgcagctcattccctaaggaaaggcacaggtgctgagatgggaaggactggaaatgatggctccatggattcttacctgaggcagaaacatcacaagccaaggcctctcttggtccccctgcgatgtttccctgttatgctgagacaggactggtagtgactgaggtgggttttgcaacctggagcccatcgtctcaatgccctgccctcatgccaccagcacttcttgttcagcaccttcattctcttgcccaggatgagactctagacatagcaagcatcctgtcctcccatccagccttctctcagtcaaagacttaatgctttctgaggcccaaactcaggaacgtttgaacagcagcaaaaacctcgtgcctctcctgccgcctttttgccggcagattctgcagccccccggtgtctgagaatgacttctggtgactcattagcaccaagacctgtg

SEQ ID NO: 52867 - DNA, 1775 bp, Bovine  19866880799137
gcaagaatattgaagtggggttgccatttcaaacccttttccaggaaatcttcccccacccaggtattgaacctgggtctcctgcattgcaggtggattctttatcatttgaggcaccaggggagccacacatcccaccgaccgcccccaccccgacacaaaacctctcttttcccccacaaacacctgggcaccccaaacccttcccactccccccagctgccgactggctgtatttttcactccaccctcaccccgcaccccatccctgagggacaaatatgctaaattgcttgcctacacgaaagggctctagccttggaggggagctctctaggcacctaatttctcttagatttctttctgtcctcagaggtccccaaaggtacttgtagaatgtttgcccttaaacggttgtaaattagggactgagagtatgaagcattgatgaaggcttcgactggaaccagtctgcctccccaggctggcacatgtttagtcctgagaagttgtttctttgcaggccttgcgttccttagtatcaggtttcagctcccctttcttctctttcttcttttcttccacaacttgtttccctcccctaccttccttgtcttccatcttttccctttcttcctccaaacccactcttccccccactaagttttctaaaaggaaccactaaggatcagactgaaactaatgaggccagaaaagcagcgtttatttcttttcgaacataaggcaggggcaaaagagttcattctttttttttttttttctatttttcctttttactctttgtgtttgctttctttctttatcttgaagccaagttcagaatggatacttgcagaagagtggaattttgaatagctgcctaaggtaaacagaatgtggagaaagttcagctttgtcccatgcttgaaaaattaaaattagagaagaataatgtaactcaactcagacctcgagggacaggccagaggcagctaggggaccatcacagtgctaatatagttatacctgggtaagggagagtcacattttaagcagcttcattatgtgaaactatggatcatcagaaatatatccaaagatgcatgaagagatctttatgtaattcaatgcaataaatgcttttaagcagctgtatacaagttgtgcaaggtaatgaagtctttttagataacaaattcctgagtttgctcaaggtgtgatttccttgccctaaatccatttcttctccagtagggtacttttgacagattgtgtggagaatatctacatattcctcttcctgggatcagtgtttcctgtcacatctactcaaaggtcactttgaggtgctttttaatttagtcagtatgaactgttcccatgagagaataacatggtaattgtaaaaaaatatttttattttgtttatgtatctggctgtgccaaggcttagtttccgcacacagggttttcatcttcactgcagcgtgtgggactgctgtggcatgcgggctcttccttgactagggttgaacctgggctccctgcatggagagtgtggagtcttagccactggaccaccagggaaggtcccggtagtatagtaattttaagcacacactgtttcccagacatagtgtaaagccctttgttcattatttcactaaagcctgttatcatttccattttagaaatgaagaaactgagggttccagaagctatatgaatggcattagactgctcgaataaagctgctgatttcttatccaccagta

SEQ ID NO: 52868 - DNA, 2558 bp, Bovine  19866880801026
cctctgaatgaaagaaagcgctctgccatgcctatcagcctgtgacacctttagctcggaatgacctcctcagacacacacctagccctaaggaacacagtcctgtcttgggaacaggccttcgggagcaagtctgctgcccatgctacaaagatcatgaccatgattctgggcctacattgggctgtaggttccctgagggtaagggccattgctggcacatttgcatttctccgtgtctttcatgcctcaaacagagaagtgtcataaatatttgctacagcgacaaatgggccaaaatagaatgcaaactctgtaatttcatcatgtcctacaggaggtctaaaatgaaatgtctaactggtattgaaaaattaaacccaagcagggcaggaatttatttttaacttttttacttttcaacctgtgggaggtaagagtttggcccaatatctccagaaatgtctgtgttcaaaaatatgtgatcaaggacttccctggcagtccagtggctaagactctatgctcccaacacaggggttgcaggttccatctctggtcagggaactagatcccacatgccacagtaagagttcatataccacaactgaagatcctgcaggccacaatgaagacctggtgcagccaaataaataaatattttaaaaaatatatgtggtcaaacttacttcaaagcaatcaagcgttcatgactcttcacttatgaaggccaacattcaggaggtgacattagccaacgtaagtgagaagaagatatattcttgtgggatattggcaagacaacccatctttgcatacgttaagtccaaatggaagacactggggagattttctccttcgtgtaaacctctacaaagttaactgaaagttgtagttaccaagatattccagcctgaaatgcctaaaaagggaagagatagtatggtaaatgagtaggagggggcagtgtccaaatcagcaacagagagaaggtaattattttcattctttattatcctcatcattggtattagtattgctactcttatattttagctataatatctataacagtcagaaagaacatgtcaactctcaacctatataataacgcttccatcttctcccccagagttacaggggatgagaaacttatcctgtgaaattaataatgggcctcattcttcagctggtggatccaagactgggctagtagaaatttatagagagaattaattcaaagattttcaaagtaatgaaggaattcaacatttctgacttctcactctcccacattcactcaatagacagtttctggagggtctaattagaggacctgatgggtgccccgggaggctgtaacagagcaatgataggaaagcacaagaatccatttaagaataataatcacacatgaagaacatctttcgtagtgtaactttctacaaagaaaaataaagtaatatggcttaggcctgagcatgacgacagccccttcctgcctcggctccagcaggctaggtgggggaggggaggcaactgtgtgtatgggctagagggggggcaaaccaccaaaattaatcctttactttcagaagacttgcaaaaagaaagcagcttgaggcccctttaggccttcctctgagacaagacaatccaagcggccatatcagcaactaggtctgcaggaaggcctccaaccttcttcaagtgttaaagaaagaccaagcttgacaaaaacaaataccaatgctgtttaaaatacatcaaggttctttgggttaaaaatctccccaggggaagatgctccctgtaagagatgagagaaagaagatgggagggtttctgcaggaacttctgattatgttacttgattcatttcaataccataaagcatcaactagattatttaccgaatacagaggaaacgacaccgaggcaactaagcaggagctgcaaattaagatgtgtgcgtgtgagcgctggcacccgcagacactcacccacgtgcttgcacgctgccttctgaatttcacttctgtatgcaaaaccaccgccgccagtgtctgtactgctcggccactgtgcgtatggaaaatgcagcacagcccccacgcctggctccctggtgacagacctccacacccttgctcctcaccagaggctctgattgctgtggcaaggtgggtccaagcccggcctgggggggtatttaataaaagaaggatggttttctccctatgataggataggattgggtcctctcctatcaccctctcggggattagagagatgatgagggcagcccagaaaggaggtggctgggaagagagggagcctggggcgccaaagagaagaaaatccgtgaatacacaaccaagctcagctccgggaatgctcggcttccttggccgctcaagagcggccggcgccgggcttgggggctccaggccgcttctgcgcggggcggcggctcctggccagtgagcgcagccccgcggggctcattggaggcctccggccggcaggggaccggagccggcgggcgctccccagca

SEQ ID NO: 52869 - DNA, 2419 bp, Bovine  19866880949943
ttttgggctgaaacagaggaatggactctggctcacctactcgggaaggaatttactggacagatactcagtgccgcacagaatcacaggaagtctggggaaccaacctcggaaaaataagcccaggcagctgagaccacagccaaagcgctgccacgggacatcagctaggagacaggcactggacggctgactctggacacagaccagccactgccactacccccagttctgtcgctacctcggtcatactgtccgtagcacatggttccaatcagccaagtgtaagtgctcatgaccctgctcctgaagaaacggaaggtgtctgagaagtgtgcaggttctgcaaaagcccctcaacggcaagaggacattcttctcagattcagctcctgctttcccagtacaaatcccaacttcccttcagccactcaaaagagccctctttgttcagcaaggagtgtgacagaatagaaataaaatatacggtatattttccctcctgtataatgtggtttgggtattcaaggaaagtatagagttgcagttctcagagaactcaagcattaaaataaaggaaggagggctatattcctaaggagaaggtggcagagaaatgcatgttccaggcttagaattcaaaaccaaaagacctgtggacacagaatctccaatcatatttcaacaggaccttcacctgcctccaaacaagatgatatgaatcaacgtgtagcttcaagtccggacatatccctgggatgtggtttctagagctaaaaacaacacacctaatttccaactatcaggggaaagaaatatttccacactgtgttgatatcacgctggtcacaggtaggggtggaggggtggggatggaagccacactctctaagtgcctcctatccaccagccactggaaaacacaagagctaagtatgattgccactggtccttccgaaagccgtgatgaggcaattgtaaagtcgaggttaaaggccggagttctggaaatcagaatcttctgctacttagtaactgtgtgcacttgattggtgattcaacctctgcctcctttgtttcctcggtaatacaaagagcatagtaagagcctctaccctgaaaggatgtagtgagcattcaaacaaataatatgggtaaagtgattataacaagtacctagtatataggcactaatactggctgctattattattatcaggtagcttttaaaatccccattttactgatcaataatctgaggttgcagaggctaagtattctgtccaaggtcataaagtgggcccatatatgcagaaatgtagccgaactggagtgccaaactcagatttgactctaaaagccaatgttatttccgtgacaccacactgcatccacacgcctagaatgtcaaacacattcaagctgctgtccagagccaaaaccgtagttccactgctgtgaatgttgaggaactgtcacagcaattatctatattaatagatctctagtatttcagccctagcgattatctgtacttgttttggtcattcttagactggaattcccagaaacctttaaaaccacagcagataaaaagcagttttcaactggttgctctacacacaccaggctgatgagaacctttagaaacgacacgttcgctttcctggcctttgggcacagggtcacttttacaagtcagctaaatcatggctacaggattagagtgggtcatgaggtcgattggtcttttttgtttccaccagttctccttctgttcttcctttttcttatctgttatttgagaaataccacaaattctgaatgccactgtgtttaagagaaaaggggactgccctctgaatttttaggcctcccaatccacctctcacctgtcaccctctcctttctcccctagaatgtgccttctccctgctcccttctcccctagaatgtgcctgacagcagggcacaaatcccaacagccactgaagctgctggggggcgcctctgcaggggcgccttagcaggtgggcattcccaaagccaccggaatgatgggatggcaggtcaggaaggggaggggcacccggagtttgtgtaactctgggactatctgtccatcacctttcccgcacagcatgcaggctgcatgggcttaaccacagcggtcgataaagccacacagatcagagtgagtcaatgaaagacagcaagacaacaaatctaaccggggaaggaaaaggagtacctctttcctcaaccaccccatcaaagtaaaagcgagcctcctttctacttgagcagcacaaaaaagacgtaacgggcacactcctcatgctgaacagggaggtgtgatgtaaatgttcctacatcccacattccacagttcagaaccaactaaagttgttgttaacat

SEQ ID NO: 52870 - DNA, 1742 bp, Bovine  19866881129021
catcacctacttcatagggtttggggaaggataatcataataatagtagctaatatgagcttacagtttacttaccaagcactgttattttacattcattagttcttttaatcatccctgcaaaactgtaaaggctgtagtatcagtgtactcattatattgaccagtaaactgggcttagaagtattaagtaacttccctaaaagacccaggtagtaattcacagaatgaggatttgaacctaggttgaatgactacaacagctgagcccttaatcactgaaacaaagctttgtagcctcccaaatctttccgtgaaaatcaggaagctctcgtaaaactcccattcagattaatcgcctcctctaccatgttcctggaacaaaatatctgtagttttaataagcacatattttatgatttcaatcttttattcagccttttagtcatttgtttaaagtccttctttgttcactgaattataagcctttgaacacaggaactgtgcctacctatgtattttccctccaataccttctttatacataggtgttatgtatatttgtatatttcaatgttaatttgttggaaagaaattatatgaaaggctcaactttccctaaggggagttacctttggtaccttggggtcacttttgcctgtcaccaaaaggaaagactaaagtgtcaaggagtactataaacaacactaatgaaatgtgatcatttaaaataatgaaataatgtccgttagtctgatataatccttacctcacctcctcacccccaacacacaaatgtcataaaaacagaggtgatctttgctcagtcagtaagttgtttgtgacgttcagaattgaaccagataagaaataaagtattggaaaccagttcctctttgcctccaggtgtcacacatgctatatcccatttggtcttaacttttttctcacatcagtcccttcagttggaatgcaagccttgtgctgaagctgagctgtgctgtggtctgacttcctattggtggagagtgggtctgggcagttgaggtggacataagtgaatgccattattcgcacttgagacagagaaaagaaactccatgaccgcttgggtagcagcagagggagaaggtaagactcccatctctgaaggcctttaggtttaaagtgcatgattaacagatacacactactgctgtgtataatacagataaacaataaggacttactgtacagcacaagaaacaacatcctgtaacatcctatgatgggaaagaatttgaaaaaaactgtataaactgaagcactttgctgtacacctgaaactaacaaggcattgtgaatcaattactcgtcaatataaaacaaaaacaaaacaacagcaaagtgccttttagctgctcttggttgcaaagccgagtgatgataatggtcctgttggtaaaaataatgatgcacagagcgtttcatccttatcaaggtacctcttatccctgttctttgagaaacagccccgtgtgggtgaataggaggaatcacaaaattgtgttcagtaaaaggctgttagttgttgttcttgttttgtcttctttccaccccaaccctgttctttcctgatcctgaatgaatctcgctgtagttacatctcaccatccagcacacactgttggcagccttccccatgtgaagctatggaggcattggcacaggaggcctctgtatgacccactaaaggctctaag

SEQ ID NO: 52871 - DNA, 1182 bp, Bovine  19866881183430
taaaataatgtcactaaaacaatcattgctgggtagtttcctagagtgctccaatagagagcatttattttacggattcagagaatgtagcataaccctaaaggttagcccaagctgcacacactgaaacctaattcaggggggaagggtggcttgaagggtggcaccctccagcagtccttcagcaagcctttccctaagctctgtttctcttcagcccatacccgtgtgcatggttataactaaccagggcctgggaactggttaggcgacttttctcccaaggccactatgaaccatcaatcagccaaagcccaagagtcctggaattagacctgaactccctctcctgctccagaaggagaagaatggggaaagggaggctcaacagattatctttgaaccaacagctttacctaaacggattaacactggggattcactttcacagggccagggagctggatccccaccacctagggtgcaaggctggaaggaggttggcacggcgctcagccaggccctgggaaggaacgaagggcagtgtttggtccgaactggcttcccttgccaagttgctctccccagaatgagctctgtggaaaatggatcccacaggctaaggggtctcatcttcaaaatatccagctcaaacatttcaagccatgtgaccctcagggaaagaaagcgaaagctccaagtgaggcaggtggcaggaattgggggtggagggttcaggtggagacacacccagccctgttccagatgacttgagctccaccttctcctaccacaacttaaaagtccaaaggctccctcattctcacttcctccagaaacagtatttctgtgcttttcccactgctgctgctgctgctaagccacttcagccgtttccggctctgtgcgaccccatagatggcagcccaccaggctccaccgtccctgggattctccaggcaagaacactggagtgggttgccatttccttctccaatgtgtgaaagtgaagtcgctcagtcgtgtccgactctgtgtgaccccatggactgcagcctaccaggctcctccgtctgtgggattttccaggcaagagtactggagtgggttgccattgccttttcctagtgagatacaaatcccaacactgaagtcctttttcccacttccgtcaaatgtaaa

SEQ ID NO: 52872 - DNA, 875 bp, Bovine  19866881183916
cgcaataggcttttagaagggtgcaacccactgagtctatgcttccccaagcaattcttctacagaggggcaagaaaaaggcacatgtcctgatgatcaccactatcccaactggattcccagtcatccccatcccaggcctgagcccctccccccatgctgagggacagtctcactccaggcaacttctgtaagtctcaaccctcgcaagaaaaatgatgggtttgaactattaacccttccccagagaggactgcaattaagaagaggccactgccaaaatattcacaagagattactgtaaaaaataataataatgagctaaatatttgccaggagttccagacttgcctaaagaaagacaaaagagaaaaaagggagaagtgatcaagcagtagagactgggatcaaattcagaatctatcaggtaagaatcacacaatttagggaaaactggagttcatgttggcagcagaggtgagcaaggaacaggtaaaagactgggattggacacgagatctgtagaagacatgggaagggctaaaaagaaatcatattgattaggatggctgactctgctgaaaaatcaggaggaaaaagagatgaaaattgaatctggtgtaaagaaacatggcttggtctatcagcagggagaaactgataatgacacagaccaggattcaaattcaagccctgccacatacctgttgcataatgtagggcaagtcactttacctttttgagcctccatttctttttaggtgaaaggaggataatgatacctctccttccttcctccaggtggttttaaaggtcaaatctgatcatataaatgaaatgtgctgtaaactctaaggtactatacaaatgtcaag

SEQ ID NO: 52873 - DNA, 1605 bp, Bovine  19866881237821
ttttcaggtttccctacccctgccagaatatatgcatggtcatcaccaatatttactgagcagtacctgcaggtcgtggtttagccaccttggatatggactcagggaatcctcaccaccgcccccaggagctgggaaacatgattgtctccattttcctggtgaggacccagcagggagggaatcagaaacaaggtcccacagccatcagtcaaggtcaggtttggcttccaggatctagtaccacagctgtgtgaactcgaacactgtgctacctgtgaagaagagcaaactccgagaggcagtgaagctataaaaagcccagcagatggagtttacataggacaggctagattcccacctagcagtgggcctgggtgataattggcactcataatgataaatgatttgggtcgtgaagaagaagccaagttatgttcaagattcccatctatctgtctatctggatatttttcaaaagtgaaacaaagcaaacgaaaagaagctagaggaaagataacattttaagtggcttatatctaaaataatgaaaatcaacacagttttggttaaacccctaggaacagggagacgaggcagctttctagagtggtttctttcacaggagttaattttttcttccttatctactcctggcttccagaatctctgttccctgggtatcttccccagaacaaaggttatggacccatggactgcttgtacctcctccctagactcttgttccagaaaagatgacgtgaatttatgaatcaccctctgctgtgaacagggtgccttgtgcctgctgtcgctttgcttctagggtggcaggtagaaggaaggcagtgcagtaaatagcagtcctttcttaaaccaccatgaatgtggaagaggggtgggcaggggattcgagagcagagaggggaaatcaggtctttgtctggagggaaatgctgtgaccaccccttcaggtctgttaagtgtctactggataagaaggaaattctcttccttgcttccacctccccctatccccgttcttttttctccctttgtagaataatataaaataaaaaagcccagcagaaagggagctgtgatgctgtcgtccctggcgttgatgttatttattttcctcagttgctgctctggaagcccggagttgacagagcggttttgtagaatagaaacattatagactgttactgtcagagtgttaaatgtgatggatagagaaatagaggcgaaggaggggacttaatactgagagccagggtgctcatgggaaaataaaccatccgcatataagaaatgaatgaggtaatgtggcgggaggtaatgggctttcgcaacatgccggaacagagatgcttattacagggtgtgcttaacccttggcatgctgatttccttttgtgggttccccggctctccgccgtgtccctcggtgtgagcatgtgtgtggcttttcttcaggcagggaagcaggcttgtgtaggagtggagacaaacgcgtgcttaataatgcggtgttagcagcagcctgtacatcagaaagccttggcagctcccgaggggcttggaatccccggggctgcagga

SEQ ID NO: 52874 - DNA, 862 bp, Bovine  19866881307745
ctaacagtctgcattcccaatgcaggggcctggatttgatccctcgtcaaggaactagattccacatgccacaactaaagattccatgtgctgtaaccaagacctggtgcaaattaataaataaaataaataaatataaaaataaaataataaaatggtgacagcacgtactcagcagagttggtgaagggagaaataaacagtgtgctgtgtaaagcatagtatctggcagagacaggctcccaaaatggtaactctctgctgcacgtcgaatacatcgtctgagagtaatgagaatatgttggatgacaaaatcaggatccaaaaaggtctcagcaggctggactcaaggaccaaatctaataggatggcatttaacaaagataaatgtaaaggtactgcaattaggtctgaacagcaagctgcacacgtgcccagtggggagatagggcttatcaacggcacacctggaaaagacttgggggcattgcatgactctttgctcattaatgggtcaatcaggtgaagtggctgccaaaaagcaaaggcagtcttaaacagtgtaaaggctcattgtctggaacaaagggagaaataatgcctgtcttccatgaccacactcgggtactacactttaataggggtggtgataagctgggctttttccaaagacacagaatcaggatagtgaggagacagaaactcagtcaaagcaaagaacagcggaggccagggaataccacggaggcttaggataagtgcttacaaacatgagaaaggcagttttggacttgatgatgaattagagctcggtaatacaaattcctaactctttgcctgtttaacgttgctcaggggagaa

SEQ ID NO: 52875 - DNA, 1260 bp, Bovine  19866881428872
atctgaagagtaggaggaaaagctaccagtgtttgtgaacatacacatatatatttactggcaagtccatttctcaaaacatcagtctcgatactagaagatatatcaagaatttgatttagttcttaactcctcctgcctaggtgagggcagtttcctcaccctgtacaagatttttctgccatctcagataaatctaaattaaaatgaacttagagctgccccctggagtctggaatacagcatgccctaattaacaaatgattttagtggaaaaagcagttgcccataaaactaccctgcagatggtgggcaggagaggggcttctggcgatggtgcccttaaatttggtctttttagcattgcgtaggtagtggcaaaggttgaggaagaggaaatgatttctaggagattaaaaagaaaaaaatctgccactggtgagcttagaggtaattgagaaaaaagtttcacctctagggttccccagggactgggagaacgaatgccctggattgaactaagcaagaactcatgctcctgtctctcctccttcgaacacctctgccccactcccaacaaataccagacaacaaaactgctcaatactcttttcacctgaaaaattgtgagttaagaaagatcacatcatcaacacctcgctctcacacacagacacacacacacacacacgagctaaggagaaactggcatgcgtccccaagcctcacacttcaatcttaggtgagaaactttccgaccacaaaatgtatcacaggaatgcatcttctttaataaagagttcttttacaggaataattatgagtgtatgtgttagctaatgaaaaccaccagattacaaacatagctcaaaggaccacagggatgggggctgtttcaccctcagtagactgtggcagatgaggaacggggttcctgagatttttcacctgaggccatggcctccagctcatgttctcaacctgtcatgtgaagaaggccaacagctttgctcatcaaaaatgcaatttcccacacactgagggcaatagcacaaaactattttctttcattgccaaatgaattgtgtttggtaatctgaaagcatcataaattgcagagacacagacccatgaaggatcatgccttttatgcaggctgggatacacacagaaaactgtggatacaaaggagctggacgttgccagtgtacagagaaaggatgcagatccctggagcgaagttcatagtctattttcagg

SEQ ID NO: 52876 - DNA, 1776 bp, Bovine  19866881520330
tttgagtaggtatttttatacagctaacacagttcttcattctcaacaaggatgcagtgaacatgaggtgcttgccttagaaaacaatacacatcatgagatgttgaaaggaagcaatataacaaaaaccatctgccctcaaggagctcatagtctagtcgtggagaaaggacagaatactgggtgtctgtcctttgctttgacaggtgtcactgtgatgatttgaaggcaaccagctacctcttgttcttttacccagcccagctgtttcagatgaaagaaacggatagagaggcgggcttctgctgtgacggaggtgatgttctattttaagataaagtatggaagtaactgattgatggattataaactgggaggtccaggctaaagcttcattctgggggcatcagtatatttcactgggagcctcctgggcattaattctgccgttaattttgttattagagacttagccaaacaaagggaggtggcgaagcttgaggctggtttaaccttgatgaaacagtgatttcaccaaggatgatgttcccccatctatcttcatccatcaaggcactgctgaaatatgctaatgaagcccagagataggagcccagagcagttaaatggggcgttgcaaacgctctccctacccttgtgacagggcgatgccacttactgtccagatttagtgcatgaagacgagcaatgctgacgtggtcttgtggttgaagacagagtgttggtggaggggccacttagcagaaatgaagagcaagattcagagatgcacactccggaatcgacggaaaagtgcgggttgtggtgaaggggacgttttcctttattctatttgtcgcaccttctagctaatccatagtgcagatgaggaagcattttgtttgaagttctggcattcgacctcccacttcgtgccacagcgatgttatctgtcaccatgttagctcatatcactgtgcttctttccagtgattaaaaatgagctaataccttttttctaccaaattagtttaagtaccttaatctaattcattgcttataaacacccttgaagaagtgaaattacagcatttattttactgaggaggtttaagagattaaattcatgtccagatcacatagctagtaagtgggatgtttgggattcgaacacatgtccatccaactcctcagcccttgcatgaaacctctgtgatctgatggctcttatgcagggtgtatctgggaatccttgctacctcttggtgtggtagggtagctgataattcattgttagatttggggattcttttacctaatttctaggaccacctatagttcaggattagcatcttgggaaggaagatgggctgctgccttaactgtctaggatcagcacaattttgtacacagctcctagaacagactggcctgatgatgccatttaatgagtaataattaaactttactgttatttactttttttctctggtctcacttggcttacttatatattcacatattctttgagttcactgtatctttattattctctttatagtcctttctttcctaaacagaccataagctctctgaggccagggccaggatcctcactctagtgccccaaacactggacattttgattaataatgtacctgtctactgttgatacccctagctttcatgtagagggcttaatttgtcactgtgcttttagttaatggtagaatagagctggccagctgctttctggttttcatacttcgataaatg

SEQ ID NO: 52877 - DNA, 1479 bp, Bovine  19866880746631
tactctgtaaacctttgtcagatataactaagtacaatttctttctaaagtatgctcttcctttcaaagtattagtaagaaatctaaatccgggacaaattctagtctcctatatgtagaaaaattagaatacacatagcagcttttaagtatgtttccctattccttttccaccatcctaattcaggcctccaccatctccccatcacttggtaatattctaactactcctgctggaattatttccccctcagtaaatttttctaaatgatatcttacaagacgtaaaaagaacactagttatttctaaattaatcagcagtctctcaaattctaacacaacagggtcacttatatgtgtggggtcacctgaggtgggtatataactatgacttaggatctcacttttcctacgttggaaagctaggaaagtgcttcacacaaagctgaactctcctaccaggataggacctggactatagctaacaatcctctgatttcacatttgagaacaggcttccttgaggttttcatatttttaccagactagtactttccttagaaacatgactccatttagaatgttgttacccagagacacttaaagtcaaggaacccaagtagacacttaattcttattgccaagacatataacaatacacgtaagtcaaaaacaagtgaagaagggtaataaatctaattttcagagtctgtgttcttttccactagattatactcctgaaacacattcttaattctctaaaaattaaatattatgttaacaacacactaaaaaattcttaagatataaaaactatctttcaatatgctattatacatgcatattacaagtcacctttccaacaacagaaatgcagtgtaaaatcaaaaagacacagacccaagaaaacaatctgtatcattcatccactgatttataaattgtacagttacaggtccagggttgtgaggcaactgaattcgttctaaagtatgtagcagcaaatcagggttgtagtacaaggcagcaattgcaacctgaagacacatagtacgaagctcactagttttgacccctcgggttaatctctccaaaacaagttgaacgaagagtggaatgcactagaagaaaaaagaaaaagagaaatcaagtaacttttacagaaagctgaatgctggtaaagtgtaatcattaaataagatactcttaaagacaatagaacttgctagtttaaatcattttcagaattattaaactcagagagattaaatgaccaaaaaaggtcctagagcagtaccaaaatgtctcctttccttttaactgaagattacagttagatgaaggttgtcctacaagaatacacaatcaaaaaactgcaataatccaaatgtagactcagtcatttccatgtttaagttaaaatgactaggatggagtttttctttgataaatcaaattggaaatacacttgacccttg

SEQ ID NO: 52878 - DNA, 800 bp, Bovine  19866880768726
cctgcctggcgcactgggaattccacatgctcagacactataatccgaagtagactgggggcaaaattgataatcttgtaagactgaaattacaaagaaatgttttattaaaaatagggcaatacaagtgaataactgtcagcacctgttcctgaatacattcctatccaaacaaaagaataactttcaaaggaaaagaaactctccaaagcaaaataaagattaataaaatacaaaaaaatttcttagaataaatcgatgaataaaagagtaagaacacttttatgtttttttagatatatattgtcaaaatgttctccagaaagggtgtagcaatttatgcttcccacagtagattatatgtgtacccatctatctaatatagagattagcattatcattcctccaaacttttcatccttattcatactttaaattacacttattctagcttgaattttttttcctgtcagttggctatttgttttcttccacaaattctttattcccctcactcttctgtaaaaggaatatttgttttattcttagtaacttctaggagctattttatgaatttaaaatttcaaatttttatttgactcatacattgtgctcagtcgctaagtcatgtctgactctgcaaccccattagactgcagcccgccaggctcctctgtcaatgcagttttccaggcgagtgacttatacaagtgtttctttccagcttatttgtgcttcaattttgctagtacttttgatgaaaagaaaacatgggctacagaaaaggaagatccaacaga

SEQ ID NO: 52879 - DNA, 1375 bp, Bovine  19866881054930
cccttgagaaatttgaatcacatgtgtcctctgtcatcagcatgacttatcaaacatgaatatgacagcatgatacaagtgtaaaaaccatttacataaagactgtgcccaacattgatgatgctcattcactctttcaccccatctccaaccacccttctccccacatgtgtttatctaatattgccttccattggaacagtgttgtatagggataaaggctaatgttattcataatgcagaatttacttttaaaggtttatttgaattttgaacagagccttcttctcaacaaaggagatatgtgttatcactcactagaaatgcaacttgctactttcagaactgtgagaatcacagaatcctagagctgaaaggaatcttaaagccatctagtccaatccccctaaatttaaatatatggcaatctaagccttgacagatcatatatcttgcccaggtctagacggcaaggcagaagctcagtcaaaactagactcctaggtctcttgattccccatctaccctaatgtttaacaatcaacttgtttcctaatctcaaatttttctggaaaccacggttaacagacatttctaaaagtggcaagaataaactctataaaattctgagggggcaaaacctcaaaaacccaaactctgaactttaagacaaggaagtaaacaaaactatttgagaagaccacatcaaaataattatttaattaataataccctctaaaaaatgtatttttattctaaattttaaattttgttaatttaataataattttggctttaccttgtgtctggttagaaattaatgactgaagagcaagggcagcttcaaccttgacaggcatctccttatcctcaatcaggctcttctttgctagatcaactgcatttcttaggttgagctcattatgaaatttcaaagaactgaatgcatgaagtacccaacaggactatgttataaggaaaaagttagtaggaaactattaggattatggttttatgtaataatgaatataaaaacttctaggtaaaacatcattaatcctaccatgtactattcatttatttgttttttggagggaaacatattagtctcagttgctaacttctcgattccatacttcttataagaaaggcaattttattacttctaaattacctttatgcaatatcgttattcataagaaagattaaacagagcccaacttaagtgtctctaaaaaaaaatcctgtcaatgctttaataaatattatgactcacaacttattatttatatgcaaaagcactacaagccagtgttgacattcatttactggtcttcaaagcaaatgaataaaatattattttcctttacactaa

SEQ ID NO: 52880 - DNA, 639 bp, Bovine  19866881214687
tgataagctaagtttcctgaatcaagctgttgaatttgaacttcactcttacacattatgggtttatcttgtaggtgcctaagcctatgcatcagcctgtaggttcttcctctacccttccaaaggatccagtattgaggaaagaaaaactgcaggatctgatgacccagattcaaggaacttgtaactttatgcaagtatgagtcattattaagtgaatcttaaatgctagttatggggctactagcttctggtctgaagcattaaatgaagtcgttaagagcatatattctggtgttcagaatgagtacaaatctcagctctgccacttgctcactctgacagtttaggcaagttacttaactttctgcctcagtttcttttttgaaaaaaaaaatgaggataatagttcctgttcctgtttgttgtgagtaatgaaatgaattaaacatgtaagaagcttaaagtgctcaaatgatattgctgctatagctcattagtagtttctactcagactgggagaacctgtactatgcttggtatttgatagatgccattgtgtgtaaataatcatgacatttattgtcctcaaagagtttatatttcatttgtagagttaagtcaatagttaaatgtaaa

SEQ ID NO: 52881 - DNA, 864 bp, Bovine  19866881283242
taggatgttttctatacatatattacctgatcaattccccttcctttgcactgaagaatgatgacttcaagaagtttggctgcatgacattctgcatcttctcctgcatctccacatagtacctgcagtaattaaaatttcactcagcagtgaacagcattgtaaaaccttaatcaagtttacataaagtaagtatcaggtaaaaaacagccattagaatcatggtgtttgcatcatgagtttaccttgccaaaccaaaaaaaagacgttcaaaatgaagtccatctatcttttttatctactctaattccttatatgagtaatgattcactttatttaactctggattaaaaagtaggctgttacctgtctatacaaaaaagcttctctttaagtaaggcaccaaaaacaataaaatgatacaatgaaatttaaaaaaaaaaaaacgaaaaccttcttaaacaatgaaacaaaccctgtatttttcgtatttttctgttctttttgaatcctgtctatatccacccagtttttcataatgaaaccataaatataatattacataccatttaatttcctcacatggactttataactcgaagtactttctgaagatattaaaccatttaggactaaacagtattacacaagatgaatataacaaagcttaccagactgttcccctaatgacaattctgtattttcactgaatgaacaattatagaaagcacatgttcatactgaactgagacctaaattagataaactgaattatgagttcagcactctttaacagagcctggtacatatctctcctaggaaggaaaacaggctggacactagctatcttactaacaactccaa

SEQ ID NO: 52882 - DNA, 825 bp, Bovine  19866881980889
ccctaacacataacccaagacatactggccaatacatacttggttcagctaacataccaatatgtatttgttgaatggatgtgttcttccctcactgatttgaaacaactttaaaaatcatatttgaaacagtaattcattgctgatcttggaggtggctttccaaaaatactcctcactgtttgcaaggcaaataaaggtgtagaaaatagggaatggggaggggaaaacaaagaaaatcactaacaaataaaaattgaggaggcatgtactttcaaaataaaccggactcactggctttaaagatcttttctagcagaaaagctttttttctgaatcactttttccattttttaaagaaaatatcacaacattatctattaggtacaatctcctataaatgttatgctgtgcttatacagactgtaccttaccagacttgaaattcaattatttttgcttttgcattcttgattcattttctgaatcatgtttgcaaataaaacggtatagatttattcagaattattacatttagtggaatatttaggatccatggccagatctatatgacacaaaggatagtttattcttggtcaattagaagacaaacatataatgattagtatgtcagaaatactgttcattcttagattcactattagttcaggctaccacaggcataaacctgagctgtaactttgtttctactcaatgatacgaaagtgtgtccttcacatgtttttacctttgttcattgctttttgctctcttaaggatgaaggcgtagtcttcctcccctgacgttcaacagctttgttctat

SEQ ID NO: 52883 - DNA, 1386 bp, Bovine  19866880285496
aaaaataaagtctgacactgtttccactgtttcctcatctatttgccatgaagtgatgggaccagatgccatgatctttgttttctgaatgctgagctttaagcctactttttcactctcctctttcactttcatcaagagactttttagttcctcttcactttctgccataagtgtggtgtcatctgcatatctgaggttattgatatttctcctggcaatcttgattccaacttgtgtttctttcagtccagcggttctcatgatgtactctgcatagaagttaaataagcagggtgacaatatacagccttgacgtactccttttcctatttggaaccagtctgttgttccatgtccagttctaactgttgcttcctgacctgcatacagatttctcaagaggcaggtcaggtggtctggtattcccatctctttcagaattttccacagtttattgtgatccacacagtcaaaggctttggcatagtcaataaagcagaaatagatgtttttgtggaactctcttgctttttcccaaccagggatcaaatccgtgtctcctgtgttggaagtgcagtcttaaccactggagcaccagagaaatccccaaaccatttatatctctacttggattgtgagaaaccaggaaaacactcaaaatctccactgtacacacccaaagtcaattaccagagctttggcggtaccaacaatcagcagccaggctgcccacaggccctcctctcttcccccagccagccagggggctgtccaccactggtttccagaatcctcgatgttactttctcctctagctccatgagcagattgaaaatcgtgtgctgactttttaattaaaaataataataattaaaggactaaacacagagttgactagaaacaaaccattattcttccttaatcacttaaggctgagcaatttatctttctatttggcaaactctcaaaaagaataaatcaatgttattctgaaattcaatgactcggaggttttggagaaaaataaacctcccaaggcatcacaaaaaggcaagaaccagaatgagttccaccagtgaaaacagatcatcaattttactagatatatacgagctaacccaaagcaccttaacttctttatgccatcttttacatttttgatattgatttcataaaaatgtccccaattattcaaaagcaagctcactttacatataaagttttctgataaaaagcagatacattctgtttcatcaccatattgtctaacatttcaagttgtagagattttaaatgcctggtacctatattcaagcacgagtaatgttccaaaacagggattatcagctggaagtctttcaacttgcatatgcagacttcaca

SEQ ID NO: 52884 - DNA, 1125 bp, Bovine  19866880355322
actttcttgttgttgctgttcagctgctaagttgtgtcagaagaccaggaagaaaagcaaacagcctttgtaggtcaaattaaagagtcattttcccatgacctgagatgtattaataaagatgaatggctcacaccagataacattttacatcatcaaattatgtctattaagctacatttcatgcttctcagttgtcgaattaaagaggtctgttagaatagcaataacacactcaaattggttgagatacgtgcttcaacatgcattttattagagtgataacttgtgaggctgaactaatcacttattaattaatacttaaaactccctgagatggaacaagccaggtgtcccatgagaaaacttcaagtggtttgtggaacacgcaccagaggtggtaccctgttggggcacttctttcaaatgggcttccctcggggctcagatggtaaagaatctgcctgcaatgcaggagacctgggttcaatccctgggtcaggaagaccccttggctacccactccagtgttctggcctggagaattccatggactgtatagtccatggggtcgcaaagaggcagacacaatgagcaacttttgctcacttgctatgtttattcagtcatgtctctgcttacctgtggcctttccctaaaatacttgtccattatcagagatttagtggagcattacaaagcaatgaatttaccaaaaagagtgatctgtggtcaaaattatatatcccttccttttctgaagtctagagagagtagagggcaaaacagggaagcaggtggagatcatggtaaaaaggatgaaacaaagtcagaaaaagaaccagaaaatgagaaaaaagaggggacagagtttccatgctctctctgagtttaccactctccccaaatttctgcaggtttggagaaggggctctccaaaacctttccttttgagtttttgtggaggcttcattattacataggtatggttgattgagtcttctgctactggtgattgagtcaaactctgtttgctctctcccctcccagaaagggtggacttgaaggtcaaaccttctattcctggttggtttccttgacaacaagtctccccccaccccccca

SEQ ID NO: 52885 - DNA, 1153 bp, Bovine  19866880368609
cccagtttggatagaatcattctggtttataactggtgaccctgtatatttgtttctaaagtaggcggtttaaaacaataggaatttatttttttatagctctggagatgagacacccagaactaggagtcagctagattggctttctggaaactctaagagaaaatctattccatgtctctctccagcttctaggaatcaccaggagtccttggtgcttgtggacacgtggctcccgtctctgcctccttgtttacatggtgtgttcacatggtgttttccaatggtgtctcttgcctcttataagggtgccagtcactgagtttagagccacactaactcagtgtggcctcttcttggattacaatcctatttccgaatgattaagactcgaaggtatcttttcgagaaacataatccttgtcactgggcttctttggtggctcagatggtaaagaatctgcctgcaatgtgagaccagggttcaatcactggaatgggacgatcccctggagaagggaatggctacccactccggtatattctggcctggagaattccatggacagaggagcctggcttgtcaactaactcctcattcccaggttgaaccacaagttgtctgcatggcagatcagcttcttcagtgatctatttgcctaaggtaaaaatcattcatcctttgagtaatatataatttggaattcatgtagttcaatctctcctcctatagggataatgccttggactatgacatattctgctgctttttttttaagactaaattgagtacataccatggttgttgatgtgcattcttacatccttgaaacttctttttaaatttttgaatgaagagtaggatgaggaaaagaattggaaaaagaggtgggacaatcagcccaagttcaaacatttgcaaattatttaaaaaatataatgataatgtgcttctttgggtaaatatcagaatgttgagtaaagggcactcatgatgttcttacttcaactttttagcttttaacaacttggtctagcttggtttgtgttcgtagaaatctgtgagatcatgtggaagaaggctatttcagaacctggagtgagttctgagccagagcctgtgggaggcacacaccgacgtctgtctgctttt

SEQ ID NO: 52886 - DNA, 3878 bp, Bovine  19866880385055
tgcaggcagattctttaccatctgagccaccaggaaagacgctcatttcagtggatttcaattgctataattacccaaacaaagcagcgtgttggaaatggaatatagagtgagtgagtgagtgagtaaagtcgctcagttgtgtccgattctttgcgaccccgtggactgtagcccccaggctcctccgtccatgggattctccaggcaagaatactggagtgggttgccatttccttctccaggaatatagagtatgtatctttctttttttttcaatttttatttattatttttatttcttttgatcattcttttccttttatttgtttgaggggcatgtttgggcagtgaatagcatggagatgaggacttgggcattttgaataaatccagtgattctaaaactataaaaggagataataattggaactattcaataagaagtcattccactcttagcagactggcatagggatgcacagcaaatgacatgctatctcataaaaatcaatcaacaagaaacagaccaagacaatttcatactgaaggcaaataagccacattatttagatgaataaagtaaatatgatttcaccagagaagtggaaggcttgacagctcctttgaacagatgccgctcaaacagcagaggagcctaattatttatttgtgccttcagctcctctgtcaacaggaggaagcctgtggtgtgaggatgtcatgtctttcagtaaccagatgtgacagaaaatcttactcagcccgaacttatcagggcatattgtaagggtcacctgatgtgagaaagccctttgtgtgtagaaccagaagccaattgctaaacagagctttccacacttcaacacttaaaataggtatttgtaagagctggatgaagccatcagatcaagtgaagtcttataagctagagaactataatatgcttttctttgcacataaatctgagtatgtcacattgctgtctgtagaacctagcccttttaaagcactttgtctctgcaggtctcaataaaaacttgtcaatagaatataactatatggatggatgttcctttggaattagctatttgtaagaggaggggatcagctctttgagaggaagataaaggagaaaggggaaaatccttgatctagcactcaggacagctggttctaaacccacccagctcatttctaagcttctcctaagcattgttctccatggacaacactcaattctcttctgtcatgctaagagcttctcttgcctacaactaggagcaccaaaaggcaaaacagcttgggatgtccatgattgtttatttctgtaggactgagctactagtccacagtgggattcaaactctgatttatccccaagaactacacaactaatttatatcaaatttaaaatgacagacaacgagacaggtgaagaatagctgagtctcagccttactcacacagacagttcctttctagactaaggaaaaatttccatgtatcatctcagaaataaaaatctagtataggcaccgttcctttggaatatcagggaataaggggcttatccggtgtgctgagatgacatttctgtcctggcttttctgtttgatttgtaagttagggggctagttttagattcatgtatttgtgtatttaagaggaagtgggatgcattgaatcattttgttcttagctggaatatatttgatggatggaactggccacctctacgagccattcactgtggctattagcatctctgatgtcatcatccagtggcaatgggataaaagacaggtaacctgattccctaatagcaacatctgtcaatagggatggtgctacctgcttccaggatatgaatggtttcttaggacaaaagagcaaggcagcctctacctccaacttcactatcagctcaacttgttatcctagggtttcctgtatatggccacttggttatacttttcaagaatctttcaatgcccccttctatttaggcacaaaattccaatgcctaacatggtgtgggtgacccctcatgaactgtcctcagtacacttctgtggcttcatctcccctctttcttagcatctagtcaggtgacactaacagtaaaccttatacaattccagtgcattttgtttcacctgctacaccatcctctcttcagttcagttcagttcagtcgctcagtcgtgtccaactctttgcaatcccatgaattgcagcacgccaggcctccctgtccatcaccaactcccggaattcactcagactcacgtccattgagtcggtgatgccatccagccatctcatcctctgtcgtccccttctcctcctgccccccatccctcccagcatccgagtcttttccaatgagtcaactcagttcatgtctattaatccctaattccaaaattatccctccccttgtctttcccctttggtaaccataagttgttttctatgtctgtgagtctttttctgttttataagtagattcatttgtatcatatttttagatatcacatgatgcttacctttctctgctgacttcacttagtaagataatttctaggttcatccatgttgctataaatgccattatgtcatttttttttttttttatggctgagaacttttactaattttaaataccaacttgaaaagagagaagtaaatttagatccacctttgaaataaattgggtggatagctccaattaaatgtatttttctgtcataaagggaaatgttagtctctctatattcatttcccagggcttctgtaacgtattatcacagatttggtggattagaaaaactgaaatttattttctcacagttccggaagccagaggtctaaaatcaaggtgtcaccagagctggatcttttggagtctaaagtgtgttccatgtctctctccttgcttctggtagttcctggcagtctttggaattccttggcctatagatgaataaacacatctaaaccttctaagaactgatgcttttgaactgtggtggaaagattgaaggtggcaggagaaggggaagacagggtatgagatggtggacatgagtctgagtaagctacaggagttggtgaacaacagggaagcctggcgtgctgcagtccatggggtcgcaaagagtcggacaggacagagcaactgaattgaactgaactgaactgaaaccttccaaaccttgtctaaaccttcatatcattgtcagtctataatcagctttccttttctttctttaataaagagagcagtcattgcattgggggtcaaccctaaatctaggatgatcttttctcaagatctttaacttaattgcatctgccaaaacactatttccatacaaagtcacatttacagtcacatttacccaggttagagctctacacatctttttgggaactactgttcaacccactacaccgccatgctagaatcaggaatttttataaaattattaatattctaatggaatcataataattgactagacactaaagatacataaattagctataaattgtcacaagtgcaactgaattgtagaggaaataaattttatgtatgaaatgattgggtgttcaatagagcatttaatagaattctaaattatctagaccaaggaattatatacaatgtgataggtgatgtgttccactcaggagtcaaaacagaaacattcaaatgaaatttagaaataacatttcaacctatttcttaatcttatcattggagctgatataagagaaacaaaactcgatattatatactgtatttgaatttgcttaatttagtgacatacttgtttaatgaacagaatgtggactgtgcatttcaacag

SEQ ID NO: 52887 - DNA, 1261 bp, Bovine  19866880506680
cccctttcagggccccaaaagccggctcttgtttgacactcggaaaaagaattgtctgaggagacaacgtgctgacaaagcaagagattttattgggaaagggcacccgggtggagagcagtagggtaacgtaacccaggagaactgcttttgctacatggctcgcagtcttgggttttatagtgatgggattagttttccgagtggtctttggccaatcattctaattcagagtctttcctggtggcgcacgcatcgctcagccaagatggatgctagcgagagggattctgggaagaggacggacacgcagtgtctccttttgacctttcctgaactcttttggatggtggtggcttagttccatattccttaccaggatctcctgtcataaaacaacttgtgtgaatggttactaaagggcctggccagggtgggcggtttcagtcagtgtgcttcccctaacagaacctgcattcagagatgctcaggagcatggatgtgctggggttagactgaacgcagtgggaaaccattgatcccactccctgggagccccgtgtccgctgcagaaagaactctgcatgtctgaatagcctgtgtgtgtcttgaggagtcggggttcctgattcctaccttgtggggtatggtcttcactgatgaggcaagaaaatttagatctatttatgtacctaagttttccaaagactattattttggagaaacacaaaaacatgtcagtggcttatttatttatttatttttccttaggcaaagaaattgaatctgaaatggccaatgaataagccaaggcttggaatagagtgcagttctatttttggtgttttagctttctttaaaatgaatagcattgtttcttgaaaataggaagtcagttatttccatcctcttagaacatgaaatagattatttctgaatatatcttttcagttaccgatttttctcttagtttttctgggtttaaaaaaaaaaaaaagaattagaggttgcccttaaaatttaagatgaggtgatctgaagatttcatgttagatggagttaataagggaagtgaagttgctcagtcgtgtacggctctttgtgatcccattgactgtagcctaccaggctcctccgtccatgttttccaggcaggagtactggagtgtgttgccatttccttctccaaaagtgaaagttgctcagctgtgtcgactctttgcgaccccaggactgtgcagtcctggaattctccagacca

SEQ ID NO: 52888 - DNA, 810 bp, Bovine  19866880542586
taatcatcaatgctaatcatgagagtataccaggtggcactcaagtgtagaccaaatcagattcttctaaaacttaatacagtgattcctttttaatgagtaagttaaaccatctcagaaaaaaaataacttggccaagggtcatattctccatggctaaaatataacttgtcatttgacttcttcagagcattaaaaaaaaactcatctcctacttagtcatgcaacatgggcaagtcacttaacccttactaattgcttctattttaccatccgtagcattaaataacaatgaaagtccaaatatctgaaataaattgtctcaatttgtcatctctatcatggaatcacaatgcaagtgcaaatggctacaaatgaatgctcaagcatttcaaagctatgagggtgacttcatctttaaaaatacatattagtttcacaaataacaatgacttttgccagagcagaaaagctaacattaccatctactacttttgtgttttctccctcttaattctccatttattctccttgcttgcctctactccatgaaaaattttagtgtgaattagaacaatgttcctgaaagtgtattatgttgggattctcgcatttcctaccagaatgttatgaataataaaaatattagttaagataagctggatcatgttgcccctaagttccaacagtttggatgtacaaatgtttactgttccttcatactgcatatccagcatgggtccatgggggctttgattcacataatctttcagcaactgatgctgttgaagattccagcatcttgagatg

SEQ ID NO: 52889 - DNA, 3113 bp, Bovine  19866880561182
ctagcaccttgggcttgctctattcacagaaagagagccttcaggcagaacatcccttggtacttgctctcagcatgtgcaggtaagagctgagaggttatggaagggcttctcacagtatctgccataggacactgggtgacatgaagattaaggcaaacctgaaccttgaagcccttgggctttgggtttcttgctctcagcaattcaagcacatataggatatatatatatatgtatatatttaattgatcggaatagacttcaagattgctgatgctctgaagggctggctgagccatctgatggtatgattgatcttcaagcagaaggtaggaatgtgtgaagacatagaattcggtgctatgagaaagatgacataaagggaagagacaaagccatggcaactggtgaaggatggtggcagcctgggatcattttgcagagctgatagtagctggatgtacacagtgggacactttcttgtaatgagagacttacggttttactgtttaaaactcagagcctacatggaagatatgtgtgactaggcaccagggacaactctgctcacccccaggatataaccaggtggtaagtctgggctcccttgcttcggttgctcagtctttatttgtaagagagattctctgcatgagccactgatgtctagtcagcagcagcaattgtgttagcagcttgtcacagtgcccttgttctatttccgacccggttgtttgattgaagtcctgtcagctgatttaagactcacgtcaaagggtgtgtttacaaaacacaagtgttggcctgagaatcaaggtcatgtcctaacacagaagttaccttttctagccttaaatactgttgaatatgcccaatcttattgatgagaaaaacagtcatctgtagggtataaaaaagcagactgaagtataaacaacacagtgacatgagaagcacagatcatttgctgctaatggacgtagatttgccgacacttggacctacattgctgtttgttcaaggatgtcaatatccatggtacccaacattctgcaattaaatgctctatccctgagctacaccgcactcaaggcacccaaaattatgaatggcaaaagaatctcttgaacattcttgagataaccatatatttctcatcttaaaaacaaattctcttcttacacaaatggcaacacaccctacatattatctcttttttttgtttttctaacttatcattaattcttgatttttgatccaaattagtacacagaagggctcctcattcttctttgtggctgtgtgattttctattctatggagaagacactggtcccttatttatgcatatttaagatgcccccaaccttgcctaattagaaactatgttgccatcattaactttaagcacatgccattttatacttgggaagataaatatgaatgatatttcctagagttacaaccccatggattgtagcttgccaggctcctctgtccatggaattttccaggcaagtaggctaaggtagatagccatttccttctccagggaatctttccaacccagggatcgaatccaggtctcccacattgcaggtggattctttactgtctgagccactagggaagccctagaatactggagtgggcagcctatcttttctctagcagattttccagatccaggaattgaactggagtctcctgcattgcaggtagattctttaccagctgagctaccagggaggccctacagttaggaagacattgctgaattgaaagatgtttgtattaggattttaatagattttgccaaatttctctctgttgaagctatatcactgatttcccgtcttagctgcaatacatcagagagctaatttcgaaaatttactgtgctttccattaaaatgtgtcgtcagattgaccttttccactttaacaggaaaaagagggtaattggaaatttaatatgcatttctcttcccgtgcacaacactgaggattcttcttgatgtcttaagagctgtgggctgtggctttctattccttagactgtgatgagggtggttttccactttgtggatcccaggaactcactagaattgtatctggaacaaattgaggctgacttagtcagaagatattgaggacagagctaatttgagagtcaagcttatttgtgcgtgttaaagccacaagaggagaaactatggtgaaaagatggtgctataaatgcatatttaattacatggaccatatatttaaaatatagtattaaaggaaacaaaacaagttaaaatatacattagtgtgatccctcttttttaaaaatatgtgcttgtaaaaagatgattataaggatacatatgaaaaattaaccatgattatttctgagtggaaggactattgtagtttaatttgtgctctgttgtatttttgaattgtcaattattaattgctgccttaaataattaaatatattatattcaaataccttctgcctcattgacagtcatacaaaatacacaaaatgatgagaagaccacaagaccaggaatctggaaactcaattttttatcccagttctgccattaatgtgctctgagatgtggagcttatagtttaaattttctgggccttgattttataatttgtgaagtgcaagaactggataaatttatcttttaaaatttttatactaaatcatctcatatggaaacaagtggatacttttaaactaatgcttctctagtcttttacagacaggtgtttaaactttgaatagcttcacttcataaagtcaaggtaattccatgagcacctggtgttcttatgtgaacatgttgtctgggaaccgcatctatgtgtgatgcagagcaagtcttcacacagagtaattcttctctcaaggcttcttgaaagaggttaccttggaaacaagaaatcagacccacctacttcatcttaggggtcagaacaaggttctccatgtaatcatcatttttactcttcgggtacaaactgtgaaccaacttttatgaggatattcaaatattagtaacatgcatttttttttctcaaagactcagtgtttgaattattct

SEQ ID NO: 52890 - DNA, 2000 bp, Bovine  19866880566234
aaatcccttcccacctccctccccatcccacccttctaggttgttaccgaagcctggtttgagtcccctgagtcctacagcaaattcccattggctctctattttacatatggtaatgtatgtttccatgtgactctctccatacatcccaccctctccttccacccccctgcagctgtgtccataagtctgttttcaatgtctgtgtctccactgcttgtgcagtagacactgttttaatgcccttcctatatcccctctccttgccctggagatcactgtagaccatgtctctctgtgccaaagtcttcatgcatctctctgctgagggggttctctgactgtggatgcatgcttggtctgcttggggtgggcagaagtacaagggatttgctgcccctcaggtgtaatctgatgaagaataggggctggtggctacattttctggcttactcctccttggatgggataactcagagttgctatagctcccagagtgtcctgtaggagaatgttgcagaagtggtcctcattttttttttttaatgtggaccattttttaaaagtctttattgaatttgttacaacactgcctctgtgctatgccttggtctcttgaccacaaggcatgtgggaccacagtcccccaaccagggattgaactggcactgcccgtatcagaaggtgaagtcccaaccactggaccactgaggaagttcccctcactttgctcatgtctctctgtatcagttcctttggatggttcccttccacactgactttgaacctgaccagatggctttctttggccaatgggacttaataaatgtaacacaaccaaagattcaaaaagtgtttgcacacaagagtttgacctcttctctatatctgaaacctttcttacttgtccccaagtccatgtcttggggtctgatatcacacttgcctgagtatactaggcacatgtttattgaatggactaaaccttctgcttgtatgcttaccctgctaaggctgtggctcctgttactttctttgtccattggtttcaaactcccataacttttttttggtcctttcctcctttctaagttcatggccagaatggcttgtttcaggcttcagcttctgggtccaaatttggctctcaccttgcctcattgcagacacaactctccaaggttcccttggcctgattctgcatcccactccctgatggtactgctcctggactccaagagaccaacagtggcttgtttcccaaactcctccccacatcttgggctctgcaaggtcttacttggtctcctattcttggttgacacaggcaacaagaactgactagaataaactttcatgccaactacctttttacatgcaaactccatcattttttaagagaactgatagtgtcctgatgaaactgcatttgctccccccatccccaacccctgccctcagagatgtggagaacaagctaagggcgaggaaacagaatttgtggatctcccttgctgttttctgctgctggcttcttaatttctccttaagtcccaagattttagactatttaatgttaattaattaattgaacacaattaggcacaaattaggatattcttataactgttcctaacatgcttgattttcctgattacagtatctcataacacatctgtttatcatttactgagtatctaatgctattgcgaaatttttgaattttttctaaccacatattttgatatttattgagtgcttgctaaatgtacagcactgtgttagacactaaggaggcagtcaaagaaatacaaaattcttattctaccttttatcaagtataaatccaatagatcattgttttaatctctgcatctatgagcagttttgtttgggaacctggaatccataaaaaatgtaggagcaaaactgaaaagcagaccaggaagacctgaaagaactggcaaacaagttggtttacatgcctacatcactcaaag

SEQ ID NO: 52891 - DNA, 878 bp, Bovine  19866880582439
ctatgaaaactaaagatgcatccctttgtgtaaaaaaataaaaaaaaaattagaaatgtctctgccaatcagtcggcttcttcccacccactgtgtgtttctccagctcccacgatggctcagagaatgttaaagaaaaattactttaagctgtctgtcagagtaatgaaatatttttgttgctgccggctgtgtcataatgaactctggttataaaaggtgaagggggcaggaagcttactgaggagttagttataagattgaacagtttgcctccatatttggctcatagcatgctagagagacgatgccaaggggagaggaaggttgaaaagctttggtgttcttgagaagaaggaaaatctcagatgtgagccatgtagaaagtctgagggtatcaactcacaccaaggagatgaggtgggaagctggagcagcaatgtttcagccgaatggtctagtggacgtgtccaccttggatccctatacatgctcatttatgtccgactatgcaaccccatggacgatagcccttcaggctctctgtccatggaaaatgtccatgggattttccaagcaaaaatactcgagtggtttgccatttcctcctccagggtatcttcttgacccagtgatggaacctgcattgcaggcagatgctttactgctgagctaccaaggaagcccacatttgatggaaagttatatactcatgtagcactgcctacatccctcctacagtgcaatcacttaaaacaagaagcataaatttagcccatgagtctatatgtttataatgtgtgctgtgctcagctgagtagttcttctgctatttgcggggctcactcacatgggtgggatggtggctttgctgttgg

SEQ ID NO: 52892 - DNA, 1099 bp, Bovine  19866880653989
attgctattttggtttgctgacccttgcccactggaccacgtcccggttttaattttatacgtcaacttggctacgttaaggtcctcggatatttggtcaaacaccagtctagatgctgctgtgagagtatattttaaatgtgattcacacttaaatcaatagactttgagtaaagtgtattactctcccataatgtgggtgggcctcgtccaatcagttgtaagttttaaaagcaaagactgaggtctcgtgaagaagaggaaattctgcctccagggtgccttcagactcaagattgcaccatcaactcttgctggaacttctcagcctgccatcctgcccttcagatttaagactgtgagccccctgcatccccacagtcacgtgagccaatgccttaagataaatctctgtctctttacctatgcagcctgttggctctgtttctctggagaacactgacatatacactatgtacatgacctctccagcaaggtggggacaaaggctgggagtgctaggaagtgaggccaggacgagtctgcaatccaggaagtagaacaggtgggcttaaagacactgcaaactcctattgaatttttgacaaaaccaggatttatatattaacatctgagatatggctgaagggtaatattcaaagcattgcagcaactgttacatttttctcccttcaaatgcatcttagtggcttttcttttttaagcctaaactccgggaatggtatttagtacatttcttataaagcatctgacacatcctaggtgttaaagaaaaggttaatttcctttaaaaaaaaatattctgtgcagagagcttgctctccagtgcatggaggctgcacttaattttcccatttatcttcaacattcttcctcctgcctttgaagctctttcatttaacattagcatttgattaaccttttattcaagagacgtctgggttttgttatacactattatcctgattctggcttgtttttatttcagataatttttgagtagccgcatgtgccaggtagtgaggtcttcttttattgctaatttttggcagcggggctccagcaagcacggttccct

SEQ ID NO: 52893 - DNA, 1171 bp, Bovine  19866880703544
ttttgaatctcaaacgcctactattcattatggtccaggctcttccctcgtctctgcagaggtaggcatgaagccacatccctgcagaaactctaaatggcaaataacagaccagagtgccgttccgaggaccgtgtttttaagtttccacgtggtggatggaagtggaactggacgtgttctgggtcttcagcctctcttcggccatttggaactatgttccttctgggaactcactgtctgccagtaagtcaggaggtaacctgaatggcagctcttaagacatatcctaagtcgcatccaagcagctctcccgtggcccagtgcgtaaagaatccaccccaggttcaattcctgggtcaggaagctcccctggaggaagaaatggcaacccactcctgtattcttgtctggaaaattccatggacagaggaacctggaggggtacagtccacgcggttgcaaaagagtcggacacgactgagcaattgagcacgcaagttgtatctgaagcccagaacggacgccagagaagtctggcacatcaaaacaaattcgagtgacatgtcatgctttaaaggactgtctgtaaaatagaatcaggcaaacatttttttccgcttctgatttatacccttcatctttgtcatgggctgtcctccagctctttagtaattattcatcttcccagccatgccctaattgtccttcctgcatctagataacttttttttaaacattcactttctttgttacttcccaatatttcatgtattgtctatatgttcttaaaaaataaaaacctctttccatgtctcttttacttaagggtaatatttttattattatttctatttttgaattacttatttctcttctttcaaaaattggctgcctattgaatgcacaaatgaataaagaacaatgaacagaaatgtctcaagaggatgttggagggaacggtggggattatgttgaggtggagaggaacagatggcagctgctagtgaaagaaaaacacctctaataaatgaatatttagttacccattttctgaactcaagtttgccagtaggggcatgaatgcacacagtcagaatcagccaggcaacaaagcaggaaactacgagaaatgatgcccagaaatgtcagagagagacactcaaaggaa

SEQ ID NO: 52894 - DNA, 730 bp, Bovine  19866880749782
gtgcaaatttacgtggagaaatgtggtgacacagaaagagactttcactgttgggcttgtgatcaaactcattctctctgtctgcctctgtctctgtctctctctttctctctctctctctctcactatattcttgtccttaatcgaaagtggtagagcatacacattcctgaaacagctctaattgttttctttggactagcctccagcaaattaagaagagggagcctagaaagccatttcagccctaaaataacaccatgggagcttttcttctgagacaatctcagcactcagcaaatccacgcttttcatcccttgcctggggatatcaccacagatatgtcatgcccctcctggtgttgataccttcatcttctctctcactttccctcctggctttaattaaacatcacactgaaaaaggttaccaaggcaaatcatgagacgagttctgccatcttctaccacatcccttaagaagcgggtcagcctgtcttcctccctcaaggcttcgctcgcttctctgccttgttgattcctctcagcgcttactctccttcatgcataagagctcttctcacaggctggtttctcactctgccattttctttgttagtcttggctcctcaaagagaaccctgtatgtttctacttggaaacccttgtgtctacttctagattcatccctatccagatactaggacatattccatctctaaaaggctca

SEQ ID NO: 52895 - DNA, 965 bp, Bovine  19866880939867
caatacctccagttttatccttcacaaactgattgttcaaaggactgccttgtggcattttttttcatttttgtcttgcagaggtatttgactttccctatctccctctcctatgaaactaaaagatgcttactccttggaagaaaagctatgacaaacttagcatattaaaaacagagacatcagtttgcggacagaagtccatgtagtcaaagttatagtttttccaatagtcatgcatggatgtgagagatggaccataaagaaggctgagcattgaagaactgatgctttcaaattgtagtgctggagaagactactgagagtcccttggactgcaaggagagcaaaccaatcctaaaataaatcaaccctgaatctcccttagaaggactgatgctgaagctgaagctccgatattttggccacctgacgtgaagaactgactcactggaagagaccctgatgctgggaaagactgaaggcaaaagaagaagggggtggcagaggatgagatggttggatagtatcactgattcaatggacatgaatttgaacaaatccaggagacagtagaggacaaagatgcctggcatggggtcacacagttggacatgactcagagactgaacaacagcaacatctccatctcatcttcccagctacaaactaaagcaaattctctgtccctgagtagtagtagcatttctcccatctttcagccactttttggacacatgcttaatgaacttacatatttcaaaaacataccaacagaaagttaaacatataggaaacttgcagtacttgcataagctccacgctacccacagctcaacaagtccacaaggagaaaaacaccctaaatcagcatgattcactgggtttgcacagcaggaaaacctattcatcctctctgattgcttcaaagaacttgctgaagataggtgttatattaatctaag

SEQ ID NO: 52896 - DNA, 1933 bp, Bovine  19866880940304
gaagatgggggaggaagataaaaaggctaatatttttaaagtttaagccccttgttctcacccctgattcagagatgtcagtgtaggctgtgggatggagctggggataagcacaggcttccagatccagttctatccgggctcaggcaccgaaaatgtttgtgtgactctggctgcatagattctctgagtctcagcttcctcatctttgaaacggaagtactgttctcctcgaaaagcagttttcgaggtcggagccagttcactgaaagtgtttagcttgcagtaaacacgtaaccaattatattccttgcatcctcatcagtactttcattgaccacattactagagttttgtggatggtgcagaaagaagaaataattcaaaaagtctacaggctttattttcttgagctccaaaatcactgcagacagtgactgcagccatgaaatgaaaagatgctttctccttgggagaaaagctatgacaaacctagacagcatattaaaaagcagagacatcactttgctgacaaaggtccatcatagtcaaagctatggtttttgcagtagtcatgaatggatgtgagagttggactataatgccaaagaattgatacttttgaactgtggtgttagaggagactcttgagagtcccttggacggcaaggagatcaaatcagtcaatcctaaaggaaatcagtcctgaatacttattgaaaggactgacgctgaagctgcagttccaatattttggccacctgaggcaaagagctgactcattagaaaggaccttgatgctgggaaagattgagggcaggaagagaaacgggtggcagaggatgagttggttggatggcatcaccgactccatggacatgaatgtaagcaaactctgggagatagtgaaggacagggaagcctggtgtgctgcagtccatgggatcacaaaagtccaacatgactgagcgactgaacaacagcagcaacttggttttagagtgttgtgttgaaattaaattgtcctatatgtttgttgaaattggtaacattttgtgcactggttgttaggcaaaacatgttacaaacagataagtttaaaagaaaagatacacacacatgcagagaataagtttcttttttccctaacagttaatttttaaaatatggcttcctgttctgatgattcaagttacttaggagaggaattttctaagatgtgatagtctcatctctgtgatgggaaaagcccagagataatttgaagaccaaggaaatcagaattaaaacaagataaatttagcctaattaaaataaaggatctttaattaggttaagtggaagactgaatgttaagttagaacagacacagactttggtctgaggaagattattgacagatggattaaggatgacagacatgatccagaaaaataataatgaactaagcatgaaaacgataacctggtaattaaatagtatttcaatgttttggtatatttgattatcttttgaggcggaagacactgaatacatcttcttaatcagcttatttatttttcaattcttgtattattaatggattcattcttgttttcattcacaggtttatgttcagcaatgaatgccaggtgctacgcaggtcttggaaaaacagaccatttagacacagaacctgagctgaacagccacctaaggcttgcagtctacagggggcgctgactcatcaccagaccatcatgatgcaatatggtgcgcaaatgacaaatacttggttatactttagttcataaatcactggtatcctgtcattagtttgaaagtcttctctacaacaatccaaatcctcaggaattgctggcagttctggagccctcagggaatcaacaaggggctgcatgtacatatccttagttacaatgttaacagttca

SEQ ID NO: 52897 - DNA, 943 bp, Bovine  19866880986867
acaggggttggtggatcaacacccagctcccacaccctcgggcagtgtaactgaagaccgagttccgccccgtctcctagagcccccaggtatgggggctgagcgccagcagcccacagtgccaacccacctggtagcgcctctcctctctgatgccctgctgcctccacctccgtctcctgccctcctgacgcttcttgggaccacgtccccagaaatgacatcagatccttgctgcagggtcagcttcttggggaacccaaactgagacagacacatttaatcacctgacttctaacaaagcacccgtcatgcaatcgtgtgcttgtgcctgaaatgcggtgaaaacaagccgaaccatcacctgacatgtttcaggtgtgaaatccagactctgatcctctaatgagccccgcgatgccccagggcaaagggctcgtctactttcttaaatgagctcagctcagtggccgttagcagggcacccctgtcctgagtgaggctggcccacctgcaagcccaaggcccctgttaatcagacaaaggatgtgcaagcaaataaaacattttaattaaggcttcattggtaagccagatgggccaaccatgatctaatccaaagaaccttgtacccttgtagcctctgttctaaaacatccaagcacgtgtctacaggggcctagaggcacctcctcccggttagctcaggcactggaggatcccttctctcccagtttcttcttgtttgccttcgtcttttcaatcatggtctccacaatgacagcagtctcttcgtacgtctggatgctctcggtggaaaacttctctatggattccatcacctccaccttctcataggccagcttcctgggagggcttctcgccagccggctgccgctccgagccccatgcccctcggacccacccagaatgacctgaggcc

SEQ ID NO: 52898 - DNA, 1574 bp, Bovine  19866881045383
tgcccactttgggggaggtctagggaccgggaaaaatcctccgtggatgccatttctaaattacactaataaatggatatgttcttggctcagatggggtgcaggtgtgatgctccagttcttaatattagtcaccttataagcaatatgctggggcaacatcttggtaaactagagttcatcattatttgtaagccagaacaataaacaggaaaatctatggaccatgagtgggaaggaggtcatggcactcttgtttttcgtgaggcctcgaccttgataacaaacatcatcagcccagaagaggggtgcatctcccctcggaacaggggctgactctttgaaggcaggccctccttccatgacgtcaccgtgtctgcgtatgatgtcactaatgtcctcgcgcacccccggccctcactcaccacgccggccttcggggttccgcttgcgcccattactgaaggtggaggccagcgtggaggagcagctctcgtcgtagagcgcggtcctgccgtcgttgatggccgagttgatggagatggtccacatgctcgatgcgtagccgtcgcagttgcagtcatcgtagctgccgccgtcgcccgaggcccacacgtagatgctgcctttgcccccgcggccctgggggtgggggacagagagggatgtgcgggctgcagcggggtccgcctggcctcttaagcagttgaacctaaggactggcttggtttctatctgtccttgaaaaccactgtccttctggacaggcaccctgagaatttttcttttcaggaaggattcaatataaagtcatctcaatttacatttaatctgggaataacaaggtgggaaggactggaagaatctccttaaaactgacaaatggactgctttttaaacattgataatcctcatggtaaaaagtcaaagtatatggaaaggaaaatgaaaaaaacaaatccctctgcatgtaattcttacatattctttcaggcattttttagcaaaaatgcaaatgaacctgtaaatttatacttagctatgtaagatgtaaaagatatttatatatagcttccattttacaggtattatgtatattttacatgtttacatatatatatagatattgtgagtattataatacacacttacagattttatatatatatgtatatgataccgatctctgggttgggaagatcccctggagggcatggcaatccactccagtattcttgcctggagaatcccatggacagaggagcctgtagggctacagtccatagggtcgcaaagagtcagacagtcttagcaactgagcacgcacacacgtcagaggaaaggagatgtctgaattacctccaaaggtctcctgcctcctgacaatgagaagtgacattttgattgcttctaagaggacttggagttaattagcctgtgactggctgagtcgatacatcaacaaagattgatttagccactggctgagaagtgtcctcagtgtcttggtaaatctgtcctggaaaactccatccaagcaggcaactgcccgcagaaaccaagacacagaagga

SEQ ID NO: 52899 - DNA, 2394 bp, Bovine  19866881075386
tagagcttaactgatgtaggattcaaggcacagaatcctagtctgtctggtgaaacgaatatattttcacacccctatttgggtgggttgggttatgtttaaaagagacgggctcacgtgcctccaaaccaacccaaaccacagagtatatggaatggaaggggtgactaatttgtaaatgtttgtaatttataaacagcccattgtaggaatgcatcacaatttttcccttggagtttcagagctggactatgctctaggcttcagggcagggaattctataaatccagtctgggtaactgaatgagtttatgtgtgttaggattgcctaggtatcttacaataacaaacaacccacaaatcagagtggaataacaacatcaaagcttgtttctcactcacgttatgcatccaacactttgaaatcccttaggtacccaggcttcatcttagctgcatcccaatccctggttacaggagcaactcaatggcgggagaaaagcaaatcacgcgctggctcttaaagcttctgcctggacgtgatgaatggcatgtaaactcacattccattggccaaaaccagtcacatggttctaacttccagggcatgaggtgtcatcttcacatgtgcttaggagaagagtagtcatttctataaagagcgctaataagagttgactcattggaaaagactctgatggtgggagggattgggggcaggagaagaaggggacgacagaggatgagatggctggaaggcatcaccgactggatggacatgagtttgagtgaactctgggagttggtgatggacagggaggcctggcgtgctgcgattcatggggtcgcaaagagtcagacacgactgagcgactgaactgaactgaactgaactgaatgatatttacatgtttcagcagcatcataccagctacttgtcactgtgggcatcagtcaataccagctctaacttccctatttttttttttaatgatttatctttgagagaatctccgcaggacaaaaatgcataagaagagggtagtaaacatatttgtatggaatttttcttttttccttttctttcttttttgattttttaagggggaaggcttttttttatttcttatattagaacttgcactaaaggtaaggcagctctctttaattcagttcaacaaataattttaagcgagacttggtgtgggggtattgaacttaaaaggtaaatagagcatgctccctcttgcaaaggatattattatttagtgaggaaattattcaatcagaataaagcaaaacaatacgaactaaattctgaaagtgaggaataaatacagagctacaagagttgtgagcacttaattctaaactggggagggtttcttgcaatgttggtcctcaagagtttaaagatgatgatccagtaatgaggtagggagacagaaattgcatttgaatatttccatgagacagaaaataccggtgttctgtgtatcaaaaaacagaaggagcagactagaagaggtagatggagggaacacccctaagtcctgtttcatggaagacgtgacctctgatctggccctgaaatatcaggtggctgcagagtgtgtcaagcaaatacttaccatctggtactttaccatctacaccaaactaataagagcctctgctttggcattcctgaaccagatcaataccgggcaagctgatggtactcccggtctcgacttgaatgtggcagaagcctgggagctgggatacacagggaaaggtgttaccattggaattatggacgatggtgagtattccaaaagcttcattcatctggaaccaagtgtgtcttttgcatgtctttggaacagaaaagatccatcgtttgggagtcagaggtaggagggccagaggctgggcatggtcatgtatactgtgccgacatcctcagcctcctcacgtcagtgatcctcaagcccttcaccaatatgtactgaattaataagtttacatttttttaatgaacaaatgaaagttgacaaccactgaattataatttctcactggggccactggacttcccctggtggctcagtggtaaagaatccacctgccaatgcaagagacgtgggttcgatccctgggttgggaagatctcctggggaaggaaatggcaacccactccagcattcttgcctgggaaatcccacagatagaggagcctggcaggctacagtccatgcaggtcacaaaagagccagacaggatttagcgactcaacaacagcagcaacaaacactgcttatatctcaccttgaaacagcttctaaacctgtttatatttaccacctatgtctctagatccacactgttcaatgtagtagccactagccgtat

SEQ ID NO: 52900 - DNA, 2474 bp, Bovine  19866881103879
tgactgaacaacaacaagtataaaagaaaaatgttacttgagaaccaaaccatctgtacccacacagtgtaaagcctacattgaatgactttcatattccactgtctttatcaacatgctgtcactgtttcagataactcttgcccaagaaattacaaataacttgattggtcattccagaaactttccctaaaagattaatcaactcttcaaagaaagaaccaaatgacgttttatatcctgaagctttgaaccttacaagtttaatcgtcaccacaaattccctaccctgctgtgtttaccagttctaaagcattatgtcaagatccttataattcttaacctagctcacagcccctcctactgaaaggttcactttaaactagatttcaaatctactttaccttgccccttctgagtgctactaagacctgctaagtaatactcccccttaccgcagaagagtccacccaactctgtctcatcaataagtgacagctaacactgggccttattctcaggaatcactcagtaatgactggaataatctgaagtgactgagcacacgaatgccatcttcacagtgtacctttcccgatgactttaaagtgtgactccagtcactttaaatattaataaaattaatgcttatttatatttaaacattaatattttaaattattagggagaaaaggatgacagaggatgagatggttggattgcttcaccaactcaatggacatgggtttgagcagactccgggagatggtgaaggacagggatgcctggcgtgctgcagttcatggggtcacaaagagttgaacatgactgagtgactgaacaataacaaaattaatgttataaaaactattatttattgagtatttcttattagttagacattgttcaagtttcctattaaaggataattttataagaggtaaaatcatgacacttatacagataagaatgagcgcccatcagagaataatttaactggtagctcatgcatctgggttatgttcaccttccattgtctttgagccatgtcacaactctgcaacttgcagaaaattgagagtaatacaaatgagtcttgcccatgaaatgcaaattcactccagtgaaatgcaagtgattagtaccttgtggagaaatccatagtggctcagcagtaaagcatccacctgtgatgcaggagacacagtttcaatccctgtgtcggggaagatcccctggagaaggaaatggcgaccgtctccagtattcgtccctggaaaatcccatggacagaggagcctggtgggctatagtctatggagttgcaaagagtaggtcacaacctagcaactgagcatataatgttaagaggcatcacacaaaggcctggatcctttccatggtgtaataccaatcttctcccttgagcatcacaaccagtgactccaacaggaccatggctcacttcttgcctgttggtttagtgatgtgataagcctcaagtggccaggtgtggcctcagcttctgggacagcagaacctttgtctgatgttccctgttagaatcatttctccctcagtaacctagatttctaaaccagcaaagcccagtattgcagagacaggaacacagtttttgcaaatgggccattaggaaagtctagtcccagttctggcccttgttcctggaccagtatcttcaaaaagtctgaagacttccctggcagtccagtggttaagcttccatgctcccactgcaagaagaactaagatcccacaagccctgtggagtagccagaaaaaaaaatctaggtcctcccctttccctgatgctcagtccctttggagaaagctagaagaaatattttggagaaggcaatggcacccactccagttctcttgcctggaaaatcccatggatggaggagcctggtaggctgcagtccatggggtcgctaagagtcggacacgactgaacaacttcactttcacttttcactttcatgcattggagaaggaaatggcaaccgctccagtgttcttgcctggagaatcccagggtcgggggagactggtgggctgccatctatggggtcgcacagagttggacacgactaaagcgacttagcagcagcagcagcagaagaaacatttaccatatacatgttgggcagtgtggtccttccttgaagggacccacccttcccttcattcaaggggctctgttctatgaaccggcccaattctaggaattgaatgagggggcaaagctccttagcgtggtgactcaaaccacatccctgtccattaggagttttttcatttgtacagattaaaactttcttaggctgcccaactacatcactcctaagtacaccatgaccaattaacttctgctaaagccctctcgggttatactatcctttcactatttcagctctgtttcccaaggtactaaccacatccaccttaca

SEQ ID NO: 52901 - DNA, 1534 bp, Bovine  19866881214892
cgaacactccggctgcttcgggagcagccgcggatgtcccagaatgcctcagggtgcagttgccatataaatctgtggttgcctggaggggaagagagtgaggaatgagtaaagaagccccattgctttaaactcaaaacaacacagagcagaagatcttctgtttcttttacttaaagtctgccttgttctgaagatgatttagatgaaggcaagaataagcttagcactcatgtatttattttgccacacatttttatctgagcttcctagtagcctatgcaaaaagggaaacacaatcagttatagttacagtgtccataagatacaagcaagtcaactgtttagagagtcaactttgcagctattctaataaagagatatttaaagtgacaagccaataccaccaccatactcaatgcaatggtggggtttgttaaaatgagattggctcagaaagcgcagggccacttcatcaacaaattattttcccttcaggaaaaaagggtggcattcctaaagaggaaaaatgaaacaagttcagctaaagtttgcctagagggacagccattaaagagaaaatgttaccgttctctacatctaaaatccaccaagagattctggaacacagtgaacaagacaactgctacatcagtgattaccccaagtggggaggttgatcagctgagttttaaaggattttacagagaaagtcctcatcttcaatgtttgtgagagacagggttttcattaagattgtttataaaccatgagaagactcatttatcttgtttgtctgtaggctccttgagtgggtctattattttgggggacaaagcatccgggcagtttaaagtcatctcctggggaaagtgactatattcaaagagaattcagtgctcctccccagctggagtagcgtcacagacagggggttgaggacagagtgataccactggaaggcccttgagccagggaggggagcttctggggggtgtttgggagaaggcttacaagcagaacaagactggggccacacttgctcgtccctttctgctcatacagctcagaagatgagaaaatgaagcctctttccacttgggaggagctgacacattttccatcctccccaagactaaggggagctgagcagactcatgggagaaattaggggggttcatgggggagccaggctaaggtctgggtctcctgcagggaagggacttctgccagctcatgtgagagctggtcgggtggagcccaggcaggaccttgggactgaagggctagctggtactgatgactgcattcttgttcctgcctttttgccaaccctggaggaggtggtggccaggcagaatgtagcccagcctgactactgagtcacccactaaattcctagcttggaggactgagaaaaggctgtatgcctagcggacttggaaaattcactgttaaacctagggcccaggaaggcagagttgctcagaagagtgcaataaatgtctatattcttaacctttggttttctcaa

SEQ ID NO: 52902 - DNA, 1238 bp, Bovine  19866881222453
tatgttatggtacatggtgagagctaagtaaagtttctaatcgctggctttaagatagggagattatcctgggttatccagagcttgatcatcacaaatacttcatcagatggaagcagaagaggaagtggtgccatgtaagaagaatttgatccactgttgctaccttagaagttggaggaagggtttgttgtttagtccctaagtcgtgtctgactcttttgcaactccaaggactgtagcccgccaggctcctctatccatgggatttcccaggcaagaatattgaagtgggttgccatttccttctccaggggatcttcccaacctagggattgaacccatatctccagcactggcaggtggattccttaccaccgagccaccagggaagaccctagaggagggggaccatgaaccaatgaatgcatgcagcctgtagcagcaaaaaaaggcaaggaaatggggcctttggaaggaatacagccctgctcacagctcaattgtagacttctagccttcaggactgtaagaaaataaattcatgttgctttaagctactgagtttggagatgtgttagagcaagcataggaaaggagacttcagaatgagaggctgttccctcctggcatttctcagagtgcagatccaagcacatgatggtttctgtaccttccaggagcacaactgcaaagtcggtgcgtgactttcttcatttgttctgcattgctgggctggggctcgttaatgccgcgcactgggtgctctgtgcattaagtagaagaattgatcactctgacctttattctttgttggtgtttcgtcattcgtgggctgcttggcttgacatatgaattactctccagcctcctggtgcgggggatgcacagtcaccagcccccgtgtattttagacatatgccagttgtcatttctacacacatctccttttccactctttcaatctgggattgttccactggcaattaatgaaatatggataaaaggaaagaaccgacagggcattgctattgacaaagaggttagcctttgaggaagatgaaaaacacatgccctttaggaagaacccacggagaaatggaatattcagtccccccttgccaggactgaaccctgttccttaattcattggtctatggtcctaacccccaaaaaccaaacttcagtgtgtgtgagtttaagaaaaggagattgtaaattttcaagactccacttat

SEQ ID NO: 52903 - DNA, 1234 bp, Bovine  19866881250994
gggtgctgacctgggcgtcctgggcctggctggcctccagcagggcctcgatggagcggatcctctccgtgagctgcgagttctgcgcccgggcctcatccagctgcccatggagaccacgcagctcctcacacttgcccctcacctcagcctcggaggactgcagcttgccgtgcagctctgcagaaggggtggcaggtgggtcaggggtggggggtcactgacacagacgctcccaggctgcccagcacacacccatgggctcgagacacacggcgcaccaggggcagcccaccagctagctggtggagagtcaccaccaggcttctgcacaccaggggacaacaaagtgcccccaccacttggcaaagatgggatctgaacgggtgtctgctgcagagtctaaactctgctcctgggagatcggctcacattgctgagacaaaggcgggagctcctggcgtgtcctttccccttggcgacctccacaacatcccaccatggctcagaatgccagccacgttcatctgactctgcacagcccctggcccgaggctcgccccacacacacagggctatgctgaaggtgtcctcctccccacccctcactcatctctgaggcctggggatccacatccactgctggcccaatcctctgggcgcctctgtggctgcctggcccagccctggtccccgggccattctgcgcctcggtcctttcttgggccagagccggagcatccggaaggacaagtggggggtttggtccctccacccccacccacactcccagccctcatcactccacaggatggtcacctgggcccgcctgtctgcccccacactggccactgctgccatctccagccttgcgcgccgacctcctcggtctgtttcttgtacagtccaagttcaagtttgtccccattcctcaggggctctgtgccgggcatttctgccctttcctggcctttgtgaggcagacctcttccagtcatccagacctctctccccagaggcctcccctgaccacctgaagctacaccaggcccatcacagcagggggtggcagcccagaaccctgagccatcccagcctatagcctgcttttgtcaatagagctttcctggcccacggccaagcctgtctgtcctgggctatgtgggcactgtggcagcagagctgagcagctgtgacaaacaccatctggcctacaaagccgagatcactactg

SEQ ID NO: 52904 - DNA, 1207 bp, Bovine  19866881260884
gtccagaaggagccttgtcttggaaacagggaacaagattcagcagcaattggaatgccttgctccactgtcagcaggaacccagaccagcccacagagagctctgaatagcatttatgatccttaatcagcaagcatgcagcgttgatctggaaattaattggatgctcgggtttttcacacactgtggagagttagatattacaaagattttgacaggaatatatttagtaacagcatcactgatgctctatggcatgcagagacccacatccactttgggactcattatatcctgagtgacagtggatgcttagcaaatctctcttgattatgatgattaaccacattgctcagtgtctttaacagcgagtgaggagctggaccagagctggggttttctaaatatgacccactctactattatttatttaaccatctttacttaattgactcatttattagattgtttttaagggtaattgtatgtttccactataatggaaaaacctcacttgccatgcaaataggacagtctttaaaaacagatacagtcctcccctaatccagatcatggcccattgtgggtgcgtcacgccccaagaactgctgggctgggatgggcttgcagcaaaggaactcagaataaagagccagggtcatgtgttcccacagctgtgtgagtctgccgtacacagcaggtgatacaaggaagggataaagaaggagaaggggacagtttctcaagtgaacagaagtgaagatctgttgcagttcctgggagcaccagctaaaagacagagagaagtgggtcttctggactcacctccagggatcagaactcagttgttcaaggaggcagggacagaaatggacaggggctcagggtcgtgtttactgctgctggaagtttcctttagcctttactctgttaaaaaatatttacaaatgtacataaatgtaggtttcttcaggggcaaaacattgcttcaacttcatacattgctagtaggaaggtcaaatggacaacccctttgagaagaggcagggtgatttcttacgaagttaaacacacacacagctgccgtataaccagcaagcccccccccccaagtatttacccaagagaaaatgaaaacatatgttcattaaaagacatgtgcaaaaatgttcacagcagctttattcatctttgcaaaaagtgtaa

SEQ ID NO: 52905 - DNA, 674 bp, Bovine  19866881373179
tgctgtacaatgttacgttagtttctgccgtttaacaacatgcatcagatatatgtacacatatatcccctcccttttgagccttcctcccacatcctcactccttttaaatcactgggacttgaatggtcccatctcccattcctgtagcttttaccagtttataccttttccttaaatgacctagccctgtttttttcttcagttgtgaaatctcagctgactcttgtatctaagctgccttaaattaatacagtggggaggactcatggggttttagtgagagttttattatcagcaaggcattaaatctagaatgggttgtattcattttataacttcatcaacaagccatcaaatttattcagactaattgactcttcataaacagaagctactcattgcttccttatttttcaggacagtaaaaatttattttttgtgctaatttaggttctattattttgctaggatttggagaagctaaacaatgaggaccaagggcctttttcatcttcttttgaaaattaggaacacattgctattcactatctttagattcctctttaggtctacaggactacaaaataatgtttgctcactggaaaattaattagttatttctcagggcttattggaacattgcttattgtctgtagaaaggattacctatt

SEQ ID NO: 52906 - DNA, 723 bp, Bovine  19866881789058
ctgaccttttaattatagctctttctctggatgggtctacccctgatgcatacccaaataacttcagtgatttcacaggtctttactgagcaccatgtgtatgcaaggctctgtgagttgtctatgaacctgtaggacaagtcctcctgtaggtaccttgcccagaggaaacttgactggcccattgggaggtgtaacaaggtgaatttagcaataagagaggctgttccccgaggtaagagggcccctcttaaaggaactagagaggaggaggagggttggctccatggattgcagaccccactccaaaggcaatctgggtccgaagaccatggctagccccctgctgggcaccctggttgggtgtcagagacttacttgagtctcagcccagctctgcccatgagcagcagtgtgagcctgagcaagaaactttcatttcatatttataaaatcagaatgttgggttcactgaaacacaccattctggtcccttccagcatggtgtgtctttgttaatttacagtctgcggatggtacggaattcacacaggtttccaatccctattctgccattttcaaatcccaaatccaaaaggctctggaaactagatttttttttttttaatttcttggcagcaaaacctagtctgaactgacatgaggctatttatagtctttattatgccacttagtgtgaatatttatacattttgccacagg

SEQ ID NO: 52907 - DNA, 1692 bp, Bovine  19866880478995
tgaatgtaggaagtgaagaggcagcagttacttttttcagagctcaagatccaaacctttagtgtttgggaatggtgtaggaagtgatttatattgccctaaaacatgtgttgctctaaatcttagaaattcagtagggttcctccttgacaaatttatggaaaatggcaatgtgttatggaacctggcactttccttgctctgcgctcgcccagccttgcccttggcagacttggtctcttccacagaaaattgtctaatcatccgtgtgtgctgtggcctcagatacctggtggtccaccttcccaggatgtttgcaggagacagggctgtgttcaacagaaaggcaaacatctgctgaagaaatgtaggggacggggaaaggagattttacagttcccccaggaacactggtaaccacttctgtgtcttagcaatggttagtcaaatgcccagtgaccttcaactcagcccatttccaaaacttcttattttataataagttcaactacaggaagttcaattgctacctcccctataaagctatacatggctccctgtctcccttgtcttccctgacctcctttttcagggttcccactgattgttatacatggctctgttacaacattcatcatattattttaatactaacaataatgtcttttgtaataatagacaacacatttcatatttattaatgtcattttggtgatacatctcttcattatgtggtaaggtatgggaccctgtagtttcatctgtgtatctcaagtgccatctgtcatgtgacaggtgctcaaaaatttctgtgaaaaaataaatttcttgctaggcctgttctcccaaggtcgtctatggagttcaccagattgagaacttaatcatggccactgtgaatctaatgctggatataggccaagaccagcgcctagttagtttcagatgaggaagcttgtgagcttctccaagatcaggtagctggcgggtgatggcgcagtgacttaatcctcgtattgtctgtttccaaaaccgttgctcttattgtatctgtctcttcgtctcattcatcattcattcatttaacccacacttaaggagaacctgctgtgcttcaatagcacgatgtatgtacattctgagagtccatcttcatcctcaagggcccagacttccctgagctcacagaatggtggaaagaaagtccctaaaactgctaaacaagtagataaacacaatcctgtttgataagggctcttgtctgggatcgacatagtacttttcttctaaagaatataaaactctgactacctgaacaatgagaccataaagagattgttgtcatttcattcctttccccctatggaaatgaagcccattcctatacaacatcctgagacctggaggcagatcagattaagcagggtaccttggtactgctcattatcccagacctacctgcctgtcccctgctttaactgctagctttcctgggcagaaatatttctgagctgcactctgcacttttccctcctttttaacatcatcagatttgaagtagacatacgctgcaatagacttgctggaaatattatagaattccagtaggagatcgttcaccttctgttggacaataacacgtgttcacagtctcagcagtttgttcactttgtctgaggaaggaaccaggaa

SEQ ID NO: 52908 - DNA, 3413 bp, Bovine  19866880485669
actgatttgctaaacctgggacacaacactaaattgtaaatggaaagatcatggctgccaaagatgccataaaaaatggatacagacgtttgtttgatgaagaacattctaaaattggacatacttggtaaggaaaaagtgggaatcctaggggatgccagtgaaagcaaataactccatttctcatttataaagcagtaatcagaaatggggtggggggtgaatgctgagggctaaaagtatgctggatggatgcaggtacgactgggatagtcatgatctaatagatgtataatacaagccacaaatataattcaaaattttccagtagccacactgaaaaatagtaaagttaagctgaaatttaattcaagactatattttatgtaatcccacatatcaaaaatactatgcttttaaaatgattaatgaaatatcatacattctttttcaaattaactctcaaagtccagtgtgtcctttactcttatcacttatctcaattataatttttcatcctttaaatctacattttgatatttatttaggttacaattgaaaaaggagacttccattcctaccttgttccaaatattcttattcctataactgagtcagttttcagttcttaaaattttatttcaattaactaagtaaagtataattaaatgtttggtttacatgtgactagaggtgtgtactggatactgtggatatcgaagaatgaggagcagactcaccctggggagttggagtgaaattaggaggtgatctactgcactgaagaagcctaactggaaaactttctttatctcctccaccattagacaggtgagagatattccctaaatcaaaactttagtagcaagatggaatatgggttattcatttacctactaaattattgttattttattttagctcttcccacaacttctaagttctaggacagactatatatgaaaaaaagaccaaaattatgtattcaaaatctttggctttaggacttccctggtggctcagtagataagaatttgcctgccaatgtaggagacatgagtttgatccctagtccaggaagattccacatgccttggagaactaaaccctatgtgccacaaccactagggcccacacaccctagagctttgcaagtgacaactactgagtccaacctcaacaagagaaaccaccacaatgagaaacctgcacacggcagcagagagcagccttcgcttgccctagaaagcctgtgcacagcagcaaacaccgagtacaaccaaaagtaaaaatgaataaatgtttagaagttatatctgtaaaaagcctttgactttaaattgaacacattttaaagccaaagaatggaaagaaatgcaaaaatccatctaagtaaatttatttggtagagctgcaaacattaagtagacagttcagttcagtctctcaggcgtgtccgactctttgcgaccccatgaatcgcagcacgccaggcctccctgtccatcaccaactcccggagttcactgagactcatgtccatcgagtcagtgatgccatccagccatctcatcctctgtcgtccccttctcctcctgcccccaatccctcccagcatcagagtcttttccaatgagtcaactcttcgcatgaggtggccaaagtactggagtttcagcttcagcatcattccttccaaaggagacagagacatatactaaaagcctaactttctttaagtactaaatctgccattataaactcaggatgtctctataaagcctagagtaagaatatgttaattatatgttctatctatatgctatatgtaattaatacacattgtgttaaatttatgaataaaatccctgttaattgcaatctcaattggttgagaaaatattctccaaaattgataggcatgatacatatattttcttactgaactcaaagatatttagaattaagtaagggatattcaaagaatctaacttatactattttttaagctaaataatgagagcacatttataattttataaatgtacaatgttcaagagaatttggcctcctgaataagaagtgaaatttttaatttcaatataaagtatacatttgaataacagatacagacttagaattttaaatttaaatatgcctcaatctgtaaacaatattgagattgagatattagggtatccaagtacatctatgtgtttcattgacttgctatataaaaattacataagcatatgtcagaaaatagaagtactcacaggagagactaaaaatattgaccttataaatgtggtttaaaatgtttgaagaagtttaactatactaaaattgggaccaaaaaataatcaaaagcattgaaaagctaaataaaagttggatttgaaggtttagaactttaagaaattgaatattattcttaaaacaagaaaaatatccttgtttcctcttaactctcttctatgtatataattttccttatccatttatatatcaggggatttctggactaattaacctctgctttgtatagagggcagcaaagtagagatcaggagttggcaaactttctctaaagggccaaaaaaataaatattttagaattggcaggtaactttaagaaattgaatattattcttttttttttttttcattaacaagcagcatttatttatcctctgtcatcctctgctatccaggaagagacttagaaaaagggttctttcttcttcccaaagatccaatcaagctaaatttaaaagactaatggatattcctgttataatcaaggcctaaacatgttgagatagaagggaacactagggcactgactattgtttgtttctctagcagcgtaagaaagcgctccccacacacacatttgttctccctggaggcccctggcctgtgaccttataacatcatccaggggttatgaccagacagacaaggcaaataagtgaagcacgccaggtgggtggtgccctctgtgctccaccgcgtctggaaggagcaactggttctgaaccccactcggtgctgagtagaactgcaggcccagggtttccagaacttccagtttttcaaaagatgctccatatcaccatttttaaatgtcagattatacttttaatgctatgtcagtcaaaacatacctgtgaagcaaagcagtccacaggctaccacttcgtgaccttggccaccactcattgtcatcatctattgcttttactatcaagtgtgaaacttaaaagtgggtacctcattaaacttgccagggaactgtgtatattgggttaagtatctggtgttcctctgtgaggtttctttaaatgaacaaccagaggcgccattaggttatacctctttttctttgtaacaggaaaagcataaagcaa

SEQ ID NO: 52909 - DNA, 962 bp, Bovine  19866880535535
acaagaatgctggagtgggttgctatgccttccttcaggggatcttcccaacccagggatgaaacccatgcttccctcatcacatgcagattctttactgtctgagccaccagggaagcccaagaatactggagtgggtagtccttggctctaggagtatgtaattcttcccatctgagagtagccaacaacataatgaacaatcagaaagctgttttttatgctaccttatatgcgtgtttgatccctgggtcaggaagttcctctggagtcagaaatgtcaacccattccagtattctttcttggaaaattccatggacaagagaagtctggcaggctacagttcatggggttgcaaagagttggacatgactgatcatatacatacaaacatggcactgtgctaggcattgtgggcagagaaggcgatggcaccccactccagtactcttgcctggaaaatcctatggatgaaggagcctggtaggctgcagtccatggggtcgctgagggtccgacacaactgagcgacttgactttcatttctcactttcatgcattggagaaggaaatggaaacccactccagtgttcttgcctggagaatgccagggacggcggagcctggtgggctgccatctgtggggtcgcacagagtcggacacaactgcagtgacttagcagcagcagcaggcattgtggggggaagagcattagacagttttctcccagagaccaagaggcagaggcagaaactaggatgaagatgattttctagttccagtgacacaggtggtaaaaactcaagtgtttgtaaaatcacactctcacttctatttcttaaaatcatggaaagcaaagaccttcggatataataacttcaaatcacggaatacttaacctagtttaatatgcaattgcctttgaatgtatctgaggtttgcatgcttatctattctttt

SEQ ID NO: 52910 - DNA, 1125 bp, Bovine  19866880594714
gcatcatcttttattggctcaaccactaccaactgactgccctacttcccccctgtacgtctagcaagctcttgttgatacagcagcaagatggttctttaaaacataaataagattacattattcctacgtttaaaatctcacttagaataaaatccaaagagcttactatggcttgaggatgctgtggatctgacatctggatgctcctctgatctcatttcttgcttatcttctctctgcccaagactcataaatccattttttgtctctgaattatactaaacaagcccagggcttttacatgtgtggctccctaaacccagaatgtttttccgttatttttgttgcttgtgaaggaaaccagaatattcataggaaacccaaaaaaacaccaaaatgcctcttgaatataaacattattttgacctgaaggcaactaagcagcagcaaatgcaggaaaatctctgcattccgccttttctggataaaggcatggtataaattctccttttactcttaactgccctgagatagcacaagagaaatctgcaaaaaaaacctttctccactggtttactcccatacatttaccttcccacagtttgctacccttggaagcctaaaactattttactttgtcctgtcatctctctacaaatttattgatctctgttggaaatcttatgtaggtggaactctaggtcactgctttgagttactgttcgtaaaggtttctcctgcataatgtgtactgcatgcactaatacactacttttctcttgctaatttgtctctttgctaaagctgaaaactttaaaaaaatgtcaaggtttgcctcccctacactctaagttaagaaaatgggtgagtgggtcaaagctcagaagagtgaatgaagcagcaaggtttgctcaggaaatctaagcaggccagcagagctgggatactggtgcagcagtcctcagcccctttgtgtctccactcatgcaaatccaccgttcatacgtccagcagaaaatcttccctgtggtcctcaagtatagatgatgcccgctttttacgatatgacaggatctcataacgtgtggatatcaggaaaaagggaaggaaacctaggaagaa

SEQ ID NO: 52911 - DNA, 1084 bp, Bovine  19866880595568
cagtaggtttgtaagaaggcttagcatacttgtttgctcagaagcacaagggaaaaaaaattatgtaagctccaaagtacatagcctcatatttggttctatatagaacagattagaaaaccacaagttcaattttatctctacttctgtaagattaaaacaaaaaacaaatccagacccaaagttgttttttttttttttttttaatatagcaaaatctctttaactgcttgaaccacatagattggacttagttaaaacacatgttcaactatcagaaatgctgtcattcttttattctgatataaatcattattcctgcaaaataaattgattctactttaattgtctgccagctgtgactataaagaagctatgtgaggcttacacttgaatctttaccacaggtggatataaggatacaaacctctaaaatacagttcgtttgggtcattaagagttcacattctttccaatacttcagagtaaattacattatgtttatggtgctattaatcacattatatcttctacgcatccaaaagaaaagtatcatgtctctttatctatattccttacccaataaaaattgcttaattgttctctgcattaaagaaaaattacagaaggacattaattgcttacctacatgatattttatttctgaagctaaaacattaacatatgcaacaacaataaaagtggagatgagtaaattacataaaataaaaccatgctttggtttatgggctataaaacaaacaaagcctgactttaaaagctgttaatacatataaatgaaagtatagaaagttcacaaaaataaaggatgtatttcttcaaagaagaaaatgaaacaaagaatcttcactatgtatatgacagttgtatgatgtttattaaggcaaggcatttttaaaaaatgtatcatgagttgaaattttgaaaatcagccaaagcattttcagaaaactggatgctaacagtcaacaatctctgctttcagaagtatttaaatataggtagaacttttgtttactttgattattaagatcttcatcttatacatatataaatatttata

SEQ ID NO: 52912 - DNA, 2039 bp, Bovine  19866881150671
tccttataattttaatttgcctgtctctaatcactaaataaatcaagctctttttaattccaactgctttttcagaattgaccttctgatgtgttagattttcttggcctggaaccactcttcatggtaaacaactgacttagttgatgttcttgataggttttcttagagtgtacagatttctattctaaaaattggtgtgtcatgtggacattttcctcatataataacacagttaaaaatccacaccttttctaaatgtagattttaaaatatttccttcatctcttacaccctaacaagaactttgcaaaggtgtaatttattaattacaggtgtaatagatattttttaattaattaattaaaggtgtaatggatattttattggtgtaaatggacattttatcagcaaataaaatgaatcccaactgtgatattcagatatgtgttgaatcaaaaaccattgccacttctgctcaccctcatcacagagaagggcagatacaaattcaactacatgaaggtgataaatatgtacagaggggagtctatgagaagagatggaattaggttttttggttcatgttcaggcttgatattttctactcttgtactgactttttatttcctttctatattctgattagatcaaacatatgcctgcaaagaacatttgagttttatgatgttactttatatcataaacttacttgaagaccaggtaacatgtttgatattttgtaactctgttatactctggaaaaaaaatctctgtttctggcacgtcactaaaatcccagggagtcccccataaaccaactggaaattgagaccaaaacaatgcaagagcattactatgtctgggacattggatttgtctatttactgcttttttgcagtagagaaagctcagtatctagtcctcccagtattctttagcaggacttgtaatggtgtagatgactgttcagcagattaattcccttgccattcctgctgtgggaagagtcaacttccttgctttgttgatgttgagcttggaaagttagtagatgtgacataagcagtgttcttaattatgcttatgtggtttggattgacttttggattccttgcattcttcaagagaagaaaattgccaggtggccattgatccaaagaatatgaaaattttgtgtagcacatcagaacccaacctaaatcctagagtccagagcctagagtctgacctagccaaaatgcgctgaaactgactggcaaactcccaaaagagaaataaggtcttgagattttaagacacttagttttggtgtggtttggtagtcagcgttattaaggaagaagttgactgagacaagtttctgagtttgttgtttaagactattgatgttaaagtcctccagtataaatccttcacttactaatttagtccaaaaatatacatgtatttttgaatagttgtaatgtgccaggccctatgttatgttctagggaaagataaagaaaatctatctggggaaaattgataaggtaattataatacagtgtgatctgtatctgatagggatacccatctattataggctgatttagaaggaggaccagaactggttttgacaattcaaggaagttttgtcagagatgaagtgcgagtaggaatcattcacattattgtaggtagaggtaataacatgttcaaaaacttagaaactagaagatatgttcatctggtggcctaaaaagaatgttgtatgaaagggcctggatggagtacaaaggaaaaaaaataaatctggaagggttaagtagtttgagaggtagcaggtagaatatgtatctgaggcttctggtagccatcttgcacactaaatgtaaagagtgaaaaagctcagatgacatcattggtttttaagattcaattatgcatgaaaccaaggctaggtttctgggtaacacctacatatatgagacagaaaaaaaaatcaatggttcattaatttaacagctattttctgagtactgggagtgtgatgacaa

SEQ ID NO: 52913 - DNA, 810 bp, Bovine  19866881215333
ttttcccctaagattaaggctcggcttgcttaggattcaagggaaatgtatcctggtggttaatttcacagtctgaatctgtgcgtgctcagttgttcagtcatgtctgactctttgtgaccccatgaactgtagcctgccaggctgcctctgtccatgggattttccaagtaagaatactggggtgggttgccatttccagggaatctttctgacccagggatcgaacctgcagctcctgccctggtaggtggattctttaccactgagccatctgggaggtccctgatttcacagagcactctgtaaattcccattcttgttactttcaaccagctgctgttcttatgttcaacgtgcactgtccctagaagactccatcaggctaatctttgctgtcaggttttaggaaatccaagcgttgtacattttcagcagctggcgcctgtgtctgcaggctggcagctgtcacatacttgcctgccggtaaggtttggaatgggggtcaggcagtataagctctgccaaagacacctgtctgatgatttctgtcacttttgctttttgtctgcccttttcctttcttctcttactgtgtgtttgtacctttttatttagaagaaatttcatatgctgacgggaaaatgctgatcgatctatggctagaagggacaggaggggttttgatgaagtcttaagttgtagctagaccttttccacgtgtcacttggcacaaaattcacagacgttctaactgctagagaagacagaaagatgctctcattggtacatagatgatttattttaaat

SEQ ID NO: 52914 - DNA, 858 bp, Bovine  19866881286995
tattattaactttccaataaaagagtacttcatgagaaaatagatggggcattttgaagtgaaagctatatgcagtttattaaaaagtaacttgagaataattacatatagtaaactaaaagttataagtggcacactcttacatcgccttctgtctttagtattatccggtgaatccttggccagctgggaatgctgaggggcatggcttctggtttggtgtactttagaatttcttccttccttctctgagcagaacttgttaatttcccttgtgggtttcatcctgcctcttcccaggggctgggatgattgctttttgtattacaatgtttgttgtaatttctgagatttttcctctctatagctagaaccagtaagatactttaagcagcaaagtctttaccaggatttctaaggatttctaagactagagcctgcagaaagccagcctgcctgctgtaggttattcaatggccaggaatggcctcttctactgctttcttgagccagtcagtgttcttgttcttttggcctcatatattcactctgtgttctgcccacttgactccatgatgttcttaaagctgtggcagtgaggaggctcttaagatccatgacactttttttttttttcccccttttggtatgtaagaggaactttccaattagatcattactaaatattgattctccactaagtagaaacataaataccactttatttcctgtgtaacaccattaaatgccctccctggtaatagtagtccaaattttatgatgtttattatttattacccagtggtcatttggctgctgaagctcccaggatagcacagagtcggggggggggggggg

SEQ ID NO: 52915 - DNA, 954 bp, Bovine  19866881316208
attttcctgatgattctcactaattccctcaatgtgtatctggcacagagagaactcagtaaatctttcctagaaagaagagggagaaacagagagggcagggaggaccatattttaagttttagctgaatgtatttgataaaaaattcaataagtaagagatgttaatatttttcattcactttacactaactccctccaagtaacctattgactagtgagttaaaatatttattaagaataatttcagaagtccataattacaaagggcataaactggggtggctgcttagaatggatttctatctattcttccctcagcaaactctgaacaaggaaggagtcaacatgattagactcctcagtggatgtcatgccctcatctaagcatttgacttcatgattaggaaatggaccatggttattgagtagccatggcagtccagctgaaggatgatcaatgaacttcaactcagatgcatagtttgagtgacaagaagataattctcattcaagctaatggggaacttgaattagactcatggtgttaaaaaatcagaaaatggtatctttctaaatgaggaaaaagaatctccttggtgagtccatccttttagcctgaattcttttgatagtccatgatatagaagtttgcattttcaaatgatcttttccagtttagagtcttatcactgttctctgtcggtataacttagtgaattttctcagaaagaggctagaaattgccttctttcctccaggagagagtgggcattataaaggttttctgccacaagcatggaaccttagataagtaatctcatccttcatccatgataaataagctattaaaaatcaaggagaaaaaaaaaaaggtagcagttggaatgtctgaaatgcatagacagtgttgtgaaaacctcatttttatgagtcttctccattgttcagcca

SEQ ID NO: 52916 - DNA, 901 bp, Bovine  19866881532900
aaagactgttacacttctcccttaaaaactattgtggggtagatgaagtctgcatttggaaaacgtacagaatggtagcagtctcttgaaaaataagccaaggttgccatgtgcttgtgctgataataagtagcatggcgcaactgcctcttctacaaaaccctaggatttatgtccagtccgcctgcatcagagactagagaattaactcatgaaacccatccatcaacacgtagaaaaaggaatcacagtatcaaaatgaaattagcataaaattagttagctgtaggacataaatagaggtgctgacattttctggcatcttctgtattaagtgtctttggagaactcaccaagcttggactgtggttgatagcctctgtgatttatttcaacaatttctaccataggcagattgtttgcaaagtcattcaggtatcattaagacaaatcaggaaacatggataattctacaagagaagaatatgatcatgggaagaagacactgctcatatcaaatatccacaacatgtctttgcagcctctagaacagtgcatcactgtgtttattaaaccattgctacagagagtgcagcaatctgacatggagccctaatgaatttttggcaaatttggaaattgtggctcttgttgcccagggagcctcttaaatcaacctcccttttactgcagttgccttttcacagtgtatatcgcattgagaaatggattacgcaatccacagctttaatccccctgcattagttgattgcataccatgagtgcatactgcacagtatatgaatcacagggaatctaggatataggtgaaaaaggttatttaaacacgaaacaaaatgggtgatgcctgggacctgagaaattctggttttttggtggt

SEQ ID NO: 52917 - DNA, 755 bp, Bovine  19866880439428
tcttcctgacccagagttggaacccaagtctcctgcattttcaggcagattctttaccatctgagccaccagggaaacccaaggtctgctcagagatgattcagatccaacagaagtttggccagaaaataggagcaggtgaagagggactcagtatttagacagctttgtgcataatctacaggtgatgaaaggtgcctggcgagagcttcctcctcatttaaatatgtgatttggactctccctggatccctcagttgtttgtttttcctgcttcttgctacatcttaaatttgagcattattttaagcaaagttgttgtaccttaatttactttaccaaacacacacagagtcgtcttgagagctgacatgatagatggtaactgcacgggctagggccccaaaggcggtaatttgtgttttgaaattccttaattatatatgtacacagtgactctaatagcccccacagaggcactgggtccagccgtagtccctaaacactgtctcagaaataggaataaaaacttgtaaacgaagagttttaaaccagggctggggataaatcagatataaaaaatctgcaatgtgatatacaagacatcctaatcaccacgtctgtaattacaaagaagagtaaatcacttttttaaaaactgtgttcttgatgcaataaagaagaataattaactcttaactcaaagctgctgtcctgatcccggatgactgtgctaacccttgggaaaggtaagg

SEQ ID NO: 52918 - DNA, 1538 bp, Bovine  19866880485468
tgagtgatggggagtattatcatggaggtccatagatggaatattttagccaaaaattaagctttcaagtttctcatgtttctttatttccccacgtaaggtcaagaggcaagtttcatcagttgaaatctatcaaatctagtcccttttcctattcaatagcccttctctgcaccccattgtttcttttgatgcaattaatcccactcaccttcctggtgtgtcctgagctctccagctatactcatcagaagctctccccaggaacagcccaccagcagtgaagtaaattttcaagttgagttctgtttcccgcagtgcctatcactcttgtgaggggatttctttcccttttgattaatgatgccattttgcttggaagagctgacctactgattcaggatgaggaattcaggagctcacattgtagtgaatggttttcaccttttgggtgctctttatttactcttcagagtcctgttgatgtttgagaatacaaaatgctccccgttcgcccatttctcatctttctgagctattgtttcactttggaagcatttgtgaagccattcaagccacagtgatgctgattttataaataaattgggatcaaaatatgaaggagtatgtccctgttagggaaaggggaaaagggccatatatttttagatccactctaatcaaccacaactacctggttaattcaggtagaaatggggtctctttccaactaaatgatccaggtaatttaggctgtgaactttggtgtgctctgatagacactgattataaatgacttatacattactaaatgaccaattaataaatgactcatccagtgataactaaatactttgaaaaaaattattcccaccagaagtcttgatttcttactatttatgatgatgaacataaactcatcatgaaagcactcgaagtatattgctacatggaagatgcaagttgcagaataatgtacataatatgctaccatttatgataaaagtaggaggaaaataatatatgtttgcattggattgtaaatgctttaaaatctctgcaaagaaaaggaaacaaaaacagggacttccctggtggtctagcagttaggaccctccgctcccaatgtagggggcccgggtctggtccctggtcaggggaactagatcctgcatgccaaccaagagttctcgtgctgcaactaaagaccccacatgttgcaaccaagacctggtgcagccaagtgaagcaattaattaattaaaagaaacaaaaataaatgcaaatctaataatgcttatcctctattgggagcgatgaggaactggcatcttttaggaatttttttttttaacatttgaagtatatgaatgaataatttggcaaaaaacaataattttttaaatgtaaagaccttcatgcaaagtaattggtgacgagtgactaaacgaaggagggtcatctttaggtactctggcacttgttctttgcccaaaggggaacaatgaggcagaaacaagggctaatgcatttgcctt

SEQ ID NO: 52919 - DNA, 759 bp, Bovine  19866880594921
ggtatcttttttacattccgagtatctcactgtttgggcagaatggttctcttactggaattgttcacaaagcaacctattatatggtgagaggtaccctccgggcaccattgaaattaatatgaaaggaacaatcaagaatgccaagtgcagtgcataaaacgcaggtaggtggtggaagacagataagcagcctaggaggtttaagttgcggaatctgaagctgcagagagatgtgttatacaatttacattacaaccagtcacgattttagaatgggcaatgaaaagctcatatagttaagtccataaaaaaaaaaaacaacacacaaaaagcttcataacacaagggaactaaatgatgggtaaatagacaaagaagataatcaagagagcagggggagaaagccggactcgctttcacaaaattcctctggttttggcaacttagcccccacatcacaggtagcactgtctctacagtgggattattttaaaaggggctttctccaccttggaactggtgacatttggggccagataattctctgttgtgtgggctgtgctatgcatcgtgggatgttagcagtgtccctggcctttgtccattaggtgttgatagcacctgcttcctccgttatgacaaccaaaaacgtctccagacattggcaaaggcccccaggaggggactgcccccatttgagaaccgctatcttagagaaaacaacagtatgaactactccgtgaacttcagattcca

SEQ ID NO: 52920 - DNA, 2670 bp, Bovine  19866880643454
tacagccacttatttgaaggcacataataccatctggaagggtttttccaggcagtagtaattgatcactctggaattcaactattaaaaaaaaataaagacatggctttaatgtttagctcttgtctctcacgcttgacaagaatcctcttcatcctgtctgtgatgtgcttctcttttgtgtttcagtctgaaagaataagtcactttgggtgaaaggtgtctagacgtccagaaacttccattcatgcagacttcaaactatcacttgggaaagttgccaacattatttgctgtgtgtgcccttatttcagagtcacgggaggtctgaaggagcttccagtgtcacatccacataaccgccgcttagtgagcagagcttccttgctgtgagccacgtgctggattcttcttatgagttctagtgtgttcccctcgttagcctccctgaatggaaggtatcctccccatttaaggaagagaaggttaagattggggcttccctggtggctcaaattgtaaagaatctgcctgtaatgcaggagacccaggttcggtccctgggtcaggaagattcccctggagaagggaatggctatggggtctcaaagagtcagacatgactgagcaactgagcgtgcacacacaaacacacacaggctgaaatttagagaggccaaataactcactaaaagctccccaggtagtgagtgaccgaagtggaccccgtctggcagagtcgcaaactctgtgtgctgcctgcttcttcagcatccacccctgagtgcctgggggccaggagccccgcatgaccagggacacgtctgtcatcaacaaagtcaggtctgggtctacttatcctgatgcagcaagggaggacgttcatgcctccgaagttcggggaacctctcaacagggaaagatgagcttatgctgggggactgtaaagatggattacaaaaggggagccagcttcaggcgttcactgtcaagatacggggcagtcagcagctagtaccccgcccatctttgttcagcggggaaggactaaagtggggtggggactgtcagtagcaagagagcagcaatcccccagaatcacccagcagaagtcttgggggctgaaatacagccatggatagaaacctcattatgcagcgttgtcatgaccagttggaaacgctgcttgtatttcaatggaaacttcacagtcttcccatcacagggctgagtttcactttcttaagtaaaaacggtatgacttaccccacagtaggtattgggaatgtagcagggaacatgacatgttctcctcctctcaaaaggttagcaaagagagggccagggaagggggacacattaccgaaggtgatttgtccccactttgtaaccaggctgtagtcctaattgttaaaatctgctgcaccccttccacccatcagaaatgtttgtgatggtgaaatttaaaaggcagccccacgaccactgccctggttatcaactgaaatggtctctcaacagaactaatggagcagtccagctctatacacctcccattcttccttactgtccccaggatgagcttgctaatatccaaactgttgttcaattgctaagtcatgtccaactctttgtgactcccaccgcccctggatccttgcaagaaggctgtctccccatcccatgggctcagagcaccagccacactcagtggctcagaagcgtggcgtcatttgtttcgtgtctgtgtctcatgcaggacaccttcacatgccccatgacgacagaggtggtctgtcgtgtccaccccagtcccctgatgcccagcatggtggggacactgcctgacactcagtcgatgcctgatgtagatgaatgtcttcttaactgcgtgctcacctccccactcagatgcctgcccgtaagcattccatgtattttcatctctatgtccagaaattagcccagaagtgggtcatgtagtaggtacctcttatttcctataaaatgagtgattgaacattttccccctttgatcgccccaataagtcattttagaaccatgaaaagggagtaaaataatcctatgttcttttacttgacttgaatagaaatttttagtctctccaaaatgtcatcgtttcaagtctcagcaggcatacaaaacttttggaagctcactgctttgagttttcatcacagttcaaatcaccgtgctccatgtaaaatggaatttgtatttcttgatcagtatggggccttaggctctcaaaagaaaaacatggcatctctcactgaagacgctttaactctacatctgagcggaactactcctctcctctctgaaggaagtctttgaaaagaagtcattgaaattactgacctagcaaataaacagagctaccctagacttaaccttcattactgggcgcataaaacctgcataccctattttctgggaagacgcacaggatgtaaatgcccttccagctgtgagccctctggagagcaggccttcagctgttaatctctgcccactgtctccagcatcaaaacgcagcctccgagacatcttgaacaagtaaattactggggagcttgagtatgttctttaacaactacttgctctaaagaggcgacagttttaaacgggtgcatttccaaggacct

SEQ ID NO: 52921 - DNA, 2062 bp, Bovine  19866880815038
gcaggctcgtgctagtacacacacgagtcctgccgcccgggtcagactcgggccccagaggggcctggaacagagctgcagaagctgcatgcttggtgaggcaggagggggaccatgactccaggcttctgctgccctccccggctcgaacaacagcagcattttctaccctgcgttcagggccctgggcctctgagtgaaaacagggacagggccatgaggggttgggagaggcgtttcccgggttaggttaggtggttctgaagaccctgccccccctccacacacacacacaatgatctttcctttttaaaaagtatttatttatttatttggctgcacctgatcttagctgtggcttgcaggatctagttccctgaccaaggattgaacttgcgctccctgcatcgggggctcggagtcttagccactggaccaccagggagtgcccacatgatctttctctcgtgttcctgctgaacctagaatgctgcttccctgcacacacagccggactgtggccagagcagcaagtattaagtccacactccagtcagagcagggctccccggttcctgaagccctcacagtcttggggtgcgggggactgcacccctgtggcaggcctgacatcacacctgacctccacagacaggtgactttgacctcacgacccgcccggctcccagagactccagcctctaatggaggccttgagtctgggctttgccattggtaattccgccccatcctccccttgctgaggccggggaggatggtggtccagcctgggcccaggtgacagagtcaaacccacactgcgctcccctgagacacgtcaggccttggaaaagccgtttgggggctttgtttatgaacttgagatgatcccgtgacatgactcaggggacagaggtggacgccttactccttgcgttacgggcctttccagcaggacgggcaaagataaaggccagtccaggccataaagtccatttatgtgagagagatgacaacccttaaagtcaaaggcgagtactcgactcagatcaacctgcagcttaacaggctgaagctctcagccccaaggaccctgggacacagaccggaaagacacagccctctgggatactccttcaggatgccccctcgtcctgacgcttccacggcctcgtcccatcccccaagcccggcctccccgctccttgatcaggaagccagaattccagatctcaggtgcatccttgctgccaatatgaggttctcggtgatctgaaatatccccgcaaatatttcctatttttaataacatggtatcaatttgcaaacagagtaatgatctctgttacttttcaggaaattatgtttaatatactttactagagcaaaggaagaacaatttaattgaaagagctgctatgaaccatatttaacctcagatgtactaaatggagtgtcttggagataagttatggtttttaatttaacgtaaactattctgtgcagaagcacggtgtttttgccactctaataacgactggtttgggtttatgaactattttttcgatcgtctttttcctctcatgaacaccgcttgtgaatgtttaagtccaatccggaggctttcccacataaaatcggaagcgaaaggcgctacaggctgggcgggctccgccgtctgcggggacagctgggcctcaaatgggacatgtctcacactggagaggacccccgggttttgaggagcgcccgtatttcatcaccccagccgatcctgcgcctggctggctccttcgtcactctgatggatggattccagcccccaaatgaagtttcatgctcaccaagattaattgctgaaggaaaaatattgaaactttattattcatataattcatttgaggggatgatcccgagaaaatgtacatgcagtggaagttcatcatttgacagtaatcagagggaggggagacggaagggatcttgaggcaacacctcagcgcctgatcccccaccttacaggagccacgggcaatggcccccgggtgtgaggaaaaagctg

SEQ ID NO: 52922 - DNA, 2710 bp, Bovine  19866880948184
gggctctctggggtggggctctccgggggcggggctctccaggggcggggctctccagggggcggggctctccaggggcggggcagatgcgcagctcactggatccagcgccaggtgcagccagtctgcacatggccctccgccaccaccatcttgaattgagggtcgtgtgcagccttgagggctgaagtgtcagtgcagcccgtttctcaccaggagctctggtctgaagcgcagattctgaggcctccgcacgtgacctgctgtgagcaagtgatagcagactgagcacaaggaggaaaaaaaaagttagactttattttattacccagattctagttttattttctaggaattgttaatgggctttgctggtgacataaccacataggagcagtgggaagatagaatgagatattctttgtccaagtgcctagaacatgccgatgctctgtggatgttagcttgttctgtgcctttcctagtcagagggtttccgtatttctccttccactggaggagttaagcaattaatgtaaggctacactagtacatttatagaactgttgctgccgtgagtcactgtgaagaatcgtttatgctattaacctgtgtaaattttagactttttaaaaatagtaagttatataggtcaccacattatacctgtaactaatcgcaacattagctatcaagttctcactgttggttaatttatctttaaagactcaagaatgcaattcacgtaattactacctacgccgtatttcatttatggtctctgtgagtcacggatcttctttctataactgaagacatttgatgcagttaattcaagaggtctgccacatgtgttgtataaccacgcttaactcaaattgtagaagcgtgtgttgtgtttgatgcttgtgccctggaattctcacacaagatatgacaccccctagttacactggttggaggcgagaaatagagaaggactgtgttcttctttcgtcatctgaatgaagctttcattaatttttttcttgaaaaatctttgcaatgcatttccctattttttgagcttctgaattacgtaaacaccccttgcttctgtttgatttcgattgtttgcttggcctagtttccctgtaagtatttggtaaaatcggataattgtgtgtgtgtgtgttgcacagtgtctatgctaatctactcacccttgggttttgaagtgttgctataatctactgtctatcttttgctgaatttttaaggggatattttattgcctgtcattacctttcatagtaacttccgggcactgcattccagcagcctctcaggtacccagtgctactcacccggccctctgtgcttagagagaatctcatgccttccccgcaagccacatcttacacctccagcagctctgccttttggcacactttaaatgtttttattctagatgagttgttaaagcttcaacatgagagataatgccttttaagatgaggataaactccccgatgcctgtgatgatataatttgcacagtatgttcccagcctctgcctagacgcagcaccgcgacgatggcccatcctgtatgggtggctgttgtgggccttgagaaaattctccagtggggtgaccatgatactgagagaccagatctgcctcgtctctcagaggggtgacaaggtcaatttgcaaggcacatactgaaatctttccatacagatgtcttgatttgtttcctcatggtggaatatgtctttgtattgtacttgaacagaacctaatgcatgagcatggtcaccagattcaggtagcccacctgcctcgattctgtgctgccctgatgggctttgctgccctaaaggtacaggcaggcacctgacatccagataagttccacaaacattccttgaccacctactgtgcaccaaccaccacagaactgtggtatggaaataagaaaagaccccctataagcagctggcatcctaatcctattagcttgaaatccggcatttctgtcttcattcattcattcattcaggaaacgtgtcttgcgtccttgctgtgggccaaggccctcggctaggtgttacggatgcagtggtgagcgaggcacactagacatggtccccacccttatagagttgaaatctagccctatttctaggttaggaaaagatccagcagaaactagcttaacttacaggattaaccatgcaagcagcatgcagttttaaaaaagtaaccttcaaggaaaaatcaaaatgactccttcctatctctaatagcctgatgaccatgaaactgttgctgctgcttcagtgtctcaaggtaaatacaaacctctctccctcagtctctcattgacagattatacctgaatttctcttcatatctcatcaagtggaaagagtgttgaactactatttagctgctatatcctaggagggtgcagtctgtggtttaattttgtgaccagaaaatattgctcactgcacaaatggataggaaactaaccactttcccagtttttttttttttttttttaagatagattgagggagaaagcagcagagagactttttagactgcatggaacttggttattttaaactactgttaggtttaccctccagattaatttggtgtgtaatagggcttttggccaaagttggcatttgtttataaataatgctctttaaagg

SEQ ID NO: 52923 - DNA, 1616 bp, Bovine  19866880988434
cagagacttgattgggagcttgtaggcagaagcctcagagtgctacttcccaaagcctgaaaagaaaaacaagcttgtttctttagtgatatcaaatgagacaaaggaaggaagaaaccgcccgaggtcacaggcaaccgtcagagtggaagacttccatccaagcgcgatggaataatcaagatttattttttaaatattgttattaaataaacattacagaaacttttgcatatccaacttatttatagcttaaggcatgaaaacccacattagtgtgttgaattataagaattcactgcagcctgctagctgacagcacgtcaaattatttgcaaatattttctggaacagtaaccttgaaggatgccagccccattcagtgtaaccttatcacaagacaggaaccgagcgaggagatgagttccaaagcaaaggatgctttagttcctggaacctctgtcagctgtttgaacaaggagtttatcccccatctcagccaaaagcctcgcttgtatctctcgggcatttacatctctctctccgctgcactttaaaaagatggtatgcagaaggcccccttgagaaattgtgctctgggcaggaatttgtgagtacattagtcacatttaagaggctttatatcctccagtctgcaataacgtagttctgcgaaaattatgtaatcattttaacaaagagtctctaattgacatgaaaaagcaaaatcaaaataaaaatgaattttaatgtgagcagtacaggctcttcgtttttactcaccatcatggaacacggtctaggagagcaagaaaccaggacttcattcctggcttctggccttaggaaaaccactgtggtagattcctccaggggggtggtttttctttaatatccaatatctctaccttacaaatgcctcagatatgttgctttttttttctaattttcaacattattttcagtactttaaatatctttctttccaccaaggaaaatattcttttgatgaaaagctattatggcccatttaaaaaattgtgaagtggttgggtggtttaaaaattatatctagatcatttagcaaggttggcacaacatctgacttctgaaatcaacattttgccaaatattttagccatatcacagttgctaagctaacgagaaaatgctaatcatttggcataaacgtggccatgttaaaattaagcaaaattgattgccttcaaaacaaccttttgtttttgtctccaaaaagctgctttgcacatttgatataggtaagaactcattgcttatcctgacactaccatctttcatgtcttgaacaggctctgtgtttttctttgttgtctcatcaacgagtccatcttgcaccctattcagtgaattcaacagttgtttaagcacctactatttgctcagtgctgtgctgttcaggctggtaatagtcctctgcaggctccaagcactaccattgtgatagatcaggtgccaccagagaaaagaaaatagtgtgtctagcacatcatagcaagattataacatttccaaatgacctcgcaaaattgcttcatttagcctatcaattctcctaggtctcaacaacatattat

SEQ ID NO: 52924 - DNA, 1172 bp, Bovine  19866881006413
tgccgcagggtgcagccaaaatttaaaaatactacattataaatcaacattaaaaatgaaaaaaagacaactgtaactaactgttaaagctgtagcctctgtgatacctgcgtatcgcatataggctttaccctctgaaacttcattctatctgattctctcctttcctttattcattcaatacctgtttttgtgctactgaggcatggtgaaaaactcaaggttgaatcccattgagagcctgctttcaaataacttagtgttacctacccaaggggatcagaagatggcacagaggtcaggagtcacgatttgctcaaagtggtgagctgttaggaagtcaccagaaaacagcgactctttgaaggagggcaggtttgcttccgctgtggtgatccaacatggctcccaagaggagcctgcacctgaggagtcctcgaaggagccctgggctgagatctgcagaggctgagggtgggcattccaatctgagccaaggaagcttggagcaccattgtctttcactttctccagccaggtcagctcctgagggaactgggagatgcctcagcgatgctggtggggtgtgctccaggcacaattcccccaccacagctaggttaaaaaaaaaaaagttgaaagctgacacagatagacaaaaataaaacaaaaaatgacctggatttgaggagctttaaaaagaaagatctctaaaacaaacaaaaaaaggaggtgccgtgtagtatcggtgcctcatttggctgggttctaaacccgtgcccgggtgcccctgagccctggcttcgagttgctggaatgctccttacgtctgagagagtctcagaaacaacaacaatagattctcagagagccctgccctggaagcctctggagagggagcgtgtgtgactgttttcaaaacaaaagatgattcctgagcatcagagagctgcgaatgctgtgacaaactcacacctcgggttccgtatgaacaaatctcaacctgtgactagaatgttctcacagttatttaagttccccgagtgtgtcgcattttcctcctcaccatatcattatcgttgaaatgttaagaaaaagaaagctgagtaacgccgtcttctgagtaagtgtcagagagccaaaaatgtaacagtccatcgcaggcatttcca

SEQ ID NO: 52925 - DNA, 994 bp, Bovine  19866881215665
tggtgggaacaggcctgggctgctggatgagctagggatttgctctggacatctccaagttctgagctgtctttcttcatcttggtcaacatggggatgagtgaacttgactagcagctgcctggttggatctggaaggtctccgacggtgggattacaagggctgaagcctgagctaaggtggaggaaacctgagggcctgtcccccacttggataggacctgtttcataaggttcaagctttgctccaggtcaaagtgatgcctgtccctggctctgtgtgcaaaagcccattgccagcctgggttttgtaaatcggtgagagcagtgtggtagggtttgggggttccgggggtctccctcatcttgtcctggggggcctttgctacatctgattcttctcagaggccacctaagtaagtcaacagtcccggtggactcccggatattttctgagcctcaccttgataaagaataaaaatgttttagtgcttgatttgatttgtttgctggaagattagcacaaaagcaggaaggaaaaagaatgtgtggtggaggtgattgctggagactggcagagggttatttacggatttttgctgacagtccttgtttaaaggaattccctgcgagatttatgaagcctttccaatttattgtctttccaagtaaggtaagcaaataaataggttattctcttttattatgaacctcgccaaagtaagattaaaaataagaggaaacagggctccatttttttttttttttccagcccagtgtgtttctggaatttggaaagcatcttgggaaggctttttgttttgtttttggctcgagctcattgtgcatttaaaagataaagtctgacccttgatattgtgtgtgctgttccccatccttgagagctggctgagctcctgcaggggaccgtgggtggggggggtgcttggcagttgagcccaccacagtcagcaaggcctcacaggcccctgaa

SEQ ID NO: 52926 - DNA, 1151 bp, Bovine  19866881217091
atgtttaagaacaggcaaaataaatgtgcaagagaagaggtcaaaatagagattgctgtgagtgtgtgttgtttgtacagtgtgactggtaaagaagaatgtgggagtattccgcggtgtcataaccatttctatttcttgatcaggggttgatgattacttggggtgcagaaatacataaaacactagactagaaatcagggtggaaatttttctccacagagggttggttgttaagtatttgccagcacaccactagatcccatttcttttccatctttattgtaacgttacatatatatatagtaagagaggatgcaaatcttaagttttctctcagtggactttttttatgtattttttgagactcaggaattgcagatacctgtaagaatcatgtgcatctgcttttagaattggtgagtgttaaaggcagaagacagggaatattttaggtaactataatgcatgataatgaaaatttgttcttgttgggtttatttgcaaaaagcacctgcatggttaaaatgttaaagttttttaaattcactttatatatgtcttaacataagcatcttataacacactcagtctctgttagtttatttaaaaaatccttctccttcttataattgccttgcttaatataccgtatattttaattatccaacttagagggtttgggaagacctaaaaaattgtcatgcatcagaacattaacaacctatttagcagtattttttaaaaccaaaggcctagaggacaaatttatcaagtgtatattacacatatgatttctttaagtgtttgtttctgcttcatttcaaacatcctcattgtctaagctgatggatttttattttaattagttttaaattccaggagagtgatcttaatgttttaagatgttggcagttgaccaatgataaaccatgagcccagttctgtcagtgtgaagctgacagccacacaatggtctctggggacctagcctcagtctccgatgtgtaccagatcgaggccaataaaaaaaagttcttgctttggcaagaaatgggaagagcctggcactttcttcaaaagggctttttttaaaaaaggaggcaagtaaaaagaaaaaaaaaaaacccaaaaaacacttgccgggatgt

SEQ ID NO: 52927 - DNA, 850 bp, Bovine  19866881352435
aacgatggccttttctttctcttccttgctgtgctgttatttgtcagtcggtggaagctggaaggtgctgctgtttagcatgtaaataaaccaacactttttccactaaatagctctgcatggcattgtgtgccaggaactctcatccacacaatgatgaattcagttcctgggttgtgctttcctttcctgtcctttcgcagaggggaaggtgatcacactgtaattatagaagtcctttttactttatttttttctgattgtgcccctagttttttgcaggctcctagtagatagcacttccctttgctaagataaaattcctaaggcagttttttggaattaatttacttcctgtcatccagtgttttatagatgatgtaaatgaaggatgtggcttacagatctatttaaagagacgtgcttatccttcatggttctaaccagatgagtgggcacatgcttttgcatttttatttaaaccccactgaagttggtcattatattttgaatgccacagcacgtctatacctttatttaaaggatcttgttcattcatccatataatgattggcattggctataacttgatgcaatgttacactattttaattctttctcaggcagtgttatctttgatcacttcctattcactgggaaaaacccccatacaattgcaatcccacattatgtttcagtgatgatgccaagtactccctggaatatagctattcaagacactttctccaccctcaggctgctcattaaagggatggcagtttctaactttaatgaataaggtagagcgcaaattccactcttctttcaaagagactctcggttttcaaaa

SEQ ID NO: 52928 - DNA, 3022 bp, Bovine  19866880359195
gtcatgctggaggaaaggaaagggaaaaggagaaagggtttcatgcttaattaaagtataaaatcatccatcatcttgggcagaagcagtttacctgaatgtcagctactcttcctcctcggtttggttcaaggtctccaacattcgtacagcaccaggtatcaggtgggatcttcttcagttgtgagatgtgtatccaaggttcaagtccctggagcttgactgtcatctgggtagttgggacgacctggtacagtctcttccaaggaggttaaaggggagtctttgctcctagtggtgtcaaatctcctgatggaagacaactgggactcagtttggtgagtcacagccaaactaagtgctttccagcctcagctcaatcaatgctcatgacaatcatataaaataaggcctgcaatatgctacatcttgcaaatggtgaaagactaaaacagtgtaggggagcaaaatttgccatcccaaaatgtgtcacttggacatgaggattcatttaggccaaatctttttaagaacctgaagacctgaagtttttcttgttactcctcctcaactgctgcaaagaatgtagataaaggacctgttccaataatagagccgggacctacgatatctacagaacatgggccgaggtgtgctgggtgaaacctggagaggtcagagtccactctgcatccagaaagctcttatttgccaagcatttgtttatctggcttcttcctcattgaaatcccaaccattgccctcaacatcctcttctgtcttagctcaaggtggtatttaaggtgagggcttcgaccattttggtgagttagttcttctgggtctctcccatgtatatatgttactaaacttttgttagattttctcctgttaatctgtcttctttcaatttaattcttagactggccagaagaacctagaggggtagaggaaaatttcttccttcctcaacgtcatcaaagttcacacatgctaaaacctgagtcagaattcccctccttttcaaggctgaatgccattgtattgtatgtatagaccacattttgcttatctagttgtcacgcgagtgtatgttccttggttctttgtctcatcacaacaaaaatttggagcaacggacattaaagccctcggcgtgtcacagctctcgggtcttggacaaaccgtgctacagctcttaggcaaatcagtgttacagctctattttatttagaagatagcaggagagagagtgagagagagagagagaaagaaaagagcacacgcacgtgggagagagagtccgagagaaagagctttggctcctccttttatatgtttttttcctccacctgggcctgccctatgcaaattgggcttagccaggagtgctgtttgttctatttgttcttcctgaagtcttcactctggtctttggaccttcctgatatacattttggaaataataaatacactgattatattcacaaagtataaactgctcaaccagctaaaaagcttctttttaaatacattcattacatttaatacattcaaaccacttatcctgacatagctggcattttatcagatataaaaataataatgtttactatatatttccaactagaatatggggtattgtgttttcacttagttcatattatttttaggcaattatttctctttgactgaagtaaacaggcaattcattgtgcttgtgattttaatcacattgattctgctccccaaatcacaaatgttgagataccacacaatatttccatacaacatttgtaactccccatttggaagtcaaattttttttttataatcatcccaggtgcctcagtggtaaagaatcttcccaccaatgcagtaggcacagaagacatgggttcgatccctgggtcaggaatatctcctggagaaggaaatggcaacccactccagtgttctagtggaaaatcccatggacagaggagcctacagcccatggagtcacaagagtcagaaattgagtgactgagcatgcaatgtttatattgcagattcagagaatcccttgagttctaggtaaataagcgaaaaatagctagaattggaaaaaactcagaacatgttggacaaatccttcttttcataggtaaagaaaccaatgcccacaaaacaacctgagatcatggagaagctcaaggtcactgtctttaccacacagaagattcagatttttacttactacatcccactactcagccctgtcctccaattataaccaaactactagaagcagcaaaatggatttgattctaaaggcattattatggtcttttacaaagttgtattgagatctgcagaaagctgtctttgattccactaaggatatagcattattagcagacaacaaccaacaaaatggtaataccccaccatctcatctgaagtttgtgatggaatcattatgttatcctgattaaagaaattgctctcctttggtcaatctgccccggctattatctgagaacatctaatcaaaaagtgctggatggcatgttctaacaagaaaagaggcaattgtaagttattagaaaatgttggttgaccctttatttacagtaggaagaaaactgcaataagatattcttgaatcctgacatatttctcggaagactcacaattttaatcttttagtcaattagaatatttgtataatctatcttcattttactttatacacagtgacaattagagaacaaccttttcataagagtaaagaaaaaagttatgcatccacctaatgaatcatatgtgtacaggtaccaaaccctggaattctgtgggacatttcacttgtttttcaattgctatttttcaactgaattttctgattaattgccttaatctccaaacatctttgttgataaaaattcaaccacagaaaggtcagtaatcaaagaattattaaaatgggaagaatgtccatatctcttgacttcaatttttaaaaagtaggtttcttttt

SEQ ID NO: 52929 - DNA, 1675 bp, Bovine  19866880385368
tctatctctgaaatttattcatagcaagtgagcaagtgagatgtaatgatggggttttgtaaacagaaaaagttaatattctgattttacttttggatttggtttatattaggactctgaacgtcgcacaaatactccaaaagataagaatatttattgtcaccaactactcactgttgcttgatctaaagtcctcatatattctataagcatgttgaattcattgtttgactctgacactgttccttatgtactcaaaataagtatcaccagaaaatctctgcaactttatatggtgtctaaaactattcatgcattttaataaaattgagtcattcttaaaatatgaaattttagtataaattcatacatcaactgggaaggcacagtttcaatacagctgctgtacattttcttcacagcttatttgtaatgtcattagtcattgttaggtctattagtcagaagtttcaaatctataaggtggttgtcatatttagtaattatttttttaaatactgacatataattaagtgtcttgaaattcagctttattcagattttcccttcttttgcaaaatcaatttggataatctcaaaataacagtgcctctccacactctaagcattttagatgtgtcatcatattaattttttgccctttactacttccattaattaattttgccctttaacttttgctgatcaatgtggactaaattgtaattgcaacatttctatgaaataataccaaatcaagactgatagtggcatgctgtgaattagtgaggggttttaacatttttgagcttggtgtgatgatttaatactggacagacttaaaaccaactttaaaatattttttgatttgaattattttaaaattaaaaaatttttgaagtatagttgttcaaatttatgtgttacaggagtacagtatagtgagtcacagtttttaatggttatattcaatgtgtagttattataaagtattgtctatattccctatgtagtacaacatatccttgtagtttatttcatacataatagtttgtatcccttaatctcctccccatattgcctctcccccttctttctccccactgataaccccaagtttgttctctatatctgtgagtccgcttctttttaaactgagaaccaccatttgatttacatttaaattctaggtgtgatgaattttgaagattatattatggttaaaattcccttgcagtgtctgctaaacactggtggtttggagacatgtacctttatgtgatcactagcccactagagttaaaatgtatgatgagggaatgaaagaattaaatatctcatgaatgtttatattcatgctcacaaatggatcaaaatactgattttaatctagattacccaatatgactgattttttattaagtgaatatacaattattacttattttgcaccagataatgtaccaggaaatgagggtagagtgatgaataaaatttaatttctactccaaaagaacagtctggttgaggagatgaacacatagtcatatgtgtgcagtaaaattagtgccacattggaggtatgcgttgaatactatgcaagtgcaaaggaaagtcacttagatcttcaggtttaggaaggatatgacacccaaactccttcaaagagtttttt

SEQ ID NO: 52930 - DNA, 1914 bp, Bovine  19866880451980
ttctttaaagttccctgatggtttttgctgaggtgctccctgcagtcatagttaagaaccacagggctgttccggccacgacattggctctggtccaggaaatgtctggggctctccacaagtaacagggacccaggcaagtgtctcaggcattcctctccagcatcatcactatgagtaggctgagatggacacaacactttcccaaaaatgtttaaaactatatattgaaagagcagggacttgtgcgccagagaataacaactcagaataaccaacatcaatatgtacttgtaaaattaccagattttaaagagggaaaaaattcctttgagcattttggcaaaaagaccacattacttataaaggagagagaattagatcattattaggtgttgacagcaacaccttatcctagaagaaaacggatataaaatatatttaagatagtcaaggaaagaaaatgtgaacaaaaggttttatatacagcataactaacctttaagtataaaggcacagacaaatctatcaacatgcaggaactcagaaaatattgttcctatgacaccttcccaagaaatttagagaatgaactgataccagaatggaaagcatgaaatagatatgaaagatgatgaaaatactaactatcaaacccataggatagagcagcagctacagaaaaaattaacttttatagtaaataaagatttaaaattagtgtacttatggtgtagctactctggaaaacagtgtaaagtttcttcaaaatgttaaaaacagaactatgatccagcagttccacttctggctttttatcagcaggagtgaaagcactaacttgaaaatatacatgcaccccatgttctttgcaacactgaacatggaagcaacctaagtgtccatcagtgaatgaatggaaagaaaatgtgatacatacacacaatagaatattaatcatccataaaaaagaagctttgtcatttgtgacaccatgaatggaccttgaagattatcatgccaagtgaaataagttggacagagaaagataactattgagtacgatatgatcttacttgtacatgggatctaaaaagacaaaatggtaacaaaaacctaaacatgcagatacagagaaaagatttagtggtttccaaaggtaaggggttagggtaaagggtaaaaaggtgaaggtgatcaagaagtacaacttccagttataaatgtcaggtctagctgccatcttgcatccccacatgcatgcgcctaatctcagctggtctgcccaagaccacctgagcaccaaacctagtccccagcgcagccccatttccgctccagcaagatgaaagaaaccatcatgaaccaggagaaagttgcccacacaagtgtgcactggtgggaaaggaactgcttgcagaaagaagaaggtggttcatagaacaaccacggctgatgacaaaaaacttcagttctctttaaagaagttcgggttagacattatccctggtattgaagaggcgagtaggttcacaaatcaaggaacactgatccactttaacaacgctaacgttcaggcatctctggcagcaaacacttccaccgttacaggcaatgctgagacacagcagctgacagaaatgctacccagcatcttaaaccagcttggtgcggatagtatgactggtttgaggagactcgtcaagctctgcccaaacaatctgtgtacggaggagcaccacttgccagagaagaaaatgatgaaggtacagatctagtggataattttgacgaggcttccaagaatgcagcaaactgaattgagtcaacttctgaagaagataaagaagttactgggagctgctattttatattatgactgcttttaaaattttgtttatggatctgataaaa

SEQ ID NO: 52931 - DNA, 717 bp, Bovine  19866880464462
aatagcatcatttgaaaaccagagtcccttcactacccaacatatgtagtgttatatagaatgtggttttctccagaacagcaaaaagttttaaaaaaaacaaaacacttaaaatcaaaaaaccagtaatgttaaattatccctgagtgcacattatttagttcttcattaacttaattgttttctagtaaaagtgaaatgtgcaatatgcaaattaaataatattatgtgtcagagtttgaaagaaatattcatttaacattggaaaaggtttttttcttttccctaggaaatcttgttcatttattttgcaagaatttttgtttgtcgctatttgttcaaaacataatacaattgtgagacccagtgcctgctggcaaagttggaatagctgtcagcaggaaatggcaaactaataataagtgctggtaaaatatttatattatagtttactgggaagctgaatgtagttttgtatttcattagagcttgaggcaatacatagtaaaatagttgtgctccaaaataagtggatagaattctaaatactatagtaacttgtctttcaactatctgctgggaagaaaaagaattaataataataaagccttttacaagttgaaatttaagaaattttacacgaggtccataggggcagtaattagcagcatctcacattcagtgttattagacactaggctgctggatcaaccactt

SEQ ID NO: 52932 - DNA, 2113 bp, Bovine  19866880613328
tcaaactcatgtctattgagttggtgatgccatccaaccatctcatcctctgttgccctcttctcctcctgccctcaatctttctcagcatcagggtcttttccaatgagtctgctctttgcatcaggtggccaaagtatccaggttccgcttcagcatcagtccttccaatgaatattcaggactgattgcttttaggatgggctggtttgatctccttgctatacaagggactctcaagagtcttctctagcagcatagttaaaaagcatcaattcttcggccttagccttctttatggtccaactctcacatctgtacatgactgctagaaaagccagagctttgattatatgaagctttgtcagcaaagtaacatctctgctttttaatactctgtctaggtttgtcatagcttttctttgaagaagcaactgtcttttaatttcaagagactagttctaaaaaataattttatggattgtgcttttatagctaatattccaaattaaaatcaattgtattactgcacaaatacttaataaaattggaaaaagttagaaatttccaatatttccttccatttggatcaccatttagatgatttcagattgctgtctagtcaatatcatggaacacactaaaaataactccctcctttaagtcaccatatttatatactccgtgtatatcaccttgcttgaaatatttttaaattcaaagaaataggattcccattactagatagtcttcatctctttttgtatcaaggattatctgggcacaggtgaagtcttagtaatggcagagagactgcatagcctaagacatttcagagtaactatgttagcattttcttggcatttcatactttagacagaggtaaagaattcatcttattctctgtgagcttataagctggcaatgtgtgtgggcatagtttgttcatgcactccgtgaagtgcgtgtttcaattcctaatagcaaagcagatgatgactgctggaatgtatggatccatgttttataactttaaaggaatccaactttgtttattatattttactttgaccagtactttctgcgcttttactatgtaatttcgccactgattgacttagtagatattttagccaggtagtatctagtctaataagacaactagacacataattaaccccagggagaacttaagctagtcacaccactttctttctttctttttttttaaattaattaattttggttgtgttgggtctttgttgctgcgcattggctttctctagttgtggtgagtgggagctaccctttgttgtggtatacgggcttctcagcgtgatatcttctcttgctgcagagcacaggccctggagcatgagctcagtcatcgtggcacatgggcttagttgctctgtaacttgtgggaccttcctcgaccagggaatgaactcatgtcccatgcattggctggtggattcttacacactgtacctccagggaagtcccatgccactttcttgaccttagcttccttaattacaaaatgaggaggtcgaacatcccatgtcccttattgctcaaaacaactgtaaatcaatagctctccagtcctcatttgccaggaccctctgtgggtaactctgtggtcatttgtgactctttagtatagattctgaattctccagttaggcatcttgtcagaaatttcaattaaaggaactgaggaatcctagttcttcatgtcctgcccatctccccctttgtctgatttttagaaatggcaaaaatattagactttccagtcaacatttaccaattcgttggcattcactcagccctctgctgtccatccagaaaaatcacagtgtgggaatggaacaactgaacacaaagctggggcagctgtatttgagtttatctaacatgttcccatatcctcgtggtaatgattatttattattattattagccagagccaaagtattctggctgcaagcagcctacatttccttcccgtttctgtggctctatgaatacatttcttcaagagatggcagtaaaatgtctcccatttctgtgggctaaaatatcatcacacgatttctcaaggaga

SEQ ID NO: 52933 - DNA, 1243 bp, Bovine  19866880648117
aactaaaaatgtgctgtttgtttcattcttggatatctcctatttcttgtttgtttctctctagacaacaggctatgagctccttgagggagctctggcttctagaactcactgttatattcagtaagcactcaattcttgttgaataaatgaaaaagcaggtatcaaagtatcaataattctagcaggtatggcacataattttgaaggaagaactgaaaatagtatatgaagtgtcctaagagcttattggcctagcacttatgatagggctaaatgaagatatgctattcttggagaagagcatgaaagagggaggatgaaaatcataaaagcaaattctaaatgcctcacagcttcacctttggctaaacatggggctgagactagatttaagggaaaaaatagcaactattgaaattttggaaaaatatgaattattagtagcctagatttctataaattattgtagttatatatatatatatatatatatgatatatctgccatgttcattacctgccaatttcttaaagagataataaaaaccttcattttccactttgacaccatcaaaatgtagcatagattcatgaaggcttatagatgatgctttccaataatatacacatagtaggtaaccctgaatcttataaggaagacttttttttcaggtaaaaatatgattaaactagattcagcctagagcaaaattccatttctgatttattgatatttttggttggttaaatcaccacaagggaattatgttagaaaagcaatatgtgtcatcctagtgaaacttaaccctgtatccaataaatgacaagcagcacttatattttgctttgctatgtaatgaagacctgggaacatataaattgtcctgaatatagatttcttttacctggggcattactgaggaacataaaggcttcaaatcactaaatataataaaatgtgaggttctactctaattagggatctgctattatttaaaatgcttttatgtcaaagaataactgcatataacaatataaataatgaacatctttcttttgaaatgttagaatagaggggtaaaaataatgaagacactgtcatccttcactgttcttcctacataataaagttgaatgaatcattatctgtgaattataaaatatacacagcatttttctacactcagtaataataaaaatctttaatgttaaattaatcaggatgtttttattttagataa

SEQ ID NO: 52934 - DNA, 1642 bp, Bovine  19866880656373
catattgaaaagcagagaagttactttgccaacaaaggtccatctagtcaaggttatggtttttccaatagtcatatacggatttgagagttggactacaaagaaagctgagggccaaagaaatgatgcttttgaactgcgggtgttggagaagactcttaagagtaccttggactgcaaggagattcaaccagtccaacctaaaggaaatcagtcctgaatattcattggaagaactgatgctgaagctgaaactcaaatactttgtccacctgatatgaagaactgactcatttgaaaaggccctgatgctgggaaagatcgaaggcaggaggattttgggatgacagaggatgagatggttggatggcatcactgactcaatggacatgagtttgagtaaactccgggagttggcaatagacagggaggcctggtgtgttgcagtccatggggttgcaaagagtcggacatgaccgagtgtctgaactgaactgaactgtactgatgcataatgtgtctggtcttattttttgtttgtttaggttgtcttcatttttcctttccagagactagcatagctgacttaatactatctttgtgtttgtacaacatatgttaaagaattagtctttatttttgaaaaaataaggccaaataagtatttttagaaaactgttattgttcatttcactttcctctgtgttttcacaagaaaaagtcatgttataattaaaggacacccttccttggcatgtttcatggtcccactaaacatagcactatattgttgaaggtgctgatgggtaacaaaggcaagtattccttaatgtcagatttaccttttcatctcctggatacctggggggataaactttactaaacgcaaatgtcagagctctattctgcatttcagcatgatagctcagcaatgtgcagttgtacacttcagcagaaatgtctgcctggccagattaatggtcagattaatagtatctgtttattttaaataaatctattttgaggcaatgtctccaggtgtttgcctagttaataacaaaaggctccctagagggcctagaataagcataaaagaaataaaggattttttcaaggtaattatctctagtcaataataattagtcaatgagtagagtggacaaatgaaaaatgatgttttaaactttttatcagagtagaaaaagttaagattagatgactttctacttgtttttcagtttataagtgttggggatgctgaacaatgtttagatatgatgttctgataaatgatgaaatgtttcattttaagcagtaattatagtagatagtaagaaggagctctggggatctttatttaactcttaggtgtgtctttgaatccaaatctaaaagtaccataccaaatttaccctctgtaatcttccgatcaactcagaaatgtcatttcagcttcttttgcaaatgttaccacttggttctgaaatgataaatcatctctttggttcttgttccattttccttttctgtagttttgacaacattgaacatcattacctataaaatttctgcttattgagtttttcagattggttgagcattcttcatctcaacattttttttttcttctgcggagttggga

SEQ ID NO: 52935 - DNA, 1099 bp, Bovine  19866880939214
ccccatcctccatttttatggagtgtgatagtcaccacaccctttcttcaaaggagtattactcataaatattcagagtgtcattaaccaccccccccacagcccattttaaaaatatttattgtgtcacttgtgcaacagatctacctgtatctgccttgaaaaattctttgttggaaaaaatgttagcatcatttgaaaccactccttttctgtgatataatagttttacttgggcttacctctcttgtctttgaaactgtatatatttcttttatttaatagtagaatatgaatgtttaaagaatgaaatgactacatcttcatttactgaaaacataaagagatcttaactccactcactgctaagttcctcactcctgcataccctgaacagaaagaagcctatatttgcttcacagtacagtccaagcagaatgtcatggttctggctttccttcagtgtttacaaatcacaaacaccaattattggtggttaaaagttagaaatactaatatgtttagttcttagtttctaaagtgtacatgtttaaactatattcagcatagtacgtatagaatatgtgcatacgtatttatatttgttggctaatgatgtttttaagatactgggttatagaagcctactaattttgttaaatgggtgcataaacagtgcaggtgaatgtctgcataacttttactactttttgaaatgtctgcttttattgtttctttactgtcaaatattcccattataaatgtattaatttagtttattttagttaggcatgtctccaatgactcaggttctcagatatgtacaattaaaaccaaattgtttgaaaataaattcttaaaagccatattttgggaatgtacataacaggattgagggctacttttactgacgttgttggtttcttttaattttctgactgaaacaaatgatagctgtcttttaatcaaggaagaattcaaatgaataaaaacaatcacaataactgagaatattttccataaaatgttttaattagagttggattttataggaaagctccagttgatttcaaattgcagagtgtacttccagaagagg

SEQ ID NO: 52936 - DNA, 894 bp, Bovine  19866880975203
ttctaaaaacaaaataatcaattttagaagtttgagtccaaggaactgtaagctttcatttggttatatattagatgagcctcacctttattatgattcctatttattttgtgcatccttcagtgtaacttctgggaatcaggcttttttattttctatcctcacttttcaaattaatataaggttaataaagatgttcacaaaatcccagttctaattatttagttatcagtaccactgatttccttagaggctaccaagctatttcctttattttttcattaaatatcattacagtttttttaaactctaaactgtagtttgaacaatttctagcacttcatctattctttttcaaaaggtttggaacttacatgtaaagtttaatgatcttattttaaactagtctgaatattttagttagaagcgcaccacatgaacctaagaaatttaactaattataatattaactaattgtagggtatacaaattagaataattttctctccatgtaaaaatttcaatttgaataccaagtgtacaatgcattttacgtcaaaatattaaacatcttcataaaaatattattcatatgttatgcttctacctaaaatattcagactggtttaaaataagatcagtaaactttacatgtaacttccaaatgactaagtgactaaacacagcatagcacctctaagaagaatatatttagtacatacttgctgattatttaccgatattgattaaattggataatccaagccaaaacattcatggtaaagtcttatattgctgtaattattcatatacacatacatttgtctgcctgataatctcatcctattttcattaggttgttgatacctggtaaatttctttctttgacatcta

SEQ ID NO: 52937 - DNA, 1437 bp, Bovine  19866881096724
cgggaagttggtgatggacagggaggcctggagtgctgtgattcatggggtcgcaaagagtcggacacgactgagcaactgaactgaaatgtccttctaattatgtggttttctaaaatctttaggtcagagacccatgtacatgtgtaatagttcaagtagctagagaaaagagaatgaacagtgggttgtcttcctaaccttcagtgcccacaaacccatgttcctaatccagaacaagatgtatacggagtgacaaaactccccaatgtaactgcaaaagtgagcaaacgttctctgatgttagcagtattaatgaaaatagcacaagaggaaagaaccagagaattaaaaaatatatatatatgtataccctgtgcacacttgaaatggagaagaagaattcctccttctgaaggaagaattagagcacaactcaattcatggagcactttttataaccaagagtagctcacactattttagagaagtttgcacttaataaaatgtgatatttaaagaaattttgaagtaaaattttccataatagaatattttgaaaggtcaactaacaacaacaaaaatgagatgaatattttctgtcataattaagtattatatttaaaaatggaaccaattctcttctgtataagcaaataaaaatttaggtttgtaagatcattagttcaaattcaattaaaaataagtaccagttattaaattggagattttcctttcctctttattttcttcacatttgcctatctttaaacctagactatatagctattttctcaaattgttgctgtgtgatgtatatacatggtagcaatttgtttcagatacacaagagtatctgaaggtatattgaagtgcaggtatattgaagtgcactgacaagttttatttttaacacaaatgaataattctgtaaatactggaagaattaatttcctgagcctgtctttacagccttcacattagcaagcacagtattctatacatggtaggtgatcagttaacaactatgagatggttttccattttgattaaaattgagaaacttatataactgaaagtgtgaattttgaaaggctttcttaaatatttgcaacaaaatccttatcaatatgtaactctcttgcatgaacatatgtatcacatgttataaaattgaaatttattttgctgaaacacttaattggcattcatataaattatagggaaaaagagaaacattatttatggagaaaaagagataacctcatttagggctgtaaggtcacctatgagtttattagtggaaagattatcagagctttggatttttctcatcgactctgaccaacatgcctgtggaatagagtgttttgatactacatttattgttaagggacattgggagtggatttcattttactatgccagttatcagca

SEQ ID NO: 52938 - DNA, 1859 bp, Bovine  19866881178564
atgtctgtgaaaaaaagacacacttgaagtgtaattaattaaaaaaatctctaatgaaaacatgttcttaatatggaagtgttcgaatgacaaaatatactgttgagtaataagaaatattggaagtgggtagtaagagcttttcaacatttattcagctcctgtatctgattgacaccagcattaaaaatctccaggctttaccaccacagatgggctcaaatagcagcaaagtggttagactaccttttgtcctgactttctacacacataactactttatagttctaagtttgatattttttcaggggtcttaaattttagaatagtgtcatagaaaattaaattgaggtattttggtaactagaaatatgtagtccatagtctaagtggaaaaaaaagtcacaatcaagtgtatgaatcaatattttgggagtttggttaatgtgactcacttacctacatttaaagcacttcatggtaacgaaacagcttctgtgataaaattgagaatcaaacttagattgtatagtgcattactgccacaaatacttcatgaagccttttttttttttttttcttctctcttctaactaactgcctgagtgtcgaaactactctctaatttctactggaggttctgaatactttatgagcagtttaatagttataaacagaaataagaaataattttcttttgtaagtagggtcataatgccccaacttctactatgaatacttagaacttactaatgttttatattttccttcttttgctactttggatatcaaaggatcaataacatgaacaaaagttttttatgtatttacaagacacttttctgactggtggtaataaaatatgaaaagcagtatgatgataaataatatcatgcttttcaattaattagatagcaatataaatcatagataatctaccacattatttacccaaaaggtatttatatgtgtggtattactgtgcatatgagataaattgtagtgttttccctttgcttaaaggtctgaaactaagatttcagtaaacccacaccaaaagtatcttagagatactggatgaaactttactttttccttcttgtattcttatgcacaattccaagaattgtatggaaaagtcagctgcccttttaggtattttcttgacccagtatagaaagatagtatagattgtttattacagttcatactataagaaggtaaaaatctggtcttcatgtcgggagagtggaattcattattatttctctaccaaaattaatttcagtgcactttttaaaatttaaaatcttaattcccattatgacacttttttgatagactttcactctgttggggagggaggtctttttctttttctaaccttttttccttgaagtgatttggttaagcaggaaaaaagaatgaaggagttttgacaccacatcccctattctattaaccaaactacataatcttctcctttgctcagtttgattttcctttattgaattttgctttctgcaatgttctcatttcccttattagattaaatcagattgttcttacccatccaacattatccctttgggagagcaaaattcagtctcccgagagaaaaatgtaaagaaaatctacttagagaagattactcagctactgttattatccgtttccaatttcctttctgctttacagagtaagtttgactcattccctgatggcaaactttccttccttctactatgtaacaagaatgaggacagggcatctataatagatgactcttaatgtaaagtgcagaacctcagaattgataagacttgttatatacaataggtcagggaaattcttagatt

SEQ ID NO: 52939 - DNA, 2248 bp, Bovine  19866881207956
tgatagtaatatttgacttctataaaacttcattttgtatgacaggtgttttagtttaggaagtctctttatacttaaattcatctttaatacacaaatgtgataacttctaaatatttaccacatcatgcttttttcagtgtagtcatataaaccacatcatgctgttttcagtgtagtcatataaaccattttatagcaatttttatcttctatcttatgtcttgctttttaaattatgacacgtgtgctgttctaagtcacttcagtcatgtccgaatccttgcacctctatggaatgtagaccaccaggctcctctgtccatgggattctctaggcaagaattctggagtgggtttccatgccctcctccaagggatcctcccggcccagggattgtctcctgcattggcaggtgcataatttaccactatctggaaagccccaaattatgacataaaattgtttatatgtgatgtatgacaacattttcatgatttgtctctgaaagttttgtactttctggaaagccaggattgtatcatactggaaatattttcccttttattttgttcttggatataacccagtggactctgagcacagcatgacaaattgatttgactcctacatttttcagggagagggcaggggcaccaccttgaagcacctattctcctattctgttcacaaaagtagggaagaagaaaagtaatatgcaaatcacaaggtcagcatagacaatcttctgctcagactttccaagagttaagggcaaagcagcctctactcaccaaggtttctcactccacttcagggtctgaagtctagattatcagtgctgaactaatgtttgcagaccacaatgattatactaaacccaagcttgaaggctcatctcatctatttccattgttttctctttccgcagatgaagcccaaggtgggacaaactaactctcaagaacatatattctacaacatgctctccaaagttaaactagtctcaaaaacacaatttgcaaatggtcagatcaaagaagaagaactagtctgaccacttcaaaaatgtaatatgagaaagagttcttttttttttttaatggcaacagaaaggactttgaattgtcttataatagcagttaaatggtttagttcaaatatgaccaaaacttttctaagaattagcagttagttggaattagtcatctatctctgccccaggaaacaattggttaattgaggttaagaagcatgttgccctactgtgtgactcttccatgtgtactcaactgtgtatattggagactggcaggaagtagacactcatgaaatctgggtagactgaataaatgaatttatgaaagaataaaagaataaatcagtctagacttgactcaggttagaggcaaattgtccttgttttcctcaggtcttacagtgatttatgaatgattaaattgatgtattagaatttccctgtccagtgtaatagaaagatgtgtggctgggtaatagaaaagtcagagctttccaatttgatagtgaaaaaaagtgctgaataattgagttggagttgaaatggtgttacacataactagagaagtggcacacttaaagagctctttcttggaaatttaagtgatcccttggtcagtacaaaccttaatagcttttaagaaacctgctgtggctgagaatgagttggccatccatgagcggttactagtggtctttctcacaactatattgcactgacattagctacaccctatgatggtagattctgcagacagcctgtggatggagcacatttggtaactgaaaaaccctgccacctgcggagtcaatccctacagtgcaggtttagttgttagattggcatttcttttacaatacccatcttacaaactgaatgattgtccttgtttcagctcacacatttattgttcacgttaattttattttaaaatcctataataaacataaaataactgcaaccaagtagctcacttcagttttaatatctaaacacaaagcctgtatacttaaaaaaaaaatcatttcctaatgcaacttaatttatttttcttatgttatgttagaaatatgacatacataaagcagtgttttaaatcttacctatttaacttaatttcttttcttacccaaagatgttcaagacatgaaaaacattaattctaattaactcacattcagacagtatatatttttttcattttccta

SEQ ID NO: 52940 - DNA, 1242 bp, Bovine  19866881216027
tagctttgccttttccaaatgttatctaagttggaatcatatagcatgtatagtcttttcagattggcttctttgacctggtagtatgcatttaaggttcctccagatcttttcatcactagatagcttatttctttttattgttgaacaactttccagtgtaaggatgtaccagcatttctttcttcattcacctcttgagagatagtttgcttgcttccaaatttggcagttatgaataaagctactttaaacatttgtgtgtaggtttttgtgtggataaatataagctttttatgaatgatttcttctttccatcttttaccagaatgtcaaattcagttacaatcactgttacatgaaggtcaatgtataattatcttctgtattaaccttatttgcctctcaggacaaagtctaattcaggtgacatagaacctgaatctgttgttttggcttttctgtcagtcttgtaatgtgatgcagtagttctacactgctgttttcatggcagaataaaaagggttgatatctttatttgggaggggagagaagtggaaggaacggtttgtgagtaaccttactttagatgagctatgtgagctcttgttaccctttctataccatgcctaattggatcagtaaatcataccaagctgaaagctatatatctatgatcaagtgtgttttaaatatcttattcataaacagagatttattcattgaggctgcattatttggtatttctatgtgttatataaagtagaacatcaagaaaattaagtcagaatcagacaactgttcaaatactagaatatgcaaatgttagaattattcctaataaagagctccgaatatgagataatctccatttttcatattaagataattatatactgcatttgtggcttttgcaaacatagctgtaattacccctggcattgtattgcttactgtcttttttccccacttattaaagctatttatttaccacaaatgctttgtatgcaaacattagtctgctgttaacaaaagtgaagcccaaatttgtaattagctacagctgtacatgctgcttcctttattcaaaagactcctatcattgtgaagctggttagttcattttattctttgtgggaaccagtcttgggtacgtgataaagaccttctctctgtgtgctgagtttaaatccactattatctgcttttagttgggatgaggagcacagtttacagcactag

SEQ ID NO: 52941 - DNA, 1475 bp, Bovine  19866881383744
ccgggggtaacacaagcaaggataccttaatacgattgccaaagaactagaagatatcaacaggtaacacatagaaccaaaggaacctcacagatccagcagtaaacctgaaaacgaacaatctgaactttcagtgtggactcagtaagatacaattaaatgggagtagaaagcagactaagaggaagggaaaacagtaaaatggagcttccacaaaaaataatatttttattcagagtgatgggagcaatgaaaaactgaaattagttgaaaatatcccaggttagagtgtgggcctacttcagaaaatataattacatgccatacctataaagattagattttgttaaaaaggaatgaggaaacatctgaggaaattaatggagaacaaaagcagagaactataaactcccatgaatttttacaaacgtaaaaaaaaaaaaaaaagtagaaaatacagcaatagaaataaaggagttaaaggaaaaaacccacattacccctgacactcaaacacgcacaaaatatcttgtagattatagagcaaaacaggagcatgtaaaataggttaaatacaaagaaaaatgaagaaattgccttcatgattagaggaagaactggagaaacaggaagaaatggatggaattaagtctattgtttataagaagcactgtgatacgattaaatgcataggtaaatttgtttggcttttacagtgtcaggtttaagaagagctgtaaatgagtttcataaacatggcatttttattttcaaaaatatactgtggaaaatcaaaggggataatgcaagtgaaagtgttttgatgaagttaagtgctttatatgtggaaggtgttattattattatctttatcttatgattccagtgatggttttcagtccttatacccttgctcatatctaatcaatctgaattcattcaatggctaagatgtcattatcttgagtctaagtcactgctaaagtctaaatatatttcactttaatgtgtgccttctgtcaactcatttgcaatgctaacaagaaaatccatcaatttttctagcataacttacttttgattaaaataaaactaatttttccatatactctttcttaagaatatgcttaattttaaaataattgtattcctatttcaacaagaaaaagaagaggttatacaccaaaggcactgctttacttgatttaaaaacacaataaatcaatattttgcatttggaaattttgttgtaaatattccttaccaaaacataactctatctcccaattagtattaaaagtgaagaactctgtaagtgataatgtgaaacaataattatgatacaataataattacctcaagaaattataagaaaatcagagtggtatacatatctgtgctacattttctgtttccttaaaatttaatttagaagactgtcataccatacaaattgtaaaaaaaaaaaaaaaaat

SEQ ID NO: 52942 - DNA, 1081 bp, Bovine  19866881616755
ctgggtcctatgtttcctgctataaaaactacacgtagtgctggacttctgtggttagtaatactctggtaaatcgtttggaaagttagatgcagtgttagtggagaagcagaaggcttgctagccctagtggctgagtgccagtggagggcagcagagagctacttcagacaaaataacatttaagaggaagaaaacagctcccagttgagagcagggtccttcgccagatctaccacctgctactgaagaggcagcccatttggaaagccagcccacagggtagccagcaagaatggaattcccaaatacattaatgtatgaagccaagaaggaagggagatgggcaagaaacaaggccagaacactcagaataattcaaactgggactcagcacagatcccaagagccactgattaagatagtgatctctctccagagctgctgaatcagaagatgtattacatttgttttaatcccaaaatctaggatcctaagtcattaacaaacatgttttgagtataatctttttgcatcgattgtccctcctgtagaaaatataaatattatgtttttacattattttgctatctttttacaaagattatccctcaagaagaaaatataaacaatatagataatataaaattgttagcattaagaggagaaaatcatacatgagtgaacagtagcaagcacagattctatcatggtgcaaggttcccaagaatcccctaaaagttgagacttctcaaatatatgtggtaggatcttggtaaggcctaaggaacagcagcaggccagtcagtaacctggtttccagtgtgaggacctcaaccctgaagaccacctgcaggaagatgcaacctagtcggggccagaattcatgctgctgctctgggtcttcctagaggtacgagatcaggtgagtaatttagtctctctaggccaatttcctcacttctaaagtaaaataatacctgtctcttgaatctgagaggaattcacagaagaaaatatgccttgctaattttatacccatatagggtatttttattaccagtctgagttgtataaagag

SEQ ID NO: 52943 - DNA, 1066 bp, Bovine  19866881826708
ccgtgggaacaaggaacagtaactctcttgaagccagtttttgaatattcacagctttaaatattgaaaatattttaaaatattttgaatattttttaaaagtaataaataaaatggcacaaaccaacacaatattgtaagcaattatattccaattaaaaataaataaatttatttaaaaatttttaaagttaataaactggcattactgttattagaattacaatgcacagctctgttcaacattttattgaaatagttactgtggtaagaaacatatttagacaaagcatttagaaaaataatgttgataggaagtagttagctttcaattaagctggcagtcatgtttcatagtgattttgaatatcaggaaatcacattaaataagatagtgggaggagtaaattggaaacttgttaggtagttaatctcaaaaagaggtgacactttggcccagttttggtttcatctgcatggctgtaacatagcaaagcctgaaggactgtccctgttcctgctctaccctggctaatcctcttatgttaccctttgggcactgaataaattacagctaatctacaaacaacaggaggatctgtgcgatttcagcttttgagaacatttttctagggagatgacaagtaaggaataatgaacaccagtctacaatggctgttttgttttttgttgttttttttttaagaaagatgaaactatatattttggccacagcaaaggtttcaggggaggaaaacaaaacaaaacaaaacactgaagaacacagtttacttggtcatgggtaaatgtaaatattctgttccttaaaatgttaaaagaagaaaaatgtccatcccagagaaaggagttgatcggactaatacagatgtcactgatgtaggtgggtatcagatatcttcctgagatggcaaagatatgtccacatcaaaagaaaaacttgtcacatttaagttgacagctgggatagaaacttctccaaacccaggaaaaaaaagtctacccctgtggaattatttaggactctgggtgcctcctacatccacat

SEQ ID NO: 52944 - DNA, 799 bp, Bovine  19866880903915
atcctctacttttgagacagttgcctcccccaggaaaacctcagctaatgcatccaccctgaactgggcaagtgcaggaaccttccaggcccaagtccttctcacagcctccctttcctttgtcctcccttctcagatggtgtgggcatcttccaatcggctgggctgtgccatccacacctgtggcagcatccgcgtctggggcagcacctggcgccaggctgtgtacctggtctgcaactatgccattaagtgagtgcagctttgagatcgaggggactctggggcaggagggtggctcacaaggtgggcaggattctcataaaaggaagacacacaggacaccttgccctcctctgttctaaatacaccatacagtttggtacttttagaattgatcgagaatcctttttctttacccaagcttcacagtcaattgggtgatagacagaggaccaaggcaggtggatagtagataggcagtctccctgatgaagccagtagtggagaatgtgttttagctctgccagccaagtgggcttgcaaatagctcgctgttgaattaaaccttcacatccattaacaagcaacactggacaaccagaggcctcttctaagtacagtgctggcccctttaagcttcccacgagaaacagagccaccaaggacatatgctccctgcagggaggcagatcccacaggaaagaaaggaaggatgcagtgagcatgctcagctgcttcttccagactccagtcagctaggtgggagagaggtcaagagaagtctttagagcagaaa

SEQ ID NO: 52945 - DNA, 733 bp, Bovine  19866881231301
cccactggaccacgaaggaagtcccaatgcagtagcttttgctatggggtgcccagatccttgctgtgatcctcccaggagggcaaacgagccactgtccttgatgtatgtcttcctgtttccttgcagaatttgcaaggcccctgagtaccaagctgagactcacccagccttggccactctgaaaaacaggacttggttctggagatgatgggggaatatctgcccctctcatagctccctctgcccagctaatcagggtccacaactgttggacgcatcctaggaaacagccagtttcttcattccttcccagagaaaactgaggctagcgatcgccaccacggggaggagcagacccttgttaaacaactctacgaagtcagtgtcacaactatccctaagttacggatgcgaaatgggagttccaaaacagcaaggaacttgcccaagttctttgaggggggtcagtagcacctgggtttagctgaggctgaagccctggaaagatccctacaaggctcacatccttttctgaatataaaccaccaagagagcagggcctctgagaggtgacttcctgcccctcctgcgtcctcactctttgcttttctggcgcagacacatccccatcagagggtgccaacctcaacgcacccaacagcctgggtgtcagtgccctgtgcgccatctgcggggaccgggccacgggcaaacactacggtgcctcgag

SEQ ID NO: 52946 - DNA, 922 bp, Bovine  19866881311371
caagaaaggtaagacgggaaagaaaaaaacccaagcctctggagtcagtgtgccccgtcgtcacatcagtcatttgagccttgattttcctcatctgttaaatggagctgataaagatgtcctctcctgattgttgtactagagaggtggggtggtaagcgtggggttcatagcccagtgggagtagtccgacagagggtctggagcatcaggggagtgtgggaggcgtgggctgtacctgggtcaaagaagatgatggctttgaggcaggcgtactcgttgtcgtcaatctgcagctcttgaaagggcagcaccaactcatcaaggatgcgcacggacactcgactcatctctgccagctccgggcagtgccgagggacgatgtagtcattgcctggacgggttaggaaggagaggggatgggaagccaccggggtgtacctctctcctctagcttttgctgtttgcagttataatgcagcagctgctcacggaaggaggggctggtggggactgtcacacccatcttacagatgaggaagccaaggcccagattaaaggaatgagtgacttgcaggcattggagtgggcccagagcctgacttcttaggaaccctttcatatcacccaagctccattcttcagtggcgacaacagaccacaagactgatgacaatcaagggctgcttgggaggcataaaagcaccaagcataagggctcaggttctggaattagaccacctggactgaatcttgctttttccattgattagccagatctatctggataaattactttctgtgcctcagttttccatcagtaaaatgggaataaaattatagtgcttatctcattgggttgttgtactagaggggttagtatttgtaaagtattcagactagggcccacggtgtgccctat

SEQ ID NO: 52947 - DNA, 3423 bp, Bovine  19866880494238
tgagaaaataattctaccaaaagaataaccatctgataattagtgactattcctaaaaggtgtgggcttccctggtagctcagttgataaagaatctgcctgcaatgcaggagatcccggttcaattcctgggtcgggaagatccactggagaagggataagctactcactccattattcttgggcttcccttgtggctcagctggtaaagaatctgcctgcaatgagggagacctgggtttgatccctgggttgggaagatcccctgggaaagggaaaggctacccactccagtattctggcctggagaattccatgaactggatggtacatggggtggcaaagagttggacacaactgaacgactttcacttcactttctctttcctaaaaggcatggacttttagaaatgtatgtcacttgagtaatcagagatgtaaacaagtgtgtatttgtaaggggaatcaaacctcattacttgtgataaaacattttaaatggtaactgcatccaccattaaagggatggtgagttacctcagcggatctttagagggagttctctgcagacacaaagcaactctctcagagtgtatttttgtttaagggagaagcctcacagtaacatggtaaatggttaaagagattctcaaaaacatgttcaagaaccagatatacttccaaaaataattatgagattttcttttgatggtatatttaataattacaattgatttctattttcttctgtatactttatttgcattctctagatattccataaagaagatgcattgaatttatattgagaacagaagtagtctgagtgactttgtgagtggtggggggcctacccagtgcctagctatggagagaaattgatgtgacattgataagggagaaagtagagacctcacaaagatgccatgtcctgaacagagaacagacgtgactcataccagatgcacaggctttgttttcctctaaattttaaatgagaagtggaggtaattttcctgctaggagattaagaaaaaaactttggcaagacagaaataaacattttgaccataatactgaattacagagaagactaaagcacaaagaacatcccaagtgccatgcctgtaataaaaaagaataattaacaatcacagatgaagcttctatcttaatctctgacgatgcaaagaggaactgaaagagttgcttaaccaactgttaaatcaactcaaattgttttaattatagactttatcttatgacaactttctaacttttttatttccagtgcaccataaggaagagatgaagatgctttcttcccatctgttttcatgctatcaaacaacacacttaatggaaattaccttagggattccaattgaacattcttcttcttgacttgagctctcaaatcatgtgtgaatttccaaggaacatttaagttaaatttgaactgaaacagaagagcctcattctggaaatgggagagagaggggatatacagcatctatggggcaatgatcctattcaagggacagtttcaattcttcatccttagactgacaccacaggtctcactctcttcctgataccaagatggtgcagagtctcaggacgccacctgtccattcagggcacaggcgtccctgctttgtgccaggaaccgctgagggtgctggaggtcatgaacccacacaaagatctctgtccttgtggggattaagtccttgtcacctctgaaggatgttgatatattaattcaacaggactttttacaaccgattgtttgcatcacgtgttcagagatgtccagtccccacggtgcactcggccgtgcagtgtaagcaggagcccagagctaaaggtcatagtgatgcccacagacccaaagagggtcccatcaacaaagctggggtaataggccattatggactaagcagagcccctgcggaataaacagggcttccctggtagctcagttggtaaataacacgcctgcaatgcaagagaccccagttcaattcctggggtgggaagatcccctggagaagggattggctacccactccagtattcttgggcttcaccgatggttcagctgataaagaatccttgtgcaatgtgggagacctgggttcgatccctgggttggaaagatcccctggagaagggaaagtctacccactccagtattctggcctggagaattccatggactgtgtagtccaatgggctgcaagagtcagacacgactgagtgactctcactttcagggaataaacacgatggtggctcccagtcccccatggaagacggtggaaagtaacaggaagtaacatccagatagtggtcagatttagctggggggctgcaaatagcagactcatgtgttagcttgtctatatatattgtaagtttgggagagagaagagagggaagagggagaaagagagagagagagaaatagaagaaacacactcacagcaatgaaatggaacacagttgcacatttattttggccacctgatgccaagagctgactcattggaaaagaccctgatgctggggaagattgagaacaggaggagaaggggacggcagaggatgagatggttggatggcatcatcgactcgatggacatgagtttgagcaaactccaggcattggtgatggacatggaagcctggcatgctgcagtccatggggtcgcaaagagtcagacacaagtgagcgagtgaactgagctgaactgcacacttactgatctctgtgaacagaaataggaaaagtggagaacaccttaattgcatggaaaagaaagatttcacattaagagaggctttaaaaatctgaaaatgttcagagtaatttccgcaaatgaactgtttgtcgtctgctacaacaggaaatccaggaaatatcagaacccaggaaatgggcctgaagttggctcaagcatgagtctgcggatcaaggttcatagctagtaacccagaatctggttccaaattgagtgtccacttgggttgtcacaacacattccaatacacatgagaaaaatgaagagctgagaggatacagggaaaaaaatagtctttccaaatgggagaaatatcccaccataaaatggaaatggcagaacagtctagaaatgctgttgatagaatgtttgaattactcaaaagcaaatacgtggaagaatgctactaagtcgcttcagtcgtgtccgactctgtgcgaccccatagacggcagcccaccaggctcccccgtccctgggattctccaggcaagaacactggagtgggctgccatttcctcctccaatgtggaagaatagcaacatgcacaaaagaaattaaaatgaaaagaaagaatctatttaaaatcctaaaattaaaataggaaaatatatt

SEQ ID NO: 52948 - DNA, 1108 bp, Bovine  19866880501826
tgtggtcaaaatcatgtccattgaatcggggatgccatccaaccatctcgtcttctgtcgttcccttctcctcctgctgccagtctttcccagcatcaggttttttcccagtgaatcagctcttcacacccgatggccaaaggattagagcttcagcttcagcatcagtcctaccaatgaatattcagggttgatttcctttaggatggattggttggatcttcttgcagtccaagggactttcaagagtcttctccaacaccacagtttgaaagcatcaattcttcagtgcttagccttctttatggtccaactctaacatctgtacatgactactgggaaaaaacaccgctttgactatacagaccaatttgttttaaatcaggagaaatttatacaaaagtccatatagtgatgaattctatgacatctaggctgcgcaaactttatttaaatgtagtgtcccaccttaacacaagtttcgcatcatacttttaagggttttatggttcatttcatgaatattcatttttttagtccattttctttagcgcgagctctgccacaggtcttgtgtgatgactttgcttttacttcctctccaaatgccccccctgtagacatgcccaagcctcccaaagaagaccttttcatcctgccggatgagtataaatcatgtgtaaggcaaaagcgctcccttctgaagtcccataggaatgaagagctgaatgtggagacgctggtggtggttgacaaaaagatgatgcaaaaccatggccatgaaaacatcaccacctacgtgctgacagttctcaacatggtaggctcgtcctgctctctgagccgcgtgtgtgattctgcctcgtgtgggtgtagtgtgtgcgtttgcctccctcttttacttgtggatttatgtttcatactcaagaaatatttcatccatgatagctccttcacttttactatgctccaatcagaagagccattttcaatccttcagagaataaaatttggaggatgaacaatttggcatgaaaaaaaaatatgaacaatatttcaagtttacgatgtctccatttatcagaaatctccaagaggatgctgagac

SEQ ID NO: 52949 - DNA, 2035 bp, Bovine  19866880525244
tcatggccttgacactgagtgtgtgtcacctgagggtgctggcacggttctttccctttttctaagtagtgactgagatgaaacacacccgcctcttgcatctcacgtgtgtctgggtggtgcacagcttggaggagcagctgtgcagagggcaggcgtgcagagtaagttggagccgaaatgccaccaaatcccggaggtaagagaaagggcttcaccctgccttccagctttacgtcagcagcagagggagaaagggggagaggcattttagacaaaggcaggaccagggctggggcccagaaccagcttgcatcaggccacaggccgtggcaaaagtgggcagctggtggccgcaggcctgctggtctgtccgtcactgcggcccaggtaggtctggtttgcccggtgctcgtgatgtaaaatgctactttcctttcttgtttggtccctgtgctaaggctcacaggacatgactgctgcaattaaacacctgagtttagactgctcagtcactcacgtgtcctcccctaccctcttcctctacgtgctcgtgagcactctctctctctctctctcacacacacacacacacacgccttgccctgccttctccatctcagtaaatgagtcgtgattgcttatataggcttaatagttcacaaggcaaacgccttcatcacggcacatccagctgccataatggggctgaaaaggacgccaccgaggtgttaagacacaagttccgccgagaatgatgccagcatgagggaccaggattcattaaatcgggcagcctttctcattaaacgtgcagattgacagtcgtgactagctgtcatctgtggtttccctcgcgtccccctgcccgataatatacatatagatgtttttgcacagttgctattatatttagaacagaatagtgaaattgtgactattcgggggttgcctgctttgtgtaaaaacagcagtgttctttcttcctttgttgcttctctgaaagaagaggaaccctaaaaagaagtaaacccaattcggaggctaacccccaaggcttctagttaggtcaacatatcagataaaatggacccatgttacctggaagagatttaaaaattaaccatgaacccaagacactcactactctggctttctgttttctagccacttaattcctgcatgtgtttcactttctctacatccaataaatcctttatggaaaattcctcataacacgacgaaggaggaagactcccaaaagccatatccctctatgtgtagaaaagtgaccggatgaaggaaaggcacaaactcattacaaaatatcgtttttcctcaaagatctgaggcccctagaggacactgttttgcatcttaacataaaatatgtaatgtagaaccttctggtattaacagatagcaccagagtactctgccctgggcactttgcaaagatgcaagatagctgcaccttgagggaggtaaagaaaaaaaaaaagaaaaaaagaaaatatttcctccataaacatgggatctcaatcatcaatgaacaaatatcctggaaggcactgtcaacatgaaatgtcatctaggggcaaagatgcttccctgattaagaaataataattgtgtagatgtgtctgtctacatgtataggacatactcctcaaaaaaataaaaaatgtaattttccagagaacaactcaaggacctgttcattactgagagatctcttactgagaagtggcttgcacagctctgtgctctgtttttgttcacttcctattatccacttccttaaatgtagcctctatttaagcaaacaaaaaacaaaaaacacgacactatgagagggacacttctgtctatgcaatgcctccttctttcatgcacttctgttctagaagaagtgcttcagtttataataactgatttttagttcacagcctctttccctcattctgtcaggagcttggatttctctcttaaggtaaattctctaaggcctcctgagctactacgaacttgaaag

SEQ ID NO: 52950 - DNA, 734 bp, Bovine  19866880591046
accccttcccctaatatggttcatcatcaacatctgttttcacctttctttatctcagactctctttaaattccatttttattggtttgttcaaaccctgtgtataagtcccttgaaatcaaaatagggcaagcttgctagccttcgccttgcatgaaattacaagcaggtgagagttgaacaattaatacttctttattctcagtggtggtacgagcagtgccactttaatgctgtttaagcttattatctaattgcatgcttgtgctagcttcagagacggcatgacgtgaaggcaggcttgtgctgtgttccctccgcagtggaatattcaattatttgttctgactcatgtaattccctgtattccaagcttgttaatgtcattacagagctgaaataaagtgattactcttaatgagtatttatccgataggtaatgcaattcctgcacccgctagctgacagtgtacgattatggatttttctccttagccctcctctcttcccactccaaagacaccagcccccatctcctgactcccctgtcaggaaggcaacatggcattgcagtgttctgtgaaatactgtcagatgatggggaaaaaataaaaatcctaaaaaaaaaaaggaaaagaaagaatcacagcatcccccggtagagctccggctaatgaccactgctcccactggctggcggtgatgacagctcttgctaaatgataatggcatgc

SEQ ID NO: 52951 - DNA, 2889 bp, Bovine  19866880692105
ggaaaccctttaaaatacatgacctccgtaaataagcaaaaaaaaaaaaaaaattgctgcataaatgaaacaaagactgcagataccatgcttcagcctgaagatctatgattccctttggataacgcaggaggtttttgtcggatggttcactctacagtacaagatccctctgaagcctgagtgtgggggtgccccaacaacatcatcatcaccccaaacacaccttggttcctggcttgctgcattggcctttctggcttactcccctaaaaacacttgggttctgtgagcactgttccagattcaagcccatctcctttttcccttgggttcactctgggtggcccagaggaccagactgtcaggcaagagtgacctccacccccccacccaaaggacttctgaatgttcactgaccaagcagtcaagtgtctatgcttgtttcatttataattcagtctgaggcacagtattctgtgtttaaataatccccatgttcattaaatacatagaataaaataactgataacactgatattttgatattccttgataatcaatacacaacgaaaaatacaagaggaaagtgaccccactgtcttgctgcattattagtttgcaagcttatttaaatgattatgtaaattgtggaagattaatgttttcttcttatcaaagcttttcttcactgaatcaagaatatttacttggaggctcataaaatgtctggtgtacacctgcccacagtcaccactgggaggtcagctgggtggattattaaccgggcttcagaaaaggccaacatcccccagacatcacaggggagctctccagatgcctgcatctctcatcgccagctctgtaaatcatttggcactggggaactcaacactagcattgcatttataagaagaggaagagtaagtgccttgtcagtgatgagaatgggcagctcctcagactcacagacacaaacaacaaagttgtggtttgtctacaacaaagtagacaagcagtgactgggaggggcgatataagggcagaggattaagaggcacaactattatgaactaagctatgaggatatattgtacaacatgcggaatacatccaataatctataacaactataaatggagtataaccttacaaattgtgaatcactatactgaacacttatattgcacagcaactatatttcaataaaaagaacattttaaaaaaagaaaaaagctgcttctgagcaatgtgagtaaagaaaaaaatattgaagcttgaaagtaggatgtttactgtgttatacttgttgctattcgcccttaaatgttgatagacctttatttaagcgtgcttcccaggtagctcaaatggtaaagaatacacctgcaatgcagagacctaggttcgatcccctgggttgggaagatcccctggaggagggaatggcaacccactccagtattcctgcctggagaattccatggacaaaggagcctggtgggctacagtccatgggttgcagagagtcagacattgagtgactaacacacacacacacatacacagacttttattaatgtatatctatttagaaaagttgtctgtaaaagttgtgtgagtcaaaaaataaagtgtaaattaggaagtgatgagcttggtggggcgttcacatcgtgctgtcgtgaaagggaattcccactgaactggggccaagcttgtctcgggtggcaccatgctccctttgctcgagagctagctatcagtcaacacagggaaaaagtgatctagctcattagaagaaatacacatttcagttccaattcatttcactttttactcaacttctttgtcatttcttccaaaatgtggtttgtctggggactactctactcactctagtcttcttagtgacgtttctaaagcacaagacaaatgcagcgtttatagatctttcacacttactttgtctcgggcactgtctatgtggctgctaccgccctaggtgttttgctttatttattatcttatcctaagtactcttgcctggagaatcccagggatggagaagcctggtgggctgcagtccatggggtcactgagggtcagacacaactgagcgacttcactttcacttttcactttcatgcactggagaaggaaatggcaacccactcccgtgttcttgcctggagaatcccagggacgggggagcctggtgggctgccatctctggggtcgcacagagtcggatgcgactgaagcgactcagcagcagcagcaacaacaaacatacgaagtgagaatcacaattcccatttaaaggaatgggacactaaatgcagacatttgcccaagacggaaaagctaggaagtggggtagctaagagggaaattgagtctgagtaactcagatttacacgccactgtcagcaaaccatgttacttctctaccaccatgtaccctggagaataataccaatggttgtggtcactgagagtgaactcgacttagttgtaaatgtatattgcaaacactagagcaaaaaaaaaagtttttttaagtataactgatatgctaaagaaggatataaagtatgattataaaaatgctaaattaaactcacaaatagcagaaaaacagttgaaggcaaaatatgaataatgaacaaaggcaatggtagaaaactgtaacatatatagtagatattatttcagttacatccactttgactgtcaatggttcaatgtaccaattaaaatacatgtaaaatatcatgtatgaaatgagatgccagtccaggttcgatgcacgatactggatgcttggggctagtgcactgggacgacccagagggatggtatggggagggaggagggaggagggtt

SEQ ID NO: 52952 - DNA, 748 bp, Bovine  19866880762743
tgtacagaagaacaaaaaccaccccagataatgaacttgtgtgggtaaaacctactgatgggcaagggtggagagtaagggcttacctgatgttaataataaacatataactggactgatttttcaataaaaatatgaaaacttccaataaaatgtagaagtatgaaattagtttcctcacctcacttaaaagttctgggaacttgaaacccagcaagtgagtgacctctgaaataccttcatgggattctcactgagacctcagctgagctgacaaacagaagcttgggaaatggatgtctgaagggctattatagaattcttccttgtggatggaaaattggataatccagggttctgagcctgaacttcaaatactcttgggaaaagtgaccagtctataaaagaatgtaactgtcaattcccatactgcagtggaaatatgcccactggggaaagttcagcaaggaccgattagcatcttacaatgaattgcagtttacaaatgcattctaaatttgtctatcacccagggatccttgtaacccaagacggtgaaacagcaggatgccttctgcttctgagacaacccgcggtcccttttcctgacttgggctcctgccaagcaggcttccataagcagcatttatgctaaagcaaatggctctgagtccaccagcccagctggggtttgtacagcttctctactttttaagtgatcaccacactcacctcatacacactcaca

SEQ ID NO: 52953 - DNA, 1324 bp, Bovine  19866880804799
tatccagatacagaggtgaatgctggtgtttctactcttgtgaggagtgagcagtaggaatatgaacggttttctggatctaaggacaactcctcagcaaagaagagctaactgcaggctcagactctctgcctctcccaactgcttcaaaccttccccgggttggacctgaatctcaggctcacggcccatagaaaggcaggcatttttttgtgtgggcggctttgcggagacagccacacagcatgaaatgtgcaggcctgagccccgtgatgctccccgggaggctgtttgtctgttggcatgaaggagaaggagtccagggcaaccagctgcagctcccaccagggagggcgtgtttgagtgagaacaggaaacaaataagcccagagctcctctccatgacaaatccccaaacatagcctcccgttaggaggaaaatgccgaataataactctgacgctccccacggagcagtgtcacaggtcttaagcctctgcaactgacaacacgggatggtgacttcatgctaagcttggactttgtaacgttaagtaacaacacgatattgaaagtgacaagcagacgctgcctggtccccaccggatactaatcgctgtggtaggaggaagcgtccgggccataaaaactgtcatctgttggcgtgcgttcctgttgcaaccaagtcggccacattccttgtccacacatgtttcaaatcaagcaagggatataaatgaaaaaaaatctaactctgattctctttcagtttggcagagtgacagggacagtcagctgtccctgacagtccaataccagctcccttcagattggtgggcgttctgggtagaaggaggctgcagttggtgcgagtttactttgctgaaacctaggggaggagggtggagacgttgccgagacgtgctttcctctcccacctggtccacacctggctcctttctctggcccaggaatgtgatgtcccaggaactcccacaaacactctttccctctttcccctgcagggatcagcctcccgtccaccacgagtctcttgggccattgtacccccactagaatgagtgcatctgctcaggggatggttttcttgcatttcctctgggagatagcctttctttccacaccctaaagcagaaatgagctgtcttctcaagttggttcaacgtcaagaggaacgtgccacagcgaaaattacttcagagcaaaacctgtctgattctcctcccccccttttttttttcttcttcttttgccaaaatcttgttggctttcagtttttatgtttgtggatacaggtgttggg

SEQ ID NO: 52954 - DNA, 1260 bp, Bovine  19866880908248
tgctgcagtacatggggtccaaagagtcagatacgacttagcgactgaacaacaacagtaacaagggtttctctagcactgaattaaagcattctgttattttagagggatgtaattgtgaataatggtagaatgtttcttagttatgaatccaagataccttttcaactatgcttgagtaatgctcatttttaaagtctgaactgattatttagacacagaaagacaatgtagcaaacatttgtttcaactaaatgtttaggctgcatgtcagaaaatattctctgttcactgctgggaatttattgacacttacctatttcttctaacagatgaactcggctatgaagttatatataaatagatgctgttggaagttttgaaactctaaataaggttcataaggacattattatttttctttcaagcttagagtatgaaacagcctcttttctatatagtgaatgcacgctttttcaaatgtttccattgaattaacaaaagtatgcattctagcataataaatacctccttcagaacttgatttcaaaagtatatctaagtaacttaaaatctgtatttattatcttgaatagagacacagaggattagcattcaaaaatttcacaatatgctctgctccatggtgtatccataacttacactgggccttttattagagatcatccttccaggcacagacacgaatcctgacttaaaatggagggtggatcgtcgtggtaagacactgcctgtgtagactccatcctgaacataagccagcagtgtggctctcttcatggattttcttaatcagttcatctccattcaggaatgtaaaaggactttaaagtagctttacttggactgcaaaactgggcaagaaaagattatagcaaatcttctcagcgattctattatatttcagttggtcttttttttttttaaatgggatgggtgaaggtaaagagaaaacttcaagtggcacttaacaagttttcaaatttgactgaatataagtttttgtcttagccccaaatgcacttagaacaagccaacaaatatgttttccttaatctttgaaaattataaaggcacacatgaaagcctatttgtcagagcctcatcactgcagttactgggggaggatagctaattttaataaagctcaactcttggtggagtcgtcttctggaatggtgtgtgaggagctcttcaaatcctctgccacaaagccaatgatcatagtggacaaaactg

SEQ ID NO: 52955 - DNA, 1174 bp, Bovine  19866881042220
atgggaaaaacagaaaaatatataacctttgttaaagattttaacactcatctctgaaatcttacataacaagtaacaaatattgtagaggctacagaagctgtaaatactattggcaaacaaactaacagaatctcttaccaagcaaggaccaagaggggacctcagtttgataaaaggttaccaggtaaaaatttaattgtcaacctaaaacaaatgcatttccctgagtgtaaaatttcctcattaatagaaagatgtctggaaaaggaaatggcaacccactccagtgtcttgcctggagaatcccatggacagaggagcctggcaggctatagtccatggtgtcacaaaagggtcggacatgacctagtgactaaacagtaacgacaatagaaagacatgctgcatttaacttactccctgtatttcccaaacattattagtttaccacggatgacagcctacagtctcagcaaaacagtgtggaaaccaggagtatgctgtagaacactccacctttgaaagaaaatgttagatgtgggctccttttccttagcaaacagaagagtaacacaaaaaattctcagggatcttacatattcctccaacggaaaaagcaacactgggaatactgtgttgatgctagctgatttactattctggttccaagctgagattacccagctgaggagataaacatccagttctggcagacagttgtaactgactctacggggagacctacttgagtttagaagaaagaagatgatcatgttggatttaaattgggcatattcccaacgtgttctgaaatgttggagatttctggaggactatatatttttgtccactttacttttgattttattataaactaggataaaagaaaaactcgtgtgaccccatggactgtagcctgtcaagctcctctatcccgtggggatttcccaggcaaaaataatggagtgggttgctatttccttctccagggaatcttcctgacccagggatcgaccccaggtctcctgcattggcaggtggattctttatggactgagccaccagggaagcccccaaaatcactactttcattccatttatggggtggctttgatagcagtttagtagagcgagttatgaaatcttcacattcccttgtctagcaagacca

SEQ ID NO: 52956 - DNA, 1251 bp, Bovine  19866881140843
tcctgacttgtttggaatatctctcagcaattgattcccattctgctggcaagcccctgttaagctaaggcagaagcctagaagaggagggaaatgggtggagtcgattatgttttaacatgacttcataatactgcaatgtgagcttttaactcctgagtccacacattttttcatagggtgtgtagttgatttattaatgccattcaggtcaagcaatctcagtattttttttttaatttaaaatttaagaaaatattcttctagagaaatctggaatttgggatactcatttgtgatgtgagtgaagctaaagtgggcaatatcagtgagccttgtttaaggagagtgtcagtgctcacaagcgagtattaattttgcttctgtagtatcagtgcacatctaggtaaaagtcaagacatttatttttgctctaagatttaaaatgtaactgtaagaccaggaattgggttctgtttgtttgtttgtttaaatgctttggtggtctccaacagcgagcctacatttcttgttgggttactatgaaagtctgagcagaggtaatccatgctcccgtggtatctctgttcacatggaagacagtggagtgagtggtccccaccacacctcactggaaacaccagccacagcaagtgagagatggtctagatcagcgtgtctcagagtgtggtccccagaccagtagtatcagcatcacctataaactagctcatactcaaggttgactgaatcacaaagcccagggatatggctccgtggttttgtcctcaggagcctccaggtgattttcctctgggctgaaacctgaggatcactgatctcgtcacactcaccagtggaccgaaccattgcactgggagcagctacgttaaagatgaatgcagaaaatacaaatgtgaaacactgtcagcaaaacagaaatagtggaatctgcttttcatgtacaccaaggatgaaaactgactcctacactttcaatattatttcaaatccagaaagtaatttgttacagattgcgttctggattgtgcgtgtgcgttcagtcattgtcggactctctgtaaccccatagactatagcctgccagactcctctgtacatggaattctccaggcaagaacactggagtgggttgcaatttcctcctccaggggatctttccaaaccagggaccgaacccacatctcctgcattgcaggagtatgcattatcatccgagccatcgtgatt

SEQ ID NO: 52957 - DNA, 1060 bp, Bovine  19866881216847
tgaaagttccagatttcaagttaatgtgacttcccgtctagtgctagacttatgcacagaagtggtcacttctggtttttaaaccagtcattgtaatcgctaggaaggttctaatctgttgggaccacatcgtcctcccaaacaagcttctacctgcagaaatacactgatgatctctctcgtatcagaatttcttgatcttaactcatgtataattctctaaatgtgtctggctaccaaaagttaaagatattattccatctctcggtgagataaaactgaggaagcgagcgttgagtctaccgcaagggcatacgtcgccttcacacatttcttaaccaaagcaatgtaggctacatgagctaaatggtgttgtacgtggcccacatttgcatatgcatattgtccagtgacactcataattgcatcaacaaagcgaggcagcatccgtcagccagggttcaagccatcacgaggcactcacactgcagcccccgtcaatctccaggtctgctttccctcagtgcgctgtatctgtattccatatgcaaattctccagtgaatgattttcctgttttgtaagctagactgcacctgtaacatgtgggattgagttaaaaatgacaagcagacaagcacaggcacattatcttgacaaactcagcctccgaaaattaccctgggcctgaattattaaaataacaaggaatatttcactcagctgtgcagaaatgatcctaattgtccactttagctaaatcctttcagtctctgagatcggtcaatttacattggtggcttgcaaattcctcaactcccattagaggagaggagctgcagcccaatgcaccctcatttattttaatgacctgccaagcagacatgaaaatgttaaagttggaaggctataacatgacaggatcctgacttgtcatagccacattataatctagttaaaatactttctttctccttttcatgtcttctcaggtaagtggggaactaattgtcaaattactaattttgttggcattaataccaatacgaagacaagaggag

SEQ ID NO: 52958 - DNA, 1023 bp, Bovine  19866881398966
acacgtgtgtgctgtgccctgtctctgttttcctatggtgcttggcctgtacgttctttccatccatttgtctcgtaggattcgcacccatcagtggcatgtgcagtaaataccgcagctgtacgattaatgaggacacgggtcttggactggccttcaccatcgcccacgagtctggacacaagtgagtgcatctccctgggagggcggagcctggcatcccctctgggctggatgtttgtcttgaaatggtgatgggtaggtcacgtctgtaaggggacatcccagcaggaatgccatggaccataggagatgatctcgtaggtgcatctattccgtttgaatgcctcgctgtgctcgatctcaagcggtggtgatccacgcgtttgctctttgctccctctcttcatccgtccctgctcacacatgtgcaaacaaccgcacactgcagacctcgtctgtctgtccctgctcctctgtcctgtgtcttgagcttgtcctgtgggctgactgcattccctggttagctcctgcagaaggaccccacgtagctgaggatggtaaacgttggtaacttactgttcgaaagtttgcattctgatgtcactctgatcatttgtagagatgggttgtggttggtgtgcagggtttggggaatgcagacaggacaagagatacagtctggtaggagctggttggcttccacatcccccacgtgcccacagttgtcagttgtaaagtgaagcagcaacagggtgagtggggagcctggggctttggcggacggatggacagtgcaggaccaagcaattctcagtggtggtggcttgtcattagcgatatcttttcaagtgagaagcttacctttattcctgtaaaaatgaaacacttctgtcagttatttctagcagctgttattcttaaacaagctttcttactctaataatctataggtcgcctcactttgaggcaccatctacttaattttttttttttttactcaatggggctcacttgctgcaa

SEQ ID NO: 52959 - DNA, 1060 bp, Bovine  19866881411408
aattcagcttcatagcacaactgagctcaggctgtgagctcagaaaatcctacatcactccactaactgcaatctaacttaaaactccacatttttatgttaaaaaaaaattaccaagaattaaaaaaaaaaatcttgcccaaatttgaagaagtttttctcagtcctgaataagggatagtagtttattttctatgtttttgtcacgagaactctaatgatggagggtaatctgtctgagtttcaggtgtggagaagagccaagaattactaacctgggtatatattcttggtttaattgtgtttttcttgatttctttgaaattcactctcttttttcccctaaaaaaactatcttttcaacccctctggtttgtgtctgcaaatctcagtgacctgagaacataaagggaattgattcaaaagttttagaaaactttgcaaagaggctatcattccgctggattcttttgtaagatgcctgaacctgatcccactctctgaaaggagcgtgagggagcctctgacccacgtcattttcagggagtgatgttgaaagaacaaaccctaccgttctcaaattcgtcattgttttgcagagtgcttttgcctacagtttctcataagttctttgtatgtaaacttgcctcaccagccaaggaactgttcaatttccatgaggttaaatgatttccccaaagactattaaatcttaatccaatctcagtagaacaatctcgttctattgaattcatcacagaaatgtttccaagctttaattgtaggtacctatggagcaggatgattttctgttcattgagttgaaagaaaactctttcaatttcaaaatgttggaaaacatttaggctcttcattcttatcttatttagatatgtaatttgtgggtatactgtgatgctgaagctagtagtaaatcagattaataagttccaggccttaaactaatgtaaatattaaaagtctatttttaaaagcctatattgtatatttaggacatagtgtttgtaaaatacaaccttgagaaagggatgactgcatt

SEQ ID NO: 52960 - DNA, 1165 bp, Bovine  19866881418458
ctgaaaggctgctgactgaggctgcaaggttgactgtgcatgccagaggggtgagaattatgctgaaaacctaaaaaggttatgttttaaataagatacacaatggaagaaaacctagatacacgaaatgaaacctaccagatataattttaattaaaatgtatttgaaaatgccagaattaagttcgtcatcatagagaaaaaatttcagctcctccatattttagcttgagtgattattcaggcaaatattctgaacttacatttgaaagccattctgaataaattgtgttttgataagtatttgccttgaataccaagtttcctcccttaaatcaacacaaagtgaagacagcaagctcaaacaagaggagaaaactgattagcgtggacctccatccccgagccatcttgctgtttacgatatctttcctacctttatgtcagtgtagtgtgaagaggaaaagctgcctagctgaatggtggatatgtaaagagaatgtcaaattcagcttgtaagatcctcagaatttgggtagtctaatattaacgaaggtgccattaggattttaatctaaggaattttaaaacatatttcagagttagttttgcagtttctatatggttgcaagacttttacttgcaaatataaaatacatttaggagtatgtggtgagacaaggaaatgcattgtcatgattttatgtctcctgtgctagttaccaggcttcccaagtggcacaaaggtaaagatttcgcctgccaatgcaggagatgcaggaggcgtgggttccatccctgagtcgggaagttcccctggaggaggaaatgacaagccactccagtattcttgcctggaaaattccaaggacagaggagcttggtgggcttcagtccatggggtcgcagagagtcagacaggactgaagcaacttcgcacagaacgcacgtgctggttaccagcccctccaccagtaagggccaaggaagtcagtggtaacccggagaaggccaacggtccgctgacttaggtagatttgcccacaaagacatttgaacgtcattaggtagtatactactgaagttcctttgaagatcttaattgaaagtatcatttcaaaaaaagttaaaaaatgctttttctgtgggagagtgatagatcaga

SEQ ID NO: 52961 - DNA, 1634 bp, Bovine  19866881475797
ggaaaatatctatttagagatatattttaatgtggaggaaatgtatacaaatccagataggtatacggtatgggtaaagcagccaagagatcatttattatgtgaaatgatgcccctacctcctgcatttagctgatttgttttcccacaaagtgtcatagtttccaaattccttgctagaaaatatttacattctaacctaatataattaggaactcattgagctgaaacattacataggttggttttcattataatttctgcataatattgcacacattttctaggtagtaattagatacattaaggatgaatgattccttgggggcttattctagagatttttcttccgaatttgtgtcaggggtcacccagggtagaaaacaataactgtcactgaggagaatgcagataaaagcttctgaaatgaatcaatggccacggaccaggaattggacatttaaattatccaagccatcagacttccgacccttgagctacacctgaagcagaacacagatggacaggaagttacctgcatgcgttactggtgctttgagaaaagaaaatgagcgtatagctttcaaataaatgtaagtttggacaaaacaactatttaattgatgccacaaataaagtgttatcaacctaattaacaaaggattaacaaaggttaacgaaggattgcttatttttgaccaaggtgaattttatttagctgtcttaatcttttagaggggctcccctggtggctcagacagtaaagcatctgtttgcaatgctggagacctgggttagaggtttggttcctccttcacataatggggcattattctttataatctttggacttatccaagctaaaaatgtggagaaggaaatgacaacccactccaatattcttgcctggagaatcccatggacagaggaggctggtgagctacagtccatggggtcacaaagtgtcggacacgactgagcgactaaacaacaacaacacagctaaaaatgtccgatatttgtaaaacgtgtgttgttttgtaatttttatatcgaaagtctatttaaaatatctcagagtatctttaattttttactttttacttttctttttagaaatatgtacgttttgaattcactctatggaattaatgttcttggatcaatttcttttaaaccgagttttctttggtacacgagtcctcattttcctccacaatgtaagtgctatttggaacaataatgtaaaataccatactaaactgatttttctagatttagcaaatgcagatataggacactcaggtaagtctgaatttcaaataaacaaccaccagtttttgataccagcatgttccaaatactgcacagagcacgcctatactaaaaataaatgtattccagcggattcattttgatatttggcaaaactaatacaattatgtaaagtttaaaaataaaataaaataaaaaaaaaacgcacattagagtatgaatttcacacctcagtttccttctttggagaagtaagcgaatgaagcatcttgaacaggttgagtgagaggtactgaattcatttttcagtgcacacactgggctgaatgggaggtgattcacactgagacctgcaagat

SEQ ID NO: 52962 - DNA, 2218 bp, Bovine  19866881590876
acacagagagaaacatcacttggaaacgtggagaaaaactgaccccgtcccattcagtttgctgtgtctcttttcacacggagaaaggatgtggctgtctctgctctcctaccccacgcttacccttcagaataaacccgcacggggtgccccacctctgcccagcgtagacccaggatataatgagatcccatctactggacgcgtggagtcgccatcacggccatcgccaggctggcctctgcccgactgcccaggactaaatgcgccatcctgggaggtgctccctttactctgcatggcgctgacccttggatgggacccaacaaggctgccattcccacaggatggctttgtcttccagctggaatatcacccctgagcttcgtcatcaccctacaaacttgcctgatgccatcgccgcgacagccaccgaactcattattacattctggggactactttacagcgatttccagcctgtagaaaggggtacttagtagagttccacaccgtgttttctggcttggatgtatcttaactccattttcaatacacaaacacctcattagcagaactcctgcaagaacaagggcaactctacctatgacccgattagtaaaaggtgttcttatttaagagttataacaagttactatgaatttttttctttacttaaaaagattaaaatcgcatagacttgttataaagaaagcaaatctgaagaactacatgaagcaacgtattagctttgtcctcagaacctccccccatcctgtttctcagaggataccaatggtaatactgtgtttcattctccgaattggaactgttgatgaagattccagaaaccttgtcaaaactgcacttaggacaatgtcaacagtccagaatgttcctccacccaagctgcataaagtctcaaggtaaagaaacaatggccattttcttgagcaaagtatttctcatattcccaacacaaactcatcatcatctctacatcttttagatacacagtagggaaaagtagaaatacgtggactctatttcacttgatgacacacacaaatctttcacccaacgattgatttttcttcacagatctctttttgatgtagaaaaactggaaaatatttccatgcaaagcaccagttaatttgtattaaagtgaatgaaattaaagatccatataagaacatcttgtaaaatggtataaagcacaatataaaaaatacaatataaagtaaaaatacattttccacaaataaattatgtccccaaagattaagtgtattcaaaatgcaaagaacagctaaatagagtgttttatggaagctgtaggagggttttaagaatgttttttagtgggcaaggaatcctattttgcagagctataaaagttgctttctttttttaccctcagaaaagttctaaaaaatctttccagattcttgaacctgctgagagtctgcaaaaatccaaacaaacattaaaattgccctcacgttacatccatttttaagagtttatgataaaacttactcaagagacaaataatgcctatcctatgatttatgtaggtaaataaatagcttaaaatacaaacaacaagatatattagaaagagaattgggatagttctgattcctgtagctattgcagaaaataacatttgccatattttacacattaaaaatgttccctattattttaggaaagaaaaacaactcatctgagctttctttatttaaacattaccaacagaaagagggcatctgggcaagtctgtagaggcactgaaagaaatacgaagacagaattaaaaatgagaccactgagagccaagggacaaacacaggtaaaaccaagcatcaaattcaggttaagggagtcttcatttattattgggatttcttgtagacagtatttcagaatactttatatagattataagattaattgctgtcatatttagagagttaaaaggcaagaacatattgatcacttcattttatagatgagaatactgaaacaaaaaaagaagagcccttctgttcatcgcatgatgctattaagagagaaaaagtaaagccacagagtggcagaaggttttttgaagtctatatatctgataaatagctcacataacttcttaattcagtaagaaaaggacagactatctgattccaaatggataagaaaaagtagataatcataa

SEQ ID NO: 52963 - DNA, 843 bp, Bovine  19866881834949
taaaaatggactctgtttatgatgagcttccctaatggctcagatggtaaagaacccttttgcaatgcaggagatccggtttccatccctgggctgggaagatcccctggagaaggaaatggtaaccaattccagtattcctgcctgaagaattccatggacagaggagcctggcaggctacagtccatgaggttgtaaagagtcagttacagtcatggttgaatatttcacaccactctacagagggcagtttatcacaccaaatttttggatgagacacttgagactcatggagatgggatgattcatctccagtcactcagttagcaagtgttagagtcacctttcatgtccttgctccaaagcttatatgctctccctttatgctgttcagactctcagaagcacataagatcatttcttgactggcttcttgagttgccatagaggtttgttctttcaaagctggcaaagagctttttggaatttgagtgatgagacaagcctcctccagagcggttggccatcagtctaagaggatggccttgtcctgcagagccctgacaagaaggccaacaggtattgtttacaatgtcttctcaagtggaaccagtctgctagttattaagtgtctggaagcatttcccagtttttaagtagccagaacatgctgctgatacagtcagagccagcatgacgctcactgctcataaatgacttacttagaaagaggcaggactgttgtgacttggctgtctttccattcttcagagataaggtagaagttcctagtaacgaaacatgaaaacaaacatattacagttctttaacatatgttacaa

SEQ ID NO: 52964 - DNA, 951 bp, Bovine  19866880528134
actttatgttcttggttaagtatgcagattcacttaataatttagtggagccctgaggatttcagagaccccagcccctaccccttagtctgtggcgtgaggttgccaccttttgggtcagcaagcacacaactcctggagaccctgacactatgggaggatcccgcgctgctgacaagcctcttggttttgcagatgtccccctggggcgcaccctccttggcctggcccccgaccaccaggtcaggctgctgccggtcgccttctacaggtaaccctcagggcctggaggtcaggggagacacagcaggggtccttcaagacggagaggctgcgcccctgctgcctgccaccagccccagtcagacgtgtgaggtcgtcacctgacacctgtgtctgccttcagcctccttccctactttgacgaggatgccctcctcacagaagatgccttcctgcacgttgctctcaacatgtacctgaagctcgttggcctctttgtggccggggagaccggtgcaatctggactgtggcccatgatggggagctcccaactcaggcaggtgcagggccaggccccatctccagacagaccagggtgatgctcctggcacagttcacagctgtgggcaccctgaccttggcactgcccatcttctttctagggtgaccccgtaagcctgataacaaatgcccgtctgtttctgctgcaattgatacctcggtgcccagaaaggagcttcttgcacgtggcagaggtaacccccaggtgctcaccgcggtgtctgtgtttaggtccatgtcaccgtgtgacgtgaggatgctggacgccttggggaaagctggcatccagcatccaggcccgggagggacgggggcagaacgggcccagcatgtgggctttgttgcagctgctggctgagagtggagattgtgacccggaagtgagt

SEQ ID NO: 52965 - DNA, 871 bp, Bovine  19866880706253
ctgtatttagagagcgtccccgcctatatgcaggcaggtgctggctgctggccggccttacccacgaggtcgcgtgccgtctcctggtcctcctgaaagcggcatgcgtcgctgagctgcaggagcgagtccacgtggtaggggcttgactggagcaggacctatgggggaggggggatgcgtgctgacaagatgacacccaggcaggccccgggcctccggacgcccccaggaccacaccagggtaccaacgcaccacaatattattgggctccatggactcgacggcggccaggaacttgtgctgcgtctgttggtactcctcgctgtgctcaaaggcgaagaccgagcggcctttcctggattccaacagccgcatcgacagacctggggtgagggttgcccacatcaggatgcccagagccgactgcccgtggctcaggccacacctctgacgccccttctaccctttctcccccgagaaaggtggacaacagggggacatgcagagcccgccccaaccccccaacctggtcagccctggacatggtttgcttaaagtcagaatccagatgccacccccaaggcgacagggactgctaactcatgacaccctctgctcctatgctgacgctgggtgccaggtccagggtctgagaagcctgacaacttcatctctttcggcaccttcgtgagacccgtcagggtcgggggatgcccttagccacagtctctgacaaagtctactccagcccaacaggaccccgtggcactgtgtcctctgcctgcactcaggggccgctgttgcgagcgtgggagggaagggccagggggacgaggtgtccaccaggccctcactgggcacaagggg

SEQ ID NO: 52966 - DNA, 1278 bp, Bovine  19866880957561
agggccggcataggacactgcagcactcagggctcacccagtaatagcagcatgtttgtcaagctttcgtggaagggacagccatagctgaggttcatgctccctcatcccaggctgtctctggctctcagggcagggtggtggccggtgggtgccctgtggaggccaggctggaggagaggaactgccagatgcaaagcaggggcttctgttcgcaggtaccgagcccctgaactgctgctgggaaccaccacgcagaccaccagcatcgacatgtggtgagaggtggacgctgctcccaggcctctcagacagtgggggtggtcttgtgggacctggggcggggggggtggacagctctggggcttggggtctccccagctcccaagaagatgggcctatgcctggggtcctgagaggcagagggagacagccccatcactgaggacctgccctcgtggccataagaggcctgctgaggccaggtcacgtggctcacctggagaccccagtggtcatcccatcatgacctcctcccagctctgcccccagcctccgccccagcagctggggcactggtccaggcggagccagggagctgagaggagaccccgcactcctctgcagggcggtgggctgcatcctggctgagctgctggcccataagccccttctccccggcacttccgagatccaccaggtggacctgatcgtgcagctgctggggacccccagtgagaacatctggccggtgagtgccagccccgccctcctccctcctgcccctgctggccattggcctttaccggcccctccccacagggcttctctcagctgccgctggccagccagtacagcctgcggaagcagccctacaacaacctgaagcataagttcccgtggctctcagaggctggcctgcgcctgatgaacctcctcttcatgtacgaccctaagaaaaggtgctgagagagccccacacgtgcatgagtcaggcccgattttgtggggttctgttggtttacccaactttctcttgtgtggaggggaaccagggggcgctctgcggggcagctgtgtgggagacaagcctgactgggcctgggccctgtgaacagtgagctctcctctccagggcgacggccggtgactgcctggagagctcctacttcaaggagaagcccctgcgtgagtcttccccgctggcacctggccgggggcccttgtgtagggtaggggttaaggcaggtgggtggtggggcccaggcgggtaggggc

SEQ ID NO: 52967 - DNA, 2233 bp, Bovine  19866881023849
tcagcatggggactggaggctagccctggaaatccaaagaaactacctcagtgtttaaagaaaaatgagcgctgtgtatgcaaaaggtcagaaacatcactgaccagtgttgtcttttcttccagggtgtctggtaggaagagtgaaagcaaagaagccaagaagtcagaagaaccaaaaatccgaaagaaacctgggcctaagccgggctggaagggcaagccacggtgtgagaggtgaggggctggagcgggggttacacagcctgtgggggccgtggctccacgtgtgctctgcattgcagggaggaactgcccaccatctacaagtgtccgcaccagggctgcacggccgtgtaccgcggggccgacggcatgaaggtgagggggctcccaggagagcgcacccccagctctgctgacagggcctgcctgggtctgtgccttcgctgggaggaggcacgtgcgctgctctggggtgttggccatgccaggggactcacgcccctggtccctcccacagaagcatgtcaaggagcaccacgaggaggtccgggagaggccctgcccacaccccggctgcaacaaggtgttcatgattgaccgctacctgcagcgccacgtcaagctcatccacacaggtgtgtcccctcccctgcagatggggctcccgggaactgacactgaagaaaccctggtgctgtcctgtgagtttattgtggtctgttttacatcattgtgtgtgtcagttgcttagtcgtgtctgactctttgcgaccccatggactatagcccaccaggctcctttgtccatgggattctccaggcaagagtactggagcgggttgccatttccttctccatttacatcatcactggaagaaaatggtatatgcttttcagattataaaagtaacccaaagcacagggaaggtggcgcccgtgatcaccgccttcagcgtgtgaggttgctaccgctcctctctgaacacgcgtccacggccttggactcgtgtgtgccaatgctcgtcactgctgttctgcccagaaggcagctctcccgacctgcagcccccatgtccagatagtccatcctaaacgatatctttgctctgttgatctttgtacaaacgactgacttcctcactctgatttgcccacttaatggctggctcacagtcccttggtttcacagcatttcatgctgtgagtgttcttgtctgttagtccagacacagtaattccctggtgtcgggtcaagctgttgtaactcagtctgaccacagtcgtgaccacgagcagtttttattttcagcacagaacagtctagacctcacagtttcaggacgattgctcctagtcacggaggagcctgcctgtgcggctgcgtcacatgttggtaggcgtgcagtgacgtaggagagaagcatgtggtcttgctccaggtgcatggctgggggtgtgacgttcaagttttgttgaaaagctcttgtaagactgactgccacagtgggtacccctgtggtggggacagtccttagagtaggagtagctgtaatcagtcatctgtgaaattgcactgattgggcttcctcttaagaattggtgctccagaaaataggtttagggaaacatgctacagccaagtgacgtgggtcagagctgtgtcacctgtgagtcaggtgcttgggcaccaaggggacagtgtcagggcctgtggtcactccctatctggtccccagaggtgcggaactacatctgcgatgagtgtggacagaccttcaagcagcggaagcacctcctggtccaccagatgcgccactcgggagccaagcctctgcagtaagtggggggtggtggccctcccactggcagcaccctggccctggctcactgcccccatcccataggtgtgaggtctgcgggttccagtgccggcagcgggcatccctgaagtaccacatgaccaagcacaaggctgagacagagctggactttgcctgtgaccagtgtggccggcggtttgagaaggcacacaacctcaacgtgcacatgtctatggtgcacccgctgacgcaggccccggaggccccgccccggcccgcagcagggcaggtggtgaaggctgagcccacctgagggcctgcctgccccaagctcgggtggtgactgaggttccggcctgtgcgcagagtggtgccctgatgtacccccactatgcgtgctggtggtga

SEQ ID NO: 52968 - DNA, 1105 bp, Bovine  19866881168123
tgctgagttgtcctgtctagaactttacagtgcaatgctcactggaggcagtaggaacagacactttgtcctggtcctggtcttgggagaacagttttcagtctgtcatcattgagtacaatgtgaactgtgggttcttcataaatgccctttgccaggttgaggaaggtcccttttactcctagttagtttatttttttagtcatgagatggtgttgaacttaatgttttatctgtgtgggttttggttttctattttactcacgtttattgcattaattgatttttgcatattaagccaacgttgcattcttaggataaatcccagttggttgtgtaatcattttgatgtgtcactggagctggttgctggctttgtgctattgctggggcactgtgcgtgcgctgtggtccctgggtactccctggccctgtgactacaggccatactggaggcagaagaagaggtagcccagcatagataggagacactaaggaggctttcagtgtgttttcatttcagttcgaggagtcatcatcactcagagaattctgatttggttctcagtggctgcaaaggaaatcgggacattttttccagattgcaggtgagttagaaaatgcaaaactcagtgtgtccactgcatcgaagccatgtgctatcatgatatttattgagtatccagtgagtccagatgcctgttctaagcagaatgaaagcctgagtcacagacatggtcactcagaccagagaccatgtgttctgtgaactcatgtcaccatgaacgtcaaaggaacacaaaaatgaaagatgaaatacaggaagcatctccaggctttaggacatttaagatttgaaaacaggaagtaaaaatatggacttcagtagtaacttggttgctactcccattctctgctctttaactctgggtgctgcgctaggaggtcagactcttgagaactgatataaataaccctccacttggctgagtattgagagtttggaatacagtcccttctgtttcctgggtcacttgtcactgaggcaggaacactgagaagggtgcagaagcccttcaggttctcgtcctgcagtgaaaagtgc

SEQ ID NO: 52969 - DNA, 879 bp, Bovine  19866881217566
caagcttatcctgttccccaggaagccctcggcccccaagaagggagacagctctgtgagtaaccggctcccacagcgcccagcgggatgagggtgtggaggtctcactgcgggtctagctgggctgcaaggacaaagtacttgtctgcagcttcctatctaaagcagggttgccacgcagaggagtagagagaagataaataatgtgggagaaagcctctgaggagcctcaaactaattgcctgaaatgtcgggattcactaagggcaggagttggagccagctttgttaaaattgaaagtgtactgcgtgttagtaatctttgtatgagatcagcagtgcccatctatatgggttgctggcagtcattctccctgcatccctggttgatgcgtgggtgtctcatctgaccctgcctacctttactcgatatcgggcaggaatccacaggccctcaggggtgacaagtttggggctccttgggagatgagctaaactcacctgactcccttctcattgacaaacaggctgaagagcttaaactggccactcagctgaccggacctgttatgcccatacggaacgtaagtgggcatgttgggagaaccatggatctggggttggattggagggattctgtgtggcagccggggcccatgttgagatttactggtttgtgaaagacctacctgccctgaggagagtcagctgcatccagacagatgggctccttgaggaaagcttagtcgccctcagttgtttccctctatgtagagtcctttccactccctgatgtttgggaagcccaggctggaggcagctctccatgcatgtttggtgatcctatagcctgaccagcaattgacaaggcccttgagg

SEQ ID NO: 52970 - DNA, 1783 bp, Bovine  19866881247351
tgcagcttccctggtggctcagatggtaaagcgtctgcctgcaatgtgggagacctggattcaatccctgggttgggaagatcccctggagaaggaaatggcaacccactccagtactcttgcctggaaaatcccatggatggaggagcctggcaggctgcagtccatggggtcgcaaagagtcggacacaaccgagcgactccactttctttctgaacacatacctgatgtgtcccgtcctattgcagtgtctgtgcgccctcccagaaacccagggcaggggggccgcctgcgtgccgtctccacctggagcagggcagggcagggcctctccctctcctaaccccatgccagttgccctaggactgctggcagcaggacttaagaggtgggctcatggagatcagggtggagagcaagggctcctgctgcagcagacctggcccctccatcctggccctcctgacgccccctctggcccagcagcatctgttcactcaggcccgcttaagggctgtgacccagtcccacatcccaactggggactcccaagccaccgcctctcttgtctccacccacaaaggaaaaaaggaagttgtgcctgcttctccattttgttttgcactttcctggctgatggtgtggtttcattctacatcaaaggcccaagctgggcatctactaacgaggcgtttgggtgttcctgggcccagggtgacacagtgataaccagcctcctctgccagcacccacagagcaagaacacaaaaccctgtgggaggtgggctgcctcaacaagggatcagggccagaggtagacccggagcaactgcagggccaggtggccatgtcgccaaggccctgggcacagagggcagaaggcgagtgggggaccagaggcaaccagagcagatacaggtgggtggacggatcacattcacagtgctgcactaggccaggtccctgtgctgaactgggaaagtcctgggctacccagaaaccacccttcactgggctggtgaggtcaggccattagagaagcagagcgtgtgctgaccaaggcagacaggggaaagctactgtctggtccccgctgcccccggggcaggctcagatctccaggtcacccactggacacctcccaaaccccggggagctcatggcaccaccatccccttacttctttcctgggtacggctcaaaggactcatccgaggactgggtgttctgcttcttgtcattttcatcttcactcaggaaatctctaggaaagaagagaaccttcagcaatgctctggagcaggtgacggaggcagtgaaacttcctgtctaacaccatgtggatccccacactacatgttttacttctcagaaggcctaaaatccccaatactctaataccatctcctaaaagaaagggaaaaccagggtcacaggctgaggatccctggtaagccatgcctctcatcacaccaggaccccaaactcagaaagtcagcctacggggccccaggcagaggggaagaccctcacaagaggtagcttcgcagaaactgggcttttagaatgtcacctcactcccgtaactagaaacacctgcccaaatgacaggccagctgtcagtgatttcaaagggtaacaaagacctgaaaaagatctgcatgtctgtaatctctaccctaaaatgtgagtcacgacataagctctgctagtctgcagacagagcctggctggcatgcctcagctgcccctataggctgccaccctccccacagagaaagg

SEQ ID NO: 52971 - DNA, 1062 bp, Bovine  19866881336065
tggctgttggagaggtgggagaagctgatgtggaccagctgctgcagtcccatgaggagggtctctcaaatgaggagctgatgcagctggagcaggagcccgcaggagaggaagaggagggtgaagaggctgcccctgccctgcgccaactaaccacacgggagctgtcagcagccttctcacattttgaggctggcttgcaggtccttaccagtaacagccctgatgctgcgtggaaactgcaagtttcaagagaaatcaatgatgcaataagctgctacagggagctgtacagtgagaaagagcggtgctccaaacagctctcctaggtgacctcagtgcacaacacactccacggcaggaagaccagacacaacagggcaacctcctgggtgacgcctggccaagtcttggcctccagatgtttaacatccttggaaaccctgcttctggtacattcattttgacactaaagaacatcacatcttgttactgaaattgtgcttaaatatgtgctttaagaagattgaaagaaaaatccaggaaaagttatttaaaacacacgatgagaccagccctgctagacattgaaacacactataaaacctctgattgaatcaaggaggtactcaaacgtgtagaatacaatagaaagtccagaagtagatacagataggttgtttttttttttaatagtgcaggacagctagataaaatttggcaaaagctaattagttcacacctcacagcatacacagaaataaacagatgagggatttgaatctaaaagctgaaacaatacaagtgctacacaacccacggatatatgcctcttccccatgggtggtcagaaagatcttctgtaactcaaagtccaggtgaaatttaagattaatcaatttgatgatatgaaaatgtaataaaacttttccaagaggataaaagaggacaaacagagtcaaaggcaaatgatacactggaagaaaatttctcacagataatgagttaatatctctgatatgtgaagaactcataaatatgagaagaaaataccaaaaaccc

SEQ ID NO: 52972 - DNA, 852 bp, Bovine  19866881821188
ctgcccccacattaggccctgccagccccctccctacttcccttcctgctgcccaggaggctcccttggctcacctgggaggaggtgggaggtggcatgcgtttctccctcttactttagcatcttcctggtgatgggctactgtgagcaagacctggccagccttctggagaacatgccaacacccttctctgaggcccaggttggaggcgtgggctggggtggccgggagtgggggctctggtggggggcttcccaagccgttgttaggcacattgtgccaaaagcagacctcctggccttctgcaggtcaagtgcatcgtgctgcaggtgctccggggcctccagtacctgcaccggaatttcatcatccacaggtgggcggggcttgtggcttgggggcggggtgaccactagactgactcagcaccaacacgcaggggagtagagcaacctcaaggcagtggagctcctgtaactggtcccaggggagggcgggacagcatagtacctgttttcccctctgccaggcagatggccggggagggacctggactccctgtgcagggtggctcgtgcggccctgggggggaccaggggcaggactctacctctcaggaagtcactgagagctctctgctgtttccagctactgaatggccttgcattacctgtgctcctcctcctaaaaagtacaaacaggacgagatgtgtgggggaagcgttctgagtgttgctgcagcggtaacaaccttgttcctgcatgcgagtttctgggaaccactggtgttatctttctgtcatagggatcgaaggtctctaactgctcaggacggataagggctgcgtaag

SEQ ID NO: 52973 - DNA, 2821 bp, Bovine  19866880153164
gtgatctgtatggatgtgagagttggactgtgaagaaggctgagcaccgaagaattgatgcttttgaactgtggtgttggagaagactcttgagagtcccttggactgcaaggagatccaactagtccattctgaaggagatcagccctgggatttctttggaaggaatgatgctaaagctgaaactccagtactttggccacctcatgtgaagagttgactcattggaaaagactctgatgctgggagggattgggggcaggaggagaaggggacgacagaagatgagatggctggatggcgtcactgactcgatggacgtgagtctgggtgaactgcgggagttggggatggacagggaggcctggcgtgctgcgattcatggggtcgcaaagagttggacactactgaactgaactgaactaagtaagtaacccagctgccagtgattaaatcttaactactaaatagttatttaatggattgttacttgctcatttgtccatatttttctctcagaaattatgtctgacatctgtatagttattttggtaagttctcctgaagcatttaagcatgaaagaatcagcctccaactttctcaagaatttatgtccatggtatacactttccagtgtatttatggacaggtactttgctgacaaaggtccatatagtcaaagctatgatttttccagtagtcttgtatggatgtgagagttggaccataaagaaagctgagtggcaccgaagaattgatgcttttcaaatgtggtgttggagaagactgttgagagtcccttggactgtaagcagatcaaaccagtcagtcctaaaggaaatcagtcctgaatattcattgaaaggactgatgctgaagcttcaatactttggccacttgatgctaagagccagctcattggaaaagaccctgatgctgggaaagattgaagcctggaggaaaacagggacgacagaggatgagaaggttggatggcatcaccgactcgatggatatgtgtttgagtaagctccgggagttggtggtggacagggaagcctggtgtgctgcagtccacagggtcgcaaagagtcggacacaactgagtgactgaactggactgaatctgaattcttttagtctaactctcagagaaaaaggtagctggaatgggaggcagtcattaactgtaaattgaagtgaaggatgttgaagaagacaaatgtaaatttttaaactcattggaacattttacatggcctaaatttttaaggagctgtgacttagatttcagcttgctggagctgaggtaacagatcagaaatcactactgcgtatataaaattgtatttcccaaaatatggcagtttcagttcagatccattattttctacaggtagtgctactaggtaaagtaaggattgatgactgttttcctgcaagcaaaactaaaatgagcaaggaagtaattacatggattgtgctttgtaccattaacagactagtgcaactgtaaccataaaaagttgagactcttcagaagtacagataagtctagggaatgcagaggcaataaaatcattagttttatataaagagtaagcagagccttaaaagcttatactttccactactctatactcagtccctagaatagttgccaacatctaggagttgatcaacaattttttgtttctgagtgaagaagtaaagacccagaatgttaatattaggtaaaacagtgttggagagatggttttaggactcagactaaatgtgtgaataggtgcatagttgagagagacttatagtagataaatgcataataaaccatcaggaagtcaaagtgatgcctcaccttctgaatattaacttttagaggagacagctacttaattctcagaatctctcgtgttgccattgtgagaagcagcgcataatagagtgaagtctgttgtactgacgtcctgtagcatttctggtaggttaagcattttaagaagaaactgcaggtcttgtgcatataaacactagtcctggaacataaaaggagaagaggggacaaagtacaagtaaacccatatacttatgtctgcagccaaaaggtttcttgggaggaaaaaaatacataaccaaaggtttagaatcctgattcatctttctctattatgggtatgtttgtgagaagtcctctgtttcgtataaggagcagaaattcttaactcattttaaatttgagagtaattttctgatgttaatttaatttgttatagtttataaagaatgtcattgtaagttaacctgcagtgttgggacccatgtttccttatcagtcaaaagaaaaactgaacaatctttcctagtttacaggaatctgaatgtaactttacttttgctctacccttaactgtatgacttatgttgcagaaattggaatgggattaacaggatttggagtgttcttcttattctttggaatgatcctcttttttgacaaagcactactggctattggaaatgtgagtgtttcaacatatattttaactacattcataatgaaattttaacttaatacaaatgaattattgccagctgtaaaaccaggggaagataattcactgttactcatatgaagattcctgttacattttctgtttccatcaggaatgaaacttgcaagcttactgtttaaataaaaggtaaacacttaatgaggttttctaatcccataactgcttggttaaatattttgatatgtgatttacaatagagtaaaatcaagactacctctgagtagttcaaagtagagacttcaaagcc

SEQ ID NO: 52974 - DNA, 1657 bp, Bovine  19866880476988
tttgtttctcatcgcagatgacgcagtagcactagatcgtgcactgctctacgtttgtgttccgtgcctcaaaaactaacagtgcctcctcaaatcaagaaaacgcccttgccccggtcctgtgttgtgaatcgtttccgttcctcagttacttgttcctcttgtctctgtccttcctctgggcctccagttctatcaggtctttactagtaagctccttgtgttgcacagcaaggagttcagtattataagaacaagtgacttctaccatctttaaacctcactccactctcttaattattttcacttttgtttccatcgttattgcttggtgcttcttagcagtacaagctacatcatcgctgctcttacgcttgcttccagacatcctgtgctcgaaataaacatactgcactattgcactctgttctgtactgtattgtattgggcttcccttgtggctcagctggtaaagaatccgcccgcaatgcgggagacacgggttcgattcctgggttgggaagatctcctggagaagggaaaggctacccactccaggattctggcctggagaattccatggagttgccaagagccggacacaattgagagactttcactttcacagtaaagtgcacagaagcacaaccacttgtagatgatacacacacctgacagtgtatgccagacacatgagctaacttacatgatcgggtatgtgaacgcatactgacatctttgaaagttcaaaacttgaaggtttgcgtgtaggggacttactgtgtatgctcacttggtttacattttacatcctagctcttatttgaatgcttaaagcattcctgagcattgatctttagcttcatagcaattgacatgattacttaacttcatttaaaactatctagactgaaaaataatactatcgactgagcataaagctggcagttttgatctcaattatccagtcaattgttttgctatttttttctttctttctgtgcatatgctcctgtgctttcggtgttttttacatcctgacagctttttaagaagatggaatggggcatgttttattgcttacaaaatgtcacttaaaatcttggttggtgatcaaaatagaatataaattttgattcttattaaaacctgggaatgtaagaattcaaaaaggcttgactttattctgtttgtgaaataagctttattttaaacaaagctttgtttattggtaagtatctaaatatttcaattgggcattctgaagcaaattttatttgtcatatttagcgtctgttaaaatagtgtgtgtttgtaaaaagcatgattttaggacagctgagttattgcgaatttatttaataaatttagaaagaagtaccatttttaggaaaccacccttctatgttttgtcacacactataatcctgagagagatcataaaggatatgagaataaagggagtaaacaacgtctctcttgatctaactgggaaaagaaaatatttaagattttgtgttcaagagtttccttccttacataaggtaatacattattttttggccaggtgttccaaaattgtagctgcattcaaacaccaggaaattatcttgcagttcttgggctgtgtgacaaaggaaaagactgttccatgatg

SEQ ID NO: 52975 - DNA, 4784 bp, Bovine  19866880543047
ccaattaatagaaaagtacccttttattgagaagtaagacaagtgtatttacaatattcaattgttagatcatataatctgtgagacttttaaaagcagcagtattccaggaattacaatgtataaggggaaaagaaaaacattccaaataggtttctgttacagaaaatagatttgaacaatgccagaaacacttaaggctaagtagtattagaccttttcttccacctttatagcaataactgatgctttttttttttgggtcacagacagaagactaattttggaaaggaagaaacaatatgatgtacagtgttttctgtcagaaaacaagttatgtttaaaagtagagcctcatcaatggttctaagaaacatacaatgctgccaagcagtcccaaactcacatttgataaaactgaaaactgctccaagcctctcattcttattgggagattatcacatcttttatacacttctgtctaatcatgttttctgaaacaagattgttgaaaaagagatctctgctacagtgcaaagaacattttgatagaaattcatgtctacaagggagttaaataatacagatgctccttacattaacagatactgttcttgctctaaaaaaaggtagacttatctagccactgtaaataatatgggtcagtcaaaaatatgtataacagagtcccacagggcaacttatataagtcagtcccccaagtatgtaggtatttgacactctccaagtaaggatagtacttttttgaagaacattagacaacaaagggtttcttaccattccatgaactattgaggtaggagtctcattttgtcagtatcatctatgttcacagattatgtcataaatcaaatgccagtaccgaaaagacagtaatccacaaggctgaaccattaagactatctaccaagtcgttctttctttagatgagcaaggatgggacttccctgtgcatcaagagacttaactactagtaacataggcaataatgtatcttgtagacatgtttgtaaataaaaaccacaaatttcaattatgattttatgtattaaaaagctttgcaactgttaaaaaaaaatgagcaaatagtacaatcattagtagtaaaacaaatagtactatgactcttgaaatggcttcctaccgctacaaaagggtgcctccctggaaaactactactgaggaaacacccccagcttcctacctactgcccgtcgagcagcaacaggggagaaaacaacacatcatttttgtagtgtcatgtttttcagaaccatagccagtttaattatggtaaagtaacttttgcgtgtgaactcagatattctctccacgaattcaagatgaagagcgagtgtatgaaacacacattatgcatactgatttttatattaggaaaaagctgaaaataagggaaaaattggcttctgtgaacagccctttaaaaaacagctgtaaatttaaccttataacgtgttacatcttaaagtaaaaattacccagtagttattccaatgtatgaaaagcaaaataataaaccactgctaaaatttaaaaaaaataaaaggaaaaactggatcatgacatggaaaaatctcacttgggttgtatcacttagtatcttaaagaacacaccattcagtgaaacaagctttgtaacagactgtttcatggccgagatggctttctgttaaatgctcatgtgtcatgaaagatacagatgctcagatgagagtcccaaggaatatcaggatttccagagtgtgttgctgaaggaaaaagtgctgaatgagctgtaacttaggaaactgtaaggctagtaaagaatgacctttgcaacattacaacaaagaatatctaggtcggattttcatctggttttaaaatattaagattcagaagaaccatgaaagttttattttaaccatattcttaccaaaagaaaaaaaaaagggattcatacatcaacactgggttttcctggttttaatagattaaaataacataatccaatctaactcatgcatcattttcagagacacagtgcaactggaaatatttttgccattgcagtggagacttctaaaaagcaaatgcctatggatatgcttgcatcttgaacataagaaggaaagaaatagggattacagtcctctaaggatggctgtgtttcacacactgtggaaaaataacaaacatggcctttaaaagtttcaatatgcatgtaacatagatttcacctccttcggtttgcttgctgacctcttagatgacttggttagaagcctgttttcatcgcttctttgttaactgttgttggtactttgtaggctatacgttttaaacttctgtaaagaacattacaagctatttcaggtaatttaattttgtgctgaatattcttcaaaggattttataaataatacaatattttaaatgagtcttcaattcaatggttgttataccatattgttgctttctccgactttatctacaaactgcaaggagaagaaaaacagatagttaaaagaaagcctagagcacttaaaaatatcacatcaacactttaaatgttgattaaaaaaacccagctttgtaagatttgtggaaatttaaggtatgaccgacaatgactaatccagtactactcaccatcttctgacacataaatgtatataaaaaatttttttctacaagtttttgcatgacatgttatacatatgactttaaaagtgcaacatgagaaatgcaacacaatgaattaaaaaaactggataaaatgaagttaacgcttctagcttaacaaaagaaaaattaaaaaaaaaaaagctgaaatgtcagccattcatgcattaatgaacccaataatattatttcaactgaccattattgtggatctcttctgggcctatgtagtctttgaacaaacagatttagctccattaagttcaataattaacaacagctattgactaaaaatactttaaatgtgtattctggacttcagactgaaagtggcaatgacattaaaaagagacttaatgatgcaacataaatcggtaattacagaacttaagttttaacacatagtaatgtaagtggttatttacttgattactccaccccaaatacaaagcaattgggctttcttcagcattccagatggtgatgcaaacagatgttaaaacaaagtaattagtgaagatattaagttacataacccaagtggctacaatactatcaaaatgtagcagtcatttacccctttttttttaatcactgttcatacttttacttaataataaaaaaataataatattaagaaatgcttatttattttaatgaagcaatagtagaaaacaaaatttatagcactgaatgttcatttatgcaaatactgaagaattcttaaattagggacatgattaataagtacaactctatataactagaagttttagtacattcaaaagacattctaagtataaacaacagtgactattgtatgagtttggggattaatgcaaatgaaatcaggatatacccctataagcctaggtcccaacattttatattattgcaaataagtgactggcactcatgaattcactagaattttatgacaaattcaggtggagagaaagcacattttctctctaaaggtaacttcaaatatctaggttatctgagctgtgagattctgactctaaaattgaaatgagatcaggcttacagtggtacctattccttggtgggaaagccatcctttagctctttgagaattcaatacatgctatggagtatctctagaagcatctatgcaaatctgcaaacatctggtaagaagttgatggcctgccctggagatacagatttgacaagactgttctaactgtggacagaactgggaacagaattttatcatctgactctcagtatcacaatgctttatttaattgtttcaacacactccatttggtgatacagtctaagagagaacatatttgtaagaaataatggtgttcttttatattattgcttctaaaattagagctcttataaaagttaattgaaaggtgctttgaactctcaaagagaaaggtaacatagcaatccaagtcacatgaaaaaaggaaaacaacattaaatgtggatacagtgaaaccaaatttcagattttataggtttagtaatgattatattgttattcactgtaaccacaatttatgtgatgcaactgtttatatcataataaaaacatatcaatcatgttatcaattcaaaaagagcatcagagaacaattatttatctttaaaatttttattttatttaaacaatttaaaaattgtagttgatttacaacattgtgttaatttctgctgtaaagccaagtgattcagttatacatatatatacgtatattcttttttatattcttttctgtaatgatttatcgcaggatgctgaatatagttctctgtgctatacagcaggatattgttgtttatccattctaaatataatagtttacatctgctaaccccaaactcccaaaccattctttctcccagagagcacttattttaatggttcaaaaaatatgttgctaaatataggattacttaccgatctaattccaggtaagttcaagagtgatccaaggactggcactcttctaataaagccaacaaccacaggaaagaagcccctgggagagggggaaaaggtcttagaacaaacagattctctatcaccaaaatcg

SEQ ID NO: 52976 - DNA, 650 bp, Bovine  19866880695650
cggcccgggcggggccggctctcccttgggccgccccggagcccgccttcccgggggcggagtgcgccctcccgacccgcgcggtcttccggcgcccgcggcctcctggatcccgcgcactcaccgagcggcggccggtcggagaggtccttcctccggctctggtcggaaaggaagcggcgcccctctgccaaggcgagacaagggctcagcgcccgcccggcccggccggtgggagtttccggaccaggagcgggcgagccggggcggcgaggcccgtgctcccacccggggcgcgcggggctgcaggccttcgggcccccaggtccccgggtccccagcgcggtagggggaagagaccaccgggaaagccgcgcgccttccccagcgcttcggaaggggcggcggtctcgctcaccagccagggcggtgtgcctgggaaaccccaatcttgctttgagcaagagccaactaccttccggttttggttagaggatttcttgttattcctccccaccccacccccacctccacccccgacctttctccttgattaactgagaccaggatgacctcaattatttatgggaacaacctcgatagtattctctctcctcaggtctccatctgtcccacggattcatgcgccc

SEQ ID NO: 52977 - DNA, 1869 bp, Bovine  19866880945269
aatgagcaagggctagtctctagttgcggtacatggatttctcactgcagtggcttctcttgctgcagaacatgggctcagtagttgtggtgcatgggctttgttgtcctgaagcctgtgaaatcttcttggaccagggatttaccccatgtcccctgcattggcagacagattcttaaccactggactccagggaagtgccccctaggacttgatccctccctcctttcttccagtatattagctttttgaaggtctttcctgaccaccttctcaaaaatagcatgtgccggccctctctgggcttccctgatagctcagatggtaaagaatctgcctacaatgcaggagaccctggttcaattcctggatccagaaggtcatctggagaagggataagctaaatactccagtattcttggggccctctgtatactcttaaccttacttatttctccttacagtggttatcattccttaatatagatcctcttgctcatttatttattgtcttcaagctccataaagtgtcaaagaatagttgttattctccactataaagaacatagaacagagcacccagtgactgaatgaataaaacatcccagatttgaaataaataggaaggacaaaagagaaaaatctagagatgtagaagacgtcttctccattaaaaaataatgaatttgcccatgaaaagtttgtaaatagatgtcacatactggaagctaacaaactttttacccaaagttttccaggagttactctttacagaaaggctttattagggtatcatttacaattagctagactttacaactgaggttacttaggtgcatctacacaaaagaccctttaatagatgcattttctaacattcagtttccaacatcagtacaaccaaatctaggttatacagtgctttaggccaggtctggcttggattaaacccatattttaaaaatccaggcattgatttatttcatgcctaaggccaatgtgattggaacatactccatgcttcataagtaaaatccaaagtagtgaaagattccaattccaagacagaaaagcattcaggaggtgaacaaatgcatctgtttttgccttattaagaaacacatattttaaaaaaaagcctaccagaaccctggccattttgaaagtatatagtttactgtcattctgaaatagcatttttgccattctaaatctgggtcgagatgacctgggagttgaccaagtaccatatctgtactttgctattgttcagtcactcagttgtgtccaactcttcgagaccccatggactgtagcccaccaggctcctctgtccatggaattttccaggcacgaatactggaatgggttgcaatttcctcctccaggggatcttcctgatgcagggattgaaaccacctcgcttgcatctcctgcattggcatgcagattctttaccactgtgccacttgggaagcttcttagttccctgaacagcaaacccatatttcctgcattggaggtgaaatcttaaccactggaccaccagggaagctccctccttcatttctatttcttccgagtttatgttttttagattcatgcttccaccctcccctaagtgatttcttttgtatttaaaattttttttctaccttgtctcctaaaagtgacatttctaatctagagctgtctgttggacacatttctaattaatcacagatatctgaaacttaatttgcctgtgaggaaattaccccgatgttaccagtgtatgtgtggtttttgcaagtttgggaagacctactggcatcccactccagtactcttgcctggaaaatcccatggatggaggagcctgatgggtta

SEQ ID NO: 52978 - DNA, 821 bp, Bovine  19866881028920
ttattactgtcaggaggacactgccttcctctgcctgatctgctctctcctatcaggattaacatttgagaacatggagaatatagtcaaaatctcgagctctagcatcctccggctgtatggtttaatctgggcttgtgtgcatgtgtgcatacatgctcagtcatgtcatcctctttgtgaccctatggactacagcccaccaggttcctggtttaggcacttgtaaactgtgtgaccttgaacaagttacttgcctgatctgagcttaacttttttccactttcttccccagggcaatggtgattttaaatgaggcactttacatagcctccatctgttggggcctagccttcagtgagtgctcaataatttagagacttggagctttagttgctgagatctgtcccagggaagcaaaaggacggaatctcttcagaatggctgcagaaaaagattatggtgggatggagggagtaaatgataggctaaggcatagctcattacagcttctcaaattattatagttgtgtatataagcaaattctttccagtctacttttagcctggtgctggtcacactgctaactttaacagcattgagtgtttatgtgagccaatgaaaatgaactgtataactcgggaaacagtagaagagatttagtgcactattgtaatgcacatactatgaactgttggcttttttctttctttgaattgtgttctcttccttgtgaaatacagaaggcaagtttctaggtaattagcaacaactttaacctctggattcaactccttacttgacagtagaatccacgtta

SEQ ID NO: 52979 - DNA, 1058 bp, Bovine  19866881071920
tcaattaaaaagagtttaaacaaataagaactctgaacaacaaggctcaggtgggcttccctagtgacaatattccatgtgttgcacacagatcccaggaaaataacaaggacaagattccatggggagaggacaacgggagctccatatttattaacagtacttttcctagactctgccttatgctgttcttctcttggttgattttaatctctgtgttttccctgtaataaaccataactgtgaggataaccaaaaagagagaggtcagaggcaaattaagaggaaaaaaaacgattcctagctggcttccttggtacgtattccagcagaggtcactagatacatttagaaaaccacacatctgctttgcaattttgcaatcttcttggaagtctttaggatttcaaaggcttgattagccctcacctgcatatccagaaggatcctattaacatatatatggagcacctactgtgtactactattgtaggagctgaaggtattttctataaacggtagacaagtccctgcctttgtgtgaatgctgctgctgctgctaagtcgctttagtcgtgtccgactctgtgcgaccccatggacggcagtccaccaaggctcccctgtccctgggattctccaggcaagaacattggagtgggttgccatttccttctccaaatgcataaaagtgaaaagtgaaagtgaagccactcagtcgtgtccaactcttagcaacctcaaggactgcaccctaccaggctcctccgtccatagcattttccaggcaagagtactggagtggggtgccattgccttctctggcctctgtgtgaatagatagacattaatcatgtaagccaaagtttccaaagaagaaaaaccacaatggtagagggtcccatttgttagaaatgggtgcttcagctgaagagggcaaggaagatgactctgaggaagtgttacatgaattgagacacaaataatgaaaagaggctacacctgaagatctgggagaagagagaataatgcttttaagtcacacagcaacagaacga

SEQ ID NO: 52980 - DNA, 1006 bp, Bovine  19866881217610
cttttggttagtcaaagaagggaagggaatccagaggaaatctctaagtgaattcattgagcagatagccatgctaatgctaaagtgagtggagcatagaaaaatgccacgggaaaatgatagtctttatttctacatgtaagggcttcccaggtggcacagtggtaaagaatctgcctgcaatgcaggagacctggatttgatccctgagttggtattcttgtctggtaaattccatggacagagaagcctggcaggctacagtccaaggggttccaaagagttgaacatgactgagtgacttatacacacacagacacacacacacatttctatgtaaggaatttcaggcaatggtgaaaaggtgggggaatttttggaaagaatggatgaatctgtgcagcttttaaatagataccaaatcacttaaaatatgtttgctttggattttttttttaatcactttccttggaaaacttttatttttgttttcttttctctttacatttacttatgtaaatccttggctcttctgtattttgttaatatgaataatttaaatacacctagggttgcattcttctttggtttgaggctaaaggtataaccattagaatcacagactactttgagaagaggatactgaggtagaaatcaattgatatgaaatgttttcttctttgataactttatgatagaaatgagtgagcaaaaagtgatggataaaatgccaaagaccagaggtggggcttctgtgaaacttatgaactgaataattaggccttgaatagccaagacttgagtatgcaagaaaatttgctaatgctcaatgtgttactagcatacaaatagttgttttaagaaactatggtagtttttaaatttttgaattcattaattttttaggtgtgtcaagcctgaagagaagtctcttggtgtgggattacatgcattttgtacacgagtattaggtaaaaataattacgtttcccaatatcacatcaga

SEQ ID NO: 52981 - DNA, 2978 bp, Bovine  19866881272699
actaaagggtgaagtgatctcagcagttgctaagaagtccacagcagtgaaatattttgtagctgtaaaacaataagagccttggaaatcagtctttgttaaatgagccaagtctgttctcaattcctgaaaggatggcagtaggatttcttcacattccttgcattacctcaagatgattatgccttgcttaaaaatcagaaaattaagagcatctctggcaaagtgggactgtgtctaagaacaaatcacagagctgtatattggctgtgtgtccccttgaccagtataacttctttctgacgaaaccaacagccataaagggtgtgtaggttattgcaagatataaaatacagtttgtgagtctttactgcttatctattttatatatagcactgtgtatcttttaatcccatactcctaatttatccctacccaccactgtttaccttttggtatctctaagcttgtttctatgtgagtctgtttccattttgtaaacgaattcatttgtgtatgatatttaaatttcccttataaatgatacctgtctgatttacttcacttagcatggtaatctctactgcatctatgttgtttcaaatgacagtatttcattctttttatgactgagtaatattccattgtatatgtatgccatgtctttatccattcattggctgatggacatttaggttgcttccgggtcttgggtattgtaaatagtgctgctatgaacactggggtgtgtgtatccttccaaattagagttttcatctttatcagacttatgcccaggagtgggattgctggatcctatgatagctctatttttagtgaaacaaagtaactttaaggctaagaaattggtgccttgcctagtgttagacctggaattagatctgggtcctcagtgtgttactaaatttctatttgattctaagcaaatctcttcttcccccagtcccatattcttaataatatacaaaataagatatattaaaaataatattaataatataaaataatattattataatataaaatattgatgtatataataataatatatcagcaaaaatgtttttggctctaagtagcagaaaatccaggtaagactgacttaaaacatgaagtcattacttttaatttaaaaaagaagattgtaagtggcttgtcccaattgattcagctgctcagtgaaacttcaaaaattttattgctattaatcattcattcattcaatgaatatttattgagcacctactataaatttattctaggagtcccctctgtgaatgcaaaaataaatctgatccatactgaaaaagaggattaagccataaacatatgggctttatgaacaggaagctaaattctagaaaacccttatagttgctaaatctgcatggtttatatttagattccttttaattgtgctaaaatttacaagcataacaactttccttattctgtggaccatgagcaagatcaaacttcatcctgaacttttctacaagcttcttttctgacctaggtgacggaccatgctgatgggagacatgtcattgtccagttccatgaatggcaagctgggattggactgatcctttctcgagctcggaaactgcccattgctacagtctttaccacccacgccacactgcttgggcggtatctttgtgcagctaacatcgatttctacaaccaccttgataaggtaattagctcttccaccctcgccacctttctttccgactcttgaagctgaaggatgggaagtattgatcttcacctttcatctgtcatccagatgccagaaatgcccttttgaccaatcaatattcatgacgcagcttcccctgaggggactgagagctcataaaatttaactttgttcagagtgcatcagagtgtagcggggacaggccagacatctgtccactttgaagtaacagaccccaagatccaaaggggcctggaagacatcagccactgtggccctgaggttgggctgcttgggaaatgctgtgaggaccccgggatcctcacgcagctttgagtggcaggtaccccacagggacgctaggcatctgcttgtactatgagcctcacttccttccatcctccaagtgaacgaaggtcagatttctgctgtaactctgcagtgagttataggtggagttttgtggggagtccagttaagacagttaccaaaaacaggaatatagatccctggtgatcaaacagctgggtttgcttatcttagaagactgccctattctatgacctaaagttttgacttctttcttccagttttcatcagtttagattaatgtaactatgtttttcatattatcctgtcagtagtagtggtcaagcgaccaatataacactgtaaagcaattatcctccaattaaaatcaaacaaattttaaaaataaataaggaaagaatgtaaaaaagttaaaataaaaaaaccatgattaagcatttgagtaacatacagtcaggagttttgcagacgtggtgtctatattgccagtcaagtcaatttagcattttagagttttgtgtcactatcgggaacattaggaagttgaaaaattgaccccccctcccgtttaaaaaaattctaggagtctatgcaatagactgcatacttttctgagtgtatttttgtgcctatttgtaatacatgattaatactactcagagaatgagagcagaaagttataccaccatctcagaggcattttgaatgcaggaaagttctttgggacaaaacttaacatttgcaaaacagtgagtggtcctaaggagagcttgcctataaaaaggtcagttgaacctgaaggtcaaattgtaaacataagatgtatattcaaaataaagtcaccaaggaattcagaaaggtcaagaggtcagggagatttcctaatagtagactaataagggcaaaccagtgatctgtgata

SEQ ID NO: 52982 - DNA, 1398 bp, Bovine  19866881549648
ttgtgtctctttgtgaccccgtggactgtagcctgccaggtttctctgtccaaggaatttttcaggcaagaatactggagtgggttgccatttccatttcctcctccaaggcacctttccaacccagagatcaaacctgcctctcttgcatctcctgtattaccaggcgaattctttacccctgagccatcagtaggcaattattgcgtatttgctgagttaaggtgggaaaaacccttacatcaaaagaactttatatcagagatgagaagaaatgaaaatctagctttatttttaaaaacatccagaagcaggagtattattccagaggaataacacacaccagcagcatctcagattagaagagtggtcctctaaagttgacctggaatgctaaagagaaatgtactactactgggactaaatttatccaatcaagagcgtgagagtccaaagggttgaagacggccaggtttcagaaataacgcaccctctgtgtgcagaagtctttaagcccggaggctagcagtgaccgcggccgcggccgccttagcggccagaaggtgacctcctcaattaggccgagggagggcgtgggcacacccgagcccttgtccttgaagaggattgagcgagccgaggggaggggtgggcggtgctcgggtttccaatcacaatagaggaagctcggaggcggccagggggcgggtcccgcctgctcttcctccctccttgcggatcctgcgccggaggagacgcacgctgctgactttgtcttcgtgcagcccttatcactctctggagaactttctctcccctggtaggtttctgctgggaccctgcatcctggctttgcggaaagacctggtgggacttgtgcagcaagactcagcgggggaaggaccaggaaggacatctgagctcgcgggcctggagccctgagcatccggatcgggttggggcgggggccctgtcccggggctgggggacccgacggagccaagggcctgcgcccgatctctgggctgtgtcggccgctcatcgcagctcccggccagcctgtgccctcccgggggacgagtttgttgcacttgcggctacatcccggttctacgtgtccttgatgggttcatggcggccgcatcacccttggtgcctgctggcgggcgcccggacacgtgccggaggagccgggggagggaaaggcggccaggcgacccgtgaagctggggggtggggtggttgttggcgctcaccaccttgggcctggagaaaggcccggcttttcggggatgagagtgaaggatgatcttggccctgcccttagcctctccccagcccttcctggagcgatgggccggctcgtttcggcctttttttccccttatgcttcggatg

SEQ ID NO: 52983 - DNA, 1035 bp, Bovine  19866881713904
ttgcctgggaaatctccatgtcagagaaagtctggtgggctacagtcaatggagttgcaaagtgtcagacatgacttattgactaaacaataacaaaggtatctatttactatgaaaaatgatttatctctttattatcaagaacaaagactagtatagagtctcgtaggaggcacttggcaaaggtttgttgaatgacaaagtttatctctgaataaatacagtcattcaaaccaaggaaaaataagcctttgtatcagttaaatcaatattttggtaaaaacagaatttttgagccttaatccctcaccgtatcagagatggtcatgtcattagctaactgaacatagaaaaatggaattgtggaaagaactttctaaatgcaagactgagttaatttttaagaaaggattaacatgtacttactacctttaaaatgacatttaaatacactagacactagaatatagataactttttgatcttcctggttatattttgttgacatgaaacatattagttaacttttctgttaacagcaatgatagaaagaaggtacaaaaaagagttctactcagtctaaaacctgcataaacatatttgccttctcatatggcctatgtaaactaaatagattacatgaaattattgtcttcatagatatcataattctatttcaaccactatctcaggatttcctaaagataaaacatgaaaatgtttgtaaaactgtcttgaacttgtaacagtgaataagtaaaggaataataactattaatgtcattcagatgtttgccttcgcttgagggtttttattcaatcataaagaataacactgaaaaatgctttaatattaactcagttggtattttaggaatgtttaatgtttctttgcctttatcttatttcagaaatgttgaacctgaactgaaatcacttgccatgggtttccattcactaactattcgaacgctaggtatgataaatatgtagatgataaattccagatataatttttcatgtcaaagactaaaa

SEQ ID NO: 52984 - DNA, 3494 bp, Bovine  19866880394260
tcaacagtacaaatggcacgcagagcataagtgagtttctctcctatcatctcccacccgtccaatcccccactcctccaccccaagaagtagccactgaaacctgttctaattgtgtacatgggagtcatctgttggaagaatcccaatggaatttctgggacaagaaaacccatgcattttaaatgtggaaaataccacccaaatgttttccccaaatgctgttactagtttgcacctggctagcagtatatgggatatctgtttatataggtatacaccaggtatacagccactgtatattatcacagaccaccctcaacctattttcaaagttttgacttctacccaatcaagcaaaaatcatttgtattttttttttctgttcatatgttttgggaacacatttcttattgatttatgagagctctttgtatagcaaaggaattaacttagcaagatagcatattatttttgcagcttcaaagcctttttgaaatgaaatgaatggatagatacatgcttagataagtaaaataaatagataatgaccacttaaaacacatactggggaaagcacaggctagtccttgagtcctagcaagaaatttttattttctcactcttctgtctccttccttcctcttcactttgaagtcatacattttggtgctttgttctctcccacacaagatgggggcttctgcggtggcttagtggtaaagaattcacctaatgcaggagacatgggtttgatccctgggtaggaaagatcccctatagaaggaaatggcaactcattccagtattcttgcctgggaaatcgcatggacaagagtcaggcggattacagcccatggggtcttgagttggacaggacttagcaactaaaccaccaccaccaggctagacagagctccgcattcagtaagtgaaaatgggattaatgaactctctatgggagaggcaacttcttcaacacgtgttttgcaatgtgtacgtttctgaacatttgtcaaatatccaggataaaatttacatttttattcatcaaaacccaggtacacagaccccatagtaagccaaacggtatgtttctaagtagtatgtgtattcagtcagtttctactttgccagcaagatcagcctcaatatgccagtaggagaaaggagaaaaatttctgaatgtgggcatgcaaatgccaaacacatctgcctgctgtcctggctccagttacatccaagtgtccgtgtggtcatggccaattcacctgaaagccactgtgcttccaacctcacattagtaagagaacaatgttcccagtccttccccagtttgaatttggagcagttttgttgttcctattgttgtgtaaataagaaagtctcttgctctgacttgcttttagaccacagctgttctgaggttagttctcccagccccagtttgcttttgtgccagttcagaaatcttcagacctcctctgttcttccaaaaatttaatcatctttggtgccttaaagtgaaacaactattttcagaagtgaaaaagaggacttttgcaatttttctgttatttttaactatctacacataagttatggctgtttaaaacaaactgaaacatctactactgcaaatacttgagcaaattatgaatggactattgtttttcagtcactcagttgtgtctgactctctgcaaccccgtggaatgcagcacgccaggcctcgctgtccttcactatctccagagtttgctcaaactcatgtccattgagtcagtgataccctccaaccgtcttatcctctgtcgtccccttctcctcctgccttcaatctttcccagcatcagggtcttttccagtgagtcagctgttcgcatcaggtggccaaagtatcggagcttcagcttcagcatcagtccttccaatgagtattcagggttgatttcctttaagactgactggatcaaacccaggtctcccatattgctggcaaattctttactgtctgagccaccagggaaaccaggaattgcctattaacagtattaaactccacacactgccttcaatgcaggaaatgcagaagacacaggtgacatgggttcaatccctgggttgggaagatccagtggagaaggaaatggcaacccactccagtattcttgcctgggaaatcctatggacagaggagcctggagggctacagtccacggggccccaaagagtcaaacatgacttaacgactaaacaacagcaatggcaaatcttgcccgaggaaaaaaaaatcagattggcattgtagaatagccatagctaaggttaaagggtcttgccaagtgcatcaagagggtttctgaccattttaatgaatgtaatagcctacctttttgtttctagatcagttagacattcttttagtagaattcaagatgtcaaatcacatttcaccctatccagacagagctcagtcaatgtgaagggaggattgtatgcatcctctggcccgtccttaagtggacacaggagtggataggtcccacttctgtcaggggcaacatctaggtggaacctggctacaaaatcaatgtgtcgtacttttcgtttaattttttattgactaaaaaaggtgaaattgcagtttccacttttaaatcttaaaaggacagcagaaaaccaatatagaagcatctaaattgcttcagacagctagtaaacaataaaagcaaaattactttttactctttgtgatcctgaaaaattggttaagtcattttttgcaatgttctctgtactttgaaaatcaaatacaatctttcatggaattttacatgtatatatacacacacatatatatttcataaaattaatttagaaaattgaattcacttcatgaaaccatatgaatatatattaaaataattgaatatatgcatatagtatatgtacatattcaaaggcaaactctcctatgtatacaactatctattggcaacagaaaaacagcaatttttttcccttaactaaactttaaaactagacttcacctgtcagaattttaaagacacatgtaataagtcacaaaaagccatgaatactggttggttttagaactaatttattaacactaggtcaaactgaaaaatgggttattgcaggtaagaaagatgtatctatcatcactaacactctgggcatggatcattagaattttaaagttaaaaggggtttcaggaatcatcctgaacaaccttttcctgatagtgaaacagtctatatttgaaaattccatgtttaaaaaaaaaagaacttaatgttcaacccttaagagcttacattcagaaagaagacctgggactgcagttaccacagccatggcgcaagggtcagagaacacatgacattgttctactggtgtccaaaggccccactttaacgtactcacacccaggcaagaccctcgagccacaaaagaagacccaagcaag

SEQ ID NO: 52985 - DNA, 757 bp, Bovine  19866880624641
gcagttagagatccggcctttacggagaggattttcctgataatataatgttatcgtgagtccccattcactgcaagtgaatcatctcaccaggaaactgggagcaaggcaacagtttaccttctatttaataaggaacaaagttcacctttactcaatacttcagctgactctttcacctgaatgttgaaaatacacacttttagaaggtttctcttcaaactgggcatttctatctgctttccttgtggtgcagtaagcactgccatggagacaggaggaccttcaaccctgttcagcccccaggtggacactgacctcactgtcctcagatgttagccctaaaaagtatggaaagaacatggtgcctggattctgcaacactcttctgagtggcccctttgacagtgctagagggagctggcagagcataacctttcagtgaatgcaggggaccaactgcacgtgactctgaaaattcatatttggaaggtggattccatcctggagatcttggaggggactcgtggcctctccacacttaggaagggcagtgctgggccagggtgtgtgatgacaaagattaatactatgacatggccatctccccaccatgtcactcatccttaaccatatgatttgagaactaaagcaaaatcacatttaaagttctcacccctgagaagccctcataagcattatccttgtttgatgattcagggtctgaggctcaggtgggctgagctattaagaaacg

SEQ ID NO: 52986 - DNA, 2293 bp, Bovine  19866880632625
ctttccatcagatcggtccctgccaggtctgagaccaccctctggtgcattctgaagacacctgccagtccaactggcgacgttgagtcgcaggtctgcacgcgtacacctgggggcgccactgagccaggtctatatcagcattcttttgggggaaaaacaaaaaccaaaaccgataggtgtcctcaccgcctgctcaggctataagtaatctgtatctccctcgcttgcccaaatctgtaaattttgcagacagcataataaaaatgacctgatgttttcattattgagaatgaaggggttttacgtgagatttttttgttgttgtttttctccaagcacagagcaaatcccgaaattagacacaaacattattcctattcagataagtggacccgggggactggaggctgcctaactgggagaagctactgagttggggggggtctctatatcactgtcttcaggagaaactctcactcatgagccccaggcaccaagcacatcataacagacgggggcagtcaaaagtccattttctaaacagaatgatgggtgagtctgaaggaagaaagcatttctagcagccttaatttcactggaagtaatgtgcatatggtatccttttgataagaaagctattcctgtcacttggacttcttttttcatggcctagaaaacatttagcaatgattatgaccttcatttttcttttttttttaacagctctttatgatttttctggactttcacttgcatatatgattttatctcctaaaacatacatgggctagtatgtgattgaaatgaaagtccccaaattaactgactaagcttttattatctctgaccctacacttaccattccttgactgtctttcagagggtgagctagtctactttaaacatctggacaccctcctttcagtcttcctgaaccatgggaagcataaccgtgtgatgtaaacaggcaactctgagctgttctgagccgtcaatcattagtaccttaagtttgtaaaacctttcctgatgcacctggttcagagaagttacccaagagctaaggcggggccctcttcttggggtcctcacgcatttttctgaaataaaaacaaacatcgccaactccatttaaactctatcctgctattaaactagaacaatgactgtatccatgctgtcatggccttctatttctcctccccagtttgaacaaatgttaccagctacaaggcttttggagttattaccagataataatttcaccagccctctgggtttagaaaacaatacttggggtaagcccgttctgatcacctgctaatccgagataattgcttgcgggtttcatggggaagctgagattcttaatgccagattcactgaatggctctaagggaaggggtttggggcctatttggcctctaccggcaaacctgaggtttgaacagaggttctatagcgaaattacctcttcctccagtaaagaccaaccatcaacttcctgtaaaattattgcattcactgagcaattctaagctactcttttataaattccccactttctcctgccctctcttttcagcttcctttccttttcttctttatttgttcctatagctgttgttttccaattgtttaacaggcatctggttaaaccctagacagtggctgttgaggatggctcgctgctgcttggaggatttgagtaggtttgagtggcaaagggcaccctgtcttggcttctctttcctgggaggaacatcaaaattgtgctggttctgggatttccctggtggtccagtggctaacactctatactcccagtgcaggggcctgggttcgatccctggtcagggaactagagctcacattctgcagccaagagttcatacgccacagctaaagaatacacatgccacagcgacgatggaagagcttaagtgccacgactaagacccggcacagccaaataaataaatattaaaaacaaaatcatgttggtcccaccaggactgctggcaaatccccaggtgctctgccagtttggtttgaattctctaaccagccacttggcagtcgattctaagtatttacattaaactcagacttcatagcctcaaaccaagaatactggaggccaggacctgatgacctggtgcccggagactgtgttttcaggaatagagcagggggggctggaagttgaaagtgtgggactcacatggagaagtgaatctcctaggatcacgtgctctttgtgaaagtgcaaacccagctgttctccagg

SEQ ID NO: 52987 - DNA, 1190 bp, Bovine  19866880677278
gtgacattgtggacagtgtttatctttctaggaggcctccagctgatgttgtaaccagggcagagttgaagcgacagaaagtcctcttgacggaggcttgggttgagcatccacccgatgtcactcttcagagaagcccgtctgcccttccaaaggctctccatcatcttgacagcattcttggtcagcaggtattattatgataataccttgagtttatttagcgcccagcaccctttcaggcgaggtcaaagccagttgggcagtcagtcaacaaaagtgattgaagtctcttggtgtttagagctgtgtattaaatcactgtcaagcccccaccagccccatcctcaccacacaccaaatgtacctcggggcctgccggcctgaacccacatggccgcctgcccccccaggcttcaccccatctcattctcacttatcggcttttattgactcacgtttacttagcgtttgtacagacctctctacatacacacttggagatttctcccctgcacattctctctgtgtctgacaagccacaaatatcctctctagctgcctaagctgcccacgtagttaaaagcaggaagcacagaatgcccagaaacgaaaaagagcaaactggcaaagaagttaacttgctgttttaagccaagaaaaggagaaggctgctttctgagagcccgtctgtccacccgtgagtggacggtggactttggcccacatgctctatctttcactgcttctttcatgggataacaggaaagggccggtctgtgggggaaggaatgcaggttgtgagacttttcaaatgacacaggaaatacaattgccccaaaatgagacaattgagctgggcaaaaaaaaaaaaaagaaattgtcaccagtcatacatagtcaaaggacatctgtttccatttttacgaacttctactccatccattcttcctccatgtgtgtttcctatgtttttaattattttttattggagatagttgctttataattctgtgttagcttctactctacagcaaagtgaatcagctgtacatatacatatatttcctcctttttggatttccttcccatttaggtcactgcatagcactgagtagagtaccctgagcaatacataggttctcatttgttacctgttatgtataatatcaatagtgtgcattttttgg

SEQ ID NO: 52988 - DNA, 1968 bp, Bovine  19866880779627
ttaattaaaaggagagaatcccagctgagcctgactttatcaggggagctctcagtactggggacagagggctgtcccttgctggtttggggaagtaagctgccaaagtgtgcctaccgatgaagaggcccatgtgccaagggcttgtggttcctggtacaggtttggactaagctggggggtgggggggatgttggaccagagtgggtggggtgagtgggagacttcagggaggcctctttctgaagtggctgtcaccttcccggccaccccagaagtcaactggccaggctggggcctgcctgggtttgggaagaccagcggtgtattagaagacctgacccacctgaggtggctcctcaggtctgttttttctaggcaagtgggccccaccacatccatttcctggtcaattcttggtagctctatagcatatatatccataccctttccagtggtcatacatttggggatgttcgtacgtgccttaggctctgttgagggtcttgaggctcaggcctgggctaattaattcaactttatgcccagacacaggtatcagttcaggggtgagctctgaatccatgagaccctcgggagacacgtgctgggagcaactggaaaaagaactgctttgctcttctgagacgcgatccccgccttccctccaggatgcgagggaagaatgatcatcgtgagagtctccaggagctgttggcagccctgcatgaagctgcccactcagcgtaagataaggaaagcaggatgaacccagggtcttgctgttcttgttgtacccctgaaccacacaaaccagaagcttgtctctctctggacctcaagggatgttatctctgcagtccattctggtatgagccagagggcttctgcttggggatggctttttccagtcaaggtttagttaggtctcctaaacttctagcaaagtagaaccttattggcagaaaaaatggccctttgctgtgtttgtaccattcaaagacctcactgcccagtggacctcgccaatgctggtaaatttccctcaaactattgttaaataaaaaccatcatttccaatttgcaaaatatctctaaaagccttggaggcttacaccaaagtagcatttttctcttaaatatatctacaccaggattccaaaaattatcaagattactattaaaaagaaaaattcctgaaactttggggactgggttttgcatttgcaaaatgatttgcaaccagacctgtcaggtagcacttcatggaaatcaagaagttaggttttgaatatctaggtaattttcttctcaacatccaaatccatagtaaaatcaactttctagctgtctagactcagtggggctagataatcaggttagcgctccatcaggtgctgagtaattgtgataaaagtaggcagagctgggggcttccctggtggctcggtggtaaagaacccacttgccactgcaggagacacaggtttgatccctgatccaggaagatcccacatgctgaggagaaactaaggccacgtgccataactatcgagcctgtgcttgagagccaggagcctcagctgcggagcccatgagccacaacgtctgaagcccttgtgctttagaacctgtgctccacaacaagagaagccattgcaacgggaatcctgcacaccacaactggggagtagcccctgctctccaaaactagagaaaagcctgcatggccatgaagacccagcacagccaaaaatacatacatacataaaattatttttttaaaaaaagtagatgtagctgggaaagcagtcctattgaattaacttaattctttaaatccatcatttttttttttttttgccccagaaactcctcaatttcggttgttctgtcctgcggccaccttctgtagttggcaaacctggcccctccaccctaaataactctgaacctgtggcattggat

SEQ ID NO: 52989 - DNA, 942 bp, Bovine  19866880790909
aggaggttctgtcagggctgtgcttttcttttaatctaaattgctgtttctttttctctgatatggccatcggtcataaagagttgaccatcattaaaactgtttgatttggaaccctgtagtgtttggctaagagggtaaatgcaaatttgatgaaagaataaggataaatttacatatcagcctcagctcacatggagagagtaaacattctgtttatctcaagtgtcgctttatgatttcaggagaatataaaactgaccttggcccagtcattgcaaaaggcccagatgaaatatgaggttgtctaaatacgatttactcgagtagaacttgtgggcaaaccctgcggaactcagcaaacaaggccagagagaacagaactgaaagcattttgttctgataaattccaaatggaattctggaatgaggggttggtgaataaaaaagcataaaaaattaaaaaacaaacaaacaaccacttcatgaatctttgtcaatcaccatgaattaaaacctcctttttagccggtagttttcatcttcattcatctaaaaatgaaaaagcataaatgcttaaaagctggcattagccctttaaggtagagtgagctttcatcaaacctttgtttgatcatttggagataagagtaagaccatcgtctgtttggtttctagaaaatataattttttcgaggaactttcagcactccatagccagtttataatgcaggaagatgcctccttctgaaagctgtctggggcaacacgcttgcattttctacacttttaattagttttattctgaagctaagtcaacattcatcagtgtgtgaaggaacatccaacttttgctccaaacgaaggcttttgagtgtgcagaaaaatactcagatgtttgcaggcaacggattttccctccactttctcacacccatacgt

SEQ ID NO: 52990 - DNA, 1247 bp, Bovine  19866881031331
aaaagccacccacatgctccgatctctagcttgaacccacccagattcccaaggtgcctttccagaaggttgtcttcatgccctggcagaaactaggtgtcaggcaggggagccagtattcagatgtctgtggcttcctttcactgcaaaaatagatttacaaaataatccagtctttggtcaggtctcttccaagacggggagacctgacagcccccgtgtgttgggtgttccagctgccctgagcccacatttctgtgagctcatgggttgcttcaaagctgttgaacgcagttgaaacagaatattaatacatgtgaactgagtctatgcggtttattctcttaataacgtctccaggtttacagggagggtcctgttaagtgattttctttagctttaaagaactagaaagtagagagaaagtgtttgggctcttttaaccttcaaacatgaccacactgaggacagagattgcccaagaaatgccagtctctttcctgagacttctgaagggtcgtcgtcacaagtcctttcttacgctcatcaaggtctcaaaatgcgttttcattgtgcctgatgcatagtgtttctctgatcacaattccggtcttactaagcaaagtatggggcaatttagaggggaagagggacctttttaaaccttaatggggcaattgccaagatcatgactccttgtgggtgttggacacactgccctttagtaaatcttaaatgaccacacttctctcttctttccctccatccctaagggtttcattcctaatgtctgacctttattctggactcaggattctggattctttaagtagattcaacctgggaagagtttgtaaagattcagatctctgcagtgtaaaaagcccagataaaatttttatttattaaattggacaaagttttacacttgttagtgtgcagcactggccaaagtgtagctgaaaatgctaattcttaggttggctgtgagagtaaaatggctgcaacctctaaggatggattggtggcactatctaccctacgatttgtcttttagttgtttatcctccagcactgaaagtgagcagaggtttatagattgcatttgtgttgatagcaaaacaacttctatgctaatcaacaggggctccaacgcatatagacacacaaaggaatattatgcaactgtgtaaaagaaaaagctgattgaactgtggtatcattaagaccatttctaagacagggct

SEQ ID NO: 52991 - DNA, 2589 bp, Bovine  19866881103924
gtagaattttagttttggtactagtgtgtgtgtgtgtgattggtctacaatatgtccaagattgtaactctcaaagaataaggctaaataaaccatttattgttgttgtttagtccctaagacatgtccaactcttttgcaaccccatggactgtaacctgccaggctcctctgtccactggattctccaggcaagaatactggagtgggttgccatttccttctccaaaaatcttcctgacccagggatcaaacctgcttatcctgcattgcaggcagattcttacccatcttaattgtggaacattaagaaactgttaaaagaatgatataaatctctctaaaattatataaaaagtgtatctactttatgatgaaaggttaaatactcattcgactggggtaattttatttaatttttgtaaagataattctgactctatgcacagaaaaggtttgaaagttgcacacaaggctgttaacaattacacccccagaagttaggacttggaaggcttgtgagaagacttgccatttttactttatattttcctctattttaaaacaattatttcttctctttttgccattaaataatgttaagtaaacaaacattgaaaagtgcagtctttgccactgggtagatgacaggctgcacagggtatttcttgctcctatgatcaaacatatatttttctgcctcttggtttggagaaaatgagtgagtctgctgaagacatttttgcaagaaaaggatcaaactgggaacacccatggcccaggagtgttaggtaagaaaaataagctgataagactgaagaaatctgttctaacttaaaaaataaaaagcgaatgtcccagggcagatcttaaagaactgggcagtgcttaaactgctgtgggtcttaatcgctgatggttcttaggaaaggaaaggattgaaatggagttctctgcggttcagcttaattaatatttatggctacagaagaaaattaaataaggcaaatggtgtaattttaaacagtctggtgctggtagcaggactcacaataaattcagaagcaggaagagagtgctgaggaatggttcctgagttcaagcttcttcccctcccccgcctcccaggcaacctttttttttttttttggtactgcagcatacttcagtactgacatctctgaacactactgcctggttcacttctgttttctgtatgtttttgtctttgtgactgattatctgcaggaagattttctttcatggggcatgctgatgggaaggattatgtcctaggatgttagctctggcaccatctctaatggccccactgagtgtttctggggcatgtacctgccacttactgattctttccatggtttgatgagttgagcttttctatcttgggggtggagagctgatgagatagcacagtttccctatcatggggaatcctgaccttagatctgcttctgcacactgacaaacatttattggatggatggatggaaggatagttggatgaatggatggaaggaggggtggatggaagaacagaagacagttgttatgcaactctaatggaaaaactcatagtttacccatgaggactggcattggagggataaaatcagattaggacaagttgtgggcaaatgcttttcaaacttcaattgatggctcatcagtgtgttggggcggtaatctacttcactgaaatgatcattaaaggaagggagtagaatagaatctctctgtgcgtcgcacatagaaaaggcatgtgtagtcctgaaaaacttatttttgttataaacgtgtgtgtatctgtagcaggatggaaaattcattctctactgggttaagtgttagtcatgtccaatgctttgctaccctatggggtgtagcctgccagcctcccctgtccttggaattccccaggcaagaacactggcgtgggttgccattcccttctccagaggatcttgacccaaaaatcaaacctgggtctccctcactgcagactgactctttaccttctgagccaccacttcaaaaaacctgaaagaccaggtccactgggagctcagggcttcttagcaaaagagcttcagatttcccatctggagtagagataacagcaaaagccacagaatgggtgaggatgaaatgaattgaggatttgatgggtacctggtattttgagaacatctgatcactcttactccccactcccccaccacccccctctcccagcattgcgcaccagggggagttccaaccctgcccagagagacgtgtcatgccgcatcttacagtttgtcccctcaaatctaaccaaatcagccttcttaaaagatagttaaacctgctcaaaatgatgccacatatttgataagatcattttcatttctctggatgaggtcagagctgtgctgagccctgggtcaaggaccactccagaatgatcaaaagtgttctacccacttgcaactcttagcaagagctagaccttggtttcaattccatggctttctcttccttggaaggttaaattcagcgctgacagtaagtccagcaataagtcctgtc

SEQ ID NO: 52992 - DNA, 1094 bp, Bovine  19866881136489
ctgagggtcaacttactctatgtcaactataacaggcccctgaggaactccttgttaaaatggtggaaaaggaggtgaaatcaaaaattacatggcactcttaaccaacagcatctaatatgtcaagacatacagtggctggaacatgggggtgggttcctagctttagaaagacacagctttcccctacctctgtttataagtcctgcttagggcagaccaaacacaactacttaactgaaagacacttctttcaagccttcaagaatcttattaaagagattcatagtatttcctggatacgaaaatgaaataattctttcaaaatagcattttgatgagttgagtgtaaatgaattagaaacacacggattaaatttcccttgaaatacacatgggcttcaaaattaagggaaattaacttctctgaatgtgttttcaattttgcctgacctcagaagtttgatgcatggtttgatacggttggcctgatgccagctttgcctatccttaccatggattttgcctgagaaaatgttctatttccagctccctagggccttctgagggtcttccctagtggctcagatggtaaagaatttgccggcagtgctggcaacccaggttcggtccctgggttaggaagacccctggagaaaggaagggccttctgatggtttacagtattactaatcttatctgtaggatctagcccattttaataaatattatcctagtgaaaaactgcagttttagaatggtgaccaagcttagccaatcaccctctgatttaatccagctttggttggtaaagaatcccaaggcaaccgatcagtgattttatgaaatctctgaaaatgttttgagatatttgatctttgagaacaagtgattctcactctctctctctctttttaaaaaaatagataagaggaattctttttttaaaaaatgtatttgtttttggttgcttcgttgctgtgtgtggctttctctaggtacagagaaccggggatactctctaatggtgcacaggctgcttctcattgcagtggcttttcttgttgtggtacacaggttcattgcccgcagca

SEQ ID NO: 52993 - DNA, 3923 bp, Bovine  19866881163655
cttcctggtttgcagatgactgtcttctcctcctataggaaacaggaaggaagctctctcctgtccgtatatggacactaattcagtccatgagggctccaccctcatgacctaattacctcacaaagaccccactttcaaatactatcatactggggataagatttcaatacatgaatttgggattgagaacacaaatattcaatccctctcaggggcctataggcagttggcatttccagtccttctatatcccaaattcttgactgactctattccctaccctttctcttgcaaacttgctaattcatgctgtggtggtctctttcttgtataaccttgctgaatgaagccatttatagacacacactactaacattctgttttccaacaacatttgaaaatttgaatgagagggataaatttccaagaaaaacataatttataataagttgttcacagaaagaagcaaataacttgagtgaacaaataacaggataaaataatagttttgaaataaaaacattagaaacatagcattagggtcaggtaggttttgtccaaatgcattaaaagccataagaagcaattactctaatactgtatatatacttacagagcagaaaggaaaaggaaactttaagtgtttttttttaaataagctattagaaccttgattttaaaacatgacaaagagaagatgcagatacagaccagcctcacatttgaataggatgtacaataaaaaattggcaaaaatatattttaaatatagatgtaaatattctaaaatattagcaaagaatcctacaatatgacaaaagaataaaactgcgtccccacaggaagtatttatagttctgtgaccatttttctgaatattcattggaaggactgatgccgaaactgaaactccaatactttggccacttgatgtgaagaagtgacatttgaaaagaccctgatgctgggaaagattgaaggcaggaggagaaggggacaccagaggatgagatgattggatggcatcactgactcaaaggacatgagtttgagcaagctctgggagttggtgaaggacagggaagcctggtgtgctgcagtccatggggtcacaaagagttggacacgacggagtgactgaactgaactaaactgattacacactgatgaaatttgagtgaattaagaaagagagcattgtatctataagcactcaactgaatgctttgaatagactgaattaaaacaagttattaaaatgccttcaatttagttgtgcctgaaataattaatgctgaggtggagtatgcatcacacaaaatataaaatgatcctgcacccatatctctttcagttcttgctctgctttagagaaatccaaaccagaaattggaaaatatatattttggggtatagtctttgcaagaaaggcaaaatggaattccaagcaactaccacacccacaaagcaaaggcttgatcctatatcaaaagacagataaatgggtatgtggtctgatgctttaagttaaatgaaaatattagaggtatgtatgtatcatttttatgtccaccacccaaaatcaaatacctgaattaactaactactactcttaactctatgaaataaggtgtttttctcctgtagaaagataactggatctttatgaaattcagcaactctgatcactcccctagacacagtacattacttcttttttgtttggggttatcattggcatattgtaggggcttgcctcgtggctcagacagtagagaatcttcctgcaatacaggagactgggttcaatccctggttcagaaagatcccctggagaagggaatggcaaaccactctagaattcttgtctggaaaatcccatgaacagaggatcctggtagactacagtccatggagttgcaaagagtaagacacaactgagcaactaacactttcacactttggcatattatacttttgggaaaacacaatctgaaaaaaaaatcttgcagatgggttatgttctaggttataaaggttctccagggaaacagaggatataggatggtcctacaaaagttgcatctttccatccactccaacccttacatttggagaatatacttacctggagtttaaccactgcagctatgaaacgatgctcaaaagtaaaaggaagtgcaggcctttctcctcacagtcccatgagcccagaaacacatggtcctattctggccatacttctaacacctaagatgaagcacatgaagcaccaccaactactttcagctgttccccagtgatgaaaagtttcagacatatggtcccagagattaatatctgtgcagcccagaagtcactgggaacatgtggcctgagacaaacataaattctgagcctggtgttttcctctgtggacctctccctccacacctggactcttggaatgagtcaccggtagtctctgagagtgaggaccaagaagcagggattagcacgtgttgaaattctgagccaccagtcatagactcctggaggggctgttcatcttggtgaaccccaaataaagtgggcttcaggggagggctgttctttcgagggatcttcccaaagcaaagagtctccctgggcagtttgggggcctgtgttctagggatagtctcatgaaataggtgataaaaaaactttttttctagattcttccactctcaggagaggatacattatgggctgcaatcctgcatctcctccagctatttcactatctctcaaacaacattgtcccagctttctgtgacattagcctaaagatgttccttgagaaaaagaggggaaaagctagtacatagcgtgccgagaattttcatggctgcctctaccaagagttttgaaaagattcacagactcacggctccaaaaacactattcttaaatggtttcagttatggttaagaaaactgctttgtattttttagaagcacaagccagaaatgataagtcaaaggtggcatttccaggttaggcttgaaagttggatatttattaccttgagtggaaaattttttctacctggagaaaggacatatggccttcaggcagctcatgaagacagagagagagacacacacacactagaaaattggtttaaatcaagggtaaaattatcttataacaaaagattcatatttgtgctggtttaaaaaatactttaaacaacttcaggtaagtttttgcaagactgctaagctgctaagtcactttagtcgtgtccgactctgcgcgaccccatagacggcagcccaccaggctcccctgtccctgggattctccaggcaagaacactggagtgggttgccatttccttctccaatgcatgaaagtgaaaagtgaaagtgaagtcgctcagtcgtgtcagactcctagctcccagtcttccttaaaaggaacaaagtgcaagcgaagaagtcttttctttttcgctgacattttcttccaacaaatgacgggttgctcagaacacactttgctacccaccttgcaatgacacaagaactgggaggccatcagagccccaaccagtaaatgttagataaagttcttccgtttccttagaaaagaattgtaacataagctactccaaactctaaaagatccaccaatattaataaactcaggccaatggtctatctcatcattcaccaaattcctatgtccagggtacgaaaaatcttgccctgttctcagacaaagacaactaacctgaactttgtgctcagtaaatcggcttttaggtaacacatttgaataaatcatctgggtctccgtcatcttgttttaagaaaaatattgaattattggcaaatccttaagaagcaactctggctagaacccaggaacgacacaagtctacagagagcagt

SEQ ID NO: 52994 - DNA, 1286 bp, Bovine  19866881166572
gagcggctgtcagggagaacgtcacagaaaatattttccttcagggattaatagcaggttaataaataaccgatcagacccagttgaaatgcctttgggtaagagtggttgatctgcatacaaacatgggtctcttcttattgctttagctttatttttttttaatgtttcaaaagagcaaggaaaatgttcgtgaatttctcagacatcaaatagctctcaaaaatgtcaacaacatcagtgtaaaactaataaaaatatggcacagatttagcacttgtactgaaaggaaatataaaaacagggaaagagaagcatatggaaaagcatgtttggggcttgaacagatcaacctcacatattaaaacaaacagaaaccagagcatttctggtgggaatgttgaaaacggatgacttactggagaaacaaatgatgatgtccccacaccgccttgcttttcctccaacaacagtgaggttgaaaatggacttcaacttcaagccagtacttttggcagtctgagcaggggagggtttcagaccttaatttctttcccagccttcaatgtgggggaaagtcggctttggcgccgagacatgctgtcagtgcaggcccatccgagagggatggacatgcgctcaggagagatgtctggaagatcttgaggtgatattggctgcctctgaagctcaatttctgcatctagaatgtagagccaataaacccttgttcccaggtttcttgtgagaattaagcattgtaacacatggaaagcgcctgcacacaggcgacacgtagaccagcgtgtccaatacaaatttctgcaatgctagaaatatgccatgttctggattgttcagtagaacagcttccagctctgcatactcctggggcacttgaaatgtgactactgctaccaaggatacacagtttaaattttatttaattttaaataatttaaagagccacacatggctagtagttatcctattggatggctcaggtctggaccatgtggctaatgttgataataatgatgatcgtatgggttttgtatcctcaaattggagcctcaggtttcgtgctcaggggggctgttggcatatctaaagctcataggtggagttggaggctaaatttttccatgacaagttaagtcctggtgaggtctctgtgcatgtggctacccgtgatcaggttagctgagtatagctgttcttgagttctgtcttctcccaaccagtcaagaagaaggccaagagaagcaggtattctatgtacaaga

SEQ ID NO: 52995 - DNA, 966 bp, Bovine  19866881206202
atgtgccagcaagtcttttgcaggaaggtatttgctttgaatgggccacatttcccctgtttgtgtgccctgtgattttttgctgaaaacactattttgttaaccctggaaataaattctctcccttctccagggggtgccatttcttgttactttttttttttttaaactagtaggctatctctgtgccaaggatcaggctgaggtgtaaactaaagttctcaggtctttctgagcctgctcctttccctgaacatgtggttactttttaattttccttgtatatacagttgtttttgaatgtttttaatgtctgactcccatcatgggaaaaagaaaaaacattaagcgggtagaaaaaatgcactaacctttgaaatcaccaggaagtcaatttagccaactgaccaatttaggaggaggagtctgtcacaacgcggaggtgcagaaacaatggccaccctcctcttcacaactctgggataagagcagatcccagaggtacggaagacagggtcctttttatccactctggctctacaagctgtgtgcaaggcactcaagaacaagtgcacagctgccccacagccctgcgggtgggagatgggtagttgcaagtgtgctgagagttgaagttgaccaaaactgactgcaatttacaattcaagccttcccctagaatttgcaattcttcagtagactccagagtcccaaaatagttacattggacaaattctgctaatgcagttgtctaaggtgtaaagacagattcctagttgccaaattccccaaattccctggttgccagatttctacattgccaaattccccgaaaattatttatccttgtatattgatcttgtcaccaattgtattccttgagcttttgaagtacaatcagagcatcacaaataatcccctatttcttcctttaaaatgtttgtatctctcattactttatctgga

SEQ ID NO: 52996 - DNA, 2535 bp, Bovine  19866881220057
gtgacccatggctgcccagtggacagtcttgctttattaaaaacatagttctggggattaagtgaagcaacagtgctccatccatgccaccctgtggtgatatcctgggttcatcagtcaggtctctgtgctgctgctaagtcgcttcagtcatgtccgactctgtgcgacctcatagacggcagcccaccagacttccctgcccctgggattctccaggcaagaacactggagtgggttgccatttcctcctccaaataatgacctgctaatacccaaagctctgaaatgtaagtgttgagcagtctcgaggatcgtccacacccaagagcagtggggtataaagccttctcctaagagcagtctactcagaggccttagcaagacgttggagcccacgggctgggttgttccatccaggttccctctgcagggcggggctgcgtctcagatctgagtctttggagaggctcctctttgcccgggtcggacagtcagctctggagtaccccttttctgaggacgacgacgagaaacacatctgccagttgggtggtgatctggagcagatggacctggcatccgcggcagggtctggcgcggctcctgggcgttgcaggcgatccgggttccccagagtgagtgcacctccctccaggcgctcagctcctgctgcccagagccgaggctctgcgtggttcgccactgcctggtcctgcccgtgctccagctgcaggatgcacacgaaggtgtccatggagaaggccacctgcacctcaccacagctgcactgggaggccgctttgccataatcaatccagcgtggggtggcaaaattgatggtgtctgtatccaatgctaatttaaaattggctcttgaacagaaatgtgttgatttcagtgtggctgtgaccagccgtccccactgacagcaatgactttcctggctggctctcttccagccccgtgattgacttggtcagttgaaaacaaaattcaaatggcagccactaaatggtatgaaatatcttaattttaacctaaacagagggcaacaacagcctccaaagctacagaagccagggctcagcggatgatccaaaagacaagaagaaaagtcagtttaaagaaaacaatcagtggctgaaagctattaagttcactcttctagttcaaagagattcgaaatggcaatttgtcaggcaactgttgtcactttagacgcccctggttgtttgctttgaagcccttgattgactgcaggagcctgggccagattcttctaaggacaggatttccacagttgaacacatttatgtcacagtaattatgactcttcccaaatttaatcaacaaaggcataagagtgcaagtttgagaaattatgcatgtgttcagcagggtccagggaatagcctgggtgaacgtggataagtccagacagccagctggatggttttggtcacctagttgtatcaatcccaggctggagaaggttgtctgttggtgagacaacaatgaaacagacttcaacttgagaaggatcatttctacgaatgagcaactaacagagagtaatcaagtgtgctaacactgtattatctctctagccagccaagctggggtctagaaggatctcttttgctagtcatttctgaaaatagatgcaaaggtgagtgcacccctgggaagcaatgacaggcttccatagagatatgagtacaggaaaaccagcgtggaagagctgtacgtgcgtctatgctcttgactcacacttgcctctgaaatcgaacagaatggagagagtatggagaagccttctgaagcattttgacatcaagaaaattatttgcaaagttatttgctattttcaaggctgtcaataacctcctcagcaatggaagtgtgtccgtgggtgtttgcagaggaggtgtgaggggtgaaatttgtcaggcaggggtccaacctacgtgtccacaaggaaggtcaaatcagaggtttgagactgaaagaaacatggctatcttcacagaccagccccgtttccaaactcttacataccccctgacctaggcaacagcagtgtcccaggtagaaacatggagggtgatacagattaaagatgggagctgaggggccctgtggagagcgccaatgaggtagacccttgcccagcagctgtgtgccagatgtccccacaatgcagccttggggacacatccatggcaagtaactccagcagagaaaaaaaaaagtgatttctgcatacggctcgtggggccaggggcaggagtgaggtcggaaaagcaagtcaacaaaggcgggaaggacagatgggaaaaaggtgaagccaggaaagatctggaaagctgggaagggagcttgtcacagtcgtgtacccccaagtacaggaagccaggcgacaacatgtgtggagcaaaagctcatatccatacctggcaggaggttccaaggtcaaagccccaggactcttggcattcagtccacaatgtactgtgcagaccgcacaaggag

SEQ ID NO: 52997 - DNA, 725 bp, Bovine  19866881332050
ccaataatttgatgaggacacaggttttaatcaagcctcttccactaaaatagcaatttaaatccccatcgtttaaactggataaaaatgcttaagctgtgaatattggggtgaaaaataaaaatttactagaaaagaaacaagaaacacaatatctctggggaaactatgatttgacacaacagagggatatccatgctgatttaaacatcaggttggtttcaaggccagattctgggaatctgaaggtatttgtcttgcattcttgttgggaaatgaaggtttacaggtagtattgacctcagaataaaagcgaccttggaatgagaaaagagagcctctaagctgatccagaggaaatttttattttacttattaaaagaagaaatattcctcccccaactcaacagatttctatctgaagtggaaacttcaaaattgactggaggtgctgggagggggtaggccagttagggagctgggagcgccatcctgagggctggtgttccctttgtaacagataagacaatcaccccagccttgtgttcgggggaggcagtgttgctgttttatttcccttcctgaaatcactggggaaaggggtggggatgggggggtcaggcaggcggtcaggttaattaaaatgccagcccaaggtccaaggcttggaaagcctgtatatgagaaacagaacaaaataaaacaactcattctgtaattgcttg

SEQ ID NO: 52998 - DNA, 703 bp, Bovine  19866881460278
atgtaagccataacatgcagtttccccagcagtaattgagttttagtaacctctgatactggatatacggacaaagatctgcttccatcacctcctgcacttaatctgccttatgatcagttactccggaagacttctttaatgctaacgggttgcccttttccttctgatgggaagtcccattataatcttctccccaacaccaaggctcctcagcagcccttatcacctggcaagttgttagggaagcagattcctgggttcccttccagtactaggaaaatcagaattcctggggattctgtccaggcatctgtattctagccagctccccaggtgaccctgatgtttgctaaattttgaaatgatactttatgctaaggagatattttttccacatgtggaaagacatgtcccctccatgtggagggctccttgcagtttgacacaagcttcccaagcaatcaggagctaagatacggccatattggaattcccaggctggattaatatggatggaataaaaatgcagaaatggtatcaggaataatgaaaagcatacagcttaaaataatcactggaatacttgggattcttaatagaaattatagggggaaaagaacgtttgaaaaactaacttaccaggaaaagaatattaaattcggagaaacattgcagagaactagatttttcgagatgccaa

SEQ ID NO: 52999 - DNA, 1432 bp, Bovine  19866881500618
tgcactcctgtcttatagcaagaaattcagagtactgtattacgctaacataaacatatgtaaaatctacctcaattttcaaaatttgaaagccagcaattccaatcttggctaggtatctggaaaaaaaaaacaaacaaacactaattcaaaaagatatatacaccccagtgttcacagcagcattatttataattgttagagtatggaagcaacctagggcttccctggctgctcagcctgtaaagaatctacctgcaatgcaggagatccagcttcaattcctgggtgggaaagagcccctggagcaggaaatggtcacccactctagtattcttgcctggagaatcctgatggacagaggaccatggcgggctagagttcaagggattgcaaagaatcaggcacaactgagcaactaacataacacacggaagcaacctaagtgtccatcaacagatgaacagataaagaaactgtggtacatatgtatggagcggaatactacctagccataaattggatgaaatattgccatttgaagcagcatgggtgaacttatgctaagtgaaataagccagagaaagacaaatactgtatgatatcgcttatctgtggaatctaaaaaatacaacaaactggtgaataaaacaaaaaagaagcagactcaggatctggagaacaaactagtggttactaatggggacagggaaggagggcagggcaatataggagtaggggatgaaaaaaaagtttattataggattatatgaaatcacgtgtgtgagattttgacaattgtaaagtactatgggatttaatatttcattccaaaaagtttttagaattaaaaaataataacaaagtaatacagaagaaaggaagcaggcttgaaagacactttgcacttgtcaggacttttgggaactgtctcctgggggctccccagaagcagaaaatctctgtttttccacagttagacaccgagagtccccaggaacaatagagctgaccaatgactcagtcagcagagcagcctctgggatcatctcatcaaggccctgcccagtttccatggcagcagcaagagtctgttccgctgctaacaaagcagaatcctcagtgatcagaggcctcgcctgcatagaacctccaggtgctggtgtggccagggacacacacatagatgggcctggcctgtggttcccctgtctggcccgaggtgtttaaagcctggagcttgtcaggccccgcactttggaaatccagaggggctcccctgttaatctttgggcaaatattttctctgctctgctggcttcgtggtgagttaccggcctacgcctctgtggcaaattaatggagcccagttgtccgcttggggcaaggggaccgagactttccaccagcaggcagcttcgctcacaggggg

SEQ ID NO: 53000 - DNA, 1919 bp, Bovine  19866881561910
ctttgatggcatataatgaggaagtatgatagcaggtacctccaggtaacatgtatgaaccatgtaaaagctgaaaagaaaagtcacagaagaaccagagatctaacagagcttgatttggaccagattaagacagcatgctgcccatctgcctagatccttatctacccattgaagtcctgtccactcccacctggccatccctgcatccctctgcttaagcactttggttgctggagtcttttctcctaaaggtgcttctggctagaatttctgggggcactaacagccctgaagaagcccttgactagtcactgggagagttagtgggccccagcccttcagccctcggttgggatgacccccgaggtgggctttctacactggggcctagtgtagtcccagcaggagtaagtgaattgttcccagcagggactgtctagatgacaagcccttcactccctgccttcctgctcatttctcccactccttgatctgtgtttcctgggaccacctcctaagtaaactacttgcaccttgattttggtctgcttctaggggagcacaaatcagaaagcatgacttgacccccatgtctccggggattagttctgagtggggttggtagccagggctgtggtgcaccctcagggtctgagttctcgcccggggctctctcactaatgagttttctgagctgcagttgggtgaaggcgacccacttctgcatcccttccaactcggtatagccgctgccaggagccgggagcattggggtaaacatgacatttccctcatgctcagcaagacaggaagttcattaaatttagtataaatctttgcctttaaagtgccagttggtgatttattttctccttctgtttagattttttagagcgtaggtgccaacctctggaatccaatccaaaaccccaagcgaagtcctgttgataaatcaacaaaagccatgtttgcacaacgcaagccaaatgcaaatccctcatccttgtgaggaagcctaatgatcacttttcagtgttataaaaggtgccgtgtcgaagcatcttgctagttctcaccttggcctctaaagaacatcctctgactgcctttcttcagataaaatccacagataaataaaacttctcagggaacaccagggccacaaacacatctgaggggaaagaaaattgcatcaggatatagttggctggcccaagtcctgcttatctctccatcatgttgggtagcacagttcctaagtgtgcgcttctccatctactaaggggtctcaatgtggcccccacacaagaccttagagaaacctgcatagcattgctgaaacgtggctcacttctacacgttatcagctgaggctcaggcatggatctgaaaccatctgacactctatttcctcatcttgggaggatggttgaaaggattaaatgcattcacttttttgttcttccagccaagaatatttatcgagcgcttattctgtgccaaaagtgggcgaggcttcgggatatataagtgaaccaaacaattatggccaaaggaaagaagttcaggtacaactgaagaaccaaaaacaaagagatgaagaaaaaagcaggccaaccccatcagcaagagccaaaccatgccaggtctcaaagccagtgatcaggaattaggtctttgtgcaaagagtgactggaaaccattaaagtgtattgagcaaggcaatgggtggcacgagaataaattagggacaagaagagaatggatgagatgagagtaatctcataaagcatccatactagtgtctggcccagtacaggactcagtaaatgctggttcttccccctcctctttgtgtctttcccctcagacacaggagttactacccagccccttaaacacctcccccaaagcaa

SEQ ID NO: 53001 - DNA, 781 bp, Bovine  19866881792300
tgaaaaaaatcctgagaaaaaattcactaaaactgaaaacaatttaaccgtattttaaaaatataaggatatgtgaaatgttacaccagtatgcttttcaaatacaagtaggttacctataagcactcattatgtagtaagttagcctatttaaattatgattgccaattcatgacaggaaatttaaaaagcaagaaacagaggtaatccagagcagtacatatccaaatgaatcatgaagcttttgtagtcacctctataaacaaaacaaattgtgtgcacacacatacacacacccaaacaaacaacaaaaaactcaagacagtcaagaatctgtctgcaatgcaggaaacccaggttcaatctctgggtcaggaagatcccctggagaagggaatggatatgagttacattactgaataaacttttcatagcctacactctgtcagttgttcagagaatctgattcccatcaccttggaaataaaacatcaaggtttttttgtgtgttataaacatttatatctagataagggcttaactatttcattaatggtaaaatttaaggaaataaagttatagcttccttgttgcaaagacgctctgtggtaaaatctcaataattttgaatattctgatgtctgtttgatctaactcacccctcccccattataacatctacagtctgttgagaaactctaaatcagatgacccctcgttatggtgaccacaaatctcagaatttctggagcaggatcaattcccaatattctgtcttttt

SEQ ID NO: 53002 - DNA, 832 bp, Bovine  19866881859672
attaatgatgcatagtccaataaattcctccagctcagatgcaagagagaagaggaaattacaggacagattaactggtgcccactatttccatgtctgtctgtaccattacacaagtcagcatgtataatgttcacaaggttgggattttaatccctggttggtatttccttatcttgctgttgaaacacccaaaagttgaagaacaaaggtcaatatttagacacattatgaaatcacttcagtttttctttattggaagcttgtttggatttgttgaattaataatttctaaagttggtattcaacattgtgtaagcatgacttttaaaagtagttctcagccacctgtaatgaataattactagagggaaatgacagttgatctgagtttcattcatccacgtattagagtaaaagaaaattaagtaagttctccagatagaagttttggataagaattgtaaaaatagaatacagctgtccattaaaaatattattttagtaatgctaatagaagaatggaaattaatataaacttatattaaataatggactgaatacctctatgcaggaacatccccaatgtgtattctttgtaaagggtcggatttaatagcaaatagaagggggaaaggtggaagcagtgacagattttcttgggctcactgcagacagtgactgcagctatgaagttaaatgatgcttactccttgcaaggaaagctatgacaaacctagacagcatattaaaaagcagagacatcactttgctggcaaaggtccacctagtcaaaattacggtttttcctgtagtcatgtatggatgtgag

SEQ ID NO: 53003 - DNA, 1953 bp, Bovine  19866880410361
tattttagtacgtacatttccttttattttactattcataaagtcattataaatcaaaccaattgcagcataacaggaaatgcttgacattttctatctcaaagactcattcataatttctcaattacatgtagtttaaatacatagcatccaatctgcagtctttgaaatggtgccaaattccatctgctttcctgaatattaccacagttatttctgagcatgatgtgagagagggcttctgagaactctaacttgaacacaagcctctcttgatagaaccttactgttaatcttgcacttttctgttcaataaacctctcttacataaatacacagttttattgatttccatatctggctgcttacttacctccactaacaatctaccagcatttcttttccattcaggcaaggatgagcccattcctcttccaagattgtctcaaattcacaaaaggttgattctgaggaaatgccaatgaagttgccaaattaagtgttattggcataacacttaatcttttgatggaattcttgggttaggtctcaaaattctacccagaaatatggagaatttatactttgagaaagtaaacctaaaactgttctacagacagtgtcactagtaaattatctgtattatttcaatttttcttcactatttcttggtttatcccctgctgatagcattgattttctagagtacttgtggtgtaatacataatgtatgcttgcattttaaaaaataggaacattgggttgactttgagaatttaatattcctctggaaaattataaatattctagtgctaaagtctgatatcccacagacacaccaaagaactgaaacaaatgagaaaaatatcttgcccttgatgcattaaggctaaatcatgatagatttattacataatctctaacacattctatgttaaaatcatagcaaaagctctatcattccttaaaaatttgacatgtgattgcttgtaggcatacccaggtattttctcattcattaaaaaatttttgtttattttgcatttgatttttatgaaaatgctaaaagaaatattaaatacttagagcacatgctgcctatatgatttctttcagtttttagatgaacttttggaagttgggcccttcatctgggcttctgttatccctctccattgatcagtatcttcatgtcttatacaagttgtttgacttttcagaattttctgtctctcatctctttagcaatatcaacctccctccaaatccctctagcacagttctttctgtagcagagaaggatggttgtccatccatgttagcaacaatctttaagtatggtgcaaaaatctctgggaacaatttatactagttagagaagttacacagtgatgattttccattacttagtcagtttggctggagaaggcaatgggatcccactccagtactcttgtctggaaaatcccatggatggaggagcctggtaggctgcagtccatggggtcactaagagtcggacatgactgagcgacttcacttttgcttttcactttcatgcattggagaaggaaatggcaacccactccagtgttcttgcctggagaatcccagggacggggaagcctggtgggctgctgtctatggggccgcacagagtcagacacgactgaagtgacttagcagcagcagcagcagtcagtttggtatagattccaaccagctatgggcttccctggtggctcagatggtaaagaatctgcctgaaatgtgggaaacctgggtttgatccctgggttgggatcatcccctggaaaagggaatgacaacttactccaatatccttgcctggggaattccatggaaaaaggagcttggcgggctacagtccatgggtcataaagagttggacatgactgagtgactagcatatatatacatatggatctcagg

SEQ ID NO: 53004 - DNA, 2625 bp, Bovine  19866880438678
cagtaaaccatgctgttcatgtctgctgagctttaattttactttctctagctcaaggcggggcactgacaggcttaatgaagacattcacatcatggtaaattcttagggtaatccaaacaccttaaaaacctgttgtttgctctaaatatctgagtaagctagacttaaaactgaattaaaactttcaaaatatgtttttatggattttaaaatgcaaatgccctattctcagaagatttgtttacagatatgcatataaattgtggttgtatgctattacaatttttccattgataatatgatagtgctaatgaattttctaaataggagggacttacaggtagaaatcaggttgtggtacaagttaggaatctcctttgaagctatttagaatagaaagcacactgtttttatattgtatgtttatagctagggcttaaaattaactttctgggaaaaacagagtattttacaatagattgtacatttacttgaagtagcttgggaaactctcatggagacttttgggacctaattcatttccatcaggtaatgcatttgcattgcagggaaggaagaataatttttctacctaatttactacccttctaagttctcagtggggcccctctaataaaatacagattaacaagagaaaaaggagtttattgacacatgtagctcatgaatacatagaagatctgcaggggcaaaaataaataacttttagaggtggcttagaattcaggttcaaataccatcttaatacaggaaagggaaggagatgcaggactctgaagggagagtgagtgatttttagaaaagatgaatgggcctttagaaaaacattggaggcatgatggtttgtgacaaagcttatctgaatgtggtgtcaacctctagtgtcctgttttgtgataagttaatcctccttgaatgataaacactcccctacttttctgggtgggattgatgaccactgagttccttttagagcatttgtctttaatcaaataaggggaattcagagaaaacctttccctgaatttgctattttctaggtacctacaactaaaaataatcaataaaacaaagtggaatacttgagagtggcatgccttgaattcctacaggaatattttaggctggcatattctgtgacccttcaagcattaactctgaaaactgatcaactttccaatataacaaggaggatgtgacaaattatatatccattttggcctggtttataagcattccttcataggtccttctcaagtccagattcatttacattttttcaatatccagtatgctatcaaccctacatcatcacataatgcaaataattctcaacaattctttcttcaatcaacattagaaaaccatgacattgaagatctcatctgagattacaatcattaactttccattgcattatctaaaggcctggcaagaaaaatgatactaaaagtgaccaccactgaagaacatatcatcaatctggttctcaggttatatattaaactcagtcctatctttggaaccagaaagctatataaatgtaccacattaacctagacccatgcagaatcgctttccctgagttatgtctcaatattcaactgtaaatttatacctcgagaccaaatgagaaagaaacatggagcatactgtcatggaactataaaatcaaagtaaaaattactgccttttaggttattcaaagcctcctaacaccgaaaaattttaataggaaatatgatgtttgcttttcgaagtggtttgaggttagttgtacgtggcaaggacatggtttatcctagaacttatattcatttaaggtagttgcgaggactgtgatggaaagtaatagaagctaaagccctctcaacaagaaataatacatttatttttagagtttagtaccctaggtagacccttgagttaagatgacaggccaaccagatgtttgttatatcattttgcttctggaaaatttactaaattaattaagaaataaacacaataattgaaactgcatagtgacagtatctccatttcagggcacatcaagttcatttttgaggaccagtcttattcatttatttaattacctgcctgggccatagaggcagttaggtgcggcctgggtccacaaggcaagaatcacaaagagaaggaagtgcaacaaaaatgatagtatggggaaaataaaccactgcccagggaagtaggcttgaaaagatagacagttaagggtatcttcaaacactggtatcttcaaaccctaagacaaaggtaagccttgggggtaaaaataggaacattaatcaaaagtcatagcacccatctttctgttgtgatctggcacccagccagatgtctattgcttggttgataaaaaaaaaaataaaaaatagatctcttctctaaaggatttcctgagccccaggaaaaaaaaaaatctcctaatttctgacattttcaaacagttgtaacagtcatgtctgtccaattgctctaaaatgaacctatcaaaatacccaactcggcactgacctatgatgtgctttacatggctttgttcaaatgtatttaggcagtaaagcttaataagat

SEQ ID NO: 53005 - DNA, 2628 bp, Bovine  19866880461140
aaaaagcagatcaataaagggaacaagtggaaagcatctttgctcttttttcactccaaagccaccaatgtaaatccactctttccatatctccctaattctgcattctgttgctactacttagagcagtatttcaatgtctaagaattgggagcaaggacaggctatttttataataagccagagatgaaattctagaatttaacctgtctagaatctcttttccaaacgctttgggaggcacatgatcaggaagtggatttagctgttgatttagaagcaggatttcctcataaggagtaagatgttttcattaaatgatatgtctgtttatattttcaagtaatctatagtatccttagttgtagtggctcactcgttcatatcttcagtgaacttttatttagtgctaattatgggtaaggcatcatttagtaagggaaatataggatataaaacaaaaagtactctacagaaaataaagtacagtgggaactcagaagcaaactgttttttaacttgggtggtttacagacaaaaggagcatttgaatagaaccttaacagacttctagaatttgagcaatttgaaaaggaagaaaggccattttgggtggaggaaagagagtgagcaaaggcacaaaggcaggaaaaataaaatatgtgcaacaaataagatcagtctggtgaacatgagactcttcagtccaaacatcacaaaatatcgtgactagccatgcagctaggtgtagatattacgtaatcactcagtaagcagagattccagtaactgctatcagtcactgctgccaggaactactaatcaggcagcatgtttagaatgtcaagacgatgattgttaatatgtgaccaaccaaggaacttggtgcctggtagaggcatctggcccaaagtgatataataagtaatccaactgggtaatattttaccttcaaaaccaacccagtggttgggtcaataggcaaacactgttactgttcatttgtgaagaatattttggcaacttcaagaggcttgagaggaacaggctgcacacgtgaagcttcttttgctgtagagcgggatgttccttaggacattcatgtggcaatatcatatatttttttgctttctaaactcaaaatgttaaaactatatcattaacatagaaatagaaaaatcttattgacctcaacctcaagcttacaattaatgtgtctttcagctaaagagtgaattcaaatgatggtagcattgctgatttaagttttctttgttgcattcagcactgagctaaaatgtcctagatcagagaatgattccaagtcaaactagttcaatgtcctagtccaggctatgtgctttatgggccctgagaaaaaggcttttcttttattcctcaacattagctagaaatgcattttcagctaacatttgtcatgtgtttattatatacacagcaccgtgtcaggtacctcataagcattacccattttaatcttcaaaacaactctatgacagaggttaatatactgatctctgtttcagggatgaggaagctggggattagggaggattagtaatttataccctgtcacatagctaataagaggggcagggctgatttttgagtcctgttggactgttaaagcaggccatgggcatctgagcagggacagaggcctgtgtgttgtaatgagaagcaggcaagaagaggctatcgctttcgtctgcctttctgtctcttcaatttctaccctgctcttcttcctgcttcctcattttttgctatttttcaaaatcacaactcctctatttccgtgttccttgcatgtaaatctttttttcatttatgtattaatttatttctcatttcactcactgatttatctctatggtagcaggctttgtctgctaggaaattacaaggagagctagtaagtgaatgaatgagtggatacagtgcaatgaaatgaatggagtacagttgctttgagggcataaagaaggaaaaatataaaaatttgaggcctggaagattatgcttgaattgtgtcttgaaggaagagaaattaaatgaggaagcaggaagaggtttccaggcaaacacactagcatctgtatagtcattgagttggggcaatagccaaacataactgggatctgatggtcatatgggatggtggaataaatgcagagtgtttcctgggagtgttgagagatgaagctagagagaaaggcaggggcaagcatgtaaagttcttcagtgctaaattaaggagtttgaatgttaacttgaaagttacaggaaattgttgaaaggatttaaattacggaaatacatgattttttactttaaaaatagcattctgataatcatcgcttgcatagccagttcccatgcctcgaaaaggaggccctaagtttgcaccaagattgtacattactggccttgagagatttcaaagccttcatcaccctgtgatcttccctgatagaaagagtttttcaccctacttcctgattcagaagtcttgctcaggtgggtacaaggcaccctacataatttggtccttagagatgaaatttattgttgtaaccatgagagcctgcttgctaggcgcaagat

SEQ ID NO: 53006 - DNA, 1299 bp, Bovine  19866880507767
aacattgaaaacatagaacagctttagggctgtagaaataaatgaaaccaacccaaaagagaaaagaggctatttattcagaacttgctatggcatgggtatccgcaactgtcactcgcatttgtcagagactccaaggcagccagaagggtggggaaaaaaaaaaaaaaaattaaggcttcaagtatgctctgattggatgttattgacactgggtatttggaggagggcaacgagaatcacagcctagtatataatgaatttagaaagcagattgatttctagttggtcttgagttggaagcagaggcagaaattagggaaactggcagtcattgactaaatcctaattgtcctgggccagttactgaagacgttatggttttgcttcttgaactggctgatacagaggttgtaggtcagaggtttattttcctatattatctggccattgtctctgtattcagtttttcagaacagaatccaagtcgttaacataaaaggactctaatatcatacctgctgctattatagaaatattttttttaaataaatttaatgttctaacttggttttaggctagttctctcaaatattagaagtcataaaataatacaatgcaatttgaatattttcatttgtgtttagtgaaatatgagaattgtgagagaaataataagacagcccctgttattgaggtcattagacaattatttctgtatctttcggagtgcagaataaagaagcagtggggattttacagaggaaattttttgttgtggtactagtgactgaatttatagttatcactagtaaagtaagaaatcatcaacgcaaccttgaaagcagttaaaggacaattgagttagaaagatgggtcagcatgtgtagcaagttctagtctaacctattagactaactggagaaatgaaacagtgaaataattttaattaataattaatgttcaacttttgaacatttatgtactccaagttcagtcttattggctattgagtattaaaaataataaaatctaggtaagtcatcatcgaaattagtgtgatagatatacattcagtacttttatctgtatgcaaaaaaaaatctatgatttaaatatgatagtgtctttttagaaatggattgtggcagctaaaaatatgtttcaatgaattaatggctcattgtgctacttttaaaggataataagtttatgcttcttatgcataatatatgtctcacttaactgctgttaggaataccatcagaaaatgtatagattatcaacatggctttctag

SEQ ID NO: 53007 - DNA, 4841 bp, Bovine  19866880539163
gaattggctttctttattatggaggctgacaagtcccaagattacaaagggcaagatggagacccaggcgagccgatgatgtgtttccagtctgaaaggcagcaggctcaagcccccagaagagctcttgtttcacttctaaaggaaggactaaaccagtgtcccagttagaaaggcaatcaggccttcctgggcctttcagggaggaatttctcctagtcatgggagagatagacttttgttctatactgactttcaactgaataaatggggtccaactcacattagggagggcagtctgctttacttgtgtattcaaatattaggtctcatccagaaacattctacagacacacccagggtaatgtttgaccaaatgtctgggcaaggtgtgacccagtcaaatcgacacaaaatgaaccatcacagctggtaaggttgcaaacataccatcaatatgtgtcacactactaaaagagaacacgtcctaatgttctctttttagggggaactaaggaaatgaataaatacaaatagcacacaatttgataatctccacttgaaattattttgaaatatttaatgtcttgaggtaggggcttgtaagcagggggtcctcttttaccttagctaaaaatacagatcaaatagagaaaaaacagggccatgagttggtgggcagcaatgtgcttgaaaattacagtgaattatctccctcctcttatcaggagaaacagagcagaagaagacctggcatcaaagtactgattggatctacatcctgcaggcttggcattgagggtgctgggagccaaggattggattgagggaaatcatcagctgtgacaacaggccagaagcactaagcaacataaaacagcaaagcagaataataggagcaaatgcaacaaggcaattgctgaaatctgggaagagaggcagcttctcagagggtatgagttcactaaaagtgaaaatgttagttgctcagtcgtgtcccacttttggggacccataaactgtagcccaccaggctcttctgtccattggaattctccaggcaagaatactggagtaagtagccattcctttctccaggggatcttccttacccaggggttgaacctggatctcctgaattgcaggcagattctttaccatctgagccactagggaagcccatgaattcactggtagatgacaaaaaacaaatctcctggaattgttacccatattcctcataacagtgacttgtctcctccagacgctcaaaggaagtgaaaacttgataaatataaattatactttcatgtttctgagaataccttgcctgatagcttataaaaagcactagtctctacaaatttgaatgacacaggagaactaagatagccttgattaataccactttttgcttagatagaaaagagagaattcgttttgggttctagacataatatttggaaatctctgttcaataaacttcacttaaaaagtgctttgtattcttggcaaagtaaaattgagaactcagattttctgcacagttcaaacctccaattcctttttgacctgaggatctggctattttttgttttacttaaattgccaacataatcacctcaattttctcttccattttccatgttgaaaagagaagtgacatcactcactatatggaagtttagtcaaaggcaacttggcccagatgttgacattagttttcatcaggagcttagctgttttgggcttccctgatggctcagatggtaaagaatccacctgcaatgcaagagacccagctttgatccctgggttgggaagatcccctggagaaaagaatggctacccattccagtattcttgcctggagaattccatgaacagaggagcttggcaggctacagtccatggggtcacaaagagtcagacacaactgagtgactgaactgataacttttttagcaatgcccaaagtggaatccattactaaataatcctgctggtttggctaatcaattaacactggaagatgctgggagagtttgggtttgacaatttcatgcaactcttataaaggtcctgaagctatttttcccttagtacttagttttctaactttagaaattatttaccacttggggattggaactgattttattttaaaagctattgatttgctaatatatattttgttgttcataaaccgagatggcagagaataaggcagagtgcccactgagagagaactgaacaaattttatctcaaattctctaaaggtaagtcacaatttgtttttgcatcactctcactctcaaaacgcaatatggaacaaaggttattcactatctctcattaaaagatttttcaatattttagttttgatactgccttctttccagtttgtcaacagatccataatgagaatttctcttatttcacactccataatccctggtctgcagcccttgtcctatggtccaaaatggaaaaaaggtccaaaaatagagataaaagccatacacacaccataaatactttaaggaaatttcatgaaagctgctgctgctgctaagtcacttcagtcgtgtccgactctgtgcgacctcatagacggcagcccaccaggctctcccatccctgggattctccaggcaagaatactggagtgggttgccatttccttctccaatgcatgagagtgaaaagtgaaagtgaagttgctcagtcgtgtccgactcttagggaccccatggactgcagcctaccaggctcctccatccatgggattttccaggcaagagtactggagtggggtgccattgccttccccaggacaatttcattatttcactggttggaacttagtcacatggtcacactaccaacacgggtgtcccggaaatgtactgtgggtgttcatgtgcccagctgtcgacagaggatctcacttaaacctatgttaccaaaatagtgtcattatttactcacagctttaaaacattaaatatattgatgtatgtacaaagacttttatcaccattatttttaataaaaatattagatgccacaaacatttctaaatacagaattcttagatgtattatggtactttgctgtgatttaatgatatgtaagcactaaaatcagttataaaaatcctttgtgtgctcagtcactcagttgtgtctgactttttgtgatcccatggactgtgcagcccaccaggctcctctgtccatgggattttccagggaaaaatattggagtgggttgccatttccttttccaggaaaaaatctacccaaatagaaaatgcatatatgacagaacatgaaaagtagcagaatagaatagaaggggaagaagtggaagaagtgacagactttattttcttgggctccaaaatcaccactgatggtgactgcagccatgaaattaagagatgcttgctccttggaaggaaagctatgacaaatctagacagtgtgttaaaaagcagagacattactttgccaaaaaggcctgtatagtcaaagttctagtctttatggtagtgatgtatggatgtgagagttggaccacaaagaaggctgagcaccaaagaattgatgctttcaaattgtggtgctgaagaaggctcttgagagtcccatagacagcaaggagatcaaaccagtcaatcttaaaggaaatcaaccctgaatattcactggaaggactgatgctgaagctggagctccaatacttcggccacctgatgcaaaaagctgactcattggaaaagactctgatgctgggaaagattgaaggcaggaggagaagagggcagcagaggatgagatggtaagaagacatttccaactcaatggacatgaatctgagcaaactctgggagatagtgaaagacagggaagccttatgtgctgtagtcatggggacacaacttagtgactgaataatagcaacatatataatatgagctcacacagaaaaaagataggcaggaaattgatagaaaggttaactatggtcagtttgggaaagtaattggttttgagattagccttcctatattactactctctaacatgttttcttttttttctgtttttttttttttttttcttttttgagaaagtatccagataatttaaactaccagaaggtagtttcagtggtctggtaatttggaagctgaagaaagtgttttgtctatattataattgtctatagataattgtatcaattcttgactttatttcatctactgaaaaaaaaattctttgtatgtaatctaatgaacatataggaagaaaacaaaaatccaaacctttctgagagacaatggaaatgcaactactctatttattctaaaacaattgtaacattttactcaacatgaaaatggtctgcaaagtacttaagattatacagtggaagacactaagcaaatttggggaactcaggattcctgacaagaataaatgagctgtcttacttgtttttcatttgtgcatttgtttctcccatatcactagtattcattatggtcacacagccaggctcacaatgaaactgagtttatgctctgggaaatgctggaaagcaccatcttcattatgtcaacaatgaaaattacgtttgtccgtgttctctggagctggtggctgaaatgtctgaaaacaacatgcaggcattttccctctcactctgggggaaaaatatacctactgacattattattattattatttttactaataatctgtttcccctttgccctttaagactgagaaaaactgcatgtaatgaatgctatttgtacataaaggcaatt

SEQ ID NO: 53008 - DNA, 1846 bp, Bovine  19866880540122
caggaaaatgaatctttggctgtggtctagatcctgatattaatgatttgttcttcagtgagcatctaagaacattcaggaattgtaaacaaatgtactcacatttgttacaaattgtaaacaaatgctgttcttgagtagctaagtcaggtccaactctttgctactgtatggactgcaacatgccaggcttctctgtccatcactctctccctgagtttccttaaattcatgtccactgagtcagtgatgccatccaaccacttcatcctctttcacccccttctcctctggccctcagtttttcccagcatcaagggtcttttctaatgagtcatctcttcgcatcaggtggccaaagcattggagcttcagcttcagcatcagtccttccaatgaacattcagggttgaattcttttaggatagactggtttgatctccttgcagtccaagtcttctccacttccacagtatgaaaagtgtcagttctttggtattcagccttctttatggtccagctgtcacatccatacttgactactggaaaaaccatagctttgactatatggacctttgtcagcacagtgaggtctctgctttttaaaacatggtctaggtctgacatagctattctttcaaggagcaagagtcttttaatttctctgtaagaagggcttttaaaatttcttctgtgataatgcttttcctataaaaactcctgggatgtgatgatgacccaaggaaagttgacattattagaggaaagagcaaaaggattgctgggaatctgagaatgtgtttatatgtgtcaggactcatagggttttataggctcatgaatcaagcctgtggcatcccgattttgatttaagattatccactggggagcagattttgttttgaactttgcttaaaccttcctgagcaaagagatccctcagatatgctctgtgagtttccctacatggcagcacaggacacttgggggttggatgttccacataatttactgtgtgcttcgactggacacacatcattgctctctgcacagcacagcagtatttagataggtgctgctggcaatctggccttctgttctctgtttggttgctgctccatattcattctgagaatcaagatagaaaatcagagaattatgataaaaaaaaaaaaaaaaaaaaagaataagctgtgtcacaaacagtcaatcttcaaaccaaaagttaatgggaagtttcaaagctgagtcttacttttgcagtggccataagtttttaacttctgctgtgtatttcatttcatctatttggtaaaattgtacatgtgtgtttgtgatggagctctcctttacaatgatgttggtgaggtaactctattatgagaataatacttatttagatttgcatgatgtataattttgagtgctttcccatcttctattggaattgatttacacattggtaatcaatggcaccccactccagtactcttgcctggaaaatcccatggatgaaggagcctggtaggctgtagtccacagggtcgcgaagagttggacacgattgagcgacttcactttcacttttcactttcatgcattggagaaggaaatggaaacccactccagtgttcttgcctggagaatcccagggacgggggagcctggtgagctgccatctatggggtagcacagagtcggacacgactgaagcgacttagcagcagcagcagcaatcaggtttcaagttaatacaagataaagaattgttttatatcattcatcgtctagtgctacacagcctggcactctccatatttattcaccaatggtttattcaataatt

SEQ ID NO: 53009 - DNA, 684 bp, Bovine  19866880541890
attacttattcatggtcagtggctatttgcaaggctgattattataaatttacacaaaactgtctgtattctgtgccattcttcaataatcaaaatccagagtttcaataagggtgctcctcatttacaaggttaattcctccaataatgatgtttacattctcacacacatttcagagctgagaatttattgcatagggcacaaactcattggatatgctgtgtaaataaccttattaagaatgcagtgagaggatatacattatattcctttgggtcagaagggtaaacacagcaagaaaatgaggcatttaccactaagtagccaaactgatttattttactctgcctttttcattttgaaccttttgaagcacagattgcttgagtactctgccttcatataagcattcagttagaaattctagagggtgtagaaactgtcccagagaacaaagccagagactttgtgttaaccaaaactaggattgagataatgttttaggtaagggtgagttgatagtaaattattgttgttggacagtcgctcagccgtgtctgactcttttcgaccccatggactgtagcatgccaggcatccctgtccttcaccatctccaggagtttcaaacttatgttcattgagttggtgatgccatccaaccatcttgtcctctgtcatcc

SEQ ID NO: 53010 - DNA, 805 bp, Bovine  19866880546131
acagcttgtatgtacaagtgaagtggtaaataatagtagttgaaggttttggccacagatttaatgcaattcctgtcaaaacatccatgacatttttcacaaattgctaaaacttatatggcaccacaaaagaccccaaattgctaaagcaatcttagaggaaaaaaagcacaaagctacatttctgcccagatgtatgcacctgctcagattcaggtgtggagcagacagaaaactggttttaatcagggatggagttttgataagtgagtacaataaagcaagagagcagtttgaggtatttgaagctgtatacatggaagtaagtaataattgacatggaatcagatctagataaaggcatggagaataataagcactgaaaagggagaagaatcaataaactgaaaaccgtgctgggatggagggactgatgaaatttgagtactagagagtatgacctggaaatacaggtcactaaagggagtgatcaggggctgggatatatttgaactaagactttgagggagttgtagttattgaaaataataaggcccagaatatctccaagaaaatggatagttaaggtagagtagaaggtcacattatcagcagagaaaagtttcagaagtggaaaagtcagaatgttggagaggtcatttacatgagtgttcatatatccaagaattaaggcacgaatcatactgaagagaataacaaagagccagtagctaatatcacccataaatgaatgacccaaggaggataagatgaaagagagtagatgacatagtctaaatgaaat

SEQ ID NO: 53011 - DNA, 2262 bp, Bovine  19866880589202
taagaaatactttatatggtaatctacatgaagatttgtaaagaaattgtttttctccacccttctaagagtttcttgtttagattcatggtagttagtctgtaaaatatgtttctttacaaatatgcactcaatttttgtagtactactgctagaaatttgtgacctaaatataggaatttttacaaatgcactgtgtatattgaatgcaaagcatggtacatttgtaattttgtacactgagttattgcatgtatgcacgattcatggggtcgcaaagagtcggacacgactgagcaactgaactgaactgaattgaactgatatatatatttactgggtaaatttctcttgcctatgcagtacaaactgtattttctagttaaaatgttacacatatgataactggaagaattttctagaacctattatttatttatatgcattttaaaacttgtatttgctttctaatatttctggagcctggatgaattctttgacctttcatctcagtgtttgtgtgctgggtaagtcagtacagtggattataggaatattcttgacattattattacataactacagctaacaaaaaattaactatacatgaaagtgaccgcaaacaacatacatacgtattttactctgcccatatttgatgcattgtcccttcactggacacaccacttcatctgcaccaacaggaaggaaattttgagagtgaagtcagagtggaaaacacaagggtttcaactgattatagtttaaatgtcttaatttcgcacattttataaaaatacatgatcccagaaatacaatggtagtgcccatgctagggctctgaaagtgagggaccctgaacttccgagtttcagaagctttctgtagatctgtctccattgttagccatcctcacaagcatacaaataagaatcataataaaaacatttaaagttttgagttaggaagaaaattctagttgtcctaactttcttacagttgatggcattttggttcatagtaaactccatcctgctagaatctagtttcccatagaaacactcgtgttaatttcttaaggttcctctaggaaaacataatttgaacaatttattctacaggcaagtatctgtatacttcgattattgaatttcttttctcttttttcccccaaaaaatgtacattcagtaaaaggattgcctagtactgtgcaaaaaaaaaaaaaaggtgttagactttattctgtagatatatgtttatgttcaaatgtgaaattctctatcatgaaacattcccttgttttatcaacaatgctagtctgaaattttagattgtatattttcttaagaaacattgtagaatgttgctgtcatctagtatattcaaatttctcttatgttttaaatgtatattagtttcataaatatgtatactcttgaatggttttgagtcccagactcttaatttattatattccttggtgaaataatgactaagtcttacttaacttcattacgatttccagggaaattcagcctctgtggagtgagtctcaggataattaaggattgtagacttaagaaaacatttggctttcagtgtttgataaaggaatccattttctggaggcatgatttgcttccccagattgtttgagaaagcattacatttcattaaccagactacactctttggaaggaaagttgtttccttattctgcttgagtgttggattgtgagaacccttttgcttttgccagaagtgacctagttgatacagttccctgtcaattaaggtgggagccaggtgtctcaggtgtcagctctgctttgataaccatataagacaatttctggcttgtttatgagactacatagcaggaaagagccacattataagggggatgcttttacttcatcataacaaaatgtcctaaaagaaaattttgcccatggtgttaatttagtaaattggttagatatttacgagtaagaaattatttgaaataattataggcaataattagggctaccttcagaaataatattagtccatctaggcaggtggaataaaattttcaagtttcaaatgcaaccccatgtggctactttagttacctgttccaagatctcctaaatatattctttaggagaataggaaaaggtccattggtcatcagagttctgttgttcgtctggtctctcaaccaagctatggcagtattaaccactttaggcaaattaggggaagatccttgttgg

SEQ ID NO: 53012 - DNA, 2642 bp, Bovine  19866880624826
tgttttgcttggccttccctggtaactcagaatggtaaagactctgcctgcaatgccggagacacaggtttgatacctaagtcaggaagatcccctgagagaagggaatagcaacctactcccatattcttgcctggagaattccatgaacagagtagcctggttatagtccatgggattgcaaagagttggacacgactgagtgactcacactttaatatattttgctcaccttgacatgagaaaaacttcccttgattatctagactgctacttatgcacctaaattcactcagccagcatcattcagtggatcactaccaatatattggataaggtgatttctagaccttaaaaattcacttctttgtgtgcatagttctcccaatatcagccactaggtagaatccctaaggcaccatggtctgcaccatttattttgatatcttaaaaacattaaaaatatcattttacatacagcataaactagatagactgcaatacagcaatgtcagtttcttgacgtttctatttcttctctacttgatgctgcatggtgaaataatagtatttcttaatctttatttgtattgactgaaataccatgaattatgactctcctccacagctgatgaattataaagtcataattctgttcatacacaaataaaatgcttacctatatttggcctttggacatgacttccattggggaagatctcatgagatatcagatccatgggctgtatcaggtgtgccagatatacctgatgacatggtatttctagatagatttcaagtttacgatttcaatagacctgtgaactacaaaagttgggggccatgtttccttctccattaaattaatcaccatttgcaccctactggtaaagaatctgcctgccaatgcaggagatgtaagagatgtggatttgatccctgggttgggaagattccttggagaaggaaatggcaacccactccagtatcttgcctgagaaatctcttggacagagaagcctacaggctacagtccatgggattgcaaagagtcggacacgaccaaagtgacttagcatgctacttattttaagtgtaactagagagaggaatggagaaggtgatggcaccccactccagtactcttgcctggaaaatcccatggacggaggagactggtggggctgcagtccatggggtcactgaggggtcagacacgactgagcgacttcactttcacttttcagtttcatgcattgaagaaggaaatggcaacccactccagtgattttgcctagagaatcccagggactgcggagcctggtgggctgccgtctatggggtcgcacacagttggacacgactgaagcgacttagcagcagcagcagcagcagagagaggaaaaagtctccaaatgcaagtgctcactgggagaggagagaagaacttaattcttccttctgtggttgctattgttaaattccagatgaaaatggttagtgacattagactgtgaaaagtgactttggatgatgtatttagaacctgagataaacagaaatgtgatacagttaattgtatattcaaacaattgaatttactttattggattttcccaaaattgcataaacccttaacttggaagatacttgtcagtaaggttaggttcaaacttatatttcttaaaatcaaccagtgcatatgtaaaaacagtaaagaaacttctctctagttctgtctacataatttatgtttggagcatgaggttacatatatattatttgtagctggttgtatgactcataatttacaaggatttaaggtattgtgtagttaatagttaactgcctgtgaagtagagaaggctatttttatggtcctgacgtgaaagaccccagtactggtttatctgtgaggcagttgtgggaaagttataaagtaatcacaattgacttctatttcatcctttgacatcaagaccattttatagtttggtgttggtgtatttttagattttaaaggcatggctggtgtatttagtagcattaatctctgactcaaagatttattgttaacctttatcatttgtttttagtagagaagcagctatgggatggcaaaaggcttccactcctccaatctttttacctggaacgagaggtcattaagtattttactcgcatgctatggagtaagaggacttctctgatacctcagttggtaaagaatccacctgcaatgcagaagagcccggtttgattcctgggtcaggaaggtcccttggaaaagggaaaggctacccactcctgtattctggcttggagaattccatggacagtccatggggtcacaaccaaagagttggacacgactgaatgactttcactcactcactcacggagtacgaggtctttagtaattaatttagaaaaaaaatgtgactggggacaagagcaggagatgtggagtcctgtacagcaagtgcagtttactatatttacgtatattctttaattctctgtgtgtggatctatagatatttcattcaagggctatctttcaaagttatcagcttagaaagttttatacttactccagtgatggaatctttgtttattaaatatttataatagataagaat

SEQ ID NO: 53013 - DNA, 2565 bp, Bovine  19866880722575
agtcagtgatgccatccagccatctcatcctctgtcttccccttcttctcctgcccccaatccctcccagcatcagagtcttttccaatgagtcaactcttcgcatgaagtggccaaagtactggagtttcagctttagcatcattccttccaaagaaatcccaatagagtgcgataatatgcaaatcagtgggattgacagagagttttaaaaacagtgcagggcagtagataatcataagaaaaataaagtatctgtactttgctcattataccatgataaactttaaatggattattaatttaaatgtaaaaactacagatttaaaagtgatgggagagaaaatgcaaaatatcattagaactttggagtatggaaaatcatctttagcccacatactagaagccataaaataaaacatttaaagttaaattatataaaaataaaatttctcaaacatatgtacataggcacatgcacacacagacacacacacacagtgaggactggccaaagccaagcaacaaagtaaaacaattcacaatttatataacaaacaaggaaccacatttcttaaaaaccaaggatttaaaggaatcagaaaggaaaggccaataatacaattaaaatttgggcaaaaaacataaacaaatttcagataaagaaatacgaatggctctaatatatatgataaatgcacatatccattcacactaacaaaaagctgaaataatattacatgatgatggtttattgtccctgtcaaatagggaataatccagaattttatgcatatactttgttgatatagctctgagggaaattaagtattttttatacattactgggacagtgcaaaatgtggcaatacttagggcaatatggcaaagtctgttgaatgatccttacagacatataaggatatatgtaagatatatatatataagataagataaccctgcacattttccaaatgatgcattgtaatgctgttcattattatttgtaaaattcaaaagattcaaaacaaagcaaggaaatatacatgggacacaggttttgtcaactccagcacatgtgcatgatgaaatagtatacaactgtgagaaaagatgaaggagggtctctactgatacagagagatctctaagttacattgttaaacatttaaaaaggcaagatacaaaacaatatagagagtttgctatgatttgtttaagaagaggggaacattgagaatatggcttctgtttctacttgcatatgtcctgtgaggctgcagtaacatgtgagatcacctcaggcaggtttgtgtgtgggcgtgcaagggcatggccaagggcaaagacagatgttttactttgtatattttatgctgtttggatttttcaacatataagggtatgattcctctaaaatttggcagaaatattgtaatcataaactgatttgtttaaattttatgaactatgtcactcctacctctgttgagttagcttgttttcctattacaaatctgtaacacggcataattttgttagctcttaatgtaatgggcgctggggaaaccctcttaatattgcagaaattaatgtacaagtcatgggtgggttcgtactttccagtattaattgttgtcactttctctaacatgcagctgtgacaaagatcctcaaactaccgtcattgaaaacggcagaagccagcggggccgcttttcttttgaagtgttccgatttgtgaaacacaagaatcagaaaatgtctactgtcttcctgcactgcgttaccaagctctgcagagctgatgactgccccttcctcatgccagtaggtttttgataactttattctgaactgttgtattaaactaagctgaaggttatcaagtgttaggaacttatttctacatagaaagtgaatatgcatcaggtcagatagtttgaagtacaattttttcattcatccagtaaagatgtcttgaatacctactttgtgccaagcattatactgggaatacagagatgcgtgcatgaattctgaatttaattagcttaattgttataagcatgagatagtcaaggaataaaatatgacaaaatgttatgatgcaaaggcaaacatatatatgcattgtagcaaaaggcactattcatcattgtgagagaggtgaaacagaagaagatgagagacttgattgaagagatgtgattttgaagacagagacattctacaccaaaggatggtcaaagcacagacacaagaaacagagtaacctgcgaacttccagtctcagtagggctacggagcagatcagaggatgatgggcaagcctgtggtgggggcagcactggcactagaaaggttgattgaccagatggccagggaatccctggtattaaaagataaaaactataaaagatgtggatctgtactacatatctgttagtcactcagtcatgttcgactctgcaatcccatgggctgtagcccagtaaactcctctgtccatagagttctccatgcaaaattacggaatgagagccatttcctttttcagggggt

SEQ ID NO: 53014 - DNA, 1101 bp, Bovine  19866880766212
caccccaaataccttaaaccaaaagaggaagatcaataaatgaaactttgcataaatgttttcttaaatttgaatcaattattttatgttctgttctttaattttattgacaactttagagaagaatatatatacattcctataaactgttcacatgcaaaaatatagttatctattctacagaaatgatatagcagtcaactgctaaaagttataaatgaaaaagccatccaacttgatatctcatcagcagagttaatataaaagtatagtaagtacttttaaattttgttggaaaaaatgaagatctttatccaaagcagaggttgttctctcagtcactgctggctccacaattccttgaacagcatctgtcaagagtcactcaataagtcactcaatattgaattaatgaacatctagctcacaaataagggtcacgtggttaaactgattttactttattcttattcatccaattcctgaaaataacataaaaaaataatgaatgttagacataacacattcattatatatggccattacatttttacagtgtcactctgcttctagctttttgactcagctgagtaaatacagaacacttctgtctattactcataacagctttgaaaaacaaacaaataaacaaacaaacatttccctgagtgcactagactattactctatcagaagtcaagagtgcattagtatcttttatataaactgaacttccaagtagtttgacactgatcaagttaaatgtgataatggcaagagtgatgaaatgatagtagaaatgatgtaatacaatagaattaggaattctggtgtgctaaaattaattgtccaagggagtactgtgctcacattacaaaatgttctgaagataaaatttccaaaatttaaatgaacaagtaataaaatcagctttccaattgagagactgtgttaaaatagctatttttataatttctggggttttttatacatgagaacatccattttatgtgccatgctactaataaaaaataaaatgcaacttaaaggctacagttaaaaatggtatgccaaaggcatcacatttataaaatgacatca

SEQ ID NO: 53015 - DNA, 1371 bp, Bovine  19866880777993
tataggttaggctgtccctttcactaagcagcaaggcttttaaattctcacacttactgattacacttcctctaaaggtatttgttaaacctttgaaagtgaaagtgttagttgctcagtcgtgtctgactctttgagaccctgtgtgtggactgtagcctcccaggtcctctgtccatggaattctccaggcaagaataatggagtggatgccattcccttctccaggggatcttcctgacccaggggatgaacccaagtctcctgcactgcaggcagattctttaccatctgagccatcagggaaacccccttaaaacctttacttgttccaaaggtatggcaaaccaaatgataatgtccctttagcattttttgcacagttgagttaatgatgatgaatcactttcaccttagaaataaatgcatgtttgaatgcactcacacatgctttatagacacatacacatgtaggtccagcaagagcaaagaggaatagtctggagccatttaaatagatgctttgactttagaagaaaattggaaattagagacaaatatcaaagaaggggaaaaatgtaggaacttgggagaaaccactattttcactattctctgacctttggtacattatttatctagtaggttgcaatgagctttaatatttgaaaaaggtcagattcatgtaccatatttgaataatgtaggcagcagtggtctagagaattatcatacttagatgaggaagtgtgattttccaaccttctgcccctgatttgtttgacctgaggtgagtcattctcttctttgtctgttctcatggtgataataagatctctttttttccctttctaatatagatgttgtgaaaaatgcaataatcttctaactgacctttctccttttacactgtcttctgaaactacctatatatgaacttctgaaaacactgctttacactcactcttcctattcaaaaatccccatgtcttcccatggtatggtattcaaagtcctcccatttttaataccaagcaattgctgattatcttcaatgtgctgtgcactattaataattttaatcttcagactatcatgagcatagctactaatgctcacacccttttaaatataaagagactctttaataacacaagtccgaagacaagcccattggattcttggcttttgctttttctacatgcttattcatgctgttgctgtctagctctttacaaccacacacacacacacgcacgcacacacacatgatcttttctttagaactttatattcccaaactactttcaaaaaggatacgagatgggacaataaaattcagttatacaacaccattacattataaataaa

SEQ ID NO: 53016 - DNA, 1036 bp, Bovine  19866880806226
tacaaccccaataaaactttagtgtagccttgtagctgcttgctaacttaccaaccagaaatttatgttgatcaagaagtaaggctaatttatttggcttttagacttttgagattagaaatatttggttaaattacttgttgaattgggaaatcaattgcacttatgggtaaagcttgtttgggtcctctttcaagtgtgactgaatctgtatttataatttgtctatagtgttgcatggcctgaaatcccattaggacattagagctacagcggcttctgttagtacctgagaagcctgttaccactcccacagtccagctcgatagtaagaaaactgccagggtgcatctctgagatgcctacatgccaaatgaaaatgaatagtaaaggaaatctgtgcaggacactctctgatgtcaaaaactattttctggctgctggtttaattgattgtatatcaagaaaagtttaaaaattaatttggggctttctggtggtccagtgattaagactctgcacttccattgcagggagcccaggttccatccctggatgggtaactgagattccgcatgctctgccatgcagccaaaaaataagcagtcagtgtgtgtatacacatatttttatgaggggtcatttatatgagatcaagtccatcttaaaacaaaaaataactctgaaaatgagactaaacatcaaactttatcaagcacagaggttatcacaacaaaattcttactttataatacagtgctatagtgggaagctagaactttaatagaaaattatgctaaaactagtctttcttatcttttcctttaactttgagaaaaacatatttttcctactttcaaatacattttctgtaattcatcactgtctttcttcattcatttgtttattcaaaatatattattgagtgcctcatgtaggccaggctttcttctgagtacttagagaagcattggggaacaagaagaatccacagcagggattgcattcaggtatgtgtcggagggagaagacttat

SEQ ID NO: 53017 - DNA, 1288 bp, Bovine  19866880824444
cctgactcctagtcagataagcctaaaccctcacactaaaggctccagttcccattaaccaatacatcatgttcagctttcaataaaaaattacagggcatgccaaaaggcacaaaacaggacatcctgtttcccccaagtaaaacagaccaaagagttaaaacaagcatcagaaccagactcagaaatttggaattgaagtgcagtcccaggaggagcaacatctgcttcccatgttagaactgcagatttttagatcctcccctaaatgtgttggatcacaaactctggatggaggaccccagcaacctgttctttaatcagccctccaggggattgtgcttgaagaccactgcagcaagcatatcaagcagatgtagaatttgtgaactcttgtgtttctttagattcttagaaatagaatagtaaaatttttgctatgctaatagcaaggtgattcaaaaataaagaatccactaaagacattgtttataactttgactttcagttttgccaagtaatgttgttgctaatgaattgttttggatgactgtatgcagtttagagttcccccagctgtgtgtttttgtgatacttactacctgacctgggagccttaccgccagtgggcaaccaggcagaggaagtttaaatctggataaagggtacaggatcttgggggaattttcaggacaggattatcacatccctgtggcctcagaagcttttacctatggttagttttttcatgaggtgggtttaggaaaaaggagaggctgttaacatgtgtccttctaaaggaggattatgcttttatttagctcttggctaattcagtgctcaactgccctcgggcctgatcagggttctgcagtcccttgagagtcagttgttaagcctactgttcatcactttgaactcccctgagactctgatttcaaaggtctgcttttaggtttttgatcacattttttcatcctaggtcacctcttatgtggtcatatattgctgcattcctgctcacatactgggagcctgtctcttcttggtgcctcctgttaagtgatgataaatgttttctgtctagccccaaaagaataaaaacttgctattacttgtagaggcctcctattttaacactggagaaaagtaaagcctacagaggtatggtaatgttacttcattcattcatgtgttcaaaaatacttattgaacacctactatatgccaggcgctgtttaataatgtcagtaataatgacaaaaacctgattagaataaagatatca

SEQ ID NO: 53018 - DNA, 1642 bp, Bovine  19866880913566
tttttagagtgtaataataaatgaaagttgaaaagtttattagagaatgtagtgaaacaatttgtctacattgggaataattactggtgaggcacagacttcatgtatggaaagttttttctttatgcataaggaatatttctatcctttctagccaaaaatagtatataaaagcttcagatttctttgtctttaaagaaagaacttgccaagcaagtaaataacaacttagtctctatctaaattatttaaaatcttttaatcttaactgatttgtttttcttatgtgaaaatgtcaaaggaatagtagaaataattccattgaaagagtctggttacaccacacatatttttagttgtggccctgtagccagttttagaattctctgggtatcttcacacttgtctgaaaatgagattttaaaatatgtgatctccatgtttcttttcatcaaaaataagaagagtgtttttgaaatggaaatttctctctaagatgagaagcttcagtgattgttgaactacaccaaggggcaatttgatgtttctccagtagtttttgggctatgtcaaaccttttgaacctttaaaggtgatagaaagaaaatgactcaggataacaatttcaaaatctgcctagctgctggcatgcttggcagaattattttaaccttaaccttatcagaaccttcttttcaacaaagcacattcctttgctatcaagttttcctctatatgccatataatcacaaaaatatgttttgaccttgactccaatttggggaatatatttcatgctatagtccattttaagtacagcctattataatggaagctgatgcatagttaatttctgactagtacttcataaattacttagaccaccttttcctgtgaattaaaagaatgtccattaaagtttctcagagattatgctagcattggctgtgcattttctgcttgtttataggttttgtagtacttctgacagaatgtggtccactggagaggaaatggcaaaccacttcagtattcttcctttgagaaccccatgaacagtatactgaaagaggaactccccaggtcagtaggggcccaatatgctactggagatccgtggagaaataattccagaaagaatgaagggatggagccaaagcaaaaacaatacctagcggtggaagtgactggtgatagaagcaaggtccgatgctgtaaagagcaatattgcataggaacctggaatgtcaggtccatgaatcaaggcaaattggaaatggtcaaacaagagatggtaagagtgaatgtagacattctaggaatcagcgaactaaaatggactggaatgggtgaatttaactcagatgaccattatatccactactgcgggcaggaatccctcggaagaaatggagtagccatcatggtcaacaaaatagtccgaaatgcagtacttggatgcaatctcaaaaatgacagaatgatgtccgttcgtttccaaggcaaaccattcaatattacagtaatccaagtctatgccccaaccagtaacgctgaaaaagctgaagttgaacagttctatgaagacgtacaagaccttttagaactaacacctcccaaaagatgtccttttcattatcag

SEQ ID NO: 53019 - DNA, 1719 bp, Bovine  19866881006190
tacggagtccaggggccaagagggaagtgcctctttgctgctttcttgggtaatggatgagccaatctgaagtcaattcccccaataactggtaggctgggtagtctccttatcccaccccacttttcccagcaaagactgctgctgtgattccttcctgctatcagccattcatagtggggtgtctctccaggaccgttttgcctcagacatgtaaaaatcttctattaaaccactgatgttgaaggagaaaaggaacaggccaagctcactccatcttgaaaaagaaggaaactccatcttatattcccagtgaagtttgtactatgtgcctggtagccaaggagatcatatacctatggccaaacaggcttccctgactgacagacaccagactccataccaagatttcccttcgccagaaagaaagtaataatcccctatgtagtcaatcacctttgtaaccttgatggcacccactggtgtaggttacaatgtacaaccagctgacccttctgattatgaatcatggctgtaacctgactgtatctccccttaacattttccaggctaggtttaaggaatttgggggtgtgggcttaaacacatacacttaaaacatataagagaagtcagtcatggttcctggctaacgaggaaactctgcctcggactgcagtgtaataaactgcactccactatccacactgtccttctgaatgagtttgtatcccggagcgtttggctttaacaatgtctctgttgctgactccaggctctttcttcagtgctggggctgggtaaatacagggcttatggggtatagcccacacaaagcaaaaaagcaaaagaaaggttgtatgaaaaagggtagcaatttgtttatctgaggtttcgctgaatgcctctcatttccttgtgtgtgtgtgtgtgtgtgtgtgtatgtgtgtgtatgtgtgtggtgtcacattcctcatgatggcaagcatttctggatctcttcactgctagataccatttgactcatcagcccaacctggaatacgtttaccattttacttaccatacagtgttttcttggtaagtattgatattcactttgtcttccctgcaagaatatgagattaaggccagaaaggaatatctcggtcctgctcatcattttatcaccactgccatacagaagacctggcacagggtggcatttacttaatttttaccatatccatgaataatagggtttattttattaagatgatttcctctcttatgtacgattgtaatagaacaactgagtttacaaaaaaaataaataaataagttctccatggtacacctccctgaagtggctcaaaaactaaattgaactcagcattcatgaatctgaaattccactggtggggttaaagttctatatcctacattcaatttcaaatacaattgcaaagctaatagctagagtgtgaagaagattttattaatcacaacgttcagttagagcaagactctgctgaaaccaaagcaaataaattataggcatagctaatagggtcaagaagctgctagtaccaaaatcctgggaatatcctctaaatctccaaattacctttaactggcttaagtaactgctttataaatggatagtcacctatgaatagttattctagaatagatgtttccatttctcctctgagaacatgagctgtgaatttcctcttg

SEQ ID NO: 53020 - DNA, 1198 bp, Bovine  19866881021169
aatggactggttggatctccttgcagtccaagggactctcaagagtcttctcccaacaccacagttcaaaagcatcaactcttcggcgctcagctttcttcacagtccaactttcacatccatacatgaccactggaaaaaccatagccttgactagacgaaccgttgttgacaaagtaatgtctctgcttttgaatatgctatctacatttgttattaacttatatcaatacacagtcacatctgagcaatggaaacatctgttcgtttataactattaagttataccgttatctgttatgttaaaaaaaatactgacagattaaattatttatcagaaagccttaatcattgctttttgacagtgccatattatttcctctgactttgaagaacaatggtacatgaatgacataataagatttaaaagcaaatagtgaattatgtctacatacctaaatccctaataggaggaccatttgtgcactgtggataatactgaggtctgaaaacaattgatccttgaatggcacattcccgaaatatttggttaagaacatattgtacggaaagaattcaaactgtcaacagatttgattccttgatgacttttagtcacatcattagctttatattgatataacttttatgttttaacattctaagggttttacacctattaaaataggtcacacatgcaaaactttcaaagctcaacagaccaggaaattcaaactttggttattggagactttattacttcaccataattcacttttctgtcattccataaaatcttattacagataaagtcataataagtgtccacatgagatccaatataatatactcacaaaaagtaagttttcaaaggagagcaatacaaatgtgtcttgttataagtcttttcacattactttactaattactgtcaccttaacatgtataatgtctaccacattatacaaaattattccacgtacttgtgtcatgaaataactatttttactgtgaatatatgtctttaattgatcttggtaaaaatttctggtcaaaatactagttatataactatgaaaaaatatcctgacataaaattcagtattaattatttatcttctaaggggaaagggctgtgaaatgttcttaatcatacacaaattagacatttttacatactttaagtgaaaatatgatt

SEQ ID NO: 53021 - DNA, 1377 bp, Bovine  19866881044886
aaaaagtttaaactcaactttcatttctataaatttatttataaactcttcttccacttccctaaatccattttttgggagtttacatatttgatataggtacaactgtacaaatattctgtattgtgcattattcacttcaacaatctcttttgaacttttcagtgaccaaaagaaccccccagagcttttatttctagtgactttgcagcagcattccattttcttataataacttttttgattatttgtttagttattactttattcttaaacacttgaattgatctcagtcttatgcccttttcaattcaagacatgtctgtacaaatcactttttagttgtttcctttatttccttgaggcataggcccaaggttaaaggttataaacagctttacaactcaagcgagtagcactttcggtgaaacaactgtggtctcatcatgtgatttcctttcatcagagtcagtttcattagtattaatgaaagaataaagaagaatttctctgttgggaaccactcagttgtagccaccacccgtggccactgccaaaaacccattgacattttgctcaaattccctcagatctaggtcctgcaaacatttctcaacggtgagtttgacccattcattcagaatgaaagagttcctctgtgggcagctgtcccatttgccaacctcggcatgttatttgatcataaggccttcaacagactaactgccttaaccccaaagcagacagcaggcactgccctgcagttcctggcccacactcactgacatcaggatgcactctctggagggtgctgtccttacccagctcatccatgagcagtttggctaggggcgtggcatttttggaatttgcatattccattttgtgaaggctgacagcctgacccacccttcctataatgcccaagtccagacagcgtaaactccacttcgctcaaccaataaataccttttgggagagtttactgctacacttggcccctaataaattctcagcacagtagccaaagtgatgtatgtaaatgtaaatcagatcttgtccatcttctgctcagaacacatattgtctccttcccaaagacttcccaaccaaaggactttcagtggctataaggccctctgcagtctggctctctgtgttgtatttgaccacttctcctacctcccacccactttgatctagatacagtggtcctcttgcaactctccaaaacttaagtcccactccaatttgggctttctgccctcattgttctctctagctagaacacacttctttgagagagcaatcagcatacctcactccctttctttaggtgtttggccaaatgccgtatctcagtgaaccttctgtgaa

SEQ ID NO: 53022 - DNA, 1986 bp, Bovine  19866881069355
cttctccaggggatcttccccaacctagggatcgaacccagatctcctgcattgcaggcagattctttaccagctgagtcacaagggaaacccaagaatacttgagtgtgtagcctatcccttctccagtgaatcttccagacccaggaatcaaaccagggtctcctgcattgcaggtaggttctttactaactgagttatcaggaaagccctactgctagtgcagacatgatataatatgcatatattaaatattgcaggtttttgtgttctgtcccaagagtggtttctcttttttggttctggcccactgttttttttttttttttgtagttataaactgtttttgtgtacaaatgttatcatagttattgttgaagtctaaagtatttctagttcagcttgtttagttgtgtattcggaagatgctaaattttctgaaatctattaatgttatcatctacttaatggactgaaaatcttgtatatgagttgcactcttcactcttgaatattggaaatgtgcatcaagtaagtatgatctctgtgttgagaacttattctctgcaaggtattgtgtcaattctgtgatcacaagaggcaacagctgaactcagttggctaaaagtagtttaagctgaatgtgaagtctcccaaaggagtaaaagaaaatatcttactcattttaattttaaattttgtacagttttgtcacaattcccgatgctggaaacatttttaaaaattatatgtcagactgcctagttgagacgtcattttctttttgatgaccagtaagatcttaaaatacatttcattacatttttttctgatttaaatttaaagtactaatttacttcttcagagttaatatcaagaattcaatgtaagttaaaagtttttccaaagattttgactaagtccaagcatttgctctcagagaggaaaggccaagattagctcaatctaccaaaagtaagtagtgtaacaataaaagaatccaaatgtacttgcttatctgaatcaaagcagaaagttgctaatgtgagtttaacttcgtaaatattactacagcacaatatttgaaaaactcaattcaagcacttaaaactgtcagtgaaatcatgtaaagggtccatttaatttttacagagtcaaataatgtttttacttattttcactactgaatagagtttctgttgctttttaaaaattttttattttggaaaacttttacaggtacacattttgcgagaatattctaaggggtcctacataccctaatttttgcttcctctatggttaccattactgtggtacagttgtctcaaccactaggctagtactaatacatgattaactatagtatatattttgatttttgttttcttagttttcacatcttgtcttttctctgtcccagtatccatcttggttaccatgttatacttagtcatcatgtctctataggttgctctacattgacagtttctcagactttccatgtttttgatcactttgacgttttttgggagttctggacagacatttttttaatgatgacctttaatatgtttttctcatgataagaccaagtttattgttttagacaatgtaacagataaagtatcattctcaccataatatcgagggcatatgttattaaaatgtcttatcagtgtctacaatagaatttttctttttttcttgcttccttccatactatactcttgagaaggaggtcattacatacatcccaaggttaagatttgggaagttatattctacctccataaggatggagttcccatcactctactgacattgggaatatggtacaacttaatgtgtcttccagttcaaataaatgatcaataaaatactttaataggtacattttaaatgattgtggagctggtgcaaaataaaatagtttgccaacatgagattcaaaataaaaaagaggacattagttggtaaggatat

SEQ ID NO: 53023 - DNA, 1313 bp, Bovine  19866881069813
attcactaggaatcatgatgtgggtatagagagtaaggcagtcatgatttcctggctgcaaaaattacttggcaatatctatcatatctggccagatattagccactgttctaccacaataggcagatattacctttgaacaagtgtcctactaaacccatacccaacactagttggtatattatccaaatcaagtttgctacttgtaccagctcctagtgcgtgattagtatttgttctaagaattaacactgatgcctctagaaaactttaaactttacttctttcaattaattatggttgtgtatattttttattgaaatatagttgatttacaatgtggtattggtttaatatatgtatatatttgttttcagattcttttcccatataggtttctacaaaatattgagtatagagccccaggccatacaataggttcttatcgtttgtctagtttatatatagtgcttttctggagtgatgtttactgatggccattgaaaaagctgattttgtgtcttattcatcagatgtatgttaaaatggtgtgggcaattttggacagaaaggtagaatttttaattactgtatgtaattataaaatgttgtggagtatatactttcaaagatttattatgaatcatttcagctctattttgaacctaagggacaatattgtacatttgaaacagaaagtgctgggacttacctgagaaagtccctctgtcttattgctgggtggtacctgtgatagaatttctaagatctggcgtgcaagttcaatgttcttcgcattggatgtaaatctgtctaaaaaaatccatggcttctcatatcttaaaacccttttcattgaggatgagtgtcttagaagtcacatctgtgccctgacttcattaatactacctctaacccttaccagcttgcagctcctcacatagccctgtttgctcacctaagagagaaaacagcagatttctggatttgtgtgaactccctatgaagataataggatttacatgtgtatacagaaggagaaaacaggttttgttttactgctacattaactgttctctcattttccctgaaataaaattctatgatcatttccctccagttctgtgggtttgcactgttggcctaatttaactatctttgctttggggctgaggtcccctatgatgcttaaatgcaaaatcaatggttgatgacagatactttgtgttcatttaatatatgaattatattcctctttgcctttttaatagatgagctgtttgccatccagagcatcttcatttccattttca

SEQ ID NO: 53024 - DNA, 1010 bp, Bovine  19866881170552
atttaagtctgaatttgacaataaactcatggtctgagccacagtcagctcccagtcttgtttctgctgactgcatagagcttctccatcttagctgcaaagaatataatcaatataatctgtcatcaatgtaatcaatttataatcaatatacactgtcatataaatgcaaccaatatgtagagccagactcaggcttaaatacaaaactttttttccaagggtttttttaggttttgcctgaaactctgaaattaatatttccagtaactaaaatagggcataatagcaacacatttttttaaattcaattgttcctatccctctatataacccatctttcctagatgtaaatccatagagtgactattacaacagcataactgaatgattagaaaagaaatcagcttttactaatagacgggtagatacagtcataatctatgaccaaaactttgttattcaccattaattgagataaataacaaataccaaatatatagagaaatcaaatatattgagggtaaagatatataagactaatgaacaacagctgcttaaactgatcagttttattacatatttctattttctgttgtttatatggaccagacttagtatataaaggtataattgcctctctctttcattaaacaatagttttacaacattgagaaaatttacgaattacaagtatttggttcttcaaactgagtctcctattatttgtctattctccttaggatggcatttttccatttctgaacattactgctgctgtaggccattcaataaaaatattatttctaccctgtaaatgtctattctgatttacttttacattgtttctttaacctcgatttagttttatcctacggcaatgttttgagctgaaaagggtaacttaacttggcattttacctataagaattactgacgtgaagatgtcacagttttaaaccaagggcagcatgattaaaataaaagagtaagaagaaaagagttagcgt

SEQ ID NO: 53025 - DNA, 1001 bp, Bovine  19866881223896
gggagcgtgaattctaaaatgcatgtgtatgttttctgctgtatctttttctgaattatccatatgtttttgtttggcctatgagaatacttgtttcttatcccagcctgtggttaaacaaatcataatgccctgaataattacatatgcagtacaatttcaccttcctcagacaatagattataaattgacagtatcatatacttgagattgatcttgagttgatctcgaaatgtcccataaagtataatatcagaacaacccaaattagttttatatggatacttttccttcttgtttctttgagtgagcaccagatgaagcatctggcttatttttaggggccatatgatacaaaacaaacacacacagaaacatatagcaactttaaacactagaattagaattaacacaggtcatgtgtacaagacgtgacacaagggacccagactacactgggaagggcagcttcttgtcaaatcatgatcatgctggctgatcagttttgagtaaaagagtgacagggggtcacttgtattatttaaatagttatttctttttcccttttttgtttcaaaatgaacagaattgaaccagcctaattaaatgtgtaaacgttaccagtctactatatgttttcaaaaagaaaatcaccccgtattactctttatgtcaacaagtactaagtgtaaaatgaaatactgactaggtataatattttgatggtaaccaatatggtccgaaggtttgtgccactctgcaattcatttattaaaatcctaacctcctaagacaatggtattaggaggtgggcccttgagggctgcttaagtcatgaggttgaagcccccatgaatgggactggtgccttattacagaggctccagaggtatgtctggtcccttccaccatgtgaagatagaacaagaaatttatgactgggaagagaatcctcatctaaccatgctagcaccctggtctcagactttcagcgtctagat

SEQ ID NO: 53026 - DNA, 1020 bp, Bovine  19866881269027
ttggtacactgagtttgaagaagcaataaaaacaaccccaattggtcagaagaggcaaaataacaagactgatgggtatgtctggagaactcagtagcacgcaggatgtggattcaccgtgcagcgcatgaggcgaatagcctctctgtcactaagattgtcatcatgggtataactcactgagaaccgagaaccccctctgctgtctagtatttcaaagccctttatttatttgttcagaggttcatcacataaatggacagcttataattgtaggtgtagtaccaaccattaaagcaaatatatttagagcccctgtaattatattctggtaaaagttgttctggatgacttagcaggactcttctctgggtagtatgtttacttgggtattttctccaatgatgcagaacagcttctagtccaaactttctcctgatgatacatttatttctggcatgaccttctctttcaagttcaaaagaaaaaaaaaaaaaacaatttatagaaacatgtagagtggtagataaatgtaatatactccaggaacttattgatttattgagcaacagtcacattttgaaagatctataattcaaaggtgatgaaagaaggaaggcacagtaaatatgacgttaaataaagtgtatgttcgggcatgatggttgaattcttaccctgatgtccttgttcttagacattcttggacagatttttctattgcttaagcatttatgtagaataattgagtcatagatgttatgtaacagaaatgctgtattacaacctttctgttcagtgacaacatgagctttctcttgagagtgttttaaagcttaattaagtcatttttgggcaaattgagtttcaggcaaattgaaaggtatctaaattctttcagatcaccttggtaccgattagtgtcctggtgtgttaatttgccaaatggacacccagggaaaagaaataattaagtcaataaagaaagtaagtaaacgcttacttatacataagaacatc

SEQ ID NO: 53027 - DNA, 892 bp, Bovine  19866881284554
tttagagtaagcatttgactaatttaaataagctcaaagctgaaagctgagatcttatacagtccagatttttattcagtgtgtttctgggagaagtcttttccagacaatatgggacaatcagagtgggaaggagttttgctccctaggatccttttccaaaaggtaattgcagaagaacaagtaaaactctgttattcttctacatagttcaataatatgaatctttgaacatatatcagtgatagcctttcttttatttcaatgcgttcatcaagtaagaagaaaaaaagactttctgagaatatattaatatatcattaatttcattcaaccaatgttttctgagtactcttcctatgccaggtactgctcaaagatctagaaatcatatttctcaaattttgagatatattagtgaacagaagaaaaaaattctgccttcatcatgtacactaagctgaataatactttgtgataatgtgacttcaaactatactgaaagagtatcatgaagaagactttttctaagtaatgacataaagaaagtgcacaaaatcatttctaactttgagggaataaaacaacatgaactaagtgataattgggtccttttcctctgtcaattgtgtggcataatatttcagtttccaaatgtagttcctgaattatgtttccacactataaagtttacagaacaatttgtaattctctgtatatcagattctttttggctctgtccctttacacttgtcctgatactcaaataatatagctttcctactttcaatcttacctctcctttacgtggttaatgattattatttttcagaactcagacagcaattccttcaggaaacctactaagtcctcaatattccccatcatacca

SEQ ID NO: 53028 - DNA, 1255 bp, Bovine  19866881310412
attgatatgagaacttaataaatgtaaaagcttagatccatacacagttgtttttttttttttttattcttgtgtatttaatcttgacactttaaacaatatgctaaaacctgaaactaacacacagaagaatgtagaatcaatacctgttcacagtttagtggaaaagacagataaatagatgattcctataagcatgttgtttgctacagagaatgttactggaatgtttaagaggggcatgcaatccaaagcagaaggcttcctctgagaagtaatatcacggaaaaggaagactccttttgggaagatcaaattccagttatgtgggccaagatccaaagccagaggttaacaacactggtttcttctttccatctccaacgtagcatgctgtgaaatttatcttttaattctgcgttaaagatcccagtttctgtatccatttctagtattctatctgatggagacattaaatgcttcctgtcttctaggagctatggagaaattataataatttttttataaaacacactgaaaactcatttgtaaaatctccattgagaatagaatggctaatccttgaataagtaacttcataagccaaaggaaaaaagacaaattttagaaagctattctgtaaatcccagctctggcttttattggccatttattagactttttcttgaaaaggggaatttttaaagttttaaatggaaacctttgaataaaagagataaagaaggcaaaactaatttctgcatgcactgagatagcatttaatagtttaattaagatgcagattaagtggtagatataaaaccttactattctgggttctaaccggggagttaagaagattgtattttcattttgagcaaacagatgcaaacaaaggaaatcctagttgataaagagtggtgttgccagaatggtaaattacctgtaatatgtacaatcgtcctttgaccatttttttgtaacttcagagcttttaaaaaaaatttgtagttcatatctaatatatttttgaggtctttcataatttcagatatagcaaaaaagtaaacttcagagacttgcctttaactataattggctacaaattattttatttatagatagagtacttacatggttagcccctgacttttttcaaagtttttccttgtcttcaaacacataataaatttatcatcttaaccatttttaagtgtatgcttcagttatattgcatataatcatattgtgcaaa

SEQ ID NO: 53029 - DNA, 1049 bp, Bovine  19866881359441
ataagaatgtaatgtatagtgtaaggtatatgatcactagtataatagctttctataaagttatatggttattagaagtcatgatcagtttatattttcataggtcaaattattatttagtatactacaaactgacaaaatactaatttcaataaaattaatttaatttttacttctttttaacttaaaaagtgaatctgcaagtcctaagtcctaaaaatttcaaacatcacagtccctttaaagattctaaactagtagtagtcaggactaactaggaaaaaggcatactcagccaacacctgtggcttttgatggaaaagggctgtttcatcttgatcctgaggtggacagagaggtatgtttgcagaaagtcaccagtgatcagtacagccctttataacctcccctctattgaagacaaactgacaatatatctaaagacatagactcgtgggttttcatctttctgctttctttctctcagttttacctctcctccatgcagcccaatgcagcctctacctggatcattccactgtagtctgggtgccagcttcagctctacttatacgatagctgcatcaaagtctaagaggaactatgttggcaatgattgccaggccaactgtagcagctactggggaaagaattgagagctaaatctaagcccatagaatgtaggaagacaaaagttaggtgcaatcctaccagatggagcaacagagctaagattgaagagcagagggtagatttcaacaaggtcagaaataaaatccaactatgacaacaatataatacatatggagaaatggaaattttggagggtcttaaaagcagccagagccctcaaagacccaccatcaaacttgatttattataacaaatctagtttctaggttatgacagacctgagcaaacagtaggttatccgtaatcattggtaaagcattctcatactattcacccatgctacttttctaaacaatatgtatctacaaataagctcttttgggagtttttttagaatcatccatattgagaaaaaa

SEQ ID NO: 53030 - DNA, 1004 bp, Bovine  19866881399800
gctagtcttgacctagttttcagaggagccactaaaaatgattaattgagccttctttatagagtactttaaaagtatatagttgttctgcatgtaggaaaaacctatcacaatttttaaaaagatgtttaaaaataggtgggaaatccaagatgcaaatagggacttgctaatgctgaataagacagaaggacatatttttctcagtcagttttactagattttaagtaaagcttatttaattatgaaaatctatttaatcagtgatggaaacatttcattttagtgagtgtctaattgtagggaagcttcacagcacaatcatgacctctttctgctgtgctcagctcaagactacctttaatgaaatgtgacgatggagcagttcccttgattaaagcactttgataaataaataagtagctagacaaatttgccagctagggggaaaaaggaacaaatggagctgtaaatcctagaagaatagttttattgtttcaaaaaactttttatggtttatttaagttgtgcttctctagttacaatagtttgtagcattccattgtgtttaatagcacttgctttgattgtatcattatcatagttaacaagttgctctaatatctaccttacagtatctttttaataatgtgaaagataattggaagctgtttgcttttctatccctataaagaggcccatagcagtcagaatctgggagaagattcatttctagaaaatttatattttatagcccctgatctacttataactacttataaatctatttcagatttatgtaagggcggttaaattctgcacagtcacccattctgattgccctctcagaaattttaatatttgcattccgtgtgggcagcagagagagagaaatttttccacttttgttcttggttagatccacagcattgaagagaaaatttttgaaagatttcagtcttcttgtataccagaatttgggggaaacctctgatcttaccctg

SEQ ID NO: 53031 - DNA, 1249 bp, Bovine  19866881410608
attgaagggcttcattgtcagaaagtattactaatgcatataattatggctttagattatcaagaaggtctaaagacattttattttaatacttgctattcaattgcattggtgacatttgctaataacctaaggaagttacctactgtgatggtgagttttgagttgtaaagtttagcattttgacatgcaatggcagtaatgtgtataatgcacataaagagagcaagaatcaataaacacgccaatttaaaaatgttaaaaacctgaaatattcctcaataactccattaggaaagacaaaatataatggacagtagcaattatttcttgacagactgcccaatagcttctgtggcaaaattgccacaattcacacttaaaaaattaggagaatcctggcagattgaggttggcaggtaaactaattctgcaaagtagtaaacatggctgggttaattgctgtagcttcactatctttcagagctgtgttttcttacttggtgtactgattaaaaaataaaaatttcagtatttttccagtctttagagaactacctggtatgattcagaagatattggatattcagtctctgatatttttcagttattcctcaagcatcctttctggacagtgagatgaaaagcctagtgtcttactaccagatgttaggttttttatgcatacaattaaaacacttggtggccagtttattttgttatttggagaaagaagaaagatggctcagctttagaagtttccatctactccagtatggggctttggctcaaagacagtggtctcaagattactactgaagttaatctatttattgggcagactgggattttatgaatacacattgaaaaagttgctttagttttttcctcatgaaagtaacaaatgttcattatagaaaacttgatttgaagaggaaaactaaattaaaaaatctcttcataggaagaaaactattgatattttaattttattttaaaaattttttctgtgcagagactttttttatatacagttgtccatccatatgttccattttggacatttttttttttcagctgaacattctgacctaacaatgtctcatgttaattcaaattacagctattaatgagtacgagagttcttttgagtggggtgtttcctgtcttacttagccattatcatatggttgaatattaaaattttcaatcaaaaattttttcacttttcaagtgaaaagtttacaat

SEQ ID NO: 53032 - DNA, 1164 bp, Bovine  19866881659024
tgatggcagaagaccttgccgaaagtatttagaagcaaaggaagcctgggctccatgggagaactgcccatcaattgagcagacgacggttctccagtcgtgctggtcaggtatgtcatgagggctccaattggagctggcctggcccaatcacctttctcaggccaataggtgagaaggggcagctatggtctgatggctccctaacgttagttggcttgctcagtccaccctgggccagggcattggtagaatgggctttctgaccactaggaatcaaagccctgaggaaatctggctcagtgtgaatgaaatgattgactttgtcctttaatcattattataagctactactttgtatatagttcttggtatgtactcacttcttaaagggatactcaggagccataggatctttgtttttgaaaacaacatgtttttctttttttttaaattgaagtatggttgagccacaatgttttgttagtttcaggtgtaccacaaagtgattaagttatacatacatgcctatctatttttttacatttctttatcccatagattactgagtatatttgcctgtgctatatagtaggtccttgttggttatctatcatactgtctaggttttgaccttgttctgccacttaccaactatgtgaccttatgtaaattacttaatctctccgaacctatctcttcatctataaacttggggtgataacaatactggatacctatatatttattgagcagcttaagtgaaataatacaggtaaaatggtgaacagaaactattgcaaaataagcacagtaaataatagttttaatacttttatcatatataatgtttctttctcatttttattatttatttctttaaaagttattagatgtgtgtgttatgagaaatattgtataaactatttctctgataagaagactaaagttgagagaaattaaataatcaaatgaaggtatataatattggaatatccttttactaaaataaaaccagtcagttttgagtaatatacaattttctggactctataagaaagttattatataagtctgtccattaataacagtctgtgttgtatggtcagcattattttttatcagaagtcattgcagagttaatcagggattaacctgtatgtg

SEQ ID NO: 53033 - DNA, 680 bp, Bovine  19866881682006
tgatgacatgccacactattttttcctgtaccagaaacaccagccatcttaaatttttatcgttctataaaatttctagtgtgttgacttgatgctgaattgtatttgatattagattattgttatcatattttatgttatccctttttaccagatctatgttacaaagaacagttttcttcaactgaaaggctaaaataaaacttgatatgttcatttatgttgaaattcatcagaacataatataccttgattgggaacttctggtatataaagcattctacttggtatattattactgatatgtgagaataggagtatgaaaatgaacatgatataaattccactctaaataatgttaaattcaatatggccaagtgagtaacagtactaggcagccaataatataatgaaggagaacaatctgaaaactacagacagcttggattccataatgaaatatatttggaagctgcaaactaagaatttgacatttatacttgataacatttctgttcttattgccttctatatttcttcaataatatgtttataaaatctgtgcaagtgagttaaataaagcaatgaatttgagatgttttatataggtaatccaaagcctaaatccactcacaaggagaatgaaggcaaaaaatcataacttctgttttagcattcag

SEQ ID NO: 53034 - DNA, 1015 bp, Bovine  19866881694155
attgttttattaattcctatttaagagaaaaattaatatgacataattttgtattagtttgccagtgaaatattcttacataacattcaatccagtgggaaaaattctgtgtagaataagacaaactaagttgctacaaagactatgagagaaaagaagaaaaacagactgtataattctatcaaataaaatcctttacttaaaataaaatccttgacttaacttctataacctatttcttcaaaacattcagaaacagaccctacagttgatggatagaaaagtgttaaagaaatgtaacagtgtctctgcaggtaattgatttactttagtagtgaaaaactatcactgactttactaaagtttcaatttgcttttcagccactgcaattttaagaaattaatttttcactgcagttttagaaagtataactcagaccaagagagaaataaagaagtaaagatcatgctttaacaagaatatttccttattttgacatatacatctggaagcatacatcaccctgcttagaagagtctgtctctgatttaggagaccaactctatgatttggaaagacgcaagccctatagcaataactctaatgaaaataggacttgaaactagaatgaaaaaattatatacacttctgtttgagggttatgattattgccataaacaaaaatagctaccctgaagcatcaataaatgtaaggagaaagccaagtgttcaggggtctgaaagaaatcaacaggtacctaatgatggccttgtatagacatgtgaatgttattgttttccttctaagtagacagacaatgctgtttctttatctattaaaatggagagcttcaagaggagataaatctatgaatgcattgaaaacatgaaccatgagatattaattgctatatttaatgtctaaaactaagggaataagatatcactttaaagaaaaatttgtgatcagcttggtttctctgggttccaagacttatgcaaaaatttaggcaa

SEQ ID NO: 53035 - DNA, 915 bp, Bovine  19866882024376
aattaatgacttaaagtatcaccctttaatcctataatttatttctatttattaggcattcctaaatgatgcggcaatgacaatattttttttatgaataagctaactttatgattcatcaggctttgctgctgctaagtcgcttcagtcgtgtccgactctgtgcgaccccatagacggcagcccaccaaggctccccccggtccctgggattctccaggcaagaacactggagtgggttgccatttccttctccaatgcatgaaaatgaaaagtgaaagtgaagtcgctcagtcatgtccgactcttcgcgatcccatggactgcagcctaccaggctcctccttccatgggattttccaggcaagagtattggagtggagtgccattgccttctccaacatcaggctttaggcagccaaaatgtattaaccaacaaaagatgggagcttgaaattacctgccatccagattagtggcttgtacagctgcaaatactttggttttcaaaggtagtcctatacttgggataattaactgctgattgtaggtcgaatcctaataataaaaaataaataagcaattaacccgtcattgccttcccaacaacagcacgtttacttaagacaataatggcctattaaaaaaaagagagagcaaatcaacataaatttactgaaccatctcctaaaaggacctagttaatcctctagtttttggcagaactgttcttaaatcatatccaagtaacaaactcacttccatgcataaatcttttcatgtccatagtttatcatttatgatgatttatgttcaatgtgtttaaattacatgcaatggttactagtaagaggttagtatttagtttggctaatattcaactataactattcagttatttaaattcatatttca

SEQ ID NO: 53036 - DNA, 1006 bp, Bovine  19866882028256
tgttattatgagatccttgatttttgcatttcctgacttctgtgtttaaatgtataaccttaatgttgcattattgttgtgtcttacattagttattgatggcttgtaaatgaaatagatgccttagcaggtcttttcttcttccaacttccgtagataatttctgcagacattttatgaaccaatattacagaggctctataaaaactgtaatggaaaacaacgcaatttttgctgaaatgtatgggaggttctaaaaggtttttcactttgtaacaattatgttgaatctctttgaaaggttgttacttgttttgcttctttatgtcatcacatctattttatcttttactaaaaacatatttcaaaaattaaagttccacagcaatttccaacttatcaaggaattaaatgcagccttataagatctgcgttatgttctctctaaaattcactgaggcccctgacaaaggacagagtgagccagtacttaaaagtatgctaattgtaaaatcatttctttgacacgtgattttctattgacacatttcattggtaaatggtaaaatgatgacagattaaatgccaaagatatttctaattaaaatttttaccaactcaaagctctagctttcaaacacagtaagtaatttaaccaaaaaaaaaaaaaaaaagaaaatccacagaacaatgtgtggatatgaatctatctccttgtggatcaagtaaggaagattcctgccatgtctactttttcccagacagctccccacccactactgccaccggtaagcagaattcaaaaatctcaaaattacactgtttttcctgtccaaaatactcttattcttcagagtacattgataaaagtttcaatatgagcagtcattgaatataaaattagagatatactggaaatatctaatgtaaaagcaactctgagcaaatgatactttggccagattctatgattttacaggcacattgagctcatggaacaacacca

SEQ ID NO: 53037 - DNA, 2548 bp, Bovine  19866880752293
aacgctggagtgggttgccatttccttctccattgcatgaaagtgaaagtgaagtcgctcagtcgtgtccgactcttagcgaccccagggactgcagcctaccaggctcctccatccatgggattttctaggcaaaagtactggagtggggtgccagtgccttctccgtatatatgcgttagtatactgtattggtctttttctttctggcttacttcactctgtataataggctccagtttcatccacctcattagaactgattcaaatgtattctttttaatggctgagtaatactccattgtgtatatgtaccacggctttcttatccattcatctgctgatggacatctaggttgcttccatgccctggctattataaacagtgctgcgatgaacattggggtacacgtgtctctttcaattctggtttcctcagtgtgtatgcccagcagtgggattgctggatcacaaggcagttctatttccagttttttaaggaatctccacactgttctccatagttttttaccattgttaacgaaagtttgtaagaaagccgatgttgttctgagttgcccctaaaatgtgtaagaaatctatttgctgtcatactgacaatgacagtatagtgttcatattgtcacaatattcctggtagattatacttgtcatagtgaagtctattttgtcataggttaagaaaacaatacagggcacatgaatcacagaggatgcaaaactggtcagcatagttcgtgcagtgttctacatgaccgtctactctggatgaatgtgaggatgatatgattgctaaaatccttttaagttgtgatatttgatgatttcatacatttttgacatggcagaaaatactaaaggctttggactgattgtcatcatttccttttcaaaaaaagtgtttctgtgaacaatgaagttaatgctggccaagtgccgtttttctaactgagggcctatctcaaaaggaagagacgtatattgacatttttcaaccagccagccttccagcccatgaaatagaatcaatcatattatgcagattaattgagccctggaacattcgtaatctgagaattctgggtgaaatctttagaagcctttccagtcattttcagacaggctgggacccgggacttgggacattttactatggtgcttgcatctggataaacttctcctgggatcaacagaatacaaaccataagggcctaaaaataaccgcctgcatgtgcagttgcaacaaattatgaacaataagatacaaaaagaccaaaatccaactgccatttctgaggttccaggagcaaaagcaaaaatgatccctgcacacagcaccaccaagcgggtgggaaaccacccaagtcacccctcctgccagacccctggacctgctcctacccttaccccatttaagggaccagctcacccgcttctcagggaagaagcaaaacctgttgtctcagggaaaaaacaagcctgtttgttctcgctccctcgtgctgcagcacaagtcctggtaaacccttccctggatttctcctctggcctcctctcaatttctattaattaaaaagcccaggcttcccaggtggcacagtagtaaagaagtcgcctgccaatgcaggagatgcaagagacgtgggttctattcctagatcgggaagattcccctggagtaggaaatggcaacccactccagtattcttgcctgggaaatcctatggacagaggagcctggtgggctacagtccatggggttgcaaagagtcagacacgactgagcacacccacacgcacaccaggaacctaggtcaataacagtttgggtcaatgtgatagtaggctttatgagtcccaacctagagaccttagaaagcatttactttaaatctgccattttatgtggaaatcaaggcagaagaaattctggagatttgattaaagacccagaggaagcaatatgctgacctagaaccatatcaagtcccattttgcctcctgcaccaagggctctttccaatctccatttcccccaaattcctgaacacaacaacttcccttcactgtcaagaaatgaatggacttaagtggctttgatcacagaaaaaaaaaaaaaaacaaactctaagacaaaaactctctggactctccaccaccagctcagaatggacagccgccctttgttcctcccttcctgctagagtggagaggaggcccctgctttcctaggtttatatcttcacccgtgcttctcctcaaaacagttttctcctcaaaactgccatgaaccaccaatctcccttctgggaattttggtcaactgattatccccttgctgtactgaggcttttccacactcaaggaaatttcagctttatcagttatgttttatgcctcttagtaaaaagaaaaaagatttgaactaaatataagtaagtgttcagatttgttgattctagtgatgggtacaggaaatttattattttagcctctatactttttctatctacttttttttccttca

SEQ ID NO: 53038 - DNA, 702 bp, Bovine  19866882158678
ttccacacatggttcagctatatttatccacacataaatctttgagtgagtaaacaaatggtcaaaaacacatctaatcatctgattacagcacatgaaaacagttataaaaattgcaatgtttctgagcatttatttacttaaagttcagaataggaaacacatgtttaattcaacctgtgccgaagattctaatattcagtaaacaatagtttaccattgtaaacaataatttacaggtctactgcataggagccaaactttaggcaccatattcgaatctagctccaccatctctcagcttctgtcttaccttactcttctctttaattcttagcacagttagaaaaaattctcttcatgtcctatacttggaagctctgtcttcacttggaccttcttcagatctttgtttttcaaatggcttatcaataaatgtcttctgaataaaaataaagtgctctcaatgaaagattccatgtaatttcttccacctcatttcaaagcacattcaaatcgacagagcaatataaagtatagagctttatatccagatattgataatgattgtcatcagaaaaaattttaaaattttaggcattgatcaaagatgtaggaaaactttggggggggcctctaaaaaagtcacaccacttattaagtagaatctgctttcatgtaaataacatggtccagaattcc

SEQ ID NO: 53039 - DNA, 1898 bp, Bovine  19866880370033
gctcctatcggccaaggaacagtgctcgcctgcctcttgctctctgactgttaacttcattattctccatcaacacatcccagcaggaagtaaaactacttctatacttgtaataaatacaaagaagagagaatgtcaccactaaatatcaagttccaggcatgtgagattttactgagattttatttcttaaaagtcaataaattttacaacttataaatattaatgagttcgtcgcctttgcttaagcctgacctacgtgggcgacagtgataaacactgaagaacatttccatcttgtaaacaagagagctaaatataaacaagacttgaccctcaaaaccaggaaatctgatagggaattctctgtcaggtgtttgatatactgtatattcttctataatctcaaaaattatttggaggggaaaaaagggaaggcaaatatgaaagagaaaaaaattttcgacccaaatgatcaaactgaatgtgttaaattgtcagcaagactttgaactaaagcaatcattctgctataatagagcattagatgacttgaaggcttttgattttaaattttatctaaagcccgtcaactttttctccttgacacttctggtgtcctttcatctccaagggagctccccgactgtctaattaatacatctgaactttaattatataatgtacctttattgttggcacaacttcctggaagtttacaaaaacattatcttggtgtttggttagatggtctgcttaaaagattctaccattgatcaataatccgaggttttcatttttctcacaaacttctctcacacatacacaaatgcacaaatttgacagggaagaaccaacagcagacgggtctgttctaggagagaccctgttgatttaagctgagggtgccagcaaactactagtgaaagcagcctcacacaagcgccaaaaggaacctgttaaaaaaaaaattcattctcctccaagaagcagaaatgattaaattaatcatttcaaacggcctttttagaagaacagacagtacgtgcagtcgagatttgtggatacttgcttatggaggccacaggcggggaagcattttgtgacccggcggaccacaggatgcacgcacgccctgtggcagatgcaggtgaggtggggacgcaaggtgagcgagggcacgggtccctcaagacatcctgctctgcccacgccccagctcagctgcacccagagacgtgtcttctttgttctgattcagtgacgatatttatcactcaaaaggaacatctgtagctgggagacctcccctgatatactataaagctatttctgttcctatttctaaatgcattggcacaaaatgtgtgatgtccaccacacaatcaaagtgcacctggaggtgatttgaaactacgattacggacacggagaggtacagagactaacgagggcagagatttcagaaaaaaaggtcaccaatccctttcagtttgtgaaaatcacacactttcaattatttttaccactactggggtaatttgtccttcacatgtggctcaagtgacctaaatgaattagattctgttaccaggtataatgcttagatcacttctagtgttaagagcaatgtgaggtcactatttaagaaaatacagagtggagctaataagctatttgacacatagaggctaaaagaacaaaaccaattggggctgaggcactaactagatagattctctaagtaaagaagttacttccagagaattaaacattttaaaggcatgttaactctgagtttgtaaagaacttttgaaagttactgtagtagtgcaatcaattggctttgaaaagaaaacctacttaccatcttctcaaattgctagaatattttatca

SEQ ID NO: 53040 - DNA, 936 bp, Bovine  19866880459676
tttatgcctaatcggtttcatcccatgaagctgaatacagatagaaacagggtcagagctcagggccccctgagccccaggtcacagacgtttggcagctccacctcaaatcacatcaaacgcaaagatgcatcccggttaaattggattgttttgctataaagttttttggtttttttttttttaatgattttcattttgcttttgaaattactaatgatttaaaaaaatttttctctcataacattagaacctctatttcttttaaagccttagatttttagagacaatttaaaagcttgtgggttctactccctgaaatttcagtgcccaaaggggcctcctggcctgccctttcttcctgttttcattctgcctatctctgatagaagatttgaaacaatttatgaatcagtgctcaaaattgacagcaagaggtgtgtgtgcgagagtgtgtgtgtgtacagaaacacacagccacgtatgtgagtttccttttccagcagggacgtttgtctacatgcagataatgcagaagccctaaataagaactcaagaaggacaaagtagtacccaccaggtgcagaacgacttaatccgtgtgtctactctgtagctggctttctagtcccctggctttttcctcccctccggaaggcaaatagacggtcgtctttctcacattcactaactctgtgttttgtttcccagctctgaaggacagcaggttccagctgctgaatttttcgagcagtgaactgaaagtgtcgctgacaaatgtctccatttctgatgaaggaagatacttctgccagctctacactgaccccccgcagggaaagttacaccacaatcacagtcctgggtaaggaatgcatcaaggcttgtcctcggagatgagaggggtagcacttactgccaggtggcttccagcag

SEQ ID NO: 53041 - DNA, 1786 bp, Bovine  19866880464997
attcctggtcatcttagagcccggcggatccaagagttgaaagtgctagagatgtctgactttataataattctgcttctcagaagtgcaaattacacaggaattggtgctaaactctccattaactacagagtccaaggaacctttagtttcccaaattacctgtcagtttctctgcgacgccatataattctgtcgtttaaggggggaaaaatggttgtaatttgaaatttcagtgaaatttctaattgaatctgcatttaactttgaagacttgatgttcctccatttcagcaatgggttgagtcacattggaaatttcagtttcaccttcccctgaattccacagctcctttcttcctctctcaattgggagcacttattatggtagcaccagctgctcatacaatcttcatcctgaaacaagaccttcagagattcaatccacctgctgctgcctcagtaatgggggaaaaggggggagtaagaagggagaactaagctcagattatgtttaaaaaataatttattccccttttaaaaaattgtaaatgataatacatcataattattcttggtaataaattcaagtgactgagagtcttaatagtgatagagatataggatgttttggttttgtggtttttcaagctttctccctgaggaaactctggagtgtacagagagatggagcagggaaaggggagtgtcttattttctaccctcgtttgaaccagaagaattctattttttattgaggtatagttgatgaaaaatattatgttattttcagatgtacagcatagccattcagtattttttcatattgtactccattaaaagttattacaagataatggctatgattccttgtgctaaatagtatatctttgttgcttatctattttatactttgggtttatatctgttaatctcccgcttccagtttgtcacttcccccttctctcttccctttgataaccacaattttgtttcctgtatctctctacttctgttctgtatatacttttatttgcattatttttcagatgccacgtataagtgatatcttacagtatttgtctttctctttctgatttatttcaccatgtgtaatattctctaggttcattcatattgctgaaaatagcattcttttttatggctaagtgatactccattgtatacaccatatcttcctctaatctaatcacatttaatcacatcttgtccatctaatcccatctattgacaagcacttggtttgcttggctactgtaaatagtgctgctacaaacattggggtgcgtgtatctttcagaattagtgtttttactttttccagatatatatccatgagtagaaatactgggtcacatggaactcagtacagctaattaatataattaaaagtgaagtttttctggttgaaattgtctgtttgatttttgctcaagagttcacttaaagcaagagttccctagcttggaaaggtggacagagtttgaagtctattgaatatacattatattataacttgggaaactgagaccagagagagaactttaagtctctatctgatgctgatgctatctgctcatttatcccacaaatatttggggggagccacttgtgctaggcgtgttctaggcactggagtacagcagtgaactaacccatctttatcctcagagagtttacattttaacgggaggtgacagacaatgaaccagatgtcaatatacactcggtcgtgtttgtctgtgctcagttgctaagttgtgtc

SEQ ID NO: 53042 - DNA, 928 bp, Bovine  19866880535645
attgagaagttgttttgcatcttagttattttgctcctggtttacatttttgcttctaaggaactgtttgtgcagtatgcttctgaaaggctcaatgtgagaagtagattacactgaattatctaaaatgtgaaatcaaaagtttttttctgcttacgaggctattaattaccagactataattagttatcaatacctttgacaaggtataaccttctttgctaaatccagggtaacagtatgtcattttcctttattttaaagagagcaatagaaatacatgtttcttgtatggcaagaaaagagtgtttaggatttgtgaatgtgagaacacagatgggtgagagtgacttaatccagatggtttatgcaaggaacttagtaagaggtgagagtgatgctaatgtggcagtgaataataaattggcatttcaatattggcaaactggggaattgtgaagaatgtcatatttagttaacttctgatttttaaaaaccaagctgtacattggtaggttaatacctgggaagtgtgtgcatacgtgcatgtgcatgcgtgcacacacacacacacacctataaatgtgtagtttttgagaattatctttaatgacttcagtctaggcactctgtgatttttcttgtttttaaaaactgagatgtaattgttacataatatattaatttcaggtgtacaacatgatttgatattcatacacattgcaaaatggtcaccatagtaagtctagttaatatccatcaccaacatagttagagcaatttttctcttttttttcttgtgttcagtacttttttaacatggcactctgttcttaaatggcttcccttgtagctgagctggtaaagaatccgcgtgcattgtaggagacctgagttagatttccgggtcaggaagattccctaagaa

SEQ ID NO: 53043 - DNA, 963 bp, Bovine  19866880587206
ataaggataagcaattttaaatagcaaataagccccttagctaccaaatttctaaaaagtgttctccttgctctaaaggtaggagggggaataattggcccatgggcccagaaactgaatgacaagttttggtcctaagcaaattttcagtcaacagagtcctttaaaaaactagaaggaggaggtggtaaatgttggtattggcaacagcttaaacaaaagccacactttttttttttcatgtgaacactgggaataagaaggaagcaatgatgttccccttaaaaaaaaatagcaatccaaatgtattaacttccctctgcctaaagaaaatgtgtcaatcttagtttctcaaacaacatattttccccaacacaatagctcatttctttatactacagctagttggccatccccgatcagctgaaatcactgcacagctcaagatctgggactgaaaccaaaaggaataaatcagtgaaggcctgaatttctatcccaccaagcaggccagactctcctaagatgaggagcagccaaaagcagcaggggagttcacaactgtgctggtcagtgatctaaaattacatgacatgggaaaggtacgttcccatcaaaatcccgggaaatctcctttaatcttccctttactacgctatattgcatcgcaaaggttctatgtagctcctcctcctagcacttttgcagaaccaaatctactctaagaaaattagtgaagacatcactcttatgtggaagggctttctaagtaatcaaagtcctgcaataaaggaagtcagcattatttcactgcacagaagctgggggcaggggggagatgttggccagaaaatacttcactccaaacagaaaagttacgttttgaaattgttccaagaagaggatattggcaggaacttcaagattttgtgctttttgctgctactaaaatgaaatagattt

SEQ ID NO: 53044 - DNA, 992 bp, Bovine  19866880611176
ctgatttgatgtgtgtaggacactgcacattcattgagtgatacagattgtgttaaatgggcctgaaataatgttcaggaaagagaatcactttctattcttcttgacacaaacagtttgtcacagatatgcgttcctatccctatcttgttagtatagtcgttatatgcaaataattctagttttccttgattaggtttacatgaatacattgcagttgtgggctaggtgttattaatatatgtgattaaacttgtaattaatatgtgtaattacatagtgagaggtatactgtgctgggctctatgctgatttactgtataaatgctgcatgcacaaagacatggttagaacgttatgctcaatgtttactcccacagtaaatcggcagtggtttgtcgttggggcacatgctctttcatttgaatgcaggagaagcacttttatgggcttgggagtgactgggtcatgattgtcttttactgtggctctgtcaaatattctacccagggagcccacggaagaaaggtttggcatgatgttatggtccttcctgagtgtgtgaaccctgtgctaggcttagcccaacttgagaatatacagattttttattttcgcaaattttattttactcaagtatagttgatttgcagtgttgtgttaattcctgctgtggagcaacatgattcagtcttatatacatatttatatatatatgtatacatatatatataaacacattccttttcatattcttttcaattatggtttatcacaggatgtttatatagttccctatgctgtacagtaagatcttgttgttcacccattctgtatataatcgtttgcatctgctaaccccaaactcccagtccatccccgtccacccaccatcgcacttggcagccccagttctgtctctgagtctgtttctgttgcatagatgaagttcacttgcatcatattttaggtttcacatgtaagtgatatca

SEQ ID NO: 53045 - DNA, 843 bp, Bovine  19866880615686
cggatggatcccgatgcattcagagcagacaacacatctgttcccaggtcccccttggagacatgccgactacagatccaagtcaacctttaatgctcatgttttttcaggagagcatatctacataagcactgaaatcaaaattatatgctggtagttattgggcccttgggtcatctcccacattctaaccaaaactgagaacattccacacgaggttttgagcagactgcaatcaactatgacctgaactgctttgctcagtaagaacaccaactgtaaggatgccttcaattgctattttctgcctcttatcaactacattgctagcttccagctgaccatgcctctggccagcataattacatatgatgtcccagaaacaactccggctccccttgctactttctcacatccagtagatttcaataatctcactagattctattccctgttagtcctttctaatcctgtctctgccattcttctactcttggcatagtttaagtcagaattcctctcttaaaaacaaatgaaatacacagtcaagggagggaaggggacggatggggaaagagcaatagaataaatgctgaaaaggaaacagagtaccttctgcctgtttacagagcttcaaaaaaatgtgcaatgatgctgacatgagtgagagtatgatgggcacagatgggtataattaaaacagaaaggcgctctcaagatgcttaaaaagggggtagttcagctcccttagttcaaagtaaccaaacatatttaaaagacagttacgtgtacttggatgacaatgaatattgaattcacagggtttaaaattcatgctatctg

SEQ ID NO: 53046 - DNA, 1200 bp, Bovine  19866880712276
acgtttaaatttcctcagttttggtcataaatgtctcactgggcacatatccgtcagaaaaccccatattttggttctgttaagtgacttagaacacagtgctttcccccaggatgcttgtaggaagacactcttaacaaagcagtattacttgcgaagaattatgcttcaatatcttgtacttggtaaagcttcaataggtgcttctgggataaataaatggatgggtagctggatggatggacggaacagatggagggaaggaagggaggagggaaggaaggaaggaccagagggagggagggagaaaagaggtgaaactgaatggcagctttgtgaatggaatgatggataagtgaatggataaatagaggaattatagtggctaaaataataaagctataagaagagaagttatataatatggctagaaaaaaaactatgtaaaaaagttgcattttcgagtttttgaaactgacatgccagcaatgtctttttacagacacattatataacactgcatcatccagccacacacacacacacacatcacagctaacaatacctccatattccccttccaactcctctctactctctttcctctcccatcaccaacaacatgttttagatgaaactaaatgagtgctattactcccactgacacgatgggtccttggactcatcacctcagcctcctagtctcaataattccatctgcgtcaatgaaagggttgaatcagatggtgcccacagtcccttttagtgctaggatcataaaccattgtctttgttaattttaatcaagtgacagagaggacatttagatagcacaggagcagtattttgggtcacgtctataaattctgggttgggaaccactgaaataatatgatattttctatacatatgagataagaagtcagaaagaagtgaaaggggaggcttcccttttggtgctgaccataggacctctgccccctcctctccccgagagaggaattgagcctggaaaaaaaggatgtgtttccgttgtcgctttcagtctggctccatgtggctggtgtgaagttgtacattttgcagctgaaggcagtgggctccccaggataatagcagctgttcaagtgcatattagcactcgagatgcttgataagaggaattagagtaccgcccggtttctttatttttattttttg

SEQ ID NO: 53047 - DNA, 947 bp, Bovine  19866880758567
aagtctcttttcttgtttaactcattgcactatacatctactagaaaagactacagttattagtattgcactcccataaaagctaggctgctgttatatttgaccactcggaatgctaaaatacaggtgaacctcacaactaagactgtgcctgaggccagagggagaattctcactgcttagagcagagtgcctggtactggagtagatttgcttaagggcaattcttcatttgataaaatatcagagcaatttatgtccttgtacacttgttcccttcctttcctcttatgcagaaatgttaattgacaatcaaaggagtaacaagtgcatacctgaattcacaagtctttgggggcctatctttaatacttctgcagatccagtcctagtttgggttaagctttctttcatccatgctcacccgagagtgctggtgttttccttgttcttttttctgcattcagagttctgaaactgactgtctggtcattttattactcctgtcttagaacatgctctagttttctatgggtccctccagttttgaattaatattaaaaacgggggaaaaagagttaatctggaaatgactgcttcttaagatcagatttcagtttaaaaatctaaccgcaatgttgatcatcctttagcttcatttaatattagtttagctttgttttgcatttgtaaacattcacattttattaatgttcttgagggagagacaaagtggccactgttactctcactttatggtgcagaatgaaacttcagagctttgggtggaacaaatttactcatatcttatatcctgatattctttctattgtaaaatgtgacttgtaaagaatccaaagtagtttccagtgttatagtgcaagcaagatgattttaggagacttcaacaaccaattagaaggagagagtgaaaataagcctaagtg

SEQ ID NO: 53048 - DNA, 925 bp, Bovine  19866880771986
ccggtgcctgcctaagtccctgtaactttttgaaactgtaggggcttgtccaaagggttccagaaggagaatactcatcttactcttttgcagatttaagtagcacttttcccccttttttataagttatttcagctctccaaagatatccttctatcagctagcaggaaccccacgtggtgctttgaatattgccttttacctgtcccccaagtgaagaactaaagttcggtttgtttaaagaccatgttttgaagaaaagcaaggcttaatttcaacctttcatggtcattgacagcattgtcgcttcctaagctatttctctaaaactttcgttacagtactaatatctctctatatattttgtttatgtggcttggtctgtgatgaataacacatttatgcaaaactctcaatatatctacaagatatcaatagacagaatagacatgctctcatatgctgcagttaataaaatgcagtaaaaagcatatagtttcagaggcaattagtacagttcatgacttcaattaccaaaaaaaaaaagtcttcatgatttctaataattgttatttatctttcatctaaagtgttcctcttgtctgtgtcagctttggcccagaaatagcattgccgctggggaaagcatagagctgccgcttaccacactaggataaagaagagaaactgacgatcaggcccctagaaactcctacagtctgcccttggtattcacagattcggagggttgcagattcaaccaaattcggataaaaaatattcaggaaaaaaaaattccacaaagatccaaaaaacaaaacctgaatttgccatgtgccagtaacaatttacatagtattcacattttattaggtattataaggaatctaagagtgatttttctggcagaatcccatggacagag

SEQ ID NO: 53049 - DNA, 1749 bp, Bovine  19866880775955
ctggtctgctggattgtggagatttcttctacttaaggaagtttattagcaccaaataagaatcttcagcttataaaaggaacacatggaaaggttatccagcaaaaggccttaatccctttggccttatagatcctgactacatcctgcaggaggcttttccaggtggctcagtggtaaagaatccacctgccaatgcaggagatgccttcgatccctgggttgggaagatcctctggagtaggaaatggcccactccagtattcttgcctagaaaattccatggacagaggagcctggtgggctaccatccatggggttgcaaagagtcagatacgaccgagcacacacacacacacacacacaccattgcagatactaggacttgaagccaactgcaattcaattatgctctaatgggatggtttctgtggaaataactatccactcttaattttagtctttactcagaaccctagtatatttggtctgtattcatagtaaggttatgaaacatctgcaaaggagatgggagcagaggagttgaccgtgattttgtattttaagcaagataagtattacaacagaaccagagaagtttacgtttctttgttcatttcttaaaaagtctcagcattcttatttattacttacaattaagtaatataagatcagatccctttaatatgtcattactgaataaatcattcaggtaaaatgtttgccatctgcaaatgtttgccctggctgtgctctggcacataatatgctctgcaaatccatggtggtatcatcgtcattactgtattttttttatgaaattgctaaggccaacctaaagtccactgtctcaggaaatgacagttcctagctatgttaacatggttacaatactaatgctaaaaagttagaagtgctggaagatatcaaagtgccttgatggatggtggtggcccaagggtatcggtctgtaaaaatcaccaataaattatacgggtcagttggacagtagttatatgaaacagagctccatatttggagcatcagaagatggctgcaatggaataataatgacctatttattggaggcaaaggaagtgaatgacagtgatgaaaatacgatatgtatgtcaggcctcttaaccgcctgaagcctttatgtaaaaataatttctgctcacatcctcaaatatttcttccaaacagaagggtgtactgtgactcgataaatttccccttgacatagatatcatgacaattaggttgttacaaaacacaatttgatgtgtagcagaaggatacaaacaggcaactccagtgcctttcttaaataatccatttaaaaaacctttctgattttctaaaactcaattagcagatatactgtcaaggtagaaaatagcacatgttctgggcaaaagaaatcaaggaggcttcaagcaggtacgatataaccgtagccattaaataaggctgttagcagcaaggtaatttattttaagtgtggaacaatgtctgacacatacagacatttttgactgctaactggtatatgtgggtgaggtttaagagacagaaccaaactaggttttaatttataccagcaactgaattccctataacatgcctacttgccccacaaattctaaaaacaaaacttcagcattagagaggcccattcactcacaagcaagtctcccatagaactctagaagttgccaagatattcagacaagaataaaaagcatc

SEQ ID NO: 53050 - DNA, 1731 bp, Bovine  19866880832871
attaactctggatgtgttgatgcatgtttttttaaaaaaggattgtagtttatttggaagtcagacctgggctttggaatttttaagagctctctagatgattctaacatccagacaaatttggcaatcctcagttttatatgtagtaatggccagaaattgaaatatcaaggacaagttttgaagtatcacagatgtattacgatttctataaatctgctttgtcactccttactttagctgaatgaatttccctgatactctctcactttctctttcataaacacacaccattaaaataatccaaaagttctgacccttctatttttgtcttttcttctggaatgagaacagtgggtgaaaagtaattacctctgatgttttctttgacatgctacatttgtctgttaaaaaaattgactccaaaattttagaacattttgaattaagactgcaaaagaaaatcaaagcacgcagctagaagggaaaagaacagagttcctgttttagaaacttgattagcactggaaattgaacttgagtttttgacattgggttccacacgatgcaccatcgtgctcagcctgcatgcaaattgttttctttaagctctttataaatgatgagatgacattaaaagaatagtttaatcatgttttcgtttttcaatatgtaacgctagaggagaagaggaaaagtagatttcttcatttcataaaacaaagtatttttgcaataaagttctaactaaaacttaacctggcacttttttcatttaccttggttattgcttttcacacgtctcatggttcttgtaaacatgcttttctccctgtggagctagattcaaagcaaaggttatgaaggaaagtcttggtatttgagcatcttgcttctgatgtttagccttaagaaatagatttgagcttaaaagaaaagtaatacgtttgcttgaattttcttacctttcttcacattcgcttttactgcctctatggatagccctaaaacttggtttagatagagatctgatgtaatttcatgaagcagtgctgtcagatgacggcaaagcatgtttatatttgttgacacagttctgtagatttcctttccaaagagcatgtgcagatattacgttggtaggtctctatctgtaggcacaaacgttttgtgttgaatgtttaaatttgttttagaattgtttaaatgattattctgcctgtacagatatttagggggaaaaaaggctttcttaagagtttagatagtttttcttctgaccatctgataaagatagagctttttttgttttgtttttataaattcagcctttttctagcagatgatttatagctgtgatcagtgactctatatttggctgatgtatcgaaaagtccatttattgtcaataatttgtttatggcaaaggacatatgccataaatgttttgtattttttctcctttttttttattttttaaagatttgttcctctttcatagctacatgagttaggaaataaaacgattccctgtcaaatttcatattgaactttaaaagaaaaattctaagaatatgctcttggaatgaaaggacttatagaggttattcagggctgtggtttcttaattgctgctttttatttaaaggagattaagggtgttctctttcttaagaatgctactcctgtgtttttgcagatactcttctaacatttacttttttttttttt

SEQ ID NO: 53051 - DNA, 1238 bp, Bovine  19866880837297
tgagcgacttcctttccttttactttctgcattggagaaggaaatggcaacctactccagtgttcttgcctggagaatgccagggacgggggagcctggtgggctgccgtctatggggtcgcacagagtcggatatgactgaagtgacttagcagcagcagtagcagcagtgggaagttgccgtataacacagggacctcagcctggtgctctgtgacagcctggaggagttgggttgaggacggggtgggagggaggctcaaaagggaggggatatatgtatgcttagagttgattcacagttgtggtatggcagaaaccaacacaacattgtaaagcaattatcctccaagtaaactttttttaaaatcgtgaaaaatatcatgtgccatttaatatgtgtttgtatgtggatagataggtggacaggcttggtgtgtgggaacagaaaatgaaaaacgcagagtccctgctctcatggcacttacagactgatagcaaaaagggaaacagggacagaaaactaacatttattaaacacataccattaataaaaattagccaggctaggaggagggaaacatgggaaaattacacgcattttctataatataagaatagatttttgccctttgatgtgattcagaattttccagaaggacagaatatctgagccagatgggaggagttaagtggttttctttgcttcaggccaggaaaatgtcatctgatgataactgtgctaattgttcttctagtaaacacattgtttatccatcaaggaaactttgagaaggacccaggagttcagtttatagaatttggccacagtcaccctcaagaatctagaacctaggacccagggagatgggtaacataagggaattgtcaacccataagatgccttgacaattcaaaagttctttgggagcagatatctccacctaatgcttcaatacagatgctataatttatagcatgaagtttatgtaaaagatattgttttctctgattggcattttgggggtagtccctgatggtaagtacagtcttttgcagggctgacgaataatcattcagtgtctggccttttcagactgctttgtcaggagaatctacaaagatgtattgatttaccttgtatcaacaatgaagtgttgaagagtctggcaggaaaaccagatggagaagcccagcaaaattgcaaagctgggaccaaggcttggaactggttacag

SEQ ID NO: 53052 - DNA, 851 bp, Bovine  19866880875111
ttaagtgctcgccagctcagttgttaggaatggaggtaaagctaaagattgaagacagcttgacaaaatcctacacaccatccagctgggctttacacattatgagatgtggtaggacagaatgagggtgtttaaaaaacttattgctcttatgttgctgcggggcgttgggctgagctgggaatatgccagggggacttgtgctgcttgtgtaggtaaacttgcaggacttcagctttcaactccatccaatccttcctgtcagattctcttaaccttgtcctgtcccttgctaagcactgacattttcagagcagaagaaaatcatgttaaatttatgtatggggagggggggtgtctgtgtgttttgctagactctggtcttaagtgtttgggctcttttgattagttccgtcctgggtttgttttgtcgtctgagaagagcttataaataagtgctggttaggagtttaatttggattctcatgttctctggccagcatggctgcggttggttctttgtggtgggttacagaagagcttcagccccttctgagcagccagagggccccccgagtagcatgctgctgctggaccattacgtctgtttcggcccaggcagtgatgtttttgtcatttgaacttactggtttttttgcccaaggtttcatttgatggaagagtttagaaactgagaaatatttgaaaaggcctgatattggggacttatgagagacaggcctagaaaggaagattgggccaaattgtagaggctcctgaacatctgacagaggtgaacacgtttttattttccctgcagacagataatggggagccactgaggacgactg

SEQ ID NO: 53053 - DNA, 1161 bp, Bovine  19866880908071
aacaattattcctgtggccttcagaatacgaactcttcctaccgacgatgatggctaacccacgatgcaaatcccttactggacatcctcgctgggagatgggagagacagttcacaggctggacatcaggagaccagctcctcgtccaggaagcatagctaactgtagcctcagttcagtcgtccttccttctttgggctttggctcccacactgcaaaataatgagattttaccgatgatttctaattcctttccaaaattccatgactgtaagacactgtgattcctcaacaggtgatatgaagaaaaagaaccttgcaataaaatgttacaagtttctattaaataattttaaatatgactgactatgaatactgggtgaacttctgtataagtgcatatatacacacatatgcatgtggctgtatacatatttgtgtgagtacacacaaacacatgcacacacaggctaactgatatcatcaggtccttatacgggactaattgcttacaactcaaagcagcaaattttcaatactgcaacagatgtcgctgtgtgatttctcctttctgtcctggattttctgttaaaaatgcccagcgtgatggtcagtactattcttcccaagaaagagatacaatatttgaatcctttggatttatttctcataaaatttcttcatatgctggtaaatttccattcaaatcatagcattgattcgtttggcccaatttaagagattcccctgaataaaaatgggccttttgttaacacgcaggcacaaaaccatttttaaaatgtaaattctaagtggccagttaagcatcaaaatatcacatccagaaaccgagagattgcgtttatattcacagcaatattataaagtttttaaagacggaaaatcacttagcaatataggccaaggaataattaaaaacaaaaaacaaaaaacaaaaaacctcacttatgtttaaggccaaaacgtaccaggtgtgggcaaaaggcactgaaaactccaaaagcacctttcatgatcatgaaaattttggattttagttttcaaagcatttctttaaaaataaataataaggctaatactataattgcaagacctcttacccgtttgacagtcactatcaaccactttctgacacatgc

SEQ ID NO: 53054 - DNA, 3826 bp, Bovine  19866880928064
ccaaagataaatatgaatagcaatttatctttagtgatgtgattgtgttatcctactttcttttgtatgtttgctatatttccaataacaaacatgtattatagttgggaaagaatgaaaaccacataaatgaaagtgatgctttcctctccagggtctgagatagtgaaaaagacagacttgcaccaaggaaccctcttcacctctgacctcttagggtgtggcttcagagatgctttctggtcctgacttgcctggtccaccctgagcaatcctaagaccagaacctagttgtccaagcgaacagagctggcgtggcagtgatctcctgcaggcctgcccatcctaggagccttttttaagcctcctgttagcaggctttcctcctgtctattaggtcactgcagattgattcatctcacttcactgtggtttacagtttgcagttcgtgaccctgacatcctcccctggtgctggagccctgtttctgcaatagcaacaagccagtggcagccagcggcaggtcagcggcaggccttgtatcctcctggcctccttgcagactcctcaccctctcctttcctctctgtgcctgtccggcatccacatacacaaggctgcagcttcaagggaccctgtggggtccgaaccatgactcaggggaaaaagaagggccggctgagaccaggccaatggcaactcagttctctgcaagagtccttagctctggccaagctacaaaacaagaggctctatttgcagagtccacaaggtctgggaccctatgccttacctttcactgtggagcagggagctcacaactgagtgaactcaacaggctgaaacattctgggcttctattaaaaggtagggtatttgtagaaaaatccattttgcaaataatattagcaaaaacccatgggagacagagaaagtctatccctctgtcccatgttgccatttatggaaaaaaaaaaaaaaaaaattgttcccttcagggtctttggccacctgccctcttcaacatttctgcctgatgtttcacttctcctcatcaacatggaccccatctataaagtccactctgcctactccctgcctctgacatggttttcaatcagtcctttctgcctctccttccagtgtaatcataagagccactggacacagaggaaaggaacctgaattctactcctgactctctggttcaagagtttagaactgcagggccagcctagagcctccctgagcctgagtgttctgtctgaaaatatacggcttgaattaaaattcgaaacagcgttccagttctcacgttctatcgcgcgtccaactcccagaagtttcctgagtgaggctgtccccgaccctgaggtccacaggcgccctctgaagtcctcacagggagaggaatttactcttcatttcccatcggtttgcacaagatttgtgctttcttgtttgtcttctcctgtcgaaatagaaagcagctccgaatggacgactatgcttcttcacgacctccatctatgtgtgcagaacacaggaaacagtcaggtgaggtggttagttctctgactaatgcctccccctcgggcagacttgaaaagagactcatttaaatttggttttcctgccagaattgtcaggcctcagtggccttgggaaatcacctaggaagaaaatcaccatttatccaaacaactctgccatctgcacgggctgccaccatctccaaacctctgcctaatctgcacacagcagcatcaactcccctgttccagcgcctcccccccaaggtcatggtcatgcctggtgaagtgtgggcctatgccctcagccaggatggactatccagggagcaccagactcattaaaagccagagcctgtgttcgcaacacagatgagctggagaggcactcacccaggtatcagatgcatcgcattctgagaactgcaactgtctttgcagtgtgaccctgaagaaatcacttgacatctctgagtcccatactcccatttctctggagtagacatcataacacgtaccttgtagggttactatgagacttaaatgtaatcaattatgtgagcatgcatttttaaatgtgaatattttacactctttacacattacggatgttccgaattacctgacccagtaacacatccttgtcacaaggccactgtcaggggagctacatcatgaagaagaagcatttgtcttgacacacagagttggaactcacaacatattctcccattgaaaggctaatatgcatggtatttggttgctggggatagaaatgaccatagttagtacattagttatgtgtgagttaaatagattttcaaggagttcccggaaaacctctccctccatttaccacttttttctatgagagaatagtgttcccaattcatagaaactaatttccaggcaagtctttggaaccctgcccatctgtaagtctacctttgttaaatcaccttcagatgcagtcattgtgtgctacctggggggctaatgacacatttgcggatcccagaaggtctgcgatattacaggcacaggtatggtctcctgccttcccctacagagtgaagaaggggtggaaggaaagtaagaacagtcacttcctcggccccctcattctgcagtcgttgagctttctgaatctgacagctctttccaggtaaaggaacatctacaaaacacaaacacatcatcacagttccggaggaaaggaaacctcagaagagacacctatttctcagccagaaacagaaacagatccccatcctaatggcagccttcaggaggtgagaggcaggggttcgggaaccccaacgctggtggtggattacccagtgactcagggtaaaggcaagagtatttagagagggtttgcactgcttcaaaaacctagcaggttcccagtttcactcctctgcgaggggcaatggccagaaggccatccaaagccactttcctttctcccaaagggctacgactgaaaatgcaacttgccaagttgtatgcttgagcctgaattccacccaccccagccctgcaaacgcgtaagttgaaggccagctcccaccctccctccagcagctcagaatgtgactgtagttggagatttgggggtctctaaagaggtaatgaaggttaaatgaggtcattagggtgagcactaatccagttagactggtgtccttataaaaagaggacatcaggacccagacacacagagcggagactgcatgaacacacacagagaagatggccacctaccagccaaggagagaggctgcagaagaaagaaacctgctgatactcagatctcaggcttccagcctccgggactgtgagcaaggaaatttctattgttgaaggcacccagcctgtggtgctttgttaaggcggtcccagcaaatacgcagcagaacagcaccaggggcaaagagcaaggaaaatgagatacagactccaggagtctggcctcccagtcaagaaaacaggcagacttggatggatgtggttaaaatacttccagctctgaatcagtgccaggctcctggttccttctttgatcaaggcggctggcctgcccgtccatcgccccctgccttggcacagcatctgccagcatccctgttcctaggagccatcctccagccactgagggtcccgtgccatccagagaaggagaaaagatgggaccaagtaaactcttgtcaaggccacactgtctggtttcccagacattcaggacagctgaaggcagcacagacttgggtgtaaaatttactcctctctc

SEQ ID NO: 53055 - DNA, 1404 bp, Bovine  19866880970329
gtgagtacaggctcagtaactggcgcataataaaggcaacaatagacttatattggctgcaaaaaaaaaaaaaaaggaaaaaagggctgggtggggggagcgctggccagggatattgcttttggagtaaaaatgggagccgtgcaatgccgcttggcagcagaacaggatcagattatacctcctctgtccagcctgctcattgaaggctcggagtagtagcggcagtactctatttgtaagtatctcgcggtaagaagttgccttccccagcgagggctgtatgctgacttggaaaggagcggtctggagctcaaccgtgcatgtcaaagctacaagaaaattctgttgccagttaccatggaagcagcttcttgctcttgtgtacatccctgtttgtactctggttatcagattgtgttcaaattagaaagtaattgggtttgatttgtagtgaggggacgagacaactttctttaaatcttttttctttgcttttaatgtgtattttggtgctccgtttgagaagggattttggcctaaccccaggtcctagacccggaaagtagatttcaggtggggacccagggacttctcttccttactcttcttattttaagctttctctgaagtctccagttcctactccagggttagagaaacctgttggcattgcctttgaacttcattaggcttgtttcattcacagcctcactagggtagccatctagggctattgtgcagtggggtccaggttctctcttccccctgtaactgaaccccatctatcctctggagaaaatctcccatccttcttgtggtgtttggaagaaatggatgttaatggaatgcagctaaaatgggatcatcaaagctcattcagtgtaaatcatgaccgttaggtttgggatgctggcatgctgttgtttttgaccctcagtgaacccctggttggtcaccctccttttccctttttcagcagtagaaaggatggccagtgggtgggggtgggtagcctgctggggagcccaggggctgagtttctgcttgtcgcagcctgttggggcttgtgtaccggggaaggttagagactttacaaaagtgccgccctgcaattgtcgcctttccctgcatcagatccagtagccacgggagggacttacacttgtctgtgatagctttgataaaatatccctcattaatgccactttatatttacagtgtgtcactggagacgcacaaggcttcatttagtgacttgtgtgacgagacaagcttgcattatttgcctgggacattttggtggaacaagagacccattgagcaatcttttgaaatgaacaaatacggaaaaaggggggaagaaaagagcaggcagtgctccggaacaaagagctttattca

SEQ ID NO: 53056 - DNA, 1145 bp, Bovine  19866880976641
tacattcattgtgtatttcggagcaagtatttcaaccccagggctccactgcagattgaatatcctgctgcctgtggatggaatgcgtcaggtgctgggacagtgcttctgtgcacattctcatctaaccttcatcatagctccagcatatggacagaactatttctatcctatgtgcgaaaagctgaggttcagagaggtggaataactttctcaagtttgcacaattagtaagtggtccagctggcattctaagctatgctgtatcctgggagatttgaaaaccatggctccgagaggttcggcgacttgcctgagatcccactgccggttgtggggttggcattctcattgatctttctcttaagtccttttcatgtttggtcctctacatcacactgttttttttttagtcattcctccagtttctgtgttgatggtgcctccacaatggcgagaaatctgtgtccagtatggagaagaagtgggttctagggaacagaaaagacagcatcatgaacaggcagtattttgaaatgagagtccctgtgtatctattttttgtttctttgaaaggacaacattggagagagagagagagaaggaggaggaggatggagggagggaggaaaagagagagaggaagatagaaagacatatacccagagacaaagacagagagagggagatggataaagagagagagacagagacacagagacaaagagaaaggtgcgcgcgcgtgcacgcacacacacacacacacacacacacacacacagccatcttgttccttcagccccatggccctcagcttccctcctcatcctgagacagtgatggcttggctttgggttaagccacttgttgccagttggtggcatcaagagttgggagtgctagtccggtcacaggtgacaggatttggaacatcatcgtggccctggctccttcccagtagacccagtgggtcatggaaatgggattccccagttggagaattgactgggggtgaaaagagatggcagatggtgggtcctagtggggaggggaggggtgaagggctcgccccatgagtttaacactttgatgcaagggtttctccagtaagtattaataatgttcctataattatacttcagggc

SEQ ID NO: 53057 - DNA, 811 bp, Bovine  19866880979366
cgatacaaagcgctttctaatcccgcatctaattagaaaaaaaaagagtaaatctccaaacaaaattagttttcagagtcttaattatcaccagaaagagtaattaataagcgaaacaggaaatgaccctgctgagtccctcagttctcaaagatctgctttgcttctcagcaccacttgggtggggagcatgggggaccccgcaggggccgtgtggcgctaaagctctcagagccccagtgggcatcacagctttcctgaggcaccacacatccttctcaagtctgcctgcctttaaaacgtggtttgctgaatttctaggtcattccttccaggctcctttctttcccaggcctcgaggccagggtaaggcagcagaattagaataaatagacggaccagccttcccttttttttctcccccagtgtaacaggctctgggccagaaactctcaaaccaattgatgataacaagctcaagttcaatgccattggctgtctggtgagaccttcctggctatacttgtctctactccttggcttgtatttctttctttatttattcattttaatagtagcatcatataaataaaacactattacaaaaatgtcgcagaaagttcaaaactattcattatccatttcatacagattaaaattgccatcaaggctgtttggatttgacttgcgttcctttccttctaatgagccgaatagagaaggaaaggatgctaattcatccttacatctctatcatatctcgacttttactatataaagcatcaaggtcgcattcggggaaatgtctttt

SEQ ID NO: 53058 - DNA, 913 bp, Bovine  19866881000926
aacctgctcagacttggaaggaacaatttggatcgcagatggaaattacttaactttctcttcttcttgatcccttgtgtgcatgctcagttgcttcagtcatgtctgactctttgcaaccctgtggactgtagcccgccaggttcctctgtctataggattctccaggaaggctactggagtaggagccataccctcctccaggggatctccctgactcagcgatggaaggtgagtctaggtgagtcttctgcacttaaggtggaatctttacctctgagccaccggggaagccctcttgatcccttacttacatgaaagaaacagcgaatttggaactggtctttcctaagaaggtgaactggctcccagactgagaaccagagttcatttgaagcttggaattcaattgccccaacagtgaggggccttgggggaaggctgggggaattctttggggatttgtagccagtgcttttccctgacttgcggtcgctgccagtctgggagtctgaaatgtgttttgacagcagacatcctgtgtgtcctgactataagtagtgatctgtgggtctcctgactttgtctcttccactggcagctcaaagagtgaagcagacagcaggagacacgagggaagggaagaaggggttgatgggtgtgtcagagtgaggcctgaagttcctttttcctccgttcctctttcgatgacctcatttattatggaaaaggtttacctgatattgagtcataacttgcaagaaggagaaacagcccaatcgatacctctcagagcacctggggaggcgcatcactggaggtagggtgaggaggaagcagagagggaggagaggagagtagttagaagatgatcggcttaagaagggctctggaccgtctgtgcttttgttaa

SEQ ID NO: 53059 - DNA, 1968 bp, Bovine  19866881012087
gagactttaggtcacactacagtagcagccaattaaaaaaacaatattagaaagacattctgatttgatgagactttccttaaatggactttgctctctataaagggggggatatatatatataaaaggaaactcttaaagaggttagaatggcttgctggcagattacaattgatttcatgccagtttgaccttgcaccgtattctatgatcttttcagaagatgaaactcaagactctggaacctgtatttcactttcccatgtaaatgaaaagtcacagtctccttctctctagatcactgagctcatgtatcaggtctttacaatttcttatttttaaaaagagaacactgtggtttccttttgcctgggatattatccttcccaggtaccagagaggagcattgctgaaataagacagcacggtgggagaagacctgttagcccaggggctcctgacacttcccctgcctgagaattcaagtcagaggacgtggacctcacatatttgctgatgcgctgactgcaaagcagatctagaaacacgagccccagtgtgcttctccaggctcttcgtgtgactgagatttcctccaacattctgaaacacctgttagagtgagactggaggcctctggaccaagtgttcattttttgggcaaagacaagggcagggtgggggcccagataaatcagactgacgggaggcagtgtgggtctgtgcctgtgcattcaggtggggaaactttacctgagggtctttgtcaatcatggaggattactgcagttcagaggagcatggggatgccaagatgaacctgagatttggtgagggcttagaggtaagaactgacccctataacacggctgcctaaactgttgggcaaggccggttttgctctgaaggagggcgatgtctagtgacacaaggaggttgggactagtcagagaacagagtcacagcaagctctccgaggagttaaagagaacatcttgcaaaaggcttgctttccattgtcatcatacattcatgaataattttcactgccgtttattttgtttgtttgcaaggtgaaggccctcctgctgttacatctgctgtatgaatcggagcacttaaacggcacttcttcgaagagggctgagctatgatgagtgggatgagtcaggccttggaggatggatgtgggaccgaagagcatgtgccacatcacacagtaaaatacaatttcctcttgttgcaacttgtaagtagctttgtggatactgaaatgactgtttactcaacaaaatcaaattttattctgtgatgttgtggcagagagttgctcccagtgcctttgaagtggggtgcacactcacccacacagcactcttccagatctatgagaaatcttcaaaatttgaaagtgaacactgggtgagaaaaccctcatagcaagagtgtccgcacaagaatgtaagctctgtgacaagaaaggttttcgttttttgtatccctggtgcctagaataatgtcagtgactggaacatggtaggcatttagtatgtattcaccaagcagatgaatgaatgaaaaagttgggagatgttggggaatggaagtctagctctgctactggttaaacgaaaactaggagaccatgaattcaccttagccctgttctaagacagacaagtcacattaaaattttcaagtgtttctttgagcagacatccagttcaacagggcagtccaactgaaaataattcaaaaggagctgggggaaaggtttctataaagatgacatggaagaaaagcaagggaattatttgattggctagagctaagcagttgccttcagagaaggcaatggcacccgactccagtactcttgcctggagaatcccagggacgggggagcctggtaggctgcagtccatggggtcgcgaaaagtcggacacaagtgagcatcttcactttca

SEQ ID NO: 53060 - DNA, 945 bp, Bovine  19866881033933
aaatgatgctgagggctgacgttctaaagtgaaagcgaaagtcgttcagtcgtgtctgactctttgtgaccccatggactgtaggctcctctgtccatggaattctccaagcaagaatactggagtgggtagctgttcccttctccagggatcttcccaacccagggatcaaacccaggtctcacgaattgtaagtgaattttttaccatctgagccaccagataagcccaagtatactggagtgggtagcctatcccttctccagaggatcttccccgaaccaggaattgaactggggttttctacattgcaggcggattctttactagcttcgctaccagggaagcccctaaacattctgttttaagaatttaagaaataactgttttaagaattcagagaaggggggagagatatttgtagggtgctgggttcaaaaagtatttaaggaggaggggagactcgagcaggttattaaatgatgggttgcatttctcttggtagagaagatagcaaagggtaataatcagacatttaagataatcagttctgccatccacttgctgtgggccttttggcaaatctcttaacctctctggccctcagtgttttcctctgtaaaatggattggatgtattgcttcaaaattttatgacccaatgaaaatctagacaggggaagagtttgaatgattttggtaaccaggcagggcaaaggcttaatgatctttggaagaccttatctgattttcccaaagtgactgttctgcatcagaaagagtgggctgtctttgaactgggggccatagcctgggggtctgatctgaattccttttcccgggactggaagaaacacagcctcactatctttgccaacaattgcctgtggcaaattcagtaccctccttgatgtagcattggaggaaatttttccataaaacaaaa

SEQ ID NO: 53061 - DNA, 1712 bp, Bovine  19866881047636
ccaggaaaacactgccatgtctcccaaggcatgtatattaacgaactccacttaatttttcaaaattcgaagaatgctacagatccaaagggtgggggaactcgggagggattaataaattcatctttctttctgctccatatgagaacatcacttggtctattctgttaactcaaacccacctagttactgacagaaagcttaaaatgaccaacagtcagacgaagaagatgaatgaagttctccatgtgcagactctgcggtccagcaacgctctctgttggcgggtatcctcggcgcacgtgcacaaggagacacatacacgaaccttcactgacgtaagaaaagtctgcagacagcccatgtgcctatcaacagggggacggctgaataacaggtatatgtgtgctttggggtacaaggtagcggctaagtggaacaagcaaaacctgcatgcaacaacacggacgggcttctgggcaccgccgcggaagggactaagctgcagaatgatgtgtgcggtatgctagcacatacgccatcccacagcattcccacgaactatatgtttacatctctatctggacggacagacacagatacacacagacagacaggtaggtagacagagacatgagcaaatacagaggaaaacaagttagcggaccccactagcatccatcaatgaggacttcagccttttctaaaatacttttaaagggaaatatattcatatatttcttgactaattagaagttaaagaaaaaatatatttataataaactgggaggtaactgaaggggacaacatcaagaactaaaggaaatacatctgagtctttcaagttctatcaaatgactagcagatgaactgattctacctcctctaaaagtgttacttttgaaaagcatttcaagacaaggatacaaatatctagaatatttgtatctagttttggtggattgtgaatttatgtaagtttaaaatatctagacatttattttaaacatctaaatatttatgggctcctttagaaaagagccaactttatcaatataactaccttactacaggatggcaatacatccattaaatggaaaaaaataataaaatattaattcttataacaccttcaggataactggccatggaagaaaatatataaatgggactcatttatataaaagtgaatccattaagaatggcaagagccttgcatgtggtgaatttcttgtgtttggaaatgtgcctagaagtcatcagatttgttgttagtgaacccccatctgtcatagctcgtatctgaactatggatagctcttagtccccaaatcaatatgctgtgcattcgtgtcatctagcatccagtctagaagctctgcaattgtctatgagctcctcgattcttattttcacaaccctgtgctttgttataattcttggcatccaactgacaaaatatagaaatatcattttaaagacttcactcaagaaagcttggctgtggagaaaaggctacttctgtgtgtgtgtgtctgtctgtctgtctccacccacacatggaaactcaagagaggataaaattataaaacattatacttcattatggttaagaggttatcacctcaaaggactggaacgtgtctcaggcaagatacttttagcagtgtctcatctatgaggccaggtatccagcaagtccagcttcccag

SEQ ID NO: 53062 - DNA, 4285 bp, Bovine  19866881049831
ctgtagaagtgctcagttatgactccagaaagaagtgcaaaaagatgcagacccaagccagaagataatatcaaagtgaaatatttccactaatgtcagcaaaatgtaaaaatatcatcagaaacaaacatgtgctccctcccacctgtcctgccgattttaattcagaaaattgaaatgatttttctcatatcaaaaatgagtgaaaatactagggagtctttttattctttataaactgaagtcagagtaatttattttatctggaggagagtattaaattagctgtcaactgtgctacacaggtggatggtaactttggaattgaaatgaccaaatctccagtcttgaggcattcattttaatctccgttttccattgaaataggcaaaacatgaaatgttgagataatggcactaaaattccaagtaattgcttttgttagctcaactcatgtttactcatattaattactgaaatttgataacctctttgttttctacttagcatgactctgaatgcagggacagagccatcaatcaggtaggcggttctcaccgaaggccggactcctttgctttgatgttggcagcttaaggctaattccttccgcttgataggtttataattcaagaagatgtgatttaatgttgatggaatttatttttgaaacacattataggacgaaagcctttcaaagtaaaaaatgaacttttgaggtaaatcttaagtaaacaaaggctgtcaggttctctccacacccaattttagagatctctatagaactgtggacctgtgccatgcatgtccacccttcagctggaggggatgaggtggtgaaaggagaaaatgcaagagctcttgagtcttagaaacaaggtaggcaattaaagacatcaactttttccttcctctcctctttgtaaatgtgtttcacgttgccttctcttcctcataccttttcatttatggtattccttacaagttgtttttccaaaggtgaacctgaaatattcaagtttttaatatttcattcaaactctaggtttgtagagtttggagggatcctgagtccatttgttttcaatctgctgattcatacatttcttcagcctctcatttatttcatttatacattcatgccctctagaagcgttgagttccagtcactgctctacgcatggaaactaagcaggtaacaagctacactaagtctttgccctcatggacatctttcttttggacactattgttattagaccccgcctgccaatgcaggagacatagagactcactttcaatccctgggtcaggaagatcccctggaggagggcatggcaacccactccagtattcttgcctggagaatcccatgggcagaggagcctgatgggccacacacagtccatgggttgcacagagtcaaatacactgagtaactaagcatgcgcgtgcgtgtgggtacacacacacacacacacacacacacacacacaaggaggaaaaacaaagcaggggttggagataggaaccatttgttcaaatcaagaaggatgtggaactgatctttttgaggggaagctggagaagttctcaccaagaagatgatgttggaatgaaagtctgaggaaatctaaaaatattgagggattccttatacttccaacttgtgcaagcaaattcctgcctcctctttaacaatctggtcctacctgagggcctgttgagttctggagcagagggctctggtgggacacttggatgccccttgccctggtgaagtttgggtttgtctctggggaagccaagccttggtcatcagctctttagactccaggtggacagggaggttctagatatcctgtccttaattgtcactgaggtgttacgtctttggaagagagtccttgaggaccggagttgtgagatagcaaaaaagagacttttaaccctcagactgtttggtgaagccctggggagtttctttggggtcatctgtgtgctttgctctcttctgcacttgagatccaaaaaggtccaaagtctctggtaaagttggggactttctggcacggtcctgagtttggcctgacttccagccaggctatctcccagtgcctttgttcagcttccctctgcctcccaacttccctgcctctagtcttgcttctctaccctatggttacagcagctgtcaccatcctggatcctgactgtacactgaactgtgctaagctctctgcatccatgatctcacttactcttcacagcagctgtgtgtgagaggggtcttggtgcctggcatagagagggtgggctgttggaccgcaggttttctcagggggtgggggggatcagaaacttggttttagacgtgttgaaactgaactgtcttttagacaatggagagaagatgctgaggagctgggtataggagtccagagtttggggatgcagactgagtttgaggtataaatttgggagttggctgatgacagaggttctgtcaagtcttgagcgtggctgagatcacagagggtgagaatgtagatggagaagcgaagaggtcctgggctgagccctggggcgctccgacctggaagaggaggaggagactgagaagatgaggccggggaagcaggaggggaaccagaagagttgtcctgaaaacgcagctaggacagtgcgtcaagagctgggaacggtgtagtggtgtcagacgctgagagagcaagaagacagcctgaccaggggacatagctaccctcaggccgctggtgaccttgacttgatgtgaggcatttgggcaaaatggtggaggcctacggctgacaggagtggactagaaagagaacaggaggagagaaacaggagccagcaagtggaggccactcctctgaggattttagctgtaaagaggagtaaagaaatggagtgtgcgttggctggagacgtggggtcatgaaaggaatttttaaaaagatgactgaaatctcagcctgtttgtatgctgatgaacataatctagtagagaccaaaaattgacagagaattgctgaggcagtgtccttgagtaggcgaaaggaaaccaaggctcagagaggttaagaaactcactcaggatggcacagcaaggaaatgacggaccttgcgctgaacctgctctttccactgtatcgcgtgtcgcccacaactcccacccttcccaaagctcggaggcatcaaggtcacagtttctcttggtattctcagagacttagcagctccatacacactgatgtggcagagacagctctgatttcgccccaggaagtgtccttcttcagtactttcaagaagaacacttaagggcctgtgtatgtttaggccgttgcagtgtaaccccctcctccctggtatacattcataccactttgggtcagggaaatgttttataaccacatgtccctgcaaatgagctttctgtatctctaagcaaggcagctgggagagcagagagagagaaaacatctccagtggcaggcagttcaggcctgtctctacactgcccacttaccaaatcagccaaccttgagccaagtcactccaagctcagacagatagagcaacacttcttgaggcccaaacaaaatcaggtgcttgattgctgttactgatctgaagagcctattttgatgggagaggctatagtatgaagactttctcatagaaaaggagaaagacccaccattgcagtgggaataataattgctcatgttttttgagagattaggtatgttctgagaatagtgctaagtttttaacattagttatttaatacaactctcacaacaacctttagaaataattattattgggcttccctagtggctcagacaataaggaatctgcctgcaatgcaggagacccaggttcggtctctgggtagggaagatcccttggagaatggctaccctctccagtattcttgcctggagaattccatggacagaggagcttggcaggctacagtccatggggtcgcaaagaatcagatgcgactgagtgactaacagatacacacacacacacacacattattattatttccatttttgagatgggaaaagtgaggcctaaggaggttgagaagctagcccaaggtcatacaagtagtaagtgactgtccaagggttggaacttgggtgtgtctgaatcctcttaactactttagacaatggactaggaaaaagttcatttatttttataaataaagaacttcctctttattttaattttttttaaa

SEQ ID NO: 53063 - DNA, 1828 bp, Bovine  19866881099774
gggagccatcctagcccaccgggggcttccgagggagttagggctacgtgctggggacatggggctgccaaggtgtccgtgtctttcttctcttccaggcatggtgcctcccaacacgggcagaccctgtcctcaagtcaaggaggatccaaggccaggaacacatggctttgcatgtagatgtgtatagagaaatgtgtgtgtgttaagatgtattacaactgcgggtgtgaatgtatgatgtgtcgtgccattggggagccatgtagcaaaggttgtttttatccggtaactttaatctatgtcaactttgggagttaagattctctagggaatctctatggaccatcccctttttcagctctctcactgctcccctagatcctcccttctccgttaataataaaggaagcagtagttagagttgatgctcagaaccactctaaatcttttctcccttctcccatgactatgtgttggcctgagctgagtacatcaggctcagtgagtcacacgcaggactgggatgcaggctgtttcagcttccgctggaccagtgtctcactcctgggctggcattttgctgggggtgctaaaaggatcattaatctgtctccttgctatttttctgccccagccaagggaatgactctggcctataaatcagctcagtaccgagtgagaaactcaaggagggatccagtaagaaggaaaataaccacttaggaaggatatagacctgaggtatgggacgcagaaaatcagaggaaggaagaagagtgatcttttgaggaaataacaagaagagaaaaaattgtaccaatccagcagggccagatctgggacaaaggagatctagattctggtcttcaagatgttattctaagcttcttgtttcagctaatctcgctgggctacaactaggccatctgttcaggtgggctctctccaggtcttgctcagccttgtgccttcctgggaactagaaacaaaacaaattcgtacacgcaaatgactccaagcctacatatttactcctgcaagttacttaatcaaaagtacccatggtaaagacttctaaggtgcactgggaatgctggggggcagtgtggccagtggaatgggtctggaatcagatgtgttcttagttttctctggatttctggatctgttgttgttcagacaccaagtcgtgtctgactctttgtgaccccatgagctgcagcatgccaggctttcctgtccctcaccatctcctggagtttgtccaagttcatgtccactgaatcagtgattgcatctcatcctctgttgccctcttctcctccttccatcaatctttcccagcatcagggtcttttccagtccattaacccttggccagcacctcagtttcctcatactttaaggtcagtttgaactccagacttctgtgatgatgacttgtctccacagtgatatgaagcactcacatctctcagtgactctccaacatcttggctgtcactgacaggagccacagctagaagggagaaggggaggccttaatggggtccaacactccacatcccactcaagcttattgctctccaggctgtatgggctggagcactccctcctgggactaagtctgctctaggggctgttatcttctgagagtcagcttggtagtttcaagagctcaggctctagaaagagatgtatttgggttttaaagtcactcaagaattatgtggcccctggggagatcctaagcatgcctgaggtcctgtaaccacatctgtaaattcaaagtgttagtcattcagtcatgtctgactctttgtgg

SEQ ID NO: 53064 - DNA, 1294 bp, Bovine  19866881100382
ttagaaattcccctggcagctgagcatcccactggccacaattaacctgctcaagactaggtcagcaactttgcagggaatgtttgctgatggcattctactgggtatgctggtagtactgactctggtccccagaaagcctggcatgtctctagtggcagaagaaagctaggagcaaattctgccagcatcacagaatccttaggctgagtgtgacatttagaggtcgcctggtccagccatttgcctgcaggcatacttggacataaaccagctgagacagatgagaatctgttctctctccctgccttcaaaaaccttcacacacagaaggacatttcatgtatagccttagtatctaatattcctcaaccctgagacagttgtttctgagcgctcatctgtattccacttgctcccaaatgattctctctttgatttatatctcgatagagatggaaggaagaaccctttgcatgttgtatgcagtaggccttggatcttgctcatgaagacatctccagaattcactgtgcttcttctaactctgcattaagtgacatcactttggtagcttgaaatcagccatggtggacttctcagatgactcagtgggaaagactctgcctgccaatgcaggagatgcagcatatactggtttgacccctgggttgggacgatctcctggagaaggaaatggcaatccactccaatattcttgcctgggaaatcccatggacagaggagcctggcagttgacagtccatggggtcacaaaaaagtcagacatgatttggtgacgaaacaacaatcagccatggtatttacaccatggaaacaggcgaacaccacagattagggctttctttcctcccagaaacaaataggggtttaacatttcccagcacacagctggtcttggagagcagtagtccccggaacttgggggtcgacgcttctgtgtacacgtcaccttagtgctctcaggtgaagctcactctctggcacgactgtaattttgcagcgagcagaggctgtgacttgcattcaccccctgcccaggactttttctacagcagctgcacgtctgctgtatgccagaggaatgaaggacacatatcagatcatcaggctgaatgactctagttttcatcgtcttagtcctaatgcgatcccacggttggagtcagatttgccaagcaggagatatgtttatctcagttgacttcagagttgtgcaattcaattcaagcagggtttgagagacaccttctccacgttccccgggttctag

SEQ ID NO: 53065 - DNA, 1062 bp, Bovine  19866881158158
caaaacattctaccatcagctaaataaataaatccaactctgttttctagaagtaattttggggcaacccatggttgaagttcagacttaagaagagtaagtcatagacagcagtaaatgtatttagatatatagaacctgtaaccattatttattctaaatctgagttttcaatcactaaatatattagaaagcgtttaaaagtccaggagagagaacttccacttagtacaaagctgacctttgaggtctctttggaaaatattagaatcttaagagtgaattctttaacaaagcaacatatttaaaaaaaaaaaaacaacatattccatttttagtacttgggttttcttgtagcaaggtataggtatcaatgacacaaaagacttttttctagtttttatcactaacttttgtaaattataactgttacacatagcctaaatgctaatatatcaatttttactttttgaatgaaatttgttcattcatttttctatttagtcaatcaacaaatatttattgaggcactgtgctgaatatatttatggatggtgatttacctcttttcactttaaattatctatatagacaatgagcactgaattatgctacattttacacaaaaggtagggatttgcttccacaacctggcaggaaacctttaagcagggcataaacggtattcacagttttgaattagatcagaaatgctctgctgaaaccaataatttggggtttcatttttctttttatcttctttattcttattccagctataaatcatatcactacccattcattcttctaagacatgggaacatttaagtggaagggttctgtttattctttccccaaaccagtgactaaatttaaataaaatgttctttgagggttgaaggaacatgccatttcttttaaagttgtcaaccctctaaaaaaaagtttcaaaaaggaaagccaaaaggagtgtcaatgtataattttaaacacacagattagctgtaactcatgggctttttcagtgtataacccaagaattctgccaaagtaaagaaaaga

SEQ ID NO: 53066 - DNA, 1025 bp, Bovine  19866881165540
cacatagtaggggatacacatacccacacccacacccacaacccacacagatatgcatgcagtatttacttaaaaggctaaggacaaaatttaaagtcacattaattttaactcttagaaaaacatcacaccctgaagcttctctatactcactatagcacacagccttcttgagttgagtcgtggaataggttccatttgtcatgggaagtaaaggtgggaaacttatgattctgtttctcctataaaatggtcaatttcacttgagaaatatagctgtgcactagacatcacagattctcctaacgagttcactcctttcaggagtttagagtctcagaatctgtagaatgtatttcaagaaaaaatttgtggtgagtttttggtatatatgcatttctgtgcatcagtattctttaaaatgtcataaaatgaatggcaccacacgtgaaaattctgtttccaaatggaatattcatttttaatgttaagttttgaaagttaactccaatgtccttctgctaatctctcagtttggttcgttattagacttcaaatcactgtcactgggcaagcagtgaacatggaataattatttcatatttttctttctccctctctatcatctttaaatccacaatatctcaatccaactgatgtccgtaaatccaggctgtcgcaacttttctctaaaactcttaaaactatttgaatgaggtgttgagcagctgtcagttatggatttgaaaataaaaagagcctgaaaattgtacgttcagtataaaaagattaggtgaagcaattcagaatgtttaagaactttaaatcaagttaaaagcagttactatggccagatctcatgaagctctgcttaagagccacattaacctggcagtcaaaactatttaaaatgaataatgtttttttcacatttcactcacttttggcatcatccaaaaaaaagaagaaaagataacaatgtgaattggcataggcagtaagtcgtgtaacagtaccttcaagat

SEQ ID NO: 53067 - DNA, 1362 bp, Bovine  19866881199556
actattcatcttcccccctggtgctgtgtctatcatgcaatctggcaccaggaattctgctggttggtgatagttcctgagcacaggaattgcatgtactctgttggcagctgtatccagggcacccagcgtaatatctgggaggcactaaatgaatgaagaatgagcgttttctacatgatcacgtggtcgtcttagactcttgactctgagggcccgcttgtctacccttgtgtttcttaggaattaggaaggctcacttgtatcaattatagtgaggtatgtcctttgaagttgaaggacaggggcaattattgtgtgtatgtgaactttttacattcacagaagaaataatttactgggaatgagaaggaaaagtgactcctgatgcataatagggaccggagctcgttaacttaattacttagtggtccctgacaatgcttttctcccctgtgatcaccctcttacccttatgcagtatttacccgtggacttggatagagaatgccgagcagagtggcttccacccctgcccttccctgtgctcgcgggtccacaccccaactgaggctcacagtgctgtttgtacaggggtgtcctgaggcgctagtgctgcatggactcactctgttgaccttgacgattagcaggttgctcctgacaagtcggttgagagcattattcataattttgtcatggatactcttgcatctccaatagcaattctctgagaacctattagtgaagttagaaagctgcaaattttgcagtgagttggatatttagaaattaagtttcctttgcttaatagtttgaggtggatgctctggttctatggatagtctagctcaacccagccattcagtgaccaaggctaacagtggctctgccgccttctacaaggagattctggagtcgttccagtcacacccttttagcctcttgtaagagagaaagggaaacgggaggggagcagtctgttctttggacacacatcctttctgctcactccggcaggacatagtcacctgaccagcctagctgcggggacggctgggaaatgcagagtaacagccactcttgtgccaggctgcctggatgaaggtgagagtgggtgagtgacagacagcaggctctgggccacaggcttgcttggtcttgcaaaattccatcgtttaccatagactttacactgtctgattactcccccctttcgtttcttggggtcaagctgtttatgaagatgatgatgtacatcctggtcgagcagctatcttatgtccttctggttaatatcaatgcacgtatgtatttttttttaacactttgaaagcaacgtcaatcctctgaccagcttgt

SEQ ID NO: 53068 - DNA, 1639 bp, Bovine  19866881205112
cccttcccttttattgttaaacgagttcttgtttggaccataaatgattgtacccaggcttgtagatgaggagttgaggcttagagctttgcctaagtgtccccagctggtcaggggcagaccaggttttacactgggttctgtttggaatctgaactcttgatgctcctgcttctgggccggtagggaagaggaaaggcaggggactgatgctgaaggggaggctgaagcagttccagtgctcctctgataggtagcaaaatggaatctctctgtagggtccggaaggcagaagttgggggcacccagcttaggaagtagttcgaagatgcctgttgactgacttgtcaacctgatctctggggggccttggcctgcagtggctccaagtagggttttggctccaagccagaaattgaggccgggatgcggcagtgagtaccaaatcctagccactagaccagtggtcagtgacaaggccctggccctttggatctgcagaaaagaattcccacaaagaagaaaagtagtgaaacaaataaaatattcattaggaggaaaaaaagaatacagtacgtgtggatagacacatgggcagactcagagagtgctgcagctttagttttcatcacttatacgggacatttcttccaggtttcctttggaccatcctttgacctgcctgattcagagtctgtatctggtatatctcaggatcctcccatatgcatacatgcgtctctcagccaagatgggttccacggagaaggcctatgggcagccttgacaccactcccgtttcgacttccaaggaactctctagtcaggaaggtctccttgacttcaagaatgagaaatacgtggtctcgtatcttttatctgtgcagggcccagcctcctctctcaattgtcctgctatcttcatctcacagtttccatccacagggaatgaactccaactgttcaccatggggtagatgagggcgggggttggcatctacctcctgcatcaaacctatggcagctgagaaagagagtctgccctctgaaatccaactcctggataaacttgttcaaggcaggtgccaggggaacttagatggggactaagtgttgttctttgccaagaggtgacccacatgtgcctggctcttcttaaagtccagatgtctgggcacagaaccaagaatctgagtctctgtttccagtctttggcctctgatctgaagctagaagaagcgacaataagaaaatccccctccagttggctgcctttaacacatcctgtcccatcccatttgtggaggagggaacggcttggtgagcctggctactgctcttggaggctataaagtcggtgcctgagaaatgaaaattgttgttattaccatgcaaactgttgatgtaaagggctggtctggagtactttgcttccttaattagagctgatctttcttttcctgcaaatttggggactatcctgttattaatgacctttttggatccatgcccaggacttagagatattgtctttggatccaggtaatgaggtcgctactgatcctgaacaaatggggaagaatttaataattactctgcactgtactgtggggacctttcattgtcaagatagaggcat

SEQ ID NO: 53069 - DNA, 1492 bp, Bovine  19866881205814
acccggcacagtactctgagccttgcttccaggcggtcgttcccaggacatcagcccagtcttgggaaatggtccatgttgcccatcccatctgctttgagctgagtgttccaaacgcaaaccgaccctaaaagccgggcctgattttaggcagtagcaaagttgggctattgtaaggtttcttggttccaaaatgctgccaacttgtgcttttgtggttcacaattagactcttgatcatatggaggcaatgaactgcttctgctccaaaagatttggaaccaactggctcatttaacattttaagaaacactcttaggcctcagagaatcctttgtgcatcctgggattttatccacagggatgtggggacggtggggcacaaatcaggatcccatatccctacgttgaacacattgtactcctgcccataaaggtgaggcagagggacttccctggtggtcccgtggttaagatttcacctgccaatgcagggaatggggggttcgatccctggtcaaggagcttaagatcccacatgcctcgtggccaaaacaccaaaacataaaacggaagcaatattgtaacaaattcaataaagacttttaaaaatggtccccatcaaaaaagttcttaaaaaaaaaaaaaggcaagggcagatgtcacgatattcacaacatggccctatgccctgcctgctctgtcttgggcagccaccgcttttgttcagattccagttcccatccagtttctgtgattccggatcattcattggctgatgtgtcctttgtctttgatggtcaggtctggcctctccagcctcaggctttctgctctctttcagcatctctatctctgattcaccctaccagctctgtcctgccagtacagatccgcttgagtaatgagaagggtacagactctccttgcccggtagagagctgtttacccagcataagtcatttctgctgtttagtcttctgtgacgcgaaacccgtcagacagcaagtgagctccttgggttctaaaagtcatggcgccgtcacattacagaatgttctagcaggaaaagcctttagatgccaccgcattagcactagaactcttccttctaatgaattaccctgcagaatcatgatacagaaactagattttttttttttaaagaggttgagagttttctggtagaaacagactcctgagatccacccattttccagaaacccctgggagtccttagagtcctagtgactcctctgagcccagtgtgaaagccactcatctagtccaatctttacttcacagggaaggaagtgaaagctcggagaggtgaaggaactcttggatgagtcacacagctgtaagcaagaggactgagttgagtcccagagcactcgccttctaagtcagcactctgcccctatccttcatgtttaccttcatcttcattatttttatcaatcacaatgtcccccagcctttaataaacatg

SEQ ID NO: 53070 - DNA, 1446 bp, Bovine  19866881225296
cagcccctggcggaaaagtcaaccagcaaatagaaatgtcactcaatcatttccccgtgctttcctctcattggccttctccaccgcatataatgaaaactgctttttgcccaaatattgtttgaatttcaaatacacaatttcccccaggggtgaccagatgaaaagagaactctggtttgcaacataagacctctatgtggaagttgccttgaatgaacaccaaaacgaaatttttattgagctccttgaaatgacagaagcacatcaaggcaaccaggctcccttcccactgtggtgtgctaaaattattttaaatgaacaccaaggaagcacccctcaaggggtgaggaaagaaggaaaggattttaaacgcagtgggcaaaataataaatccgttcatggcatctaacccatccctacaagcaccccagcatgtgtcttccgacgtgtctctctgtacagactctgactgtccacagctggggctcttaatcagagggaggaggacagtctaagaggccctagggcaatgattctcaatcctgactgcattagaatctcctaacgtgttgtagaaaaaacagatgcccagatcccaccctggaccatgtaaatcagagtctctatgtgtaaggcccaggcctcagaattttataaaagctgccagaggattcaaatgtgcagccagggtggggtgtatacatcaattcagaggatgtaacccctagaaatggcagctaaacttgtgtatgcgtgagaataggtgtgtgtttctggggtaagacatcatagtaaaagtcacttagtcatgtccgactctgcgacctcatggactatacggtccatggaattctctagaccagaatactggagtgggtagctgttcccttctccaggggaatctccccaacccagggatcaaaccctggtgtcctgtactgtaggtggattcttaaccagctgagccaccagagaagcccgaggggtcagtttcagacaattctttaaaatatctgcaactctaaacaggttctcataatacatctacaccttatgtcatgggttccttccaaccagaaaatgatgtgtacctaagatgttgctgaggtttaggagctaaggggcaaacaaaagttctctgcttccttgagcagtgagcttgttgatcaagatcccacacggcaacaagctgtcagtgaggggttcagggacactaatgagggaaggcccactgaagaacagagggaagcattctcacaggcaaaaacagggccccggtgtaatttactatttcggcagcccagcctgtggctcagctgacagctgtgcccagctcggcctccaaatctggacatcagaagccatgaccagagggagggtcaagtgcccaggatctcctattttgggaactccatagctcggcggccactgcactccataaaa

SEQ ID NO: 53071 - DNA, 908 bp, Bovine  19866881249313
atacacacctacgtatgttctgaggaggtgcacctgtgtgtacttgtgaagcacgtatgctgagaagcatgggatcccaaaatcgacttgctggggattttctttggctttctgacaaatgactgcacagcttgatcgacctgaaagcgctgggaagcccactgcctcatgggcagctcctcctttgctggctaagagtggttgttggacaatgttattccataatacaaaatctgcatccagattaattctggttctgccctgcagcaactgagaacaatatctaccttctcttcctatatgacagctcttcaaatattttaaaccaacgttcacatccctaaagaatctttgcttctctaggctaagtatttcccgtcccgtcacttcctacagtcataccttgagtgacataggacccagattgcttgttaggattgagtagtggattgttaaaaaaaaaaaaaaaacaggcgctgaaatcagacctagctgagtgtgaatcaccctcattgagtagagtcgactgaacagagacctggtgtttgcagctaaattgcaattgccatcttgcaatccaattacccacacatttggattaaacaggatttattgagctgttactaggtgatatgggatctatccttatcaaacgtacgtattatcacttctgttttagaaacataaaaaactggtgcatagaggtgacctaccttcccttgggtcatacagctagtctataaaagcaaggatatgaacctattatgggttttgtttccaagtcaagtacgtgtttgtatttggagactgactgggatactggagatgcaaatgatttgcatatgtaagtatatctggggattccctgatagctcagttggtaagaatccacctgcaatacaggagag

SEQ ID NO: 53072 - DNA, 2076 bp, Bovine  19866881260745
atctcgtcccagtgagatccctcttcctggttcctggcttgtgccttctggctatgtccttgcatggtggcagggctagagatctccctggaaccaccttcataagggcactagtcccactcgtgagggtcccaccctcctgacctaatcacctccccaaggctctaccatcacactggggatcaggatttcaacatacaagatttggtgggacacaaatactaaaaccatagcattacccaagtattttattctgaggatatagagtagcagtttaaaaaaaaaaaaaaaacacacacacttcagaagccacttattaaatacatatgtttttatatagtttagatagaatttttatcttgttgtcttcgtagaaaaataatcaaaggattattttactgaaacactgccatattacagaatgccaatgaggattttgaaaatgctacatttaacccaaatgtaaaacttgaaaatatttccaatctgctctagcgcatgacttaattaattaaattttgtgaatattgactgtaatcatttctatgccaacttcaaaatctagggtaatttccaccccctggctttattaaccctatcataagtgctggatttttttatagaagggattttattcccaatgaacatcagcatcttgttttaaattgcacattctcttccattttagcttaaattatactgacgagtttaaaactggaactctttgggatgggtgccacagttttgatggcttcatcaataaaagctggatcatgataagtgaggtctctcctctctgagccctgtctcctcatcttctcctctggactctcctacatatggataagaataaggtgttttttgcacacagttcttcttgcactgaggttgtggctaagtagtcaacttctcaactttttatcaaaacgcttctgtaacttgacctctgcagatccaggtgctatttgagtgtgcttagtgaaatgttacaagagtttgattggatgacagtgacagagcattgaataaaggaaaagcgttactctctatgattattttattaatcttctaggcctgccataacagattacctcaaattcagtggcttaataaacgacagacatttattccctcaccattccagaggacagaagtctgaaataaaggtattggcagggcagactccctccaaaggctctaggaaaggatctttcctttccttctgtagcttctggtgactccaggtgttccttggcttgtggccacatcactccagtctctgtctgcatattgacctagccgtcttctcttctctatgtgtctcttataaggacacttattggacttagggcccacccagataacccagaatagtctcaattcaatatccttagtttaattacatctgcaaagatcgcacttccaaataaggtcacagccacaggttccagacattaggaagtgggcctatatttgaggggccatcattcacaccccctacaatttttatcatttatttaagttgcaaaacagggaatggggaaaattataaaaagttgcttctaccaggctatcccactgcaagctaccctatgagcctggctcaatttaacattacataatgcaggtttttcttgttaactcatttcatctacttcattatgtaccttcattatgggcatcatgcttataatttttatatcactaaaactattgtggtgtaatgtccctataatgggaaaacagaaatgatcagatattacctaaattggcagatagtagatttcttgtgacttggttaatatgtaattcatttaagcaaacttaacatccattaactttccttgtaggggcccattagctttaataatgcattagctcttttgtgagacttgagtagctattcacccagttcccacccctaaactcttactttcccagggcgtcttctaaatagaatatagccccacccacctaaaaagttatactctctcccgaatgcaaaatatttcaagcactacacctcctaccccttggaagacttgctaatgatctttataaagccttttcttttga

SEQ ID NO: 53073 - DNA, 756 bp, Bovine  19866881281803
cctttctgccaaacaggggttttgcaaggatcaaatgaaataatatatgtcgtgtgtattatacacctcaaaaacaccacatcaatttaatatttccaattatattgatgttaagattaaacacactggaacattaacagttcaccgaataaccaactttcatggttccaaacctacctctgctcagactagtcctgcttgaaatttcctctgcttcgccactgccagactaccaccagctcagtaaagataggaatctctctgtcttaaccacctcagaattcctaaaagttggcagagtgcctggcatagaattcataggtactgcataatgagtgtctactaaacactagataccatcagactttgctatacggttccttaacccccacgcctcaaccctattagatgggtaacagaagaggaagctgacgctcagacagtttaaataactctgcaaaggtgataaagctccactagcgccaaggttaggccccaaacccaggtctttcacactccaaaactgtgtccttcccactctgctactccccctttcacactgcagacgcccaaggagttgtatttgatttcaagttgtatttgattcgttttaaccatgttacataataagacataacttaaaagcaagcattttgacaataaactaaaattgcaaactgaaattttaaaatccatgggcttaagcctgggtaagatttcccccaaatgcacctagattcacagataaagcaaaag

SEQ ID NO: 53074 - DNA, 1152 bp, Bovine  19866881364258
caggtgagagcaggtcgtagtcatataccaactaggagaagcagttcccccgtacaaggacccaggaagccaggccccttgacaggagggccccagacctaccaggggtcaaggagaatctccaactgggagccatggaccccagcaggcagccactggcccaaggagtcctttggcactccatgtttaatccccaggagacagcgtggctgaatgtgaagggtactggtctgagagctgtgtgaccttgacaaaaaccacctctctctgagcctcagcatcctcactgcagaggagagtgttgacgggacaacctcacaggcccttccaactatgtgacgagtgacactctgtccttcgatgctgggtgggggttgggggctggaacttccatcacctctcagccttcccagccttctggctaatgtcctcattctgaccccaggaagagcaccccattctccccagaggggttcgggagttcccctgctgaagcaggacaactggaaagcctgggtgggggtgggccctgccctcagggacgctctgtccaaacggcaagcaaagctctgctggttttgatgatgaagatttacagccagaagtgagtttctctggcaatattgtctgctgcctttatgagcagcaattacatagcatttggtacctgggaaggcaaccggcgagagctgaaatggtaaaatgctctatcactccaaggagcacaacgcctttggtaataaatattgacgttcattaagacaaagccagaattcaatctgttctggggaattctctgcttccggcctccagaatggcccttatttacaagatgtccctgagggaatgagacaggctggctcaccttgctccccaagatacattttattcaaccgactcgtcctgggcaaacgtgcatctgacaagccaatttgaaaatgaatttggtacattttttgagttgattatttattctgaaaatgaatgcctgctctggtcaggctgacagctctcaggatgagagaacccgtgctcccagctcccattccttgcttcctccccagggaaaggggcacagatccagagacccagctctcccagcactggggcaggtgggcccctccagcctcactcaccggtactcagcccagc

SEQ ID NO: 53075 - DNA, 1082 bp, Bovine  19866881366075
ttttagtgactgtcttgtctgatcctgtttgcctgctctccggtgacctctgagggcctgattcaactgtgaagttgatatacctgacgcccaagtctgcatctttcttcgtcctgtgaaaatgtagagctgcacatcactcatctgttccccactgcctgtgtccccccaggcctcccgtcttcacggaggagtcctcgcccttcagactcactcttggcatttacctccaccgtcaccatgcttctcccacactatggttcagagatggaccaggttgtatagcttctcctttgtgattctaggatctgatctttcctatttacgactgctgctcctcccacccttgttcaggccagcctcggcctgcctggtggtgctctagtaacttctcaagcaaagtctctcgtgtccgtggtcccctgcttactatgcttatcacacacacacaacgttctgtccatcttacctctgtagaatccctcttcttgagtatggtgtggttattatacctcttactccattccatccacactcataagcttaactacctcctctccctctgcagcatccaaaggttacagtctctattttgtcccaaatgttcagacccctccgtagtaatctccaagtaaggccttgcttcgcccatcttaaggccttctctcctctaaaatattcacaggatctttatcacaccctatcttttatcctaattctctgaagacccatcttgtctatcctactaaatcttgagtgcctggagagcaaattctttttctttagtttacttatatctatcacgtgtcatagctaccatgtaatcaacagatcaataataaatacagctgacattcactgagcattaactatgtgctgattacagtactattcaaagtgctttacatacttttttttcttattttagttcatgaaaaggtattattattgttatttccttttataacggtgcacatggaattcaaagaggcagacaagatcacttctctgcaacatagtcaggcaaggcttcggataatccatagggtacagtagggaagtttatgtgcagatgggcagcc

SEQ ID NO: 53076 - DNA, 1805 bp, Bovine  19866881384060
ctattctttttaagtacttacaagttggcaataactaggtttccccagaccactctcagaccaaaatttccacagccaaattgatcgtctcttccataaagaccagttagccctgcttcccctctctctctgttaaaagcatcaccatctgccaagtcagccaaatagaaagaagcatatctcctcccccgcctcttctaatccagttgcaaagtcttgtccatttgttctcaaagagtcctcaggtctctcccatctctcctattctccctgccacttctttagcctggcagtcatcacatgttaatctcatctcttgctcgaacccctgcaaaagcctcctaatggtagccagctgtagcctcctctgttttaccctccattctgactcaagaatatttttctatcgtgatacagagtaggaaaaacaaatatagtggtgtcgaccccctcaaagtcccgcaatgtctctccatcacctcccatgtaatatgaccatccttagcactgcacatgaggccctgtgcaatgctgttcccagttactttcacattcttctacactattctagcctttgcacccacagccagtcctactaaatactgttccctccaaatgtcatgcttttatacaacttcatgtctaagcatttttgcctgaagccatctggtcacgattcaagacagcacatcttgcccctggaaacccctaagaaataagtcaaacacatacagactttggatctctagctaactgggaactgggataaaacctgaccccttagagctgcaaacttgactcaaaacagctgaaggcgttatcctcggcacagcacagtatctaagcaacaaactgcctgagttcaaaccccagctctgcattgtactgatccagggcaagttacttcatctttctgtgtcttagtttcctcatctttgaaatggtaatcaccattattattccctatagggtctcataagttaatatatgtaaaacacttagaaaagagactctcatgaattagggggagccattactcagtgtcactcagacagatgatatatttggggcaactaatgtttctgccatctgactgtacaggtaagcagttaattggatgaaatggtaaaatgtgaatgcaagctctttgaaaacttcaaagcactagcgaattttccagtattactatcacaatgcctctctgtacttccaggaatgcatacatcaggatctaaatcctaagagttagatctcattacaagaattagagatttaaaattacatctacccctatatacaatggaatattattcagccataaaaagaatgaaataatgccatttgccacaacctggatggacctagaggttatcataccaagtgaagtgggtcagacaaaggcaaatatcatatgatatcatttacttatatgtgggatcttaaaaaaatgatacaaataaatttactagacagaaatagactcacatagaaaagaaacttatggttaccaaaggggaagtgggggagggataaattaggaatttggggttaagagatacaccattatatataaaatatatcaacaaggactactgtatagcacagagagctatattcaatatcttgtaatagcctataacacaaaagaatctgaaaaagaatatatgcacatggcattcctgctgctgctgctgctaagccgtgtctgaccctgtgcaaccccatagacggcagcccaccaggctcccccgtccctgggattctccaggcaagaacacggagtgggttgccatttccttcttcaa

SEQ ID NO: 53077 - DNA, 1226 bp, Bovine  19866881403280
ttcatctgtgagtcaacaaaagtatgacaactgtagagtttgtaagcagaatacattattaatataaatggtaaggctaaataataataataaacgtcaactaaatgctgcttctctgaaccatagctccgtgccaggcactatgttgatccttctgccacacctaatggttctgaacatgttctggcatgcatgagaatcgtgggccccactctggggttttaaatttggcaggtcggggcccaaggattggcattcctggtaaatgcccaggcgatgtgatgctgctaccctagggaccatagtttgagaactggcatgcatcatcttactgaatccttcactgcgtccattttacagatgaggaaactgaggctctgagaagagctctgatacgtcatagctgtctacatcaagatacttaacttctccaggtgtccgtgagggtgaccattcccattaggagtttactcatggccaagtcttgtcctttctctctaaacgtccccctgactttatccgaatgttaatccgtgtcccttttctaccacccattactataataccatatcagtgcagatttatgatctgccagcagtgttgtgattagatgtcatccctgtctttctattactccgatattgatagataaaattctgtggtgatgcatcgcctgccctttcaaaggttactgccagcagatgctaggaatcaatacagttcttatctgtcacaaaccacaagaaaaccatggtaaacaaggctcaatgaaaggcctgtgaataggtcaaagggagaattccagaggcacggtgtcaccatggtgtccctacctaaccgagaacctgctttggagctcaactatctgttgaggatttgggccatataatatagtggggctcggaactaggccctgggtccaacacgacctctggggaccctttgtcatgggagctaaggtcaaaagaggttaaaaatctacttttattataacatgcggccaagatcgataagatcatttgagctctttgaaggcaaaggctaaataaatctaaggagatacggtaggtttacatacctgctgttttctccatccatctttcaataggaagagtcttagtttaggcaaaaatgaagataaaaagcacaatattttcattttttaaatgtttgtaactcaatttacattaagaaaaccaaatggtagttatagataccctagaaaa

SEQ ID NO: 53078 - DNA, 923 bp, Bovine  19866881412034
tgggaggatgaagggaagctgctccctgcattcatttctgggccagcaatggtttcaggcctcttcatttacattcgtaattgacagctccttagcagctcattaggaaagtagggctttgtgaccaacaaaaaagaggaatgaatccctggggttgggatttgagaacctgtttaagaatctctaaaaggcaacgacagattcccagggagcaggaacacaaggagcttagcaatcatcagtggcaatgagcttcagcatttcagcactctgcagtgagcctagaacccgtgtctgcacctgctgtggaggcgagagaagccgggacaatggactgaggcaggcaggccagtgccaacactcaggggtcagctagtgaccgctccctgcctcccctggactcagactgggctcccagatcctcatggcatcagcaagcaaggggtagccccttaaggtatccgaacccaaatgctggggaggcagggcaagagaaaaccatgcgtgctacaaccattaatcaggcaccacctgtttgtgaaccgtatcccatatagcaggttgttttagtcctcacaatggaattctaacaggataatcacctgcatttattttacaaaaaaggagtctgtagaacaaaaaaggcttcttgatacgttaaaattcacacaagccagatattatgagtctgggaatcatttccccacagcagcaaagtggacaacccaaggaccatgtgccaagagtgaaaggagatgcatgcacaacaaattctacaggaattcaagggagatagaggccctcctgaactagaagagccagggtaggctgccaggcaggtggcccttgagccgggtctcaaaggctgaagttgggtttagaaagacaggagggagaagagccaggggtaagggggaaggcaa

SEQ ID NO: 53079 - DNA, 1433 bp, Bovine  19866881442687
agtccctggtgctggcagtcctcaaaattgacaaatctaaaaagtgaatagaacagcaagtagcccactagaggttttcttttttctttttctgtatttttttttttttaaaggaacaccttataatgtcggaagagttgatttttgcatcttatacatgaaaagtagtagtaataaacttccacaattgttggtcttttctctgcagaaattatggctgtgcacaactgtggagttttaactgttttccaccaaagtccgtaattcacacactaaatgtgacaagcgtgactggccgtaaacctaacgacttttttaagagactgaaattcagaacagcattctctctgaaactgcactttggtaaccccacagaaaacccttcagagatctgctcccactgcaagaaaggcatctgggtgtgccagcagtcagaatcctgaacgctttcatgtagcacacaagttagggggatgaagtgagaaccgattgcaatcaccctgtattaagcgaccagaagaacagaaactcagtggtggcaatgactattgtgctggcccatcctctcttccctcccattaaaaaaaattataaaagtttgctaagaaacttacatagtggtcagaattcttatttttatgttttaggcattttattttaactttttattttgtattgtggcataactcgttaacaatgttgtgacagtttaaggtgaaccgcaaaaagaccccagccatacggtatatatgtatccattctcccccaaactcctttcccatccaggctgccgtataacattgagcagagttccatgtgctatacagtaggtctttatcggctatccattttaaacatagcagtgaataaacttatggttgctggggtggggaaaggtgtagttggggagtttgggatggatatggtcaaaattctaggtatataaagtttcagagtgataggagagaacctttccaagctgaggttcttaggctttaggtgaaggctttgttctttgctttcaaggtaagtgtcatttcttccagtgagcagctgctaaggatgctgttagcctgcatctggaaagcaaggcacattcgctccagcagccggtccaggttgatccatggatgttcattaagaggctgtggaaaagtgaatctcctgtttaccttttcttcccctgagcattctacgaggctctttctgtgcccgcttttttctgcctccagcttaagacccttattatttcccttaaatgtctgtttatgtcattacctgtatttttgcagcaaattttatctcctggacagagattgaaaaggcctgctctaatgggatagtgtagctgtttttcccccctcccttcagatcatataattgaatctcatcactttcgtaacaaacctaggcagcctcttttcagtttccat

SEQ ID NO: 53080 - DNA, 1752 bp, Bovine  19866881485982
tgtttcagagagtgagagccctcagctgttgcagctggaaaggagattccatgcgtaacttttaggcaacaaaggattgttttcgggaggtgggggctctggttactcagtgcatcttctgggagggagataagacaagggggctgcagcaggtgggatttaggtgggatagaaggaaggacctcatgacccatagcatcagttgtaaagacaaacgggcctggacaaatcactttccctgaggatattgccctgctctttcaggccacccacctgacatacttatctggaggcctggggtggggctgggggtgtagaggagggaatgggagatgcaaggctttctccagcagctgtatctcctgctgtgtaagtttgcaagggctgctgtaaccacaggctgggtggcctaacaacagaaatggattgtctcccagttttggaggctggatgtccaagatcaaggtatcagccgggtcggtgttgagaatatgttccacgtctctgccctagcttttgatagttgctggccatctctgggggtcctcggcttgcagaagcatcattccaagtctgccttcatcttctcacgatgttccccttctgagagtgtctgtgtttaagtttctctcttttataaagatattagccttgtgggatcagtggtccatcctacttcagaatggcctccccctaactaattacaaaccctatttccaaaaaggtcgtattccaagatcctggggtgaagacctcaacatatgcattttaaggtgacacatttaatctgtaactcttaacagttagcaataaaagattatcaagagggtcggtgggctcccctagtgggggaggggataagaatctgcctgccaatgcaggagacatgggttctatccctggtccagagagatcccacatgctgcagagcgactaagcccatgtgccatgactactgagcgctctagagcccattctccacagtaagagaagccactgcaatgagaagccagcacctccatgctgcaatgagagaaagcccatgcaaggcaacaaagacaataaattttaaaaaattaaaaaaaagagggtgggtgacccaagaagtcagaagttggagaaagaattccagcctctatagcctttggctccacaaaggctcctccatgttatttctgttggaggagcgtggatctgcttctcaaactcagatcttttcttttccttgacttttactccccaaagcagcagacggtcctgacattacaaataaagggagctctcgtgggctccttagcttaaagggccggctggtgtccaaagtatcctaaccacaagaaactcataacagcacaggcagcaaacctcccagctgccttcccacaggtttcagaacagattcgatgaacctgctcactttggaaagagaaggtaaaattatttcacatctggctttatgctgacctgacaatgacaccgcccagggatccagttaatgttcaaagaaaaatgacctgttgttcaacattctctatactgtccatccaattcaattagctaatagaatcatgaaatgtcagtgctggaagtgtagagataattcaatctaagctcctcgttttttagttgaagaaagcaacgctgagacaacgcaaaacattgtctgcattatcgttagggtcctttgtggggacactcaggtttgagggctcccaggccagttcagtgtgcatttcctgagcacctgcttaa

SEQ ID NO: 53081 - DNA, 1082 bp, Bovine  19866881534635
accaaatctttgagtatatggtcttccttgtgcccctcatatcatctctccctccactccaaggtggtagtggttaacctttcattataaaatcgttgcactcagagctccttgctgaagtactgctggagggttataggttgcatgtttgaaaagtcctttgagttggagtaagttttgtaactgctttgcatggcaggaagaagcctctctgatgactcactgagcctgtcttggagtgggtgctctgatgataatgtgtcacctttaatactgcttgacaggatttaaccacacatgcaacaaatcaatggaatggagcgcagatgcacttgatctatattgtttgtcttcttttgactgatgcagaccaaaaaaaaaaaacaaaacttgatagcttcttggttaatacagctttggtctgaaaagcaggctgtgatgtatttgggggtgcatatgccaaggcctgaaacaaagaagatatttactagtctggacaataaataggcaatatccagctaaacaatgctacaggaggaacctggttctttggcacacacaatgttatgtcagagttctctaatacattattactgtcattgacaaatatatagcccactaaaaatcataaatgatcattttaatgaaagttgcatcatttgtgagtggtacttgcctatacttatttttagagctgtgaaaacaaattagaaacaaggctgatggttctactttcttcttttatttatttttgcctcttccaaaccttcatgaacagttttgactgtcggatttgtttcattgtttccttccactgcctctagaacatctgttggaaaataatgcttgtcctgtcagtttccagaatcagcagcaaaccaaagtgtgtgttcaaggtgggtgccagcattgcactaccgctgccaccaggctaccggaaggatgggcttgatcctattgtggtaaaaatcacttttaaaaaccatctggacacctcgattcaggaataggacgttcatcccaaaatggaccaagcagaacaccagcagagatggattttggggccgaaggcacaaatacag

SEQ ID NO: 53082 - DNA, 1569 bp, Bovine  19866881777596
atagctgaggaggcttattgactctgagctccctttggaaccgattcagaaagctgtgcacttctgtggcacctgggagacactcagttgaatagagctacggagaaaagcatttcagttattggcatctttcctaatgcattttgtatgtgtctataccgcagggagaaatgtgtggttattgttgaaatattatctacatggctctgcagaagaagaaaaggccccgtacaacagtcaacacattaagtctcgtgatgttgtaatgctttgggggctgtgcatctctccccaccaaacgccggtgcagatatatggcttcatcgtttggattccctcattagacatacaaaagcccttaaagggaccttgaacttgacaagttgaaccttgaacatgacataatttggaatgttgtttaaacattagtgtttttgttgttgttcacctgattttaaccaggaagctaggctttgatcatctgagtgtgctgtacgaatctaggtaggatgtcaaactctcagaagtgcacagaaattaatttctttctccttctgcacagatagactcctgttcaaatgaaaatgtgtgtggacagatttttgtttgtcatgtgtgaactgggcatgttggtctaaaaggagcagttttaagtgggtggatgtgtcagaccctccggctatcagagccaccttatttccacaaatctcttctcatataacaacattgcaggaagtctggataattgattctcctgagcaatacaaatattgggatgcttaatcattccaagagatggtcagagctactgcttttatatttttaaaaaaacatttgtttactctgctcaggcattcattaagcacttattgatcaacagtctaccatgggccaggctctaggctggatgatgaggaggccaagggggagaaaggcataatctctgacctcatagctcatcaaggaaggcagatcccagatggataattgcaacgcatgcaacaattaatttaggatgtttttatttaatgagtatgtgctaggtgctgagtggaagaagccagtggtaagcaaaagcagatttggcctctgccctcatgcgccttgcagtcaaggagtaattattaaatatacttaatataattatttattaagcgaacgtcgcacaaatgtacagttattaagtggtccaagtgtcatggaggagaaacctatagctcagtgaaatcataaactaagagaacttggtgtggtctggatggccagagtgggaaccacagaaaagtgatgactgacctgtgactgaagggccggtgtgagttaaccaggccataaattgtcggaagtgctttccagaaggaaccaagtgcgttaaagggattgaaagaaggccattgtggctggagtcagagggcgagtggagaggtgggcagtggtcaggccgctcagggccctgtaggctctgggaaaaattgggggctttattctaagaaacatggaaaggctttgagagggtttaagaaattaggaaggggtaacatgatcctagtcatttcctgagaaagagca

SEQ ID NO: 53083 - DNA, 832 bp, Bovine  19866881808635
ccagctgcgactgggacaagtgtctggtcttctgagagtgacccagaagagatggtgaatctgtttgagatatttctactaccagtgcattttctgcacatacccgactgtctgttctccttctcttgtttatagtttttaaaacagaaataagatagtctgtagaaggtattaacttgagattcacattcttaactgcatagcagatgtcttactaattgaggcttgtatttaactgggttaaatgcagtggtttgatgttagcatacagtgtggtgaagtccattgtactttgatgggaagggctcagctttgtaccaccctgcagtgtgcaagtcttatatcgtcctaggatgctggttttgctgtaatttcatttggggaccagggaacattgcagcatggcgagctgggtaggaactaaatatttcagatggaggaaggaatattgttctaattaaactgaatctagagcctgtggcaaagtatgtgcttaatatattggggtatgtgtgaaaaattacatgtattttcataaactggtttttttccctctctcatccttgctgaagggcttttgttttgaatattgtttgcacagaagaattattttgttactgacacgggacagcataataaaatctggaaagtcgtaacagttaccctggccctgaaatgtttctcttctttggatgaatagggaatatgagttcagacttcttctttaaggtggaaaacaaaagagtgttattttttctccattatctaatgcagagggcttccccgatagctcagttggtaaagaatctgcctataatgcaggagatccctg

SEQ ID NO: 53084 - DNA, 1555 bp, Bovine  19866881875081
ccaggtaataatactagagtgggttgacatttcctccaacaggatcttcccaggccagggatcaaaccctgcgactcttgtgtctcctgcattgcaggtggattctttatgactgagccatcggggaacacccatatatttaggttgtacaacataattttctttaaaggtgtacaacacgatagtttaatgcagtatacattgccactgtagatgtataaattagcattatatccatataaattagccattgtcattgtatacatataaatgagcaatcctcaagaagcactgagacacatgtacacatactacaatcaaggtgagtaacacatccatcacctctcttagatcctgcagtaatttctcagaaagcatcatggaccctctaaagtcaaagacatgggtaaactgtaaaagtataaagaataataagcataatgagtttttagcttttctgtttttcttctgaagggagtgatattttagatgtgtataactaattctttttattctaaaaatcagagaacttaaaattgttactaggcctatgcccattgaggttcattttgtatgctgagcaaacacgcatcactcactgaaatattcagcgaggggtaatataatactacattataatatctttttccatacacatagacacacaaacaaataaacaaaaaaggacatcaaagggggttttctttttctcaggccatggaaacacctattagtcattttgttaaggctcagggcattcagcttatatacaaaactcattactgtctgcattttaagggaaatttaaatgcagtgacctgaccatggacacaataatgaaacaagattctcattaccatgctctaaataataatctaaaaaaattaaaccttggtaatattttaacgttcagataaatgcctgctttaagcccagtccatggatgctcgtgatttctagttgaaacaaaacctgactcgggtaaaacatacactgtggtagttcgatttgttatgctctggatagcgcctgtctttaaagaactacctttccctccaattaaggaacaattttgccaatcagttttcctggcaactcagcctcacaaaagagagagggaaggggagaagcagggggtgtcaggaaggtggctgcacctcctgacacattgcgactgattaaagaggctctgaaagaacagaaggaaagtgcatctcaagaacaacagaactttcagtgaaagtacattcacctaattgaaaagcagctcgaagctgttatttttgtaccccaaaatgcggaattattcttcaaacaatttcacaaaatcaataaaagagaagtagtgctctcccgactcctcatcctaacagttgccggtctgagatatcgcctctccttttctctgtttagatttaggcccaagtatctaaagagaggcaagagcaaactgtggtctctcacttaaggaagacaccatgaaagaaaacggccatgtatgtcttgcaccacagtttttcttctaatgtttctacatcgataatctagaacacca

SEQ ID NO: 53085 - DNA, 819 bp, Bovine  19866881907584
tccctctgtctgcagcacagatgagggagttggtttgctgatgctcagcctgttcttcacccaggctctgggccaggtctttccagaattcttgaggagaccaccatctcgggagtcatctgcctatatctctatctcctaggagctctcagaagactgcctctgttcttccttcctgaagcctggactccttttgcaccagcagtcaagtttacagtttctttctgatataatgtagttcatttgatggggggataaaagatgcatttgctctaatggatgactctaggtcaggcaatttacttccccactttgggtttttatgatttggctaggtgacacctccttcaggcaggaatctttcaagggtcacatccccacacgatgtctttgtccttcatacctcagttaggttcgcttccctgtcccccttcctcagcagcccacatcctcaagcttagtccatggctgtcacaagtcaaggagatgctgccaagctagggcaggcacctggcccatggctgggaaagaagtcaggcttcccaatcgatcgtttcttcctttggtctctcttcagagctggctgctgcaattggatggggactgtgatgttttatcatttaagtctgttaagaatctatttctttctgcattcaaaactttattcccatcttctcagggacttaaaatactgtccttgaactgagatgggaccctggcgcattaaacacactcgcaacttcaaagctctgtgtgtgttgctgcagagggtcccaggggagacatgtgtttgctgtagtacaaagagaagccttgctt

SEQ ID NO: 53086 - DNA, 946 bp, Bovine  19866881971232
tagctttaagtgtaagagatagtttattctcaggcctttaacttaaaatgaatgttatctctcagagagaacaaggataaagaaaaaagacagtgcaggtttctgtctaacagccagagcagttggcagtaggggccgttgatagggacagatgaaaggtcaaggtcaaggtcagccagcagttcatggtcattcttataggtttcatattatgaagcattagagtgagaaaaaaaattctatgtacccctctttctttctcatcctttcccaaacctcccccacattctacatgtggaaatacaatccagaattcttgtggaagtatttttgttgccccaaaaaacaaactgacatgatgacctttcatcctttctctttacttgacctcaaaacctcatcccacagaatgtcagtatgagccccagtgtagaaaagaagtggtccaggtttgcacaaaatgagtcagggggcaatgaagaccctaaatctagctccactggggcctcttatactttcctccagcccctgctgttttctaatccatctagaagcaaacaggagagactcagctgtgagcaagtttggagacatggagagagacattggtgaccaggccctgttgttgcccacagaagaaaatgatgtaagaggaagaaaagagactgattgtatgtgaggcaaatacactgaaatgctcctgattttaacccaaatccaaaccaggtgttggcctttggacaggtcattttcatctctctgtgacccaatttcctcttctggacaatgacagatgtggaggagccaatctctaagctgtctctgaacttgggccttctgtggcctagctcatgatcacagatcttgttctgctgattaggctgggctctccttgactggaagagaagccgatgaaaatgcaatcagagggtaatagacatactga

SEQ ID NO: 53087 - DNA, 786 bp, Bovine  19866882010228
ctcagcctgtttcccaggctgatgccgtaaggaccctgccatctgcctgccttgctattttcagacttaatgctcaggaggaagcctgacactttccatcctgctctccatttctgttctgtcttatgtggacctgtcgcaggctcctcaccctctcctacctgcccagagtcaacccctcagttgaaggcatcccccacacccgggacatagactgatggctgtttgggttctaatgcccttctgtggcagctgggcattgggtccatcctcagggggccctcccatccttcttccctccttgccacagctctgatccccagcacctccactatcagggcatttagactttgcagccatggtggcatgctcctacagcaggggcctgggtggcatttgaggcaaaaagccataaagtcaagccctgaactttcacagcccttcagtctcttgtcacttccatcctctgtaagaattgagtctcgctgaaggactccgtgtgtgcaattagatcaaaggttactgcagagaagaatctctgccattgttaagtaagatataggccagccagggccccttggtaacttttccttgggagtttaatgcctcatgaaccaaactgtgtagaaggctggaagatgcacctcagagatggggaaaagcctctcccagggaagcaccaggaccaccaacctccctgactgcctgtcccaccagcctccaggagcaccacccacaccaggggagagggaatggagggagaagggtcgtctacttgcaggaacc

SEQ ID NO: 53088 - DNA, 812 bp, Bovine  19866880396997
gattccaagctttggccctagagactggtttatgatttggtttctcaaattttaggttgctaacactttatttcacaaaattctcaacaaaagcaagaaagaaaaacttcaagttatttggcgcacaccggaacctctaacatcccagaatatttatgcgagagtgaagtaatttagtttgttctttgacttcaatttctataggagccaaagtggtttcctgctgtactgtccctcttttgtagttattttaagtggtcaaatgaatactttataaacttctggacagcttgggtcaagtagcaaagattccaaacatttggagtctgtgtagatttccttcaaaggaaaagggtccttggtaggggggtggggaggtctgcattttgagcaagtagctcttctgtttcagaaattagccaggagacagctgtgaatcctgtggacattgtcagcactctgcaagcccttcagatgctcaaatattggaaaggaaaacacctagttttgaaaagacaggtaaagtttctgttagccttttactcattgctttatgtctcttgaggcctagcaaagtggagccttcacaccttaaagtgtaaccttccctttttaaagagtctgactccatgcagcttttccttggtctcattgttaggcttgtctctgactgttcctttatcagaagcttttggtaagctcctggctcacacttggatgacacaagcatcaacagctccagttaagcagctttatgttgcactgttgtacttctgtcctttgatgattttcttagatcagagaagagtgcc

SEQ ID NO: 53089 - DNA, 1628 bp, Bovine  19866880461531
ctcccttgcatttgccgtctaccctgggtgagtgacttattcctttgggtttattctctttgtgtgtacagtgcacactacccaggagctcacgggtttgaggtggaaaccctgtgatgtgtacaaataccctttgtgagataggtgttaccctaaggggcattagagcctctccaaggagctcggggcccctaccctggccctgcccatatttggctgcatctgttttcctccatgtttaaagtctcaggaaggtgttgggcagggtgtggatgttgtgaagggttaagggtggttactcaccctgggccaggggcatggaacgggtgtaccctcatctaggacgggacacatggtacgctggtgccatctggtggctacagataacaatgctagttactgggctgagagaagagaggaaggacaggaaagctggaaagtgggtataaaaggaaaggaggggacagagacgggcacccaggaaagaggggaggagggagcgagatggaaagagggaggcaagccagggcccacagcaaaaggggagatgcccaggactgggcctgctggatgttgtcacaggcccaggcagcccagatcaacagcccaggaagatctgcagcctctgagaggttcccagaggccacgcggctccagccccagcatgagtttgagccatgaggcctgatggtcaggaggctgagatccagcaggtcaaaccaggtgttattccacagggacccccagtttctaaggccacccccccatggggcctttagctgttggcccccagacaccagcgatgaagtgaaatgatccctggaaaaggttggccacagctcccccaaggacgcgtgtgaaggtaaacacgcttctgtacatgttgcccacatgtaagagcccagcacacaccctacaggccccatggacacccgtgacacgcacctgtgttacgtagatggcttaggccgggtggagtgcttggaggcccccacctcaccctcttccctgcttcctctcaggggcaggaggcagagggcaaacttgtttaccacttctgttctgagcaatggtgatgagctcagactggcccattgccctccacgggcagggctaggcctgagtcatgagggtcagatgactgcagaggctaaatgggtcccatcctgcagcccccaggagctgctggcaaccccgccctttcgctgatggtgggccgcccttccaaagcaatcaggatggggtggggagggggattcccagactcaggccccaaccggcccctcccctgaccagaggacaacagggcagatgacccccttgatctatgcccagccaggcctggtcccctcaacacccatccaggagcagcacctccctctgggacatcgtggttcagaccaacgccctcccagaatgccaagcactccttcggtcatgtgcaaggccccaaacacatctcagaaataaatggaatgatgcaaaagtggttgtgctggagattatgatacttctccctgggtctcagtctgccacactctgaaatgagaagagggatcaacgtcgtccaggggcagttcctaactgacacctgccttggcctgcagtatgtctttggggggctgcag

SEQ ID NO: 53090 - DNA, 1435 bp, Bovine  19866880558017
tggtgttggagaagactcttgagagtcccttggactgcaacgagttccaaccagtccatcctaaaggagaccagtcctgggcattcattggtaggactgatactgaagctgaaactacaatactttggtcacctattgcgaatagctgactcattggaaaagaccctgatgctgggaaagattgagggccggaggaaaaggggacgacagaggatgagttggttggatggtatcaccaactcaatggacatgggtttgggtagactccagcagttggtgatagacagggaggcctggtgtgctgcggttcatggggttgccgagtcggacacgactgagtgactgaactgaagtgaaccctgggttgggaagataccctgaggagggcatggcaacccactccaatattcttgcctggagaatccccatgggcagatgagcctgacgggctacagtccatagggtcacaaagagtcatacacgactgaagagacttagcacgcccgcaccttcaaatgcacgcatgcttcttgaagtacacacattggcccttgataaacttcattggcacccatgagcagacatgcttattccttcttcatatacatttgttctcctctataagagaaagtttgttgaccaataatgtgctggtaaataatcacctctctaggttggaagagaggtgatctgatttatagcatttgccaatttccatagagtaaatactctaagtatgccctttcaagctattgtttcaagttatcaatgcttttgcaacctgctcacaaaattactgccaatttcacaatgctcttagaagcactttggttcagtacaccattgaatgctgaccaacccagatgccctcacttgctttaagtgactagtgagtctgggtcttactgcaaaatggcttagagcatgggcttataattctctgcctcatggaggcagtatagtgcgtagttaacagctattacattaccattatcttgaaggattgtgatgaggctttaaattaaatgagatcaccatgatttttaaaaactgatatttacaagtatgaacaaaaacaagagtaaaaaaaacaccaaaagttgaaaaaaaagatgtttaaaagtcctgagcacaaatgtctggcatttgtaagacagttgtacaaaactttttaaaataaccctttcagattcattgactcacagagacacccaagattgcagaaatacagatccaaactcctcctcaatgcagtcagctctatcatggagaatcactaaaatatatcctctgaataaaggcatgctctaaattgtgtgatgcatacttttagaactcaaggaggttaaaggaaaggaaacccaaaatgttacaattggaagagattgcaaactggcagccctcaggcaaattcagttctccagggagttttatt

SEQ ID NO: 53091 - DNA, 956 bp, Bovine  19866880587364
aaaaaataaggggctgcttttcctgagattgaggattaaaatagattgagactcgattgaatttcaaagtattttagggggaaaaagtgatttggaagattatgaggaaagaggcggagatgcaagggatatgttgtcagattctaagatgcccctttattgtttactttttaaaaggtgcctcaggttgcgctagaaaagtgttttctaagtggtcatttaactgaatcagaacatcctgctttggggcctgggtttgttttttaacatctcctgttgattcttatgttctggttgcctcctatcacttcatgagcctgcaaacatggatgcttttgacttttttttaacttctgttttgggcaggtgtttgcgggtaaatccaaaaggactagatgaagaaagcaaagattacctgtcactttacctgttactcgtcagctgtccaaagagtgaagttcgagcaaaattcaaattctccatcctgaatgccaagggagaagaaaccaaagctatgggtaaatgttacctttgtttgactctgttttcacatccagcaactttatacattgacaagttgtggatttgatttgatctttttttgagtaaccctaaatataacttttttttttttcactccagagagtcaacgggcatataggtttgtgcaggggaaagactggggattcaaaaaattcatccgtagagattttctcttggatgaggccaatgggcttcttcctgatgacaagcttaccctcttctgtgaggtgagtccttttaccctgctgtgagagtagccagttcccagacctgatgggtattggtagatgtactgttatcaaggatggagagcgagaaaatccccagtggagtggtgctgcacgaatattatttacacgactgactgaaagctgtgccatgttttcaaggttgttgggcaactcagttttcca

SEQ ID NO: 53092 - DNA, 1161 bp, Bovine  19866880606272
tttttaataaatattccattgatagaagggagcaaaggtcaaagggacagaattttcaccaaaggatgatctagctctgaaatgcactaagaacttagatgagctgcagacatttttaaaacccacacatccaacacacacacctacgcaactgtcttgcaacgctgaacgctactaagtccacagagagtcttggaacagaaacgagtctcactaggcacaagcccaagaacgagaagcaacactcagcacctgtggccaacagagaagtgtgagatgaacagatggcacacctggtccgatggtaagaaaccgatggcatcagcagaacccagccagacgtttccctgttcaacatctcctcatttccaaagtgccatctcacttcccttctaagtcagtaaggcatttctaaacttaaccacagaatttctcctaagagaatttcatatggggaagcaaagagagagcatctcagactcaaccacaggatgagaaattgccaagtgagggcaggtcaactggtttccaaatcaagaatgtcaatacaagggctgaagcacatggaatggatctgggcggggtgaagtgctggggagagcatgtaagaaaacgctggacgcactgtagacttaaaaatatggcaataaaggttctggtactgcctaagacaccagatgcattatttagaggtgatttccttcagagaatagttcaaagattggctttcatttccaaaagaaattagaatccactattttaaattttttctgaaatacaggatctctaaggtgggtgaatatttgatagtttgtttatataacattcaatctcacacgaaaccacccaattgttcttgctttcatttctctacttgggcaattgagtatgatctgtaactactacttggatttacgtagaattgaaattccaagataaaaaataactgcaaaattttataaaaaataactgcaacatttcatgtatttttacagacacctacactctagtattttcttatttcttttcacttagcaattaaaaaggagaaaaggtagctattatgcaaactatattttatgcattcagtgtagtattttaataaactatacctcccaggttcactaatcatcagcaactctataaaatattcaatagctg

SEQ ID NO: 53093 - DNA, 1917 bp, Bovine  19866880616215
acagaggagcctggcgggctacagtccattgggtcacaaagagtcagacatgactgatcgactaagtacaacccagagttaaacaggaaggggatttcaggtagaggggacaagctggttggcgccattttggctaaactaaatcagtagataaaataaaccctagcctagcacaatcgttacaggagagtggaaggcacgtttacagttctggctgaggacttagacctgagtttacatccagcctcagtcatttactagctgtgtgtctgtccttgggcaagtgacttaatctcgtccagctttggttttgtcatttgaaaaatggagttaatagtaggggcttccagctaggattctttgaacacaaaacaagtgggcactcagtgactggcccatggtaagggcccagccagtgtcagttctcgtgacaatggcaacagctccttaagaggctcctaaagggaccagaagggtcagttctcaaaacagatccccaagctactctgagccacagaaagcatgtgaggcgccctttgccctgcccctcaagcgggctatcaagggaggagatgactcttggtgggttctacccttagcacatggtccccatggatgactcctgcttctaatcagtcaacaaatcccgtggattcctctaaaatgatttttccactcctccctcttctttacctccaaccccaaagcagcagcctggtctaagtggtctctcttcaccaaacctcctcctccccatggcctccagagcagagcagatctggcctcccgcctgctgaaaaaacatccatggctcccactgccaggaaaaatgaaacccaactccttagcctggcacccaaagcccctcctccacaatccagcccctgcctgcctttccagcctcctctcctaccacccacatgccagactctccagtcacactgggccaaccacctccaggtactgaacagcttttgtgcagccctgctgtggaaccctctttacaagcagcccttgccttaccctctgcctggaatgtcctttctcccttctctgatggctaaatcctagacaagtttcaaggaactatctcagacagctcaccctccctggagccctcccagactctattccccagcaggatggctcactcagggccatctccttctgcaactgcgtgtggaacatggttgaaggcctggggtcactctgtgcagtgacccagaagacctgttggggaccactcctctcagggcagagaccactgctgagagatgctccaccctgcagcccccttggaatacagcagggtggggctgcagaaacctccacggagccttggcatggatgccagcagcccagatagagcccaggcagcagccttggcacggctccgctgccggagatgagggtgagacaaacagcaattagccaagcacaggctgggctctcaaggctaattaccaattagatggggccgggcgattagcgacatgaaagagacagtcagcaaatagtccctggcaaggcacagcagaaggttgggggtggtgtctgttcctgcaagcaggcctggccgcctggtggtcactgcagccctgttataggggaggagagtatttccagccatgcaggggctgagctttctggggggggcttgagctgatttgctgccttctttttgattcccagaatcatcttcccagtggaactcatggcctgtgtttctagggggtgtggggtgatgggtgatgcgtgatttgacacccttggccaggttagcccaggaggaccttgcagcagtttggagcctgtgcccagtaggctgcatttgggtctggagcttgcctggcatggccaggctggaggaaggagcagagtgtgagggagggaggctgatagcttccttcctcctat

SEQ ID NO: 53094 - DNA, 1947 bp, Bovine  19866880693069
tggtgactagtatgaggtgtgcctgagaccccctggttgggtaaggcagagggtagaggtggaggggactggcctgataactgggaaaatgtctcttgttaaaacaccaggcccagggacttccttggtggttcaatggctaagactccatgctcccaacgcagaggttcctgggtttgattcctggtcagggaactatatccccacatgctgcaactaaagatcctgcgtgccactgctaagatccagcacagacaaataaacaattattttttaaaaacccaaaacaaagaaacaccaggcccaggtaaggactgctaaataggcccctggccctggtaacatgctctcactgcctaactaatccacagaagagagtttggaagaactatcagtccagtaggtaaggagctaattgatgcgactttcaggatgagaaacagagaaaagaaaggggtggagaaaagaaggaagttcagccagatgcatttaaaacctctcttctcaaggaggagttcaaaatgagagggggcctttcagggcagagctgcagtgacacccagggccccaagagagagagacgagtgcaactgagccaggcttgaaaggctgggtgcagggggtgggaaggcagcagcgcaggaaggaggctgggcgcccatctggagagccaaggggctggggctgctgaacagatggagtgaaagttgcagctggtggaaatgcactttcatgtgtaaagtttggtccacggaggatagcgatttccaactccgaaggcagcagtgggcaggtggctctgctccatgctccgccttctccccccactgccacccagaaaactcaacagcagctctatgccaggactcaaccactgtgccttcagccagcatccctttcaacaggcaggagctggcatgggaataccagggcaccgccaaggatggcagaggcctgcaaggctttagcagctgaagaggacaagggaggattaacccagcctccccaggaggggaccgagatgactgagaacagacacggaggtagaaggagggaggcagaccttccaaagctgttcacgacatgcacactgggtctccgctctcgttttggttgagctttggttgaaggggaggaaatggggaaatgtcaaaacgcagcagactctgaggctctgggctcgtttcatctcaacctcaagagaagtttcttgaggagagaatatatctgcagttttttaagaaatatttgcccatcagagctttaagagataaagtgctttttacactctctagctctcacagacacctacctgttctagcgtatttagaccttcgcctgtgggaatagaggccataagcgcaacagttcttgggggaaccagccacccagccacgttaaccacacccacgtgggagcagattgggtcatgaacaccaagctctgcctcttctctttccctcttgttttgtgtgagactgtgctcctggtcgtcaagaacagaaatggccaactgtcttgttaaaatccaaatgctttttttagaatatgtgattttgcttctttaaaaaataacaacaacaaaaacaaaaaaacccagactgacactagtcctttatctctattgtgtccgttttcccaagagatgtcactgttggagaaaataacttaaatattcttggagtggaggtagtctctctcttcctagtgggatgtcttcttggctcccttcccaaacttggcatcaagaccgagacctatggaaagagagaacatgggcttaactttatggggagaaatgaagtctacaaattatttgaggatgggaagtggggtgtgccttggtctccaaaattggagctttaaataaaactataattttcaaacatcagttttataaaatctcctcagagaagagagaattagtatcaaataaaaaaatcacca

SEQ ID NO: 53095 - DNA, 1964 bp, Bovine  19866880696284
tttgtgttgaaaaaaattttttgaatgctacaaagttctggcaggaagcacaccattaaccagagttacctgatggagttatggagcactttgtattctatcgacttcagtactgcttacagaaattctgtatcctaagcatgtacttagcagtaagaccacagcaaaggctagactggagcccctcaccaaggctcagtcccctaggcacaccttccactctcctttctgcggcactgggagaccagaacaagccagagtatctgcttcccacacacaggcattggaggctgcctggctctgcaggctcattcttgtcttcccgaggctttgtcaggattcctcacgcttccgtgggacccggggtgagccacttggcttccctgtgcctcagttttcccatgtgtaaaatgggagtcggccatactaataactaggatcaaagagattatgtttatgaaaatatttcgtattagtggctgcttctcttttctaaatgaaggcggccccttctgagggggtaagaggagggttggagtgaaggtgaatacctgccaggtccttcaggggagggccaaccacagcagttgggcagcacccaagaggtctgggtgggaactgcagccctcctgcctgctggctcactccacggacaggaggctgggggagctgatgggagtcctgctgcccaccccccacttcagtgggcagccttcgggtcctctgcaggcctctcgggttggggtgggcagagaagtaaagagagagaggaaaatggatcttcctcctgcagaggaatctctgctgctgagagaggcgtctaaacttgggctgccatagtggggaccccggcaggatggggaggaggtcctgggagggagccaggtccccttgagaggtagagaggagaagggcaggagccaagggccagggtgaacagtggcatccaaggagggacaggctgagagcaggaaatagggtggttgttcaaggggagaatggagccattttggccagccccctgcctcaaaacccctcccaaaagggatgagttattgttttttcctgtgaaaaatcacctgaatcctctctcccaaggtcggcttccccaggtctagcccttcttgggaagttccttctggagcgtgacctcggatgtccccctcccttctgcctgggctggggggggagggaaaccgctgctttagtcacgccagataatcacctctggtcactcactgtctggcctcttcctccaagtaactccaagtatctcttagacattatctcaccatgcaggcctgggaggggggcgcagtgggtagttgggggagaggaggggagccacatttaagaaagggaaactgagggcagaaagggccaacatccccctaccctgcttccccacgtaggctgggaaggggacactgtgtcgtactccatacaccaaggaggggtggcaggcagacagcagaaagaacctccaggagggcactcgaaaggggcctttggagaaacccagtgaatgccagattctgtgttaagagctttacagggactatgtcatccctctcccactctcttatcctcattttacagatggggaaactgatggggacactgaggcaaccacttgtctaagaccgctcagtaagcaagggggagtgtggggcagcctcttggtggaacaacagagcagtcagtctggaggcaggagcacggctggggcgacctccggtcagtcctcctggaggagccagtagaatgacctttaggtgtccatcgaggggagggttgtttaattgctgtcaggtcctactctttgtgaccccatggactgcatcacaccagccctccctgtccctcaccgtctcctggagttcgcccaagttcatgtccattgaatcggtgatgccatccaaccatgtcatcctctgccaccctcttctccttttgcactccac

SEQ ID NO: 53096 - DNA, 1538 bp, Bovine  19866880706935
agtagaataagtaaaggggcaaagggcaagaactaagattgagcagacctggaagatcccctggagaagggaatggccacccactccagtattctttgtctggagaatctcacggacagaggaccctggcacgctacagtccatgttgcaaagagtcagcacaaccaagtgattcacactcagagatcactcagggtgggggaagtagggggccagggcagagctttcaggttcagggactaacatccagagctttcaacctgaccctcatggctcaccgtcttgccacctttgccaatgacccggccggctgctgacgctggcacccggatatgggtctccagctttacttcttccttgggaccaaagaagttctcctccttgagttttccataaattcttccctgagcctgggcaaaggaggtctttgttatgttggcagtacacatatgtatgacaaaagggaagctccccacgccccactccctcgtgaggggtagatcaccacctaggacaggtgacgtgaaaggtccacagccctgacctgtcaacactccttctgctcacttgtaacactaggaggcctgggcaaagtaactgaatatgaatacataactccccaggcgaatacagtacctaaatcacaaaccagacctaaggggtctgggaggcttgcatggactcagacaagcagtgaatggcaagtcaagccctgagtggcagctggaggagtcactcagtggccggctgctggtcactgtacacagcctaaggctgtccccattctccatccctccctagaccagaacaagttactttattagctctttggctgtctgtcagaagtccgagaccctaggaacgtagcagggacataaaggagagaagagccttccttagtcatgacagcagagggcaaggagacggccttcctttccgtgtgcctattcactctcaggaatcagagagggaaggcaatagaatgcaagttggatgtcagtctgaaagcagctgtgcagccccgaatttacagggaagcttaaaatctgatgcagatttgcactcccacacaaacttgattcccctgggtcctactcgaaaaaataataaagatcagaaccttgaactgggcttctgggggtccagtgatgatgaccatacgaactttggagtctggagtttcaggaggagcaatctacaaagcaaacactggtcacagataagccctctatcgccctctcctccagaaccctaccaacaccctgcttccacttcccacttctgatggccaagagagtgaagaacaaagaccccgcacccaaggctattgcccctgtgccaaaactcttaggagggcacaagtgcatttgtttcttgacgttttctaagtagggcctccctgctcaccacccagagggggttcagttgagtcctgccaagaggtacccctggtgggggtggcagtacagggggaacagactgatctcctagagaatctctgggagcccttattcaccagagaacatatactccatttg

SEQ ID NO: 53097 - DNA, 1016 bp, Bovine  19866880812995
tgagcctggaggatcccaggccaaggaaagcaagagagaaaggaaggtagactcaaccttcatctttccctccaggcccaagtcaaagtgactttcatcaaaaccagtgccgccaagtaggagcagcaggcacaggatgctccttggactgtgggctgaaggggttcccaaccaggaacttgggcagacagtacaagacctcctggctctcccagctcgtatcaacaggaagacgtctatctacaatgcatgacctgcagaagggtgggaggagagcgcggtgcagggcctccctgaggttaacacacagctgctcaactgaggctctggggctgttcactcaacaaatgtttacggatacctagtatctaccttaggcatggttttgatatgttctagatgctggagagaggaagaaaaaagaaaaaacaactccacccgcttggagtctataatctctaaagttaaacgtctacccatatatctttctttgtttgattctaaggactaaggcatcttgattaggaataaaaatccaagtgtgttaatggtggggagaaggagatacatgaaataaacacaccttcacaaagactgaaagaccaggccctgtgcaaatccactgcacgccagcacactgacacatctggatggatttagtgcttgaaaacaatccagcgacaatagtgtatctggtgcaacgtttgatcctttaggctgtcagctctcactgtgtgaccaaggctaaaaacaacttctcagtgaagctgaaaatattccagaagaaacatttttatttgtgggagagttttgatcttagggacgtggaaaagaaattactcttcaatgatttaggaacataacctcacatatctctgactagaccctaaagactctggaaccaattgcaggagtacagtcttttcaatccccttccgatgatcccggaagaagagatgacagatgatgaatttccaggccacccagcaaacggggcggctgagcacaggagaaag

SEQ ID NO: 53098 - DNA, 1185 bp, Bovine  19866880820019
tggctactggcgcagaaggggaagaagagcgagtgagtcacgtgcaccccccaaccccctgctcccctgtgccccgtgtgatgcacaagcccaatgtcgtctttcacttaggtgctgatcgggagctgaattgcacggcagtcctgcctgggctcctggctcaggcagcagtccggtctgagggcaggacgtgggcaattttccaatcctttgcttctaaggggaggggtcagggaaggtgttttgggctctgagaggatccctagggggctggggatgaaggcagaggagctgaactgctgccaatgactcttcagtggtggcagcttcagactttggaaataagacgagttgatctcggtcttctctttgcaaagtctctttccctgactttgctgtttgacctgcgtggtagcttttgaaaagtttttcactggcagctgaagacaagcagttgggaggttgactgaagaaagaggtaccctctgctccttgggttgaggtaccaaatggttggagcttctttgggctggagaatatctggaatcgcccctggccctacctattccctaatctttattttaccagctggatacacaacatcacccagagggaggctggggccctagagctggcccatcagtctaacaggaaggaggaggcaaaggagaagcaggggtgagtctgcccgcaagggaaggggtgggggtggggcctccgactcactcccacctcattgttccctttcccagaccggagcagggctaggccccagacaagcatcctcttctacccagaattcaaagaggggtcttcacagagctcctggagatcagcccaagcctaagggaatagcctaggaggaatggggatgggggtcctgggaggggatttggggctagagtttctaagattgatgacttaatgtgcagagtcaccaagtccaggagagactcaagtccaggagctcaaggctccaggagggacttcagaaactggcttctcccttttgtctgctaaacttcaggaaggcttttatggaacaaggaccctcccaaggccagtcccctgaaatcagttaccctgtctctgtaggaagctgaggaattgacacagatcattctaaagagtgaacattcccaaagtaatctctgcggggctggaatacactctgggaaaactgta

SEQ ID NO: 53099 - DNA, 2125 bp, Bovine  19866880832547
caggagggtgaatgggccaaaacaggagaatggcatgatcttgccccaaacctgcatgcccctctggtattcacaacactcacatgtacacaagggttcccacctctgaggtgaagggacactgttttagaccctcagacgtccttctccagcggtccccccgatctgatggaggcagacctcagactcacagcccgtgacaaggtgggggagatgggtctctaacttctaaaactcacatttttggtcatgtgacccacatcctcactcacctttaaaaaccagatgaaaactaggaaccctctcccccactaacacatagcacataaacacaaagcttacagggggaccacagacccaagactggatccccacttgcacccaggaatcaaatgaagaacccctattaattcagtgttaaaaggactgatcaatcttgaggcccaaaagcaaagtcagtgttcccaggaccccaccatgtgaacgcccacccacttggagacccacttctgctatggctccggctcaaaggcgtccgacactcacgctcatggcagccacgtcattctcataagcttcccgcactttcttcatgatctcctgctcggccctgcagcagttctcgatggcgcccttcacagtgatggtcctctcggggttatagagggtgagatcctgcagcctggggcagggagcaggttagcgtcaagcttccactgacaagcccggactgggaaaagagcctggctgaggacatcacagccacgccgtttccacaggatgtttagtttggggcaaatatgaacagctctgtctctggctttcagctcatccccagagcaaggtttccccacagggaggtgaggacattgggcacagactgtaagcaaggagggtgctcctggctgggaattccccagtggcaccagcaatccattttctgagccctcctgaagcagagcaggtaatctgcccacaagtaagtctcttgacacagtcaagagacacagtgttcacagaggggctaacagattcctcctgagaagcaggccaccacagagcacctgctcaaggctcaggtaagcatctgggtctgtcctctccctgtggcctggcagtgtgccgggagaccccccgtcctggcccctggctgcaggctctctcccccagaggcagagtgagagagacaggatgcggcagccaaggactgaagaggcagcaccctaaccacagcggtgatggaaggacttcagccgttacagaaaaatgctcttcattgctgctttaactattcttcgataagcagaaactgtatctgacttacggggcaggtgttaaggacagataatgaaatatgccaccctgggggcccaggcatcccactcgcagaggaaaaggaaagtgccttacgaggaaatggtgatttttgtctccgtgtcctgctccaccttcttcaggttgcgcccttccttgccaatgagtcgccccacaaagttattatgggccaggatcttcaggggaacctcgtcagcccttggaaagaagtgaggcacaagagctccttagatggtaggccgctgcagatgcgggtttccgggacagacgccagaaccaaatcatgttttcaaacaatcagtgggcgagaaatggggagtagggaccggtggcaaaggcacgggtcacgatgggcgatgggcacactccttaactgtggtgatggtttttgtaaatagacttgtatcaaaagctcatccaagggtatactctcaaatgggcatactgtagaatttagctccgttggtaaagaatccacctgcaatgcaggagaccccagttcgattcctaggtcaggaagatccgctggagaagggaaaggctacccactccagtattctggcctagagaattccacggaccatatagtccatggggtcgcaaagagttgggcatgactgagcacttccactttcacagaatcctgtgtacctttgggctagtgggctcagttggtaaagaatccacctgcaatgcaggaggatccggtttcaatcccagggtcgggaagagcccttggagaagggaatggcaacccacttcagtatgcttgcctggagaaccccaagaa

SEQ ID NO: 53100 - DNA, 1803 bp, Bovine  19866880848477
agtattgtgtcattgagttctgaggccctcaaaatgggacctgtacagagactggattccctcagaccaaatcattctcctgtgaactaattagtgacaattttactttgtgcctccttttttccctgtcttccctctgccctgaagttccttagtgtaagttcatgatatatttgagagcaagtagtacagttggatcaaaacaaatcgagtagatcagatgtgcccaatattaacctggaccttcatttctagaacatttacttataccctttatttgaaaaataggaagtttttaagactgaaactaaatccaggttctctgttgctttgttcttctaccctcagaatcttaacctcaaccccaataaaatagggctccatttatccttttctattgaaaaggaggcctttggttgacaggaacaactgcaggcagagatgctggtaaaagtcaccacagggctcctttcacagcccgatatcctgctgggctggtggcagtacttaagtagaaagggctgtgctgcaccctagtctggctctaaataaaaggattgcagaaatttaaaatgtaatgtccctgttgacttgaagcagagaaatgcctcattgtaaaggtaggtggtgattgtttaagagagactttaattgtagtcagggtaaaggaaaacttgaagatgtgggtctattgcatagacccatattgctatttttctaatagactttagaacttgaatggcagccctgcaagttattttagccatcttcatctcagccttcagcgtatggttatgttttataattgccttttcatggtctgtggagttttattcaggtatccagttacatgatggtatggttgaagaaaactgcttcagtagcaatcagcccagagcctttcctgttctgacaacagcacgcttgtgttttacagtacgccttggagcgtttaaaggtcatgtgtgaggatgctctctgcagtaatctctccgtagagaacgccgcagaaattctcatcctggctgacctccacagcgcagatcagttgaaaactcaggcagtggatttcatcaactagtgagttgccatcttcaaagttctttcaggatagttgggttagctagcgaatgaaaaagaaagactttgaattggtgagtgaaacagatgagtaactttaagctttcaggagtaagtagagagtgtctgtcttttccttcagcttgacagtgtgaaaaatggttttgctttcatcagtctaatctgattggtgagtgaagtgttttactaccttgcaggatgagaattgatgaaaaggaaaactcgctggtctgaaagaacctttgtcccccgaagcagtagcatctttacttcacactcaccagcttattacaaaaagactagcagatctctgagaaaacaagtggattttatgagttagtaagggtgtccagtggtcaactgcagaatggggaaaagagaaaacataattaggagatgaggttgtagaatactgttttgagaaagaagtatccattccagtacatctgttccttcttcctaaatgacaagtgacctggccatattactttctcagtgggaagtaattctcagtgggatatgttctactgctttgcctgatgaggggcaaaagttggggaagaaaccccaagaagagaatcccctacaatagccgtattggagtaagacaggtctaaagttgcagggtagatgagtaaacatcatttaacacagaaaatgccttcaaacaaggaaagatgttctgtaaggctaaaggactat

SEQ ID NO: 53101 - DNA, 721 bp, Bovine  19866880880469
ttctttccttttcccttctcttaaaactacatgtcctttttaagttttctttttgctccaggcacctgacgatttgttctgctcagtcagatgcagacaggtttctccaaagtaccaccgcggggatgtcctcagggccagcgcctaaactgaatccccacagtatcaaccttggccgggccaaaggggacacagtgacgcagcaacagggttttcattaggtagaacagccccgagtcttgggcccttccctccccccacccccatttcccccaggtttatttagtgctgtattaaaagtctggggccacgatgcagtcttttccccccacaacagagtaaaagctccacagattgcgctgtctgcctggtggtcagtggcagccatgacggctgctgcttctggaaaagaaacggagtcttacaacgggcaggatcttaggactgcttcaggcgtttgcgtgggggtcccagaaacgggcactgtgctgaagccagagagcggtacgcctcagccaccaaatggggatgtgacaccaccattgacttccaccccggaggtctccaagacatccgaagcatggctaggagaaatgtgagagatgggttaccaaaggagtacatgaaggatgaactgaacagccatctagagagcccagtttcccagggtttgctgtctaggtgtcaatgcaagacacactcagacagaacccttaacatg

SEQ ID NO: 53102 - DNA, 1130 bp, Bovine  19866880894983
tggcaggtgattctgagccaccaggggagccgtattttgaatacttataaaaaatcaggattttctctattgggagtttatcttgatgtgagctgtgagatatattcaacttgtcattctccatatagctacacagttatcccacatgatttcttgaataatccatcttttcccctctttaatttgaaaaattacctttatcatatggtaaaatttcaacttgtctatttctagatttctaatttgatgctattgatatatctattcctcgtccaggaccactctgtttttataattattctcctactctgtctcagagaggatcccttctgaatctcatcagtagtctataggacccactatggagccccaggaacaagggccttacctggtccagggtcatataacttaggcataacaggaaagcggatggtcactggaaacttggccactgaggagttggactccagactcactggagggagaaataaggtcagagttgtgtactgcgtctgggtcactccccatgctgcccaggaagccaacaagatgggggaatgagagattggtgggaggagattgaggacagcgtggagtctacggcatttgagctcctgacttgctgtgtccctggggcaacccactgagtgcctctgaaactcacatttcttccccatgcggctctgtagggtgaagtgggcttggcatcagaggggtgggttaagtttgactttgttatttatcatctgaaataccttgggtaaatcattcatctccttcaccatctacaaaaccaggaaaactcgacctgcctcatttgacctctcagggtcattctgtgataaacatttgaacacctgaaggtggagggaactctctccctagtttgtgttcatgggaaatctgtcccacagttcattctgtgtgtgggtgggtgtcctgggaatgcatcctgtggagctgctcaaaatgggaaagagtgcctttaattcatccagaaagaaattggggctgcccttactgtcagcagacactaaggaattctggggctgggatgggaggagaaagacaaagctactgccctcccaactgcaggtttcctcacaccctactttctggtgagtgcccag

SEQ ID NO: 53103 - DNA, 1175 bp, Bovine  19866880902282
tgaaattaatggaaatataatgactgggagagtactctggttagaataatgagcactggaatcaaaatgatctggttcccaatcctagctcccccattttgtccttccctcattagtacagtgggatttatcacatcagatggtttatgatatttcagtgacctttacgtaaagcattttacagtgtatctgttgcctacctagctaattcatggtagttgggagagcctggtttgttttgaggctttttgagatagatgcaattatagttattatgactgcccttaaggtagtcaactttttacccaaacaatggggataatgtcttttgtgaaaatgctttgtaaattgcaaatcactaacagaatggtgggttggttattctcatttcccccaaaggctcttacaggtggggcactataaagctgataggctgcaaaaggaccagaacagtttcttctaccatctgtgttgtgggtgctcactcatgtgaaaagaacactcagaaggagctaaagcttccctaaaactgtgcccagagattcaatctgaatgccattcccttgtcttgtaaattgccaaaccgtttccccttggtcaccctcatttcccaggtaaaatgcactctctgttagggtgtttttccagactcacccaagaaaggatgacttcccccactaactccttcactcctcatccactgcattcaggacatcccttctctggctgcactgtttatatgtccatgtagagaaggcaagtctgctgtcctgaggacacagactttggacccatccacccaacattatgtgttaagtaaaggctcctcttgaagacaaggatgaagtgattaatgataccctcaatctccatcctgctccctcacccccaaaatatttaacagaaactcaagctgctgggaatacttatttatttggtctattaacaccaagatctgcaaaaaaaaaaaaaaaaaaccttctaaacacaggataataaaacttgaacattaacattcttcttcaattttgtgtaagctctgcattacagaaaatatacaaacttcaaacagctgcaaaaatagtgtctttgggagaaaatagagtttctacatcgatacaagaaaaataggcattttcctaatccaacccagtcctggggcaggtggagggtgg

SEQ ID NO: 53104 - DNA, 962 bp, Bovine  19866881013349
tctgaccctttgccccctatggactgtagcccgccaggcacctctatcctgggaattctccaggcaagaatactggagtgggtagccatgccctcctccaggggatcttcctaacccagggatcaaacccgggtttcccggcattgcaggtggattcttttactgtctgagccgacagggaaatccagtctcttctatagctaaccttgtatttgtgatgtggggttgggaaacaatgctctcttgagagatactagctgtttttcacaaacagtactcaagataagaaagctgtgaggtctaagattcagaatccaacaatgccagtgacacagaaatgaatcaaacactaggtgcactgtgttaaaaaaaaagacacctttagttgttagaatttggggacagaagctccatacggagattaacaacacagtttattaaaatggaaggaagtgtagtatagatatataagcatacagaggtaaggtgaggggacatctgagacaagaaaaaagaaagtcattcagcgacttcctctgctagaagcttatacaccaagtgtaaaaggctcccaaaggtcaaacatgggacattttgagcatccaaaaaaaaagtctgtgattattggtaaaacacagagaaaattaaaatccatgagtttataaagataccaaaacagagcaaaaaaaaaaaaaaaaagaaaattcatttcattagaggtataccaacttcttactcagaaaattgctaaaggattctgagtaaattaagaatttatctgaacttttgggaagaaattataatctattcctaactgatgagagatacctttacagatgatggaaggctaatcaatataaaaggaatgttagaattagaaaattagcactttgtaatagccaaagaaatagttgattcaggcaaagactgttatcagtaggtgataaaggctgctgaagaag

SEQ ID NO: 53105 - DNA, 1225 bp, Bovine  19866881074560
tgaagttgatggcagtgaggatgagcttggtttggggctgagttaaaagagtgtgtgcattttcaggtcatggtcgcagcaaagctctccctgaggccaaagatctggctccctgtctcaggttccccctctcacctcttgaaggcgatgtaggccacaaggcccacaaccacagcagccaggatggagcaatagacagggatgaggttgtcggcggtacctcgggtcaccacaggctgggagctgcccatcaccgtggtcaccacatctgacacagtgctggttaccagatcttgctctggaggtacctcgggctcctgggtgctggggtctgtgctgtcggagccctcagggggcgtggcccgtgtaatccaacgtccagggatctctggaagaaaaggctacaggagtgaggacccactttcccctgagtccctcccctagatcctgacccccagagctttaccccagccccggccttgccctaggtgcttgtatgcccggcggctacacgtacaggtgtgggctgggattggctatatgacatcacgatggtggagaagaccaaggatctaagaatcaacagccctcggcccccttcagctctgtcactgacttcctgtgtgactctggaccagttccttcaactctcaggacctcaatttccatatctatagaatggggatattaaaagatagtcttcaagctcctttccatctcggggaaagctgtgaccctataattcaactctgcctactctgggtacccagaagcctcgcctggagataaacacacaaagaagtaaataagcactaggatgcctccagctggaggcaggctagcaaatgtaatttctctggccccagcttgtcctagtggtcccagtcatccctgtcctaaagaagggtaagagtaaccaggtgtggcagagaggtactgtccgatgcactgtcctctgagagctgacatccagccttttttccaggctctcgtgtcctagctctaggctcaggcagggtggggaggtgcacagctggcttgcttccctccagccagtccatggatagtggaccctatttcctgccctgtgtagcccccataccatctgatcttgccatccagagaagacagtgtcagatagcccaaacccaagtgggaaaggatgaggactgctggtggagagcaagcccacagaccaggcactgccctgtctcagaggaaggag

SEQ ID NO: 53106 - DNA, 826 bp, Bovine  19866881090054
ttagttcttgccctttgcccctttacttgattctactctccaagctcagctcctgaatcctgcagtttctaccagctagtgactaaacttctttcccctccctccactgccatccatgtttgacaccgtcagcactcaagcacctctctgatctgtcctgctcccgcctctgcccccaggtgaatgagctgcaaaatttgacagcagctgaggtggtggtgccaagagaccagacccctgatgagaacgaccaggtcatcgtcaagatcattgggcatttctatgccagccaggtacatatggcactcccccatcacaggagggtggcaggaacctggggatcagaggagcaggactctgcctgcctctggcctgggtcactcttctcttccaggtatagggtgtgatgtgtagatgtcttattccctcttaagactgtagggacttatacctgtggtggattcatttcgatatttggcaaaactaatacaatattgtaaagtttaaaaataaaataaaatttaaaaaaaaagactgtagggacaatgatttgactattttcgtgggtatatgttatgtacagtaactgttaatgttacatgtcgtatgttatatgttgatagtcttcgctgtcgtctaaccacgtggtccttctcttttgcactgggagaagagaaatgggtcttagccactgcccagtcttgtttgtggggtaacaccatgggttgcccttttccagtgcatttccttcacctttcccagaaccactgctccatccttgcttccagttcttccagtctcctggtctcatcctggcactcatcat

SEQ ID NO: 53107 - DNA, 1268 bp, Bovine  19866881179510
tttgaaagtgaaagtacagtgtaaattcaagggatgtactgctgtattcttacactttaagtgaacatagttttagaagcaggtggattgattgacgttgttgatggttgcaggtgagagcacagagccgggataagcagatagaagaaaggatgctgtcccacaggcaagatgacaacaacaggcatgcaaccaggcaccaggtacgggccttgttaacgctccggccgttcacagttgagagccgagtcttggattctctctgccccataaccattgtagctatgtccactcctcttgtttcctgtgctgcgtcttcataagtggtcttcagtcataaacttagaaacagtgctttttccaaatagtaaattttctagaaacaaaacttctacctcataaatgaaggaatcatgctacttgtgataataataggtaatcttgattatttgcaagattatattctctgctgtatatcctcattttcatccactttctaacccattataatttactttcaggcccctctactctgctggtatgtttccaatggcaccagtgactttttcttagcattgacgcttgttgattatgtcatttttcttctacttttctttgctgttggattccaagatgctgctttgctctaatcttcttgtctctctgaacattcatgcacgttgattatgcttaattccttgtcccctcccctgcccccgaatgcctttggtgttttctcttgctgtttttctgcctagaactctatacttataccaagaagagattgtgtttttccttcaaggccttgtgcaactcttagctgttgtcgaattcttcccaaatcttgtgccattaatgaatttcttcctcatgtattcctatttgtaatgttctcagaatgttagtttaggttttggcacattttatatactcatatctcatcatatggatgtctgtttttgtggttagattataagtggatagcagaggaggcatggtgacgggaagaagtttgactttggagccagacaggtctggatttgaatactgcgattctgttactctagctgcgtggtcttaggcaggtcagctaacttccctcaattttatttccttgaataatatctacctggcagtgtagtcagctaaattatgcatgtaaagtaccgtaagtacctgtcctcagtgcttggcaggtaataagcactcagtaagaggtggctacacttttcttcattgtttatcttgggttctattcttattcagtg

SEQ ID NO: 53108 - DNA, 1277 bp, Bovine  19866881233981
tttatgttaaaataactacttttactttttcaaagcacgtttgtgtggggaaattaataggatggggatgattatttcccacaatttatgcccaacacactcattgagcatgtgctgtatatgcagggtgctatacgaggcaccaggaggacccagagatggagactccagcgcactgatgattcagtgagcgacctgagatctgcacataccatggtacaggccagacccaggggcttgaggctcagacaaagaggaacaagcgttctaaggtgggtggggagtcacggaggtgatgaccctggcttggacctcaaaggctaggaaggtctgacaaggtagaaacagagcaaatgacattcacaaagaaggacaaaagttctggaatgggaaggcatgggatatgcatggccagcagtgaggagtcactttcggctggcatctagagaatgaacagtggggttggaaaagtgatttaaaaccagattcaacagccacatgctggactataagattcagagtttatctgcagtgagcaaggggcaggtgaggtagtagacacaaaatgtcgaaatcaaaacaaaagtcacccagggtcctatggtgagttaatctgtggcccagccaggacttgaatgcagatttatattgacacaggcaaagctcctagacctgacgctaacccgacagaaatgggtctgtgggaaagtgcttcaggccagggatggccagatgcttctctgggaaacccaggagcctgagtctccaaggagccgggcgtcctaccttcgacaaatgggtcttgtcgagctcactcttcccatggggcttgagtgagcaggtagctggactgcagtcgttgggaacccaaataggttgggctgggaatggctgagtgtgggatcactgcaataaaatggagaggagccctcggagtgtctcggggtgtggggagcacagggcgtgggcctcgcattcccgggtggttgagacgccacagctgatgattatcattattattcctgctctggcttctctgagctttcatcctgcaggaccctgccttgctggcccgggagtcaccaactagcaaggcgtcactaactagcaaagcctcctggggcagggcggggcgggcaggtcttggctgcaaggaaacacaacactagttcgggtttcttccccagtgagaccagggaattaacttcctaaccctggaaccaggagccgactttctcaagggggaaactgaggcacggagccagggaatgatttga

SEQ ID NO: 53109 - DNA, 1691 bp, Bovine  19866881302118
cagatgtgggtgctaaatattgcctgtaatgactgccaagcagaagaagggaggcactgaaactagccaaatgatgacagcacttcttctggtaggttctcaagggggaagagttaagggggagcagaggaactaggatcaccatgccaggcccaaggccttcccaagtacctgtcaccaacacttcaaatacactggtcaagtcccaagtgcctggagagagcgaagaggaaaaaaacatgaaataaaggagatatgtaaaactgaatattagaactattatccctcacatggtgaggctacttgttttcactccacaggaaaatgcagccatttttccaagaagccctttgagaggacagcatgttgggagtcagaagactgagtcctgccctgcctccattgttgactgggctgggtgatttagtctgagccagtagacacaccttggcttgaattgccttcattgggaataatacctgttctgtttgcatcatggggttgttggaaaatctgataatggatataacctgtctgcaaaaaccgtaaagcactcttcaagtggaagatgatactactactattccaaagactaggagcccttcagaggtttggcccatgggtagaaactcctagagacttggttcttcagccctcactctgcatacccctcttccaagaggcagagtgggagaagggatggaacaaatgtccaagaaggcaaagttagacatctcagtgagatattctaggctcactagcctccatggatgccaaggtttttctcacatcgaatctaggtttttccttttactacttatgcttgtttcctcctgtttttcttgaagattttctctcacctgcttcaatatgacattatttttagtgtttatccactgaagacattcactattgaagaacttgacccaaagttgctaaattatgatccctggagtccaagtgtaataaaaacgaagcatctgttttgagaagtagccaaggatagagtcagccctggaaccctttaatttataaagtttcaatctcttcccttttcccagactggggtcattttattccccacaggaatttttgggggtgcaatttttggagaagtagctgcatacgtattaaaaatgttgaaagctcagatttagtgcaagaacatttattaagtgtagtgtaagaataataaagaattccaattaagataaaatttggaaaacatcagagaactttggtttatggtgggaaaggtcatgacttggttctactccactggaggcctttactttgcctggttcatttcccctccctgtactccaagcgctttcaattatggacagcttctcttggcgatgaacttggataaatgctaccttgttagctaatagtaccattaattatattaatgattaatagctaattagtcatgatgctgtaatgcttaaatggaggcttcctttctttcggcagctccatatctcaagcacaatagcgcacacgcgcctgcacacacacacacacacaaaatccccttccctatttctggccgcagaacaagcagggttctaaatttgtttttctgacaagtctgggcgatctctaaatttctcgtttttattagctgtctcattcatcagacaaataacccactactgcttacattccgtcttttttatttctgtctt

SEQ ID NO: 53110 - DNA, 1323 bp, Bovine  19866881318797
actgatgcgacttagcagcagcatagttaaaagaagaactcatattttaaagaactgagaattcatcttcaatatatgaaattcctccattaaacaatttccctatcatctttttcagtatacttgatctttaaacagcaaggcacttagaagacacaaaaagtatttctccatctattcactcctgaaaattaggtggaacaaaaacccagtaaaatcgtttaaaaaatctagatagtcagctagtactcaaataaaaaagagaaggtttgaactcatttcaaatattaaaaacttacagaactcataaataaattctcttttaaggataagttacaaatgtaggtaagagttaacactaccactttacctttattgccagaggtagttacattaagatctgtcttacaaaggtcaacattttactgtgtctttcaaaatcaattcttcacaatgagaaatggacatcagttaaataaactgtcagaataagaacagaacacatcactatagtcataagctcttgaagtccttgagatctgaattctagcgtaggtgttgctgatactttcctaaatctaagttttcttatatttaaattgagggcaattatccaaggttctctaaggtccctgccagagttaaagttctatgaccctttggaaaaacttaaaattacatctgcctctcttcatatatgctttttaaaaactaaaagcaacacgtattcagtataaataatttgaaagttataggaagctaaaactgaaccagtaaaagctaccttccagacaccccaaatcctcttcctaagcctaaagacaccaatgttttcttttggatcctcagaaacaagtaaaaaacacacaaaaccaaaaaagaaagcatgtgccagcaaacacacacacacactctttctccttctccctctctccttggaagcacacatgtaccttaactttccgaaggttgcaaagaattccaccgtaccctgatgtgtggtttctgggtttttgctactgcaatgtagcacacaggtgtatctgaatataaatgcaagcaacctcaagtctaagcattgtttcttttgagagataatgccaaattgctcaacgaaatattgtaccagtatatacccccccatgactgactgctcaattctcccacatctttgagtacaaggaagcacaaagagtaggtgagcaactgggactgcagatctatgaatcacaaggagacctaagttctatcttagatcaaaagtggatttaacagcatgtaggttaaattccgccacatatatctagctactttcacccaaaa

SEQ ID NO: 53111 - DNA, 1328 bp, Bovine  19866881379097
aatgaaaaagacagcgtacctaaagaaaatggacatatgcctgggatgctgaaagtaggtaatcattcaaagatgtcagctatcgttgttattagcaagtcacctaaatgatctgagcagcacagaaatcaggatttgccaaatactctatttttggttgattcagacactctggtttatatcagaggggtcctgcccagcctcgtgggatctctcttgctacctggagccctccaacctactcacctgggccagctggtcctcagccaagacagtccctcgctccttgtacttggcctgtcaggcaaagagaccaggatgagttgagagaatggatgctgggggctcccacttgtatcgcttccgcagaagtatgaaaagaggagggtctcgcaaatggtttttcttagggagaggagggaacagacgactcccttgtaatcaaattgaggggcgtgggggaaaggactgatgggtctggggatggtgccattccaatccaccggaagctggagaaactcagctcccctggatccgagaagcccgcgtcaaattctttcgggaggctatttgagggtatagagctctgctcggagagatttgtctctcgcgagtcaggggtggctagtgggtccgccttcttcccctcacctcggcaagcttcttcttggcgatggcgccagctcccaccccacgacggtgcatccccgccgtggcccgcgggccgccccgctgctgggaccccgggtctccacttcccgggatccgccaccggctccccgacgcggaagcgcgtgtcgtacgtcatcttcgcgcgacggaagttacgtcccgacttccggctgcggggctgatatcgcccaccgccaggggcccagcggccccgcctcttgcgccgagaaggagctgcaaaactgcggccgggtgttcccacccacgtgtactcctcggatcctcttaacttcctgtggccgtcctcaactgccaccccagcttccaggtggaggtccgccactgctcactggatgtctgccgagtgccgtacgctgagttggataccaaggattccgtatcaagcatacagcaatccattctatgctaatagggtttaccttttggaatcattcagagcttctgactggggaatgccttacagttaagaatttggactctgaaattagtttatctagctcgtagcttccactacatatgatccagttgtttagtctctttaagtgaagtgaagtcgctcattcgtgtccgactctttgcgaccccatggactgtagcctaccaggctcctcattccatgtaattttccaggcaag

SEQ ID NO: 53112 - DNA, 1598 bp, Bovine  19866881406849
aacagaatggataaatttgggaagaaatacagcttctggagtctcaaatgagactcctgcgtggtcccatttgtagtcaggatccctgaagtcctctttggggatgttttaggagcccaaagttctgcccctgaagcaggagggagtgagatgaaaccccaggaagacgagctccttctcctcccacaggtgacacctgccctccccagtatgaactctgactcttcccagagcctccatcaggctagagtcctgctgctcctggcatccttccaccccagagtctgtgccatctttccctgagcaggacagggggctttgtctgggcatcctgtgtccccatggagccctacagcgtgacgcaaatcagggcacagggccttgtcaagtgcctcaagtgggcaatgccaaggggtgaaacacgaattccttctcagtccaagatttttcaaggggaagtttggtaatttagctgaaaataaaaataatttcatttggagcaacacagatatgttatggagtagaatacaaaattggctagaattttgcaaacaaaactgcaggactcattgtgtggcagccactgaagggaaagctggaggaagcaaagcagaggccctgctcggggcctgaggggccacaggaggagctgagagagaaaacaggtgtgtgtcgggcagcgggactgagggaactggagattaagggcaaatctgtgttgaatgaggcctcagggaggttcggggggtggaggaagatgaacctctgctctttcccgtggctggttccccccacccccgcctccactggcccttccttcagagccttacctcagatgtttccagaggaggccagatgctaagaaaccaggaggcttggccccttcaggggatgaaggaaggacaggaagtgcgggaagaggggtatgatctcaagccagggccttacagacatggtctcagctaatcctcacgaatggggaagcaggtgtggggcccacttttacagataagtcaactgagactcagcagcgccgcctcatcttctaagattgcccaccttcctgcctggccacctaccacccctcccacatgctggatgaaaaaaacctgtacctccctggtaggcccctcttccctctcccaggctcaccattgacccttcctcttttccttggccttgctcttctgtgctctccttgccccctcctccaggaagtccacctgaggccctcactcagcgctctcctgctggactgtctgtctcttccgtctgtcagcagaggggggaagaggaggatgtctcttccatttgtcacctgcccccatcagactgggcgtgcactcctcccaccgagttgcctaactactccaggcttaagggctgctcccttgtagaccccgtggaggggggccaggtcaaccccccatggccggtgctgggcattaggagatatacaaaggctccagatgaggtgagagtcttggctacatccccacacccataaagaaggatgttaacagcctctgagggaatgcgcgagggttaatcaaagtggtgggtcgggggtttcctgctggggcaaggctcccttccag

SEQ ID NO: 53113 - DNA, 1007 bp, Bovine  19866881478112
ctcatctgagtccaaggggaggacctaggaggagcgcgtacgtgtggtgatatcaggggaaagtgccatgggaagtgacctctaagccgagatcagcagtatgagtaggaactagatgaagagaagaactaggggggggaagagctagtgcagaactcctgaggtgagagaggtggtaaaaagggcagacagtcttgagagtttcatctctaagacccaccgggcattttatttttttgtttgtttgtttacatttgcattttagaaacatcacttctgctactgtattgactgctccccacccactgcccgccccttcctggccctgtggctgggcatgagctgaggcaggagcctctggggagacttcagcccaggctgacccagtctccccacggtgttgggggtgtaatgacaggctctcctcttctctgcaccccacccacccagcagaccacggggtcagttctgagggccgctatattgggctctggtgggtgagggttccgtccctcctctgcccgcataggccgggttcccccccgggattgaggggtcatttatatttccagggtggcagggcctcctccccagagccacgggcgcctgagataacagggcagcccaggcgctgtttatgaaaaggcagtctagtggcagtgggcagggcctgagggaatggtgactgctgccacagatagcaactggggcggggaaggttgtctaaattacagctcccagaatagagggacccggagggagtggtggggcatcctaccaagaaagcactggctgcctgccaggcacgtctgggctccgggccctgctgcaggcagaggcggggtgaccacacgccagccaggccctgggggatgccattcatccctagccaaggcagcgggcagctctggggtgggctgggcagtggcagggaggcttctggggcttgggagagaatcagcccggtgtgaccttctcaaggggtgagagcactagacgagggaaaa

SEQ ID NO: 53114 - DNA, 642 bp, Bovine  19866881553561
atcctcccccatcacccccctacagagcaccggcgcccacctgtggccccgacgccccagggagacagctgctgctccctcggcttttcttctgttgttgggaccaggcagacttggggggaagagttcacagccttcatggtaggtcggcagctggggctccagatgtgggggagccccaagcctggggttagagttacactcaagtggctaggctgctttcccaggaggatggtgatgtcgggggtgtctgggatttgagagtctgggtttgggggtggaggcgctgcttcctactccttctaaccccagctctgctcctaggccccctctggatgtgggtaacttcaaatcagctaaaagtagggtttagtgagtgggcctcagtccccacccgacaggcgtgcaaaccactaccccctttgggtccttcttgcctctgaagagaactgacccagatgtccccagactgtgccggaagccttcagccacagcagctgtgagaggaggctgagcccctctgcaagcccttccctttgtccacagtgaatgcatcaggatttggtttctctgctcacactccctcccaaccccctggcccagggctcccatccatcctgtctcagggcgggccttgctggg

SEQ ID NO: 53115 - DNA, 1542 bp, Bovine  19866880443552
aaagctgagtgctgaagaattaatgcttttgaactgtggtgttggagaagactcttgagagtcccttggactgcaagatcatccaatcagtccatcctaaaggagatcagtccctgggtgttcattggaaggactcattttgaagctgaaactccaatgctttggccacctcatgtaaagagttgactctttggaaaataccctgatgctgggagggatttggggcaggatgagaagggaggacagaggatgaggtatctgggtggcatcatggactcgatggacatgagtttatataaactctgggaattggtgatagacaggaaggcctggaatgctgtgattcatggggtcgcaaagagtcgaacacgactgagtgactgaacagaactgattaaattataagatttgcataccctctgatccagaaattctaccactctgtatacattctgtacaaactgccaagtaccaaaaaatatacacagaacatccataacagcattgcttaggacaaacagtaaatagaaaacagctcaaatggtcacctagagtagaatggattaaataaacacatggtataatcatgggagatcatatgacaataaaaatgagtaagttcaatctacatgctacaatttggatgaattttacaaatatatatatttttatttttttagttagcttttttcaattttttcaatttaattggaggctaattactttacaatattgaacccaggatgggggacacatgtacaaatataattttgaacaaaaaaaatcagctataatggaagtatgtactctttgagtccattgttataaatttcagaaacaaaacttgaaaagcattgtttcagaatgcatacatcaatctaaattaaagaaataaaaacaatgattaatgattatcacagaactcaagatagttattaactctgggaaaaagatcaagtttatgataaaagaagagaatctggggttgctcctagagttctgatcatgttctattattttttcacataccataataagattatgcactttattaatttatttacaatgagcatatatgttctagtcagcttttagttctatatagtatacatgtattttaaaattatataaaaagttgatattttggtatgtaactcttccaaataatttaaatttcttttttcaagtagccaaatgataaaaaaaaaatctgcatatgaatgccaaattaccacatgacaagagtctctctcagatatcattatttcatcatactttttcatagctaataacatgaggaaataaagcatatacaaattattttatacaacatatacatctagtatattaatattgggaaaaatatgcagcagaatacagttcaagaaatggcaacatgagaatttaaggaaatttgcccaacaggtaagaataatatgactgagccaaattaccataaacaatgatatcaggacactagaaaatgaatatggtcaacaagttgagaagcacagtttattcttgttattcatgggttatgtt

SEQ ID NO: 53116 - DNA, 1133 bp, Bovine  19866880494665
ggatcttcccatccgggatcgaacctgtctcccccagtgcacgtggactctttaccatctgacccaccagggaaggcccccgatctagtctttactacgtaacatgttaacagtatcagaaactgctaatagaatgagattttatttttttctcctagaaacaaatgaaactataaagaccagcattaatcatgtaggaaacacacacagagaaacttattattggcatttgtgcagaaaatattaatacctgaggctagtaagaagttattaaatttgaagataaacttaacttattagtaaggacttactaatgagatcaaatacacagagtgaaagaaaaggaagtcagcaaagtatttttgaccaggaggggaattccagaggcattccttcagagaggaattcctaataaatctagcatcttttaggggaaaagggtattttatttcccattttgttaaggagaggagatgacacacccacccatctttcatttagatgtacctatgattcttcatcatcagctctgagatttatcttacagtttacaatactgaaatccatcaaaactaatatagatattgctgaggcttttttaaataaaaaattagtattgactttaaaataaatctacttttggagaaaatatgccaagtaatcaaaaatatcttaagcttttgattccaaattacacaaagatattccttcaaggaatcattctgaaaaagtaatttttaagcttgtcaaatggcatcactatttttttactattgatactatcagctatacatggtttagaatcttaaataactgccctgcagatagtgttaactaagtggaggcagaatataaagactacctctcaatagagcacattacctagtggacaagagaaagcaaaagaatgctcaagagtaagcagtatttagtactccaatacctacagtaggagaacatcacgttttagtcttaacagcaaactttgcagacattcagttgccttatgttacagccccatgtaaataaagtgtctgtgaccaagatttctgtgggtaaactttctgaatatgtccatctcttgccctcagaaaatttatgctcatagagacatgatgtttttaataatgggg

SEQ ID NO: 53117 - DNA, 2941 bp, Bovine  19866880648156
ctttgtatgttttgctctctaagagatacatttttcttatgacttataaggccacctgaaagttatctaacagtaaatttacattttcattaaaaattaaagtgactattctgtatatggtagatgtattaactactttgcatagtagatgaaaatagttcagaatttttccttcatttattgatatggtaatctatcacataatacatatatacagagaaatacgtatatatatacacaaaaatagattgtttgtatcctattctgtttccagtatttaatttatttctttcattcatttattcactaattatatgcaatgaaaagtaatttatcagacacactagtgctcctcacacatgtcactcacttggagcagttcctctcatgtggtattttcacagtgcaattcttaaccagctttctccatactgattaaagttggatttggtcactagaacccttgtagttaatttatagactgggatggttttgcatctgtgatttttgcaacttattcattgctatggggatatggtactgaaaatgctttgctatagttaaagatataattttttttattaaaaagattatcatccttattgaaacctttgtacatgagactgaaggacttaagctgattctgcttgccccatatatgtggttccagaccaccaggctggtggctcagacttgtacatactgaaatttgatatagtagttgaaaagtggccagctaacagggaattgcagtgatcaacttgttggtgaaaaaaaatcaatgtactgaacagactttaatcttattataagaccaacacaagtaaagacaggcagttgccctcctttaccagcagcaatgtggaaaggaggagagaaaagaaaagaaaactgacttcatagctctacaggaaaggatatcattcaaaaggccactaaatacctacataaatcctaaaattatgaaattgaaatttgctatttctgccaaaatgtaaaatgaaattattttattataaagtcatttaaatgaattaatagaattttgttatttgtatgagtggacttataataaatttgattatgttacaaagttacataaaacccaggaaaagtggaaagtgtacagatatttaaatataggtaaatactagtgagttacataaaacttttcaaatatgaatatctagaatagcttgtgtgttagaaattaaaccaggtcagatttgggacctttctttcattcatcagcatactttgtttctaggagaaaaacggaggaagaattaggtgaggggaggatcagaggaggaaaaaaaaaaggagaagcaaagaggaaagaagaattatacacaaaacattgttgactactctcttgggggtggctaaggcctaaatcaatctaggctgctcttgaaatgcaggcatacgtttccaagcattatattaaaatttcatgatcaataacgctgaaagctgcagaacatacaagcaaaataagtgctgacaattcacaagcatctgaatttaataaaatgtcatcctccagcctcagcagttgtgccatgaggagatggccatcctgattagaatctgtcagatgaatctccatttgtcaagtaataataaactcaggatagtaccttttgtttcaggttgtgtttattctccaaaatatagcagtcaattcatattctaatataattctactgttttcaacatcaagtcaacaaatcaaacaaagaccttgttttctccctgagggaaaagatccaatatttacattctttaattctggaggatttcctctctccattaagcagctttggttccaggggctctgtttatgtattcacacatcagtcatctggtttttgtggagcttcctcatctttggagtcttacttgttatttattatgagcatgctcagtcatgtccaactttttgtgaccccatggacgtgtccaacttaccaccaggctcctctatccatggaattttccaggcaagaatactggagtgggttgccatttccctctccaggggatcttcctgacccagcgactgaactcctgtctcctgcatctcctgcattcacaagcagatacgttattgctgagtatcctggcaagaggggagcatggtgaaggccaaaggtttattggcatgtaatggagtttgccctatatcctaaaatcaactggaagccaaaggagaattttgagcaagggattggaatagggctacaggtctagtgtgttttgatgaattcactctggctacatggtggagaacaagtagactggaaagggagtcagtgattcctagaagcacagttggaagactattacagtagcccaggtaaaaaacagtgatggtgataattggagaaaagtcatcaggctatgactatgctatttcaggaggaaatagcagtagaacttggagatatattagatataaaggtggaagaaaatcagaaaataaaatttctagttgggcctttatctgctgacctatgaagtgacacatgaagactgggtcttgctgggttgacttatgggtatttgaagtatgaggtgcctttaccatatccttaaagaaaagatgctgaataacttatgtgggtctgggatggagatacactcttgtgagtcatctttaactataggtgcgctaccccagaggaagcacagggaatgacgggggctaagatcacgcctgaaagagcattaatgcttaaaatctagacacagtgaacatagggctgtttttgaattggcaggtttttttctcaggtaaatagtacgagtgttgctagatcatttggcagttctacttttaattttttgaggaagcttcattctgttttccatagtggctgcagcgctataggcaagatatggaagaaacctaaacatccattgattgatgaataga

SEQ ID NO: 53118 - DNA, 962 bp, Bovine  19866881131497
tatcatgttcataaaatgaatataaaaatactacatcatagggctatggtaaagattaaacaagataatttatagaaggttttcagcatggtttgtattaagtgtgtaacaaaagcctttaaatatcagtaagaataggagtagaatatagaataaattctgatcccccttaggaatattggcaccttcttgagaatagctaaagcggggaaaagagcaaacaaacaaaacaataataccacaaaggttgccaattatcctgtggaatattaatgctcattttatgctgattctgctataatgttaattgggaatccagagccttcctttatgcacataatgaatattctttctcatgctctacttattcatccctgacaattactaaattaattacttcaaattgtagcacatatcaatttttaaccctttatgtctgtattcaactgaggaatttaaatttggttctctaagtatttccactattcatttaagtgtgtaaataaaatgcctataaaatatgatcaaaggtcttttgaacataattatgtagcagatataggaagatttgaaaatgcagttcctacaagcagcttagtttgatcaaaagctgtcaaagcaatttacttgctattgacattctttgaccactgtagttgtacagcatgcagacttaaaacataactttgaggaatatgaaacctattcatttggctgaaaaatagtggaaatccatgaagatacaaaatttaatatgcaaacaaaatttttgcattacttagtgactttcatcctgggtatcaactgaatagagagagataaatatatgaacaagaacacatctattacaacaaaacaccatagcttttgatggttaataataaaatcagcaggaaattttcataatcttgtaccaaaaaagtcaaataatatctcccaaatactttggttaataataaaca

SEQ ID NO: 53119 - DNA, 812 bp, Bovine  19866881144894
ttctgcctcctgaaagaaattctctgtggttcctccagccttgggtaaactattcttcctctttttcacatgaaaaataatacatagtttgaaaaccttgttcaatagcatatatcactccctaccttattatttttgttcatctttgatgtttatgttccaagatgagaggacatgtataattcaacttatatttaccataatgtaaagcacctattggaagtccaggtatgtaatacatgatcaactaatatttgcttatttaaattaatcttatattcatattcaatatgtactcacagtacttataaataagatattcttcacaaagtacaattctaacttccccagcattagaatatataaagattaatttcgtttgaagtttctttattctttcctctccctttcccctccatcataaaaagtttttgaaaaacagcatattcactctttgtcgtttcaagccatgaaatttgatatagaaagcttacaagagcagtgaaactgacaggggtcaagtttaaccagtttaatttctaactggcatccaaatgacccacattttcacacctttcgaaattctttacctgttgtagctagatcccttcctccaacggcataagaaaacacatagaattagtgataaagattgataaacaatgcaaaagtttcagctatacttgttgaagctattttttttttaagtcttctgttatccaaatttcctctctgaaggaaagatttatttagtcctacacagccatcacaatgttttgctctttgcccagtatgttctttcttggcagaca

SEQ ID NO: 53120 - DNA, 3184 bp, Bovine  19866881253168
cattccacagactgtaccccatagtacatggggtcacaaagcatcagacatgactgagcaacttgcactttcagtttcactttttgagtgaaactctgagaatatatttctcctttcagtcaagttggggtcactgtgcatgcaaaagagtaattgctacacacaaagacacaggaaacaccaccttatcctccatcttttaggaaatacttaatacccaagtatttttcaaccttctaagaaaaataaatgaaggaaataattgtagaaatcattattataagcaaactctacaagaattactaatccctttgtatcttttatttcattaaaccctcaaatattttaaattgggtttagtttttcctccttatggatatgatttattaagatatataaacaatataattgctccactttcttgtaacatccaacacaaagtaaaaccttgcttccttaaattctcccctaaatcttggtaacataagtccaaatcccataccaaactattttgaatatcctttaactaagatacctcacaattgcacatgatgtgccttctctcccactgcaatgaatgcattcaaatgcaggtatgttgttggtaatctttggtcactgatacatgtaaaattcaaccaaatacatttttatgagccatctgatactaaataattagtttgatagttacagttggctaggttttcactcacagtaatttgtttggccttatgaatacctagtttatttgactctaaataatattttcttatcctgctcttcttcctccacttcttcctcctctttttttttttttccctaaaaggcaataaaggtttcatgttagctttaagtactggtttctgttttcccccagctttattgaggtataatcagtgtacaaaaatactgcagatagtcagtgcatacaatttggggagtttggaaaaagcattcacccatcatacctgcatcataacagggaatttgccttcttgacaaatttttaagtatgcaatacacctgacatgcttaagtttatggggtcgcaaagagtcagacatgacttagcaactgaacaactatgtcatacagtagatctttgaaacttaccttacataattgtaaatgtatgctcattgaattgttaaaatctaatatattctttaaaaaaatattttatttgactgaagcccagataaactatttattaatcatctgtttccattagacttcattatctgtatggatattttgaaaaaaggcagcttaagataaatgccaaaagcaaggaatgcagtgctggttggggataatagtgtcctcaagatttccacaaaatgactttaaagcccccagggtgaaaggtcaatgaatcaagtagtggcacataaaccattatggccatgctctcaggctctgcatgatcaggggtcatcctcagatttgtaataaatcacacagattaatttgatacgacacccactatcttttgactctataaatcttttgtgtgtggttccattaatttaaaacataaacaatgaggaaaaagtctgtaaaccaagacaaaaatactttttccccaaaattaaccattattttgtgatcttccaaattgcagaagaaaaatgggaaacccatttatctaaaatgcagtttcttgtgaaatgcactggagaaagctatatctaagaagggaatattttgcaacactctggcaccacataaaacaaggagagagtgagtgtctctcagtgagtggctacatttggaaggttgagaaattttcctttgattcctcttgtaactcctactttgcctacttttcagaccaaggttcagttatgctttcacctataatggacctaagaaaaatcaaaaggcaaaatcctgtatgtctgcactttcctttatattcatatttttcagagtttaatttcaatatgtgattaagtgtctttcaatgttacagaattatgcccctctaaactatgattataaactttaaaaaatgtatattatatagaccaaagcctttatttttattattactctagaaagtaagtgattaataaaccaacttctaattatttagattcaactataaactttattgaccataaattcctcttatataccatcctctgctcagtcctttaaacaatatttgcagctttttacaaagtgttgtttaagaaaagtaagaaacacagtttctaactgattttcagcagtaacatcaaataatttgatcaaacaggtttaaaatatgtggcaaaagcaatgaaataatagtattctaaactatcatcaccacagaataaagcacaataaatttaccatttgttgtttttgctcagttatgtttgattctttgcaaccccatggactgtatgtagcatgcagggctttcccatccttcactatctcctggagtttgctcagactcatgtctattgagtcaatgatgccattcaaccatctcatcctttctcaccccctactcctcacacctatcaaagcctagtgaaaaatttcaaagccatccagatcataaaatagttttagatccctaaacctgggctgctactgctatgagagtgagagatacagacagtgaaaaagacagaggaccctaaaatatgcttgtggagtcaatgttaccccttagttgcatttttactctctgtgcttaggtaatacactatcaagtctttgctaattttcatagggatttacctataattgtacaaattcctgtaatgattaccaacctaacagttgctaccaatatataattagcttttaaatatttaataccttaagagaccacacagataattaaattattttgagaaaaaactaattcaagtcaaaatacaaatattgtctctaatagtaatcctgagtctcttaattattaaataataaaaattgcatgggctctagaattatatattaatcttacttatccactctcccttactttccagaatgagcctcccagagtctaatgaaagttgaaaaacctggagaaaggagactgcattagtcagggttttccagaaaagcagaactaatataaaaatttattgtagaaattggctcacatgggctggagaactagaaaaggcagtggtgtaattcagtccaattcctaaggcaggacagccagaagtta

SEQ ID NO: 53121 - DNA, 1202 bp, Bovine  19866881336611
ctgaagaaatcttaggtcctgaattgactaataaataaacttactgctctactctgtgaatatatgcatagatcatgtatatacacacttctgtacttttcttttaattttatctatataacatttagataaattttataccttatacaatacacagaaaacataagtagataatcttaaaataattattttgtgtcacttctcaatataacaaagcaaggaagaaagcagacgttgcttttgagctgaaatgtgataggtgaataaattaactaaaaaatgccaaagggttgaaatatgttgaaagatacttagtctaccttgctaaagggaaagataatgaatgactgtaccttttacttctgtatttttatagcactttctgtaaaacaaataatgcattactgatacctctattgccagaatggcaatagagcagtgccattttgctaatttttcttcctaactaatgaaatcttacattctatgagaagtcatttgtaaaatatattaagtgttttaagatatttcttactgagtaaaaagtttctctcttggactttaatatatgtacttgctacattgtgtttatacataaacatcagaactaaacctagcaatatgatctatctatatatgcactcacacatattagtaatagtgtgacaatagtacacagctagctacccttctctcaatttgatgttattatagcgctcatgtgtattaaactgtctcatcatgccttattatgagagaaattaacataaattaatactaaattatatgccttcagtgctcttacttaaggagcttatgacattaattggtatcactaaaagagaatgtttgtgtgcaccatgaccagggaccccacagacagacagaactatgtttgagtatctcctgtggaggtataggttggcggtggtctgccacaaggacagggtctctgggtgcagcagacgttgggtatgacataagccctcttggaggaggtcaccattaacctcaccatagagctgacagaatttacaccagactgggaaatagactcttggagggcacaacaactttgtgcaccaggacccaggagaaaggagcaatgatcccacaagagactgtccaagacttgcctgtgggtgtccaggagtcactgatgaaggcaagggtcagtggtggtctgctgcagggttggggat

SEQ ID NO: 53122 - DNA, 1760 bp, Bovine  19866881349000
cttaaagagtttgtgatatggccattaatcttatcagctaacatgtattaaaatttatcacttttctaaaactctcctgtcgatttggacccaggccagggtgggcccttttcacataaaatggaataaaacagacatgcacatagactcatttcaatttggcctgtctcaccacaatgacttgaaaaatgtattcaataaattgtgttcacagatttatgaccaccggatctttccatttttgtctagaactaaaagcagatatttaactgaactagattcttgtgttgctttcagtgctccatctaaagcaatatttgaaggatgcaatcacagaagaaaaaaaaagtaaaataggaaagaataccaagtatgtttgatgtgcccttcatacacatttttttcccacaatgtcatgactgccaactgcattatcaatggcttcaggaaatgtgactaaaaggtgaaggggataaaaaattcagtttaaaagggacaaaaataactcatctcaagtgtttttgatgcttctttgttattttatggtcatataattgaaaatgtctcaatctctgtgatctctagatccagcttttgcttttctctgtttctttagaaaagaaagaaatactgtctatttttcatgcataaagagctttatagcttgtgtgtaaatatttatttctctttacccaatgtaaactgtagttaaagcttttcttctgattctttgtacattctcagatgcagtgtttgagagtcatagtctcacatcactgaaattttttagctccagtataataggtagcaattttgtttaatacctagagaaattattttttatccttactgagatttgtttaatacatatacatacaaagaaaatgtataatctttctcccctctttaattcaaatggtagcacgttctattccttgttatatttacataaaatataaatgttgaaaaatttttcatatggctacatgtagtgctctcccctttgcttttctgtggtagaaaacacataacataaattttttcatcttaagtatttttaagcatgcaacagatctctagaattttttttttcaagacagaaactctgtattcattgaacagcaactcccctttgcccagcccatggcaaccacaattctactttctaagaatagataactatagatacctctaatatgtgaaatcatgcagcatttgtctttttgtgattggcttatttcatttaaccgtatatagtccagtttcatccatgttgtatcatatgacaagattcctttctttttaaggctaaataatattgtactgcatgtatgtattaacaccacattttctttatccattcctcagtcaatgaacatttagtttgcttccatatcttggctattctgagtaatgctgaaataaacgtgagagcacacatttgtctttaagatcctgaattcagtttccttgaatatataccagaagtgagattggtagataacactgtagttttaattttttcagaaacttccagaccattttccatggtggctgcaccatcttacatgcccaccaactgaagccaacagttccagttttttcatattgctgccaacacttatatttcctatttttatgattcagttcagttcagttgctcagtcatgtccgagtcttcacgaccccatgaatcacagcacaccaggcctccctgttcatcaccaactcccggagttcatccaaactcatgttcatcg

SEQ ID NO: 53123 - DNA, 1808 bp, Bovine  19866880173137
cagtattcttgcctggacaatcccatggacagaggagcctggcaggcttcagtccatagggtttcaaatagctggatatgactgaagctactttagcacagcacagcatgcatggtttaaaagttgtggagggcagctttggggatctggagtctcagagagatggagggacccagtcaggggcctgcaagtctgctggggcggtgcccacaagcagcattcatcctgcggagacctcaaatcgtggctgagaaccctccactaccagccaggcagaccatgcgggatcttagttccccgaccagggctttaaaaaataaataaataaataaataaaagttgtgacgtacatcaaactctcactgagggcacccaaagccagtgctctctaatagtctggagggatggagttgggagggaagtggtggggagagggtggggacacatgtatgcctgtggctgattcatgttgatgtaggacaaaaatcatcacagtattatatatcctcaaatttaaagaaagaaagaaaaaaaaaagcttactctaattgcaaacttcaaaacaaaaaagtaatatgacaactgggagctcagaacccagtgtagaaaacacccatccttgccctgagttgggaggagagtcttttatcccggctaccccgacccctgggctttcctggttgctcagctggtaaaaaatctgcctgcaaggctggagaccccagtttgattcctgggttgggaagagcccctggagaagggataggctacccactccagtattctagcctcgagaatccccatggagagagaagcctggtgggctacatttcatgggatcgcaaagagttggacaaacttagcaattaagcatacaagcacacccccactgctgggactggaacctttattccaggtcctcaggctgttcccagccactcactgggccagtcctggtgattaatctgattcttgatgagccagcaagagtctggaaacagtttttgagataattgtatatttgcaaacaaggacctggttaaacagccagcagttgcctaacgagggtgtttctttacaattctgaacactttaatgaaaaaggtaaaaccttaagtcatccggtgagtaggactttggttttgaaactgtggaaagttcgaattacctgctgattctcagtttgagcccttataccatgtccctaatgagttcttcctggataggaggtggttaggccagcactaattagtctggggccacgtgcctgaggctctaccgaagaaggtcaggcatgggtctgtaataccttaggatttatacccctttctccttcagttcagttcagtcgctcagtcgtgtccaactctttgcgaccccatgaatcgcagcacaccaggcctccctgtccatcaccaactcccagagttcactcaaactcacgtccatcgagtcagcgatgccatcccgccatctcatcctctgtcgtccccttctcctcctgcccctagtccctcccagcatcagagtcttttccaatgagtcaactcttcacatgaggtagccaaactattggagtttcagctttagcatcattccttccaaagaaatcccagggctgatctccttcagaatggactggttggatctccttgcagtccaagggactctcacgagtcttctccaataccacagttcaaaagcatcaattcttcagctctcagctttcttcacagtccaactctcacatccatacatgaccactggaaaaaccatagccttgactagatggacctttcttggcaaag

SEQ ID NO: 53124 - DNA, 4725 bp, Bovine  19866880345126
tgtgcggcaaattttgttagaagtgacccccacctcctggttctgaactattttgtgctcttggttgtactggctcctcctcgggtacttacattctcaggtgcctgacttccctaaaccttctcatataaaaaaaaaacaaaaaaaacaaacccaaatgaaggacgacagcttcacatcgtccctaatcctctgggataactgcgctcaagatcttacttgaaagaagaggccattcccagcacttggcacgctgggctgcatccatgcttcagattcagctcaaacgtcccctcctcagtgagccttccctgacctcctctgaagtggcctcctccagggacccttccgccacactgctctttcctccacgatactaacacaatctgttgattcttttggtggtttactgtctctccactacctcgtgcccccataaggttacctctgaaggcaggttctttatagagtctattttgttactgcgtgcgttctacgtctagaggagtgcccggcacagagtgaaagtgaaagcatttgtcgctcagtcaagtccaactctttgtgaccccatggaccatagcccaccaggctcctctgtccatgggattctccaggcaagaatattgaagtgggttgccatttccttctccaggggatcttcccgacccagggattgaacccgcgtctcctgcactgcaggcagattcttcaccatctgagccatagtctcctgtgtctcgaggcatgccaagcacatagtgggtacacaggaagtaaaacccgagtggatgcacgagagggaggatttcgtgaggaggagaaagttacagggttcctgatatcacacccggtaaacccactgtttatacatgtctctagtgctgtgtgacatggtcaggagaggagagatcagggttgagtggattacaggactctgttgtctgacgtctaaaagaaggcaggcaacaaagaagtgcgccatttttcacgtctccagtatgaactgcacactcactatgtgtacatttcagcttcatgagagccctgatcaggggcactggctgccagccccagagccgccactgaccagtcaggtgaacttgggcacaggtgcctcacttctttggctctcctttccttcccaggagtacacagccaacactcaccttctcgtttagtcttcacgacaacgctatgtgacaggcacagagcttacaccatgatgggaaggtgcacagacggggaggcagggtcagtcactcccctggtcacaattatcaaacgcagcagctgggatctgggccgagggctgattctaggattcctgccctcaaccaagtccctttctgctctcgggttttatgatgtcacgagagttgggtgagaagaggatagacctccaaatgagaacacaattgtggtctttccccgccgccattcctgattttatgtatatttttaattggaggttaattgctttacaatgttgtgctggtttctgcttacaacaatgtgaatcagctgtaagttgacacacatccccttccctctggagcctctttcccaccactcccccatcccaaccctctgggtcatcacagggcaccgagctgagctccctgcgctatgcagctgcttccccccagctgcctatttcacacacggcaggcgtatatacgtcagtgctcctctctcggctcatcccaccctctccttcccccgctgtgtccacaaattcattctctatgtctgcatctctactcctgccctacgaataggttcatcagtacctttttcccagatgcaattgtggccttgaataaaaccatgttttcccttttttagtgttaccaaggcatcacattttccctttaaccaagatgatgtcttaacataggtttccccaaagaagagcttgaaatggagagatttggtgactagctgtactcagtttaatgctgggaatagcttttggctcaaaagcctaccagctgtagcatatacggcatgctaatacttgaggaatcaccatcttttacatttctacttactgcacatctttgactcaggtctctcaatttgctttctgtggtagcttagataaaatggacagaggccacatacatgattgctgcttataatttttttcaagtaataaaagacttcagatggatgtcctgactacgtgtttagaaaaatcaatctcttaaaaagaaacaaaaacaacaaaagctcttggtatctcactcctagagattggtgcctatccaaaggtctatatttacactgtggcaaaatttgtttttaaactcatgcgaacattctgaaatgggaagtgaagtaccaataaaattaagcttaaaaggaggagggaagtacagcccactgttccaataggtcctggtgaatttaattctaagatgggtgatggacactcacatacccccagccttcttcatgccacccactcttaattctttccttaagtttcttaaatatgacctttggttgacaaggtacaatcggcttctacctcaaacccactccacaaccccagaggacatcctgtgaattacgtccaagacggctgcaagtcatgagcacaggaaatggaaattttggtccaagattagtaaagttcagccaaactggtgtagcggtggggaaataccatcaaaactaggaacactatttcatcaccagttccccaagccatcattcccgaaacttcccttcccaggtgaaatgattcatttaggccagagaatacatttcccccttgtctgtccacaattccaccccagagtcagcgttcatccttcttcccccgccccagtttcctgcttactcttgtctgggcaaccagacaccaaattccgtctgccttgtactgcatgcagtaaaagagggtttttttctttttttttttaaggcaataaagtcatttaccatttatttatgggaatgaagaaagggttgatagacttgcatcaaaagacccagaagcctctgacaaaaatcagttcgttcgcacgcacgcacgcgcacacacacacacacacttcatttgcaatatctctccgctttcctatctgctgtcttgacccaggtcgaaggtgaaaacatttccagcatcagtgcagaaacattgtaattctcaaaaggaagtacaaaacactgagcatgtgggtaaaaagtggctaagaagtgtgccatgttcaaactgaatcaggtacagagataccagagaggcagccatggtcagacctctgggtctgggaacagaggatgcatagcagtctcctgaactggagcttccttttctgactctgcagtactaagctatgaggactcacgggagcaaaggacaaaatttaacgtactgttgtagtttaataaatgtgtgggattatggtctctgctgaatttggaatgttttgttaaacctgggataaaaatggaaaagtaacagctgattaatgagcattcagaaataattaaggaaaaggaaattacttcccagaccatataaactacttgacgaaataaccagagatgttactggagacaggaaagtctaaaggccttcggtaagtagatgacatttgtgctagagtgaacgtgtgttaaaagttacccagtatatgagtcaacgtgagatttgcaaagtgcctcctcattctgtcccaaaccctagtttctaggttcctaagattaatttaacttagagactttgaaacatattttaaaaattaatctgaatcagcaattgagtataattatcacttttgcacgggacggggggttccccaggcaactcaacggtacagaaaccacctgcaaatgcaggagacacaggttcaatacttgggtcaggaagatcccctggagtaggaaatggcaacgcactccaatattcttgcctggaaaatcccatggacagaagagcctggtgggccacagtccatggggtcccaaagagtcagacacacctgagcacggcagatggcagacttaaaccaaagacttggtactatacttggttgacccaatgtctcaaagactggtttactttacattacttcagttttagctattgttataatgtaacaagcacaacaaacataattaatatcataaaaatattgactccatatatttctgtgtgtatatacactacaaaggaataatccctattttaaattacagtttaaaaaatcataatagtttgatgaaacaaagaaaacaaattcaaggtagaatgcttattaaaaaaaaaaaacctatttttaaaaagtagatgtcaaagtgttattttttaaaatatttttatattgaaaatcagcatgcttttagtagagaaaaagtagaaaattaagataaaaattaaagatctttcatatgagagaaagagtattttatacatgtacatttataaaaatgattacacatgcacatgtgtgtgtgtgcatatgctcagcagtaaagaattcacctgtaatgcatgagactcaggtttgatccctaggtcagaaagatcccctggaagaggaaatggtaagccactccagtatttttgtccacggacagaggagcctggcaggctacagtccacagacttgcaaagagtcggacacgactgagtgactgagcacacatatatacactagatcgagcagcatcaccctctcccctagaaatcatgcccactcaaaacctcag

SEQ ID NO: 53125 - DNA, 1540 bp, Bovine  19866880562930
tgcaattgtgcggtagtttgagcttctttggcgttgcctttctttgggattggaatgaaaactgaccttttccagtcctgtggccactgctgagttttccaaatttgctggcatattgagtgcagcactttcatagcatcatcttttaagatttgaaatagctcaactggaattccttcacctccactagctttgttcgtagggatgcttcctacggcctgcttgacttcacattccagggtgtctggctctaggtgagagtatagttgatttataatgttgtgttagttgcaggtacagtacaaagtcacgtgtatatacaggttatcacagaacgttgtggaacatagccaactttaacaaagctccaccttcaacatttttcagtgatcagatagggatgcaaaatcagaaatcctgtccttcccgaagatctaacactgtgttttcttttttttttttcgatgctttagtatggtttattaagctgtgccttagtacaaatgctggggcttgcccatggtgcttttaatgtacaaagccctgacgttctgccaatttttcttgagcaatgacaccaggaagttgacagctaagtggatgttgtacacaggctcctcatctgtcatcttcacgtggccaacagccactgccagacacagcaccttcttcatctggaacttgatcgtggacttcacttcatcaactttggccaccatgttctcattgtgggtcagcaaggaagggaacttgccaaccttgttcaggcctgggcccaggattcgggggatctgcttgatcagagactctgaagccaaaaaggcatcatatttcttggccagcttcttgaccagtttcttattcttgttgagttttctcagcgcctcgatgtccgtgtgggggatatccacagccttggcctcatcacaatgctgctggtcccccaagacacacacggagaacttggggcggggagtggacttaagcctgacggtgcccgagaagcgtttgtccttctgagggtcatagttcttcaggctgatctgaagctccaccgtctccaaaaactttctgtgcttgcgctggttcccgtgcaggacttccctcactgcctcatagagggtgtcgcgggagactttgctgctcatagttctctatgccgcgataaccggaaaagagagtggagaaaactcttgagagttttgcaaggagatccaaccagtccattctgaaaggagatcagccctgggatttctttggaaggaatgatgctaaagctgaaactccagtactttggccacatcatgcgaagagttgactcattggaaaagactctgatgcagggagggattgggggcaggaagagaaggggacgacagaggatgagatggctggatggcatcactgacttgatggacgtgagtctgagtgaactccaggagtttgtgatggacagggaggcctggcgtgctgcgattcatggggtcgcaaggagtcggacatgactgagtcactgaactgtactgaactgaacacttaa

SEQ ID NO: 53126 - DNA, 1351 bp, Bovine  19866880575065
tattcttgcctagaaattcccagggacagaaggagtctggcaggctacagtccatggggttacaaagagttggacacgactgagaacaacaacaagacttgcctgaacttgagttaccacaaactttcaatttgtataaaatataatacctgtttttttttttaaagcacaataaaatgagatatgcctgtgcagaaaactgtcaaccatgctcacacattgatgatgatcttattttctttctttacttatttgtgttttcaaaatgatgtatgatgtacgatcattcttatcagaaaaatttttgaaatgaaggcaacaaaatatttaccatcttcatcagggttttgtgcctgttatttggcaactctatctccatgttgggttgggccaagagagcacctacgctagtgccaagagttttctttgaaagtccacctgagttcaatagagtttataagcagaatgattttagattggacacccaaaggcatagtctagaaagaggggagcagtctgaggggtcttaacttcaagagaggatgaatttaaaagtctttgtgttgtcctctatactgctgacctgaattatggtccataatctcttctgaatatgtttctccagaatatttattccaattgtgcttggagttattcatgtgataacttaataccaccctccttcagttgactttgaactccataagagcagaaacaccatcaacttctttatttattattttttcttttttaccattgaaaacccaatccagagaccatacttggtacatagttgttgctcaagtctattcttgactgtaggaaacaccagagtccattcacgtataggtccattcatgtataggtaaagggacatttccctatggtattttagagatcagtggagttaaacctaacgctggaagcttctgattgctgatcatgttgcatgcagagctattgctaggcagaacactgcttcattctccatggtgtaggtcccaggagacttcctggaggacctgaagcctaaagtgagtcttaaaggataaagaagaattagtccgttagagaacagtggactaggtgtgtttaaagctttgtagtgaggatgagaggtctgggggctaatcaaggaaaaaggtttgaccatgaggttgcagtagtacatacaagctttatgaatgacactggctggttgacagagaagaaaaatctctcacagtacgagcttgcccacaggtgactcagaaaggaacttagagggagatcactaggccatttaggtctgacctaaatcaagtcacttaatattatagagggaagtacaaacagattcaagggatagatc

SEQ ID NO: 53127 - DNA, 1255 bp, Bovine  19866880581473
acaggtggtaggaaatgacatcagatttccatcctggatctcatttggataactagaagtatactatcagaagagttggaatagaactttcattttactcttgtttctattcttatactcacttgtaaattgtatttccaggtagtggacttccttatgagacgcactcacagtgtctaaaatttcaaaatccatcagatggaaaacttgttttttagtagacctatactcattggctctgagaatgcagaagtgtgtgcagactggggtctgtcttttagatggatgcatgtatgaatctctacagtgagatttctctgtatggatgtgtttctaaatctactacaatgagattactgaaagaagacaccagggactttcccatcagtaagaagattaggaaccaaatatttcttctgaacatgggtgtgaactactctttatcttggtataatccttcttagcttagcatccaacaatcttcaaatgattcagctacattatcagagctatttagagaacatttacagcttggctttttgaaatgctcttactgatattcccaaacaaaagtgacaaatctattagtttaagctccatctatttcacaacatcccccacccttattgctaatttggcctcatttctgaattttcagagttggcgcaaattattttttagctttgattccttatgaatcctctagcaataccccatgaggtagcaggaaattacttctttctgtttacattttccaccgttacacttaaaacaaataagcctcctgaaggttttagcaacaggtctgaaagctgccatggtcttgttacagaaattccacggcttggttccactctgctgcctgtcatatggaaccaccgcttcctttcccagccctgccgcttgactaccacagtgatgagcccagagcaggacatcagttctgaaggttgcacagactaagataaatggaatttatcaggctggactgcttgcttatttcaacttgagaatttctcaaaatataaacacagagacaataatgtctactggtcaacctgagcaccaactatcctatcagcatgctaggttgcagagtgacagctggtgacttttgtgagtggcataatgacattagcctggctggaacatctccagtgctgggcttaactactcccaagccttggcaacgagaataagcaaaatcttctgagagtcttaaaagggattgctgaaaggtcaagctagtgatttt

SEQ ID NO: 53128 - DNA, 935 bp, Bovine  19866880611294
cctggagaatcccatggacagaggagccgtgcgggttacagtcccatggggtcacaaggaagttggatatgactgaaaccgacttagcatgcatgcatatgcttcttgaattctgtacagactataaaactggcttgagatcagggttgcccagtgacttgtagatgacaaattttcagcatgtcttacttcaaaatatcattctgcttaaaatgcatgcactgacgtgtttgtctctgttctcaagttagtcacgtttgagtcttcaagaaagccattcaaatgaatcacagattatcaggttgatgtcaaccatattagggaacatgaacagccaaggtagtaataagcctcagagtgcctgcctaaaggacttaaccctaggacatgaggatattttattttccaatacttcatatgtctgctttgggatatggtgtcaagccttaactggaccatgatgtttccaaatactgacgtgtcattctgttatttctcaaggcaatgactaggctatagaatatctgcctggtagagtttctctcatgggattctggtcgctaattttattttcgctcttggggagagagatctttcagatctgtgtgaggtaatgctactcacgaaacattactttggcttctaagttggactgaaccataagcacatctttttccagtgtctggcttagaaactttgcttggtctgtcaaaaaatatgaattgagcacttggaacattgtgtaatgatattgttgcctccatccaggcataacaattctatgtagctttcttgaaataagaatgtctaaccactcttgtgtcctgatcaagacaacaatctataatgaaaattgcctaactcaggcagactatttttttaagctgcatctcatcaacagtttgatatgtttattgtttagtagggcttgccag

SEQ ID NO: 53129 - DNA, 954 bp, Bovine  19866880640597
ttatacgtatggatcctgtcaattctaaaattggatccttagactttctaacttaaaccaataatctcccttccattctaaggaatccattctaaggaaataacccaagatgtgatcaaagtttatatgcaaaggtatattgcttataataagaaacctggaaaagactaaaaatatacttgacaataaggcatggctaaatcaattctgatacatccaaatagcagaattttatgcaactatcaaaaaatattttcaaagagtaggtaatatgattgtatgtttattgtacgtttctttcattaagcaatagaaagcaattttcaacattatctgagatatttaccatgtaaattaaagaaatacatcagaatattggtatttgttacttcagatacctgaattataagtgtttaagattatttcataaattgcacttttcaatttctctactttgaatgtgtgttattactttgtagtgaggaaatggaccagtgtaactttttattattaagtttaaaaaccaaggatgtttttcattaaggaaaaatccagaatataattatataattatgaattttagagagagatgaaaagcacacaaacagaaatttggggataagttttcctaagtgagcatggcaaaatgattccagttttacaaataacttatctgcagaaaacgtagccattcatttcacagtgctatttaaaaaaggaggcattttctgtgatgtgtcaacagtagaaaaacacaaaggcatccttattatttatagctagattagtacaattcaaaggaagagtacatgttttgaaaacatcttaagggtcaaagagactatcttgatattgggttatataaattgaaatggcttgcaagagcgttgttctttcataagaaattttcatgagtagaatagatactaatccgattaatattttttaggtcag

SEQ ID NO: 53130 - DNA, 1427 bp, Bovine  19866880682851
cagaaagatatcctgaagcctttgaatcggtggccaaagtatcaaaacttcagctgtagcatcagtccttgcaatgaatatagcctgtgagaagaaactaaaggtccttgactttgtttcatgactaaactcttattattttgtcttgtgtaactgctttcctttgtttctacattttctaacttctctgaactaaatttgctgtttaggactcagggaaggcccaggaggctaagcttttctacaaacaggaaatgtgtttgtgtgtgtgtgtgtgtcgggggttgggggctctgtccctagggaggccttgcagggtcctggtgggtttgagtttcacatgataggcatgggtcagccacatcagaaacagccctaaagactataaatctcagagacagaagttgcgagttactgatgtgttgcataaaaatattcacaggcttgcctgggaagcaggttgttctattccctgaaagacagagctgagaaaaggaagaagcagcctgagagaataagcagatgggaggaaggaactaaaagacctcaatccttgggagaaaaatagagccttcctttgcaaataccaagcaggtctattggcgccatatttccaaaggcattgtatgtggaaaatgagtagacactgactcaaggccaagcagttctctccttgctaattcaggagttatactggcttagtgccccagggcatctgctcccatccaactaggacctgcagacagtccactaactgatggttctagaaacctgtaggggactgagatgttcagcaagattctgtctagaatagatctgagtggatcaacagctaatatacctctcctgttacaggggcatagaaataaaggagaagagatacaagtaaacctaggagatatggtgagtttggttccagaccaccacagtgaagcaaaaatatcaataaagcaagtcacatacttttttcggtttcccagtgcatataaaagttaatgcttatgctatgctacagtctattaagtgtgaaatagcattatgtctaaaaaataattttaaaattcttcattgctgaaaaatgctaactatcatctgactattcaagagtcataatctttttgctgatggaaagacttacttctgtgttgatggctgctgactgatcaggtggtaattgctgaaggctgggtggctttggcaatttctttagaataagacaatgaagtttgtcacattggttaactcttcctttcacttgaatactgagaggtcattgcagtgttattcattgacctaatttcagtactgttgtgtctcaaggaatagggaggcctgctgctgctaagtcgcatcagtcgtgtctgactctgtgcgaccccatagatggcagcccaccaggcttcctctgtcccaggattctccaggca

SEQ ID NO: 53131 - DNA, 1003 bp, Bovine  19866880691458
tgctgttttgcagtctcgggagactgattcaggctttggaatcagattgtacccagaaacaagaaacatctgtcctgcagggctattgttcctcatatctgaaaagaacaagaggctcctggtactgcttaccaacagctccctacaattagctacacagatcacaagagtataattatattcaagagcgtgtggctccccggccccgggagtctaccactgtacttcccccggcaccatggacaccaaactccagaggaatcctaagtctaagtcaggtctgtcccttggggaagcgtgtacaaggctgtcctaaactgctatctgagtgtctatgatgcgattcatggtagtttgcccagactttggaccttgggtggagtttgcaagtcatttgatgccttcagagtgtaccctgttgagcaacctgacgcaggtgaggttgactagaatgattgtgtgttctacatgctgtgacatcacgctttaagtccatttgagtcatgctttcccttggggttgtggcccatcccagtgaaaagagatttttaacaatatattcttgggaggcttaggggtgttctaagagttgctcttagaatctgaaagcatttttgtggtttgttttttcacatttggggtgtttgttttaaaaagttaaaaaaaaacacaaaaccttgttactagccttggatactttttttcctaccatattaataattttgtaggaatttggttgagttttacaccttgatttctccatcgggaagaactatgcagatgcttgttactaatgctcatgagtagagtttctagagacgaaaatgttaagagagtcagttaaaattattccagatgtgaagagttggagagatgataaagagtctgcagcaatatctcccaaaacattcaaaacaaaagtaaatgagttaagacaaaaaaaaaagtgaaagtgttagttgctcagtcgtgtccgactctttgtgaccccatggactgtacc

SEQ ID NO: 53132 - DNA, 1552 bp, Bovine  19866880773529
cactcaggatgttcgaggacaacatgcacaggtcaattttcatcccctggatatgatgagtctctcattaagggagaggtctcccaggtgtgggtttgccagacaccatctccagacatctgcccaagactggctgggatcctggagaagcaagaaatccgggttccctctgtcttctattcttccctcagattctgctgttatctctgctgctgctgctgctgctaagtcacttcagttgtgtctgactctgtgtgaccccttagacggcagcccaccaggctccatccctgggattctccaggcaagaacactggagtgggttgccatttccttctccaatgcatgaaagtgaaaagtgaaagtgaagtcgctcagtcatgtccgactcttagcgaccccatggactgcagcccaccagctcctccatccatgggagtttccaggcaagagtactggagttgggtgccattgcctctgctttgccaatattacaagaagggttctggcaatatagatttacctgggactacttcattaggcactggcaatgtgtgtttcatttttaaacatccttaagtgagaatcagtggtgtgggcctggaaagtccttaacaacaaagcacatcagagtccagaagaagctgtacccatttcagagaatttcggcccaaggggcagcagctgaacaattctggacataatttgggatgggaatagagaagggagggagtttcagtcttgaatacagagtggacctggaaccttttaaaacagcacactctaggcatatttctgaatcttctgatataaaatattcactcaacagccttcctggagaactccaaaaagatgtgatgttccagatgtaggctcaggagggactttcttggtggtccggtggttaaaaatctgccttacaatgcaggggacacgtgtttgatccctggttggggaactaagatgccacatacttcgaggcaactattgagcccaagtgccacaactagagagaagcctgttctgcagcagagagccctctcactgcaactaagtcctgatgcagccaaataaaaatttaaaaaactaaatattaaaaaagaagaaggagcctcaggaaggtgggagttagactttccaaagggatactgatcagctttccaagggagaacagacacacctctgggcaaccaggggcttaatgattaagtccaatgggttaagaaaccatgttagtgggaaatattctggttttgtaaggaaggattggcttcccaggtggctcagtggtaaagaatctgcccacaatgcagaagacactggttcaatccctatgtcatgaagataccctggaaaaggaagtggcaacccactccagtattcttgcctgggaaattccatagacagagctgtgtggtgggctacagtccctggggtcacaaagagtaggacgtgacttagtgactaaatagcaacaaggaagaactactgctaaacgctgctcatttcttgcctcactccctagcctttcccacaaaattgaaataaatta

SEQ ID NO: 53133 - DNA, 1391 bp, Bovine  19866880791501
attttatattggagtataacctactaacaatattgtgatagtttcaggtggacagtaaagggattcagccatacatatgcgtgtgtgcatgctaaatcgctttagtcatgtccagctctgtgcaaccctattgcactgtagcccgccaggctcctctgtccatgggattctccaggcaagaatactggagtgggtttccattccctcttccaggggatcttcctgacccagggatcaaactcacgtctcccacgtctcgtgcattggcaggcgggttctttaccagtagtgccacctgggaagctccagccgtacatatacatgtatccattctcccctaagctcccctcctatccaggctgtcacataacactgagcagagttccttgtggtatgcagtaggtctttggtggttattttaaatatggcagcatgtacatgtcgatcccaaactccctatctcttccccccatctttcccccatgacaaccataaatgtgttctctaagtctgtgagtccgtttctgtgttgtagaatgtctgctctgctgatgtattccaagtccagaacacaaagtagaagaatctgggaaaacacacctactatcattacagcaaatgctttccaagcctcggacaccctgaatgggtcctttttgcccctaagtgttctgtttaaactaacctaattaaattgcctgtctgctttcaagtcagttaattatattttctcatatattatatatctacagctatattttctttatccatgtttttatctctccgtctagagtataggtcatttatatttctttgcctacaaatagtacagtgtgtgcttttagaaggcatttataatatttattaaattagaataagtcatctgatcttagaacaagtcacatggaagagactgagaatccataatttctgtgtactctgtcttcagactaagaaaatggattcttttaagggtgaggtctcagaaatctgcctgtttccttgacttcccaaatagacttgatttttggaaatgtctttccgtttccctgtagctgagatataatatatcctgtcagatggagaccccatcatgtctgggcaaacacacctgaatttgcaggatatgggattgtcaaggagggtgaccagactcatatttcttccccttcccttatgagcttcctgacaatctaccattcacacagtcactcaggttttctgctctcttgacaaaatacaagatcataaaagaacttgggccccaccaaagagcacttgtacattttatatcaatttgaactcactgattttatgagtcctctcaactctcttggaatccttttccagtttgtttttctcaggacagatttggatctgggagactgctt

SEQ ID NO: 53134 - DNA, 806 bp, Bovine  19866880860440
aaaaattccttactagaagacgccaagtcggggacccctgtcctggaaatacggcgacttcggcgtctctggccatcagttccctgactcagggcagagtgtgggcataaacagctaccgcaaaaagcagttgtaaggctcacacgatacgcacagggaagagcacaaaaatggttgttactttttgttcagctcagttcattcacacgttcacttctgttggcagtactggaaatgcacaggaattacaggaaaattctaactattttctgaaaaactggaggtgagatgactcgggagtgacaagacatcaagtacggaggtgaccgagtcggtgagcggtgcctcgggcagtggcgacttcccaccgggacccccgccgcttgagcatccttgaccaggcgtcgacattcctcggatcccgaggccaccacgggaaggcggtgggaggaccggatccacgcgttgattggctgtttgtgagcacggggcggggcggacggaggctctggaggacgcgcgagcggaaggccgcgggcgggtacttccggtctttgtggctctctgctgcaggtccgcggctcgcgccctggccgctcctgggcttcgcggtgagggacgtgggactctaggcggagggaggatggggagggcgcttggcccgggcggcaggcgcggggtggaggattcccgctgcttcgcctgtccatccctgggtctcggcaccttgtcgtggcggcatctccgagtgtcctggggacgcaggggaggccagcaatctagcctctgctctccggcagaaaggg

SEQ ID NO: 53135 - DNA, 2258 bp, Bovine  19866881043639
tatggctttttgcctacagtatcattgaaggaaatgttaaatttgggttctccaactgaaattaacttgtgaaaatgcaatatacttttgtccccatctaagttcatgggactcctttgaggatgaaggagctgacctgaacatgtattctacactgaattcatatttgaactttggagtgaggtgaaccttgtatgaaggaggggggaaagtaggtttcttctttaacacctactattcgcaaggctctacactagaatttttaatgtatatcatgtcattccattgtcaaaacaatgtgtagcacattaattattttatagattagaaatttgagagattgagaggcaggtgatttgcccaagttcctatgactatgatttttccatgtaggtggtagatccaggtctacctctaccccaaaggatatagaggaattactatgacctcagggcatttgggtagaaaacttgtctcctccacaagtctgtaatctccttcacaccagggttctagttgaagttgtctcagcataccccatcagcttgcagggtctcacagttgctttaaacctattatattttgatttataagcattgaaacaactgagtatattttgaatgcaaaataaatggaaaaatattttaaatgcctctattcttgccatctttagggaatagtcatataggagttgatggaggtgactataggagaatctgatctctggcaaagtcctgagtaaacttaccctatattagctacaggggttctcaggtggcgctagtggtaaagaacccacctgccaatgcaggagactcaggttctatccctgggttgggaagatcccctggaggagggcatagcaaccaactccagtaattcgtgcctggagaatcccatggacagaggagactatcgggctatggtctgtggctgctgctgctaagtcgtttcagttgtgtctgactctgtgtgatcccataggcagcagcccaccaggctcccccatccctgggattctccaggcaagaacactggagtgggttgccatttccttctccaatgcatgaaagtgaaaagtgaaagtgaagtcactcagttgtgtccaactctttgcgaccccatggactgcagcctaccaggctcctctgtccataggattttccaggcaagagtactggagtgggatgccatttccttctccaatgcatgaaagtgaaaagtgaaagtgaagtcgctcagtcgtgtccaactctctgcgaccccatggactgcagcctaccaggctcctctgtccatgggattttccaggcaagagtactggagtgggtggccactgccttctccagggctatggtctatagggtagcaaagagccagacaggactgaagtgagatagcacgcctataaacacatattagctactgaacgatattgtgaattaaaagtatgaaatgaaaaaaaaaataataaaagtcttcctggagtggcttgccatgccagtggatgtattcttggttatgagttatatacagaagctgtgcagagagcagcatccaaatctctaaattaatgataatcatacccaaaataaacagactaattaacattaactacaatgaaaacacaactactgttcaatggtcccgattgcatagtttatttagtaaaatacaagcttagaaatttctttaaatgagagaagtaatggctgttaatactaaatcttccttttttccattaaaggcctctagcatattaattacatcatcagcccatttattgattttaatgccttgcattttgctaaaaattaaattcactctacttgctttaggattccttgagacttaatacatatatgatttgggactagagaggttccactggacagttttaattaaaaaatacaatacaatgaaaaataaaactctaggttcaccaaattactttttgttcagtagggggaaaaatccagataaatcagaccttcttgcatttactttattaatgaggaaatacaatccaagccaaataaatctctttgctgagatggcaatttgttagtgctggaagttttatttcttattgattaggtaatagatataaagagactcattactcttgagtgctctgacttgaagaatgttaatatgggacaacttcagtgattttgaataattctagtagtccacttactaaggacatccatgttttattttgtgttattgtttttactataaaccttcttcaaaaa

SEQ ID NO: 53136 - DNA, 813 bp, Bovine  19866881074945
tgtgtatctgaaactaacacaacactgtaaatcaaccatacttcaataattaaaacaaaaacaatcccaaacccactcctccttggctccagccccgaagtccagagagtgactgtttagcttgacggagcactttgaggtcatgctgaacgatgaaagacagaaagcattcgtgttcatttattcagtctgctaactaaaattttgatttttttatttttaaaaaagcacatacatgttttggggttttaaattcataattaacagtcaatagctatggccttgaaatgacttggaaacttggctcttacccaaagaatgaagaaatttgggaattcttaaaaaagttcttcgtggcattcatattcatggccatgaatgaaacataactgcaacagtctaaggccttacacatacacacggcatatatttcttcatatggtcagaaatgcaactgattataagggattacatttgcctaaatgtccatctgtttcaaacagtgggtggcttggtccctgctctgaaaataacttccatgacctgcagctcattcccatgccacaggcttggctggcctctgcagggcaccaacttctgcccagtcccctcacctccccctcaacttggctcttggtacatccacttgctcttgaccatatgccttccgtttactttcccagccccacttggccctgttccctctccccctgaccttagctctctcccatgatcctaaccatgtccagtcaggtcccagcctgcccacccagcacggccctggatccaccagggttgctgccaccatggggg

SEQ ID NO: 53137 - DNA, 1407 bp, Bovine  19866881120636
taaaggaagagagtctcagtatttaaaaagtattttacagtttacatgaaaggaaatagaagatattttaagatcttctgtttattatttcaaagaagaaacaatttacttattttatagtggaagtggagtgaatactttaaggattatgtgcagtgtgtaaatattctatttcaaatgcttcctgtcctatccttaccatcatcaaagtagcttctgcaaccaagtgttgtccatcctccttccaagacaactcgtggaaagcctgtcttgaaacctattcacacagtatgttgtattagacatcatgtgtattaccaggattgtctgctccttcatcagagttgtgaactccttatacatctcttttacgtttcacagtatcttttaaaaaatttttatttatttattttaattggaggctaattacgttacagtatcgtggtggtttttgcaatacattgacatgaatcagccacgggtgtacatgtgtcccccatcctgaacccccctcccactttcctccccatcccatccctctgggttgtcccagtgcaccaactttgagtgccctgtttcatgcatcgaacttggactggtcatctatttcacatatggcaatatacatgtttcagtgctattctctcaaatcattccaccctcaccttctcccatggagtccaaaagtctgttctttatatgtgtgtctcttttgctgtcttgcatacagggtcatcgttaccatctttctaatttccatatatatgcattaatatactgtattggtgtttttctttctgacttacttcactctgtataataggctccggtttcatccacctcattagaactgattcaaatgcattcttttgaatagctgagtaatattccattgtgtatatgtaccacagttttcttatccattcgtctgccgatggacatctaggttgctttcatgtctgagctattgtaaacagtgctgctatgaacattggggtacacgtgtctctttcagttgtggtttcctcagtgtgtatgcccagcagtgggattgctgggtcatatggcacatctgttttcagttttttaaggaatctccacactgttctccatagtggctgtactagtttgcatacccatcaatagtgtaagaaaggttcccttttctccacaccctctccagcatttattgtttgtagactttttgatagcaaccattctgactggtgtgaggtggtaccccattgtggttttgatttgcatttctctgataacaagtgatgttgaacatcttttcatgtatttgttagccatgtgtatgtcttctttgaagaaatgtctgtttagttctttggcccattttttgattgggtcgtttatttttctggtgttgagctgcatgagctg

SEQ ID NO: 53138 - DNA, 758 bp, Bovine  19866881253953
atccaggtggagcagtccatcagcctcctgttaaacttcctgctggcagccctttgatccgtaagctccctctgaaatgtctgtgactctctgcgtgttccgtctccccttcctcttatccttcttggtctttattccaaagaatattctggaggaaccaactgctgcttttttcttgttcagatacttatctcaatagagtttctgtgtgtgtaacataaattttaaatgctttggaaaagacttagagcgtaaaatggcaccacaggaaactggggacacttgtattttatgtgctgacctttgtttaattcatcctacgcttcctagaagctacggacacttggaagccacgtggtggcaggcctgtggagcgatttaatgaagcatgttgtggaggaggtttttaaccctctcctttgcaaatcgtctaagacagcacttctgaggtgtcataacaagaccccagagcaaacagagacgttgaacaggcttccttccttgactagtctagtaaaaatagctgtgacttgcattaaacggactggtccataatgtaccacgtaaaacaaagtgatgccatttcacgcaccgcaagtgaaacccagcctcattatcttaaacttcccctcacagacacagagaatttcagagccgtctgagatcttaaaagtcgttcttccaaacttctaattttaccggtgaaggacccaaagcacagagagattgtcatttgtccagggcaatcagcagggcca

SEQ ID NO: 53139 - DNA, 661 bp, Bovine  19866881268108
cagaaaatatgattctgttgctgagtgtatcgatatcaagagctcaaagaagggtacctggatgggaaggacatgagtgggtgctcctgggagcatcctgcagatgcagctacatactcctgtctcctatagcaaaggagcaaaagatggcgatggctacaagcaggcacgctggcaaaaatcttaatcataggatgaaacacattgttgtctcctaattagcagaaatatcaagctgtcccttaaaagacaagttggtgatggactgcgaattagagaatcatctgattttagggcttagagctgtccagaccagacattttgcagctaggaatactgttgacttagaagggtgtgatgacatgtcacagtccattcaagatgattgaggctttgatccaagggccagtagtctggttttctatccttcccaccccctcctctgtcttcactgatagtaatttgagtaaataagcttttttaaaacattgtatgatttctgtaattaaaggtataattgcacagatgtgtccattaaatagatgtccttttttttgcttccgacccttcatcagtaccaagtaagattgtggaaagtgataattgaatacctcagtgacataggcttttctatagaagggttccctggcctggagaaaat

SEQ ID NO: 53140 - DNA, 1483 bp, Bovine  19866881278474
atatacacttctctcatatctttggatgggagaggagacctaggcattttttgcttttgtttccaaagctaaaatctgttttcattttcactaggctaagactgtgataattcaacggtccagctctagacaagcctctttgaatgttctcactgaaatgtgtccatgctcaagttcatgcaattcctttatttcctgcccctattttatttccacgtttgaacaaaacacatcttgttgaactgactgggtagcacaactgaaaagggataaaaaccttctcgggcacagtcgagtggcaaaggaaaggcaatcacttagcaaataaattatcttccagaagggtcacgagctttcaagggatgatttgcttagggctctcaaaagccaatggacccacagggctttatttctaactttgatattaacaagcagcaacagaataaagagactccttaatataaatacaaagccaagttggaaggataggaagacaggagttcaaaccgttggcctccagaatttcacagccactcgggacccaggccaccaatgacaggggcatggggagggagggtcttcctgagtctgggcctgctccgtcaaggcgggtgcacacgggggcgaaccatggcttacgggtggctcctcaacagcgtgtcaagggaacatgaggccaacagctgggaagcagtgtgagtaatggaagagaaatttccccatttctgacctcatccaagtaaaatttttaaaaagaaaattaaagaagcttgcttcattaaaagagagagagagaatgcaactggaaatcatgaaaaaagaattcaggttccatcagaaatgttttaattagcacttacgttctgtttactccagagctcataatgccaagtatctccatatcctcaattcacgctcactattggatgtgagcatgagggctccagtgacagaagatagtacgtgaaagcaaaggatcgccttcaagtagagtctatttaatttctatgtgaaggacccagacccttagcaaatccaaacgggtcctactcttaccagacagggagccacaatgagttaacagtcagctgagagagctagatcgattcttgcgattaattgctcacatagcttacttttcacaccctcccccaaagcctcatctccagtctctccagtgaggatggtatcagccttcaaagaggtggcaatggaatcaatgcgaatgagacataatggtacggtgtgcaaaaagcacgtctagtgcatttttattatttctgtcttcctctccttcttctgggaactactccttcaaaccttgtgattctaatagagcttgccaattataatattccatcctcctggacctaaagattggttcagaattaggtctgtgacccaagccaggtcactgaatagatctgtaggatttaaaaaaaattagagctgcagtgtgtatgcgtttgaggaggagttaaga

SEQ ID NO: 53141 - DNA, 783 bp, Bovine  19866881403027
tgaacaacatgtatattatacacatgtccagctctttgcgatcccatggactgtaacccgccaggctcatctgtctatgggattttctaggcaagaatagtggagtgggttgccatttcctcttccagaagatcttctcgacctagggatgaaacccatgtctcttatgtctcctgcattggcagatgggttctttaccattagtgccaaaggacacacacatatgaaaaaattatttattattatctgaagttcaaatttaactgcatatctttatgtggtaattctactaacatagtactttaatctcagaacatatttagtgggtgatttaattttctttgctttggattgtagaagaatctttttccctagcttgctgatttttatttttgctatgaactcctttcttcaaattaattcctcagctggagccaagcatttaaaacagatcatcaggaagtttctctggtaggggaagggggacagaccccagcccactcaggctccatcctgtgttactgcttgaaatgtttaggccagactcctcatttccaaatgagaaaaggaggctgcagagaagggggactgtaaatccagtgtctttgctttgcaatgtgctgtcactgcagatagaggcaactttgcagcagaggaatgagttatgttcctcaaggtaatttacaagcttcattacagcacagagcccatttttcctgttcagaaaatgctggaacattaaagtgagattattagggtgatcccacaagggtagctaaaaag

SEQ ID NO: 53142 - DNA, 836 bp, Bovine  19866881412932
ttttccactggagtcagtggtttggttttcccttgtacagcagggtcacctccaaaactctttttaacttttgttttccttgtcactttttagaagctagtttgtaggacagctttctccccttggcatgaagttcaaatgatagctttagctttgtctggtaatcatgcctgacttctttttcccatataagcatatgatatcattttgcaggtaagtcattcactgattcatttcaacaattttatctagtgcctgtaatgtgccagcccctgtgatagtgtggggaaatgaacacagactttgaagtgtagttgattgtattaatgccaacactaaatagtgtttattaagcatctgtgtgtatatatatatttaggttcacaaatcttttttttatataagatatacagtcctaataacaaattatgatgattcattgactaatttaattcttacctaagaggaggcaaaaaatgcccaaacatacattttctgtaaagaatttaggattttaaggaaaagtacaaatgccataagaattaagttttatttccatgagtattcaataaacactctagggtgttccttcaaagtttcatacttactcatctctgcaaagagctgtcttctttctgccatggtatttcctcttttcccactatcttcaatcattctatgagacaaaataataacaatgtgtattagcctcatgctaatgaggcaagcagccatttctatacaaacacacatgctgtagtcatgcttacaaacatagacacaactattgaaaactgcatatttaaaaagaatagctttccattgacttacttaaa

SEQ ID NO: 53143 - DNA, 1493 bp, Bovine  19866881422421
catggattgaatgctgttcctgggggtcattaattcccagcactttcagcttactgcacacaagggcaaaatggcttcagtggtcaagagtgccctcaggcaaaggaatatagcagctgagttggtaggagcatgagtctgtttgtcattttcttcctttagagtttcaattgcacttaacaacaagaagccaatttcatcattcttaattactgttaccttcgaatcttccaaatgctggagaaaattgcatcaaccaatatatccccttccatctgtatcatgctccagttcatcctaggtgagtgtcttcttaattgggttgccacagcacatctgagatcctttcaactctactcaccaccagtaatgaggccctcactgtctgtttgctgtgtgagtcattcagttctagaatcccagcctgaggatctgctactcagaacctcttatctcactgactatcttaatttaagctttcacagaagtagattcttagaaaaagactgcagtgcaaaaagtttatttgggagatgaggcaaacctcagtaggagaactgggcagtaagacaaagagagaagacagacaataaaaaggtacatcgtctggctagataccactatgggctactaaatcccactagggggtctttgggagctctaactcacacttgagtgttatctgctcccctccagggtaagggatttggggtgtttactaattccctttcacatcagtggcgagctcctgcagagggctgctaattccttggtattgttgacctgctgcatagcggctagaaaaagcccatagggaaaggaacacaggcactggccacaggcaccagagtggtaagcgcaaggcggtattgacaaggcacttgccagcatccctgacaccactgttttccactccttaagatttttgctcagatttgatattaggtatttatgtaaaataagaatatttaaaaattttaaaaaaactaattaaaatttccagaattgccaaagcttttcaaataacaatgaggcatttccagagggctgggtagtaagtgtgatttgcaagagaagacagatttgctaaactgaagtatttagttaagctatttatttttacttctgctaataaggcttccagatgtagatgtgaaggaacagaataaacatgtttcttggatcactagaggaaggaaggaatatgagtcatgtgtgcagagacagacagcgatttgtttagcgaggcattaccactgctgggcattaatatacctgttttatttttactttttaaaatttatttttattattttatcacatatatatacatacgcacatacatatacatgtatatgtgggtgcatgctaagtcgcttcagtctgtctgaggcttacccttattgtcacctccagtagaactgctcagaaattggggaacgagtgagtcctgttgaatatgccttcaaaaagagcaatacacaaagctcaag

SEQ ID NO: 53144 - DNA, 1169 bp, Bovine  19866881452913
attttagtggatgttcacctaagagctaagactgttaaactccaccaaccttgagtttaacatttggagaaccataaattctcatttgtgaattgttgagtcagatgaataatttcagcttgaatgtattgaagttgcacctgtagaaagttttctttttctgaaggaattagggggaaaaaagaatgactggcagagcagaaatagaattctttttctacttcagctgccttccctacacagaggaaatctggacctcaggctctcccttgcaaaatctgaaggtgtcacacatttggatgggggactaatagaggaggtgaaagagaaccacaaaccgaaatgaacttagaagtatcctggtaaaatacgggggaagatagattataagaatattctcatcagcacggatggtaaatagtaatgagctatgttgattccattggtattaatttgaagtaggtatattgttgttcagttgttaaagtcgggtctgactctttgcaaccccatggactgcagtatgtcaggctttcctgtccttcactatctccctgagtttgctcagactcatgtccattgagttagtgatgctatctaaacatctcatcctctgttgtccctgcctcctcctgccctcagtctttcccagcatcaggaccttttccagtgagtcagctctttgcatcaggtgaccaaagtattggagcctcagcttcagcatcagtccttccagtggatgttcaggactggttgcctttaggattgactggtttgatctccttgctgtccaagtgactctcaagagttttctccagcaccacagtttgaaagcatcgattcttcggtactcagccttcttaatggtctagctctcacatccgtacaagactattggaaaaaccatagctttgactgtacggacctttgtcggcaaagtgatgcatcgttattgttttattttagaaaatatcataaaacattcctaaccttgactgctccacccttactcttgctctgtcctctatctttgtttgcccacaggtccctcaacacatgtatgttcttacttcagggtttctggggactgtagttgtgtccggtggagatgcggatgtggttgaggttagagtgtgagtctagtaaataagcaaaaatcagctgctatt

SEQ ID NO: 53145 - DNA, 1073 bp, Bovine  19866881456535
catcttataaggagctctctcaggatctcttcccctaaccccagatttactgtgaaggtacccattcaacacttcaacaaatatccttctgtggatctactcttacaacagttcatggcactggaaggacaagaattctgctctcagaaaacctttatcttctgtggagtctcacccccaaagtgaattcctagcatttcacaattgtacaactcttacccaaagagttacactctggtgtgagttctctgatgctgcatgaggcctgatctatgcctaaaggtcttcctacattcactgcattcataaggcttttccccagtgtggatcctctgatgctgggtgagggctgagttttgattgaaggattttccacatgcattacattcataaggtttctctccagtgtgaattcgctgatgttcaataaggatagagcttctactgaaagccttaccacattcagtacattcatagcctttgtctccagtgtgaattttcttatgctgggtaagggctgagctccggctgaaagctctcccacattcaccacatccataaggcttctctccagtgtgaattctctgatgccggatgagctctgagctgcccctgaaggcttttccacattcacaacatccatagggtttttcaccactatgaattctccaatgtcgaacaaggtctgatcctcagactaaaggctttgctacaatcttgacatgcataaggtctctctccagtatgaattctctgatgtctaatcagcttggagctctggcaaaaggctttcccgcagtccaagcactcatagagcttacccccagaaagaattctcggttgtgttatagagtttgagttcaggctgaggcttcctatactttcattacattccaggaaattcttttctgtggcgatttccttggtgaagctggccagtctaaaatgtgtttcctgggaagggaactgactcagtttgttcccagacgcactgcctttcagcttctcaaaattgtccagacctcctaaagcttcttcaagtatctgtccgaaggagtttccccagggagtcg

SEQ ID NO: 53146 - DNA, 901 bp, Bovine  19866881491322
tcctctgtcaatggacaggttgtttccaagtcttggcagttgtgcataatgctgctatgaaactaggatgcctgtacctttttgaattagtgttcgttttttcctgatgtatacccaggagtgtttatgtctctcatctagtatcttaaccactcttccagcaactttttgtcttgaaacactccacgcacccaccctgcattggtatcacaggaacctcatttcatagctcactttaaaattctgattgttcatctcctagtttttgacctttggaatttatattatgttgagagaatgcaaaatggaagcctacagttcacataggcaaaaacggaaattatgcgctttcgccttatagcatgtatcagagacatggctcctaaacatgtttttgttagatacatccccaaagataacttattttaatggaaataactcattactgcggtaaagatgaaacagggttttataggccaccaagaaataatttcttagtaggttactgagaagaaaaaaaaaatacgtgtacattttcagtgtcatgtctccccagcctaattaggatcttactcacttgaaccaggacgcacttatttaaagcatttttttttttctaaaggatccaaaggtggtgataggtgcataggatggtcaacctgatgactgcttttcgtgatagatgcttttgtgtaattatctcataaaggaaatgtaatgagagctcagtctttctgactgagacctcatttgctttgagcaggtaaatgtgccaaagagccaggtttgttccatgacttgaaacagaagaggaatagggtgagaggcttgaaaatgaagagtacgcgttgtaagtttttagtgtacattggcacaagtctgtgaaccgagggatctcatg

SEQ ID NO: 53147 - DNA, 1640 bp, Bovine  19866881966073
tgttaatagccaagaaagtcagggatctagggaggaacagagtggctgagggtcactggcgaggcttaagcacactacccagtaatcaccctcatgatgggagcgtgggtcctgccctacctggcaccgggtgttactgatgtgtccagggcaagcaaaaaaactgcccgggaaccactgaagtgtcacctgcacggaactacttattgtgcctcttcaccagagctgtctgaaaagaaggaaactcagtgagtgcgacaggcttgggaggggacatgccgggaagcacaaagctgcgtatagcacgaccacgccctgcgaccaggtgtgggaggatgtcaccgcagagaaccaggccggattccagcctgagagaatcgggctgtcgccgaggtgcagagcaagcaggagagagaagaaagggagaccaagccccacagaacagctgtccacttctgcagtgtccgcaacaacctcaaaaatacaagcaatccttttcacgtgtaactcgataaataccactctgccgccaaagatctgagaagactccttttggtggaaagcttcaaagctagaatttagaattcatatttcatcagttaataaagaaatgtcaaagctttatgagacataattcagaaatttatttgaagctttttcaattaagaggaaaggggggggcacacttgtttgtgttttgttgcacctgctaagtcaaataacaagtgaaagaaaatctaaagttagaaaccaagtaaagtgaatgatccagggagggaaaccatctttcaaaggggcggtggggggggtggggggagaaaaagatttggaaagatactaagaaaatgtgcaaatattagttttaaaaaaataaggaatgcttttaattcattcatgtttcctctatttatgaattgccacggtttagcgaaggtcaatgacaaggagggccatcgtactgaagagggggaattccttattccagaaggtattgggagtcagatttttctgtgctgtctttccagtgtcaacaccagacttcagaagcagggttctcccttgggcttacactcctatactaaggtcgtcactgcaggccttccagcaattgtgtggcacgcccagggctgcacaccctgaagtcattctttaggatccctagcgtggatgacagggctggggctaaaacccacataaagagacaggaaggacctgtgcctgtgcagaccccctctgactgcagacccccgatgacagcttttggggagagtggctgcccaccaaagaggaccctgagaaagaaaacagcatgagaacctgggtgggggcagggggtagggacacgcagtaggagggccacgtcgtgatggtgttctccttgagtgaatgtcttccaaaactaacaacatattgtgtggctgtctaacatgctgatggatgaacactgctaggccctgaagtcctagttttgattccttttttcttccctttcatttgtgagtggagggagagcttatgtaatttttacaaaaagaattctactgtatatcctctggtgaagggctcatttgagatccatcagtgtcagtactttcagctgatatttaacaaatcttgaataaattaaggcccttgctgcg

SEQ ID NO: 53148 - DNA, 1712 bp, Bovine  19866880385520
atgattcttttttttttaaaagaaagcattttctttttttaattatttatttttaattggagggtaattgctttacaatgttgtgttggtttctgctgtgcaacagtgtgaatcagccatcagtatacatgtatctcctccctcttgggcctaaaagaaagcatttgctttcagagaatacaagtgtctgatcttgttatgttgcctagaaatgataaaatgcagattttgttttgcgcctacctactattgatcagaagaactggagaggggtttagaattttcttcacaaaaagaaaaacagaaaaactgaagtagtgtagttactggagggagcccctgctatttgggaaaaagttaatcagtcagtcctttcctaagcaagaaacaatatgactaatccttttctcttgccattatagttatcagaatggcagtttctccattaaggtaggaaatagaacctgggtagactagctgtgctcagcatcttgccatctcaccaagcgtaaacgctgaacaagaaaacctgttaaaaacacaatctgtaggatttaaagtctgcttcagaacagaggcgtcagagatttcgctgcctggccctgtagtgtcctcacagggcccagctgccaactgagggagtcgggaagagagagctgccccttagacctaggtactgctttaaaagaggtgaaaagagaagacagggagggaggaagtggggccattaatgtgaaggcctagttctgtaaggtacctacattttgctcactgtgtttctttaaagtttccatttcttgaattctgtttacttgtattagactagttttgactgcatttagctcctttggtcaagttctatttgataaagacacttaaattataaaattattaaaaatagacaagcacaatcctttctctgttaagcttatgaaaaatctgaaaagaactatcaaagagttatcaaggaagttctcacatttgaagagatcagactcataattaacctcttcatgggtagaaacggaaacaaaaattaaaatatggtaatgtcctcattcatcaggaggtctgatttctacaaaacttagatacccaggacacatttatacttcctttgtctagggattgagacactagcacagtgtggaatattgttaattcttcataagtactactgaaggattttgttaaattagtgaaaaaggctatgagtggccacagcaccataaggaaaaccatatgtgtttgatagtagaggcatgtgagactgacctcagacccatcccctggcagctgagcctgtagtaataagacccctgaccagaggctgtcaccgttacaagccaagggcagtggcagctgtctgtgaaggtgggagaacttttttttgatacgaaaagtaaatggaagggatagagcaggggtccccaacctctgggccgtggactggtacctcctgtcagatcagtggtggcattagattagaaataaagtaagccagaaagaaaaacaccaatacagtataataacacatatatatatggaatttagaaagatggtaacgataaccctgtatgcgagacagcaaaagagacacagatgtatagaacagccttttggactctgtgggagagggtgagggtgggatgatttgggagaatggcattaaacatgtatattatcatatgtaaacaaatcgccagtccagg

SEQ ID NO: 53149 - DNA, 1329 bp, Bovine  19866880450742
taataagcttaaagagcgtttggcaagagaaaatgcttataaaacaacattaagtaagaaaaggacaacttatgtatactatgattccaattttataaaaatagaaatacttctttgtgtgtatatatatgtatgcacagaaaaaatgccaaaggaaaattatcaaatcttgatgctagagttttttaaattgcttcatagcttgattatgagtgttttcaattttttcttttatacttttttatattctctaaattttctaccataaacatatattacctatttcttgaacttttaaatttgaaatatttcatatgtaggaaagaatatacatgatgaaaacatgtagtctatttagaataataaaatgaatacccatttactcacccctcagcctgagcagttgatatcctgatacagaatatgtacataggaaggaatcgctggatcataggatagtcacattttcagctctaatggttaatgcattattattttccaaagtaattctaacagtgtaaactcctacatgcagtgtgtaacaattcttatttctttttttacacatttaccaacatttggtttttgtgttcctttttaatcagaaaaaaaaaaacccaaaaacaatggcttaaatgaatacatacctcataggaaaaccaaccttggaaccttccattaaaagatgtcaattgtgtgaatgtcctcaatagtgtgtggatgtcatgtctttgcaggtacgccaacagcagcctcataaagtacatggagaaacacaaggtcaagcctgacagcaaagtattccttttggtaggtgcatctctccagagtgggaaggtgatccttagcatagctctcaccccaccccacttaccgtgaaattgtcccagctctttctcctcttcaggaaaaaaagaaactggtggatgttggggcaaaattaaatctttttcctttgagacatcacccttgacttttagccttgtttccagtggtttaccagtaagggaaaaaaaaattctaaaacagctttactgctaatcatttctgtcagtttcacataaatgtgtgtggtgtatgaataagctagcacttgatgttaattctgttagacattaacaccgtcagaacattgacctggaagcaaactcatgtgctgtcaatttcttatgtgttgctctagcttcagaagctcctcacgatggatccaacgaagaggattacctccgagcaggctctgcaggatccctattttcaggaggaccccttgccgacattagagtatgtgtccttccttttctgtgcactttgctccaggttgagggtgtg

SEQ ID NO: 53150 - DNA, 844 bp, Bovine  19866880516092
cagggagactggttgggaggccactgtaatagtccagacgagtgggttaagtggcttagtggcaccaagaaaaggtgaatggtggtgacaagtgtttggaatgaggtacactttggaggtaaagtaacatgacctgctgatgtttagacatagaatatgagaggaaaagaaaagtcaaagaagatcccaaaagtttggggcccaaacaactaaagagattaaaggtatcatcactaagatactgatttctgggggatgagcagcttaagggagaagatcaatattatgaaatctgttttgaaaatattaaggttgcccatcagacttccccagtggagatgtcaagaagttggagttcaggtaaaagctcggcaccagagatattgacttgtgagtcgtcagtgtatggatgcgattcataaggatgatatctaaaaccaagataccaagacaaagtgagtgcagagagagaagaggttcatggctcttcttagagcattccagtattagaaattggaaagatgaacaagatctagagaaggatattgtgaaggaatagtcatcaagatgggaggtgacctggtttccagttcaataaatactgctggtaatgatccagaaatatcaagacttacaattgactacaggattgacaaagtggagctcactaatgtgggaaaaagcttgacaggattggtatcaagagagaaagggagaagaactgaagactcctggaggaatttttccttaaaagggagcaggagaaaaaagggacattagcctgaagggatgtgagaccaagtgaggatgctaaaatcaagatatcacaaccctcttataaaaa

SEQ ID NO: 53151 - DNA, 841 bp, Bovine  19866880559412
attgtgggcagattctttatcatctgagtcatcaggatagaggacattaaagcagcagcaagtttgggtgggtgaaaactgaatcctggtgatatcaggttttagtactactggatatgcaggtagtgccatcacaaataaaatgtgttgaactatcctatttagaaaaaatataaaattttatgaaaaaagagttgagattaatcttcattaaagctacagttcatggggctgccaagagttggacaggactgagcgactaacacactaacaccacatcctatttagaagaaatatacaattttatgaaaaaagagttgagattaatcttcagcaaaggattctgataaatgattcaaacatgaatatgacctcaaaaatataactcacataggctatattaagtagcaaattaaaatctaaaaccatttatgaaggagggtttgacctagaacttcatgtacccaagaattattttcatacatgctgattcacaggtaatagtaaagcagatacgtggaacgcaatgagaacctcagtttaaaattatgaggtgaaatgcttctgttgaaatggtaaatgcagctctgtgctgccatttggccccaatttaacttaaatgccatatcacgagatgctcaagtcagaagactaggtctaagtggcaaggtaccattcctttctataataaatacttcctctcaattataagaactgagtcgacttagatttatccctactatatccctagaatctccaaaagcctaagcaaaataaaacttccaattagaaactcatgggtattacagctattcagcacccatatttcttaagaacaaac

SEQ ID NO: 53152 - DNA, 2092 bp, Bovine  19866880610782
aaaatgatctgcttgacaatttcagaagggctgtgcaggtcaatgagtcgcttgtggatcctcatctggaatctatcccaagtcttagaaccttcactgcaaggagttttccttgtagttattctcagagtcttggtaggcatccgaacaggtcctttcacttagagattcttttccttcgtgcctctgatcagatcagcacacaaccttctccagagacttcacgttgcagctggtgagggtgatcctaatctggtgaatggccaccactggctccacgggagtcttgccggtatctttaaaggccatggtgcggcgcggcttcctgactgccttgttcctcggccagagcgaacagcagtgagtcaggagcaggagaaggtggcatcgagctccactgcagaggcaactgcatcttcctcaaagagcctgtctttttgatccaagccaccttagcaggtgtgaagtgatatctcactgtggttttgattagcttgtccgtcttgggagagtaaatagcttgtctctccttttgagctggaaggtcaggtacctggcggcaaaggcaggtgaagattggcgagatggagactgggaccaacttattggggcatgtgaggcccttagcacgtactagagatttcatttaagagagagtagaaaccatccaagtttttaggtgtgaaaataaaaaaattgggtaaagttgtgtaatttgaaactgaaaatttagaaagtaggctttacggagcaattgctggggttggaccttgatgaaaacttttcacgtttacatcatttaatcctccaggcagaagacttggttaggttatgatgtgctgccgaggccacacagccgatcagtggcatttaggagactaaaatgcaggtctttctgagtgcaaagggcctttctttgatctcacaagtgcatcggcatttcttaccttggcctggaaccaaccttgcgacccaccgtgatctactttcttgccttgagagctcccttccggccgagcctctgccgtgcttccatcacatgctggtgtgaggatcagtgtctctggtgcagagtgagcagccagctgcgggcagagatggggccggccgtccccacagttcctttcagcttcaggactctgagccctccttgccctcacaccagggaaacccagactgggaaggcatcagtaagctgcagcagacagtcagcacctacaaaggtgttgcacagcactgctcagcgtggccaggaggaaacctttgtgttagagctgctcaggtctcctgtgtacgcgggacagccaagtgaggatagtgtttgaatttttaatatttaaatctgtgttttgaataggtaatgcattccccttgttctgaattcagatagtacagaggagcgtgcagtgagaagacctcttctttcccatccatcccctccccgctgtagcagtcagcctttccagcttagtgtctgctcttccaaaactaatttatacagcagatatatctacttatttatccagttatttccctctttttacatagatgatagtctaatcagatttactctttggcatctctcacaaaggaccccaagttctaaagaattagttgttatttctgttgagagatttgttgcagttgaaaaacatatacacatctcagagttgaagagatagttttctttctttccctttcccaaaactcagtttgccattttgtaataaactttcgatcagaattgaaaactgagcacagttcatggagtgtatgttcttagtcctggctgtgtgtgttttgcttttagtgtgtttttattgaggtatagttggtatattagtatcaggtgtacaacataatgattcaacattcgtatacactatgacatgatcatcataataagtctagttagggatgatttagtcttaaatcttgtcttaagaattgctgttgtgaagtctgacaactgctacaaaggaggtgaggtgtgactggtgtctggggttcagtttcagtgatcatcttgtgtccatactaattgaccatttcctcccttaacttgccaagaaatatcacccagacacgaata

SEQ ID NO: 53153 - DNA, 1407 bp, Bovine  19866880981715
taatacctaacctaattgcagtttcagcccctcccaggaatgtactcttccccagtcggtctgcaatctctgctcagcacttgagaagtaatctacctggtagactcctgtggtccccagaggaaggtgccctggcctgacatgatcagctctctgctaaagtaacatccggtcccacctccttctacctatagaagtccagaagtctttcatcttgtacagctcttcagagcctttttctatatgctatatgagctgctacctgatacatgaatcactgaatgcagccaatgaacctttaaaatttgctcagttgcattctgttttctgacggtatgtcaacatgaaaaagtacagcattgaggggagtacctgataatctgagggcataacaggcccgcccgagtttgtgcctgaaggccccagccgcggtttcttgttgggaggcacctggttaaggcccggagtcctggctatgctgcagccctgctccggccggaccggcccctgcacctcccgcagtcccgttggtctgggtgctgttctgctgctgtgggggtgcctgcgggggggcagccgcctgctgtggaggggctgtgggctgctgatgttggttctgctgctgttgctggttcttatgaaaagagaaaaaaatggcaagcttggtatggaacgaaatcacgcctgtcattgtaggatatgcatatgagactgtcagccaacctggggagaaacctatgtgggacaccaaagtgactggcatgcctggagaatggagcagccagggactacagcacccccacaggtgagtacagagccccaaagaggactcgttctctgaagttcatttagattgcacagtaatccttcctgtcagggacagacatcccactgaagacgcaggcccagaggaaagagcaactccttaaaacagctccaacagtcttttcagtcaatttggaaaaagaagggctgtgtggggaggagtcagtacaatcaaagcaaagcacagagagatgctttaaaagcagcctgcataaaatgatggcaatgacactgaacaaacaaaagcaagaatcaagaatcggggaataaaatagactgtaaaacaaatcaggaagttcatttatctgtgaatgcatatttcaaactgcagagtacaataaagtaaatacacaattaaataaaatgcagttaaatatataggaatgactacatttatccttccctaagtgcagtttataccttgtcacctttttcttcaggttcatcttcattaaggaattctcgtttggggtatggaatctggcagccagcaaacacactacaaatcattgaaggaaaaaaaaaaaaatacaagtcatgacctaaaatctataatatgattgaccttgtgcatttaaaatt

SEQ ID NO: 53154 - DNA, 1369 bp, Bovine  19866881254190
acctaacagctaacatccacgattccaggaattccagaaaatgcacactaaaatctaggtttggaatcaagtgaaaaacccgaccaactgtttgaatgaaatgattttcagacattggacagcaggcagtacacgacagtgatttgtgagggagcgggggcaatgaggattacccctagcttactgcctggagagaatttcaggccatagcattcggaaagggaatattggtggaacccagaagtattcattaatagggaagatggtgtttgggatcccaaggagactagtgaagttagaattcacagagtggaatattggagaagacagctacacagagaatgcctggagttctacagaactcctttgagtcttcatatgtatactgagcagtggatgcatataagggaactacatgaggccagggaaagaattatccaaaaggattagagggaacaatccctagagatcacaaaggacagggaatgcagccctttcccaccaaccagggttgaaaatcttataattagtggggcactgagtaaagtacttagaagggtattgcctcagttgtggggccttagactaaacctgttctggtccttttaagcttaaaagaaagacttgaaaggatcaaactatttccaagtaacttatgatgtgccagaacaacactcaagaatattttaaaatactggatttcccaggtggcatagtggataagaatccacctgtcaatgcaggaaacatgggttcaatatctggtctgggaagattccacttgcccaccacaactactgagcctgtgtgctgaactactgaagcacgtgtgcctagaacctatgctccaccacaagagacgccactaccaaagccttgcattgcaacaggagagcagcccctgcttgctgtaacaagagaaaagcccacacagagcaacaaaaacccagcatagccaaaaataaaataaaacgaatatttaaaaaatattgaacaaggtaaaattcaaacaagggaaatctgaaaaaaattaaaccaaggcgcatcatactcaaatctctcaaaaccagtgataaaaagagaatctaaaaatggaggaaatttttatgacataaaaagaggaacaaagataaggatgatatgagaattcttgtcagaaacaaagcaagtaacaagacaggaagaacaataatctttggaagtacagaaagaaaaatattgtcaacctataattctatacccagcaaaagtatctttcaaaaaaatgaatgcaaaagaaagactttttaagacaaaaactgaaataattgatccccagtagacctgtacgataagaaatgttagagaaagtccttcagtttgacataaa

SEQ ID NO: 53155 - DNA, 2687 bp, Bovine  19866881509066
aatacaattagatcctgaatacagcgtggttttaatgtgtactgctgagcttgcagatagcaaagatacccttgagagtctaaagaagtgagccatgagctgcgatcatgcttaagcaggaggtgggaagcacatggcaaaataaacactaagccttagacacatcacaagggtcaaaggccaaactaagtctcctgctttaagccctgacccttgaagggggctgcttggccttctaggtcttggaggaagcaaagggagacctctgctggagtcaacgcctccaagggaggctcttaggaggcccacaggtggagcaaagtgagtttcaaatcaaagacggccaaacaccaaggaaaagagccaccacaggaaagacaaagcagaagcaacaagcaatgcatttatactcctaggattttggtattggaattattaaatgcaaagtttaaaatactgcatatgatttaaagaaaaccaggatggaatcattaagtgtgttcaagtacggagaaactgtgaaatttgtctttcccaagcagatttgaaaaagagccaagtaaaacatttataaatgaaaaatataattatagaaattaggaactcaatggctagattaaacagtaggccacccactccagtattcttgcctgggaaatcccctgcacagaggagcctggcaggctacagtccatgggcctgcaaaagagtctaactaaatagcaacaaagacactgttcaaaagagaatcagttaactagcgtgtctgaagaaattgctcagaatatagtacagagagacaggaagatagaagatatgaaagaggggttaagacttgggagagaggctgagatttaatatattgatcatgagagtcccagaaaagactagagagaatagatgaccaggcaatatccaaagggataaaggacaagaagctccactggtgagcagtatcaatccacagaaagtatcatgtataccttgcaggatcaatttttaaaatctgtacccaggcacattgtagtaaaattgcagcatgctaagctcaaaaaggaagatcttaaaggcaagaaacagaaaaaaaagagacaaatcatctacaaagaaataattcggttgtcagccaacatctttgtacagcaacaaaacccagaaaactagaacagtatcttcaaagtgacaagagaatataactgagaaatgcatgtacagcaaaagtattttttaagaatggatgtgaaatcatcttcagataagcattatatatgaacctcatatggtgagcgcttatgcctaagctccttttggggcacccttccaggaatgcttttttgtgaggaaaaaaaagatttaagtatgaggttaacatttacttagctgtgtgacaaagagggtttttcgtgttccttgactctctgggaattcaggaaacaattgagttattggtggtttaaaatgtcagagagcaataatcgcaatgtgcttcccactctcaattacttcaagtattgtctgattctgaggctattcttgagaactaaaatgtttttctagtatatattgtgtagtttccacgtgttcagtatgactaatgcattagtcacaagttacaatatgagagacccaagaaaaaggcaaccttggtctctggaaggactttcttctcagtgtgtcccactccagccagctatcgccccttgttactgatacccaggtctcttgctggcaggagttgctccctgagtaagccaagcatctgttgcttcctgaagcctttacttcagtaaaagctccatcctccttcatgagcagatattcccccgtatttctctcctctgttcctgtaatctgttgtctaccagtgggaaaatgtgtgagcccagctgttagagaaaggagaaagggagagacaggaggaaaaattacataacattgatgcaacttgcacaaagatatttctgtactttttgtaacatggaaaagcaggaaccaacccaagtgtccaatgcgggaacacgctgaacaaatcttagcatataaaaagatgaaatattatattgccatgactgataataagcacaagagtatgtggacagtggctacatgggactacacaaaagtgtttaatgtcaaactggtgaacatagaacacagatttggttgtgttcaaggattacaactatgtaagaatcagggacttccctggtggctcagacggtaaagcgtctgtctacaatgcgggagatccgggtttaatccctgggtcgggaagatccccgggagaaggaaatggcaatccactccagtactattgcctggaaaatcccatggacagaggagcctgataggctacagtctgtggggtcgcaaagagccggacacgactgagcaacttcactttcactttcaagaatcatgcagatatagaactaagagttcaaagaggatacagagctttgtaacttagcggtaaatatctttacttaagcattagtatttactgtgcaagtgtttttatgtttttgtttcttccgtgcttcttaaaggaggttacatttttattttaaagggtggactaaaaaatacattgaatgtattaatactagagtccaaacaggagacagaaatcacacagcgacttctacaaagaaagtttaccataaaggattattgaaagggaattg

SEQ ID NO: 53156 - DNA, 1182 bp, Bovine  19866880121288
ctgctgctaagtcgcatcagtcgtgtccgactctgtgcgaccccagtagacggcagcccaccaggctcccccgtccctgggattctccaggcaagaacactggagtgggttgccatttccttctccaatgcatgaaagtgaaaagtgaaagtgaagtcgctcagtcgtgtccgactctagcgaccccatggactgcagcctaccaggctcctctgtccatggagctttccaggcaagagtactggagtggggtgccattgccttctccgcattcatttactagaagcaagcaaagaggtggtggtttgcggtactacttgttcactgaaaaatgtgtgcgaagatttctgaacggtgaaggacgtttaggctcttcactgccctgggttgttaacaaacgaagtcttgaaggcacctcatttgccctcccctcacccacaaccacccagcccgagctgtgactgcctcccctccccccttcctccgtcgaagcctgtatcccgcctcactatttttgcttcacttgttgctcatcactgtgggaggaaactgggccttcaattagtgcgcattcctgaagcccgcggttgccgtggttacccgggccggagccgggcagctgggtcagctcgcctggcgcattgtagtcggtgcacccgggcggcggtaaacgcgctaagctggtgcgcgtgagggcggggacggggccggcggacgggaggcactgggggcccgcgggacagtgggcgtcgccgaaaatcggctcagctctggaaaaaaagaatggcagcccttgaaagccggtcaggagacagtgacggcatttttctccagagccagctgctgctattcgagtctgccggttttcgttcacagggggatagtgcctctgagttcgctctgggaaatgccccatgctcaagcccctcgcactgagagggggctgaccatggaggaaagggcagagctctgaccatctaaggcctatcaagctgtgtgccccttgcggtcagcctcggacctcctgggcttttttggttaaggaaactagccattttgatacctttgcatctgtggtatctgtgctggcctgatggatggagcacagtgagctcaggaaatcacactgggcaccaagaaactcaatttccttcttccaataaatcccaccctcctctatgt

SEQ ID NO: 53157 - DNA, 1066 bp, Bovine  19866880381026
tctttgccgccccatgaatcgcagcatgctaggcctccctgtccatcaacaactcctggagtttacccaaactcatgtgcatcaagtcagtgatgccatccaaccatctcatcctctgtcgtccccttctcctcctgcccccaatccctcccagcatcagggtcttttccaatgagtcaacgcatgaggtggccaaagtattggagtttcagcttcagcatccctccttccaaggaacacccaggaccgatctcctttaggatggactggttggatctccttgcaatccaagggactctcaagagtcttctccaacaccacagttcaaaaatcttaggggttcacaaatacaacattttacttctcactcttattacacgtaagctgtgattagttgtggcggtgctctgtgtatctcctttattctgggatctaggctgaaggagcagcccctacctggataccgcagcacctttcccaaggcagaggagaaaaaacagcaatggaagagttatgagatggctcttaaaactttactcagtcacagcatacatcacttcccctgagagcacatttggccaaagaatgtcacaaaccaagcctgggtcagtggtttgggaaagtgtcatctcacagggaggttggttcagtgactaactggaaatgtatgatagcaatcctcaacagtatttgattgtattcctcccctactgagatattttggaatgaagtaggagtgagaatctgagagctttggatgacagctacaaggcttcatgtctgacagcaaagttccacatggacataaaacaaagagacagcagtaacaacgacaaagccccaggaatgcctgactctaggaaacagggcttttacatccccctcttaagaaacgttcagctgaactcgacagaagctaacagaggaggaagaatgggttggatccctttgctcctgtctttatttacagcaaaggacagaacactttgtcaccttggaaaccaccaacaaaggcagtgtgtaaagctataagaaatccctgtcggctctcaaagaggtggctggg

SEQ ID NO: 53158 - DNA, 1864 bp, Bovine  19866880498704
ccattgttctttgcatttcttcaagcttcttttactgcttaaggtcaaactttgtagtagatgttaaaagtgctcagcacaaagggaaaaaaaggcgagaaaaaatgactactatgtgtagtgatgaacgttttaactaaacttgtgattattttgcagggtatgcatatatcaaatctttatatggtatacacctaaaactaatacagagttataagtcaattattgatcaataattaattttagaaataaaaattttaaaaatcaggatttataactaaataaactctttagggtttgtggaatgctagaatcacacattcttaacagccaagaaaacaaaatgttattgctatgagtaggtttattttatatatgtcttttaggtgagtgaaacagaaatggatgttgcaaagaattcgttattcattcgacaccctgagatgaaaacctggccatccagccataattggttcttcgctaagttgaatataaccaatatctgggtcctggactactttggtggaccgaaaatagtgacacctgcagaatattataacgccacatctcagtaagcatttacacaccttccatctttctaatattgcagcccttatcagtggtcctcaatcttctaaagcaaaggggtcttaaccatttcctgtaccatggatcattttggcaagctggtaaggcctacgactcccctaggaatagtatttttaatacgtaaagtacataagattacaaaagaaaccaactatatggaaatacatttataaaaatattttataaaatgtggggtatataaaatataggatatatagtaatatgttggctttttaatgaatacattaaatagtaagttccagtagagagtccataacctttctgtactttcagagtagtaagaactgaatattttaagacatcagcagcaacagtgccgtgatatgaaagtatctgtaatttctatatttcttttagtggccatcacaggtacactgtgaccacttagtttattgcctacattcatcattaaagagaataatacgtttcagttagaacttaatgagaatgaaaacctctttccatcccagtttttccccatcacagacaccctgaactctatctacaagctaggacatcaggtggagactatatattttttttttgcctgcgccccatggcttgcagtatcttagttcccttatcagggtttgaacctgggccacaacagagaaagagctgagtcctaaccactgggaaaccaagaattcccaagaccctatcttaggtctgtgcttgtggagcctagttctgacccatgatggcattttctcatgagagtcagacccgggtaatttacccaacatgaaggattcacatgcagtctgagcatgtgacccagatcctcaggccctggtcctgttgtgcctgtgggagtgtgtggtatatcctgccaggaaatggacatttggagggaaggagcaatcagagagaatgaaagagaagaacataacctgaagatgggaaagggtgggaaagaagggtgtgatcaagttttttgaaattaggttagggttcaaatgaaggaatagaagggactggtacttttcccaggcagcacgggtcacgctggcctgtcgggcagcctcaaggcctcgcggatggtgatgacagtaaccagcagcaataacagcggtagcagtggcgtctggtgggcattgttggctggtgctaactggcggcttcccatgtctgaactcactcaactctcaccgcagtcctatgagttaggtagtcattttttcttttcttttttttttctggatgaagagctgatgcacagaaaagtcagaaa

SEQ ID NO: 53159 - DNA, 1549 bp, Bovine  19866880511055
cagctgagtggttcaaacaacagggtttactttgggtgttcctgtttcttaatcccttactcattaaggccagccaactgtatgtatctgtttcattgtttaaacatgaagggatattttttttttttttaacatgaagggatattaatgcttcctggaatctaaagaacattatatgcagtaattagttcatgtttcaaattgtttcacatttatcagtatcattattttgaaatagactccttcaaagagtcagagaaaactatatgtcaaaaatacaaagcttacaacttgtcttcttactcatttactcccctcagaaagtgggaagttccctgccctgtgggacttacttattcagaagtgtttgttgagctttcactggatacagttccctgttgggtattatctgagaagagaaagaagttagaggctttttcatgccctacaggaggatctatttgtttgaaagggtctctggagtagacagaaacattcttaacaatgcatatttctgataatgtatttgtccatggcttactaatggatctgatagatcactaatcctgaaaggaaagattctggagttcatatctaatactgactcttcaaatacattgggtgaccccctcagcttatagtgtctgagatctctagagaaccaaagacagaagaatattctttagatggtccttgcattcacatgttattgccatcatggccaaatgactttacaatagtaaaggtggttgaagatttaattcacatcctcatttccaataaaacttttgtggctaggatcagttcaaaatttttttaatttgttttttaatttctataaaacaacttaacaaaactaacaatgttaataggcattttcagtgtggtaaagaatgataagtaatccctagttttagcttcatgttactattaacagtagttagatccccttcatagatcacaacctttttgtggcaaagggctttgcataactcaatgaggctatgagtcatgttatgcagggccactcaagatggacgggtcatagtgaagagttctaacaaaccatggtccactggagaaggaaatggcaacccactccagtattcttgcctggagaaccccatggacattatgaaaagacaaatatatatgacagcaaaagatgagctccccatgtcagaaggtgtccaatatgctactggggaagaacagagggcaattaccaatagctccaggaagaatgaagtggctgggccaaagtggaaacaacactcagttgtgaatgtgtctggtggtgaaagtaaagttcagtgctgtaaagaacagtattgcataggaacaatatttcataggaatgttagatccatgaatcaaggtaattggatatggtcaagcaggagacggcaagattgaacgttaacatcttaggaatcagtgaactaaaatagacaggaatgggagaatttaattcagaagaccattatatctactattgtgggcaagaatcccttagaagaaaggagtagctctcaagtcaacaaaagag

SEQ ID NO: 53160 - DNA, 2563 bp, Bovine  19866880514150
tgatcacggagggaggagggttcgggatggggaacacatgtatacctgtggcggattcattttgatatttggcaaaactaatacaattatgtaaagtttaaaaataaaataaaagtagaaaaaaaaaaaagtgatcacacattggtatgtatatacaatggactattactcaaccataaaaaagaatgaaatattaccatttacaacaacatggatggacctagagaatattatatttagtaaataagccaaacaaagacaactactgtatgataccacttatatgtggaatccaaaaaataatacaaatgaatctgtattcatttagaaacagaaacacagacatagaaaaaaaaaaaaaaacttacagttaccaaaaatgggagagggagggagggacgtattaggagtatgagtttaataaatacaaaaaatacaaattactactatacatagataagcaacaaagacctgctgtatcgtacagagaattatattcaacatcttgtaatactctgtagtgaaatacaatctgaaaaaatgtatttataactgaatcactttgctatatccctgaaaccaacaaaatattgtaaatccattatactttgattttttttaaatgaccacctttttatacattaaaaaaattgagctattaattttaacttacatgctttgtgctgcggtttccctttggaggttttgacttttgagtcacagaatcataaactgtgagagctgtaaggaatcatagagatcccctaaactgtggttctcactgtagatgtgaacaaaattcaggtctttcgcaaagacaaacctgtaactcccagctttgaacagtctgatttcgttgttctacatatggcctcagcatctgtaatcttactgagtcccacaggtgagagaacctgtggtctgttcccttcgtagaacacagagtggaaagaaactcagagatgtctctgacatgctcagggtcattaaactattaaatgaccgaatcttgtttaaactttaattagtttaaaagtgtttcattgtttggtttgaggggaaggagaggaataccagtgaaataaaatgagaggtcatttgcaagataaacatttaacagtcaataatttccatgttttcttcctttcatccttagagttaataaataaaagagcaagcaaaaccaaaacaggagaacagaactctcataaaagcagaagaggtagagcttagagtaaagagaggagtagtagactgccttgtcagaaacaaatcaaagactagcagtgacaatataatgaaccatcctgggacagagaatgccagtaagagcagtggaaagatccatggtagtgaacatattttaatataagttataataacctttcatacttgcttttagcctaaagtattttggttgattgttattgttaatatgtatattatgtgcatgaatcatacccagctaatttgatttatgtgttttcttctttcttacagagaacctctcatctgattcagctctctccagcccaagtgccctgaattctccagggatggggattgagggcttgaaccgtaggaggaagaaacgcaccagcatagagaccaacattcgtgtggccttagagaagagtttcttggaggttggtgaggttttaacttttcatatacatgggattgtctgtgtaatactaacgttatgtacaggggaaacacaagtagtttggtttggctaaattctagtgtttggaaccagaactcttggcttcctcacattgtccaaatgagattatgtgtatgaagcactggaaaaattcttaaattcccactaataaataaggcattcgtttcattcatgattaattttccttaaaaaaaaaatatatatatatataagaataacattctaagttaatatgactacatttaataaatgcttattagaatatagaagttttttgttagaagtggagtaatatggccctgtatagcccaacttcattctcttgtttctcctcccgtttgcttattcatttaatgacatggttatgcctgtagttcagaaagtttttccaacagatgattttattattttccccttcagaatcaaaagcctacctcggaagaaatcaccatgattgctgatcaacttaacatggaaaaggaggtaatacgtgtttggttttgtaaccgccgccagaaggaaaaaagaatcaacccccccagcagtggtgggaccagcagctcgcctatcaaagcagttttccccagcccagcctcactggtaaggatgggatgcaagggcacgtgctcgagggctaatgtttacattatgagtgacctatcaaatgaatttatatcattataggaatctattatatatattcatgttgaataaaggtatatacatttatattttaaatgttaccgaagtaatgaaatctcttgttgttaacccaagaacttaactgatctttttttttaaacagttttaatcctttcctatttcattgcagtttcattattctctgattattctcttctctgctaggtttcttag

SEQ ID NO: 53161 - DNA, 1101 bp, Bovine  19866880536554
gagtcagtttgcagctaatatcagttatctaaaaaatctttaggtgctctttattcattttgggttctaaggctcaatttattaaacttttacttagatgattaagtgatacaatacaatccaataaattcccagataacctttagctctgagttcgtattgatgtggcccttttatttataaccttattgagtaaccactgccgttaacattaaaatagtattcctagactgaagggacatatagttgtcatgtgactcacttgatctttagaacaattgtgaatgtgatgccatgtttccaaccaggattccaaagatgggaatattgttgagtttgcatttctgatactttcttgttaatttatttctaatttaatattactccatgccaaggagacttttcaaactaatcattaatagcacttcctagtttaagtgaaagctttgattgttaactggtaagactttaatcataaagttcatgagatagtagttatgaaaatgatagtattaggtaattttgttttatgtacatgacttttgtgttttcaatttattggtactagaaggaggaagggaggaaggatagaaggaaggcaatatttgctactttagtgtatcaatatgtaatttcaaaaaaagaaactgtccattttaagatatttgttttatattctttccataatgagatttcattaaaaacaaaatcaagacagtcttgcccccacatagctgaaaatagaagtaatgtacaagaactccaaattctatgatccccttgaatagttttcttgtttagatcacttataatggtgtagtattttttaatgctttagagtatatcttattcaacataattgaaatatgggagtttttaagttaatttctcattaaaacttggacaaagccgtttgtaatattagtgaaaaaccatctagtaaaagcagcctttcaacataagccagttttctcaattccaaggtcagagagtaattaataaaatcatttcattttggacagtttaattttattctgttgtatctggaatttttaaaacgtttgtaggaaaaataaatctacagtatggacttaaaatttt

SEQ ID NO: 53162 - DNA, 2085 bp, Bovine  19866880536701
gatgatgacggggattcaattttaagttaaacacccatcaacaagctgttttagtgtttcatgtatacatttcacaacttgtttcttaaataagagaataaaagaaaaattctaagagttacctttgtctaaaggatatatttcttctttcgaacacaggtttttatgctggttttaagtttatcctcacaaagtgatccacactcatacccacacaaaggcagaatccctttatcccaaactgattagagactacagacagggcagggaatagaagaccattgtactgacacttaaagcttagtatctttttcttaatatgaaagtctattggtgatcttatttcagagagggagtatttctgagccacacggggaaacaaacacacacggcctttccttgctcctcctcctaatccactgggcttgagtcccttgggactcaacacttcctttggtagcgatttgggaaatgaatgctacaacctctaacccagtctggtgggtatcagcattttcctccctgaatccttcctcctaacctaccactcccaagggagggaccatccctgtgggcagctacagtataactgacagccctaaaatcatctgcacagactaaaattagagacgtcaactcaggaaaaggttaaattcaactacatcagagaaacagagggatgaagaggagaacaattagtaactgacactgccattctatttacacaccaaactacataaactacttaaaaaatcaagttaatgtctgcccagaggatattacaatttaccaacataaaagattaaaacaagcagcaacttttatataaaattaataaagacaaatgaaaaaaagaaattgtcagtagcatctatctcctcaatgtgtctgaactgcacgatataaactagtccattagtacagcagcttgctaaaaattgactttggttcaagcttagttaaaaaaaaaacaacattaaaaaaacataccacacataataacggtggatggacatttgttatcgtttccctgcttgcagttcactgattttagagggattttaggaaggtgaagggtactttgtgaaataaaatgggaagacaaaagaaacagaagaaaaattaacaagggaactaaaacgtttctggccttttaatattaatatgcctgtctccaacttgaatgatcacaaacaaaaacacacactgtgtctgtatcactgcctttcccaacactgagacaaatacacagaattcaagctccctcgtggacacaagcagagcaagaagaagaaaaatcacctgtaagctctctctcagccccaagcttggaaggggaaaaaagtgcagtcatggaaccactggagatgtacacaagcacccacagatgccaggcgggaacctttaattccaataagaagggagctcaaatgagctgcattgcagcgatccagtctttgggaatttttttggatacagatactataataacagaacactgacaaaaagggaaatccaatctccaggttacccttcctggagaagggaaaccttcattcctattcatctccttccataaacatttccttttcatgggctcattgacatcgtctagaaacaccctgaaaacaattatagaagctaactgccttctacaatgaataaagagatgtgtattgccatttagacctacctagcaggagcatcactaacaaaccaagaagacacgtgaggtgtgtacaaagttcctgctcaaagtctttcaaaggttcaacagatcccatatctggctaattagtgccttctccagtcagagaaccaaggagagtatcagggttagaggaaccgataagccatctactgaaaaggaagtctgtggctggaggaaaacgtggtaacctcacactcttctcatcacacctctttgggtgatccaaaccaatgaaaaacagtctagtagagttccttcaataaacaaaagaagggaaaaggttcccagtttcattttcttctttgccaagtaagttaaaggaagtttggatgaaaaacttccacaaagtggaaaaaacaaaacaaacacacccg

SEQ ID NO: 53163 - DNA, 2438 bp, Bovine  19866880666254
ccttgaagcaaacctcccttcttctttctttttccatcctcgctttctctccctcctcttcagatctcatgaaactctgggtgaatttcctcttggctccaaattcagaaaagtctgacttggatgactcttccacatcttcccagtccctggatctggccccatttggacgccgtggttctggggactcttctccttcagagggctcgggggtccggcggaaaaagtagggctctgggctttcctcccgggagcttgaggtctcactaaacatggacctggagaatgtgtgcatctctctgccttccctggtggaggaagcagagaaccgtgaagtgctttttaccgagttgctattggtctcgtcgtaggaggaggtgtcctgctcctctgaccgggatttggagaacttgtaactggaagacttagactctgtctcccgaatcagggaagatctggtgcacttttccctggagcttccagaccaatcactttggggagatttttcctctgtcctgaggccactgagccacttattaatactgttatccttctctctgccagctctgctgccacttccgtagccatcagagacagccagggaggagaaggtgtctgtttcgggtttctgggaattactgcgggaagaataccggaagctccctatggcgctgtcagtgtcctcatccctaccacccacgtcatcatcctcatcctcatcttccttgaccttcttcttcttgaaaagggagctgcgtttgttgtcggaggccagcttctccattttgtactcggacatcttctctctcagctctgtttgcatctccttctccttccggccaagctcctttaggtcaatattgtcagcaaagaggctatagataggcttgctggtccccttcactttgctcccagtaccttcagctcttgcactcatggtatgggaggacaacacagactgggtctcagagctgggtcttgcctggctttgaggcagcaggcagccacccagggcagagctgctctgtccactgagcatggagacttggtcatcccctaggcagctgcctgctggtgctgccttcatgcttacaacggacagtgggcggggcgacaacagcatttcattttgcttctgggcgagagtttcactgactacgttggcaatccagttctgtatgctggcaatggagattgtgtctccaggccccacatgcaggttaggtagaggtgtggtgggggtggaagccaagcatccgcctactttgcttagggcctgagagggatgggagctgtggctctgggcgctgagcacagatgctgtgtccccatcagcgctgactgagggggctgccgaccagaatgcagacagggggatgctcccactggcagctgagctatctgcctcccagcttcccattgactggctctcctccagtgtctgcctgcttctctccagcagctccagcctccgctgccgcttcttgaccaaggctaagtcatctcccttgctgagctccaccacctcctccttgttctcactgcccaccttcttttggtgtttcagcttccaggcctggtaggcagacagattgacatcagagaggtttttcttctccccctccacctcctccgcaccttgctcactgctgccatctcctgcctctgagtccttcttgtgaaatccaaactggattctcttgatcttccacctttccagggcggtgagtttgtccttgtttctgctgcagaagttatagaaggagctggcctcggaggccacactctcctcgtcatcctcccgcgccctgctccccacctccgagctggtgtccacctcctctctcttgttcctggagtggtactttcgggaagcctccttctcaatctcctgcagcctctggtcccacatgtcccaggtgctctccgtggacatggagtcagagcggcgtctcccacctcggttctggctgctcatctgcagctgctgcttcaggacccggatgtcatggctgctcacactctcggaggtgctgctctcactcagcgtgtgcctccttcttctcctcacgaaggagctgccattgctctcctcttcctcttcctcctccctattccacctccggtgcccttctgcctggtacctctcatttcggctttgccactcccggatgattcgctccacatcctcatcctcgggctcctcaccttgacgagaggaggctgagaacctgtcgtcctcgccctgcaggaccttgcccgtggggaggctctgcccctttttccacgcctcgtagagcctctcctcctcctcctcatcgataagggtgaggggcttggaggcctggctggccctccccaaggaggaggtactcaggtgactggcagcgtcgtcctcctcctccacggtgaagggtgtgcactctggctgccaccgt

SEQ ID NO: 53164 - DNA, 925 bp, Bovine  19866880752539
tggtgcaatggtgaagaatctgcctgctaatgcaggagatgcacgatacgtgggtttgatgctttaaattgggaagatcccctgaagtaggaaatggcaacccactccagtattcttgcctggaaaattccatgaacagaggaacctggcggactacggtcgacagggttgcaaaaggtggacacaactgtcatgtcagggctggcaggggaggtgggaggtgagaagaggttggaagtgaagtgacggttgctccttgtgaccccacagactgcagcctacgaagctcctctgtccatagaattctccaggcaagaatactggagtgagtggccattcccttcttcccgacctagggagtgaacccagatttcctgtattgcaggcaaatgctttaccattgtgccaaatgggttgccctgggaagagaggagggctccgtaacctcggtttttcctgcttgggagcagggtagtgagggtggaaagatcacccatttccctcgtgtgagcccagcgacgtgtgttcactgtgtaattcgcttgacttaattgaaggaaagcagatctgagacagccctgctgggtttctaagaggctgacttggaggaatctttacattaaaccgattgatagtctctctgtgtctgtgagaggtgttttggcttcatgtcagagctcccatcagatgggcttgtactgtgagaggtttgaaaaatggttcagatgaaaaagttgattctgttcaataataaatgatataaacatatattatttattaataaaaaataatgatgttttgtatttatagagcatctttcaagtgtggaaactctaagttctttgtggatattaacttacctttcacacaatagagaaaaaataattttgtcaattcagcatttttgaattttcttttttctttt

SEQ ID NO: 53165 - DNA, 2645 bp, Bovine  19866880814858
gacatttgagaggagacatatgggcataaaatggcctctcctcatctgtttggaaatgtgactagtggaataattatgttcatgaagttacacagtgtctaaaatccaaagattaactcatacttatgttctgttttctagcaaatagaactgtgcttggaacattcggggaggaaaatcttcaagaagattcctcgcagcctgaatgcacagggagaagcaggaaaaggccatggggcttgaaataacccaagtctggacagcagcctgagcatccggccctgggatagagcccaaccccatcccacaccatgaggagtccaaaaagttgagggacccttcatttcatcagagacgtgattagaaaagaaactgcttctgcctcacttcttgttttagaaattatgtttatagaacctgtaaataggtgtgaacaaacgtatttcctagagaagataccatttgttcaacaccaacaagaaactcatcatatgggcccaactccactggtattctttctttggagaaaacctcaagttaatgtttttccttctgcctctaaaaatgcttccatcagtagaacctgtcctcacacaggtcaagactgcagagaaggctttgtcgaaatggccatgtatgtacacgtgctacttacacatttccttttttggaaaaatgagatgctaataatgacaaaattcagacatactggcctagtgccagcagatggcttttctacaaactaggttagtatggaagatacagattaaaataaactatgctattttatttatcttcccaatctggttggcagctagacttttctagggtctcatttaatggccctatttttcattattattttatttaatgatagggtagcatttagtacacaagctcttctgtttctcaggctgcctgcagaagtcaccataaattatctgctgtctacatggtacaaagctcactgactcacctgatactgtttgattaattcctttaatatttttatcacaagggtggtaagagggcttgggcctttagccacagctgtttcaggacttctaaacttctatcccgcagaaataggtgggagatctttgaaattttacactatactaatttgcattcccacataagttgagtgttattaaaacattccatcaaaactacctgtgctacaaaaaaatatgccagaacctcatagacaaagccattgctagaaacgtcattccaatgtcagatctggataacaggctaccataaccacttttccttcctatagacccagctcacttgtataatattcttggcatcctgaaacacctatttctactcaggtactcattcctattattagtgacccatgttcctcattttttaaaaccagttttcctccaagaggggaactttaacttctggtgtctgattacttttcagtttgaattgtttcctcatttgcttttacctgcactgtgttctttatcatctcaaatggcatctaaatccagctacttttcattccagaagttttcattccctccaattccacttaatttatcctccactatcctggttcctggccctttcctctttacgtactgttttacttgttttgggagcttaaaggattttataagacctagtttttggttcctgcactggagccatagttgtcttgcagagaagagtagaaaatgggttcaactcccgtttcattccaccaacacctccttgagtctcatcatcagctgacagatgatgccttacaggttgcatagcactggaacttctagagtaatggctctactgtcagggttttctgggctcactcttccactgacttatgatctatgcctaacagagccccagtacaactattttgcagaatggctattaccctagagatactatagcacatactgagacacagttgtactccccagtagataggaactgagtctaacaataaactttgataataaagacaataggctccggtggtttattatctgctggcatttaaaaaaaagtcacatttcaaactctcatttacactttattctccactcagtttggtaccaatacattatacccttaaataaaaaagtctgttcatggggatgaccatgtaattactgttggtgtctatatgtgtggtttccaactggcttttaaaggtgggggaaagggccctagcgaaaatagctttttccctgtcatgtttggtgactgttctcaggaatggtatattaccagtcaatgaagaaaatccataaagggatactaaatttaaaagaatggaaacatgctagcaggttgatgaatagaaaacttggtcctattttgataaatatttttaaaaatgaaagtatgatgaatctatatgccttttaatattgtgtttttagtaattaccacgccagttgattcagttaaatattaggctacatgccaagaataatctagatatttttcctttattaagccatgagaactgaatgctgaaccaatctgttggccatagcatctaagtgactcacaaccattattcaaactggaggaatttctggtttaagtcaaagacacgatgaaacataggcatttttatagggtcaaagtgagcaatcatttagaaatcactt

SEQ ID NO: 53166 - DNA, 1185 bp, Bovine  19866880995403
acactttagttactctttaccttttaccaatacacacaagaccacttataaattctctaaaggaataaagaaatgtgagaatgtaagaagggtattatttaccaggattggccacacttaaggagtgctaaagattagtaagtttttaacaaagtcaaaacacatttaattaaaaaagaaacaaaaacaaaaaacagccaaaaggaatagcaaggactctgattaactatattctttgctgtcctaggctaaatttatctttatttttaaaacaagcatatttaagtgtctagctataaacactcgaattcaaaaagtacgtctaataacatatgaaatggtagaaatcaagagaccagatttttgtttaaaaaaaaaaacaaaacccagtattacttcaacaaatgcatattacctgatcttttacaactttagtgccatcatgtttgaacaccatagtcaattactttgaaatgcagaattaaaatgaagacaagtttactgataaacataatgtagaattttaagtgcccaaatttatataagcaaaacactgtaggattactctaccttgatcactttttagagacaagcctgacagatccgggggtgaaacattctgctttggtacaagcatgcctggcttcctcaatggggtgcaaacaggtttctaaagagaaaggtaatcattgaccacatatttaaactcttgcccactttataacatatacttaaatttagcaaaataactttgaaacaacccatagattactttaataaccactccaagccagtaaacccaatgagtacataaataatgcttataacacctacacccaaaggcacaggatggcaaaatctaaaaatattttgaatcaaggggctaggtggtaaataaccaatccaattattgttgaaagccatttccccactactgataatctaatcctatggagtcacataacgcatgcttgtccagcggccaaaagaatatcatttgccgaagtactccaatactgttttttcctcactcaaagtaaaaaccagattgtgttgacttcaagtctcaatgatacatatgtagaacatgacttttattttgaagggaaataagaaactgtagtgaaaagaagacaaaaaaaaaatcggggctcacaaatataattaagtattaatacgaattca

SEQ ID NO: 53167 - DNA, 1289 bp, Bovine  19866881002626
acaaataatggggctcttttccagtgcctatcttttaaaagtggtgtgataggtgtggttcttcttccacaccagtcccctaaagtattttgaagaattttgacaatagggatcaggaattgagtttctgttctttccttatagtattcccttttcttccctatcttcccagtgctaaatgtatagtaggaattcagtcaaaggcctttaatttaaatgaattcaaatgattctccccacccacctcaagcaacaaaatagagattcatgtcctagaataaatcatcatttttattatttcttatgaacaagctatttcccacagaacagcattgtaagtattaattttagaattagtggaaaccataagtaaagatcaattttttaaagtgataattcctcagaaatgtatgtcttcaggtcatagaagattacctataagcaattggtcttggacaaacataagtttgtcttgaagttttaaagagctcttttgccctgtgagaatgacttaatatgaataaaatagattcctctgggtggattgaaaataggtacatctctactatggaattctaataatctttttattcacttaaaaaattacatacaataaaattatcagtattcttttgaacttgctactttctcaaaattcagttatcccaataactttcaaagtcttaagtttaatgaatttacaaagcctcttctttcaatacatttcctaacactttctttttatatgtcttattttgaaataatagtctgtggactactttataaaacagagttttatttctattggttgtctcaagtcactttgcataatggcggttgtataatgaatgggggcaagagtgataggcagtggtatcataaatcactagcttgttgaagctcaggtcctttaaagcatgcaagagagaaccaccaattatccatctctcaagctggataaaagctacacaaacacactggatggaaacagacaacaaccaaatcagtatggctttgttaactgctctggtgttaaattagctctctctctctttttttaaagattttactatacttagccctctctccctactcaagataaggtgaagcacgtccttgttaatagtgcatgtgtggatcttaacttgactgtgtctatattacagtcagtggctcaaatcatcaagcccactgccagcacactggcatggtctagctctctatcctcttcttgccctgttaacagctgaagaactcagactatccacgacaacagtatccaaattcat

SEQ ID NO: 53168 - DNA, 1047 bp, Bovine  19866881098909
ctgtggcaaggcagctccggtgctgggcatgaggagccaaaagctggggggcaggatgggtctgaggctgcagtgatccgagaacatctctgtctgcccttctaggttatcttgcctcatctctctctgtgcctattgaacacccctttcccacatgtattaagcaagggaacgcttggggcaccatgtgcagaagtaatcagtcaaggctctttgaagaggattctctagaccccttaatgaaccctgttgacatttctctgcccttctcatatattttatcttgtaacctctaaaagaccccacccatcatctctctcatttttgatcatttgttttgtgaaaagtcaaatgccaattatgttatactgttggatttgattctcataattctaaaaggcaggtactattaatgtcctcccagttttagctggggaaactgaaacttaaaaaattctaagggacttacacagggtcatgtggccagtgaatgtgaagggacaagatgtgtgtttggtttggtatggccaatgccccaatagcaccttccccactcacctatcctttatattgaaggacagtagctattgctcttctctcaaagaaccaactgcggggtccctctggcctgttgccccacgaggtaacttgcccttcactctgaggaaggaaaaggcctctctgtttctcaccaaataatacagggctccgtgggccacagctgtttggacagcaggccacatcgcccatgccggcttcgagggtgtgagaagtgagtcaggaggctgtcaaccagaggtcatatcataatggccaaaagaaggcccacgtgtgtttcagcaccgtgtagatcacaaagaggtttttttcacacaacccgttaatccttaacgctaactcaccagatgggacggacgccttgacttggctgtgattctgaggcgtgagaggtgcctggggtgatacatccagccaggagcagagccgtgtcgggccgcgcagtctcctgagcgaggccccagccgcgatggggtccttagatcccag

SEQ ID NO: 53169 - DNA, 700 bp, Bovine  19866881168034
ataagtttctcctaggtgatattctatttcttatgctgcactggaggaaatactcattatattttgaagacaaaccgaattcaatttattttactcttgtcccaaaggagattattacttctccttaataagatttattattattagaaaacaactcaccctgttacaatgagaaagcttaggatgatcaggcagacatttatgatgtagcttcccattttcccaatgattagatcttgacatcacccagtacattcttgtcttacaataacacttaccactttgagccagactctaaatgctctataattctcacctgtgcttgactttccttaacacgatattgtatttttactttcaaaatcaacacaatttcaaggattataagaaagttgaaaatagaatgtcatcctttcgttataacctgagcttctggtaagattagagagggggtctgtacacatgctttgttaattaactttgatgctcttgaagcactggtaacaatcctaacacacatgatttctcataattgccttccaccccttgcctgtaaaggcttgttatgtagaacagaattattttgtgggtgaataagatgtgtgtcacgacgtgctgtgagttcctaagaatagaaactcctatgactaaactccccatgaacacagcaaattagagaaaataacaaatgcttttatcc

SEQ ID NO: 53170 - DNA, 2728 bp, Bovine  19866881191090
tctgactgtttgcgaccccatggactgcagcacaccaggcttccctgtccatcaccaactcccggagcttactcaaattcacgtccatcgcgtcggtgatgccatccaaccatctcgtcctctgtcatccccttcttctcccaccttctatctttcccagcatcagggtcttttccaacgagttggttcttcgcatcaggtggccaaagtattggagtttcagcttcagcatcagtccttccaatgaatactcgggactgatttcctgaaggattgactggttgactctccttgcagtccaacggactctcaagagtcttctccaacaccacagttcaaaagcatcaattctaccttgagtcctgaaaagttagcacctgagacgctcctttagatgtgtgccactagatggcgtatcaggctaactcgctccccttctctgagcaacttgctagctccctcttcacctcctgccatatttggtgagtcacctcaggccacctgataaacactcaggaaatacttaagaccaattcagcagaaaatataactcacctagatggtatgatgagtattattaggatgcctctgccaagatttttttcagagcctgaaatcagcctactttctttgtttcttggattgaatgtatttaaaaatctgactttggggtctttcctggtggctcaccggaaaagaatccacctgccaaggcaggagacaggagtttaatccctgatccgggaagatcccacatgccacagagcaaccaggcccatgtgccacagctattgggcctgtgctctagagcccgggagccacggctactgagaccatgtgccacgactactgaagcctgtgcaccccagagaccgtgttcaacaacaggagaagccatggcaacgagaagcccgtgcaccgcaagtatagagcagctcctgcccaccacaactagagaaaagtccacaaagcaatgaagatccagcacaaccaaaaataaataaattactaaagatttttttaaaaatatgactcttacatgaagcaaatggaaatcagtagggttaaaacattaaatagttgatttttcccccacaactgcctaattctaaccctatgggtcaagcccttccttgcttcatgaatgaaatctagatccatactttctttggtcactgttgaataatacatggcattctattcaccttcaactcacccaaatagttttagttctgtaattcaaatgatgattcttttataatgatcaaactgcacaatttgtaaaattagacttcttgctctcccctattgtaggatcactttactctagaagtttgcattagagagaaatgcatatactgtctagattttcccacttagcacttccattccttcttccctcaatcacttattctttttggatcctccagggctgctgtgtgtatgtatatagatgtggagttactatggagagaacaggacaggtaagcagtaggagcaagaaatgtttttcttgactggcatcaatataatgtgacattttaccaaacatgaattcacaatcaaaaactacaaaacatataaggagataagaaaccacaagtgagaatgagcagacccataaagacttcagatattggaattactggggataaagtataaaattagtacatttaatatatccaaagaaataagaggaaattgtatagcagtaagagcaagacactattgccagtgaccatactgatttgaaaaagaactaaattgaatttttaaaaatgaataccttacagatatttattaattaaaattaaaactcaaaggaaagagattagaggaaactaaagagaaaaatagtgaaatggaagataaactggaaggaattacccagaagagagcacagaatgatgaagatgaaaaatacaaaagatggctttaaacagtatgtaggacagaatgaaaaggtctaatatacattcaatcagaattctcaaaagagagctaaaggggagaagaaatagttgacatattaatgcctgagagtttttcataattaatgaaaaatccacagattcaggaagcacaacacattctaatgtgaataagtaaaaagaaatccataaccagtcacatgttgattaggccaaaaaacactagaaacagaaaatcttaaaaatagccagagagacaagactgattatttatgaaaaaaggataattagattggtaactgccttctcaaatcaacaacaaaagcagaaggcagtagaataatatcttcagtgcactgagagaaaataactattgatttaaaattgtatacttagtgaaattatctttcaagaacaagaatgaagtaaggattttgttttaaacacaaattgacagaatatcccaccaatagaccattactaaagaaaactttatttagaaaggagaagactcttacactatagttgggaatgtaaattgtcacagccactatggagaacagtatggaggctccttcaaaaaataaaagtggaactatcatatgacccagaaatgccactcctaagtatatacctggagaaaaccataattcagcaagatgcatgcaccccaatattcattgcagcaccatttccaatagccaagacacagaagcagttaaatgtccataaacagaggaatggataaagatgtagtacctatatacaatggaatactattcagtcagaggaaagaa

SEQ ID NO: 53171 - DNA, 1018 bp, Bovine  19866881254994
tttatctccttcccagctttaagccctgttgccacacctgaccccagggtgtgactcacacctggagcctggggagggcctgctggtgcctgagcacaagtcagaagccagtgctcacagggagggctcgtgtgcctggggaattacactttctgcctgtcagaaatgaaatcagattaaaatgccccagtcccagctccagccttgaagtgggaagaatgcaatgaatggtcaccctaagtgtggtatgtgtgcaatgagtgatggtttagggcagtagctgcaacccaggcagcccatcagtatcccctggggagtaaaagtacacatgtccaggcccccccagaccctctgaatcagactcttgagaggcagaatctggccatctctctgattatgaaaatttacccaagtgattctgatgtgaaaacctcagttcagagttgcctactggaccttgagggaaaataggtttaatgaatagttgtctccgtgactggggctgatactctgcgtgtgatttgcagctcaattttgcagcatctggctgcttccctgagttagtgtccagcctccaaattgatgtcttaactcacactttcatatgcatagaagtcgtcttgagatcttgtcaaaacacagactgattcagtaggtctagggaagggcatggaaatctgaatttctaacaaactcccaagtgatgttgctgctcctccagggactacagtttgaaaaacaaggcctccagggaagaactggttcatgggcacaggtgtgatcctcatcttgccctcatctttgccctctagggccccatcccagggtcttggtaaccagtagcactgcttactgtgatgctggctagcagggaggaagcctgggggaaagtattcccggcaaggtctaaccttgataatccctccctccttcctaacatactctagtccgtcggtcccccaagatacacccattcctggttctcctcggcattcctgggctaaccctttcacatctc

SEQ ID NO: 53172 - DNA, 1073 bp, Bovine  19866881337250
ttttaggtagtcttgagaagaaaaaaatgagtgtaagatttatattgagtaggattacaaattctggtcttcccagaatggctcaggtgaagaatccgctggccagtgcaggaactgaaggagactggggctccatctctgggtggtgaagatacccgtgaggaggaaatggcaacccgctcgggtgttcctgccattcctgccgggataacccgatggacagaggagccagttgggctgcagtccagggagtcgcaaagagtaggacacgactgagcacgcaggcacaatttcttcactgaggaaaaaaactgatctctaggagatagccagccattgtttaatacctaaagttttaatcattgttcttagcctgctcgttgaatttcttacactgtgcaagtacagttaaagctattgtcaatgtcagccaatgaattccaggtggtattgatttattcatggcaattaatgcctagggtgtacgcatgactgtttaagccaaataatcgggctgccctgtaatctaattatttcagacaatggccaaccaacacacagttaaggaaatgcaaaattcaatcatgttacagttaatctgtaaatatagcatattcaccagcattgctattaataggaagtctcagaatcttcaatctatgtgaaactgaaagttgctcatcagtcagactctttgagacccggtagactgtacagtccgtggaattctctgggccaggatactggagtgggtagcctttcacttcaggggatcttcccaaaccagggatcgaacccaggtctcccacgttgcaagtggattgtttatcagctgagccacaagggacaaagttaagtacatgactctgctttaagggcaacaaatttgaagtcatctccactaagaaaaagaaatcaaatacccttatttaaattcttatcttctatttaatctttgttttgctctttgttttaaaaagtaaattaatatgactttcaggaaggaactgaagccagtgcatctgctattcattattattttatttatataaaaggaaatttttatggaatga

SEQ ID NO: 53173 - DNA, 1328 bp, Bovine  19866881341271
acatattatgatctgttcctctgcttcccttccttgtcatttccccctaccccacaccgtgctagagacacagtcatgaggaagaccagaagtctctatcccagagaactgctaatctgactgaggaggaaaatagtatacaatcaaacaagacagccagaaataccatgaccaattcatccagtttgcttggagttgctccactgttaaaacagagggccctatgtcccaggaatgtctctgtcttagggaaactgagatggttggtcaccccacttaaagatcaccagtgctatggggagcatgacttggaaaaagacgtaggtaataaaactgtggccgtgggaggacccaccttggactgggtggtcagaacgcagtggaaaaattagtactttgattttctatgttacagataggtatctctgtctcaaagaagttaatgggttatctatggtcacacagccagcaagtagtcttctgattttcagtccactctgctagtgatcccgatgtcaccgtctgtcagttcgggatggtgactaaggttataaagaaaacagaggccctctgccatcctctcctcctgagtggtcccgtctatctgcagccactttttggtgtattcgctctcccttttctctctctcccctcccctccaccatctgcttccttatgctggcggtctgtccaccctgatgcccctcttcagccccctgcctgattcccaccccactctccgtccctccctccttcatctcacctctctctcatactacttttcatcttcacggagccttgaagtctggaggtacattgaacccccatggttactcagttgtggtccttcttccattcttcagcagccactcaccgagcccctattttgatgcccacgacagtggtttggcaactggtcagtggtgatgccatgtgcttctccagagatgccttcctgaaccactctatccaaagacgctcccatcccagctttgccaagtctctgcactcaaccttgttttctttcttcaaagctctaatcactatgtgaaattaatttttgctaccctaaaactttttccatgtcgtcccctctggaaatcctcccctcaccatatctgctgttgtaatgcaatatgtgctttaaagcccagttcacgtatttgttctttcgtgaagccattcctgacttcttcagtcagaagggctctctccctcatttgaactcacacagcactccggatctctcttaggatactaactaactacattctgccttgagcttgagctatatttggtctgtgtctcatccctcctaataaactatg

SEQ ID NO: 53174 - DNA, 680 bp, Bovine  19866881356799
cagagaattatgaaacagaacaagtgacaaattaaactgtacttgcaatgactttcaatatcacaggctgagtaaagctactaccaacactcacagtgagccaagttttgtgcttcacactgtcactctaaaaattaattattacgtatcctcttctggatgagtatctagtttcctgtatagtacttaaaaaaaaaaaaaaaaagaatctgataaacctagaggtttgctgattcttcttttgctgattgctacgtctgtctataaaatctagatagcactgaaaacttgagtacttgcttaactgggaaaaaaaatttaaaaacaaaagcattttatcagtcactaaatacaaataagatatcttatcaatgctcagtaaattaatatcccacagtaaaaactacgtgtattatacataaagaacttcctcaaatcagaggttctgaaactcaagacagttctcatattccaaattctaaacatactgtacatggatcagtaagtcaagcactggctccactcacgctatttttgtttccattgctattactgctaaaagagtttataagggctcattgccagtttagagcacagttagaagtattttcagtacaaaataaaatcaattaattcctaagaagaaatataaatctaaggtatccaactatctatacaaa

SEQ ID NO: 53175 - DNA, 889 bp, Bovine  19866881374571
agaggtatatgtgcttttcttcccgacgatggatgaactgtgtagaataaattggcaagataatctcactaaaaatcttttaattaatcttattttcccttttagaaaatgctaatttctaataatgctaccatgaagtacaaatcagtatggccctaaacaaaatcaaagttggatgcctttggttccgtttctctagtaataagttgggcaaactgggatggtattgatctttcttaacaaataaataaaagaaagtatgttttatatcaagtcataaatggataggaacaatttttttttttaattctaaaagactgcctatataacttcagaaacatttaaactaacatagcactcaacatatttcttaactcaagaacaataatactgttcttctgagaagcccttttctaggtctttctcctctgtcctttagatttatacagggtacaaagaaagtttataaccaaactgccctgcctgtgataagcaggattgaggcaattacattcatcactccccaggcagggcccattaccatgggcaaatatagtatcactataaatgcatttggaattagtctttggcttaatatgtgttaaccaaattcaggaataaaataaaacctggataaagattaaggggaaaacaaagaaggaccacaatgaactgtgatgacctacctggtcttttctcttagaagcgcagaaactctaccaaacatttctttttggccaaatggactccttaatttccagactctcccatataaggtggctaaaagttaagtctgagtaccttagcttaggagattcaaagcatttcttgagatgataaaaaagatgatacaaagtaaaaaaggactaaaggctgagtcatcaagcaa

SEQ ID NO: 53176 - DNA, 618 bp, Bovine  19866881698489
cagccgggcccattcagtgtgaatgtctggatttcccccctctcctctcttaggaccagctgcactttaagagacgaattagttaaactcgaacagcaaagactacaaatttaatgagattatgaaactcggtaaaaagacagttttgctttaaaaagagagataattggtactatatgttaagtaaacccaggaaaaaagatttttacaagtttcatttccaaaaggtttggtgctgggctgattttaggcagaacagcttttgaattaaatggggtcgtccattcaggctgcgtgacctcacagtaaactgaggtgagcatggagcttccagaaggaggggaaccgtcttggtcaccaagggacagtcacctggcccggagacccgggacctggcgccgccgggcaggactggtcgtcttcccggcctctggcgccccctgacgtctgcagcgggagtcgcaggctttgcagaggcctggaccagctccctcccatcactccgccctctataaatattcaggtattatctacaatttatttaggagctgggacgcgccaactgagaatccaagatctacaagagtcctaaatccccccgccccccgcctcagcggg

SEQ ID NO: 53177 - DNA, 997 bp, Bovine  19866880410658
tttgtaatgcaaattataaggattgaaggactgttgaacatctgtcagacattcccaaccctttcattgaaagttgactggcctccagaagattgtatactttcaatattccaaggaaagaagtcattgtaacttttataaaagacaaaaagaggcagcaagagaattttgactttgcagtgttttttttcccgtctcttatcaaccagctagtcactgctgcttctttgatgttaaatagatgcttgtttccattgaattttctgggtgacttgtcaggttggttgtgctttactctgatggaacatgtgatgttaaaaccttttctccccctctctggaaattcttaaactggcagccataccacagttttttctgtagattttgttacagatttgcttcataaagcttaaaaatgcaaagtttaagaaacatggtattaatttaagtgatattttaagttcatactttctattaaatttgattttctattctgttttttaaatttcacttaattttcactagctattttggtgagaactttgagagaaacatctgttacgttgctccttcttagagtttacattttgttagaatatactctgcatttactgagtgctttgcttgtaaactcatttgatcttcttcaaccaatgtaagtcttatgagacgtttataaagttaaccaaccaattataattatcaactttttttgtgtgtgtaaattaggaaatttagggagattaaatatcttgctggccatgctggcatggaaatctgtagtctgaactcaatctccatggcttttccacttcaccagctcagttgaaatgagcaagcttgatgtaacacacgtttgaaagggtttcagaagacccctgaagaatgaatttgcaaaggcagtcttttacttgctgtgacactttggactaaagaattttctctctcttaaaaatgctatggtgggcactcctcatcctttcctgagctggccctg

SEQ ID NO: 53178 - DNA, 1605 bp, Bovine  19866880444654
ctgctatgaacatggtggacaaatctctcttcagatcctgcttgcaattctttcggggcccttgccagaagtggaattgctggtggctcagatggtaaagaatctgcctgcaatacaggggacacaggttcaatccctgggtcaggaagatcccctggagaagggaatggctacccactccagtattcttgcctgggaaatcccagggacagaggagactgactggctatagtctagggggttgcaaagagtcagacacgactgaacgacttacacttcaacttttttcacgtttcacagtaactctatgtttaattttgttagaaactacaatattgtcttccacagtggctgcaccattgtacactctaaccagtggtgcacaagggttccaatttctccccactccaacaacacttgcttttttctgattttttaatagtagccatcctaatgggtacattgtgattttcactggcattttcctaatggttagcaacgctgagcttcttttcatgtgcttgctggtcatttgtgcatcttctttggagaaattcaacaaacgtttctttgtcatctgcaagttgcctatctaacggctatttccccttgtcctctggctgacctctgatttcacttctccctgatgaggttcggggataagtcctgattcatctaagtcagtggttctctatcctgactaacccacggtgttacctgaatgctgccctggaaacctctggatttatgattgttagtggtgtgtccaaggccaaaatttctatgtagaaaagaggtagaaattgcttgaattattctatgcatcaaagagaacactctagtccaaggaaggaaaagaaaacaaacaaaaagttacttgaatgcttacaaagtgattaataataccataagaagagtgtgagctaataattggccatctgaatttgccactgtggccatgtttatctatgatgatagaagaaaggagcggagccatggttttgaacagacttcaaccctggactctcatgatgaaagtctgctactctactgtccaagggttttaagtttcattcagatcacaggagagacagaaaactggaaaccttggacaagctggggtatcaagagctagaccaatgcttccctggtggcccagtggttaagagtccaccttgcaatgcaggggacatccgttcgatccctggtccgggaagatcccgcatgccgtggagcaactcagcccgtgagccacaacgagtgcgtgcatgtgctgcaactactgaagcccttgagctgtgttccacaagagaagccgccatctcgtgccacaactagagaaggcagcaatgaagatctggtgcaaccagaaagtaaataaataaagagccagaccagaactgaaagcctcctgaactgaatcctgcatctgcctcagaccttccttgtggttcccagccaagtcctgaaatctgggtcagttacagagtatagatgcaacactagaaaggaaagaagttgagttcacagaccattctgagtccaaaccacgtaagtctttagagattaaatttaacaccttgatgtgatacctagcccaaacga

SEQ ID NO: 53179 - DNA, 806 bp, Bovine  19866880449250
agacatgtgggtgttgggcaagtcgaaagacggggcagtgacaaaggaagagacacagatacggaggcttgggcagagcaacaggcgggcaggagggtcatatgggaactgctgtcccagaatgccacagggattaactcactttccggatggagggagggctgtaattttaggacggttgggttgcaaccagtccaagtcccttccgatcccttctgcttgacacaggaggtcccagatcccaccaagtactttgtcacccgctggagcacggacccctggatccagatggcctacagcttcgtgaagacggggggcagcggggaggcctacgacatccttgctgaggaaatacaaggaaccgtcttttttgctggcgaggtgggtttcgtcactctgaccctgactgctttcatttggatcacttgcttttagctgaactggtctgcattcagagtttaaaagcaacgtcaaataccttcaagtcttgtggcaacgaacggcaggtaccctgacaatatcctcctcaaattccccgagcagccatttttaactctttttgctgttttcttctggagtttacttcatgtcttaagatttttacattgttgtctttggatttaagaagttaagacattacctccagacttcctgtcaggttaaagacttagcctgtttcatctcttccctgtttacttcacaatttaattttaaattagtgtcagtgcttatatgatgtggttgcttactgctgagccaggaaggcgaccgccgattcttttcttacacagctgtttcctcttcag

SEQ ID NO: 53180 - DNA, 3583 bp, Bovine  19866880519063
aggtgctttttgttttttctttatttaaaaaaaactaacctgattaaatcagtgcttaattttcactatgggaattaacaactcagaaatttgagaaaaacggaaatagcattggctttttaaaaaaatgtacatcgtaatgggaacattcttcaattcttatgaatgtattgtaagtctgttttcaaacaatatttccattgaaaatactttatttttggttaataatgaatttctgcttttttaaaaaatttctcaagtaggattaacatctttaatctgctcctgaaatttgtttgcttttttcctgacttactttttctgaacatttcttatagatgtttatttttctcccttaagtaattatctccctccaagatcatgtatattcctctttgaagaggaagccaaatcttataacagtttcatgttgagtagttttcagaaattaaaagtgatttttttttttaatttaaaagggaaaaaaatgcttttggcttctttgtaattaatttgcttaaggtctatttcactgccagtttctttttctaaaaagctttttctgtcatttctttaataatttgaaaaaccaggtacaagtgacctctccaaacagcactggcagccccttgtttagattttcatctccaattgtaaaatctactgagtcagatgtactacctccgtcatctgtaagtagcaagcaaagagtgttgcatattgattgattccaaaggcatactgtatttttaagctgtaatttaccattgctggtaagaaatgccatttttcttaccaaaaaaattccaatgtacagaaaactttgaacatctatacacaaaatatatgtgtatatatatatgtatgcatcttctcatgtaccatttggaagttaggatggagatattttggtatccttaattttctttgtatcccctaagaaaaaagatactttttgcatacccataatacagttgtcataccccaaaaaatgtaacatgatgttaatagtaacatagtgtgcacattcagatttacccatcagcctcagactctcgtttaattgctgttttgtttctcttggtaccggatccagttacaattaagacttagcaactaagtcatattgcattaagttagcatgtctcttggattggctttaatctagaaaagttggaaggttttatgtgccactatatatttgtttcttcatagtaaatattttgagtaagagtggtatataagttggagacttccttggtggccagtggctgggaccccgcctgccagcctgcggcccctccacccagtgcagagggcccaggctcgggccctggttgaagaactggatcccacatagcacaactgaaacccagcacagctaaatacataaatattaaaaaaaaaatagtacataagtttgatgttctagttgccccatctctatttggcatgtgtatcatttaaatatgttcagttcagttcagtcactcagtcgtgtctgactctttgcgaccccatgaatcgcagcacaccaggcctccctgtctatcaccaactcccagcgttcactcagactcaagtccatcgagtcagtgatgccatccagccatctcatcctctgtcgtccccttctcctcttgcccccaatccctcccagcatcagagtcttttccaatgagtcatctcttcgcatgaggtggccaaagtactggagtttcagctttcacatcattccctccaaagaaataccagggctaatctccttcagaatggactggttggatctccttgcagtccaagggactctcaagagtcttctccaacaccacagttcaaaagcatcaattcttcggcgctcagccttcttcacagtccaactcttacatccatatatgaccactggaagaaccatagccttgactagacatgttaccttctgtttttttactgtgtccttggcttgttttctgttacaactagatgttccagattattttgtaatttccctgccaaatgcctgaaatctactcgatgtccatgaagtctcatactttttattaggaaatggcatttagaaacccgaaagtgggcatcaggaatacattattattttatgtaatgctttgaatgaaaaaatgctttagaaatttaaaatgctcttgttaaactaggacacatcattcattataagaagcacactgattttagagatttaaaataggaaaaactgtgaatcttagaatatgtgaaatccagtatacttttttgacttgaaatagagctttatatttgatgggttgtttgcagctaaatggacagttaaaggacaccttctctctctacagattggatttacatttagtgtgcctgtggcaaaaacagcagagctttctggccctagtagtgtttcagaaccaattacaagcagttcaggtaagatactttttctcataatagtttacataaaaataggttaatatttcaaattacttcttttacctttggccattcttgtaaatgcttttatgtgaatataattagctccctaaatgtgaataagttacagcttgtgaaggggatggtcacaatagcaaatttatccagtttaatcccaaaaaagtgacagtttattataaatgaaatctcagtataggaaattcaagggtgttccacattgtaattacagtggattccatctctgggtttctcttgagttcacaagcatttttatgcataaggattataccagcctctgcagacagtagtagtacataatttctcaaaaaaatgggctctttctcaaaaaattatatatgctgaatagataattagaccataggaatttgctgtggtggtcatgatgtgtgctctcaagtattgggtgcttggggaatgaagaatcatctgggctaaactgctcaggtcaagaattgagaggaagggcttttcccccagcaaacagcaaatacaagacaacaagaggaaaagcctgatgcactttgaaaatagcaaataatttgtcatgagattgagaggtagctttaagttctaaagattcttgagtgctatgctaaataattgaattttaatttgaatgataggaaaacactgcatgatttttatactcggggggggcggggtgtgagatggttccttgcagtaacagcagtgtgttgagggggtgtgggtgggagagggggtattatgggctgaggtatcagttatggggctgttgccttattcagaagtgtttctttgactatcttctgagtttgggaatcttaaaaaactagatcttccctcatagatagattaaaaaaaaaaaaaatcagaatatcaaagaaccaggacccctaagctgagaagatctttggtttgtatggtctggaagacaagagtataggttctgcaggtagcacagaataagaatttgactggtatgtttgcagtcttaacttctgttgactaaaacagccctgtgtaagagaaagtaacaagtatatttcaggtgtacttaacatatgacttttttttctttaatgttactgtgaattcaagaaggaataaaccattcagattt

SEQ ID NO: 53181 - DNA, 939 bp, Bovine  19866880554285
ctccttggagctgcctgcctgcccatgtacactgagcccgtatctccatctgaggccaagttttgtcactaatgttctatttttaagctctaaaatggggatgaaaattactatcttctcctatctattttgaggaaattttgagcaacaaatatttagtgacgtaaatattttgaaaaatatgtagtatttacacgtaatttcttttgtcttattaagtccaaaatgatcaaaactggaaaagttggatagttacctctttaacagttgtttttatgaactcttttctttcagttaagtcataagcaggataattttcatatacctatagtgaaaagggaaaacaaaagtagatttaaaaatccaataacatactctctttggataatgaaatctgtgctatggacaaagaggtacatgtagctttgaacagtacatgctaaccaccactggttcattcaccatgtagaattctacagcaaatgagtagttttaataatactgtatataaagcagaaaataaactagcgtgcaaatattttcagtgttttatatagtaggagtacagctgaattaacaatatacatgcatgaggaaaccatctagaaagatcttagctaagtggattaaattctttatattggtaggttacctgtcagtcatcttttaaaggtatccttttatttcttctgttacagcatctaatgcatttatgattcctcaacttcaactctgatgaatttcagcctccacatcactgctccatcccttccccaaagctatcactgagatccagttatatctttgagtccactcctaaatttttagcctttagatttctcaacctgatacttgctgcttggtttcacagtgactcctggtcctgacctgcccatatacacctagcggcttcactcctactgtacaattcaaggtcag

SEQ ID NO: 53182 - DNA, 1121 bp, Bovine  19866880637473
acgaacaatcaattgaagatttggtcagtaaaagaaggtacgtacctgtgtttgtagtcctttaagaccctgttagtgtaaaaggtggccgcgtcgttcatctccttgacataaggaccgggtttgggggactgagagaagagggccatcacccaagcatagaaagaaaaaaaataaaggataagaaagaaaatgccttaaagaagaagagaagcaatggagatgtcaatggaaaactggaggcaaattttgttctgtaaggatcggtgaaatgcttcctgcatctcagaacacaaagccctgaacttcaagtggggttaagaaagagctgctgcgttcagcctgaaaggaaccttcctttcaagaaggatgaaggaggctggaggtggccacaagtttccccaaacactccaaaaacgcgacgaggcacaggggcgacgttccagccggactcaccacggctatccacccaagggcaggaatgctttcgctgacagctgagagatgattaaacatcgtactcccccggttcctctctctgaaagtctggatctcctgaatcttttccgatattggtttcagaagtgcagccacgtcgttctgtaagcaaacatggagcacggttactggggaccgacagaaacgcagtgcctccgttcacactgacctaagcaggaggactcagcacttgtcaggggctttcagaagagagcgggtttttttccctttatggccatactgtattttcactgtctgaagtatgaaaattgcatggatttcttatattgttaatgctgcttccataggcatggggaaaaaaatccagcagtacagtatggcccctgttttttttttttccttttcaaataatttttatatgaggttacattggtgaagctatatttgattgagagtggattttatttttttaatttatttatttttaaaaattttattttatttaactttacaatattgtattggttttgccatatatcaaaatgaatctgccacaggtatacaagtgttccccatcctgaaccctcctccctcctccctccccaggcccctgttttgaagacttctgaatgcaacccagtgaaattgaggtgcagatcaag

SEQ ID NO: 53183 - DNA, 1134 bp, Bovine  19866880714732
tccagaggctaagactctgtgctcccagtacagggagcacgggttcgatccctagccaaggaactaagatccctcatgctacaaggaggaaaaaaaaaaaaaaaatcttttcaacaaatagtgctggaataattggataccctcatatcaaaaaaaaaataaataaataaacctcaacccatacttcatgttgtagacaggaatcaactcaaaatgggacacccaaaaattaacaacttgtagaagaaaacataagaaaaaaaaaatcttagttatcttgattaagtaaagatttcttagaacacacacaaaaaaacaaaaaacacaaacctttctcaaccaaccaagtagtatttcataagtgcctatagcagagcagttacaggtactaagagaagtgttgaccttttgaataagcaaagttgattgcttttgtttttcaagtaactcaagatccacagtaacttcatctaaagagccatcaaaggaattgtatgttgaactaaactgacatccaccacaaaatcctttttctcttgaactctacgaagtctcctttctctgtgcctctaagaaaatagctacttgtaaatagagtacatgtagcaacaatatacactcatatatatttttccacatctgttgtcttatttaagagcaaggcgttttggagtcagaattgagttccatttgtgactgtcagagtaagtaaatgtgaccttggataaatctctttagctctctgggtcttagttttctcatccttaaaatgagatacgtaatagaaattaccactgggccgttgaaaggattaaaggggctaatattcacaaatttcttggcactaggagtacataatccatcaatggtagatttcattattattctttaataatggcccccacctttgttaagtctaccaggcagttacagtcatctctattgaacagatgattaagtcattgattcagggctcaacaggggcagctccagggcttctggagcaggtcccaggacccccaccacaccccatcacccccagtcaaccttgtagacttttacagaatgggccgcgctgtccagcacaagaagagaactctccttggtgaaggtcagcgccacgggatgcgaaag

SEQ ID NO: 53184 - DNA, 1288 bp, Bovine  19866880852177
cattgggattcttgggtcaagtagaaaataactgcacagttcatgagacagaccaattttttttcagtatcttaaacactcccctattttgttactggggtgaaatgtgagaatttgctgggaatcataaacagcataaaatacaagatttgcacatctaacactattccagtcctcggttccagacactcagagccacaacatattactcttactcataagcatatcataactcagtcagtgaagggccaggcccctcccccacatctgaaaccctgcagctttaaagatctcctgttttgtggaaaggggagacgggcttctaaatcttagaacgacttagatggttccctcgctctcagaattcacagcctctctccaagagccattaaaggacactgaaaccaattaagccacatattcaacttcttggaactatgatacattcggatggctgacccgggaacaccaaacaaaggatttactgcaacaaatgttgactataaaagccaaaaaaataagagaactcaggaccagttgaaactctgcctttggtttatcctttgtatgttctggctcgtttctggctccagtaagggtgcagcccaggctctatagtttccagggtgacatgacaagcagcactcaggggctttccatgcacagtgtcctcgaaggcaaatcaggcattcccttagcaggcttgccctaggctgcgccacacaatgaactgatctttgccacctgctcttctcctgcaggcatgtgggaccagagctctctgtgctctcctttgcctggcatgagtggcagctgcatcgactggagtcacagcctgacactgtcttcaggtgtttccttaagacaggggagatggtcagggaagggaagggagccaagaattctggaaaatctcacacttgccaggcactggttgttcccactcatttaacagatacttagtgctcagtgggcttccctggtggctcagaggttaaagcgtctgcctggaatgcgggagacctggggttcgatccctgggtcaggaagatcccctggagaaggaaatggcaacccactccagtactcttgcctggagaattccatggagggaaggagtctggcaggctacagtccacggggttgcaaagagtcggacacgactgagcaacttcacttcactcactttaatgctcagtttaggacaggctcaatgccaagggtccccaaatttatctgaactttaaaatatctggggatcggttagaaattcccaagcaggaacact

SEQ ID NO: 53185 - DNA, 884 bp, Bovine  19866880870841
tattaagcatatatttttatatttactgaaatggactgtggtgactttggataataaggaaaagtttaatattaaagccatgtttatcccagtataattaacatgttaacccatgggataaatgccatcaataaaaaattatgaaatactttttgctctagtgttaaattatagtgaaggtaaaagtgttagtggaagggaatctttttatagaagttaacagtggtcagttagaagagaaattccaaagaatacatttaaggtgatttggacagctcctatgtctgaaggtacgctcgctgcatttttgtctggtgctaggaatcacgcctactttgcatataaattgatatacctttttaaagtagaaaataaatggaaacaaccatttctgtttgtacttgtatcttccttcatcggtgactagacaatgtttattgattgaatttttggagatatatacctaaagtagcccacaaaaacttcagtggtccttttgtgcgatttcttttggattgttttacggattattatttttttttaagaagtagatttgttacggcccataaaagagctcttgggcaagagcatttgacaactttattcttcaatttgaacatataattttatggtgacttttatttttactgaagttgtggttagagtctaaaatcagtactttaacatgtttgagcttttctatttccagtgaaatgatttctgttatggaaatgtcttaggccatcatcaagtgctagctttggagtcggaattttgtatttataattctcaacttattaaataataaatgtttgacatgaacctgtttggagggcagaagatgatggtgaatactaatggagtaaatggaaacgtgtggggtg

SEQ ID NO: 53186 - DNA, 2073 bp, Bovine  19866880969827
aatacctagactttgaaacacataaatacattaaatgttttctttggtgccttttatgtattcactcacctgatcttcacagaagttctacagatatggccatagttggtcgaatctgcagtgcctggaaggcatcatttaaatgtagattgtaaaatgtatcccagtgtctaagatgagtttgggggttgaatgttaaatttagccaggtctagtattattacctctactttgcagatgcggaatcagacacaggaacgataagtgatttgtctgagaattcaaaattgctcactggtgaagtcaggacttgaatcaggaagtttggctctaaaaacctgtattctaattgactgcttcacaaaaccttccataaagacagagcaaataaattgtaggtcaagtactgtgggggctgccgattaatcagattggccaaaagatttggagaatgtgattgctgagagaggtttagactcctgagggaaattttcctaagtagaggagagggaatgaaagtaatgaaaacttaaaggttgtgtagaatttaagtgggtgtggttttttactttccttctcagttttcccagggcctcttttcattacctccaaagtactggatgatcttgtttgccttaacttccaaaaattgtctactgttgcaatgtcaaggtctgtctttttgagattccctgttttccagagtacctaacatctctttcctgtacccagtatcttattttcagggcagctgaagtggtttttagcacctgtaaggctaaagcacgtgatgtgaattatttgattgcctctctgctcaagatgaaacacatgagtttctacagagtttatgttactattcagctttcactgtttccctgtgccagcacttacattatgaaaaagatactttactgaattcctaccatgagtttgtcacatagattaatggccgccccctccagggttcttgcctggagaatcccatggacagaggagcccagcgggctgcagtcagtggggttgcaaagagtcggacatagttgagtgactgacatactaaggattttttttaaaactgtaattttgtcattttaatctccatatgtggtgtattttgcttttatttgattagctctgagttagtgtttaagaaacaggatctggagtaagatctgtttgaagctctttattttatcatgtgactggacaaaacctctctgagccttcatttcctcatatgtttataaaaagttattgagaaactactttgcactattctaggagttagggatacatcagtgaacccaaaaagttcaaaaaaatccttgttctcttggaatttaaccttttagttgggagagactgacaataaataatagaatattaatagtacttacattttacagtttttttcccccaagagtaaagtcttctgcatataaagttttctctccatagtgtgtaagaaatgtgagcacctattatttttaaagtttgattctttacctcacctgactagtcctgtgttgggataaaattaagttccttgaatgttactcatctcagaagtggacagttagtaataatttttcactggtgatattgactaattaagttcctctagtattgttgaggggtgtggacaagtagaggaatgacagttagtcactcatcaatgtatgtactttgtttttatttccaacagccaccaaaaaagacatccaaaagagaaaagcccaaacagaaagccactcctaaaagtaaaaaatctgtaaaaagtgctaatgttaagaaggcagatagcagtaccaccaagaagaatcaaaatagttccaaaaaaggtacgttagaaatgacacattttcagcaaccctaaagatacaacttatatgctatagtatggtttttaaacatatatgaaaactaggtaaactgtgaagaacattgaggggagtataccagttttgtgtatttataatttttcaaaattgacaaaaatttcagtgtgtgttttataggtactgtagagtggtgatctataattttttaaatttagtaccttttcaagaa

SEQ ID NO: 53187 - DNA, 1115 bp, Bovine  19866881030360
ggtcttggtttaaaagtgaaatttacaaaaatagttattgcatcagggtactgttggaactatggtgagttttatcttttttttttaattgctttagtattttcattattttggttttaatcagttgtttctcattaaaacacagttttaactgtgttaaaacctgaggactgttgaagtcctcaggttgacttttgtgctcaccctggtctgacttcaagtgtggacccaggagtgacgtgtttttcactctcactttgggtcttgcggtcattacttttcctagaagtttcaccttggagcttgagtcttctggtacagtgtaagctccagaactggattccacagtaaactggatcctgtggtttcctctaggaagagcccctcatggggggtggtccccgtgggtggggagggcaggtggggacgggagcttgcactcacccgcctttgcgttccaggggagcggcactgctcggtgagaggcagtgagcacttcctccgaaggccacagcatctctgctccggtcgcctcccagagcaccagcccatctatcaagcacgctgcagctcagccggacctcacaccagcacagagaagccgcggcttccggggccacctcctcccctctcccctcccgagccgggagaagcggcacttggtcactcgggcgactcggcagcctctgcttccttccagagaaccgaaaatcctggcttcacaaagtgacagtatttttgtttgcactcactacacacccccacggtgtagaaacctccacagagtcaaccagactttattcttgtacaattttaatcagttcttactgtagaatctggagtcaatgctctaatttttttttttataaataatatatattatgtatatgaaatgtatatctatagtatgtctggagagacaggactacacactgaaatggataaaagtagtttgtagaaaatcgtaaggtactggactttcttacaaagcagctcgggcgatctctcagaacacaagcagatgaaagagatggtcttgcctgagaatgaggttgcaaatccctctctgcagcagggggttacagaatgccgttctttataaccaaagaacttag

SEQ ID NO: 53188 - DNA, 1496 bp, Bovine  19866881047982
ttattgtaaaactgtagcccggtaagttcttgggacacaggcatttctcaccccaacccacctgtcagcctcacaaacgtcctactctaataaatcacttcttatctaccgctttgctcttgctgaattcttctctgcgctgagacataaaaggactgtggtaccagagctctttggagcctggtttcaaaactatttcccagagacctagatgctgcttggttcttaggaagaatcatcagcagatctaagcatcccagtttttcacagtttggggatacttccagaagaaaggcttatacgattaagatgtattcccaacacatgtaaattacaaaggaaggttcttaaaaaattgcttgtattgatttgtttaaattattgttaaacattgttaatttatttggagaaaccagttcacctttctaaaaagtgaatatggctaggtaggacatgtcaggttggcaatgtcattggcctatttttttctacagtgagattaggagtactgagctaagttggggctcttataggattacatcctagggagtgataatagatacactaactgaaaatcgttcacgagtaatgatggaaagcactcactccctgggatggtagttaatatttgtaaaagtcagctatgcttattgacttgattcaacaaaaagtcatgtactgttactatgacagcagaatatcactccacattaaataacaggacaaaggttctgaaaaaggaggagggtgggcagactgagcagaagcagagaagtgaatgtagtctaagcagatacccatgattcctttttcttgggaaagtaagtttacactgaatatcttatcccaggtttaaattattgagaaatgtatccttccctttaatgttgattaagcagagccttccctggtggtccagtggctcagactccacgctcccaaggcagagggctcagattcaaacactgatctgggaactagatcccacagaccacaactaaagaccccacacgtcacatctaagacctggcacagccaaataaataaattaattaaaataagtaaaagagattaagaaatgacagaaaaacacaactattgtatgatttcaattatcagtggaatctaaaaaataaatgaattaacaaaatagaaacagagttatgtataatagagaacagtcagtagtcccctggaggggagggaggagaggggaatagaaaaataggacaaggagatgaggagggacaaacttccagttgcaaaataagtgagtccttggtatgaaatgtgcagtatgtggaatacggtcattccccagaggatgagatggctagatagcatcaccaactcaatggagatgaatttgagcaaactcctggagacagtggaggacagaggagcctggcatgctacagtctacgggggttgtgaagagtcagacatgacttagtgactgaacaacaacatctttgtatggtgacatattgtaacca

SEQ ID NO: 53189 - DNA, 1357 bp, Bovine  19866881238068
tggcaggatatgtattttaattgctcttgattttctatgtacgagtattttcatagcagatagtggggactctcttgatgaatgatacagcgtatttagtgagccagtcaatgaacggatgaataatgccatgatttgtttcttctatacataccattaccctaattagtaatagtgagccacaggatcacttcccccagtgactggtaggttacagaggaaagaacagataactgtctcaatagtctcaataaagagaaaccacaatctaggaaagtctggtgtgaagatagttaaccaattatttttgaatttgggtggacttatagagaaagtcggagaaggtgatggcacccactccagtactcttgcctggaaaatcccatggacggaggagcctggtgggctgcagtccatggggtcgctaagagtgggacacgactgagagacttgagtttcacttttcactttcctgcattggagaaggaaatggcaccccactccagtgctcttgcctggagaatcccagggacgggggagcctggtgggctgccgtctgtggggtcgcacagagtcggacacgactgaagcgacttagcagcagcagcagcatagagaaagtagtccattgtgactttttattgtttgcagagagctcacataaaagccaactgcccagccttaccctaagaaaaagcttgacagtcttcaatttcctgtcacttcaagtctattttctatttaatgttaggctcgtgatctttgaaatcccttggatctgggtttctcttatagaggagaaactccccatgagtatttctgcatctttggtctagttagaagtttaaaccagcaacccagaagacttggctcttttattaacctgaaaatattcccaaagtagtatttatttgttttatgaatttgctgtgggaaatttataaaactgtatagacaatatggagttttttaaaaattctgaaaacctaaagaaaaagagccatagagagacttccccagtggtccagtggttaagactctcccttccaatgcagggggcatggatttgacccctggtcagggaattaaggtcccacatcctacagggtgcaactaaaaattaaaaagcaaacaaaacaacaacagcaaaatgaactatggaaaaccgaaggttcacattggagggagcaggcatgctctttcctatcacgggaggaagacactgtaggtctccgtaggaaaaactaatcttgtgtctccttttaaatggaaatttcttctgcaaaaatctggctttccacctgatctaggattataccagtgagtgggcaggcgagggaaaggcagtgaggggtag

SEQ ID NO: 53190 - DNA, 2001 bp, Bovine  19866881246234
gacaggcgaagaggataaaggaaagggggaagaatgagggaacagacaggcaaagaactagagtgctccagaaactgtgagaaggggacagggagaaagcatgaagcaagctgaggcagaccgagtacctgtctgagctgaaggacgccgcctgtgttgacgtccttggcctggtgaagctccacggcgggcgtactcccccccagtcgttcagctccaggatggagatccacatctctattctgcgagtaacttcattccacctgcagaaacacgtcccagcaaacaaccaagtcattattcttttaacatttatttattcttatttatttgactttgttgggtcttagctgcagcatgcgtgtgtgctcagtcgcgtccaactctttgcaaccccgtggattgtattggctgccagtctcctctgcccatgggatgatcctggcaagaatactggagtatgttgccatttcctcttccaggggatcttcctgacccagggatcaaacctgcacctgctgcattggcagctgaattctttaccagggcactacctgggaagctccttagttgcagcacctgggctcagtagttgcacagggtctctacttgtggctcatgggcttagtcgcctctcaacatggtggagtcttacttccccgactgtggattgaatccatatcctctgcactggaagacggattcttaaccaccggagcctcaggaaagtcacatccatgacattattaaccaaagacattattagcaataggaagaagcccctagtcactgagcatttattatgtgtaaggcactgagctatgtgtatcacaggttattttcctatttagctctcagaacaacctcgtatggtataggttctttttatttgattgaggtatgacacagtgaactgtctagctctcaagtgtagagctggatgagtcgtgacaaatgcacgcatctgtgccccttgtctggccatgaccatggcaggcttgctcaggccccttcccactcaattcccacaccattcgcactagctgtataacctcagattcgttttatctgctcaagaacttcatataaatggaatcatgcagtagtgtgctcctctagctctggcttctctgattcagtacaatgtttgtgaaattcgtccaaatgggtaagagtgggacacagtccttttccttttttttgttgagtaatattctattgtgcaactactaacacagttcatcattctcacactgaaggacatctgggttgtttacagtttgggggacattatgaatagaactgccataaacatttatgtaccaggctgcttatggacttacattttcatttttcttgggtaaatacctagaaggacgatttctgggtcatgggagaggcaaagaatcaactttaaaagaagataccctcctgttttcttctataagctatatagttttatcttttacatttaaagtcgtgctccatctccaattaagttttgtggaatcatgtgaattaagatcaaggttgttttttcccaagtaggtacccagatgtttcagcctcgttgaaatgatgttcctttgccttttgaattttcccaaaacctggtagttcctttcattattcccatttcacaaagcaggaaataggctcacagagtcctaattctcaaccgctgtccaagcgcaagccttgaccccgcgcctgaagccctcagccaagcacacacctgtcatgcagcgttctcgtcttagcatgaagggaatcgacttcccagatggagctgccgttcccggtacaccggtggccccacacttcgatggccagtgctccatctgaaatgaactccaggaattcttccgttacgttgaccacgtaatcctgggataagtagggaaagggaacaggacaggaattatgcagaaaggaatctgtgaaatttccttgttacctttcactttagagtatgtaagctgatcccaaccttaaacccat

SEQ ID NO: 53191 - DNA, 1282 bp, Bovine  19866881258215
caacccactcgagtattcttgcctgggaaatcccatggaacagaggagcctggtgggctgtagtccatggggtcgcaaaagggtcagactcagcgactaaacaaagcaacaactttatatataaggttaaaaatctggaatccttgtataaactctctaaagacatgatgctttcaccataccactttaatatgtatctttccatagtgaaattcccctagaaacagctgggtttacctcacagtcattaaagaatatgaaagaggaaaccacgacatttcagcctaaagatagcctttaaaaaaaaagtgagatatttgacctgaatgtgcaggaatcctcacgtcttggaatgtactcatagacgcataaaagctttctgaatatattctgaaaaggccaatgcacttgctatccagctatagaacagaatcccaggctgccacaccaactttaatttttaccctaaagctgctagtccaaagaactcttcttaccatttaagatcttctcaagtttgcctccttaaagcaagatggcttcagtggtggtgctgacatctacgcaggtgtctgtgtggtttctgcactcacgtgtgtctgttgtttctctctcgtctcccacaactagaactcaggggagaaggtgagcaaggtgagcttggtggacctggcgggcagcgagagagtgtctaaaactggagctgcgggagagcgcctgaaagaaggcagcaacattaacaagtaaggggcctgtgcgattcccacggtaaaccccagcgtcccaccagcttcctgtgtgtctgggcaactggtccccttatcaggggtcagatggctctgatcacaggtgattcagagtgtgtagctttactgaactgggttaaagaaaaacatcagcctgcctctgttgagatgcatgaggtttatttaagtgaaacagcacgaggcagccgggctccaacattgtccatacaaacgctcagaatatcattgtataatgtaatttctcttaggtcaatgcaagtcacagttttatatcaaatcatatcttagatctaactctaggagcttattctaaagagaaaatctacttcaaatcccttcataaggctaatacttgtcttctcttggtggctcagtggtaaaagaatccacctgccaatgcaggagatgcaggttcaatccctggattgggaaaatcccctgaagaaggaaatggcaacccactccagtattcttgcctgggaaatcccaggacagaggaaccgggggctacagtc

SEQ ID NO: 53192 - DNA, 850 bp, Bovine  19866881331170
tttattttttctctcttatagaaccatgtgtcactgacattaagcttgcagctgctgcctctcccataagccagaagtaggggttgaactttgttccaagaacacacctgttgcttaggggaaagaaaaaacccacatacctgattgtacagtatggaaatttgagaatgacacaaatgtccatcaagttaactcctgtccctgcgtgtaaaagctgtttcacagacactaacgatgaaaaagggcagccgagctatgatttaacgtctgtcttgatgtgttggctgctggttgggcttaatttactgaacagtcaatagtctattgacagaacagaccacaaaaaaagggaactaatagctacaattaggaagctctgttgaaccgaagaacatagcaggtttagaaaagattagatcttgtaaagccgccttgtatgcggcataaactgaagggcttatttaaattacccttcaacccaggaacgctgacacagcttgcaccctttttaagagataaacaaacaatgcacaattttataatacatgtttagggtaaatatagtcctcaatgtcaaagaaaaagatcccccagaaactgggcctgcagaattgtaagcccttggtcaacaatcatttatccttaaatggatgaatgtcgtttgtttttttttttaaacaaagctgtcctgttgttattcatggtatatggaactaatcttaggtctgtttctaaatgatttgagcatcatgaaacaactacaaatcttatagctcttcctaactcaagccctttttggagatttatagaatttacatattaatgtttgtaaaggtcggaacatttattt

SEQ ID NO: 53193 - DNA, 1019 bp, Bovine  19866881496591
gttctatttaacccaacagtttccaatgagtccttactatatatgcaggcccagttctaagagctttacttacattatctaactcaacccctcacaacagatttccactttacagatgagtaaattaagcagagagaactttccaagtcctggcagaacaaggattcaaacccagatgctctgagtggattacagcacttttttctaacaactatgtccatttgtttttgctgacagtattaattaaacatctaggatacagcaaataaagataaaagtaaaaaacaactcagggatttctgggatgagttatgtattcaatctttcaatatccctccttctcaaaactgagaatgctcttcagccatccaataccaagcaggacaaaatatcacacagaagctaccgaaacagcaaaaaccacacaatcttataaaccagtgccaggcaaaccatagtctgtggcccagactcagtcctcagcctgtgttcatacaggcctcaagctaagaacaattttcacattttttagagttataaaacaaagaacacgcaggaacaaaacctaaaatatttactatctggccctttacagaagaactttatagactcctgatctaagctactgaatacataaaggagctttcacctccctccaaaaaaatagctaaatgcagaaactgacttgaaggacaaactgcctctaggaaaataaaatgagtggattcccttagctccaagccagaagacaaaacctctgaagcacatcccccaaacaagggcaaaaataagtagttcccctctcaccaggaggtggcagtagattcttcaagaggcaaggttctgatttgcccatgggctcaagctttttgtggcggctattaagaaaagcagcttgacctctccagagctcactttctggacctgacaatctgcataaaaaggaaatgggaaaggagactgaacaggcaacaagacctaaccacatactctttagggacctgttcactcccactaga

SEQ ID NO: 53194 - DNA, 695 bp, Bovine  19866881510142
ccccccgcgcccccccccccccctgccttccagtaagcattcccaacatcacagagacaggaagtcctgtggtttagtctgtaagaaaaaggttgctgaagaaagaacatactgagaagctctaattggtgaatgccccacagtaacttcagtatgcagtggacttcattttccgtctgtccttatatttaatatttgcctgtgttttaattttaggaataccaagaggacaggaatgaccttgtgatttcagagactgcactgagacaggtggcttacattttcaagtgcggcaagtctactctgcagataaaagggaaaataaattccattataattggtagggcagaactatggatctgtactcattatgataaattgcttttataaatatgctgtctgtatttaggattttgttttgttttgttttcctagacaactgtaagaagtttggcctggtgtttgacaatgtggtgggcattgtggaagtgatcaactccaaggacattcaaatgcaggtaagtggtcctttcaaccttgcccagccaccaccagaccatcccttctgtttacaaggggccctccatgtccaactagaaaactcttactgtcttttctctagacacagctctgtcttcacctcttctctgaagccctctcttacttctggacagtgttaattcccccttttcacc

SEQ ID NO: 53195 - DNA, 2138 bp, Bovine  19866881512953
ttcgtgctgtttttacattcgcttaagttaccacccttcagttagttaactgacaatgaatttttctctccacaacttcaagcaagatgccattttaaagatcagaagttaaaaggaaaaaatgtaaactttagatatacctcagcagagctaaaccagaagtcaaaacaggaaattgcaagtcagtggaacacatgcgaaagtcacaggtactgcgtgactacacaagccagttatcctgacaagcaatggcaaagacccactaactgagccagatctctcattctttcagtcctcagctgcacaaccaaaaaactttgtttttgcccagaaaccagtggacgtttaatcaaaatacatcagtataaaacatgccatgtcatgaagctccatgctattcatgatgactcagcagctgctgctaaacacagaggtgacagcctaggatagctgacagcaagcaggtggtctacaagttcacagaagttttgataaggactaaagaacatccttaagattttaaaaaatcctcaaattaaatcttcttttgtatatgcctggatacttttctttggtagtaactgccaatactaactgttgttgttcagtggcaagtcgtgtccaattctgcaaccccatggactgcagcacgccaggctcccctgctcttcactacctcccggagtttgctcaaactcaagtccattgagtccgtgagtcatgctatccaaccatattagccaatactaataatacctacagagtagattaagaaactcccacctttaatctcaattcaatagctacaaatgtactttttcaattaaatggctgtggcaataagctgaatactttagacagggggaaatgataaattaccaaactttaaaataaaactgcacagtctgaaatcatatcagctctaagacaatttggatcacaagtgttatgctgttaaggcatcatctccctcaaattaagtttttatccaagtatatttaaaaataaggtgtgactttggcttttgccacctagaatataggagcttctttctaaactctgtccagaccatccaatgatctgtatttacatttcattttttatgtagtaactttctccctaaggaaagcactcagacatttattttttcagaaaaaccagaaagcacatgtgtcaaacttcctcccaacaaaaggattaggttaaagggccaggcttgtgacctgaattctaatcttgctcctcacaaagaaaatttgaaaaccaagcctatctgggggaacactggtgggaggtgatagtaatgtcaagacttgtaaccattagtagagagctacctaacattataaactacaaatttcactattaggaaacttctcccaaatctttacttttaaaattctgtttttaatgatacaatttaacaacagcaccaaacatgtttaactgttaaatatttattatcatccgaataaagcaatctaaaagtctacctttaacagtatgcaacaagttaccagacccttttgctatactcttttttataggtttaaggcccacacttacttcctacctcactatcagtgaaaagttttataagtgacttttattagaaggttttcaacattttcccactcaatcccccgtaacaaacaagcaaaacttaatttaagatacttaacttaaagatacttaaagatacttaactttctcagaatcaaatgtctgaggataaactcatatttttataatttcaaacacccacaagtgcacaaggtggttaaatttcaagaccaccaacattcctgtagtgtcgaaagtacctaaacttctagaatacccactgcaatattaaaatattttgtgcatgagatcagaactggagtcccggtcaactgtgcataatggccaattctagtctccaaaataaaacgcgcgggtgtgtgtggggaggagggggaaaaagggtggacaaaagtggggagggaaaagtctcgcgacggaaaaaaagacgtagtgcggagagggactttcaaaatgccccagtgccactaacgatatcccggttgaagaaaaaaaataagccaggactcttatgatcggggagagccacggggagatggagaatttaaaggatg

SEQ ID NO: 53196 - DNA, 656 bp, Bovine  19866881565995
caaaaatggcaagagtacagttagctatgtagtttgaatgagccctgtgtgtatctttggaggcggaggtgtgctgtaagagggagaaaagcagcccagagaaataagcaaacactgatctctgtaggaagctcaaggttctcgctactccccccttacctcttaccccatctcatcctcaaactatccccccattcccaacctccagaggtacaactatgggggatgcaatgtgagcacagggggttggtcactgtgcagagctgatacaggctagtctaacgggggagtgagcagtggggtatgatgtgtacaaaatgtaccagcaatgtctctactgcaggatagcagtatctctatgtatctttaggaagactatctttgaggatgaatgtgctcattggcaggaaggtgaggccaagacacgccgtctaaacagacctttcagaagtacttgcaaagcacacaggacatgtggctgtacagcctgctttttcacatttccggtacttcttctccgacccaccatcttcatcctcatccgtcgtctccgtggcctttttctttgcctgagaaagaaccagctgaggttaagatcaacactggcgtggcccagggtggaggtggtgggaggtttactccgaaatcacttccag

SEQ ID NO: 53197 - DNA, 722 bp, Bovine  19866881724931
tgaggtttatatccctgatttggatgatactggatttcagatgtactaaaacatctgttactaggatatgcaccagaatgccttatgtcttcctcacaggaaatgttgtttatagacatcttctgttgttttagtattgttaatatgtagcagatgcctggggcggcgaggggaccgggtaggggagaagggggacgcagccttgagcaccttagaattgttccaagatttaaatttgtttctctttgaatttttattctataagaacaaataatgaggtcttaaagaagaagagatttgtgccaacttgtttgcatatcagttgtgtatatattagggtgaaatgacacttgtctttatcatcatagggtttttgacatgtaaagactgtaaaattgaatgtgattggttaactaaattgaactgattttacagaatgagtaaataaaaattaactgagtacatcctacatattaaaacagtgcttttactggttaaagacgtagctgcttcgggagttagattctaaagactttcagttcccagagaacattttaaggaaaacctacagtatggcaaggagatagaggaaagagatttttttttaagtaccatattgaatccattatagttcagaaaactaaggtactagtttctgacattttggtgagacttagttgccaggtttcgagggaaagatatttcaattagtgcttctttat

SEQ ID NO: 53198 - DNA, 1325 bp, Bovine  19866880689727
acatgagtagctctgtatttaggtttttaaggaaccttcatactgttctgcatgagtttacatttccagcaacagtgtaggagggctcccttctcgccacaccctccacagcatttgttgtttgtagcttttttgatggtgtccattctggccgtccagcttctgagtgcatcagggttctcattaagccttttaagggatggttgtgccccacctacgcaccagtaactcactctcagtgggcagttttattttcccagatgtgcattatgctcaggagggagttatgactaattaactcataaaagaaacgtccacatgaatgagccactgcaaagcacctgttgttaacagccgactgtctcccacctaggcgataaagagtctgagaacacaggacctgttttctttattgaaaagtgtgtgatactaactgccttgggtttgcacacagtacagccctctcaggcaaaggggcagacgcgatttatagccaatgaaacacgtgtgccgggcacagatgagcagcagccaccagtgaccaggctgacctgggacgttcatgggcctcaggtgcttctgccttttgaggtctcttcctccattaaaaaaatctgaattttataacagcatcagcataaagatagatggaatccaggttaggtttattattacgtagttagcatggtaacagtcatatgtattcatttttcttccttttgagttaaacagtacgtaaaacttaaaatttgtttgtgtgctgccacaggtgggaggacatgagccagggtacctactggcacatgagccagccctgcccaaggtgacagacagtggccatcctgaccttggctggcctggtggtaacggagtactagccccctttcacttctttttttcttgctgcttttccccaagcaacagggggacaaggcaccgaagtgaggccagccctctatcagctgcttacagggaaggcggcatccatgtcgccacccatggactcaggagccaagggcggccgtggttgggaagtgtccggtcccgccactgacacacccgtgtccagcaaggctgttcagtgcagagggcttgatctgaagaaggcagtggtgccggtagtcttcccagtggatgctgtcttcctgcttctcctgcttgaaagctttcaaatctcacttcgtcaacttttgtccaaaattacagcttctcaaaaggtgttccctttcacacatttaatctttgcatcaataatgcaaaggagataatagtatcaatatcttcattttatgcatgagaacactgaggctcttcttttaatgttt

SEQ ID NO: 53199 - DNA, 1880 bp, Bovine  19866880731540
tacacgtaaggacctgctggatagtgcagggaactctactcagtactctattcatgacccatacgggaaaagaatctgaagaagagtggatatatgtgtgtgctgtgcttagctgctcagtcgtatctgactttttgagaccccatggcctgtagtctgtgaacatatagctgattcaccttgctgcacagcagaaactaacagtattgtaaatcacctgctgtccagtaaagatttaaaagaaagtggaaggcatcagatccactccagtctcccctcagggtactctgagcatccctcatggctggatcctaactggctcacattctgcccctcagggcctctgctggggtatgagagcttcgggaccaaccacagcctttctgaccaggagcctccaagctctccaaggagggccagagccgagtctggctcctgagagacgcaaccgtggtgaagcagagacatatcattcctacccttcagcaagaagactgaagcctgtgacgtcactgctgggaaaaacactgagacagtgtcctccaggaggacctgctaggaaacacgtgacagaaatcttgcttctctttagatgtcagttttgtctgtgagaagacaggcgagaatgagaagagtgaggcagagggcaggagacccagatgctggagcacacggctctgatgaggccagggatgtgtgagtgagacaccacaggctgagacactgttaccctgctgcagcacaggaagtgttcacggctcagggcgtacacacggagagcctggggtcactctactgacacctcagggtgcacagagagtccctggggtcactctgctgaccctcaggatacacagagaccctggggtcactctgctgaccctcaggacacacacagaccctggggtcactctgctgacacctcaggacacacagagaccttggggtcactctgctgacaccacagggagcacacagaccctgcggtcactctgctgaccctcaggacacacagagaccctggggtcactctgctgacaccccagggagcacacagaccctgggtcactttgctgacacctcaggatacacagaaacctggggtcactctgctgaccctcaggatacacacacacagagaccctggggtcactctgctgaccctcaggacacacagagagcctggggtcactctcctgaccctcagggagcacagagagaccctggggtcactctgctgacacctcaggacacacacacacacacagagacctggggtcactctgctgactctcagggagcacagagagaccctggggtcactctgcggaccctcagggagcacccagagaccctggggtcactctgcggacaccttagggagcacagagagaccctggggtcactctgctgacacctcaggacacacacacacacagagacctggggtcactctgctgaccctcagggagcacagagagaccctggggtcactctgtggaccctcagggagcacccagagaccctggggtcactctgcagacaccttagggagcatagagagaccctggggtcactctgccaacaccttcaggctgctctctcaggagacacatctccaggctgcggtctggctggtggtgtcttctgttgaggagaaatgtgccgcgtcttagcagcatgctttttcatctctagcttagtttgttttctgagtataaaagaccatggttttaaaagacttaagtcactgagcgcaatcttcttgtctgaaaggaacttaatgtttcactaataaaacaactggatgtaaaatgcagtgtgcagaccccacaataaagaagatattgtctgtaagggggtttcacatttccagggaa

SEQ ID NO: 53200 - DNA, 2318 bp, Bovine  19866880803237
gggctagataaggttgtatactaccccccccccaagattccacagggatttatgtaagtgctaacgtgaggccagagtcttcatgtttttagagaaaatcattccagattagactgaagtcctggggctctggactgatcaaaaacagatccagtctcatgatctttgctccccagaaaagccacgtttccctaaagacagcattgcattacccaggagaaaacaccgggtccttccactgctgttgttattttcctgaccagtgccaccagcataacatctactcctgcccagacttgttccttaaacaaatatctgctgagagtttacctgtgccaactggacattatcacaggttctgaggacgtggccggggacactgacagcccgtcccagccctgtgcatgcaggtgatgacccacgtgatgcgtgatgtgaggaggaaccccacgggctctggccgcacagaccatgcacacctcaggggaggcttggaggcccacagacgagatgttcagcctcaggcctagagagtcaccggtgtgaggctggaggtgaattaggatgcagggccttcattccaaaaccagtccaactggcctgcagcaggaaagctccagaaagggcctgggtgaggctggagaggctggtagccagctccaaggtcaccgagagggtaaggaagccacgggcttccagcaagaaggtgcatggtcagggttatactctgaagagaccattcctgggctgcaggactgttgcttcccagcttttctagtgtattatggaatcatttgttttactttatcactgtctgccacggaggagcaaagaggagctcaaagaagagaatctgtttcgaattgaaaggaaaagctgtcataatcaaaaagctgactgcttgctctatttttatatgctccatgaaattttatagcactgagaaaattttatcttctaataatcctggtgtctgttgcagagttagcgtggtttatgttatagagtgctttttttttccctttcataaaatacccatagaattttgacccatcctgtgaccaaattctggacacaaaggaggtattttgattataatagtgtgaaatagatcagagataaggtaagagaaaggctctggcctgttagcatttagctaatctatttggccatcatccaacagaaaattttctctgagattgcgagtttcagttactaaaagctaatatatattcagagacaccaattttagctcacactcttttctagatttagactttgctataaacttcttccagtatttatagggggacatgtccatgtccatgttagtcactcagtcgtgtctgactccttgcgaccccatggactgtagcccagcaggctcctctgtcctggggattctccaggcaagaatactggagtgggttgccattcccttctccaggttgtagggggacacttacctataatgaccaaatctaagtacttgtatttttgaaattgtattgacccatgagtccatgaaacataaacatgttctgtttaataaatacggttcttcctgcagacataggaggatggcaatctccatctttccttccaaccccagttttaccaggtgctgtaagaatgtgctgagcaaaagagttgtatgttctttttaacaaggtacagttggtttacagcattgtattcatttctgctatacagcaaagtgattcagttatacatatatatattcatatgtattcatacatttctttttatattcttttccattgtagtttataataagatatggaatatcgtcccctgtactatacagcaggacctcgtttatccattccatgtctaatagtttgcatctgctaaccccagcctcccactccctccctcccccacccttggctaccacaagtctgttctctgtgtctgggagtctgtttgtttcatagttaagttcatttgtgtcgtattttagattccacataaagtgatatcatatatttgtctttctctttctgacttacttcacttagtatgataatttccaagtccctccatatggctgcaaatggcatatttcattcttttttatggctgactagtactatagtgcggatatgcaccacatcttctttatccagtcacctgttgatggacattaggttatttccatgttttggctattgtaactagtgccgcagtgaacattagggcacaggtgtcttttcaaattagagttttgtccagataatatgcccaggagtgaggttgctcgagcatatgtttcttagtttttagtcttttaagga

SEQ ID NO: 53201 - DNA, 1308 bp, Bovine  19866880834748
cccagggagtggggggaggccttctcaggattgtgattttagttcaataagtgcagttcagagattgatgcaagaaggcatcgggttcaagagtgaagtcaatttttcctgaagttaggaataagtctgtaaattctggttatatgaaccactgaagaattattgcacaggggtcattaaatcatgtgcaaagctgtgttagaaccattctgtctcctcagtttattagttacaattacattattaggctccagagtgttggacaaactcattcttttagctttaacattgcagcaaacgacctggcaacagatttaacatttttctttgaaatgtctaagattaactctttaatcattggctgaaaatctctttataatcctaccagaatgctagagctattaaatactttgagttcttagtcacttagaagtcataatgatactcttcagaggaagaggttggggagaggaggaatctctacttctctcctctgtggcaggggtccagttcaagagatgggaggtcatgatgatgaatgtctgtgtattatgtgtactgatcacaggtacacattttgcgtcctattcaggagagttacttctgaacaaaaagtgaaaacttaaaggtagcgactgtgcacaatgacctaagggctgattttcctttagttttgttgttttccctcagcgctgagaatggacagcatatgccagggcagaagagggtgggaccctctgcacagaagctgaaaggctgagaagttgctgtgttggtggggggacaatggggactgagcttgtgaaacacacacacacacacacacactcctgtagcgaatacagacaaaagttgggattttgttaccaaaagagtggtgtgacttctccaagaagtgtgggaaaaataaggatgatataaacaatgaggggaaagagtaggatattcagaaagctatcaaagaatcattgacctcatggactgtagcccactaggctcctctgtccatgggattctccaggcaagaatactggattggattgccatccccttctccagcggatcttcctaatctaatcctaacctaacctgcatctcctgcattggcacgtggattctttactatctgagccaccagggaggcctctgctgctgctgctgctgctaagtcgcttcagttgtgtctgactctgtgcgaccccgtagacggcagcccaccacgctcccccgtccctgggattctccaggcaagaatactggagtgggttgccatttccttctccaatgcataaagtaaaagtcaaagta

SEQ ID NO: 53202 - DNA, 1784 bp, Bovine  19866880980467
ccacgcccacagccgctttctgggggctccaccagcatcaagcgcctcacctgccctgtcatcgttccttgcggctccatttcagaaatagccagctttcagtagcgtcactgggtcctcctatgtctgagctcaagagatcgctcttttaataccagaaactccgcctgttgggatggcctctaaaaagtgaaagtgaagtcactcagtcgtgtctgactctttgtgaccccatgggctatagcccaccaggctcctctgtccatggggttctccaagcaagaatactggagtgggttgccattcccttctccaggggatcttcttcacctagggatcaaacccaggtctctggcattgcaggcagattctttaccatctgagtcaccagggaagcacccccccaccctgggatgtgcactaaggttcttttcaattatccgaaaaccttttcattttcacttagaaaaatacccaggatgagagtggagagttctcagtattctagcatagaacttaaagcaccgtggtcccttatggttctgtaagaaacttttattatgaatctattattttgttagtttttatttctattaataaccaataagcaaatatatagcaaaaagtccattgtgctttacttaagtagtgataaagagcaaattagaggtacatagataattagtatcatagcgaatgatctttttgaggaattttacagctgagccctaagaggcatcctacttgttaagacaaagaattgattccatttttctcttagtatttggcacactgagatcattaccaaaaagtatttgctaaagaatatctaatgcacttgttttcctgtgcctctgttcattacatgaacttcaactgagggtctaaagaatcttcacacaatcccacaaaaatgcactcatactcagtacaagttgaaaaaacagtagggcacttctctgaacacaaaaagaaaaacatctgcctttgaaggttttaaaatcctgcctaaattggcatgtgctttacattagtcctgtgttgctcaaacttccacgcatgtgtatgtgtacatgtgctcacaaggcttggagatggggtgtgtgcctgtacctctccagtccaagctgctttccttgaaattttgggaaatttccctaatgtaaacctccactaagtagcaataatgaatatatgtatacatgaagtgtatactttacatatacatgaaggcaccaaggaatgctttcatcatattttagcaggttctcagagttgaggtgggtgaattattccactgtatttcgggtatagggtgctttgtaagaaagcagtttagggtgatcttttcagacgtgcattcctgtaagggaaaactctcactaaacaaagaaaagaagtcatatcctggcttgctttctgcagcagctgttagggggacaacagagaaatgtctccaagtggctctactttgtcccagcagaaaggtctctctgtcaccttcctgggtgagcattttatcagcacacactcagtggaacaataagcgccttatctgcagaggccaggtccaggctgatggaggagctggcagccgccccgtctacatggcaacgggcaaatattgttcccggcgcccggggaccagtgtgaggccggatggtgccggaggcgtttcaataccaggagcgccggtgcagacaggccctccttaccttctcctcttgtggatcctgaccatttcaagatagatctcatctgcgactgtaaattctcggggactt

SEQ ID NO: 53203 - DNA, 5483 bp, Bovine  19866881012612
gttttcacagagccctggtttgagttccctgagtcacaccgcaaatctcccactggcgatctattttacctatggtagtgtatgtgtctctacaccactctctccacttgtctgaccctccttcctcccagacctgctccctgggtccataagtctgtgctcaatgtccgtgtctccactgcggccccacagataggtgcgccagtacctctttccagattccattcacctgcaggttctgagcgaaataaaacgggagcacttcccccacctgaccctccttgcctcctccccctgaccagcactgtcccctgatgctccacccactccagctccagaccaataaacttttacagcccaacagaccagaaaccagaaacgagtgtggcttcacagatgcaaagagctgaagcttgtaaactggctactgaaaaccaaaggaataactggcccttccaggggcctcccttgccttcttcctctggacatgggcccactgaaagtttctactacctacatgtgtgcgtacagggtatcgcatctgataaaggacatgaacagatcttgaaggaagtcagatacaataaatgattatgcatagaaccaaaggaaacaaattcacattaggaagtatgcttttttttttttctgtttccatttttgctttttattttacattttcctcaagagatggccaatggtatgctggggaaaaacagatcctgtagcaactggccttcagtgcgtgtgctctggccccgtggaaaccctggaagtccacaatgtgggcagaagcaggaaagtctaatgtacttggtgagaattttggtgctaaaggccttttttggtaaacgaaaaggtgaatattattacctacttctgagtccattctcacttcattcttagttttaaatgtagaaaagtttctggttttaaattgacttccactttctgattagtccagagagcagtattttgcaggtcagcaggcaagacgctgccctcggggtccagctggtgaggatggagtcatcgacgtcccggtgtccagggagcattcacagcacattacagacacttcacaaatactcttcacgtgtgagcttccagacacctaggggcctctagtttcctcttaggattgtgcatactgttcacactggaaaatcacaaaggtaggacctgggtagaaacgaggcacgtcacacacacaggtctctgtagttttccaaggtctgccacatggctcctcctgagtgagctgcttctcctgaccaaagccacatcagcacggctgacgttggaaggctggtctggggccctggggatttgaggtccacaggagggcatcgtgtgctgttgggtccacctggtaccaagtctccctgcaaggtccacggctccagggagaaatgccaccggggtggccgcgctcctggccctgagcgtgtccctggggcccacgagctgctgtccccaacaggtcagtggccccggcttcagccccagggacgcccaccagcggcatgcggggacacggatggaggtgcccaaggactggcagagcccaggcccccgaggggcggatcaggccagggaggggcacggcccccaggagaagggtgctgcaggcatccgtgaggagggagaggcccgcaccgcaggcagggacagccactctgctgtttgcgagttaaaaactcaagctttagaaaaacgtggactcctggtttccttctctattaggctccgagcatgcctcctggcttcctttggggtgaaggggacactgtgctggggtctctgccccaggagctgggctatgctgctgggacaaggatgggctggggctggcctggaggagttctgcagcccagcgggaggaaagggacatctcaggtgccaggtgccccaggacggatgtgacacctcagcccggaggtgcgcggggccctggctccaaaaccaacagcgtgccgacaactcagcaggtcacacagatttcatggatgcggctgcgtgtgaacagctcctgagcgccacgcaatgttcgcaatgttcgtgccggccgctctgtgaaggactcctgctctgagcacggacggacggatgtccctgcgctgttatcccaacacccctgttcacaggtggaatgggactttttccttcttcgggtatttcatcctgggtagggggaggtggaccctcactggtgctgtcgacaaccctcattcattgactgtgtcctctctgaacactctgcaggaagaggtctttaaccaagctggctgcaggctggcttaggaggaagcatcactccctgggggaagacagagactcttctcggctgtcttgtggaggattcacagatctcagataacggaccacagaaaccactgtcacgttcgtcttccgttacttggggttgatcctgtgaggtggctgaggctggggcccacttctgaagaacctaccctgccctgggagtctcgtgttgctggggcatcttgtgggcactctcggggccttatctgtctgtccaagcttgagccagccctgccatcctggcgttctgctctagggagtcctgacatctcagatcctaataccatctcagcctgcccctgcaggaggaccctggctactcttaccactttctaaaccacaaaagatttagaatcagactgccaagttcaacaacaaacgtagataaaaacgaggatctgttggaatttgagctatattacactgaacttagagactggcctgggggcacgacttctgacagtatgctggtgcacagacatggggcacctcttcaactgtgccttttaaatatctttcagtccaaaaaatgatacaagtgaacttacatacaaaatagacccacacacttagaaaacaaactttcctgttaccaaaggggaagggggggtggataaattaggagattgggactgacatgtacagactactgtctgtataaaatagagaaccaacaagaagctactgtcttacacagggaactctactcaatattttttaaaactctataaggaaaaagaatctgaataaaagtacatgcataactgaatcactttgctatacatctgaaactaacacaacactataaatcaactcaactccaattataaaatgtacagttttcttagacagaggtggggaggagacagaggagaaacaccccacgggaccatttctaagcttagctgaccagctgtccaatgtcatcatgcctggcgatgcaaaacacccactgagacaagctgaaaatctgtcagttgttccttaaaccatctacaaaccttgttggtttcccaggttcccatccaccattctgtcttctcccgtgcactgtttggttttcccagtctattctgacttctatcaggcccagctttctcagacctttatatgatcatggtcacacagcagctgtgcactgagtatctgtttagccccacaggtaacctcaataagaacctgttcatcactcgttttatgaggccacaggggaatggaatcaaaggcccagagcaaactcaggatgagacgtgcaggtgcctgaccttggtgaagacgggcgggaggcaggcggcagtgggtccatccggccggcagaggaacaaggtggggctgggggcctggagagcagaggcatgtgggtcagactcggaacacacaaatcacgaaaagatggaccacacaggcgacagcacggccaccgacagggctaagcgttcactgctcacctgccagtgcctacatggcaaacgctaaacaagtccagtggttcacagaatggtttctgcaaatcccactctgctttgggggttgacagggagtttctactacacgtgccaccttgagtgacttctactgcttgactctttcctcgtgtctcatctcagatgtgctttctctacggttcgcacacccaacataccacagagtacataagagctagtcgctcagtcatgtccgactcttttgcgaccccatggactgtaagctgccaggctcctctgtccacagaactctccaggcaagagtactggagtgggctgccattcccttctccaggggatcttcccaacccagggatcaaacctgggtttccctgcactgcaggcggattctttaccactgagccaccaggggagccctgttatttgtaaaacacccacgggcgctggtgctccgtggctggagggtacactgatgttcgttagacacacttatgactcaagaatgagctcacgttgcaagagtcttgggtttacagatgcccatcatagcaccaaggctaagtatcatatttgatttagagacatctagattctaattttttacataaaaaaaggttcaggtcttctgtgtttgcaaagtgaattcactacaatgacccagtcatgggtactgttgttcttcttggataaagcagtcttacgatgaaatgaaagcaggatgaaaatgcacagtgaagtgaaggaatctgaatattcctgtattatctgttaagctctcagaggacaggtggacttctgagctctatcaggtggactctgtagataaggcagacttttctcattttctgctttgttttaaatgagctaacgaatttggctacatgggaagatggcacatatgtgagggagaatcaagcggtaatagccaagacagataccactttatcagagtataagctgaaaaagaaattcccaaaggaaacacagatgttgattaatcagtggtgtgtctcagattaaaaattatttttagtgcattaaaaggaagaacttaacttatcattgtctttccacccagttgtgtgtccattgaggagatacttcaagggaggactgctgctgctgctgctaagttgcttcagtcgtgtccgactttgtgcgaccccatagacggcagcccatgaggctcccccatccctgggattctccaggcaagaacactggagtgggctgcaatttccttctccaatgcatgaaagtgaaaagtgaaagtgaagtcgctcagttgtgtccgacttttagcgactccatggactgcggcccaccaggctcctccgtccatgggattttccaggcaagagtactggtgtggggtgccattgccttctctgcaagggaggactagttggggtctttacactgaagagtctgattcccctcgggctgtggataaggctcacctgctgaacagggactgacagaggctggatcacagctgtggtcactcctgacttgggagatgatgatccaatggtcaaggacacggaagtggttttcttctgagctctggaaagtaaggagtgaagtcttgggtcagaatttcctaagcaggaattattctttgaaacatttccacagaacaggccagtttctttatgtttgctcaatctgcttcagctgtactgcttcagaaatggggacccacaacccata

SEQ ID NO: 53204 - DNA, 1328 bp, Bovine  19866881167112
ctggaagggactctaagaagtcatttagtcatgttgcttgcttccagcaggactctatctaaaattttgaaaagaaaatatgccccccacctcactttactattattattatttttaataatcccagagccagagagtgtgagtgcgttctggagagaagggaaatgagggatgagggcccagcgttgaggcccagggctgcatgtctggcctcagcagacagagtcccatccccgggggaggaggtggaacaggagaggccagtcctggacaggctctaggcctggggggcatccagtggggagagctcagcaggggttgttgtgccaagagggagaaagagcagagtggctcaggaaagaccctccagttccctcggggcttgggagagctgtgaccgtggcccagggcccgggggtctgctcagagacagcacaggcttgctgttcgtctgggagggtgagagctggccgctcacgcccaccctctgcgtggggcagggaggacaggctcgtccctgcgacagtgcctgccgggcccaccggaggagccccagcctgtccgccttcccagtgccaggtgggttctggcgggcttccaaggctcagggtcattggaggaacgaccaattcagtctcctgttcccaaattactcagctgactaggttgtcactttagaagacgtgtctacctcccactttctcctggtttctctcccggggttagatgttgggagaacaggagcaactttggagccaggagcctgagtgatggcgacatctcaacagctcagttacagctgagcgccttgaggctcagtgtccccgccctgaagtggggaagtaatagcaccccctcccaggaagttcggtgctcctgggatccgagggaggagtggggagaaccatccacgtctgcggaagcagccctgcgtcaggtcttgtctttgagctgtgagtcacggaggtttcttttttctctgccttaattccatacgcaggcccacctcagaatgatggtggtttttccgtccttgctacgtgtcaggcacataatcatgtttaatcctcacgaaaacaccatgaagtggatctgttacccccattttattacgtggaaatgatgttctaatgaggataagcattttgcccaagatcacgggctaataaacagcagagggaaaacggaaacccgggcagcccacccagtcctgcgtggagacccggggccttccctgccgggcacagccccacccttgtgttcccgaagggcctgtcagctggataggctcctcctctctgctgctgcccgaccacagcctccgcacc

SEQ ID NO: 53205 - DNA, 1681 bp, Bovine  19866881258258
tgtgtgtgttcactttatttttttagctctttattttatactggagcatagttaattaacaatgttatgttcatctcagatgtacagcaaagtgattcagttatacatacacacatatcctttttcaaattctcatctcgatttgatgttgtttagtcactgagtcgggcccagctcttcgcgaccccatggactgcgggtccacctctcacctccgtacgtgactactggaaaaaccatagctttaactatacggacctgtgttggcaaagtgatgtctctgctttgctgactgttctgtcatcatagctctccttccaaggagtgagtctttagtcatattctggggatgtgatcacggaatttcttctaacagtagtttgaccacatggaggggaccctctctcaccttttggtgctggcagtaaatttgtgacacaaaccacagtgtactttccctgtcatggattttgagaagcaaagtctgtctcgttccacaaatgccttttctggtggatgtgactgtggataccgccttgttctataaaagccaggaggtcacttcaaggagaaaacttgacttcccaagaaattcacaaagataagcttgggctatctttagtttgcttaaacataattcagtatagtaggaatgttagtttgcttgtgtttctgatctggtacaatctctgaagattgttaacttttttatctctctgaaaaactcctaatcttgaagaatacatagttggatgagcaaagaaaaaaagaaccagtcaaggtgacttccaggtattttggaggaatgtgtgcttgttctgaaatccctgtatctacaccacactgatcctgtctttgattctaaccttctttaccaaatactatggagcatattggtgactgtccaaaaactcagtatatttagataaccagacaaccaagcaggataaatagaactattcatctgtgtgttcatctttgtcctttccagggaattgtttaattcctagtgtgtgagtttatcagatcaccctgaatgatgttactttgagataacttcataacaaaggaaattttaggcattttcagcttggaaaagagtaggtgccttaggaaaagaaagcagaggtgtgagaactggccttttgtcccggctttaccctgaagagagggcttggaagaaggggtagacctaagagagcctggcaagtgtccaggggaggtgagccactcctcatgttagctcacaaggaaaaagtcagtgaaagaaaaatcagatcaaattcacagtccagcccacagccgaattctaggtgtagctgccatcagatgtgtgccttgttgcagtttgacagctgtattcaacacgcttcccatcccccacctactgcatgttaatcccacagtcagtaagttcctcgtggaactttgcaacactttgtaagtaaagtttggtatatctgatgccattttcctagtaaacaactctagtaatttaatattaaacattaggttattttcccctgaggcacaaaattttaataacatattccccacaggtagcaacatagctgcttcctatacatttttataaaaactgtccagaatttttcaagcgtttatgtaactgtgcatgaatatgattcacacacatgtgctctgggaactctccctacttggg

SEQ ID NO: 53206 - DNA, 4200 bp, Bovine  19866880203080
tagctcctggggtataaagcttgctttcataccccaatacctttctgtagatgttcaacacgtttggttaacttgaatatgttatttaaagtggtaaccttagcacttttactgtaacacaacaaattatattgttctagatatgacatggaagaaaagttatgaccaacctagatagcatattgaaaagcagagacattactttgtcaacaaaggtccgtctagtcaaggctatggtttttcctgtggtcatgtatggatgtgagagttggactgtgaagaaggctgaacaccgaagaattgatgcttttgaactgtggtgttggagaagactcttgagagtcccttggactgcaaggagatccaatcagtccattctgaaggagatcagccctgggtattctttggaaggaatgatgctaaagctgaaactccagtactttgtgcacctcacgcgaagagttgactcattggcaaagactctgatgctgggagggattgggggcaggaggagaaggggacgacagaggatgagatggctggatgacatcactgactcgatggatgtgagtctcacatgagtctgagtgaactccgggagttggtgatggaccgggaggcctggtgtgctgcgattcatggggtcgcaaagagtcggacatgactgagcgactgaactgaactgagatatgacataactcaaatgggtatgtcactgggctagtatttagctacaaaaattctaagatatccaaatattttcacaggactcttaatgttttcaattcagtgatatgaccttcatagtgtcactcacaaaatgccactgagtgccttatttctgaagcacatagatcacctgcagcaaacaccaagactgtggtagctgagtagctgggagcaggtttggtgggctgattccttttcctatgatgacttctcttttcccactatttgagtaactaagtataaagaagcatacttgactcctattggatgtcttgggcttcccagacggcttattagtaaagacccacctcccagtgcaggaggcatgagtttgatccctgggttgggaagatcctctggaggaagaaatggcaacccactccagtattcttgcctggagactcccatggacagagaagcctggcgggctacagtccacagggtcggggagagtcagacacaactgagcactcacgcacacatatatgggatgtcttatgggagcagagctgtttgattacctgcattaaaccagactttgctcttctctgatgttcaacttttcttgcttaataattaaggatgaatgtggcaaactgagtgcaggtttatatattagatttatagatgaaagctcatacagaagagtctatgtggttaacagagattggaacaacttccctggctccagactggagacacctttccctcaacacagcaaagaatcactctctactgtaactactcctctgtttgttaaacttattaattgcatctgatattctgtctgcgtcagtggtcattactcattaactcctctgcccaaaccagtgtgtcaactttgaggttttactatgacactaaatgattccactggatctggacacgagatcatgggatggactctggttggactgaatagtacccattattccttcaacagagagagcagtaggggaaagaggaaaggtctatagggaaggaacatctggaaaacacaggaagcaagcactagaactacttttcctatgatttcatttgtcagttatatctcatataagctgagaagtaaaaacaaacaaacaaacaaaactttgactctggtaattctcaaagacttttttggtcagctgacgtctgccaacatgctctgacttcaagggcacaaaatttttgatactaattctgaggaaagtgtgaagatgtgagacagctacaatttattctctgctatactattacaaaatcttgtatttttatcaaactgatttcattaagggaagatcagaggctcataatgagtggataaaacacaaaacagtacatttttattctttctgagatgagagaacctcagtgtcaaagccaagggtcagaggagggctagcaggggttgcccagatgggtcagaggcaacaaggaaatggtgttagatgttgcaggtatggaagatgggcattatgaaggtacccagacaagtgtaatggacagagatgaactaatgaaccatcaccagtggaattaccctgcttatcgggaggaataacagagggagaatcattttggattgctctgattttcactagattgtaagagtgtcagaaagtaactcaaaggcagaatggtatcctcattgaatttccatccattcattgctttgtctacatgactagcaaaagattcacacatgcttcccaatattaactctgggataatgaataagagttcattaacactcaggataagaagtgtgacaaaccaagctcttagccaagaaaggcaagtggacatctaaattgctcttctgtttggcatgttttgacttgtgacattggtaatctccccacatggttccagggctttactctgtgtgtgtcaaactgggcaaaagcttaagctttcactgaaggttgagtaagtagtcctgagattaaaatagtgcccaggagtcctgaatatactgggacatcacactggcttaattaagctacaggacttaagtttctctttctttatagttaggctaagagagacatggaaacagacacagatttaacaaacttatagacagaagagatagaaaatcttgcggttaaggcataggggatctcctatcaggctgctattatgagaattccaactcccaagcttccttgcatgtaagattgtgcaagatacttattatgctctccagactaggctcccttatcttcaaaatggagattatagaaactactgcacagggctgttgagagaattaaatgagataaggacttccctagtggcttagtcagtagagaatccacctgcaatgtgggagacctaggttcgatccctgggttgggaagatcccctggagaagggcatggtaacccattccagtatgcttgcctggagaatccccatggacagaggagcctggtgggctaccatccatggagtcacaaagagtcggacacgactgagtgactaagcacagcacaaggtgtccatagtatttagaagagtatcctgtaaatggtgagtgctcagttaaagttaattgctgttatatgtttaaataatttcattggataagaggcagtactacattgcatttctctactcatgctcttgggggaaattgagcctcttctgctacagaatctctcccagagaatcctatactgttcaacactgagggcttctagtcctcttgagactgaaatcagtgcctccaatgatacaaggtcaagggtctcccactatatggcattcatggttctcaaagtgttactagacctcttaactttaagaaggaattcatggaattaccttttgattgccaccataggttctttccacgtttatattttaataaactattaaacatttttcttaattctccaatcatttatatatttttcttaggattttatttcaaaggtgtatagatttagccttgacaatttccctttaggattccagtctctgagaatctaaacttcagccctctctaggatcaaacatgtcttttaagtacttcccatgctttcacctttttcttggacttgaaatattataatttgtaagtagatgtcacattaggaaaactaaccagattaccctgaacagtttatataactatatttataataactccagagatgtcatttttgtcttgaagcaacacagaaaatgaaatgctagtttatttttgagaatctctaaagaaggagatgtctacatttctacttgggtgaagttcacagtggtttaagcactatctgacaatgattcccaatggaatgagaaaaacgcagagcctcagacaggtatgtgatcacaggcacctctaatgctgatgcttgcaatggtactagagctgagaggtggagaacaggaagtgggcacactgttctgccattaccacaataactgaatccaacctgatgactgaagaaagtctcgtttttggacagatagtttaga

SEQ ID NO: 53207 - DNA, 870 bp, Bovine  19866880460877
tttggtgaaaggatatctgagtgagagagggtttgatttcattatccatgagaaagagtataagggaattctgagagaaggaaggtgagatggtattctgagaatgatattcagtgagtattccgggagaaatctgtatctactattttttaaaaatgttcaggaaaacttgtgttattcttacttacagctttccagttgcattatacatgtttgtacatccattggaaaattcttgagatccattggacaggagagtgttaatgtcaacctgaaagaattcaaagtaatcattttataaagaaatttgtaatatcatcagacatgactgagcgacttcactttcacttttcactttgatgcattggagaaggaaatggcaacccactccagtgttcttgcctggagaatcccagggataggggagcctggtgggctgccgtctatggggtcgcaaagagtcagacacgactgaagcgacttagcagcagcaacagcataatatcatattaacattctattgttcaggatacaatggaaaacaatgctgttttggttatggctaacatctactcaagaaaattttctccagcttgtatatatagtgtgaaataactgtatcctttaaataaatctggttttggagggaagaaaagctgtatatataaacatctaatcacagttatttatttgtatatttatgctttcctttagatagtactggagatatctaagagtggtctctatttccagaaaagacccttttaaaaaagatatttgagagtaagctttataaaattaataccaaaggccaaaagacaaaattcccccaaatcatagagacaacatcattgaggcaagtactgatga

SEQ ID NO: 53208 - DNA, 1840 bp, Bovine  19866881098550
aaaagttggatataactgctcatattgattatggtaagtagtcattccctgctaaaagagtaccatttttaaaataaattataaagcatcctttttatgcaaaaatgaaaatatagataggcccttatatactagaatattatatgggtagttttaaatatctgaattggaaaagttagatgtcaaaatatgtttccatctttgcagctacatatatcagactatagagttcttttgtacctcctctagaatatttgcgggggcggggggaggggggcagagaaaagaggtaagattaaagtcctctttatctgacaataaactataaaagtcaaatgtttgcctaaagaggggattcaagttactaattaaaaataagatttttagatcttcagatttttacttatccatcctacctcccattgttattgagagttggctgtattttctttcttttactccctggcctgattcaaagatatcctggagcattccagaagtattgaattcactgttctgaaaggggcacttactgttgtcaggcagcgtggaactaaaccattcaaagtgactttggttccagaattctgcttctgtgcttttatgaacatcacccaggctctcagcaagcagctgtggcctaataacaaaatagaattctctctttaccagagtacccttaggacataagtaggcatggaaggacactgaagtacacttgtaggtgcagggaaatgaagagaagtattttaattaatattccacacttgctttcattgactgataaataatcaatgtcagtttggttgcttaaccaaccaaaatataatcaaaagatcatcctagtagatgtttttatacagaactcacctacatgagtcatatttcatccaggtcttagaatgactcttgccatgatttttaagtgctagcaatcagaaagtacctatggaggttgattatttttccccctcactggagcactgtcatcagatgtgttatttgggtttatttaagcctgagaagtaaactaattacgtttgatgttatgtttaaatgtaagcggtgtttattttaagtacctgagataagatgtatataattgttcaatattgtaataaatctacttttccataatttctagttctgtacttaacattttgatagcaagcatcattaaaatattataaaaataagaatacttacagccacagggagcaagattctccaaaggacatcgttcatgtcacggatatgggtaaccaaactccacagcagctgctggcagtggctcatggggtgggggagaacttctgcacagtctgtggtacgattgtctagcacgctgctgttatatgcatgatgttgtgatctcagctgtttgaaagtcttgatcttgtgcatgagcttgtgtaccttgtggcaggtgaccacattctagtaaaggaatgtgctaaaaaccatctgtttacattaggccatatttcccctgcatgtacaagttatgtgtgtgattttattccccagcattattataataaagtaattttacgtatcaaccagtaacttattccattgagtaataaatgttttcttgacagttatttgtaaatttaaaggatgaaattggtagtgaacatggtttaactttataggcttatttttgtttctatatatgtttataaatttttaaaataataccctcagtaaagtgaagtcgctcagtcgtgtccaactctttgcgaccccatggactgtagcccaccaggctttctctgtccatgggaattttccaggcaagagtactgggagtggattgccatttccttctccaggggac

SEQ ID NO: 53209 - DNA, 1186 bp, Bovine  19866881189949
atagtttggtgaaaatgtaaaataatacattgttttcagctcaatgcttctccgtgactatcgtctatcaatctttgtcgtgcgtgcagttttgaatccggatacaaaattttcctgccagaagtcaatgcttacttctcatttgttttcatttcctgttgccttcagagctccacacagagaaggtgctggatctgctatctctaagacattctcttttcccaggcagattgtttatttaatgaaaaagatagaagaaaggtccactctatttgtttggagttatataaatattcttaaaaaggaggatttcctcatttgttccacttcagccttcctgttcaggaagagttttaaatgcacttttcatcactatatgatgacagctagagttacagttttgtaattgtaccaaatatattagagacattggaaataaggaaggcaagatgcaataataattctgaatttctttccatatatattataaactcaggattatcacatatatattcaaaaccagtttatcattataaagccaataataaaaaccagtaaagtgctataataataactaaaatgtgggtgtaaattatgaaacaagaaaatgataaatcattgttctgtatgtcagtcttatggttttattttcctctttatttcacattcttcttcacatggagtttgctcaccaagttgtcgttgctgcttagtggctaagtcatgtctgactcttctgtgcccctcacggattgtagtccaccaggcttctctgtccatgggatttcccaggcaagaatattggagtagggttccatttccttctccatgaccacattgttgctattgctaagtcacttcagtcgtgtccaactctgtgtgaccccatagacggcagcccaccaggctcccccgtccctggaattctccaggcaagaacactggagtgggttgccatttccttctccaatgcatgaaagtgaaaagtgaaagtgaaatcgctcagttgtgtccgaccctcagcgaccccatggactgcagccttccaggctcctccatccatgggattttccaggcaagagtactggagtggggtgccattgccttctccgaccacatagtagttgaagtcaaaaaattctgtaaaaaggatcataatagaagaatattctcaatggaaacaatt

SEQ ID NO: 53210 - DNA, 1372 bp, Bovine  19866881258284
tatcagcttgccaacttttggattgagatccaacccagtccattctgaaggagatcagcccctgggatttctttggaaggaatgatgctaaagctgaaactccaggtactttggctacctcgtgtgaagagttgactcactggaaaagactctgatgctgggaggggttgggggcaagaggagaaggggacaacagtaggatgagatggctggatggcatcactgacttgatggacgtgagtctgagtgaactccaggagttggtgatggacagggaggcctggtgtgcttcgattcatggggtcgcaaagagtcggacacgactgagcgactgatctgatctgatctgactgagattttggtgttttcagtttttagtttattaatcaatttgtggataactgacttcctaagactactgtcttccaattcatgacaatagaatgtttccactaatttaggacttaaatttttttttcctggtaatgtttagcagtttttactgtagggttcttgcatataatttcttatgattttatttgtaagtaggttttgtttttggatactgtcataaatggaatttattttttgaacttaattttccaattgcttgtggccagtatatagatgtataactgattttgttataccaaccttgtagcttatgatcttactaaacttacttattagttctagtaattttgttttaggttcattagcattttctctatagtcatgtcttcagcaaataaatgatttctttttctctccagtatttataacttttgtcttaccttattgcaatggctaggatcccctagtacaatgctgaatagagagcaagcattggtgcaatttcccaatcttttttcatattttgatgataatttttaaatcataaattgatgttaatcatgtcaaaagtttttctgaccccatggaagttatcatatagttgttcttttttattgtattaatatagtgattgtgcttatatgattgattttatatattaaaactaccttccagttagttccaggataaaccctccttggtcaaaatgtatagatttttaaaaatattgttgaatattatttgctaatttgtgttaagaattgccctttatgtttaagcaggatcttaatctgttatcttctctttttaattattttggatcatccttgtcatcctgtcatcttttggtagtaaggatttgatatctgtatagcagtgtgctctctaaccctagagtccctcttctaaacaagatagtagtttgcatctttttatagtaataggtttaattaacaaaaatgagtttataacatacatcaatattaagaagataaagtgtaaatattcacaaatcagt

SEQ ID NO: 53211 - DNA, 2609 bp, Bovine  19866880527547
aatgaaaaatttatgcaggtctggtaaagtgcgtgtgtgcttagttgtgttcgactctttgcgaccccatggattctagcctgccaaactcctctgtgcatgagatttttcaggcaagaatactggagtgggttgccattttctgcaccaggagatcttcccgacccagggattgaacctgcatctcctgtgtctcctgcattgcaggtggattctttctttacctgctgagccatcagggaaagcccattttattgtaccttttgatcccatctctttgctttgcccacgtcccagctcctggcatccaccactctattctctgtttcttttatttttttgatttatttatttttttattgaaggatagttgctttacagaattttgttttctgtcaaacctcgacatgaatcagccatggttacatatgtacatctctgtttctttaagttcaacttagatttaagtctttgatccatttcaagttaatttttgtgtttttttgccttttttttttttttaactgtaaagtatctcttttgtgtttgggcagtcctatacctatgagagaatctatctgtctgtatagactctaaaaacgctagtacgtttctacctcagttccctttgcaggtaggctgcagacctttgacatagccatttggatattttagcagagggcattactccaaaaagaagagtgggccagaatccaacctggtgagggggggaagacagtggatgtggtcacatcttgttttcagagccaaaagtgacctcttgtgtctggtgacaccatcctgtgacttgagttggcggtattgaggtcgtgctgtgatgtctgtgcctaaaaggtgactgcagtatggtgctggcaggaagactttctgtggctttatctctggtgtttctgactctgcacgttccccatttgcttttctggctctcccagagattccttgtgctattaatatccctttctgcttaaatgagctgattcgggtgtattgtttgtcagtcaggtagttgataccgggataatgtaaggcaacaggcagtgggggcatctgaggaccagttctgtgacatgaggtgggtttttctcctggctgtgtgcctccatgccttggtctctgaccctcttgggcatctccgagcttaacagtattcattaaagtcatcgcttttctaattaaattacctatatatggctttgactgttgaaagatgctgaaaatgaaagatattgagagatgttactgctgaaagagtaaataggagtgaatcacaaagtgacaaatatgttgcatattaaaagtatatttgtataattttttattattcatcatgtaatattaactttaaattttagactaagggaaactgtatatctagatattattacaaattaattatttttgcctggcaaaaaaaatgacgtttataggtctctaagaaaatactaagaaactactgactagatactttacaatgaaatttcacacaggtttcagaaatgaattaatatctattgtcggatagtaatatgtcaaggattttatttctgaaaaatattttgattaatcttcttgtctagatgtttaaaatttatgctcacttatttgatcatcatgggacagttaacaaagtatcaaaagatttcatggaaatataatcacatattcatatctgtttataaaaccattttggttcatatatatttttagatcatgaaatatcatatattttagcagtttgatttttaaaagtttatataatcatattaaaatattgtattttttctgagctttgtcttagtaattttgtttttttaaagaatctgtgcataaaatatgcaatatcctttaaagtaaattaggtttgtttgtttttcttttttgctttcttgtagttcaaatatgaagatagtttaaattccaattataaatttaagtataattgtcaattttgaaaatctctctgaaatgtagaacaaatggattaggtcagaaaattaaggatttaaagaatgccctttgttgcgtaaatttaagtgctcactgtccttacggcctaatgctcgaaacagtcacaaatttttttaataaagctatgctaaaaaaaatccaagcaccacattggtattaaataaattttaatgaattgcctgttctctcacttctctgactaaattgtacccttttacataataaaatgtataattttcttttactaaaaaataaataattaattattctatttatcatattattttattaaataagtaaataatagtaacttttaataactgttagtatttttatttaagatgcatacttaagagagaaataatgtagtattttaaatatgacataatctaccttaaataaagaatacaaatgattatgtattcattttaatatactttgcaaaattcaattatttttctttcatgaactggctttggttacttattctgaatctagatataatctaaatatagttgtatctttatactatatattttatacatcaaactaagattaaaagtttgacatatcattttgaaagggtcttcttgaacttcttataaaactcttgagtatat

SEQ ID NO: 53212 - DNA, 1288 bp, Bovine  19866881046230
acctatgatagttttgttttggatcttataagcaactgtctttttctttgctctgaaaacaacacaggttctgccccagcaggaaaatataaaaattaaataaaaagccacaaggttattaagcatcttaccctctgggctggctgggctgctccggcggctcagtgttacagacacatgtgtaaacaggagaattccctgcatccttttctcatctgtatagctctggggtccaggccaacaggattatttccagcattaaggccactccacactaactcgaagaagattcccattggttgtgaagttttatcaaaaccaataccacaacaccctccgtggatcacaagtgagcgatccgaaaggaaatcgtttgactgttccctaactcagcaccgtaatccaatgcttctacacaacctatttgaaattttactgtgcataataaaaggagaaacactcaccccttcatcacccaccagtgtgtttaatgtttaatagcaatttgcataacttgcagcagtaacagaaaaattggcaaacaaaaagaatctatctgcaaaagatttaaagaaagattataatgcagatgacaggaacaataggaagcatcattggttcagtctgatctttattagactgtgtccccaaagaaaaaagaatatgtaataaaccacttgggtatagaaatcaagatacagaaaccgtttgtcagaacctttgatttcagtcgtgtaggcaagaactgtgagctgcagactcctgggcccccagaaagagctctctggcccttggcctgggggaaaaaaaaacaaatggagtgaccttccagagacatgatgcagctgtcaggaagtgttctgatgaatgggtgatggcagaccacaaaaaaaaaattttttttctagttgaattaacagcatggaatgtccaaagtttttttcagaggagagggcagaaaaaacagtcactgtattcttatattaataaatagcatgaaaacagcatttgaaagttagggagttaatattttcaaatgattttattctttctccctttttaatccagaggaatattcttggctgtataacctgcttgtgcttagccgctcagctatgtctgactctgtgcaaccccatggactgtaacccgtcaggctcctctgtccatgggattttccagaccagactactggactgggttgccatttccttctgcgggcgatctttccgacccagggatcaaacttgcatcctggggtgtctcctgtttgcaggcagattcttta

SEQ ID NO: 53213 - DNA, 1819 bp, Bovine  19866881095696
tttgaaagacagacttcattaaggaagatagtgattagtacttactccctttctttcctaagactttttggaaatcatccaaatgcccctgcaaagctgaaatttcaggcatttcattctccagaggcagatttattgcctgcagtcttaatccaggtctcactgtacaattttcagaaatgccattcttgaataaatcaggacagtctagactgagtttcatctcctcacttaattttaatgggtcaataatcaaactcgcttcctgaaagaaaaaaaaatacaaaacaatggttagtgttgaattttaaaactaaatatatagaaatcacgaaaaaaacatttttgaatggaaataaaatgttatgattcaacatcaaatttttattttcatttattcatcattctctaatagtggtatatggtcaaagtttaacttataatttctcaggctttttttccctttctatgtcttaccttattctaataaaacaagtatctccacagtgttttaaaagttttaatttacaatgaaatctacattatatctaccataaaccctatacattatggaaaagcttaacattttagatggaatcatagaacagcaagatattatttttttgttttagaggtagaattaaatagaaaggagtaataatataaacagtaaatagtgtaaactatttaaagagataacatgaattcgtagtttccttaagcatgttctgtgggttgttaacgaaagaaagtgaaagtgaaagtcgtttagtccagtccaactctttgcaaccccatgaaactatacagtccatggaattctccaggccagaatactagagtgggtagccttgcccttctccagagaaccttcccaacccagggatcgaacccaggtctcttgcattgcagatggattcttttaccagctgaaccagaagggaagcccagtatttatcaaattacaacaggaccatgcaatcccactcctgtgaatatacccagagaaaaacatgccccaaatgatacatgctccccaatgttcattgcagcacggtttacaatagctaagacatggaagcaacctacgtgttccttgacagagtcatggataaagaagatacatgtatacaagggaatattacacaaccattaaaaagaatgaaataattccatctgcagcaacatggatcgacctagagattgtcaggaaaaacaacacatgtatgactgaatcactttgctgtacagtagaaatttacacaacactgtaaatcaactataacttcaataaaataaattaaaaaaaagaaattggaactatctcaaacatcacaaccatagagatgtgctgtgctatgttgctcagttatgtctgactctttgtgaccccatggactgtagccctgcaggctcctctgtccatggggattctccaggcaggaatactggagtggatttccatgcccttctccaggggatcttcccaacccagggatcaaacccaggtcccccgcattgcaggcggattctttactgtttgatccaccagggaagcccaagaatactggagtgtgtagcctgttccttctccaggggatcttcccaacccgggaatcaaatcatggtctcctgcattgcaggtggattctttaccagctgagctaccagggaagcccaactataaagatagttccatttaataagtgatgcacctatgtaattgcaaaaaataaaaaatcagggtaccatcttttacatggttactctacaagcactgtgacatcgttaggctgggatagataaagccaggaatatt

SEQ ID NO: 53214 - DNA, 1510 bp, Bovine  19866881120285
tggtcttaactgagctatccctgtatagggatttcttccaggaaaagataaaaccagaatttttggatttatgaggcatgcatcgctggaaagtgtcctgtcagctggaatagagaataaagatgttcacagatagactactagccatggccactgtgtaactcccttagagatcttatcttttatctttacaatcctctttaatcatcattctcaaagtattcatttgtgtaggctaattaaatatcagctgacttctctgtaatatatttaaaattttaaattagtattggttaacttaatcagatactaaaacatctgatttcaacctatcatttttctttaccactttatgtttctattagtacaagtaaagtaggttctgagtagcctaattttctttcataatacttataatagcctcagagttaagtcagtcatatcagtgttctgagggttaccttgacgatgtcataaattatccactagtagttcaattaattctgacttacataatttagtgcttacattattcttaactacgtttgttttaaaaggtcttgaaggcacttgtatgagcaaagtgatgtcccataggcttcattgttcttatacatttatagaattctaatatggtattttatcagtatcactctttctcatgataagctaatttatgtcttgcaaagaacaagttgaacagattttcatgatgcatgggacgatagatgtgaaggttcacttcagtgccctggaaaatctaaaatcttcagcgatgtacgcagcagcctctcaggtgataagaaaactagtctaggatttcacctactctccccaggtgctgcagtgttcaagaatctgcccgccaatgcagcagacacaagagactggagttctatccatgagtcgggaagatcccctggagaaggaaatggtaaccgattccagtatacttgcctggaaaattctgtggacagaggagcctggagggctacaatccatgagatcacaaagagttggatacgactgagcgactaacactacaagtatttaaaacaaatatttataaaagaacactgtaactgataaactactagggatgttgctattatcacaagaagatagatttctaaacaaagtccctaaaaagacaccagacaaaaaaacaaaattttcaaagaaagatttaaaagttacaatttcatatttagcttaaggccaattttaaaatacctagcagttttctctacatacagtaaaaaaaaaaaaaagtttcaattatgtaaagaattagttacttattgttaaatcaaggtattatcagtcagttcagttcagttcagtcactcagtcgtgtccgactctttgcgaccccatgaatcgcagcacgccaggccttcctgtccatcatcaactcccggagtttactcaaattaatgtccatcgtagtcggtgatgccaaccagccatctcatcctctgtcgtccccttctcctcctgcccccagtcc

SEQ ID NO: 53215 - DNA, 1522 bp, Bovine  19866880548561
aaaaaaaaaaaaaaaaaggaaccccagggttttaatagctgtaagtgaccatcagccccacaactttattttcacattgccatcaaaacaagccccttaatttttttttaatggaggatagatccttttgaaaaggtgactcaataaatgctatgtggaggagggaggagggttcgggatggggaacacatgtatacctgtggcggattcattttgatatttggcaaaactaatacaattatgtaaagtttaaaaataaaataaaattagaaaaaaaaaaaaaaagaaagattctttttgccaggcaaagtggaatatttctgaaagtaaattgtatttctgagcatattaccttgtattgcaggtataagactgaaattcatatcacctcttgaagatcagacagtgaaagaaggtgaaacagcgacttttgtctgtgaactttctcatgaaaaaatgcatgtggtctggttcaaaaatgatgccaaactccacacgagcaggactgtactcatctcctcggagggcaagactcacaagctggaaatgagagaagtgacaatggatgatatatcccagatcaaagcccaggttaaggacctcagctccacagcaaacctgaaggtcataggtaaatctgaccagctataaccagagagctgacttttggatggtgggagtgggtaacagttaacattttgcaatgtgtaaccctttaatttcactttgacgttctctgatcatctgccaaatgtcccttacagagggctgacccctacttcactgtgaaattgcatgacaagacaggagtcgagaaggacgagattgttctcaggtgtgaagtgagcaaagacgtgccggtgaaatggttcaaagatggggaagagctcctaccttcacccaaacactccatcaaggcagatggcctgcgccgcatcttaaaaatcaaaaaggcagatctgaaggacaaaggcgaatacgtgtgtgactgtggcacagacacgacaaaagcaaacgtcactgttgagggtgagttacacataatttctaaaggtaccccatctgaatctgcgattgctttgttcagtcattcttacaaaactctgtataaatttcagcccgactaataaaagtggaaaagcctctgtatggagtagaagtgtttgtgggtgaaacagctcgctttgaaatcgaactttctgaaccagatgtccatggacagtggaagctaaaaggagagcctttaactgcttcccctgtaagtcgcaatgatctgatcacataggtgggggtggggcgcttgcttgctcagtggtgaaagatgggtacatttctggtacaaaatctcttgattatttgtaggaataaccagttatgaaaatgatgtttttctttctctttcctcctcacctcactccaaacaggactgtgagatcattgaagatgggaagaagcatattctggtcctttataactgccggctggacatgacagggcaaggtctccttccaagctgccaatg

SEQ ID NO: 53216 - DNA, 1036 bp, Bovine  19866881289993
gtatgtaattggaattatttaaatagatcatatcatcaacatcatgatcatggcttgctgggcaaagatgtatgaatcacaagtttaatccaatagacacaacttcttctcgaagcttcattgtatcaatgatttttttctaagaatatctacctacttcatttaatgtaaacataaaaaagatgataaacagattgttgtggtaagcataaaataaagccaaaatacttgaagtacagaagcttgtacttgaagttcagtgcaacaaacttatctctctctctaaaaatgaaagaagaagagagactattttaatagaaattctaaaagtactgcaatttttttaaaatgcttacagttgtaaagaagcctgtagttgaaaaaattgaaaagacttctcgaagaatggaggaagaaaaagttcaagtcaccaaaggtattattattatttaaaacatttcatgcttctgggtagtagctgaattggtgatttttttttccccaccacattatattttttataccttccaaatattccattgttgttattcagtcactaagtcatgtctgactctttgtgaacccatgaactgcaacagaccaggcttccctgtccttcactatctcccagagtttgctcaaattcatgtccattgagtcgatgatgccatccaaccacctaatcctctcttgcccccttctgcttttgccttcaatctttcccagcatcagggtcttttccattgagtcggctcttcgcataggtggccaaaagtattggagcttcagtttcagcatcaatcctttcaatgaatatccattacgtacatctatttttcaaaaaaaattttctctgtaaattggaaggaatttgacttcaaaaaactgataataaaacatttcaagtaccatgtacacaagtaattgtttactaatatatagtcacatgttaattatttatatagtcctctaaattaagatttttaaaattttgtgcaaaacaatattcttcacaatacaaatatatttgtacata

SEQ ID NO: 53217 - DNA, 1052 bp, Bovine  19866880540221
atcattttagccagattttaggaacatctgactaggctccaagtctgcaggaagaggaaaatataacaggacaaagagctgggggctgcgccatctcgccttcatttccatcgctagcctggcttttgaagggaaaatgtttaaacgcctgtcttctgtgttgtcactagcactggatggagctgagttcaccacttaaaaacacacatttaaaagctcatctgagtggctgccaccatgttatcaagctgaacacatgttgatctgagaagattagaaaaattgttcccagtgtctggggaggcagtgcttttaaacaagtgcttttcaaagaataagccattaagaagcacttggcacacatgtagcccctgaacctgaaaacaaataaaactcacatcagtacccaatcagtaactctgagcagtagactagagaatctggctggcttattttagagatgcaattataaaaggttgctattccatttatttttcatttcctgaacacttaatgacgggggaatcaaaaatcatttttatgttggacctgcacattttttattaaaatatagttgatttacagtattgtgttagttttaggtgtaccatatagcaattcatttatttttttctgattatattccactatagattattacagtatattgaatataaatcctgcatttgtagcatttgtacattcttcctaatcaactagggaaaaaatcacattctccttcatattttactttccttttccaaaaaggaattaagtttttgtggaaatttaaatttgttccttccatttaccaagaaaatggtattactcttgttttcaatctgttctatctcagtttagtttcaagttgagactttatttcatttccagccatgtaaagagtggctgggattcctctattacctcttacttttggacataattgcttggtgaggcaataagcctactgggtaaatcaaactctctacttttcactctatacatatgcttcagttatgttagaagaaacccatatacaacacttccttctg

SEQ ID NO: 53218 - DNA, 1309 bp, Bovine  19866880589426
ggggttaataatattttggtcccaaacatgtagtcaaaaagaggtcacaggcccttggggagctgaaagaaatattgaaagtgattgatccttgacaatttgttaaaatccaagaacctttgtttaaacaaattgccaagtgtatatctagccccacattcagggctatcgtggcatcagtgtacactgtgttgaaaggcgtgtatggaaataaacagcaccatgtgtgatgagctgtcagccttgtaggagacaggtcatcagcaggagaaaaagaaagaacagaacgtgaaggactgtgggaaaaaactggaggatccagagaggtcttagctgtgacaggataattccaacttactgaaaacaatgacaatgacattactaacctgcagagtcacacatttatggagtcggagatgcagcaacagttttctttactgtgcaactttatagtagagttcacatttgtttcattattacaacagcactgtgtatacctgtctctaagtaaaggaccaaaaaaaaaaaaaaaaaaaaaggacttcaaagtctagacaacagatggacttctcagagcttggcaaacataatcattgttctacctctcttaaaaaaagtagtcttcaaagatctgtcaatgatggagaagaaaatggcaaccccctccaggagtcttgcctgggaaatcccatggacagagaagcccctaatgggctacagttaacggagtcataaaagagttggacaggacttagtgactaaacaacagcaatacatacacacacacacacacaacttgttgcagtggaaaaaagaatctgtcgatgaagttgctgttataaatttcattattgggagttccatcttcagctcatgatttccaggtcaccataggcatggatgccaaagcgggcagagtggagaataacacagaggaagaagcttttatgagctagacttgggagtggctggatctcaggagtttcagtggtgagaactcggtcacacgccacttggacctgcaaaggagggtgtgtccacaaaggaaaggaaatgagttttggtgaatagttagcagtctctgtcacagatgtttctggtgaatggttagcaaaatctgtcatagatgggagcagttctgaggataagacatctgacttgttcgtctttgcaaagtggccaagcctagctgtatctcaaagagaactggaattcaagtactcaaatataattcaagtactcaaatataattgttaaaaaatactttatgaaaaatattaccttgtaagagatccatattatggataaa

SEQ ID NO: 53219 - DNA, 2152 bp, Bovine  19866880707307
atttcagagtgtattttagacattattttagtatttggttgtttatgaatattactactaatgcaaagaagtatttgtatacattctagataatggtttttttgatatattaagctttcacatgggaaaagataagaaaattaaaagtgaaataatttataaaggaagagtggttgaaaagcaatttgaaatcttattgaaatggatttctttctttattgggtctggtcccatcagggaaacataagtactaagtcctattgatttcacaagatatatgattttagatctgagattaggtgcacaatcagcagtttctagagataatgacaaatagctgggaagtcagggacgtgtcggatatggactaagctgcttgaggatatgggttgtaccttacacatacttttatgtcctccgctgtggagagcactgtgtactagttgaataaatgtttttttttttttttttaattttgtctcctaaattaaccaagtctagaattgatatttttctaaaatacggctgattaaatctattaggtaagcttgtatcagtaattgcatagtttaaaatatttagataaccaatgtgtagatctgaacatggaaatcacattgaatggggaaaatcagatgggactcttgagagcatgaaaggtgaatgtgtgagtgatctcacattcatctcttattgcaactggatatacagctgaaatacttactgtcattttttgttctgatcgctaagccttaaaacgtagactattttatataggaaataactttataaatttgttgattctaattaattctttttgtaaaatgattttgcattaggagttattgatggtaagttttatccttggaaattggtctatatcaatttatgtatcttctgagtgagttccgccttgagaagcagctggcagtcctgtgcagtaatcagaagagacaggatacattttggcttgttagagcctgcagggtcagcctcaggtcaccaagtttaactggaaaacaactcacttagactaagaaagagcaaaagttcatctttatcctcattttttctgtaagccttttcatgtctcctggcatatttttaatttgggacaaattatagcacaatgagtttattttcacagtgttgagagaatagagaaaattttcaatgaggattaaacagtctgggaataaactcacctaaaataactcccatccttttgcttgaccttcatactctttctagttaatcattcactaattcgataatttgacataaatttgttgagtgtccaccatgtactagactctgatctaagcactggggctgcacattgaacacaatgataaaacaaatgtttcctcccgccccctttttctttctgtgatgggcagggtacacaccggttaggcaccatgggttctggaggcttgcattaaagtcctggctctgatgcttactagctctgtgacgaacttgtctgtccctagttttctgctctgcaaaatgcaagtaataatagtgcctagcttacacggtgctgaagtgaggattaaatgagaagatatgtgcaaagtgctgagaacagagtctggcacttaacaagttccatgtcagtattagtgtagctagttattattattatttagatgtttaacactttgaatgcaccatttgtagttgatgcctttaattcttggtcaccacttcctttcgaacctcctttcggtggatttctgactaaactgaaatgttgagacttcctgctgctgctgctgctaagtcgcttcagttgtgtctgactctgtgcgaccccatagatggcagcccaccaggctcctccgtccttgggattctccaggcaagaacactggagtgggttgccatttccttctccaatgcatgaaagggaaaagggaaagtgaagtcgtgtccgactcttcgtgaccccatggactgcagcccaccaggctcctccatccatgggattttccaggcaagagtactggagtggggtgccattgccttctccatgagacttcctagaaggttacaagtgaacattcttgtgaatccagaaacctttcatttgtccatatttttctagttttgcaggatttaagactctgctcccctatcctctcct

SEQ ID NO: 53220 - DNA, 903 bp, Bovine  19866880738023
tgattcttgttgagaaagaatcacccaccacaaaactcacctaaaatgaggataaataaagatattaaatacttctcatgtttaaaataaagctacatatttcatattagttgtattatataattctaacacagcaatttatgtcatttgatgtttatcaagaagatgaattaaaactttgattaatgaaaagaacatgtttcatatttatatattctctttaatcttttgtgtgaataagaaaggaacattaatctctgacaaagcaaaaagaagcctcagtgtggggagaataaggaataaaccacaatgttaacagaaatgtaagaactgatgatcattttcagtttctaggaccaacttctagctattctgaacatttatttttgtctttcaatttgaagtcctatcaggaaatacaaaaaggaaaacattcatttatggtcttcatttccagaataaatggagcctcattataaaatatccacactcttctactgcaattaatctgttcacaagaagaccaaattcagaagattaatggatcactaatgaggactgctgtccatgacagaatgactaccatcatcacctcagtcacggcactacatgacctaagtgttcagtttcttccacaacaaattgcaacacataactgtggcactaattctgtttccaaaacagcttggcattatgtgttcctgaaattttatttatattctttttcacttttgcaattataaatacctatagttaagggtcatggaaaaatgttggtaaaatctgtcctatagccctaaatgggcagtggatatcaacagtatttgtggtgttcttgggacagcttttgtgcttcaaattgtttactaaaggagctaattttaggttgaataccaataacac

SEQ ID NO: 53221 - DNA, 2036 bp, Bovine  19866880740423
aggcctttcttaacagagtgttccgggtggtaccttcgattgacttgcagttgattacagggatgaaacaaactgattcgccatctcagtgtttccgaaggctttggagaccgggagattacaaaataacggagcctccatttatcccaatggaaaaagaagacaatatagtttgatttacataactgatataagatttagaggtaaaatatgcaagagcactcagtgactataagtggtcattcttataaggtcactgctgatggggcgcaagcagaacgccacagcccagctggagaagaaaggcacttcgtggcctctctttgttgtctttcctcatcttgtgacatcgcagacccaggtatgtatgtttcaggtctcctccaaaaggactgaacagtctcaggtcaggatggcagctcaccacccattggctcagcgagttaggacagtcacgtcaggtcagcattgtgtccctatagtaccccagatctgcttatgcttctcagtctgaagggctgaagaaagtcctttgttcaagcctagttcgatttctataaaatacatatgataatctgactctagagataggtatattgatgatatagtgatggattcactaagagttgttatatattttgaaaaaaaatcaaacccttaatgagtagcaagtctatttaaagaacacctttctttgttgaaaatagaaatgtttcaactttatttggaatcatatttatttaatgtgcaccttaaatgtcttgaaatatgtcattattagctaagatatataaactcctaaaggctagaaagatgtctgcttcattaatttttttagcacacccacaataatgccatgaacaatgagatttttaatccatttacatgctacaattgcagattggagtataaactgtgtctcatactcataaagaatgctatttcattcttagtttaaactttaagaaccagaaatcaaatgaagcagttctattacaacagcattgaatatccttacatgcagcacaaatggataattattggtttattttaatttttaaagtatcagtactaaccaactttctatgagagaagcctgcccaagtaggaaatgtgaaagatgctgaaaactacatggaaaaaataaaaagtcattttaagtcccttgctggaagataatcgtgttgaataccttaatatttgtttcctgtgtgattcattttaaggtgttattaatatgctctaatacttaatgcatcttaagacattcaaatgtttcttaccatgatttccatcctttcagttagtgatcccatgttcttcccaggaagaattattgtttttttatctttcaatgcattgaaatgtgttatgagttaaaggaaagagtgctgtgagcagctggtgactgcctcctattgagaaggaaagttgtgattactgcaaaggaaaatctaatccatcttgccccagtgcacttggtcttccagagccaggtgaactacctttgactgtttccccaggattatgtcacccaccaaggtaactttctttttcaataggcgatgttaagaaacaaaacaacaccctttaagttaatcacttttggaaaatagagaacggctttatattccaaggctttgatgtgtttagtggttcctgtaaggctctgcctcccttttcattttgattgacaagacctttcctatatatttgagcaatcaagcagcccagtcacagagggtagaggcatttacccagagcaaacttgtaccactcactgcgactttccaaaatcttgagtacaagtttcagctttacaggcgagtcagctccagtaagatcaggtaagtgcttctccatacaggaacttcattctgcctgagggtaagtccagagagccttgctaaggtgacaggtcagaagtaggaactgggagataagtttgggaataaataactctgcagtctaaatcataatgaattggaggggtgttcttcaagtggagagtccaccctcgtttcagcattcaggta

SEQ ID NO: 53222 - DNA, 1809 bp, Bovine  19866880749383
ttgtcgtttagttgataagtcaggtctgactctttgcaattctttggactgcagcacaccagacttccctgtccttcattatctcccagagtttcctcaaactcacgtccattgagtcagtgatgtcattcaaccgttgcatcctctgtctcccccttctcctcttgccttcaatctttcccagcatcagggtcttttccaatgagttggctctttaaaattacaaatgaactgtgcttttaagaaagtagaatttctgcttttcaatcaaactgattaggaagagaatatggcagacctatctttttaaaaaattattattcgttaaagtgaaatttcctgctccctcccttccccactgtatgcctctttcctctcttgatttcacactctttcccatgcccaataataacttgattccaaagaaggatctgatcataggatgtaaaaaagttgcaaaggttaagccaaagtgcctcaattttccctctcacttcaactgaaagtgcttctcagcttgtcccatgggagttctcattcattctctttaaaggatattttccaagtataactggtactaaaatattgcccctccctatttcctgtattcattgtcccaaatgtgtattttggtctatatccatgaataccaagctctggatccatctatgccctgcttccaaaatgatgtgctctatggaacagggactttggccctggggaagagactcttccaaacatccagggattcttgtatctcagagtgatttatttcctagcttttaattagagactgtgaaggcttctaattagtcttatttgcttacagttatcctggaaacacccaggtaggcactttatttttatttcaactgcataagcaaagtgcctctttgcagcatgaaattacacgaattttagtttaagaagtttctagattcacactcctgttggaaaaatcctgtctttctagttctttatgctcctggaggaagcacatttaaaaaggagcatacagtattggtcttttctgtgaagaccttccgtgacacccccccctagttttttgggttttgtttgtttgaaatttttgaaatgtgctttcctctcttctatatttcaagttctatttctcttctcccccgtctagttgctgaacattttcttgaatacacacacaccccacctaaaagaaaacgggagttttgtaagtcaaagcttgacgtttagagaaaacaaggacattctctctttgtaaatggaaatcaaccatgtataaactgtaactctgcagactttgagttcatcctttacaaacaataatgagcatttagccctataataaatgaagtgccgttacctggttttgttacattattgtgtggttgctgctgctgctaagtcgcttcagtcatgtccaactctgtgcgaccccatagacagcagcccatcaggctcccctgtccctgggattctccaggcaagaacactggagccagttgccatttccttctccaatgtatgaaagtgaaaagtgaaagtgaagtcgctcagtcgtgtctgactcttagtgaccccatggactgcagcctaccaggctcctccgtccatgggattttccaggcaagagtactggagtggggtgccattgccttctccttatatcttgctaaagagccactcctcactgatgtggatgaaaaattgagaacagtgtgtttgctctgccaagggagaattttccagatgtgtgcactcaacaggcaaatggttccccaggtcatcacctccctaatgggccacagagat

SEQ ID NO: 53223 - DNA, 928 bp, Bovine  19866880875509
tgtatatagtatatacaatataaaatatacacacacacataaagttactgtgcacttgttaccaaattctatgaaaaaagataaaacctaataaaatagcagattttaccttggaacctcccaaaatattttatatacactaaaaggtacttgctgacttttgagatgattcaacgtttttctttgtctctatcatctcccactaaaatagcatatacataaacatcttatgcaaccacaagctcttcaaccaaagcatattctggtctgaaaagtctttggggaaaaatcattaatctggtatcttatttattaggtcacaatatggcttttaggtagatttagaaataaatcccaaattcttagctctaacccctcacacaatatatttcttcaaatattgtggtgtatgctttggcaacaactccttgctttgcattttagttagcttattctaaactgaatttcaatgcaaattttttaaaattacataaggagagaatttctgtgctttggccattggcctactactttaaatccatattcaatacaacacaattcccatagacacaagaatcgcaataattcttcttgagttatagtcattaaaaggatgaaccttatagtatgtaaattatcccactaaagctatttttaaatgtttttaagggttttgtttcattttgtcttgtttttttagttcatcttaaaagagggcaattcataattgctctgtacacaacaaagtgttttcctgaccaatggctcctttccttctggtcatacagggaatcaccagattccagggtcggggaaggaacggcgtcagagggcgctgcgggggaacctgaagtctgcgtcactcctggaaccaccccgggccacaccttaccctgttgcatcaatacaaacacacagactctttgct

SEQ ID NO: 53224 - DNA, 1403 bp, Bovine  19866880887096
taataatgaaaaagtctgaaatattgcaaaaattaccagaatgtggcacacagacatgatgtgagcaaatgctgttagaaaaatgatgctagtagacttgctcaatgcagggttgccacaaaccttcaatttttttttttttaaagcaatatctgtgaagcacaataaagtaagcctgtatagccataccaggctctctccctggacctggacttgttcccaggtccatctctagccattggctaagatgcatctaagatcctgaatcagatagaatattctcttctacttgtccttctactcttcctgcctgtttcatgacctgactgaaaatattgccactgtctagagctttctgctgtgcttcactcccaggtatagatgacagcctacactggaatcaagctcatcactgaccctttggatattaggatttgcatttacttgctgtccagtttcattggagccaaactgtaggaagagcggtttgaaaccaaagagttctaaactggaattttggttctgacactttttagctgtgcgaagagtcagacacgactgagtgacttcactttcacttttcactttcatgcattggagaaggaaatggcaacccactccagtgttcttgcctggagaatcccagggacgggggagcctggtgggctgctgtctatggggtcgcacagagtcagacacgactgaagtgacttagcagcagcagcagtgtaaccggagacaaattattgacttcttcgagccttagtttcaccatctgtcatttgggggtatagaatacgtatcttgaagagaggattactgatttcctatgacaagtagctaaagcagagcctcgcatatagctggcactcaagcctccccagcctgcctgatctagttcgtctgtcccagctcctttctcccattccactagcccacaggacacagattctgtcctatgtctgcagagttgcatcaactatttcaggctgttttttctctcttgatttgagctgagttgactgctttaacttcctgagcttatgttttctttttggcccatatcctttaaacaaaaactcttttttaactgcctctagtttacacatctgagccacctttgatctatttctttctagcataagagccatttgttctcttttggaagtaagttagatgcattttcaaagaacactatagtcatctccagagaagacattggcctgatctccccaaagatgaggtatagggtggatgacattcattatattcacatgcaaaggatgttcttagaatagggggacatttcttgtgcatttttaaggctgtaacaatgctttgaactgcaaataggatgtaatgtgatggtcctttgtgataagagtatttttgcaagatttcca

SEQ ID NO: 53225 - DNA, 1912 bp, Bovine  19866880893723
aaaaataaaatacaattaggaaaaaaaaaagaaaaaaaaaaaaaagaaacctatagcacagtattttatagagtagaagggagtagctatgatttttttgacagtgactgagtaaatttctgtaaaggagtcttttagtttagttaatatttatcttttgctttcattgttaataacagctgcttgctagcatggaggaacaatgcttccacattctccagcctttagtctaggaaaaggttgcactgtcttgtagttaagattcaccacaagagggcactataggttctgccacaggtaaactaatttatatctgtttctcttttctgtccttttcctcaagtttgggggttaaaactcaatgaagttagctgtcactcttggcagaaaatatctaaaatagaagacccataagaaagtgaaatgaagaaaggaattgcaatcttatattagttgatgataaccaacattttctgactgactgaatgtgatattagtaaaaacagtttatggaaacaaattcaaattttagattagtataacattcgctttagcagatgaacaaaatgttattgtaaccatctcaatgtggtgatagtatatataaaatatgaagttttgcagaataattatgtataaataatgttcacattagaaggatgaatacatattttctgtttcaacaaaaaatttcctcatcagatgtcttaatataattttgattaagtttgatcaagtagaatcagttcatgataatgctttgattttattaaaagatagtttacagatttacagatacttacctaggatgttacatgattctagtagttcaatgttatacaaactttaaaaatgaaatacagagctaaaataaatattcttcaaagttttccaaacttattaaactctcaaaaaatatgattggaggtatagtactcctttaagaggttttatttcttatccgtcatcaagtttgaatcttggttttagggattttttttttctttttggtagggttagaaaccatattttgagagatgctctgaaatgtcctaaacaaaatcaagttttagtgggaaaaattaaaatgtgtcatacagtacttttgtgaataacatagatacagtgtgatcggagaaggcaatggcaccccactccagtactcctgcctggaaaatcccatggacggaggagcctggtgggctgtagtccatggggtcgctaggagtcggacacgactgagcgacttcactttgacttttcactttcatgcattggagaaggaaatggcaacccactccagcgttcttgcctagagaatcccagggatgggggagcctggtgggctgccgtctatggggttgcacagagtcagacacgactgaagcgacagcagcagcagcagcagtgtgaaaacaaataaacctgaataacaaatcacaaaaccagtggtaattattgtggaaattgaggtcaaagaaagtagtctttatgtgttgtaagaaatggacatttgtaaaatatttttctttactaatagaattttaaaaaatccagtctcatgttcttgccacacacacaataaagcagaatagtaactatgtgaaacgatggacatgttgattagcttgattgtatacgatatgaaatcatcaagttatatactttaaatatatacaatttttatttgtcagttatacctcagcaagcctgaaaaaacatcctcagtgtatttcactaaatatgctagcttaataatgtaggatataactccttttcatcattgaagaaggactaaaaagagtcatttgaatattctcattttatataatgtagatgttttaatattagaaagacttggtctgaaagatagtgatcaaatgaacactgacaatattgtcacatatttcag

SEQ ID NO: 53226 - DNA, 1709 bp, Bovine  19866880932968
ttttcagtactttttcctgtgtatgtttgtatatgtatgtatgtcttttcattcaaaatgattactgattttttgaaaaagtgttccctgttacatacttactgtagaaaatttggaaaaaaattgaaaaatacaaagcagagagagaaaaatcccaaagatagctagtatttatattttggtatttttaccctttttttgtttcaatgaatgtatcttaataatggtaaaagagggcttatttgatccagaagacttcatactttaaatatgataccattaattgattgataagctaatcacaaacacaagcaatatttcctttttgtgaggatgaggttgacacattctccttgaaaaactgcaaaagatctgtcttactgttatatggtgaagagagttttatcgagtagggatgtagtaagaagaaatgaaggaagaagaatgtttgcaagcgcaactcacctcatcgtcgtcagcatcgtactgggcatagtgctgttcaagcagctctctctggcgcctttcttgttccagcgtctggcttatcaactgggcaacctcactcacttgtccaggtttttctcgcccaataacaaatctacatgaaagttaaagagaactggtatagtcaggctctccagcaaaaaaggaatgctaagcaaagtaaataagcttcacatttcatcagagtatatcaagcctcaaaaaaataatattacctgtttttttaaaggtatgcttgggtagaaggaaaggttagctgagcaattaaagtgatttttgcagccacagaccaaaggaaaagaggaaaagtaaagaaccacaaaaattattactttaggagaagacaaaacagatgtaatccatcctccagtactttacacatttttgatgccctacaaaatgaaagcaaggtcataattttctgtaacactgaactttagaatcatttccacagttacattctctttatttattttttattcaagtaaattttattaaaaattaactctattcaattcctttttgctatgttctttgtcttccaaacttttaaaatcacaatataattttcgtccttttcctttctaaagtttttctctaatacatctctcctaattttaatgaattaatcactttcacaaaagactttttttatttcacaaaagactttaaataaatgtttttacctttctcttcaagtaaagttatatgtttttttttgtcacccctcatccaaaaatgtccaaatatgtgagttatttactggaaaatatttcccactttgcaattaatcactgtttgcagagaggaaatataaaaagtcataattgtttcatagataggattttcttcttgtccaagactattctagcatctgccaatttaaatctttttttttttttttttttattttatgatacaatagaccagttagacctaattgatacctataggacatttcattccaaaacaatgaatttcacctttttctcaagcgcacatggaaccttctccaggatagatcacatcctgggccataaagctagccttggtaaattcaaaaaaatagaaatcatcccaagcattttttctgaccacaatgcagtaagattagatctcaattacaggagaaaaactattaaaaattccaacatatggaggcgaacaacacgctgcgaataaccaacaaatcacagaagaaa

SEQ ID NO: 53227 - DNA, 2174 bp, Bovine  19866881049798
caacaaattagtgatgattcaagaggaccatcgtctaatctgtatcccctttttacccttcagcctttcaccttcttgtctagcagagtctgcagttccatcttcctatggtgtttatgaccatgtggttgtttaaactgctgattgtgggttccagcagaaagacatggtgttattatcctaagagtttggcaaacaacccccttaacttataaaacaaatacctgcattataaatgcatcaggatgcaaaagttaaattataaatgtttattatccttccctttcccctagtcctcactccctgcccccttctcctgaggagggaaagtgcctttgggtactgatttcctctcctccaaagcccaaaggagagcaccaatcaagccttggctttcctgcgttggccaaaggagccatctatttaggaaggtgtgctggtgatgaatgaaggggaggggcaaaacttcacggctgtggtagactaggaaaaatactgagaaaacaataatttttaagaggcagtgctgtggtttatgggcttctcagatggctcagtggtaaaggatcagcctgccaatacaggaaacacaagttggatccctgggtggcaaagatcccctggaggaggaaatggcaacctactccagtatccttgcctggaaaactcccacggacagaggagcctggcgtgctacagaccatggggttgcaaaagagttggacatgactgagtatgcacgcatgctgtggttgacggtttgaatccccctttggtccctttatcttttacttaaggtcagaatggtttatgaggactttggggggttagtgtcatgtgtccttgaacgtgaaaccacactgacaccataccacatggttctccacttttgctacattttttaaatacttgaaaatgtacagaaactctactaaattaatggtctctcatctaaaacctgacaaaagagtatcagcaaaaccatgaacaagaattcaaagcctcatattgttaatcctctgacccagttgaactcagataccaagcatttcatgaaaccttcctccagctttgggtgacaatgaatgcataccacaggctgtgagagtagctgtcattcagagcattcctttactggctatgagcctctccttaataggactggctagcaatgaacttcacattgatgataagcatccccaaaattatacttttcttttcggatggtttgaagaaaaacaactggggaaaaaataggtgaataaggatatagaaatggtagatgttaccttacagaaattctgagaaaataataaagttatacaagacagtctcttagatattcattgcaggaaaagatccaaggactgttttatctcaaattgtcacacatcctcctttgatcataaattaaccagcaactattaatatttcttgacagttcttaagaactagaaaataaagttgctacctgaaaagaaccctatattagactaaagtaaatgaaataaataaagggagaaaactacaaatacataacaaagaccctgaataacaaagaggcagatgagtaaatataatgcagaacaacaaccatgcacaaaagcagacaacagaaaaatcacttaattttctccaaattatcttgtaacacttaggaaaagaaattattgagagcagaaatgcacactgtaaatatttacatggctaatttatttcactctgcctagacattgttctatatttaaaaccaatttactgctgttgtctttaccgttcatatactccttttggtttacaactaatacatttagcagattccaccatcctcaaatgcacaatattttcttgggtaccttggaaatgcaaatacaggtagagcattagtggttcctcataattctctgaaaaagatgagttgctctgcaatacacagttcataaaccttcactgcggtagaccgattcatcacgtgtgtcctccttgtaaaaacataaacttggtcctacagcctaaaataaatctgggtaagcctgaaacagaattacagaggggaaccaagaagaagtggtagaacttacatgatgggagacaacttagttaacattgaatccaatctacatataacagcaataacaatgacaaagtaactacaactgttgagcacccaaata

SEQ ID NO: 53228 - DNA, 1418 bp, Bovine  19866881385101
ggtgatctcactcaagatcttccaacttaattccctctgcaaagatcccattccatgtagagtcacattccacaagttctggctggatatattctttgcctctggacaagtgatagtgaaggcttgatgatcaaaaataatgtgatataacttgacctgaataggaacctactccaatggagctaataaaataaaaaattacctttgtctttttttttttctcttaagaattggcaatttctactcagcaagagactctaagactgcctctttcccacatcagctgaaattactgttaaccatacaatcttgtccctggaagccctgcctcctatccacccaaaaaattaaaacacagttttaactaaagttgatcagaaagttggacaaaggctcttaggaataactacaaggcaagaccactcacaattgagggcactttcctaataaaaaggtaaaaagtgaacctttcaaaagacaaagaatatatgtgcatgacagtggagaataagagcctagctgaaactgaggaatatactgacctagatgaaatggaaacatgtgtaaggatggatgctacaaatgcaatagcaatttcccaagcagaagaatgagtcattcggtcaactgagatgttaggacactaagatataaggacatgcccgtggcatccaggaaatcatactgaattaagctcatgagatacataccaagttaggcaggcatgatccttagggcactcaaatgtctatagatttttcatcctggcatttgccatagagaaacattccaggttagtagagaccaaacatgaatgccaagcagcactcttgagccttgggaggaccccaacctgggaccccaaggctcaccttcagggtgtgtccccagaagtggacaaagtcatggaatcccatggccagcttgactttttggcagcagaacagggttgtcatgagggccttctagactgaagcatctttatcatgtgtcaggatgcttggacagcctggctgccaccctaggggacaaccatcatcatcctcctcctcctctcaaaggtcagactgctggagggaactcacaggcagtggcccaacagcctgctggggaaaacatgttttcaaatggattgacaatcacaaagcacaaacccaacaccaaatgatctatccctaatacccctctaggccactcacagtcctccttggtcctccttgctgctaatattttccagaaaccccaagcccaaatcttcacccagtggcttggcttcaatttgctctattcgctcagcagagggacggaaccccacaggcatataaatacaaagagaaaagaaacctatccatgatgatggaacaacagcgtcagaacagcaccaaccaaagttgtcctaaaaggtaactgtcatcaag

SEQ ID NO: 53229 - DNA, 1602 bp, Bovine  19866881426368
agatgagatactttcagaatatactggatgtggtatttcacctctgcttttcattaactgactacttcatgtcccaacattctttttaaaaaaatttccctgctgccttattagtgtcgatctttggcttgaaaaagtagcttattttcctttatatgtattttattttttaaatgaatgtgaagttattaaaaccagattctggaagctttttagggctttttaataatacatctttgagccctgagcatatagaatttctaattttgtcttgtgtttgcttgtttttccagctggcatattgcatagtacagtttctggagaaagatccttcactcacagaaccagtaagtatttttttctataattttgaaaaacttcagaaaaaccacttttcatggagtatataagaaaaatgaagtgcaatttgtttttctccttttcattttaggttattaggggattaatgaaattttggcccaaaacatgtagtcaaaaagaggtaagtgttcagtgtcagtgtgttaatagctcactagagcactgagataataggcatctgtaaagatgcattatcttagctaatcctcacggtaactcagaataaggcaggactgtaaatattctcatttttactagttaggaaattgatagttaggggttaagtagccttcctgggcatactaagtttaggtgattaggccagagccttcccgcctgactcctgcaccctgggcttttatcctggtctgctcactgatgtccgcttcctacggagtatggaggttttgctgtcactgttgatagatgctgtagcaacctgcccagatacccactttaaagcatcatgtgggtgagatcttactatgcacaatcttaaaatatgttgcagacctttagtttcagctgttcacaagtggccctggaaatccctgatttataatcatttgtacttttgccaagacctcaccgggcatgtgcagtgtgaggttgtggtggaagcaagtcttgcaaagtgagcctcgctgagcaccagatctataccaccttttctgaaaggttagaaaccatgtggaaaacggcccggaaacaaaggtcagcagttggttttatatttggagagtgttttagaaggaattcagaatgtttcttaacaaatggtaaggctcgacaatatttcacttttgatggaaacaccctccttctcaaatcagcttcagttcgccacaaccctcctttacatattttcagaaactctctaatttcttaatacctgttaggtaaaattaaactagtcattgctgcccagatgcatcttaagatatgaaaagatcatttttcatattttaattgcgtacttgatttttttctaggcagtcatttcttcatacctaaataggaaaatggtttttatttctctctcagttttccattatatttaaaacaagtgactgtactattgatttggctccattttgtgatctaaaagctctggttctgcaagcacagggtactgaggcaacgagattcattgtgctcaatagcgagcgagtgtgtacatatgtacatgtaagcgtggacaatgggtcagcgtgtgctgag

SEQ ID NO: 53230 - DNA, 925 bp, Bovine  19866881534564
acgaagtcgttccaaagcctcccatctcatttcatacttattttaggaacaatggctgagttcaccacttcattgccttttgccagtttctcctagcaactgctctcagatacagcgaaaatcatgtttagcttacaaaatccaatttagaagaaaaccaagcaagagtttaacttgtttcatcacaattcatgtaattatagagatgctttaggtttctctgcaccctgactttcctgtcaagtagtttataataacagctaacatttatggagtgtttgcaatgcactgggcttcatgccaagcgctttacacaccttgtcttaattaatcctcccagctaccccccaaggtgtacatatcattacctccactctcctagtggaaactgaggctcagagaagctaagatcaccccccctagaaagtggcagggccaggatatgaaaactgcgcttaaccaccatgctcttctacttcccccctctaatctgaaaagaaacccttaggtttggggcttctttgtttatagactgaagccccgtatcttttttaaagactttttttgatgtggatcatttttaaagtcttgattgaatatgttacaatattgtttctgtttaatgttttggttttttggccgtgagacatgttggatgtcagctccccagcgagggatcgaacctgcaccccctgcagggtgaagtctcagccgctggaccaccagggaagcccctgaaggcccctattgtaatgtgtatactgtccccatgacttagatgctttgcaagttcagattttttatattcttttgttcagtacttgtcaatttccaaaatgtttttcatctgagaggacattttatttatgagacattttcatgtcgtacccatttcctattatttacactctagagtcaactacat

SEQ ID NO: 53231 - DNA, 1488 bp, Bovine  19866881579114
tctcctctgggcatgtatgtgtatgtgcttagttgctcagtcatgtctgactctttgtgaccctatggactgtagcccaccaggcttgtctgtccatgggatttcccaagcaagaatactggagtgggttgccattcccttctccaggggatcttcccaatccagggatcaaattcaggtctcccacatgcaagcagattctttaccgtctgagccaccagggaaacccttctttgggcacagccactataatttcagaaaagcttaagggaattagcattcaaatttgctcctaatttctacaaatatagaaaaacctgctagggagtggatactattttcactgtggttttctccctgtctgctatgtaatagtgtcataaatcaggtacatctagcaggaggaggagacgtaggtgattgtttagttctggaaaagaagctactttctacagaaaggatttcaaatagccccacagcaaagccagcactcaaacaggtttcctgtgggctatttcccctccgctgctctggacccaaagccaaagtgaagaagagaaacttccctatcacaaaatctcaaatctctggtacctcaagctggtcttatagtgatcaagcagtttatcatgttccaaaaagttgtaaaatctaggctattgtaaattaaagcattttatgaatttgcttttaaaaagtttaatcggatttactttagagattaagagaaaaataagagtcaaagtggaaaaaattagataagcgatcacatgagaaactttggaatactcaatataaccaaaagaattaagttgtaactacactatcttaactgtcagaccttaaaatattttatgccatattttgtgctttcgggacatacgttgaaataataaaattttatattaatctttattttttacttttaaaacatattgattaaaaaccacttttaattcaaaatacagattgcctaacatatttaaaatctttgaatactttttcttcaatctacttccataggaaaatgaaagtacatcaggatagcaccaattgttatggaaaaatgaatgttctaatgctactaatttcagcatttcatttataaatggcatggggtgaatatatgagaagtggcaagaacacttctttcaccggttgtgcaactagtgggtttctttttttttgtaaaagagaattgtgacgcaccacattgttaatcagctataccccagtacaaaaaaaaaaggtaaaaagaactgagatgcaattgcactacattttataatgttcacagtaaagaaagttgatgaatcttcaggcaaatattaagtaacatctgtagccccaaagtctagacggcaattcagcgtatttccccagcattattcatttggttaaagcagagaaaagggttacaatagaaggatatacaggttgttctaacaacagcaaagacctggttgctggacgcccagctaccggctt

SEQ ID NO: 53232 - DNA, 1156 bp, Bovine  19866881685221
cctgggataaattcccctgatctggtgtataatcctttatatgtattgttcattcagtttgttaatattttggtgaggattttttttcatctatgttcttcagggatattggcctgtgattttcttttcttatgttgtccttgtctggttttggtatcaggataatggtactaaaatcaaatgagtttggaagagttctctcctcttatattttttggaaaagatagtttgtctttctttaaccatagtttctcttataagccccaaaccagtatccccagccatttgctaaacatatccatggtagaatgatgacatgttaaagaaatccattccctttcttttaattttagaaaatataaaaaccagtaaactcagacacactctgctcccaaaatactattatgtttcctgccaaattcattctgtctgatctaaatctcttggggttcctatattaatatgaaagtattcgccactttggtaactatctctttactaatatactaaactaagttcttaggctgcttcttttgtgattataaattatcaaaaagcatatcaaaactatttcagaatgtaatctattccataagaaaactggccgggacttttaaagcatcaataacatagcaaggggcttgggggttggggaaggatgaacagaccactctagactaaatgcaaactggatcataatttcagaaaaagaaaagctattgaagacatttgtggacagttaaggaaattttaatatgaaatttagattacattaggaaattaatgtcaatattcttgggtataataacagtattgtggctctgtaacaaaatgtccttaagaaatgctgctaaagcaattacagataaaatatgtctgtaattcattttcaaatggttcagggggaaaaaaatatatgtgtagagagagagagaaagcacagtagcaaaatgttaacactgttaaatctaggtagaggatagaaggtattcacattgttctttcgactttttagtatgttttaaattcttttgaaataaaaattgaaataaaattctctatagaaaaaaaattttttaatgataattgtgccccatgctataacatacactttttcaaactgagatggtcattttggttttagagataagtaagt

SEQ ID NO: 53233 - DNA, 1796 bp, Bovine  19866881729645
aagaaccttaatagatctgtcaatgatgatccctgagggacccaggaatgactctaggggaacagaagagagcagggctgaaggtaaggcactgaaggaggggctgaggacacgtcctcacctgctgcttagcttagggccttacttggtaactggctggcattttaaagggggaggaacacaggaaagagtttgggttataagcgtgaaccaagagtttattctgaactttccagtgactccttgcatgactctgcagtcagctaccaattgaattcttgcatgtcatctgtaaaatgggcagaaaaacagcacatcttggcctcccagagatgattcccaaatagacagacgcatgtcaatcaaattattaattttatcaatgcttcgttagaagggcaatatcatatttctttcagattacttttggaagattccaagtagttgttttttgtttgtttaacccataacaaagtatagatatcccagctctatctcatttcattaagaactttaatactttggcttccctcatggtgcagtggttaagaatctgccttgcaatgcatgggacacaggttttatctcaggtctggaaagatcccacatgcttcagggcaactgagccctgaagtgccacagctactaagcatacaccgtagggcccctcatcctcaacaagagaagcccccgcaccacaactagagtggtcccctctctccacaagcagggagagcccgcatacagcaatgaagactcagcacaaccaaaaataaaagtaaagaaataatttttttttaagtgagtactttagaatcagtccaagcgacatgaaggcattgccaccaaagcctcttttgggactcacctcccaggtttcacagcggccccagcaggcatccgtggtgatccgaaggcccctgcagcccggcttcttggccagaaaagtaaactccctcactgcacagcccacaaatgtgcgcaggttctcactggaggtgctgatgacacagccacagccagccaggagcaggagggtcatggggccaagaaaaaggtacaccagcctcatgctgttcctccgagagggaaaggaaggagaatttattaatagatctagctacctctatcaatgcaatggacatgaacttgggcaaacttcaggagatggtgagggacagggagcccttggtgtgctgcagtccatgggtctcgaatagtcggacacgaccaggcaactgaacaataacaacaacctccatggataatgtgttggtcactatcaaagggacattgcccttagaatttcaggtcactaaacacccaaccctccaagggtatcctaaggcttttccttatggtatcccaactgctggatttgtgcattaaagaagtttgttccaataacctcttcagaatgaatacagaatatgactaacaccgaaagtaatgcatatcctaacatgatacatgaacacacacgaattatttttattcagatccaaggtattcggtatcatgctacatgcttcactcgaaattatatttccagtgtcatggatgagaagtggagagaggtagacaaataataatggcatgccccatatgtattgttactaacccaacccagcacaaaaccataaaacttggatatgcagaacagccctcacatccgacttggtggccattgataaaaatgtgtcctagttgctacaaattccctttgatctaagcctccactgtaataggcatcttgtgactaaatttaaacttgaatgatggaaagcatcaggggg

SEQ ID NO: 53234 - DNA, 1272 bp, Bovine  19866880852076
tttatattactaaagtaattctgaaagtcatgtatgcaactctatttcaatggaaaacacactaataacattattacatgtaatttaaaatcaacctgtgaaagtgaaagtgaaagttgctcagtcgtgtccgactctttgcgaccccatggactacacagtagatggaattctccaggccagagtactgaagtgggtagcctttcccttctccagaggatcttcccaacccagccattaaatccaggcctcctgcattgcaggcagattctttaccagctgagccataggaaagcccaagaatactggagtgggtagcctatcccttctccagcagatcttccccacccagaaatggaactggggtctcctgcattgcaggtgatttctttaccaactgaactatcagggaagcctttacatgtattaaaaaaagtagaaaatactagcaagcatcatcagcttttatattttagcttttaactaggcattataataaaagtaataaactctgttttacctcaggagctgaatcttgtgatatataaaataaattaagattaaaacatgcttttcactgagcttttacattaaccttcagttttccagtaggtgaccatgttcagtaattggccataaaccaatagtctcacatgctgatagtgctgctagacagctgtaggagaagttagtttgatgaaatacaaatgaaagcataatagaaaattcatctcagaacaaatgatttcttctgtgcctggccttaaactccatgagggcagaaactcctctgtttgggactttatcctatgtatcttttcatcaggattcaaattggtctttctcagaataagagttattacaaaagataaattttatttgaagtgaagttgtgtatgactctttgcaaccctatggactatacaggtcgtggaattctccaggccagaatactggagtgggcagccttccccttctccaggggatcttcccaacccagggatcaaacccaggtctcctgtatggcaggcagattctttactagctgacccacagggaagccaaagaatactccagtatttgaatggtcctttatttctttcctttaaaagtctttgtactaaaccagtaatctggtgagtgaatgagttacctgagttctgtgagtcactttaacaaattaatcaaacccaaggaggagatcatgggaacctctgatttatacctagtcgatcagaagaataggaagcaacctgtgtttgcaattttcct

SEQ ID NO: 53235 - DNA, 845 bp, Bovine  19866880815765
acaaacatccaaaatgcacaggttatgtacataaactccagtgagctttattaataactccagttactgttattcaaagagttcatagaattttgaatcctgaagggtgatttacttgatgacaattgtgaaacattctcaaacctgtcacatgcagtaattctgtcgtctgagaaactgttaatggcatttgcaagcgtggcagaaatgtaacaaattgtcgccaaaccatttgcttgtttgaatgccaaggtttccttccccactcacatgtggtgtgctgctgccaacagttatcaaaatactcccacagttgtcacagcgagaattgttcagggagtaactatttctttattcttgttgtccctctacttcattgcttttgccacttgtacttggaaagttacttgaataacttgcataatgtcagtatagaacagttagacactaagtaagggattaaaaaaaaaaaccaagactatctgagacacagccatggtgggttttgtccctaagtcatgtccgactcttgtgatcccatggactggttgcctgccaggctggtctgtcaatgggattttccaggcaagaatactggagtgagctgccagtttccttctacaggggatcttcctgacccagggatcaaacctgagtctccttcattgcaggcagattctttgccactgagccaccagggatgcctaagacagttctagatacatatacagagtgcagcaagatcaggaaggatgtttttcatacttttaccctctatatgttcctaatgtttggatttttacagacagactatgctgtttgtgtaatgtaaagctgcaataaag

SEQ ID NO: 53236 - DNA, 1507 bp, Bovine  19866881056056
gaagaaatgcaaatgtcgaaagtggccatgtcctcaaagcacacctggctgtgtgaggaataaacagattttgcgtggggattgggagatctgaaattccataggcaaacctagatgcaattatttgctttcccccacattctccattccctttgttttctcctctgcaaatgtttccttctttctcagttcctcttcttttcacactgcagaggactcgattctagtagtgaggaaaacttgggaaacaaatatttgggttgtattctaaatcagttgtcatttgttttccgtttcctctgttacattagctgggctttgtcaggagagggggtcgcacactcaagccttagcatgtgaaacaaaacagggatgactccccagcaatatgatgtgctcaaccagagtgtttgctgttaaaagagtctaactttggtaacagagtttttaaccatttgatgcttgctctctgaaagaattggttgccaattgcaaccaactttgtagtataacaaattgtacaactatttgcccttcttggaactttgaatcaccccatagatgctatttgaaatcttactttggtataaggaatattttgtaatataaaattttccttgtcataaaattatccatctttgatggttgcattatactccactgtatactgtagcaacatgtatgccatcactatccatttgttaggacagcagcagcaagttattccatttcttactaacataaactctgctgcaatgaacatctttgtgaacaaaagcaccacccgcatttgtaaccctttccgtgggatagtcaccttgaagtggaattctttggccaaagaacgtgaacattttgagggctgttggcacttattgctgagttgttttccagaaaagttgcactgtcttacaactctatatccactactcctacccctgtctgcagcctccacacaagcactataaaaataaaatgtgaaatgcttagcatatggcacttggcacctagtagtgactcagtaaaaggtaactgatgatgttgaggttgaacaagtttattctcacattgtctctttgcagaggtgcagggtttctaagctcttctgggttgtacatcatctggacatcctgaatcacctatttatgtcccttcccactgcactgtggagggactgactagctatgtgtgtgtgtgcacagtagagggactgatgagctaatgtgacaaacttcttgaaactgtcattggaaggaaaatggcctagttttacctgccctggattttcaatagatgtctaagactgtcgctcagtggttctgagctcaggctatacaatagaatcatctggaagctctgtaaacaataccagagcgtggccttagttggctgagggcggggcctggacgttggcatttaaaaaattcttcccaggtaattctagtataagcaaaggatgagaatcctaacccaaaagatgaatcgtttagaaattccaggcaccacg

SEQ ID NO: 53237 - DNA, 791 bp, Bovine  19866881430679
aatttcattttaatggttatgttttttactggtatataagaaaattaaataaaaatggggaaatagttcaaggaagttgtctaaacttaatccattttaattttcaaaagtgtaatttcattatttttcacctattaaaatggttttggaactagaatttgtatgactacatcaatataggatcatgccttttagtagaaataagtgtatattcactttgtaacagcaaattaatagtatcaaaatatctgtacctttcatgctgagtaaagtgagagctgtccctgatggcttggttatgagagtcaatcactgtgacttttctttttaaagaaaactttatagcatgcagttgttttggtatgcaaatattaagtggttggtgctgaaaataagcaaaataagaaaacacagagatatataaagttgtggaaggatctaacttataattcatgtgtgaagagatccttagtaacaagtctaaaacatattctactctgaatatacagctaatgtcattcctggcaaatcagtaaggtaagaataaaaggatatgttgaaatcatatgctcccctaaaaaacaaaacacaaaatccttcagtaaagcataccttaagggaactttccccagagtgctgtcttcaggttagatctgactaccagaggaaacaggtttgtcatataatgaaggatgtctattgtagttatgtatctagtgcaggtactactgcattttggcagattttaactcaagataagaaggagtagtttgacactcaattactaaata

SEQ ID NO: 53238 - DNA, 592 bp, Bovine  19866881617697
tttggactttgaagagtgctttcgcttttgttataaagaaaatgatacatacgtgtgaatacttcaaaactacattagaattttaaacaaattttaagatagtcttcaaatacacttaaaggtaaaaatatcatcctttagttgccaatttctctacccttttccacaaataactaggatttaataaattatttcccttaaaaaaaaaaactttttactttcagattgatattctgaaactccagctttataactgcatgtgtgtacacgatcatttttctctctcttgcaggtggcgcaaaccaggaaggggacatctgtggtttaagtcctctatgtctcatcctccgagtgctggaggcttgctgtgggctgtgtgctgttaatgctaatcgtgataggggtttttacctcggactgactcctacatgttagcattaacagggcacagtgcctgttacacgcgttcacatggaaccaactgctgctgtgggacggtgacaaagaagtgtgagtcaccctgctggatcaactctgactgtaggctttattattttctgttaatctttatctggtcactgggatgttccac

SEQ ID NO: 53239 - DNA, 1569 bp, Bovine  19866880796960
agaaaagtagaagtatgagaaaggtttggcaaattaatgagagtcttgataggagtattcttgtggactattttcaatttagtaaggtatttccaagtttatactaataaataatttctatttatttaaagtgttgttgagaaagaacaaaagatacataacatgcctttgtttctgaaaaaaaaaaaatacattcagtaatttcctagtgtaacacatgtccagagaacacactgattatctttcaagtgtgttgtacttcaaatggcatgacctttagcctgtgaacctgaaatgatcactcttttgaacatcatgggcactaatatcatgttctcctacttgaaggcacattaaccagaatgattcatccattcatttcattattatttatgcatgtgtgtgttcaaacttttgtcagttgtttccttcccattgactaggacccagacagtactgtcagtatgaatattttcatgaacaaaacaaaacagaatgcaatcactttgtttctgctttaagtaaagtcattcttggttttgttttgttattttatcaacaaaatgaataaatatatgatttataaaaaagaagttgatccaacatcttcatgcagttattctgtacatgagtttgtttcagtttcaacctctgcttattcaaatattaaactcttaagtctctggtcttatcactgtgaatcatgaaattatttcatactataaacatcaggaggatgaaaacagaaaacaacaggtgagagtgaaatgcatttgtacatctagtacacagccagggcagtaaatccagatacaaatgtttcctggtgggaggaaagagcatccaaagacaaagacagggcttccctgatggcccagtggtaaaggatccacctaccaacacaggagacacaggtttgatccctggtctgggaagattccacatgccgcagaacagctaaacctgagcaccccaacttttgagcccatgtgctccagagcttgtgctccacaacaagaaaagccatcacagtgaaaaacccatgcactgcaactagagaaaagtccacacgacaactaagagccagcacagcaattaaataaataaacaaaactattaaacaaaacagaaataggaggtggcagacagactttaaagtggccccgtgatctctacctcttactgttaatgaattcataaaattattacctccctatgctacctgacctaacttcaagcttacgcaggaccatgattaaccaacactatggcaaagggctaccttaagtaagattctgtcttgctagaaggttctttctagtttccctctctcttctttgttggaaacaagaaaactgtcattatcttaaagtcacaaagaactgaaggcaggcttccctggtgactcaaaaagtaaagaatctgccttccattgcagcagatgagggttccatccatggatcgggaagatcccctggagaagggaatggcaacccactccagtattcttgcctggagaagttcatggacagatcctggtagactatggtccataaagttggaaagagt

SEQ ID NO: 53240 - DNA, 1278 bp, Bovine  19866880934318
cggtgggaaaccctgacatgtgctcccactctgccaggccgtcatccctccctgttggagcagagtccatggaagacagcgaaaataggtcatttaaataaaatccgaagttttataatagccaaaatgtccagatttcagaaagcagtcatcatgtcaagaagaagaaaaatctcaacttggatgaaaaaaggtagtgtaggcaccctgctgtggagataatagaattgttcgaattatctgatgtggccaccataaaaatgcttcaataaacaattacaaacacacttggaacaaatgcaaaattaaaaaaatctcagaaaaatataaagaagaaccaaatggagattttagaactgaaaagtgtaataaccaaaatgaaatattcagtggatggattcatgagaagaatggaggggacagagaaaagaatcagtgaacctgaagacaccaatagaattgacaccagctgaaaaaacagaaaagagactgagagaaaaatgaacacaccctcagagaccggtgggactataacaaatgcctaatatatatgtcacctccctgatggcgcagatggtaaaagcgtttgcctacaatgcgggagacatacatatgtcaccagagttctggaaaaatagagtagggtggaagtgaagaagtactcaaagaggtaatggctgaaaactggccaaatttagcaaacgccataagcttacagattcaagtagctgagaaagttcaagcaggataaacccaaaccaggtggcgcagtgataaagaacccacctgccaatgcagtagacatggattccatccctgggtcaggaagatcccctggagaagaaaatggctacgcactccagtattctcgcctgggaaatcccatggacagaggaggagcctggcaggctacagtccgtgtggtcaccaaagatcagacacaacttagtgactaaacaacaacaaagaaacagtagatacattagagccaaacttacgaaaactataaagaaaaaaatgaaaacagaaagaagtgataccttaccttcaagaaaaaaattaaaaatgaaataacagcagatttctcagcaaaatgaaatataacctactgtatagcgtggggcactcaatgctctgtggtggcaaagaggggatatatgtatacatgttactgaatcactttgctgtagagcagaaactaacacaacactgtaaagcagctatattccaataaaaatttaaaaaacaaaattcagaggccggaaggaagagtcacag

SEQ ID NO: 53241 - DNA, 916 bp, Bovine  19866881209610
tctctgtagcttctatgattagatagatagtgatatttgcagagtgaagtacaagactaatgagagggcaaacttgctgatacaaatgagagttaattgtaagtctgaaaaacaaggactaagagctgccaaaatgtaaaaataaaatctgacaagtaataaaataatgcacatctctaaggtattcattgtgaaacgtaggactagtcaatcaattttggcttctaaaaatataaacacttaaaaatttcagtttaactgaagatttccttaaaaaacaaccctgaagtttttcatatagtcaggcattaaaggtgttttttttattctattttaaataggctattgtcgactttggaaaagttcttctatcaaaatctaatatatttggagttgcaataattatgtttctgccaaagtgtgcaaaagacagtgttctgaacagtgtattacatcacttcataatgagtaaaagtcacagaatgtccagcatagcatcttctggaaatatagctttgtacataagattgatagcaaagcagaaataaatatatattctcttaggaaattaaggtatctgcaatacagtctgatagaaagataaacagttgcaaaacctgacaaattttttctgacaagcatatgatgaaatataagagtttgttgaggtcaaaaagccaatacctccctcaacaaaaccaaataacacaggaaaatagatagactaccactagtctaaatttatctgattaattttcaaatcttcaaaaccaatttaacaacttcattggtcctgaaagtgaatactcaggacattattatactcaggcatactcaggattttacctgataacagatcttaagaactcttacaataattcctggacttcatcttaataatttggaatagccaacc

SEQ ID NO: 53242 - DNA, 665 bp, Bovine  19866881235564
ctatctaataaacatctgttttttctatgtgcatttgtgatgccatctttatcatgcattaaattttcatatattcatgaacatgactctgagaaacattaggaggatgcagttggcaaaatttgccatcaggaagatgaagtagaaaataaatgtctatgaatgactggtcaggccacataaaatcacatcaatttcactcttgcataagacattgatcctgcccttatattacccagattgctaacataaaaagttgataaataaaagtacagtggaatttaaaatgtttctttgaaaatattatctctttgcttctcctagtcaaggtctgaaacaaccaatctcccacatactgtgacttttcagagacttcaatctccctacagatttcccgagctggttgcatttgttactgttgcttatcagaatacacacgtccctttagctattgtagccactctaagtttatttctcttagcagactgagtttgccattatttgtcataagccagaatctgctcaatgccctcttcatgtgtctcatttttcctaaaacttcccaaactatgttattataatcctttcttctgtgctgcagccaaggagtttttcttcatttatagaaaattattttgtcatttttcttttcgggtgggcttaag

SEQ ID NO: 53243 - DNA, 3604 bp, Bovine  19866881253841
atggagactggcaaatgcaaaattgtcaggggtaagggtgcagagtggagaccactggaagggtagatgtttcagctcaagtctgaaggcagtgtagaggcagaattgcctcttttcaaagcaccccattcttttcagctgattgaatgagacctatccacattatgaagggtgatctgctttactcaaagtcaaaacttcacagcaacatccagactggtgtttaaaatacatgagtattgtagcctaagttgacagatgaaactattcctttgcaatttgtgatatacatatcattggtatgtcgaatacttatttctcaaactgtaagagaagttgcactttaagttgcagtgtttttctcatcctttctcatagaactttactagcattagaaaagaaaggaacattatctcctgtcttgagacagacactgagttaatcaccctagagtaatactatgaatttcttgtgagaaggatgtgatggcattgataatatgtttttaccatgaatgtttgttagttgggcttgtagtgggactatgtatgctaagtaggtgggtgtataaaaaaaacctgagacatttcatctataaatatctgattataggccaaataattaaagattaagctgttcacaacctaatacttgttttcttgaatgaataaaagcttttaagtgaaaaaaatttggggaaataaaaacttttcttcatgaagatctattagaacaaaaatacaaatacttattttcttaatagttatatatttataaaatatactgctaatattgggaaaagtaaacatcctgagtctttgaatgtattgttctttcatgggtagtcaactatttgagaaattaaggcctgatctcttttgcctccttctttttttctccttttctttctccctccctcccatccttccttactcctttgtcttttttgcaagaactgtctattaattttcatttaaatacatacagaaaggtaagttaaaaaataatgttcaaatttttatgaggttttttttttttgcattacaattatgtatttgtagggagaatatctaatacttacttttaacaaggttttatggtattcataactgagtgaaatatttaatcacttttaattgtttcaaaggcatgatctactttatgaacagtacattttcttttatcctaaattcttatgatccaaaggataaaactatttaattgtttaaatgtttatatgactttgaatttagcatgtaagtagttagaaatagctctgattgctatgacacatgaaattagtagcatagcatacatgtaatgaaagttccgattctactagcttgaactcaggcagtatctactcctttgttgctgatgttggtaagcccaatacagaaaatagtacaacagaaacttcaaatacaatgcaatggcactttcataattcataatacatataatgggaagtttgcacatatgtaacaaaaagcagaaaatttagctaataaatctccaagacattatattcttttatttcagtttctttctttttttttcctctacacagacattattctacatttcaggatcttagatagttaatggatatttaaaaatctgcagaagttgttgttatccaaaacacacaaaaacacatacaaatacaaagtgagaaagggtccaaagcttattaaaattacttatcaaaaaagcttttactgttttgcccagaaacattggtgctatgataatattatgctaagaattcctcaaatcattcaatgtttcagtggatccaaacatgtgtgtggatgttttttgatagtttcatagtttagattggcattgtgtacatatgttaatgtttgtggatataaacaagtaacagaaacagcaaagaaattattttcagccatataaaaaacttgatgtcaaatagtgaagaaagatatacatttttattcttacaagtctctatttctaaatagacatataatactaattgtaccttgaggatcacataagcatcaagaatattttaatttctaaagttatgtaaaaaattttgtttttatgcatatttttacttttttctgaatttttttttaatctgaggtcaaggttttcacatatatcaaatatcacatatatcaaatattctttatttgtccaagaatcataattctgactgtattcttaaggagaggtcaagttccacgcaaaaagtggtcagtaaatcagttggcattttctggagactgtctactgtctgatttttattttttttaagacagaaaattgctggcacttctatcatttctacaaaaatacagaagccccagtagtaacttaaatcatctcagatgcttaatataacattagttcaccaagattatggcatcttctgaaattcaattcttaaagtctaggctttgaataaaaacaaatctctttaatataagcaatgctgttttcttccttccttcttacttttcttctttccttcctactttccctccttcattttttgatgcataattaaagtagatcaatttgtcacttagtaaatatataaaagtcatcatcatattgctttaccatatttctaaaaaaatatcataaccaactcagtaaaatatgttcagacaataggacaagagaaactatgttaaatatcattagtttttcaaaatctgaagaacacaagacattacagtgaagtatcatactaagaatctgatgctgtagactgagcttctaactttattttggtgataaataataaatcttaacagaaaactttgctcatataccttcataagaaattgaatataaggactgtgcaacatgaaaaatatataagaaattataataaaatagaagtccaaacagtcaaggaacatgtgccattctaaaatgatctatattgtttaaatagggtataactccctccctttatttaggacaaaatattcacagaatatatttacaaacaattcagaattcaaaacttagttaattagaaccaaattccacggtggaactagaggaagaatggcatttattttatttgtgatcatgtggaagaacagacatgaaatatagtaagactctttagcagcatcactaaatagaagactggagatggtatgatcattaaattttggattaaaatgtggacagtatttttcccccagctttttattactgggacactataccttgttatgaagcatatttgctttgtttttatattttcttttttttatttattttttatttttttttatttatttttttttttaatttcaggtatacacgtgatccccatcctgaaacctccttatattttcttatagacattttcctgaattccccacaaaggcattataaattcaacagatagttttcctctgtgttcctctctgctatgaagtctctaattgggtctttttcaacaaaagaagttagtagtgtagagaaccagaaagttgaaaaaaatcaaataagcaaagaacaaatagcatccatcctctcagaggttattctaggaacattctgagtctccgagttgtacactctctatgtgcaggaaataata

SEQ ID NO: 53244 - DNA, 1218 bp, Bovine  19866881307707
tggactttccgggaacaactgtcaactgaagggcatttatcactgaagatgtctgctatgggggttttgatatttcaccaaaagaaaaaaaaaacagggagagaaagagagagagaagaaagggagtgaatttagacatgcagaaggccaaatccacaagtatttgtgtggctataaatattaaaagtatacataaatcatgtgcatggatgcactactctctcttcccacacccagcccataactatactactgatttctggaaagctaggacatttccgggcttccctggtagctcaactgataaagaatccgcctgcaatacaggagatcccagtttgatccgcaggttgggaatatcccccagagaagggataggctacccactccagtattcttcaacttccttggtggctcagacgacattctcctgcaacacgggagacctgggtttgatttttggtttgggaagatctcctagagaagtgcatagcgacccactccagtattcttgcctggagaatccccatggacagatgagcctggcaggttactacagttcatgggatcgcaaagacttggacacaactgggtgactaagcacaaaaacatgcatataatttttgcatttttctctctgataatcaattccttaagcataaatgcttcttcctgtaacattttatcagtaaattaattctctgtgactttttaaaaatttttgagagcgttcctgttggaaagtatggaagtcagaagctgaaaaatttctgctgataacagcggtgtacctggagccagaaaagaaagggcaagggaagttaagagagcacagaaaccatcagagatgaggaggacaggtatttgtataatcttgccagttgacttcccattttagactgaacatatgagacaaccaaagcatctgtaattggagacagtgaggagacatttcaaaatacctgtgttacctgaagctgtattgctattattttactcaagattaagaagttcattcaagttagtagtagtgtgagaaaggtgttgaagagttgatcttaggaggaaaaagaggaaaattggcatgtgaaactgaagctgtgcccgatcacactgatgctagggacatcaggggattatgtctcctgtgctgcaggtaatgagatttgactatatttaaagatcaaacataaggcactgctttaaaagttgcctttt

SEQ ID NO: 53245 - DNA, 4026 bp, Bovine  19866881652041
ggaggaggattaggatggggaacacatgtatacctgtggcggattcattttgatatttggcaaaactaatacaatttgtaaagtttaaaaataaaataaaattaaaaaaaatagctacaaggttataaagtacaacacagggaatgtagccaatattttataactacaaatagaatataacctttaaaaattttgaaccactatattatacacctgaaacagatctaatactgtatattgactatacctcaaaagtaaaaagaaaaaagaaataaagattcctgtcttgcagatcaatgagtgagagaattgagtcaattaaaaatcactaatgaagaaaaaaccaacaatctctttatattttggtttaaatctaggatcagctgtagaatttgaccaccaacataacataacattatagtatcaagtacctagaagcaaagtaaaaatctaagtcaatatttctgtatgaatttgtgaggctcattttgtagtttactccttgaaagtgaaagtgaaagtcactcagttgtgtctaactctttgtgaccccttggactatacagttcatggaattctccaggccagaacactagagtgagtagccttccccttctccagatcttcccaagccaggtctcccacactgcaggtggattctttaccagctgagccacaagggaaacccagtttactccttattatgtagttatttcaaagggaagttgcccatctaaagtgaaagtgaacttaagacacgcttttctagccactacacatccttagaagacagagtcagacttattttgctgctgctgctgttgtcttttcctcagtcttgattccactgattacattctgatatttggaggaatacatgatttacctggtaagtgtatgagatggaagttaaaactggaacaggggtaatgatgctgcctgatgcaaactgttgagaatacccttctactaggcagtgatccccatcaagaagaaatgcagaaatagatgtcaacctggtccttgaagcaaaaattgagtaataatttcatgtttttgctaaaaagaatattacaaaagaaaaacacaaagcactgattttgaacaatgtcaaaatgaacaatgacaaagaaacaatatcaattttttgatattgttaaagttaatttgttaatcaaactgaatttgcatgtaacatgcagatatttcaatcctgaattattgtccatcttgtctttttgcacccagagcttttattagtatatctatattcagaagagagcttactgttgttttaaacatttatttttaattgaagaataattcctttataatgttgtagtggtttctgccatacaactacatgaatcagctgataagtatatgtatatcccctccctcctgagcctccctcacacccccttcatccctctaggttgtcacagagaacccggctgaactccctgtgttatgtgttatacagaaacttcccactagctatatattttacacagaagagaccctactctaactatatggtaaattatttgaaatacaaacatatataataacaaaatatttagaatttcacataaaggtttcataagaattattcacttaactgtatttaaatataaagaataaagtgggtttattattacaggtatttgacacatactctatgttgattttctatattatgagtgcttcatgtgatacataggcttattttattagaattgtatttaatataggaaaaatgttactctgtatagatatttctgatctatcaccatagccacactcattagattaatctggcttttctgtattactaaatttaatcacatgctgaaaaataaagattttcaacatgtggttgtcattcaactagatttctttccagttttacttgcaaactaaatttcaggcataaattacattaaaaaagaaaatgatccattaggtagcaacatttctcttgagtgctccaggatcaaactcatcttggtgattatatttcatttattcttcagtacaggttaggaagatcattctcatttttaacattgttagctttactttaaaagtacagaaacatttccaggtaataaaacatgtttacccagttacattgcctcaaggctacaccacctacaccatatagagatgatcaaatgaaaccatcattctttacaacagctctgtcataaatgtttactgaaatggtgctgtcagactacttgaaatacagtaggccagagtccttgcacacatttcagacttctattctatggctaccctgtgtcatccctcaagctccctgtggtggaactcacaaaaattggtaatgaagcagatccttggtcagcagatcagcaatatgccaatttcatttatttcagaaaacagaatataggctaatctttaaacagagttataagcattcgagtaaaaacatttccaatggaagatataatttgtcatcactttgatgacttaactgaagtagcacacattgcatatttatttaattctttttgaatctgctttttagtctcagataatcacataataaagaatataatttttaaaaatggaacaattgtttcaaaaacagagaaaatctagttttaaatatggttaaaaagaccaaaaacagtcaatatacaaatttttttttttttttctatagcttcagttcagttcagttcagttcagttcagatgctcagtcatgtccgactgtttgagaatctatggactgcaacacaccagtcctccctgtccatcacgaactctggagtttactcaaactcataaccattcagtccatgatgccatgcaatcatctcagcctctgtcatccccttctcctcctgccttcaatctttcccagcatcagggtcttttcaaatgagtcagttctttgcaacaggtggccaaaatactggactttcagcttcagcatcagtccttccaatgtatatgcaggactgatttcctttaggatggactagttggattgccttgcaggccacgggactctcaagagtcttctccaatatcacagttcaaaagcatcagttctttggcactcagctttctttgtagtccaactctcacatccatacgtgattactggaaaaactatggctttgactagacagaaatttgttggcaaagtaacgtctctgctttttaatatgctgtctacgttggtcataacttttcttccaaggagtaagtatcttttaatttcatggctgcagtcactatcttcagtgattttggagcccctgaaaataaagtctgtcactatatccactgattccccatctatttgccgtgaagtgatgggaccagttgtcataatcttagttttctgaatgttgaactttatgccaactttttcactctcctctttcactttcatcagaaggctctttaagtcttctttcctgtctaccataagggtggtgtcatctgcatacctgagattattgacatttctcccggaaatcttgattccagcttgtgcttcatccactccagcatttctcatgatgtactctgcatataagttaaataagcagtgacaatatgcagccttgacatactcctttcctgatttggaaacagtctactattccatgtcaagttctaacttttgcttcctgacctgcatacaggtcaggaatttctcgagaggcaggtcaagtggtctggtattcccatctcttgaagaattttccacaggtttttctgatccacagagtcaaaggctttggaataatcaataaagcaaaattagatgtttttcagaaactctgttgtttttcaatgatccagtggatgttggcaatttgatctctagttcctctgccttttctaaaaccagcttgaacatctggaagttcatggctcatgtattgttgaagcctgccttggagaattttgaacattactttgctagcatgtcagataagtgcaattgtgtgatagtttgagcactctttggcattgc

SEQ ID NO: 53246 - DNA, 1754 bp, Bovine  19866880859592
aaggtggctttaagattggcatgtatattaattttagaccgtggtggtttagatatagaatttcttctgtaactttgaggcaggtgttgtaggtcttaagcttttcacttgaattaaatgtggtgacagcaacaggacctttggaagtatttattctactaaacttacagctaatagttattaagtacttagagtgtgtgaacactgtgataggagctggggatccaatttatgtggagaaatgcagtttctgtgatgattttgcatgagaagtctggattaggtggagcacattttctgcttggactgcagcaagattccaactcaaaactcgccagggttttattcaaaaatttccactatcttacctaaagattaagggtcaggaagaacagtgacaatccttgctgttatcgttgtgctgaagtgtgaaatggagtattttcctgccatatcaacaaacacggatgtcacagtcatcactgatgctggccctccaaaagtgatttcctgagccctcagggcaatcaggaaggaggataccggcacaatctggcagtcgtcaggttgcagccactccgtgtgatgagcactgaggaactccaaatgtggaaaacgtaggatgctgtccccagatagttgagatgcacatgaaaggaatgatttcagtaaacccagactcttgcatcttcccatacgtggaaagtgctaaattcctcagcttgagacatctggttttctctgctgctaagtcgcttcagtcgtgtccaactctgtgtgaccccatagacggcagcccaccaggctccgccgtccctaggattctccaggcaagaacactggagtgggttgccatttccttctccaatgcatgaaagtgaaaagtaagggaagtcgctcagttgtgtccaactcttcacgaccccatggactgcagcctaccaggatcctccatccatgggattttccaggcaaaagtactggagtgggttctctgctggttttctctactgaacagtaatcttttgatgtcctacctgcctttgttgcagaacttctgtgtaacctggctcctcccctagtcttgttggagcaattttttcagggttccttgagatgctgtctcccagtcttgaagtcctaaaatttcccactgaataaaacagaactctcaacttttaggttgtgactgatttttaagttgtcaaaaggaaggacaataaattgacctgtgatagggtagaattggtatttagcactgttgtctttgcaggaggttaagattcattcttaatctcaaaaggaagttagttgtgtcactcattgaaaattgatgtgtgttgggtagggcaagggcaggagagaaagaaatttatgtgtgtcaaggcttatataaaatgtatttatgttttatatactttttcaaataacatgcacgtacacagtcaatcttgcaataacacgacatatgcatttctaaaaatcaccacattatgtaaatttcacaaaaacaaccccaggccttgtgggaaaaatggagttagagacacaacactcaaatactttgtctctgacacatacaaagaagacaggaacctagtaaaactgatagcacacttttacgcatggtaatggataaggaaatacataaatactataataaatacggcactttaccttgaaaaagacctgaagtttgctagtgggagtgagtgtcagaaggattgcagcttgtgagtttttgcagaatgaaa

SEQ ID NO: 53247 - DNA, 644 bp, Bovine  19866881236213
atttaagaatgatgagagaggcatttccctggtggtccagtgaagactctgcactttcaaagcagggggatgcaggtttgatttctggtcagggaagtaagatcccacatgccatgtggtccaaaaaaaaaaaaaagaatgatcagggagaaaaaggtaagtaaaaattaagccagtcatagtgtgagagaaaagtgaaatatacagccaagagtctaattttttctcactgtaaatgcttctaaataactgtatatgaaagtttaatttgcttattgactgcaacagtttgtctccagtaccaccactttgtgaaatgaattgactaatatgtcacgtatctgacctctttctccatattctcccaatattccctaagaattaacctacctttttcttgcaagttttggttaatcctgtggtagttacaatgaaagaataatagcactaaccatcgtttgtgtgagcaggcactgtgtaatcttgacaacgtcccttcagactactctgggagatccatgttatccctgttgcacagacaagactgtagaaaacgcccaattgtgtgctctgcttatgttctaccaatcagtaaaggtacttggatggcaaccaagtaggactgttaaacccctttaaataca

SEQ ID NO: 53248 - DNA, 1225 bp, Bovine  19866881544225
taaaaaaaattaagccgcattaaggagtgagtcttcttttttacaataatgtaaaaatgaactgtttacatttttttaaagcattgtagttttaaaaattaagctgttttgttttgtgctgttaaatttggaagcctttgtaaatactgatgtaatgtaccaatgaaataacatctggggttgatggaaccctgataatgttgttgatggttagcatatgtttctgaaaattaaatatgtattattaaaagttggtggccaaaagttgttaaacatgtgactttattttccaatgacttcagtaacttgagaaatgtaagaaaataaaagtcgtgttttataatttgatttttagcaagcagagatcacattttggacccctaaattataatgtattagctacatacctttaagaaaaatagtttttaattctagttctaaaatgaacactgctagcagttcatctctatgcttatacattctttactgcagttgttttcagtatgtaagtgagaagctgaggagacatgatcatatccatattaatcagcatagtcttgagtgtcccggattttctagttcattccgtattgtttaccttggttttatttctatgctgctttcttgctcttgccagcaacatgctttctccttcctctcctcccacctccctcactgtcccccacctctctgctcactttcctgtattctgcctgacagatcaagttgttatgccattggctttctaaccaggctctttcttagtctcagggtctggatggcagtggaattggtctagtgtctcagagaactcagtgtcttcaactctctgaggctgcttgctttcactgacttctgcctgatgccttgtagtcttgctgtggtgctggatgtttcaactgcatataatcggggtgttgccatatgaatatttcctgatgggttttatgtggtgtcttgaacaaaaaggcaaaggcaaaatagttgggatgcaagcttaagagaacaatactgatacttctaaatttagttttgaaaatattggtttatcattatataaatatactgcaaagttacaagtcagaaagtgagtttgaaaaggtagcatcaagatgtatgtaaagaaaaattgaacagcattttcccctaaaatgaactgtattagaaactcactatattaagtggtgtggtattataggaaggagcacagattctagaattagat

SEQ ID NO: 53249 - DNA, 748 bp, Bovine  19866881656909
gtttcaaatgataactatgcaaagtgaaaaggcctacgccatcagaggggttaaaaaaggttgaaagtcttaagccttccctcagcccttacctgaagacaatctcttcctcttctgaactcctatcagtcttactgttcattataatatgaactagaatataataaatgcagagtagtacatgagctaactctgtataaaatattttctctacacctggaaagcaaggcccatgttttctacctcttgataggctcccatagcacctatttatagtacctagctctgttttttttccccctgggtttcaggaggcagcaaacagggaatgagcaaaagaacagtgagaatcaaaactttgtttcctatcaccctcctgcttcgaaaaactcattcctttcacagcaactataaaataaaaaccagatgttttagcatgacataagaggcattcccataatctggccctaaatttggtttctagactcatggtcaaacattccacacattcctcatctccacgcctttgtttatgcctctcctcttccatctctgcctgcccaaatcttatccatccatcaggaaccagttcagatgctacttcctccttccccattcctatcctcaagcagaaagtaaagtctctcttgttttcctgtaatagtttgagagtttatttgaaaacttattacattcagttttgtgttcatctaatttattctactaaaatgtaagttactgaggacag

SEQ ID NO: 53250 - DNA, 736 bp, Bovine  19866880592045
tattttactttctttgcattgaattaatcatggataggagaaaattaattcactgagtttgattctagtgcatggcagcagaaatgaaaggagtaaaatgtctttcactgttttcaatcttccatgctcagcagaaaaccaggattcccatgctctctactattaaggtaaacataaaccctagagacttggaatttccagacaatccaaaagctattcagtttaacatagtcaatcatctatatcaaataatttggtttatttcacttaattctcctgaaatgtaacttccctcatattatgtgacttattccacaatacatctaaagattctgatatatttatgcacatgaatgaaagaattcaagatgaatggctattatccctttctacttttcctcgaacctgcccaattatgaagaaaattaatctgtttttaggctcagctatcacaaatccaggaccaagaaagtccagtgtatagtacagattagtgaaaaccaagaataattttcttccatttgaccaagggtgaatccataggactgttcctatggacctcatttaatcttgaagataaagcttgttttccaaatcttccacattaaaaggccaatccaaataaccacctcttactataaaccacaaattttcactataaatactggagtcctgcaaaatataccagagattttctcataactatattcctatgcctagttcctactagttctca

SEQ ID NO: 53251 - DNA, 1709 bp, Bovine  19866880692420
tcattatttggtaactgtactggactcttaggctttcctggggctcagtggtaaagaatgggcctgccaatgcagtagatgcaggagacgtggctttgatcccctgggttgggaagatctcctggagaagcaacccatttccatattcttgcctgggaaatactatggaaagaggagcctggtgggctgtagtccatggggttacaaaagacttagaccataacttggcaactaaacagcaaccaaaaacttctttctgaagttttttgagatttcatattacaggtactctgatttcaaatcaaaacatcctattattatttctgtcaaacttttatgagcaaatccaagcaaataatatattttacatgctcaataatgtgttttctttagaaaccttttctaaaacatgcatataacaaattagaaggcaatggaagaaatgtttgttagttcaaaggtgcttttcttccatcactaaagctataaccttaagtaagttgagtgaaattatctctcttacctcagacttctcatctgtaaaatggggataataatcacaacttacattgttgtgagaattaaatgagcagatacatgtaaattaaatgagcagatactggttagaacagtgctaggtaaatagaatgtagtcagtatacattagctcctacagttatttgtgctattatgattattattcttcttaagaaataggaagcatttactaatgtatataaatatgaaatctgtttcaaacagatctcatgttaacaattgtatatcagctgaaaagagtacctcctgatttttagtttgctaaatgatcagtttgttatttctttctcattatgaaataaatacagctacactgtggaaaaaatagaaaaatacaaaaaaattagtgatataacagccgtttctcccaaatttgttaaaatcttaaatatattttaatacatttggattgattttacttataaaattaatttatatattacattgtacacttataatgaattaaagtcaattttatcaaaatatggtcatattttcagaatgtgttgcaataaagagaggaactccttatgatatgtattgtatgaaacacatgaactgaggacaatatcatgaactatcctatttcatggcattcacttctcaaattcagtacaaaacttatatgaagaaaaattactaacatctgtgtgactgtattctttgaaaacctcgcatctttaaggagataattactatggtttcaaatatttacaaaataacatttaaagtgttttgactgtgtactcaattggcacagattattttctaagtgctagtgaaatacattcaaattgtttgattctaattaaataacactcaaataagaattctttacataaacacaaatgccagatgtttgaagagggtgatgatcccttaaaaagcaaacattaaattatgaaaaatcattaaagttattttcctgggagtgatcttagattttctccttttatgctacattgataattgttgttgaataaacatttgcattcaaagtagacattaatgctcaaatttactctgtaaaatatgccttttataggagtataaatattttctgagctcattggtaacttctaattaaaagggaagtcctatttcttttggctgttgggccctgctatgttctgtgtgctaacaaacaccaa

SEQ ID NO: 53252 - DNA, 1884 bp, Bovine  19866880778018
atgctgtacaatattaacagtctagagaagtgatttacttttccatcttgcagcagttatgaggtcacctggattcaaacaggaatttagataaatcaagtctgaactttgtattgtattcatttttctctgttaatccctcaaaactgaacagcaagttttcttagatatcatataatgttttttgttgttgtttaaactatagcctattaattatcaccatatttctaaatttttatgcatttagtgattttaaaggatatcttattttacttttatattttattacattggtaatatattagtagttcctgatattcctgagtttacctctctctttagaacatgcattattaaactatattttctctttctctctatgcccctgtttccttaaaatatatgtattattgtatatgtgaacagacatatatagatcaaatgtgtgtatttgatgatgttctatgactttatacagattcttgaagtaggagtttaatgttttttgcaacataggcataaatccttatgagcatacataataaatcatacatggaggattgcccaatttacttaaaatatgtataaatattttatataccacaaattttaaatttatgattttagattatgtaaattataattattttccaagagattttataatttcttaatagtcctgaattctatggtataatatattaggaataagaaagaatattgctctaataaaattggggaagatcccacattcaatgtaaaatataagagagcttgaaaagcagacattctagtttaatcatctatttgcatctatttgctaagcaagtactgaagagctactgtacatgagacatattatatatgctagtaattccttgtctaagaaaagagatataaactttgtctttaggaaccatgaagtttaggtagtaaagttacagtacctatattttgctagtttgttgatataattggatatttattcatatcacatttttttgagttagagaaatcaactttagatttgtcaggtgatgttagattgacttcatggtcctaattcaccatggagattttattccagtgttttgcctgcttttttttttaatgctcaggttctcaaagtctcaaaactggatcataagaaaaaatgacatctccaggtgacttggcatgcataaattggaaattaataagacatttaattttatctaatatttgatatttgataaaatgctaaatattttatctgatatcatttgaagtttgaacttaaagtggtgagaatagagagactatgctgtggtgtttcaagatatagagaagaattattataaagtttgtaaatactaaatactagagtatatatataaataatcatacagacagtttatttaaatattccacccagatgcttaatattcttcagaggttagtttcctaaaccatgtgcattacagtaattcacagaggcagtatgtatgagctgtgaataacggtattatatgaaatgctttctaatctgtaattgttaataggcctccagtgactaccagctcaggatttaagaattgaatgtctcatcaagaataattcacaaccggtcaatgttctgctgatgtaataacatgaccttgatctctgtaccagatcatgattgcaaaataattaattctattccttagtccacattagtagtgatggatgacatcatttatcaagacattgggaagttatttaggaaaatttcttatcatatccttaacccctttgctacctacagcaaagtcaggtttgtaaggtcggtttttgctagtctggaaggagatttataatcattgttctgtgctgcctgcataatatataagccttgggagtatt

SEQ ID NO: 53253 - DNA, 1997 bp, Bovine  19866880955898
tggtcccagctgctgctagagctgcacctaccataaggcataagaccctatttttctctcggcccaaaatatttctcctctctctcttgtgttttgttcattggctagtaaatgacctcagtcatcagcttgaggcacttccttagttcaccttttcctgacttccaaagactgattccactcttaaatactctgatgatacattgcatatatgtaggtatgtagttgcacaattatttaatactttggttcatctcaacttctccagttagagtgtataccccatgaaaatgtgtcacgtagttggtgcttcatatttgttgcaaaatgaatgacccctagtccaaagagataatgaatttgatactgcttctctggttgtagattcttttaaacttttaaggttaactattgagttaattaaacctttatttgtcctctgtcaatatgttaacataggtaatgctctgcctccttgaacacagctgaattctctagggtataatttattcctgctctgccagctgaaatacagactctctgaccttctctttcccctagtgacttggacatttatttagtcatttatggttatttaagtgtcagattatattatttttgatatttgtcccataggacattgccaaatatacctcaggattacatttctaaaagaaaggcagaagcatttacaaaagcaggagaaataccaattgaaagcacattacaaaaatctcatttctattttctctactacaaaaccatttctactgcaaaacaaaatgactgctaacgtcacatttataagtgaatatacatttttgcttaacttttaaaaaataacagagacaactaatatgtttgaccttctaataaataatattgttttattgtaccattatgtagtcatcaatgacatttactatagaataaaaaaggtaatgcaatactaagaaaacctattaaaatctaataaaaatatactcacaaatcatagtaagtttccttcagaatatccagatggcttaaaatattcttaaaatttaatatacactggatactcaactaaatttcttatctttgttgaaatatctaacaacacatcaaggtaatatgataattcctgaaataaactaaggcaaacccttatgtgcagtcagtattataagaattaattgttgagaatttcgcttataaggatcagctttaggaaatgttatttgtgaaaataggtgcagcctataagtagttttctaggaaagtttaaagacctcagggggatctcccgaatcccctagttcactcccatcatgctgcaaataaaagagggagaacctgagaggttatgggtcatgctgtctctggacagtgatctcaaactgcagaggtgatagttgggtgtgggggagcagtaatgtgagccagcactgcctgatctattaaccttgtagttttataattcagtagggctgagggagtggaaccagctgcaactgatttctcacttcatctgagcgtgatgtgactgcccactgaaatgtcaaaaaagaaaaaagaaaatggtattaaaaaaaaaaaatccatcatgttcgtccttacaaagaaagtttcaggtatacttcaatttgaaggaaaaacaaatatttatagatgactagtcctgctaaatatactagtgaataattacttcatataaagaaagtaattactaatagccatgttttgtattttaacaaatgtatatcgaatccatactgagggccactctgagaaaaaaattgtaactgtgaccttatggtatgcagacttatagtattatcccaaattttccaaaaggaaatgaggcttccttaaatgaaataatctctcagagatcacattgccagcaagtggtataaatatagaaaaccccagaaggtcttaagggattgtaatgtaggatagatgtactgactcttttacaatgactagaatatagcagaagtaatggaacaggg

SEQ ID NO: 53254 - DNA, 813 bp, Bovine  19866881066102
aaatataccaagggaaaaatataaccctcaaaaaaacagaggagttcctcacaggcagtaaaataaaatcctctgtggccatttctgctttatgttaaaacctgaatgttatgaataaatgtaacactgagttgaaataatttcccatctggtggctgaccgaactgtcttttccttttgttgttagcacagcggttaactatttggaagcaaaaatgaaggatttgtcaggtgggctgcaaagaagagtctcacatcaaactcggaaaaactatgcaaaatataccctcagttctacattgttcccaacaactaaaaaccggcatacaaatgaaaattagacatcattacagcttactatctgcgtgtgtttgtatttctactcagaactataattcctagcttatgtgtgttagtcgctcagtcttgtccaactctttgcaacccctggactgtagctcacaaggttcctcttgcctctccaggcaagaatactggaattggtttctatttcctcctccaaaggatcttccccacccagggatcaagtccagatgtcccacattgcaggcagtttctttaccatctgagccaccaggaaaccccatttcctagcttacatatttgattacattgggaaaatgttaatggtcacccagtaatgctgccttaaggaatccccaaaagataaacacaacacacacacacacacacacacattaatttccatgcttaaatatatggtagattgatgtccaggtgctgttatgtatatttaacaatacaattagagatttatttaataatagctat

SEQ ID NO: 53255 - DNA, 868 bp, Bovine  19866880448244
tgtttttgacaccagcatccgacttccctattgttagtgcaaatgcactatttccttctgaaagactatcccctttcagcttttggctcatgctgtttccttaaagctagttctatctttagtattaatgtagacacatgatacagacctaaaccaatcagaataccagtttgtcctatccacatggttggttttgatatgtccatgtgatgcccttggagacctgagactgcgttgaaatggcaaacagactgtattctagtcaaagagggaatgattatctagggatggaaaagggggtcaagaagtggagagagtcaaacagggccttagtgactatgtttgaccttgtatacagtcatgtcaggtcagagtccacaattttcagatccctaagctgatgaacttctctgtgattaaggctaatttgggtcaagtttcctgtcacttgcaatgtaattaacaaatacaatcaatattaacgatttatgccctctccctgttactagcaagaaaaaaagtgtatcttattttttgcttactgctttccgggctacccttcctggtctgaatttctctgacatgtctatacttggctcataccaacctatacacccttcatctctaagtcacacactgtcagagacttactttgtaagggatgggttatgcttatccatactaagtagtctcttatgtgacctgatgttcatagttactctattctcattttagctttcatctactgttaagcccctttcaagtgggaaataaaaatacactttttaaaaattatacccacagcatgctttcctgtttctgggttatagttcaattataccatatcatcaagctgtctttttcctca

SEQ ID NO: 53256 - DNA, 1516 bp, Bovine  19866880541367
taacaaagaatagatttttcaggacacttggaatatatataaggtttaaggcacttgaatttgacagacttgacaattgttaattgctttttcccaaagtatgattactgtaaagaagaaaaaaaaacctgtgtttagttacatcacacatacacacctatacacacagtctcccccacctccaaatcttctcacctaaatgcatgaatatctgaattatttacacatgtaatttcaagtgatgcctagaaaaagttccctaaaaacatcttttttaaaaaagaaataaaaattccactttagatatagcagttcaaaacccagtacataattaaatacatatgatggatcttactgagtacttaatgcatggaaaatttccttcgacaattcaaatttaaactcactttagttcttataaatcttgcaagagtataatcgacctaactttttttttcaaaacagctaatacattactttcatttctatttggattttcatataaatgagaatacggaatgagaaaaaaaatgctacctagtaataatcaacagagaagcagcttgggaaaaccaagtgcattttttttctcctgtgcagtcttttgtataagtttttggtgattttgaatatgattcattacaaccaacatagtaaatagggtaaaattaatttttgagtcgcaaatgttctgatagaaatcagcagagagaaagctccaggcagaaattaacaatttttctctggagattatgaaaccaattttccacatgccaaagatattagtaaatgcatgtgcagagctatctagataaaagaacatttttctataactttaaggacaatttctatcagaccacagttctattttcctgactcatccacagataaccggcccagaaaattggactggagtcaaagaagcactgaagagggaaccaggtgttctggaatccagttctgtttctgctccataagattgaattagctctggttaagttttctatgaatcaatcttctctaaaagagaggataaaactagatgatccctaaaatagcaagaaactcaaaaattctgcttctggcttccaatgctagccatttgagaaaggacaagtatcttgcctaatctgttttctatcaaaatttctccagttgttatacttcagacaccaagagcaagcataccatacactcatgtaataaaaatcacgtgatagcacatttcttctgggaccgattttctcaactcagtcttgctaaaggtctttgcctacagaaatatttagccttttatttacatttttgtttgacactgacttcaatcacccccattacttttcttcaagcccctttcagccccattgatctccttacaacatttctatatatcagctaatctactcctctctaactaatctatttatcaatatctaccactctttgaaccctcagttgcaatttttatcttcttggatctttcctgaactaatgaaactggaacataatcgaataa

SEQ ID NO: 53257 - DNA, 3109 bp, Bovine  19866880851460
ttcttgcctggagaatcccagggaagggggagcttggtgggctgctgtctgtggggtcgaacagagtcggacacgactgaagcgacttagcagcagcagtagctgcagcagtagccaaagaagtgactgtagagtgactgtcagttgtacattccagatgttttatatctccttgataatgttctagcccaaaataggccttttacccttaatttgtaagaactctgagtctaaaaagaaagcaaaatggactttgatttagtttataacttaaaaaatgcacatttaactctaaatcggatatatagatactttctccacatcctcctccacactcactcaagtacacacagccatacacagatttattctgctggttgcaatttagttattttcaccccttgtgtaatgcaacaaggatacctttgtttgctagcttgcttcttcattaatttgagattaatgcattctaaaaccaaccaaaaaatgttaccttaggatttgagattattgtaatgtagtttggcatttagtgattcttataaatgaaactgaattgacaccaagttcaaaagtaccatgagcatatttaaatatttctctgatgaactgtgaacattcaccaattaatcctctgaatacttccaatcagttaattttccagcaattgaaaagaagagaactacataaaggcatgttcccagtttgatgtgtgtgtctgttttatccatttactgtaagaataaattgctctgtattgaactacttatcccttttattcataagtttttcatgtaatcatgttcttttcattagagattagaaagctaaaacttagtatattgtaatatgagaaaagcttggtgtttcatatttttcaatttcaagtaatacagacacatgacttttgtgcaaaatcttcaaaaggcacaacatgaaaaaaactataatcagtcaacttagtacatatcatttttcatttaacattttttcatttttggaaatgtaccgatattagtacatttcactatttggtcaaaagagtagataatggtagtctcattatatgtaattattaaaactaatgtattttaatgtgttcctttgtggagaaattaatctcatttaaaattaaaaggatagattttgcttttctatatcctttgtgcgagcacatttcacaggcttccatggttacatctgggtgcttagtactgagtatttttttaagtttaatttagagttaaaaataatagttcaattagtgacaaaatctgaaaataatagtaaatattaattaatattgtggattaagccacaaaaaagaaaataaacttaaagtaagattacttacttataaggattttctctcaccaactgtacagagctatgctctgtattgccatgctgtgttgtttttttttttttagtattattttgaaccaaccacttcacttctttttagtaataacaaaactgattaatatatcttccacaatataagtagagactataacaaagtaaacaataacaataaggcattaatttagcactgattttttccaagtgttcattatgtcatttaaacctaattataagccaaaagtttgaagtcaagtgggcctaaggaagcattactatgaacaaagatagtggaagtgacagaattccagttgaactatttaaagtcctaaaagatgatgctgttgaagtgttgcgttcaatatgtcaccaaacttggaaaactcagcagtggcaacagggctggaaaacgtcagtttcattccaatctcaaagaaaagcaatgccaaagaatgttcaaacagccacacaattgcctcattccacttgctagtaaggttttattcaaaatccttcaagctaggcttcagaagtacatgaattgaaaacatccagatgttcaagctgggtttagaaaaggcagaggaaccagagatcaaattgccaacatttattggattatggagaaagcaagggaactccagaaaaacatctatttttgcttcattgactatgctaaagcctttgatttcatgaaccacaacaggttttggaaaattcttaaaaagctgggaatactagaccaccttacctgtctcctgagaaacctatatgcaggtcaagaagcaacagttagaactggacatggaacaatggactgtttcaaaattgcgatagaagtacatcaaagctatatattatcacattgcttatttaacatatgtaaagtacatcatgcaaaatgcggggatggatgaagcagcaactggcatcaagattgataggaaaaatatcaacaacctcagatgcgcagatgataccactctaatggcagaaggtgaagaggaactacagagcctcttgatgagtgtgaaagaggagaatgaaaaagctggcttgaaactcagcattaaaaaagctaagatcatggcatccagttggtgccatcacctcatggcaaatagaagagaaaaaatggaagcagaaaataaaatgtcactgcttgggctttaaaatcactgcagattgtgactacagccacaaaattaaaagattcttgttccttggaaggaaagctatgatgaacctagataatatattaaaaattagtgatatcacttgctgacaaagatctatatagtcaaagctgtggtttttccagtagtcatgtacagatgtgagagttggattataaagaagactgagcaccagataattgactttttcaattcttgatgctggagaagacacttgatggtcccttgtactgtaagaagatcaaaccaaacaatccttaatgaaatcaaccctgaatgttcattggaaggattgatgctaaagctgaagctccaacattttggctacttgatgtgaagaaccaattcattgaaaaagaccctaatgctaggcaagattgaaggcaaaaggagaaggggatgagagagaatgacatggttagatggcatcactgaatcaatagacatgaatttgagcaaacttcaggagacagtggaggagagaggagactggtatgctgcagtccacaaggtcacaaagaggggtcagacagacattacgactaaacaac

SEQ ID NO: 53258 - DNA, 1225 bp, Bovine  19866880853085
tgctcaaagtcatgtccactaagtcagtgatgccattcaccacctcatactctgttgccaccttcttctcctcccttcaatcgctcctggcatcagttccaatgagtcagctcttctcatcaggtggccaaagtattgaagcttctgcttcagcatcagtccttccaatgaatattcagggttgatttcctttaggattgactggtttgatctccttgctttccaagggactctcaagtgtcttttccagcaccaaacttgttcaaattatgttgtagaaaaagcacttctctcacaaaagtctatagatttctataatttctatgtaggacatacaaaattattacaattaaatacaccattctctttctcttttggttggctctcaaattgtagctcttaatatttaaaacttgaaggtatatcatggatcatatctaagagtttataaaggcaacaaaaacagcagatcgattgcaacataatgaattttgatccaggttctgggaatgttcttgtgtagagtcttcaaaccaagtttgaattcttccctattccaggcaaaattccattgtcatattctattcattcaaacatttaggaatattacggcatgccccagatcctcatccaagatttgtctaggatttttacaaatagtttctgtcttctaagatagaagccctttctatgattaaagacatttaagctaatggagaatagacacactctttagattcattttgcattcatgagatcattcaagttctttaaaaaaagtcatcttctaatccgagcatgactaatgcatttctaggttgtggtcataacacttgaggctgaaaaagaaaaaaattaaactcttaactttagatgttttgcctttatgtttgccaccattggaagatttttaaaagtttgatcagaacagggcttgttttacaggaggttttcctgtgaaaaggaagtgggtagagggaaatgaaagttaatgcataagcagagttcagttactctgcttctcctagaatctatgcatttcttctgagttatttttaaatagatatgttagatgtcctgttattctgaataagtgtctagttttaactaggcaaggtacgtaagtgttttaattagatatccagatacaccatctgagacttttttcccccagaaaataaaagtaatttaatttcttcttcattaaatataagggcagtaaaat

SEQ ID NO: 53259 - DNA, 1287 bp, Bovine  19866880897847
tattccatatttagacaaaaagatgtctctgggctattacaacttgtgcaaattgcgtccttagttccatgtccgagtgctgcaaggaaaaaaaaaaaaagtacattttcaaccaaactcaatttaagttgaatagaatgttgatttaagacaaatttgagaagaggaagcaatagatatgaattagcaggctatttatttttaatataacagaaaagcacaagaaaggaaggaaaagtgaacataccaatagctatggacagttttcttcagtgtagaggaacaaaccagaaggactatcatgtaaatgataacttaaaaattcaagaatagttaattaaagagcaacttatttatttagtgctgatatgctaggtttgcactaaacagcattgtagtattctatggatgcttagctatttaagatattttatttctacagacttcttatgtccctgtatttcttgaagtacagtcaggaaaacatgattactagttgagaaattgtagttgttagttttccatattgagaaaaacattcccaaactccaaataggaatcacactgaacattttagaacaattaacagggaggaggtaagacatatcacgcaccaaaaattatttattttcagttacttaaaactttttattgtttgaaacagtcaaatctagcgcgatgatagtggtttggtgatcctttatagttctaatttgtagctaaagaaatgtggatctcttcacttatccacaagatagctggtttaattgtctttcccagcaggaaaaaatttaaaatgcttcttcttggttggtagtgtgtatgtatgtgtgcactcagctgctgagtcatgtccgactctttgcaacaccatgaactatatagccctccaggaaatttctgtccatagaattttccaggcaagaatactggagcggttgccatttcctctttcaggtgatcgaaccggtgtctcttgcattggcagacagattcaatggcaacccactccaatattcttgcctggagaattccatggatagaggaacctggcaggctacagtccatggggtcacaaagagtcggacaatgactgagcgactaacacacacagggttaaatattcaacatcatcattattacatctgaatcactatttacccagaagttttttaatgcaaagaaggagtcaggtctgatgctgactattttggaatatttagccctaactatctggacacaccataagcacaagcatgttttattttactagtttcccatattcat

SEQ ID NO: 53260 - DNA, 1444 bp, Bovine  19866880909284
atatttaatgatgagaaatgaggctgcccattatccaagagtgccattttaaacagacttttctgtttcagtgtggtgctatttatgaagcaaacccttatattaaaactaccacctccatattgatccctcccctcagctcacctttacttcctgcacagatgagccgtgtgattgtttttttgtatttcatatattttttaaaagtaacgtatctgaatgtagaatgtattttactgattcctttatttctccagctctgtaaacaatgaaatagttgttttttcaagtcgatcactctcagtactatagacactagcgtaagatcactacctggtgtaagaagtcttagaatttactacaaaacaatgtggaatgttttttgttaaatccacacaaagactttcttcgactcaatggtgtggggcactatgacagcacagagtgtcaacagataaacggaaatacactgttacaatgctattattagtatttataagagctctagtgctcttgataaatgaagccacattaattagtttcaggattgtatttccactttggcatatccactagcacttctgaacatgcaattaaaatatttcaaaatgtcacttatgtttccattctacaagaaatgcatactgattatggccacttgatttatacttggacacatacatttagaaacaaaatgtgttaacattttagggttaggaaatctctcctacactgcttgcaataaaaactgatgaaaaacaaaactatcaatgctgatgcaaatgtataatgatagcatttttctgagtatgaaatatgtccagttgtatataaatgattcaatcctggtaagtttgctttgcttttattttggaaaatgtaaattcaatgagaattttgggataatcagagaaagcagacagctttttggacttctcaagttagctctctgttaaacaaacagcatcactgatttgaaagttagtaacccatgtattgacattaaaacaaattaccattctctcttaaattatgggagattgattttcatctttgtccaataaataccagaaatcctttgattcatactaagagtggtttaaaacaaagttgatatattttctgttttctattaaaaagaaaattacagtatagattagatagatgaagatacatgtatacatataaatatagatgtatgtgtatataataataacaatattttccaaattgtttggccaatgtaataccagcttgatttcttgtacagatgtagtcagagagcaaagtaaagctacacaagggaccccctgcactacttccttgatctcaggaagagggaagagatgtctggacaaatgtagaggcatgttgctaattgctttcctataaatgataaattgagttttggagaagaacaggttgtatatcggcagatcccaac

SEQ ID NO: 53261 - DNA, 757 bp, Bovine  19866880920089
taagggaacaaattaatgccatacattgtcagggatatatgtacacataatattttggggtagaaccaatataaaaggttctataatatctctttcgtattattcttggcaaattgtattcattaccttcttatatgacttgaaagtggtataaatgtacagatttttgaacctatacctcagactggttttttctaatataaagataaaactaatattgccagaataatgagaaagataacaaaccttttctgcacttttactagtggtacaaatcacccaacacaattagaaccagtagaatttttaaaacgttaagtctaatctacataccatagactattaatgggaaagctaagaagatctgtgacagttcccccaaaatttataaaatggtcttactagagacaaacacatgcttccaaaaaacttccctttattttgtctcagatagaagactggccaggaatattgtctattgttcatatttctaaccaagtacctctccttcaatgtacttattagagtgtatagtctatataaaatctacttttccatttaattcaaaatcaaactttaagaaattctgaattctgttggaaacatttaaagcatgttctgttctttataatgtttccctgaattggaactgcagtattttaaaacaattacaaaatattactaggataaacatcatacacaccatgggcccaaattttctagcaacaaaatctctagaaacattttccttttttca

SEQ ID NO: 53262 - DNA, 968 bp, Bovine  19866880955281
tttcacaaataacctgcctttagaaaaacaaaaaccagtgcatgaataggagacttaggtttgagatttcacatggatttttaaaattatatttagaaactttgtaaattattggactagacctttattttcttgcaaaaaacaaacttaaaacataacgggagatagttctcattatatagctgtggcctgaggtataataccttttatagtatatgtctttgagggagcttaaggctctttgtagaagctatctcattatttctcagagaatttaagttagtaagggataggtattattttctgcattttatagaccctgagcctaaggcacaagagccagaggtcagctaacttttctgaggtcaatagggaatccataaggttgcttggaatagaatctttttttaatttttctgtagtttctaatatatatatatatatatatatatatatatatatatatatatatatatatgtttataggagaaggcaatggcaagccactccaagtactcttgcctagaaaatcccatgtttggaggagcctggtgggctgcattccatggggtcgctacgagtcggtcgtgactgagcaacttcactttcactttcacgcaatggagaaggaaatggcaacccactccagtgttcttgcctggagaatcccagggacggcagagcctggtgggctgccatctatggggtcgcacagagttggacacgactgaagcgacttagcagcagcagcatatatatatttctcattaaacatacaccacatggaccaatggaccctgcatgtaattccccaacaagttttactgtttgccttgcctttgtgattttaattttatttctctattaatttcttgttagtttacttctagtctcggatttatttcgttttgggaaactttatattattaggcatattttttgcttgccatttttgctggcatcttcaa

SEQ ID NO: 53263 - DNA, 1537 bp, Bovine  19866880967514
ctgtctaaattagaagaaaacaaacatgataacacaaaagatggtgagtaatatcttttagaattttttcatttgagaatgaatgtgagtttatgttgccgagtctatctcgatggggtgaggtcgggtgaaccaggcctgattttacctaagcaattttatgtcatcttaggtggaatgatcttagcctagaatgtgggatgatgtgggtaaggccagtgatttcaagagcaaaataagatctgtgaagtgtaattgagttttggagataatttgtttgtgctgtagaggacaattacataaaaaataggttgggcattttaatggtcctgattacctcactctgtgagagtggtgcgctcgttgtgagacctgttgaatgcatgtacattagaaaatgactgaattttcaagttggaagagactttggtgggtcatgttactaaagttctttatgtcctatatggtagtagcctcctctatttacctttcataatctccattttactgtagggccacttggaattgaaataacctctgaaaaaaaaaaaatctacacacacacacacacacacacaaagtaatgtaacaagtcagttgactgactcatatcaaaagaaacattgtgctaaataaccataatagcctacaaattttagcaactgcaaatgaaatattggtgttcagattaaggaaaattggaacacttttcatttccataataataattctgacagttaaagagagaataattttagttataaaaagattttccttttcatcttaaaaaagtgatatgactaaattatcacaaagactggaacttcttagattttctataaatgttaagcaaattacaaatagagtcatcttaatttttttgttgttgttcatatgatctttgcagcttttgctttagtcacgtatgaccttttatggttagtgtagctactaacacaagcactttgttaaaaggaaacactgacttaaaatatatcattcattatgcactttggttaaaaatgtttgaaagtcactgacaagaaagcttgtttaccaacagagacagattctaatcctgattcaaaattttgggagggctggggatctgcagttttaatagggtgattcttatacagatgggttgagaactacattttaagaaatgctgatcaaatttacagtagttaccaataaagctggaattactgagccacaattacctgggacattttagagaaataatcctgcctaaacttgatttacataaacacacagcaggtgtttgggtttattttcttattgctttgctgccagaattcagagagtaattggagccctggtttcagtctacttagagatgttgttttgtttgttttattctgtttttcctggagattaaaaaacctgattataaactctgttagccctttgttaaggtttctctaactacatatacgtttagtttatacaatcaagttaagaaacttaggatcagaaacaaattctaagaactaacatagttagctttcaaccc

SEQ ID NO: 53264 - DNA, 1064 bp, Bovine  19866880974012
atagtattatagacattattgctttctctctgccacatgggaatagtaatgaaagcattaatttaaaaaaacttattcccaaacatttataacccttccagtgattatgcattataccaactaaatcatatttctttatatagttctatgaaatatagaatggaaaaggtagttattacccaatgtgaataatctagatcttatggtgactctaaattatggtctccaaaagtagattattattatcacttataatatatacaattcagtgaaggcacaggaaaggtgaaaatcacctgtttttattacctatcagatacacttacagggatcccctagcatgatccttgactgtcatcttgacatccctttcatgatctttttcacttttgttttcaaatacttttccttattgtcccactttcagaggaaatcttcaacattataaacactgatgcccccagaaacgctgcctctttctgttaatctcaatagccctagagaggatagcaaaataagacatttcatttctacattttcacttgacttggcttagactgataccaggtgacactatacttcgggttgtggatgttgtttggggaagaagagagtaaaataaaagataaaattatcatttcaaaagtggctacattttggggctaccttatctaccagctttcatttaaagtaacaactctaagaatgattgcctactgctggaattctcaatatcttatttcattttaaataattctctgctactggcagatatgaaaacattaatagggcttgaaaaatgctccacaggggtaatatttaagtcattagggtcagagccatgtgaagtttttcatgcataaagagatgagttcgttatggcaaagtattcctaccatgtcttttcatttgtaatatagaattatgcttggttcgtccatattttactgtgagactgtacagattgcaacatacacacacagggaccatctcatatatctttgaatcattcaatatgcttggggggggccttgcatttataaaaagtatgctcaatgcattta

SEQ ID NO: 53265 - DNA, 732 bp, Bovine  19866881011834
atggcttctgtctttaagagacctgcatatattttcctggatttactgttaaggagaagtaaataccagaacccagtaactcacagagaagtcatcaaataattattaaagatcattcagtgcccagtagcaaagtggttcctaaaagactgagattgcagtcaattctcaaaaattcatggcagtgagaaaagccttgtaaaaatgattgccagtcacagaatgtagatagactctgccaattaggtagcaattcataacactcattcacatattattttaagcttctaattaaaccaaatacatttgtaaatgtagaaatcaacttttatgggtttttggagataatgttcagatcacagtatgaaacacctcagttataatacaactcaaacataaagggctgaagggattttaaaggggccaagtcatcacaaagtatgtctaatgtcagagacaaatgaattatagattaattcactccctgtcacacttacacacacaaagagagaagcaccagaaaagagcaaatataacgtaaagaggacaatctatccatcaaaaagaatgatgaaatcgtatctttattaagtatctaaaaataaatgataataagggtgagaaaaattgaaataataaatgaatgcttttgcactatattagtgataaccctggagggttctctatattcatttgcttcatagaattatcctgaggaaggaaatatatgca

SEQ ID NO: 53266 - DNA, 745 bp, Bovine  19866881068353
actgactattaaatctgttctacatttagttgggttttcaaggctcctgcctagaactttttgaatgttctttcctttttggtcagtgacaccttcacagtttaaggaaatatttctttctttttcatcagttgctcgtttaccgcgacggtctgtcaccttcctttcctcctatctcttcccctacgacacaccaacttgaacctgggctccaaaggcactacgttagaacacttctgttcacataaaatcgccttgcctcatttaattaaaaaagaaaataattgatcattattcagagtacattttaaccatcattatcatgtaaacagcattgtatacattaaaatatttaggtatttggttttcacatttcactgtacatattagcgtgagtgatgctgcctattttaaaaatacatgttagaatgaaaccaactgaagcctagctgctcagtgccttttcaaaaatttgtataaacatctaaatttagaaattgccattatctaagtgtcatttacctacaggtaatgcaatttcagaacttttagagttgtaaaaatctatcatcatttccctacccactgcttccacattcattctataatcttgccatctgcttcactgaaatggcagacccagagggcagggagcatatcttatctgtgcaatgctgtatgtaagtgtggattctctgtcagcatttaagaaataatagaacttcaaatagggtgatttagcctc

SEQ ID NO: 53267 - DNA, 1698 bp, Bovine  19866881238432
tgaattataaaagttttagctctcaaatgaaatcaattacctataaactcacatcgcatatttagattatcccagagagacaacaaaaagggatttttttttttttttctcccccacttcataatggccggggagaattgtttatttgtactggtttcattgcttatcagttatttgtcatctttcagttaatctgaaaattgctatgaaaaactctttctacactactccctgtatactttgcaaaaatattaaaattgaaaacagcataaaattctgtgcattacctattttgcccatccttgagcttacttacagatttaaagagtctaatattcagtggtttttaggaaataggtgacatatttcaatctttattccagtaaacaatccatattgcttatataatacttgactcaaaatgtgaaaatcaaaccaaaccaaccaacaaacaaaatataaaataatctctgaaaactaatagttccaaataaaaatattaatttattttttaaactctccaggatgtcatgaaccattaagagacagcaatttttgtattttctactgtaacttgagggcctggaatagtgccaggtacatcttaggtagcaatatatatatatatatatatatatatattttttttttttaagactggataagtgtccaaatcatgtgaataaactctttaaattaaatgaaattgtgaatttaaaatgtatttgataataacaattagcgagtggcctgaaatcactcctcaaaaaggctaaaaatcggagcagaaaaaaataaataatcccaatattatgcacaatagcttgaaactctgttggttattaaaatagggaaggagatcagaattaatatattctcctggggatttagagtcctcagggactcaccaggtttttttttttttttttaagttcttcagactataatatgaataaaaaacactgaaatcatgttttcaagttctttattaaaataagtatttaatgcaggaaaaaaatccaagtcataaatgtgactacagggaaacaatcatcaaaaagtgttgggagactctgaattgtatttgtgtagatcataaaagtcttagaactggagttaaacaggaagttagaggtcatttactctaatcttatgtctgaggaaatgattctttcttcaaatacaatatacacaattacagtacattttcatttatctgagttctgagttactcgaaagctcagctcactattttcccacttgacttttatgaaaaagaaagaaattataaataggaaagaaaattaatacacttaaagataactctgggatacttcaacaccttgaagtgtcttttcagccatcagaaaaagatacaattatcttcagtattattttagtgctaactctttgacttcatacccaggtgtggaaactctaccttatgtggatattgtgcactgtaggattttccttggaatacatgagtattagataaataaggcaagacacaaggttcaaatgatgctgaataaagaaaagaatggacagtatgtaggaacagtataaattgtgagaaatatagaaagaaacaaaaaaggaaagaaaaattaaaacttgaagatacagatataacaagagataaaagaagggactggaaaattcttgattcttggggttataacataacacatcact

SEQ ID NO: 53268 - DNA, 729 bp, Bovine  19866881291962
ggaatgagagggaactttaatttacacttatcactaaacatgataaatacaatttacagtttaaatatctaggttgaaatcactttaaacatctaggtagtatatctttgatccaagagtatattttttattaaatagataaataagaaacatacagaatattcaatcatgcattattcttaatatattcttctacttccccaccatgcttcagaaaatgttttgcctcattacctaaataggtttaatgatacagtaagcaaaattacgtacaataaaactaaacactaggaatttcagagcttatagtgtgaatttttaaagtcattagctactctgccattagaaataatcagacatcaactatacaaaatcacaaaaatctctgtagtgccaagaatacctttatcagtaaacctaggaattgttttccatgtggaacacatgagatttttaaaaattattattaatacacaaagggcacctgcacacaatcagctgaaagcagagtctgttgctacagaaaatcaaaaggctcatttctattaactaataaggagtctttgcagtctaaacactcacttcaaaagaggtcatttatatctttatatgaaaataagtctcccctaaacatcaattatgcaaaataagatgtgtaagtttttctaatccaaggcacgtacatttttatcatttcaaaacaactgaggatatatttgacaaagatga

SEQ ID NO: 53269 - DNA, 1469 bp, Bovine  19866881367554
taaaaaaaaaaaacaaaaaaaaattaaatatcttcaacatttcccatcccccattacaaattaggagaaacatacaacttgtttggcctgctgactttcctttattaagtattattttaaaatgacttgattaaaaatatatcattcagcatatattatcacctccaacatgctatgttaatgcagagatgtactgaggaaagagttcaacattatgcacatgaatttagaaaaacaacttgtgtcggcatgtatctcgagatataagtgtctaaatcaatagacagttatttttgtgtgatttaagtctttgtcttcaaatatacacagactttatcttaataaacgcctgaggatttggcctgtcttcatcatcagttttaaggatcttacctgtcatgaatatttgaaatttactacctgccatactaatgctttctaaatatagacatagtctaaattctaaatctatcaaagcattatctcttatactaaatgcattttaaaacccaacaaaagctccatctaaactgatacttaaattattaaggactaaatgtacagccaaaatcctttccttccgtgacccaacttattactaatattattatataattaaaaagtaacttgttatataatggaaaagacaatgctatgaatttcagaatttcaaaataagtgtattttgttctcctcaagcacttaattttaccatgtttatctttagctggtacttttccccataaaattacctacatggaaataatgtaaaactttcagattgattgatagattttaattgctctggtatgaacaacaacaataaaaatgtccagcatgtgcttaaatcatgtttagaattcactgattttactgttatatttctgtggcaattagtggccagtttagttttgtggaatagacaggataaattgagagttttctaagtctacttaaatcattttcattactgataagaaagcgatttgaatactacaatagggagtataatatcttgaaagatgggtttcatttaaaaccatggattatcacctttggaaaagcctttgaatcgttttgttaaaaaaaaaggcaggtgccaaattcagacttttaaggactacgctattctcatcaattataagttttgttatcccccaatattatacaagccatgatgaaactgtttataatcaactatactttaaaaataagattgaatttttccagttatctgactaggtgaagagatgttaccaagtggctgccacatttctacaatttttttgaggaacccacttgtcaattcacagaagcatgtcccaagataagctcaaaatgtctgagcaggtgtgataaactaacaaagtctctcagagagacagagaagtgctttgtctctttactttatttggctttgtttcaaagccttttctttttcatgaaagttctagctcagtctctccgtg

SEQ ID NO: 53270 - DNA, 832 bp, Bovine  19866882038009
ttgcctttccttctccggggatcttcccaacccagggctcgaaccctgatctcccgcattgtagacagacactttaccgtctgagccagcagggaagtcctgttgcatggccctgcataaacctttctctacccgaacattggtgtttcagtattgtttggcctcactgtgcatccggcacaaaaatttgcattctgtaacatctctagttatttttctttatgaaactttgaatgtaatgattgcatttattgagagaaatttgcttaaaatgctcatgaaacactatgcttagtctattatcattttggttaaaggaaacagagggagcaatggaatcttcatgaaaaaaatatttaataccacagatggtaccctccatatgggaaagcatatttgggttgttaagtattgtgtctctggcctgaccagagcacattaaaccccagttaaaatcaaatttcatgtcaaagcacctttgaaagagaaatagtgaaattccaaaggggaaaggtgcatagaacagattaataaaacccattagaaggtgtttgaaacactgttacacgttgaggatgtgactttggtgagtgagaatggctaaaaatgccacttgaactaacttgccacttgaattatcactttttaaaatcttatattaaatatgaagagaaaaattaaaggtatataatttttctgaaagcttctcagtgtttgggcagagaaaaccagactatgtctttttaagggatattggtttatagtacatttattcttatgttatagaccattagtattatagaacatcatattaaaacaatattcaaattga

SEQ ID NO: 53271 - DNA, 2996 bp, Bovine  19866880649588
ggggtgagagaagccgcgatgccttcgaaaggcctggggaggggctgatcgggctggactttccctctaatgggggattcatggagtgtgttgtgcagatgagtgaggtcatctgacctagatcatagagggaccactctggttgttatgttgagaaggttggagcaagatgacccatgagcaagctatttcggtaccagtggaggtagagaggagtgtttggattctgctgctgctgctaagtcgcttcagtcatgtccaactctgtgcgaccccatagacggcagcccactaggctcctctgtccctgggattctccaggcaggaatactggagtgggttgccatttccttctccaatgcatgaaagtgaaagtgaagtcacttagtcgtgcctgactcttagcgaccccgtggactgcagcctaccaggctcctccgtccatgggattttccaggcaagagtactggagtggggtgccattgccttctccggtttagattctacatatacgtattttttaaattggagtttagttgctttacagtgttgtgtcagtttctgctataaagcaaagtacatcagctgtgcatatacatataacccctctttgtcaccacagagcattgagttctctgtgctatacagtaggttctcattgtgtacttggtcgctcagtcgtgtctgactctttgcaaccccgtggactgcagcccaccaggctcctctgtccatggggattctccaggcaagaatactggagtgggttgccatgccctcctccaggggatccttccaacccaggaatccaacccaggtctcccacactgcaggagaattcttgattgactgaaccaccagggaagcccaggttctcattagttatttgacacatagtcgtgtatacatgtcaatcccaatctcccaattcatcccagtcttcctttccctccttggtatccatacgtttcttctctacatctgtgtctctagttctgttttgcaaataggttcagctggcagagcctacagaatctcctgttggattagagagacagtgtcagagaaagatgggtcgaagatgaccccaaggttttgtcttgaacactggcggaatgcagctggcatcagcttgacagggctgactctgggcaaagaggtttgctgaaaaacatcaggtcctatgcttttaccctaaggtcatgtttctacacatcggtatttccaataccaagtacagtgcctgctaggcagggagaaaatacacactgagtggacaaatgagtgagcagataattaaacacaatccccaaaggaaggcaacctgaggtcttgctatttccttgggttctacccaggaagcacagggcaaaagtcctctctgcttgcagaccccccaaaactatctgaatttctctcatcctaaatcatttccattttcagtcagtgtagtgatagagtaatgcccccattctcagagcagaagcggaagctctcttgttttcctctccgattatcttcttccatcccccagtccagatcatcttgatctgtttccaagaataagaaaaactgcctaattctatattttttcaaatcaaaaggttttatgcttggttttcagctttcataatgccaaacataattgtactcttagattctctgagtttagaccagctgatttaaatgtggcaagatactattttagtttattaaccagcagcatagtagtggcttaattagggcaaggggagaggtgaaaaggaatgccaggaatgaaacacaccagttaatctaccaagtattatgctgctactttttgatcattctgatgaaacagctttgcccctggaataggctctttctatacaatcttcttctaattgttatcagcttgcccattgatccacagtaaattagtctaatgatatttaagtaaaacagattctgtccatgaaattatacaaactataacaatgttgacactggtcatactgtgcaagctaataattagacattgtctatgtcattttctgaactttcaaagagaacattaaacagtaaggcatttgttaatggcagaacattttcaggggaaaaatggctggcatgagaattgagggggaaaggatcaacataacacagtgataagaatgaaatgtgaaggggtttctggggaaagagcagagaaatggttatttcaataataggaccgagcatcctctacttttgaattctgccagcattaatactctatctaattaattcttttttataggttaatctccatctcttgttcgtgaagatgctaattccctgtgagctcattaaataactgcagattcttcaactcatgagggagaattcctagaacccttgaaatttctcagattcataaacatcatgctaatatatcattttcctgatacaatgtagtttcatataagtgcaaaataatatgcaaattatccagctctcacttgatgatcagcttctgtcctggctgaaacacgtactgaattcatttcataaaattttgctttttctaattttcataaagaacatatggctggcttgtttatatcatagatcctagtcagcaatgaaattaacattccactcttatccaaaaggtctattttctggctaagaaataatgcttttttagtctccttcacttacctcatcattccaaaagttgtcttcatttcagacatcatttatctcttttctggcagaagaaaaaatgttcacacacacacacacacacacaagatcataagttgagcccacgcccaaatgcacccaccctaggctgcacactggcttctggtcacattagtgtccaagggactgagacctgttcaccagcctctaggattcacattagtttctcagcaaaattacaaatgatttcatttcatgaactttcatgtcacctgcaaaatgacaactacaagtgttaaattcagaagacgaaggttttactctggttc

SEQ ID NO: 53272 - DNA, 1709 bp, Bovine  19866880728539
acagacacaatcacatttttacagatttttttttttttggtagtagaaaaagctgtgtttttaaaatacttaaaaggaaaaaatagaactgaaattacaatataaattctgtaaagaatgcacttcgaatgtatttttgtcttgaattcacgtaataacagtatgatgcatacctcatatgagaagacattactaacacagctacaatgcttccctttcatttaaataccacacaagtaggcacataacgcttttgtttgggaagagtacataaatacgttcatccccacaatgacatgaaatgtaagcaagattttgtataaaatgacgtttaagtgtttctaatttttcccacaataagacatcaatttcacttattttttaagaagcgtcggtattattaattccaccctctaatttctttctgttctttttgatcagtatttgacatagttctactataaaggatctgttctcatagacaaagactgcaagctacaaagggaagctgtggaagtttctgagatcagggagcctgaatatgggaccataattaactgacatagacagatgtgtggatcagcttctacgaggtcaatgcagagaaagcaatttctgtcatgtggccataaaggatgtttccataaagtcatctctagaactcaggaggggaatgaaagtaatcatttccctgtgggtgcttcactctgattcagtgtagacctgactctgacatttgtgagacagaaggttaagatgacaaatacaaacaaggattacatgtgtagaaatatttacccgttaaaaatcagcctaaaaactatgaaaacatatgaccactttaacaaattacctttataatgacaaagtagaaaaatgtatagaaagctgtggcttttataacattgcaaatcagtaaaacagcaaatgactaaatttaaatttttgtatagatcaggatgttttgttgatgcatcagtaagtcacaagacatataatttgtaaattataattaattccatgaagtttatttctcatatgttcctttccacaaaatcaataattatggtgttataataaagatacatatatatacatatatttgcccaattatatcagtaatcacccaaagaattatttacagtagagatcaagtgactatatttcatccaaaatgtaaatgaatgtttacacaaaaaatacaaaatcattttatatactttataaagatattttcttccataatagagttattaattaaaacaaaggtaaaatacgaatttcatttaagatttaccaaaacttttatcaatttaagttgctgactataactaaaattagacatccatttattttttgaaaatgtaattaagtacagaaataaaactatttgtaaatccagggctcaatgttcatctaatttccaacataaagaattgataccatatttcacacacctagacctacatatttacaaataagagtgggcttccttggtgactcagacagtaaagaatccacctgcaacttgggagacgtgggttcgatccctgggttgggaagatcccctggatctggcatggcaacccactctagtattcttgccaggagaattccatggacagaggagcctggtagtcggatacaagtcagctactaagcactgcacatgaactatttgatgtcaccaaattttcctctgccaacac

SEQ ID NO: 53273 - DNA, 2396 bp, Bovine  19866880826068
tcaagctggttttagaaaaggcagagaaactagaggtcaaattgccaacatccactggatcatcgaaaaagcaagagagttacagaaaaacatatacttctgctttatcgactatgccaaagcctttgactgtgtggatcacaataaactgtggaaaattctgaaggagatgagaataccagaccacctgacctgcctcttaagaaacctgtatgcaggtcaggagataacagttagaactggacatgaaacaacagactggttccaaataggaaaaggagtacgtcaaggctatatattgtcaccctgcttgtttaacttatatgcagagtacatcatgagaaatgctggactggatgaagcacaagctggaatcaagattgctgggagaaatatcaataacctcagatatgcagatgacaccacccttatggcagaaagcaaagaagaactaaagagcctcttgaaagtgaaagaggagagtgaaaaagttggcttaaagctcaacattcagaaaatgaagatcatggcatcgggtcccatcccttcatgacaaatagatggggaaacagtggaaacagtggctgactttatttggggggcctccaaaatcactgcatatggtgattgtagccatgagattaaaagatgctcactccttggaaggaaagttatgaccaaattagatagcatattaaaaagcagagaccttactttgccaacaaaagtccgtctagtcaaggctatggttttaccagtggtcatgtatggatgttagagttggactataaggaaagctgagcactgaagaattgatgcttttgaacagtggtttggagaagactcttgagagtcccttggactgcaaggagatccaaccagtccatcctaaaggagatcagtcctgggtgttcattggaaggattgatgttgaagctgaaactccaatactttggccacctgatgtgaagagctgacttattggaaaagaccctgaagctgggaaagattgagggtaggaggagaaggggatgacagaggatgagatggttggatggcatcaccgacacaatggacatgggtttggctggactccagcagttggtgatagacagggaggcctggcgtgctgcggttcacggggtcacaaagagtcggacacgactgagcagctgaactgacctgaatgagatttaaattgttttcaactttctgtcacttgtgtgtgtatatgtgtgaatcagttattttagactagtatgcttttaaagggactgtaatctctacacatactaatgtcatctcacactgagtataatataacttggtcataagattcttccaacatatgactttcagctgtttgaaggaggctttagaactacacagtattcacattttgatagagaaaaaaataagaatgtttgctctatcttttctaagatggtaagtcaaagagcttaaatttgtggagaagtaccctaggttttggtttaaggtaaaacaatcttatagctatttaagtacaggcagctcatttcttcaacaatgcagttcccaacactttttctgtctttttcaaaagcaaagtgtggggattaagctcattattctaaacagtgagtaatataggtggaacttatcttttgcttcaatcgcagtgcatcttttacgataatacacttatatttccttgtaagggatccataatcattccacaagagaattttctcaaccacataatgtttcttaaccactcgaagaattattttaagacacttaaatatctttcaagtgttccctccaatttttatttttaaatcctgaagtatctagtgagcatatagttctttcttataactattttcttttttagaatgggtaaaaactcactgtcaacacattagtgcaagactgatgtagataatttcaaagccagtagtcatggtgttcaaaagtagtgatcctttgcatgtaaccacatattacattttgaccatttcattgattgaacagccactatgagctgacactatattctatggttatgaatatgagccagacagaagctctgcagtcaaggtgcttatggttgggtttacgagataccgtgtaatacaagctgagaggtgggagatcagagaaggattcattaaagaattatttcttaattaggttccaagcaaggaagtcatatttagacaaatgacaaccggtttttgttccacaaagaaagagaaagcctgtgtaaacgggatggaaaagaaagggccaaaaatatctctataatgcaatccattttgactgccaaaggagttcgtgctgggagatatgtaaaaaggagtgtcataaacaaagtatgtacaaatcctgagttataaattatgaaggaaata

SEQ ID NO: 53274 - DNA, 1076 bp, Bovine  19866880864426
aactcaacctgtatatttaatgcatataattttaaaagtttcgaatacagtaaatatttttaccttccttccttccttcctagtaatacaaggactttaaaatccttcagcctcagatataatctaagttatatgctaaatttttcaggacgtggggtctacttgattttttaaaacccagtgattagatattattttgttattaaaaacatggtcagtgtatatttagattaatgtttttgcttttttcctttgcttaccattttttcctcacatgtcagatctttatccttaaaatattacttatttcctgaggtacatcatttgatcttcctttactgagggtctgttttggtaataaatacttaggtttcatgtgtctgaaaatgacttttttccttcgttcataaggaataatttaatataatagataatttataataatggattagaatggataattctatttaaaagttattctccctaagtcctttaaaggtattccattttcaactgacatgtattattgctgttatatcagctttaagtaattgtgtttccttttaagttatctgtccgtttttcagattacttgtaccatctttgtcacctgttctgtattttaccctatgagctatctcggtgtgaatttcttttttattttgttgcttggaattcctgggtaggaaggtattttccattgtttctgaaaaacttcagccattgtctcttcaaatattgcttcctatttccttattatatataagttgatacatgtaggatcttaatacctgtacttcattatccatttgtgtctttgagctgtaatttcttcagtctcatcttcctatttactacttctctctccagtggaatcaatctgcagcttagtccgtccgtttggtttataatattaagaactatagattttttcttcgataagtttcatttggttacttttaagttctccttggttaattttgatcatttatttttccttcatcatattttcagcttcatcttttaaaaattatcaaaaatacaatcttaactttgtagttaataaacctaatttc

SEQ ID NO: 53275 - DNA, 1783 bp, Bovine  19866881124265
tgttagtcctatcttgtcccttgagttacttaccctgaaaatcagggtcttactgttttccttgtaaatggttcccacacacggtctacaaatgaccagtaaagactgacttttctttgaaaccactttgaattttaatggtttcattaaatacaaaaaaccaattgtatttgttttttgttccaaagaaagcttatacacagaggcagtagcatagaagcaaactcagtggacagtttaccagaggtgggaacaggtgcatgtcacatggaataacccatacattctgacttcatcaccttctcaggttttgagaaatgtacagagaatttgcagcaaagaagctgttgaataacaatagcaacactctgtatttatacagcacctttctttcagagagttcagagtgctttataaacagtatctcattaatcttcacaacttccctataaggaagtctgtttcagctatcattactcacatctttatcaacaaagaagcagtagcctgcagagtggctaagcaacttgtccaaggtcactgagggccgtgagtggcaaagccaacaataaaactcagagctttgaccttccagtttagtattctctccaggaggccaccttgaaggaagagaaacttctcacatgcatattcataagtttcccaagaaaaagctaccatttctcaatattttcatcagccaaaatttgaagctaattggtggccatttcaaatcaaatccaacggctgatggtgatgaggaatccctggaaccatattgagagagcacacagacctcactctctaagccttgttaatcaactagagaccagcagttggttacacaaaactcattaaaacaaccagatcagtgaacatggaggagtgggcagtgaccacccaggatgggaagaccctgcatgaaatggctaaactgtcaattctttccccccaaatgtaagagtgtaatattcattaggataaattgctactacttgattgaattattatcatttattgggtactagacacatgctaagggctgtgcacttgtccttaggtagtttatagtctagtggaaaagtgtggaaatgggtgtacacaagagagaagagagttggctaacactgcttggggaaattagagaaggctgggatgaaacaccaattcccagggttcttgtccaaccaagcctttgatttgaacaaggcatcttcatttcctgaactttcttccacttttcttggaatggcagacatgtttaaaccttcatagtcagcttaaccacatctcttagagaggtccttgtgacctttccaatgggggttcttgttgtcagtcaagggactgtgttttcctaacagttttcagcttagctgatgaaatagagctgtttgttaacaggtttatgatataactccctctccaaactgtaagctccatggaaaaaaacagaataaagattatacaatgtattcagtgaatggatggttattgttcagtgaatggatgacacctgttagcttctctttccttctctataaaataacaatgatgatgcctacctcttggcattgtcatataaattaaatggacaaatacgcaaaactgcattatactgtgttatgtgagtgtgtttggagtcgtttcagttgtgtacgaccctttgcaattccccctggactgtagcccaccagtctcctctgtccatgagattctctaattaagaatactggaatgggttgtcatttccttcttccagaggatcttcccgacccagaga

SEQ ID NO: 53276 - DNA, 998 bp, Bovine  19866881170461
atacctttgaaggtattatgaaggattatgaataccattggagaaggcaatggcaccccactccagtactcttgcctagaaaatcccatgggcggaggagcctggtaggctacagtccatggggtcgcgaagagtcggacacgactgagcgacttcactttcatttttcactttcatgcattggagaaggaaattgcaacccactccagtgttcttgcctggagaatcccagggacggggagcctggtaggctgccgtctatggggtggcacagagtcggacacgactgaagcgacttagcaggagcagcagcatgaataccatgaagggttatgaaggattaactaaattaaaagaaatgacttacgcaaaatacctagggtactaacacagagtagggacacaaaaatggcatcagtgacttttattaatgtttatggtaaaactttctaaatactatctaacgtgtagttagtagttttctctagtgtttcattggtctgatgattctatttatttgatcatccatgaatcatgagatggttgacattaattggtagatgttctgcttacctatcgatgtgtgacataacggttttggagatgtctcctccagcttcttgcaacactcggataatctgaaacggtgcactttgattccttccgggatgaataataacaggacagccaagctgagtctgggcgtgagctgttgcctgcagaacctttctttcactgtcagtcagaggccaggagcaaccaatttccccaataacaccacacttgatactggttccatcggctccacagagaatttcattaacaaggacatcagtaagctaaggaagagtgagaatgaaaatttataaactggattttatcaacagagagtcaatacagtatgtgaatgaatttattcattgagtcactcattcttttaaaaatgtataaatatattcaacattcgttcagttaatatggcaaatagaaaggcattt

SEQ ID NO: 53277 - DNA, 1282 bp, Bovine  19866881221674
cttcacctgggagcagtctcacctggactcaatttcactgttcaatgctaggagacagaacccaaaagaggagttttcttactgtattttgttgttggtgggattttctatttgcttttgttttcatcctagagttttccagttagtgaaacacttttgacaatgcctctcttgcgatgaaaactggacacatatctctttcctcagccataatgaggaaaaggaaaaatctatctttaatgtgaaataaaaggtttcaaatggatcttttgatcccgatctttcttacttaacccaaatggtatgagccaaagaataaatagattcatgataataggcaactcagagaagaaaataagtaacttgtcataaattaaagtgcaaggccatactgtattttgattctctgctatgcttgtctttattgttattaagattgggaaactaccttaggtagtatttctgatggcttcatggtccttctttctctctcataattaaaaacaatattaaagggtaaatgtcagagttgatgggaatcaatgttctattagtgaagattgtctctaccatgtctcaaaaggtatcagcagcatgttctttgactggcatacagagagaagtaatcagagaaaaacaaatatcatatattaacacacatacgtggaatctagaaaaatggtacagatggacctatttgcaaagcagaagtagactcacagacgtagagaacaaatggatatcaagggggatggagaggtgggaggaactgggagattgggattgacatatatacactgttgatactatgtacaaaatagataactaatgagaacttacatataaaatagataactaatgagaacttacagtatagtacaaagaacattactcaatgctttgtggtgacctgaatgggaagaaaatccaaaaaagaaagaatataagtgtacatattgctgatttacttttctgtacagcaaaaactaacacagcattgtaaagcaaccatagtccagtagaaattaattaaaattttttttctaaaaaagcatatatcttcagcatcttcttaaatgtcctcagggagtagccgttcattgtcagccaaggttgcctttgtaagacagtgcaatgaaaagtacactgttctccctcacttaaactaaaattgtatgccactgtgacacatttttcttgaataaatcaattattttaaggaaatacatatgtatatgtatatactcatatatggtaagtatataactatatttattttttt

SEQ ID NO: 53278 - DNA, 729 bp, Bovine  19866881238901
cctggggttgcaaagagttggacgctactaagtaactaacacatactatcaaatctactgaatatcttagcttagctttgcctcagaacacctacatcagcctacagttgggcactatcatctaacacaaagcctgtttcataatgtagtgttgaatatctcacataattgaatactgtactgaaagtgaaaaacaaaaaggccgtatgggtacagaatggttataagtgtacgcattgtttacccttgggattgtgaccatgaagctgactggaagctgcggctcactgctgtggcccagcatcattagcccaggaaaagatcaaaatccaaactgcaaagcatggtttcccactaaatgcatatttctttcacaccatcatagagtccaaaaccattggaagttggagactttctgcactacaaaaatggcaacatcctttgcatccctctaacttgactaaacctttcatgaggaccctcctttccttgggaactgggctgatggaggaaggtagaaagggagagatcattgaaggaggaattttaaactaataaagatttctctaagcattttttagaatttctgaaggtcttctttggaaaaatacttaacctctcaggttttctttatgatacacccacgttttttaagagaaggtggcttgtgggtataaagagcagcttacaagtcctgtgtgatggagctagcaggtggggcttgatcag

SEQ ID NO: 53279 - DNA, 1349 bp, Bovine  19866881313894
tgatttctgaaaaaaatagaagtcaaacttgtaaagttggtaacgataaagaaattataactaaatcatgacagacttgactgaaatgatcccaaaactagagcaggacaatcgtataagcagtatgatcctttagtattgcttttttagattttgaaacaatccactgaactctgtataaagattcaaactaaatatggatgtaatattacctgtttgcctgatgtcaaacttaaaaacaacaacaaagagatcctgcaaagcataccttggcaaaaaacacggtcaggtgagtttcactgccaacaatccaaatagggaattttggagatttcaagtaagagccaacctagaacaaaggtagtaaaataagtaaatgaaaattttatattgcctgttaaatatttaccaacaaatgcttgaagcatcactaaagtgcctaattcatatttaaatggaataatgggattgtgccagaatgccttacccataaaggtcaaacgttaaatgtaaaaatgagtgttataaagactgtcagggcaaagcttatactgcatcattccactagaataataataataataatacagatttaacacagcaaaaaagaaattagtgtaaccctaagaatcattctcatgtctcactgaaaatcttagataaaatttaggccacttctaggaatttcagcttggtacttcaaactctaaaactataaatctgatgataattactttatcaggaaaataatcataaattaacaagtgagtagatacatgaataaataagagaaaaagccttaagaacatcctgtcttcaaagaacttagagcaatataataaatagactctctaaagcaaaatacatacttccatctaggaatagtaaagaatccttcacttgattctttatggcaggaagtaagttcaaagttacacaatattaattctctctaaaatacattaaaaagttatatgttatagcctgcctccaaggttacacacttaacctataaaaacaatagcaccgaaaatttaagggtatcatttttgtgtgacagagaaaaagcaagcttaaaattcaacaggtgaaaaactgacttgtgaaatctgaccatgttcacatcagtcactcacactgttagatggacaaggactctgaaaaacaagtaaccttaccaattacatttgctggagttttcttttctcacacaggccttcacccgccccccaacccccactggagctgggaaatcccaagtggctacttgcagcggtcagtcagggtcaactattcatcactgagcggccaaaagcctcgccatggtgtcctgttttcaaccaccttat

SEQ ID NO: 53280 - DNA, 1688 bp, Bovine  19866881441173
catggctttaagatttctatgcaggtatgatgaagaaactagaaaacaaaagcaatagaagtaaatgtttcagactattaaagggccagcttttgtatccaatttatcaatctcggcatatccaaaaggtttttatgtttttttaatatggtaaaagcaaatctagtttcaaaatgtgctaatttcctctaaagttatttacaaaaaaagaaaatccatccattgcttaaagtcatttttccaatttcttttttacacattttgtttctcattatcaaataaaaatctgtctccagcttttataaggctttcataaaggactcccttcactgaacagcagaatgtggccttttctttttatctctctaattaaaacattgcaacctggggaagctatcagttagttctcagtaaatggcacttattttgatctcctttggtaaagcgagaaaaatggtgaagtgaacagaaatgtcctgatccctaaaattagatagaaacccactaatatgcaacctacagagccctctgggtcttcagaaatggcactcagtaatttattttgacataaatcaacttgctttcactcttcagcccagttgtgctgaggtcatttttcagaggaacttaacagttcaagattgttcatggcttctgaaatcctacatttatattttccttcttaacagattctctgaagtttgaatgaaagaccatacatcatgatataactccagtacttaatagactcatcattctagctaccactttgtattcttaatattttgccctaagccttattgtatttggtcaacatgattgtctgaggttattaggttttgggggttttgctttcaaaagaagaagccttctcctctatcatcaggctcatacacaggatgttaataataaacaaaccaatgtctctacacctttccctatgtcttaagagtattaataaggtcgtaataacttactaatggtttgcttttaaaaagatttcttttaagacgaattaacccaaataaagaatacaaagcaaacagcttaatcagctcatgtttagtgaacatcctttaatattatgactgcttaagtacaggataattcagaaacagtttctcaaaaaacttagtttctagcataagggtccaggcaggtgctcatcaaagcaatatgtatttgtatggcttgtgtgtaaaattcatgttaaatctctgaccagaatatgtgataagggctatctactggacatgttagaaaactagcataactggtagttgtgtaggaagtactcaattcataaaatgtatttacttaaaagtggccaaatttcttttattcaagaaggtaggccctgcttcagaaagtagcaatttcatgaaaaagaagcattggatttagttagggaacttgaatgtcattcctagacttatgcactgaaatctgcaaaatactgatgaaaggaattaagacacaaatacatagaaacaccccagtcatggattggaagatctgatattgctaaagtagctatgctttctagtatacagtccgcagattcagtatatcgaaccaaatggcagtttttatagaaatagcaaaaaaaaaaaaaaaattgtagaattcaaatggaaccacaaaataccccagatattcaaagaagtgttaagaaagaacaaccaaga

SEQ ID NO: 53281 - DNA, 1180 bp, Bovine  19866880692553
acatttacagcagcattatttgtggttaccaaaatctggaagcaaaccaaatattcctcattaagtgaatggataaacatactgttgtagtcagcagtaaaaaggagcaaactattgatagcttcaacaacatgaatgaatcctcagatacattatgctaattaaaataaatcagtctcaagaggttacatactatatgattccattcatatggtattctctaaaaggcaaaattataggaacatggaacctctcagtggttgccagggactgtggatagaaggagtgtctgaatgcaaagaggtagcaaaagagaatctcgaggggtacaggaatttttctatatcctgttagtggtggttacaaaaatctatgcctgtgttacaaatctaaagtgaattttactatatgcaacttaatacaaaataataaacaattctgaggtactgacattttactaaatttgataaagataatttaaaagaaactcaagaaaagcaggaaaatggcagtcatgggagtatataaaaccatgtggttggtcccagctgtttcttaaagagaaaaggtctgtttccttttggttaacatgtcttcctcattttcaggtaataacaactctaaagtcctaacactgctgttagtgacttagatgtgttcataaatgaaggctatgggcttataaaaatcacctctaaaaactgaatcaactctaaatgaattaactctattgaactgtcaatctaattaattgtatagaaacccatcattaagttgactctaaaacccttgagtcaaaaaatggcaaattcagaggccatgtataaacatgacctaagataaaagaaaaattgttctgccagatagtctcagtttttttcatatttgtaatggtaatgatatttttttgttcctgtagtcttgatttaaatttctgaaaggaaccaaacattgtgatttttcaaagggttttcaagcaactatatgaattctttctgatccagaggatggaaatatttgtagtgaatccagtttgagtaacgtggtggccttgtttttgcatttagcaaagatggtttcatcaatcacaggaaatgacactcctgacagaaagaaaataagatgtaaattagctagaggagagaacagagcaggacattccattggaataagaagggct

SEQ ID NO: 53282 - DNA, 831 bp, Bovine  19866880751782
gcttagtgtattatcttatagagtctctctattcttttaaataaccatttaagttggtttccaaactctgggataacaggaagcttacataagctactaaaggcaactgaaaatccatagcaaataataagttatttgcttagatttcctgggcaggggatgtttccatcaggttatgttagaacagcatctacctgagcagagaaatttatttctgtatttactgaaagctccctatgagtaaagtactaaataaacagtgtacttagacaaggggttacaaaggcagcaagatataagtcccactttcaggcaatttgtactttagtttgactaaaagtaacaataatagtttatatttctatgacagtttacatttttcagagttttaatacctaacctcatttcatccttaaagattcccatgaccactttaaagacgaggaaactgaggttccaagaagtaaagactttttctgaatatcataaattgaatacataaccacaattcaaacacgtcttctgactcttggttgaactgtctcatgcattatagctgcatcttaaaaataaagatctatgcctttgctttatcaaggtagaagggaaggagcagaaaaaaattttttgattgatttccccaatcaatcagggcccagtcgggggctgttatagtccatctggctctgacaaaaaagctatcaaggaatgagtagaaaaagaaaactgtttttctaccatccaaaagagccacctgggaagccccaaagaaggaagtgggaaaaaaaaaaaaaaaaaacagaaagtattaagaagactgaactagaatca

SEQ ID NO: 53283 - DNA, 928 bp, Bovine  19866881109540
atttgagggggatgactgatgtggatttatcttcttcaaacactggttcacagtgtaggtgccacacgaaggggtttgagtgagagaatgacactgaggtttaacagaggtattggaagtggaaattggtattggtctggaaatccatatgccacggctatagactgaatatctcatttttcaaatgtatgctgatacacatgttgatttgttaatatatataatcaaattcatttggcattatccattgctttaatcagttagtattagaattacaattgctatcagttgaatacctatttttaagaaaagtataaccactgtttggagaagaaaatgacaacccattccagtattcttgcctgggaaatcccttagacaaaggagcctggtgggctaaactccatggagtcacaaaagaatcagacatgccttagtaactaaacaaccaccaccaccacaattacactaattaaacaatgaggtccttagagtgacctggttctactgctttggtgacctttgtaaactaagcaaattttaagcgtataaatgccttaagattacaaaattgaaacctaaagacaaccggtcactactggttgactcaaagagttaactactctttgagctattgccagtccatcaattcctaactttcactctgccttttctctataaaatctctccccaaagttcctgtcagtggaacactcctaaacacttccaatttggccctccctaatttgaattaaaatttgctcaaataaactctttaaaattttaatatgtctcagtttatcttttaacactactgcctgaaattactcccaatattaagaattgagaggttacagagcttggggaaggagttagcaatacagatttgtaaacacaataaagtcagacaaatgatcattctaacaca

SEQ ID NO: 53284 - DNA, 904 bp, Bovine  19866881139937
tttgagaagtcatgtgttgagaacatgtcaccctttgcataggaataaaagtgggaatctacacgtattgaaaggattaaccactcttgaaaatatctttgtattatagcacttgtcttgcacaaaattaacctgggggaggttgtttcttctttgatttgacagctttttcaaagttttcaccctagtaaaggacaactcttaccactctgttgagctggttaagaagataataagcctaccaagcaaatgcaattatttctaacatctcttcttgatcatgagcaccactttctggattataagatgaggagaaatcctttggtgctatctagcagctgtcttgggagtgatgaacatggtttgagtgtaaaaaacaccttttcaattgtattattctgaatttgagatctgaactcagaggaaagcaacatcttaatagtttccaagaaaggtccagagagaagcaataccatataaaaaccataacagaattttttccataatgaacatttggaatttagttcatctcagttttttaccgttttctatagttacaaaattccccaaagcataaaatagcggaaaaattaacagactcttgagaatgtatagtcaggttgaatgaagcaaaaatcacttgccatccaagtagaatatgctgaaagaaaataataactttttattgctttacattcagaacagacagtactctagtgacattttattttgtcttctgagttatcagtataggtagacctcattttatgacaatcctctttattgtgcttcacaaatatcgtgtttttacaaattgaaggtttgtggcaacctggcattgaacaagtctcttggcatcatttttccaacagcatttccccgcttcatatctctctgtcatatt

SEQ ID NO: 53285 - DNA, 2484 bp, Bovine  19866881142304
ttctggcggaaatgaaaagcataatttagttgagttatgtggagagagttttgatgtgggccaggcatcggaaaagcaacaaggttagtgcagtatgctggggctggtaaaggaggttagcaaggggagagggcagctcctgactctggagggatgcaaccagatcacaatgacccagccaagaaaaagctgggggaaagccatgtcttcactgccctccttgtttcagagtttccataggtgcctcccactggccaatataaccagaagcaggaggccagggagcccactgatacaggtctaagagtgattgtgcaaaggcatggagaagagtctagctcaccctgctgacaaatttgtcttgtaatcctgtggataatggaaagcattaggggattttgacaaggacagtggctgtttcgaagagattactcaggccgctgtgtggagacttgactacagtaagattcagtcactataaaccggctcctggccctccctgatgtggtaaagctggctgatcatttgtcctggagcacacttaaatgtcccatgctggtgtgtttcttgaggttcctggtgtgtcatggtggtctggggtggcagtctggcagctctgtgggatgctggccatggcactatttctagtctttagtttgtgtgtaacttgacactgagtgtctcgctaaggctggccctcctcatgtaaaactgcccccaccccccgtccctgtgctgtgtgtggctcagtgagggggcatctgtgggagaagcttactcttgtttctgttttaaggcatcatgacaatcctggccattcctaggggctggtctcttgaaattgggctttggtgaaggaaaattggatttgaagaaactttatgaggaactttcataatagggttgtcttctgggaagaagacgtacgttcaagtgtgtgtgcacgtgtgggtttgcgggcagtgggaggacaaaggaaggagcgtgacagagggagacgcagtgagagcactccacatttgagtcctgttcttccagaatgttttgtagagaatgttctaggtgtgccttgcctgagttgaggataaaaatgaaattcctgaaaaattaaaaaaaagaaaaagcccacaaaactctccttcccttttgtgtttcagatgttggacactgggatgctgtatatgatttctgaggttatctgtagttctgattttaatgaggattaccctaaaaatctaaagaaagaatattgttgagttgaaaaccagtttaacttttgactccatcttaaatctgggctatatagttgactggatgcttgaagtctgaatagtgtatttctattgccaaatagaattttgatagcatggtaaggaatggaaaagaatgattttggtttcccagtcattttaagaggatgttttaaaaaaataggttacagttttttggattgaaattgctagtgaacaaatcaaatgctaatgatggatattttaatactctgttaaaggaatattgatctaaattgttcaagaatctttgaatcattggttagtattcaagagatggcctgtcatgtaatgagatggcttttaacaaactcattaaaactcattcaattgactaaaaataaattgaatgtgtactattcataaggcaagtgagggaaactaaaatgcataagatgtagtctctgcccccaaggaggttgtatactgtaataatctttcacttcagtgtaatcaccttgggactgtattgtcttttttcaatgggatcaatcttgctaaacatttaagaactactttgaaattgtctttggaggcatcttaacacattcgcacatgtacacatgcacacacacacacacacacacatgtgcaatcattgtcagtttcatttctgtagaacagtggtcagcaaagtatggcctgctggttaaatccagcctgctgcctgtttggcatggccccagacctaagaatggtctttacatttttaaatggttgaaacaatcaaaacaagaataatatattgtgacacatgaaacttgtatgaaattcaaatttcagcattcataaataacatttttattggaacacagcaatgtttattcgtttatgtgctgtcaatggctactttcatgctacagtggcagagttgagtagttttgacagattccatatggccttcaaagcctaaatatttactgtttggtcctttaaagaatcatgtctttagaatcagatgtctctatatttatatattgatattatttataaagaggcttcagttagattccctaccttcttccataaatttgactctgaataactttttccaagttttcaaaactcacacttttcattcatcagaggtaaaatattttacttcactttatgggcattcaaggaggactttttcaggctttgaagtaatccccaaagagtttccccgttctctgggcagtggtcagggttccta

SEQ ID NO: 53286 - DNA, 1351 bp, Bovine  19866881239091
aattaatgttcttattctaaaaggcaataatcacatggttctgccaagattataccctagaatatcatggaagtctacactagaagttaggaggactagtctaaggaggactggtctaagattactcctgatgagaaaaatttaaggacagaaacttaaatcggttctatccagttcagtttaatctggatagcctatcagaacaatctgcttccccaatctctgctactaaaagcagttgagtgaattacttaatcttctctgtgcttcagtttactcatctataaaataacttctcctgtgaagttaactttggtcaagaacatgtaactatggtaaaaaaaaattttttttttaatcatgctcaatttctttacaaagtatcttggagttcttccaatctcaccttaaatgtcaaggatatgcaccagttattgtaacagatattgccagctacattcatttctaatgatggggtcttacttaccactctaatgttatgctttttggaaaagaatttttttcagaactgtgagcctccttagatatgggcaaaaagacattctgcctgagctttcattacctgacatgccatttcccccacactcttaagacctggtcttgccatttgactaatggggcagcatggcaaaatttgctttcaggctctccatcctgtctaagccacagatctgaggtgcagtagaagacgtgcagatgctgctttgcccagactttaatctctctatgctgaaaaactgacaaagttgtttcctgccctaatgattgtgaacagaagatctgggtgataacatagtctaaatcacagaaacatttctcacaggtgagtatgacaaaaaagaaccaagaatgttgtgttggatttattttctagccacacaacctgaaaatttcccaaccatgtgttgaatcattcacccatatcatcatccatactcactagagtaatgcacagccataagctagaccataagaaggccaccttcaaaataatctccttgcttattaaagtgggactccccagatcatagagggtccagagggtccatggacatatcatcagaagtttgtgaatgttctgtgaaattctgctaattcaatatttcgactttgatggtaatgaaaaagtattaaattaagcatcatccatataatcctactgcccaattactggtgagccgtgtcactgtgtttcaatgcctctatacgtggacgaagtttatggttggatgttacacaaccactgtactgtcattacttctattagggttctccagagaaacaatcaatagggaatagatagatagaagaggaaatttattatagaaat

SEQ ID NO: 53287 - DNA, 705 bp, Bovine  19866880543126
gagatccaagcagtccatcctaaaggaaatcagccctgaatattcactggaagcactgatgctgaagctgaaattccaatactttggccacctgatgcaaagaactgactcttctgaaaagaccctgatgctgggaaagattgaaggtgagaggagaaggggacgacagaggatgagatggttggatggcataaccgacttaacggacatgagtttgagtaaactccgggcgttgatgatggacagggaggcctggcatgctgcagtccatggggttgcagagttggacacgactgagcgactgaactgaactgaatagcatttttttcctgttggtcacaaagtggcagaaactgcttcaggcccaaagcagaatcagatggtagcaataaaactgccaccaacttcatccaaatattctccaaagcctgttagggctctgtaagttgactagacagaaaatcacttggcaaaggcagcagccctttctcctcacgctgccaggtcttttcggcccagttggcaaggtcaagaatagtagggaatctgacagaaacttgccaactctttaaccttgcctattagaattattgacttaccaggctggcacaaataactccatcatcattttgctctagccacccatacatgtcatctatgggttatactttcagaaaccggaaattactaagcagacataggaag

SEQ ID NO: 53288 - DNA, 2121 bp, Bovine  19866880564596
gctaagtcgattcagtctgtccgactctgtgcgaccccatacacggcagcccaccaggctcccctgtccctgggattctccaggcaagaattctggagtgagttgtcatttcctcctccaatgcatgaaagtgaaaagtgaaagtgaagtcgctcagtcatgtctgactcttagcgaccccatggacagcagcccaccaggctcctccatccatgggattttctaggcaagagtactggagtggggtgccattgccttctccggtgaccaacctagagagcatattaaaaaggagagacattgctttgctgacaaaagtctgtcttgtcaaagctatgtttttttccagtagtcatgtatggatgtgagagttggaccataaagaaggctgagcactgaagaattgatgcttttgaactgtggtgttggagaagattcttgggggtccatcaaactgcaaggagatcaaaccagtcaatcctaaaggaaatgagtcctgaatatgcattggcagggctgatgcttaagctgaaactccaatactttggccacctgatgcgaagagccgacttgttagaaaagactctgatgctgggaaagattgaaggctggaggagaaggggacgacagaggataagatggttggatggcatcatggactcaatggacataagtttgagcaagctctgggagttggtgaaggacagggaagcccggcatggtgcagtccatggggtcgcaaagattcagacacaactgagtgactggacaacaacagcaagtagaaaatgataataatagtggtagtaatagtaataataataaattttaagaagttcagcaaaagaaaaatgtggggtatctggaaagtatttaattgctatatctgatctccaggaagggttcagtaaggaagagactattgtacttagcttgagggatgtatagtacctagtcaggtgacagggtcaaggaagaagacttcatccagagagaacagcttgggtcaaggccttagagtagggaagaagtgaagtaagttcaaaggttgcaatgtaatggtgtggctgagtacagaggaaaaaagggacagaatatataagatgatgccgagaggtaggtggcttgggactgcctctttctaagcattttaaaggattttggttttatcctagaatagcaggaaattgtaccaagaatttatacagaatttggtttggtttttctttgctcacacctttgtttctttggggttaatacctagattgcaaggtacatcgaaatatattcacgtttcaaaatttggagtatatacggccaagttaccctcaagaaaacttgtaaaatttactattcctcctgcaatgtgtgatgtagcttaattatacaaactccagtgttgggcagtaaacatttaaaatatttccaatatagatggatagtgacatgattgctgctttgtgtctattttattgtgaatattgaagtttacacatgtatatatgcagtttttcagattgtgtttcaaaatattaaaaatatttttatcagtattaaaattttttttatcctaatacattttctgttatttccaaagaggattatagcattttagtcaaatgattaagctaaacaggttgttcaacttagagaaaatgtgagtcattaccaagtaaaatctcaagaagtttgaagtaattgagctggtagcttacttttttcagagtctataaaaaattaaattttccaaaaattttctcagtttgttgtttcttgcatcctactccttctctctgggtgttcttttcttcttactgaattcattatttaatgactttttcaatatgagtgtgtgggcgatgcatttcttaatctttgtatgtctgaaacgtctttattttgcacttattcttatatgatggatttgttcccctcaatccttagacgctgtttctccaatatcttctgatatttattgtcttctggtgtctgttgtgtgctatcaatcctatagtcagccaaaaaatcattttgtctttggtatttggtagcttttaagattttatctttatcttgggttatatgaacctccccgtagtctgtttagttttacttatgcca

SEQ ID NO: 53289 - DNA, 1323 bp, Bovine  19866880608050
acgtactccttttcctatttggaaccagtcttgttccatgtccagttctaactgttgcttcctgacctgcatacaggtttctcaagaggcaggtcaggtggtctggtattcccatctctttcagaattttccacagtttattgtgatccatacagtcaaaggctttggcatagtcaataaagcagaaatagatgtttttctggaaccctcttgctttttccatgatccagcggatgttgacagtttgatctctggttcctctgccttttctaaaaccagcttgaacatcagaaagttcatggtttacgtattgctgaagcctggcttggagaattttgagcattactttggttaaatctaggtatgctgacctctttagaaaagaaatggtttctttccctgcaaactgaagtttgggaatttcagagctgggaaattgtgtagtagatcttaatgttataaatcacttggacaaataaaggataatgctattttggaatgcgtttgtagttatgcaagattgttgttgtttagtctcttaagctgtatcccactctttgcgaccccatgatctgcagcacaccaggcttctctgtccttaactgtctctctgagtttgctcaaactcatgaccattgagtcagtgatgccatccaaccatctcaacctctgtcactcccttctcttgctgtcactctttcccagcatcagggtctttcccaatgagttagctctttgcatcaggtggccaaagtattggagcttcaacattaatctttccagtgagtactcagggttgatttcttttaggattgactggtttgatctccttgctgtccacgggactctgaagagtcttctccagcaccacagttcgaaagtgtcagttcttcggtattcagccttctttatggtccaattctcacatccatacatgattactggaaaaaccatagctttgactacacagacatttgtgggcaaagttgatgtctttgtcaaagttaatacactgtttaggtttgtcatagctatttttccaaggagcaagcatcttttaatatcatggctgcagtcactgtccacattgattttggagcccaagaaaatgaaatctgacactgattccacatttctcccatctgtttgccatgaagtgataggaccagatgccatgatctttgttttttacatgttgagttttaatccagcttctttactctcctttttcacctttcagaggctctttacttcctctttactttctgcccttagagtggtatcatctgcatatctgaggtcattgatatttctcctggcaat

SEQ ID NO: 53290 - DNA, 1260 bp, Bovine  19866880653212
accacagttcaaaaacatcaattcttcggcgctcagctttcttcacagtccaactctcacatccatacatgaccactggaaaaaccatagccttgactagacagacctttgttggcaaagtaatgtctctggttttgaatatgctgtctatgttggtcataattttccttccaaggagtaagcgtcttttaatttcatggctgcagtcaccatctgcagtgattttggagcccccaaaaataaagtctgacactgtttccccctctttccgttttcaagggcctgggtatgtgcttaatttggttgaatcatataggtgggacaggaaggactcagataaataaggcagaagctgtactgtgacaatctcactcattgttcttagaggagaccttggcatttgtattaggtgcagccaaaaatgatataggatgttggaactgtacatccacttgactaggacttgataattttatgcaagggaaagagatggtttgggatgtggctgacaccagaaggataacttagaattgttccaagacaagcaacatcagtaaacagtgtggggtgtgagtcaaccagattaattaccaacttttgtctgcatatgtaagataaaatagttgagccaatattaattagagttccactcttctgattgggtccttggaaaaaatagtaataataaaacatatcacattaagtataataaaccacattaaaatagtaacttaaatgttctaatattttttacatgaattagtacttttgctctcaattagaacccaatgaagtaagcactacattaccccattttacagatgatgcaactgagtcaaagagaggttaaataattagtctaaacacataccaatagtgttcaggaagttcacaggattaatcctaataaagaaaaaaagtgtcaagtttacaatttatgattctaaggggaagaaaaagttgcttcctgagtctgtagtgatgaaaacctgctacatgactatgtggggttggggaactacagcttctgctaaaaatcctaaaactcatttatattaccttgggaagtctactatatgtacacaaaaacatagtatctgaatgctagagaggaaacaaagaggattatacttgatatttctcttttaagagcaatcagataatattaaagtacagaatgtgtactgtctatcaattaggacttaaaaaatcactctggtgtacgttttgctagcaagcatgcactcataaagctcttgg

SEQ ID NO: 53291 - DNA, 1072 bp, Bovine  19866880757757
catctccttcccagagcgtcctaactctttccaccttcctctcaatgtggattctgagaaggatgcacaagccgatccactcagaattttgcttcctgtctgtgggcgggatgtagcagagttggggaccccccacctatgcccgcctcgccacctccggttcacctctctttcgcgtcgctagtatttacccagtacaggtgttcctaaccgtctaccccaccagtcgcagcctctccaatccagggaaaggagtaggacttggcagacagaccctgggctgtggagtcaggctgggctattatggaatcctctctccagcagtgatttctgtgtggtctttgatattccgtttccttacgtataaaacggaataatacccccattaaagggttaatgcatccataatgttcagggaacaatgtttattggatgcttgtcaaatgctggaaactgtgcttagttagccctaatacataatggtgaagaagaaaaagagaaacagatttctgttctcatagagcctacagcaagagacacaccagtcaaataacaacagacacccttgaaactgccattgccataaggagagtgcatgaccttgagacctgtggtgcgaagatctgacctaggagcatccctttagctcagtgattattcttcccttttttccctttgattcccactgtttggcacatggtatgcactcaggaaatacatatggaattcaatgctatgtcatggtcataacagtatcacgcagtttcgcactaagtttttgccactgaaaatatatttgaaacatacataactggctgctatgtctggaaagatgtgcaggtcttatcagaaagtactcattcaaacccagagcccatcatgaagagtctcaagaaaggttcaaagtgtttcttgcctattcacatggggttaccttagtaaggtgtgcatctcagatgagcacatgaaagtcctctttgcctcatccctctccccttactgttccactctctgccgtggtcccagctccattctaccacttccccttgatgcatagctgcaggacacccat

SEQ ID NO: 53292 - DNA, 1100 bp, Bovine  19866880823109
aaaacatttcttggcacatgcacaccatgaatagaacaatcctgaatgtagtgacagcctggctacagaggtatccagcttctggccccactggcaaaaccacctttgaggtccatgtcccgagtcccttcacatgggagcttctggcttctgcatctgttggatttgcttctgtagctggtccttgtccagcttcatcttggcttcgagaacttgcctgagggatcctatgctttcatagatggcggtaaaccctttaagaaagggtaaatttcacaagagttaatattaaaaaacaacaacaacaatgctgtatcaaatcctacagcagatactactgcttgatttgggcaaaaattatcaatagattctcaaagtactggaataaaagtttaatgggaaacagaatagttacatagtttcacagtgtctccctacagataccaagggaaacatgaaatattaccatagagaaatatgacagacaccactttaaccaagggtcaaagctatcttcaccaacactgggaggatccaacattacgtacccctgatgaggaattggaaagaagcctgggctctgcacgctaagatagaccacctcagcgctgtctgcacctaagtgctctctgactcaagaagctaaattctgtgtctcccttagtaggatgctcatggtcttctttcttcacattgattttggagaagggatttcagtactgcttcatgacatcattactggaagtagagtccttcagtttcagtctgctaaaagatcaagccctgagcctctggagtgggagcactgactctaagaccctagactatcagagaactcctaaccttttagggagtatcaaatagtgagaactcccacaaaggaaaccacttgaacacaagacctgacatcatccaaccaccagtagcaccctgtgcaggacgcctcatccaaacaacagacaagacaaaaatacaaacccaatcctcagcattcaagattaccacgtcactcagccctgcccatcagaggaaataaaaaaaaaaaactcagcacaaatctcaccctatgtgtagcttacacaaaactggaccaaacttag

SEQ ID NO: 53293 - DNA, 1810 bp, Bovine  19866881071008
tggagaaggaaatggcaaccccttagtgttcttgcctggagaatcccagggaacagaagagcctggtaggctgccgtctctggggtcgaagagtcacacacgactgaagtgactttgcagcagcagcagccctcattttcccattaacacattttttctgtgttgtgaatgcattctgatgttcttttatgaaactcatttcattgccctatattatcttcttcctaattattttctaaaatacatgagcagtgctttttctttcactaatggatttgtctggggatctgcactttgtattcatctcaattttttccttttgttccttttcatttcaccccagataaaatgcaaataatcatgccaacttctgtataaagtcttatctgactagctccatcatgtgtctagaatgagttttacaattttgaaagttttcacttcattgctactatgatctcaaataagaataaatatctggtaagatattactgagttctcttttaaaaaaaaggcataaatgaagaaaattggaaaacctttcattttaaaaagtgaggattttttgggaggtgaaatttggccaaaaatctatggtgaccacgaaaagtctgacatttcattttagactgaacatcaatctattttatagttaagggaattgaagctcagagaaattaagatcttacagacagttgagtggaaaagccagactacaaattcaacctagtttggtttatcattcaaactaggccttttggactgagagggcaatggcaccccactccagtactcttgcctggagaatcccatagatggaggagcctggtgggcggcagtccatggggtcactgagagtcggataggactgaacaacttcactttcacttttcactttcatgcattggaggaggcaatggcaacccactccatgttcttgcctggagaatcccagggacgggggagcctggtgggctgccatctatggggtcgcagagtcggacatgactgaattgacttagcagcagcagcagcaggccttttgggaatgcaagaggggtgcacttaatcatttcattgagataaaggcattaaccagggctcccccaggtagaggacttcccaggtggctcagtggtaaagaatttgcctgctagtgaagaagaaatgagtttgatccctgggtcaagaagatcccctggagaaggaagtagcaagtcactccagtattcttaggagaaggcaatggcaacccactccagtgttcttgcctggagaatcccagggatgggggagcctggtgggctgccatctatggggttgcacagagttggacacaactgaagcgacttagcagcagccagtattcttgcctgggaaatcccatggacagaggagcctggtgggctacagtccttggggttgcaaagagtcagacacaactcagagactaaacagctcccaggtaaaccaggatgtcatcccagccaaaactgacaaagaatcttcccaagatgaggatggagcagccaagggcttaaagggattcttcatgaaattataggctcttccacatcattacactctgtattccatgctcagactgtgaattagtggattctgctttgctaacccaagtgaacttttgtgcttttagtaacagtctcagttctaatccctataccttaagaaaaacacaatgatagagacaaagatccagagagggataactaatatggtcaggagctgtggatcctaatggttggcagtcatggcatctttgaggatttgatgaaagctattaattctc

SEQ ID NO: 53294 - DNA, 1807 bp, Bovine  19866880426687
tctgtctgtaactatatatcataaatagtaacacttcagactttgagcaaatgctaggccattgatatctattttttttttttaatgaggaaaaatgctttatttatttatttttttattcttcttttatttctaaatttttaaaagaaaatccatcctgaaccctcctccctccccataattcttgtaagaaaattaaaacaattcacttgatatatttttatccatttacttctaattttatatgcaaggctataattcctttactcaagcctttctctaggtgcttaagctagaaatctatgtgattctatcacacaacaaagactcaaaaattctaaatttctagtaccaagaaacagcatagaataggggacattctttaaaaattagttcagagatattacctctttgcaaaattcaaaaccaaatataaccatctgtgaggttaaagtgaggccaaaaaaaaaaaaacaatcagatactacttttttcagggagtattacatttaaggaggaatcaaaaagctgtgacaaaatagtgtataataacacatacgtatcacagtttattaagaaccatatgatcaaatacttgaattcctttattcatattaccaaattaatcaacagaaaaattaaattatattttcaactacatcttaaattatgttactcaatttttcaggaaggaaatttaatgccttagtgacatcagcatttaaaaaacggtacagaattgcttacaatttttatctaccttttgattctcaccccactgttaatatgaaaggttgctaacacaaaatgtgtacgtgtattctgtctagtatgcctatgtttatgtggcttagaataaaacagtatttctacacacacttctaattcttttaaattacaaatgctaatatttactattttaagaagtaccaaaatatccctaaagtacacaggttgctcttaattaaaaacaattgcttttgcaaagagtgttggtggaaccaatgggcaaagaatgggccaagcaaaaaacgcctagattaaaccacatggtgggcctgtttaaagggacctttaaactgataactgtagcagcggaattccgtgattaaaatcatttagagcccgtcgttcagttacccactgacacaactgaagaaaagcccaccagtgaaacagaccgatgaggacctcacgtggaacacggcggccacagctggtgacagggggttgtacaattgagatttgctgagagaacgaacttaaaggctctcaccaataatggtaataataaagataaacatgtgaggtgatggctgtgttaattccgtttcacaacatgcacctacatcaaatcacaatgatgtatgctacatacctacaactgtatttgtcaattatatctcagtacaattggaaatagaagtaaataaataaacgagaattatcttggtttgatggataggtaaattttggcactttgaaaattacatattctgacattgaagtgattcctcctggtttcaaatccagatgccagcatgaaactcaccaacaacgtaatcctaggccctgaacctacccccttcctgcctggaaccgacttccatgcttctcttatttgaataagcccatggtaactcctgctgcaatttccccagagacactgcttctgtgaggcctaatgtggagggacctttttttctgtgtgtttttcctgttatctcctactgaaagtaaaatgccttttgaaaaaaaggtgatgtatcatattacaaaaaacatcatttgtcaaaaaaaaaaaaaa

SEQ ID NO: 53295 - DNA, 1206 bp, Bovine  19866880492205
caggctacatacagtccatgggatcacataagagctggacacgactgagcaactaagcacaatatataaactcttaagtggttgtacatgtaaggatattaaattaaagcaaaatatagtttcctctatttaatatgcacttctaaggaaaattaaggccaaattctcaaaatatttaagaagtcctagtatgactaatggaatgctttgggagcaacaatgatattatcaataatttaatcacttttatcccaactagatttagttcatacatatattcaccacacaaaacttcctgcgctattttgggctttcttcattgagcttaaaagccaagaaaaaaaaatctttatggagtgagttaccagtagaaagtatttcagtgtgcttttgtagtcttagaaaggaaaacgtactctaagaaatgaggtcttgtaaagaagtcactcctaaaattaacatgcttttattgcagttaaaaatatttagcaagagtttaagttacacttaagggtagcattaaactttgttttaacttcagttgaattgcttgatcctattaatctagagttatgtacattacacctacagattgcaatgctcgtaaccatgtatgttttatcacttgtgttaatacaataattcatattttaccagacttacttagtaattaaaatctacacaaaccaaaaagaccatctgatgtattaaatttaataataaaccacccgaagacaggacagtctctatgtctgtactcatgcaacactactctcatttttaaatttctgtgtaattaagccgctattcccttgggatcagtaactcctgatggtgttattgctgagtgaatgacccatggaaacaccaagaagaatacactttttactgatcagcttatgaaaatgaccagtttgattgaggtttggaaaaacagccttgctccaacatggctgtggtgggttatgtatgcagaaagcaatcagtatactaaatattcaatttttttttttattccgagatatgggtacagccacctcagaagaacaagtaaaatggaaaatgtatattcaatctaatgtaacaaacattattaatagggcatcttaagtaacctgtgatcatgaaatgatagcactggataagcatctaagaacacaaaagcacagttagatttttgcttaatgatattaatcttgtcttttg

SEQ ID NO: 53296 - DNA, 1660 bp, Bovine  19866880574203
taacttgtctgaggtcatccagcaggtgggtggattccggtttgaacctagatctggctgtagcatgagctgctccgctctgcatcccccaagggccctcgttctgatgcatctgctgcaagaatcggtcactcccctctgagggctctctcttgccccagcggcagaagttccagacaaatggagaagtcggtagctctggaagcagagacagagttggagggtacgcaccccagctctctcgcttctcaggcggggtaccctgaggcatatgtccccctccctccctcacttcctgtctcctagctttgtgggattactgcctacccaagtctgattctggtgtcggggtctgtttcctggaacttaaaacctagccagccttgtaccatgctagactgctgtgagaactgcaggagaatattggagaaaaggacgttcaaaagttgcttttcaggtcttcctgagttccctttgaattcaaactatataagccaggtgtgttcaggtctgcaactctggggagagagcggtgaattcaggacactgagggtttgtagagctgtgaaggccaggtggcttgtaggttcttggttttgtcctcagccacttgcgagtcctcggacaagtgtggaaaaccccggaggcctgcttcttcctcagggattctgactgagatttggggtctgggactcgaggtagtccagcccaggttgggctgatccacagttggagctggaatgcatcactacacgcagcttccaactttgcataaaggaaataaaggccctggatgctggcaggcaggaaaaggcatgatggtaaacaaggaaataagatgggcagagataagggctgtgcagtcagttccaggggaaaacgtccgttataatgcagcctcttgggtcaagtccgagtgaaaatccccacaaactacaatgtgcccagggctaaacatgcagcatcatggtgagtttttctttcccaggaccatcgggttaaattacagctctgagttgtttcttctcaccaacacaatacttttagacatttaataacttctctgcagacccagtctcacccttcagcggcagtggcaccttgcctggatggtggctgtggcatcggctgaaataattcctactactttctcagaggaatttgtgaaggggccagatccccagtggaacttgagaataaagtgacgaaagcatcccacgtggcttttctcccctgaagtcctccatggctccctgcctgccgtcaagcttgggctgtgatgttaatttttccatctgctttggctgcaggtaatttggagacaccgacgtcatcagaccatctgttcagtaaaactgcagcaaggcttcccccgccctgtgttgttgacgccttgacaaggactcagggctcttctcaatatctgctgggcagagacaaaattgtgttgcaaacagtcccttagcatcgcatcaaagggtaaggacagaatactaataccatctgtaattatttgtgtaagatgcaggtgtaatcaagtcactaaaacccacgaccagggaaagcaggcagttggcatgtgagtggccacacaacctgatttgctttcttcctgatggtttcctgacggactgggattgtacaatctgatctctccagc

SEQ ID NO: 53297 - DNA, 676 bp, Bovine  19866880734600
tgtacaatcttttcatacacagcgtctgcattctcgatcagcgccttgagggactggatcatctgcaagggaaacacccgggacaggcggtcacacggacagctggatgcaggagggtccctgctcgggccaggccctcccccggcgtggctgagcgaacgcagccacaggccccccacctgacaccccactcaggttcacggggaaactgatcaagtcacacctccctacacgagcgataagaccagacggtgaggaatgtgtccccaaggtgctcacactggatgtgaccctcgagccagcaccgaactgagtccctttcagtatgaaaagaaatggacacgggtgcacatccgatccgtccttcatgttaaaacctcatcaccttatagaaagctgcagcacccaaacgcctcactcaattcacccaagttgcctccgtttgagaagcggtttaaaacttccgatgaggatcaaaaacaacatttatgtgatacatcaggaatgctatcccccaagccagtgtctgcagcgtgcctatgagtgattttcgaattccagcgctgaggtcctgctccactgcatgtgcttgattcaggagctatgcctgaattaagaaaaagcaacagggtgcagctgacccattattttattcaccaaagtgctggggaaagat

SEQ ID NO: 53298 - DNA, 1874 bp, Bovine  19866880817353
cggaatatacgcatattctatgacatagcaactcaacttcccaatatcattttaaagtacagaaaatacatttatgggaatatacataagccagagaaagccttgaaagaacctgtaaatctctttcaacaaaccaccaaaaaccccaaagacaaacacatcctttaaacccatattatatcaggaattctatcagccccaatatgaaaacctccaaataattctatttatatttcatataatctattagcatggattaatagaaataaaagcctaagcaactcactgtatttcctccaagaacaaacattaaaccattttaactattagaaaaattacatctccttatgcccacaggatatcagagcttagaaggaagataaaaaaatcacaagtagcagggaaccatatggagagagtcacagagcttgtgattctaatggtagctgcaaacgaggtcacttatccctccacggccacactaactggtcaaaagcaacagaagcctcctcagcaacctccataaaagcaggctgccccagcctgggcactttcagtttagagcacagacacctgctacccatcagtctctgacgagacagcacgcgagccgaccagcactacgcggttcggcttgctctcatctctcctatttataaacagagccttcagagtatatgcatgcgcgagtgcagcatgtgtacacacacagctatctatagcaaaaaaacaaattctcaaaggtagctgtttggaagaccatatctcgtgctattaatactcacatactgcagtattacataacaattttttttccaattctgttatgctaatatgcaaatagatgaactcaaccatagctagaagctaaatgtactgatcagtatggccttgtgtgtctctaactacaaaagaattttacatgatctctttctgctctaaaaatcccatgaatctacattattaatcacttttaaatccagctgctcagtttccggggtggtaatatccactattcccaaatccgtatattcactgtactccaagaagatgcctgaatactgaattcacagcaaggaaggtgctgaaggcatattctgtaattttataattacttgacaattccaaaacaatagtagggacagatgtcaccagaaaaaaactcacctaaaaacaaatagttactattatctgctttaccttccaggaccctaaaaactgtaagtcaaatttgtaaaaggaaaaaaaaaggaaatgatcctcttctattaagctttgaaatccatcaaaggagagcagagagaacaaaactctggtttgcagatcagacacaaccctgtggtgaggaggactggacgatggctacggccttttattggttagtccacgctggcttcatctcaagattcagccacaagaggtccagctgttttaattaaaaatcagccgtatattctaggactggtagaaatgactgattgaggaacccgaacagcttggacaaacaggaaaacaagggaaaagtcaagtctacattacagaagaggaaggggaaagagggtgaaaaagcaggcagagcgtgcgcctccaagtccatcgcgtggtctgggcgtcggcttagccccgcaagctcgtcatcttgcctggaaatcctcacaacttgaggaacaggcttccttgtgcgtaaaaagggaccaacaaccgctccccgcacgatgaggggcgacttgcgcgagacgagtgagggtcctggtgcctcaccctcaccagtccttgagttgcagggaaagggtgcatggcaggtagaaatgcaatgaaaaggtagcatgctcacgtcacgggtagcagcatgtgacacaatacgctgagggagt

SEQ ID NO: 53299 - DNA, 3049 bp, Bovine  19866880995251
tggttctttccctgacatagtaacttctttgatgctgaggtcttgatgtgtatgtaacaggggaaattaaagtgcctagtagagtacaatgtcaatgcaattagatagagtatgtggaagaatttgaaattgccttcaatctccaggtccgattatgggcaccttgggtttttaactgtaggttgtatccaaaataaaacatgttatcaccatagttctccagtgtcaaactcaggcttattgcctccataaacactttgcacactgatccatcatctctgtgttctttaattcatccattctccctgcaaagaccaaattaatctacactgacatttcagccataaaaatgagccccaccatctctgctctgcctcctttttccttttaaacacacagcttaaatcttaagtcttttataagcccctttctccaccgtggtgtataaacatttcgttccaacagtctactgttctcactcttacttgtagggaaattcaaaccttctgtctagggcagggtgttaggaagcagtctggtgagtgactcagctccaggccggagatgctttggccgggagctccagtctgaaccctagccatttggtcactgcttgtcataagacaaatcctttaaaccgtagggatttcattatcctctttggtcacacagggaagaaaacggctgccctgcctccgaacctgccccctgggatgggtgcagaccaacactgacaagttaaaggaggccaggaatgctgatcaaaaagtagcaatttgagctcacaagccatttcccccaaaggtcaattagacccacaagatttctccagcacacacaggaagtctcagcctcatctatatttaatgcacttcccttctcactggtccccataaaggtgagtttggggtgtgaaaaccatttaccagtaaaagtttccatgcggctacatttcagagccccagtcaatggcctcctttattttcactttgaatgtaataagtgtctgctcaatcgcaaaacctggatatttgttgaaacatacacactccatccccttaacgacgttggcaactgacttcaacgtacattatgttggcctggggattccgagactacccactaacccgctggtcagctcgctgtgtgctgtaaaactctttagtctttgcagcgcgtctcacaagctaatgattcttaagagaaagaaacataaaaccatgagaggacagaaatcgtgtccttctaaattacaatctggtcaagagaaaacagagaggctagcccagcgaccagtgactgtactggggaaaaccatttatccatcgagaaaggtggatgaggaacgtggctaccaggttggaaatgggattattccaatgcaccaaaatgaaagaaagcgttagtggaattggagggttcctggtggggctggctcaagagccctgcttgattctggcctgagtagagggcagggatgggacacgtatgggttagtgtccctgggcaaatgcgcatcgtttcaggcctcagggcaggccatgtgggcatcttgagatgagcaggacatctgaaaagcagcctctcaaccctaatacaggcctaaacatatgtccttcgggggtgagtaaacaggtcctggggtggacctgcttggagattcaagttttatggatttgtttcatcaagactctgtctccaggatctggaggtaggacttctgtgagcagggttcattggaaggactgatgctgaagctgaaactccaatactttggccacgtcctgcgaagaactgactcattggaaaagaccctgatgctgggaaagactgaaggcaggaggagaaggggatgacagaggatgagatgggtggatggcatcactgactcgatggacatgagtttgggtggactctgggagttggtgatggacagggaggcctggcgtgctgcagtccatggggtcgcaaagagtcagacacaaatgagcaactgaactgagctgaaccaaactccagccctcaccatcacagacatgctgatacagagcttctatcatcccctcttccctggtacatcagacggtacagatctgcctgcagtgccggaggcccaagttccatccctgggttgggaagactccctggagaagggaatgctaccagtctacccgctccagtctccttgcctggagaatcccatggacagaggagcctggcgggctgcagtccttgtggtcacagagtcgggtgtgactgggcagctaacaggttatacagcttcccgggtggtgctggtggtaaagaaccgcctgccagtgctggaggcataagagactcaggttcaatccctggctcaggaagaccctggagagggcatggccacccactccggtattcttttctggagaatttcactggacagaggagcctggtgggctacagcccatagggtctcatagggctgtagccctcacacgactgaagctacttagcagtcaagcagggaaagaaggctgacaggtgaagcctcaggcccatagatgagagacaagcccatctccagttaagagtttcaggaatgctccggtgggttttaaccccatcctgcccagaggcggttctgactcccaggatacgtgggaaacgcgttgcctccatcgttcctcacgagaatggccgtgctggaagggaagcggatctgggccccctcagacggtgtgcacagctgaggcagaaagcgtagagcagaagagggagcaagccctgcccgttctgtgtgagaggcggggaggccgggggtcccggccgcgggaaggggcgaggcgaggggcccagcttacttcggctcctgctgcaactcgaggcagaagtcctgctgaggcctgagccgagcctcatccggtgggacagctgaccgcaagctcctccagcgcctctggaagcaacgaaacaacactcgcgttacgtgaaggcggcaagaggactttcagcagggatttcaccctgccggtgggcaggagctaaccacagggctttcccagagctg

SEQ ID NO: 53300 - DNA, 1948 bp, Bovine  19866881100223
cctcacctgtactgtttttaaaagtatttggaggcatctccatctccgcagaaaagtgtgtctttttactctggcgttaggagattgagtgaacctaagttgtatgcgtttagttttcctttagttaaggaactgtgggtgtagcacatagggtttcatcacttttttaactttaaatttgagctcactaacattcagaggcaacgtagaaaacagattccagttctgctacagacgagctgcttagctgaggcacatgatctctgctcaaagtgaaaaccagtggaagtaaatacaagtgggaccaagattctgggacagtagaggcgaggaagtcaatagcgaagatcagagagactacagggctactgcttaggaaagataaaacgggtaaaccttcagccagactcatcgggaaaaaaacagaaagggctcaagtcaataaaactggagatgaaaaaagaagattacaactgacaccgcagaaatacagaagatcagaagagactactgcaagcagctctgtgccaataaaacggactagccggaggaaatgggctcgtccttagaaaggtagagtctccggagcaggaggaaaacagagtgtgaacagaccaatcgcgagcactggcctggagcactcccgcagacagaaggttctggggcagactcggcaggcgggggcctgggtctccccctccgcgtgcacgcccttcctttctcggggtgccctcatgtcctgccgccgcctccagccaggggtcctggtcccgcccgggatgagggccagctcccgccagctccccgttgtttctaggcacgcacccttctccagcgatgctttctcataggtttgtctgccggcggggagggagagacagcctccatgtgctgtagagagaacaggggtggttcttggcgacagccgatgttggggaaggagggaggcgcggtctctgcctcagcctggactggggggggccgtcttgtgcctgtggcggggtcagagccctgaagtcacccagcagagcctgtgaggagcagggccgtgtttctgccgccacgaggatgcagctgaagccaccgcttgtcccgtggatgtgggcatgcaagcacgcgaggatggtactaacctgctttgaaacttggcttttccctctgaatagcaaggaggttccaaacatgttgttgtaataaattagaaagtggtggtccagcgttaagcaatttgttgagaatggcagaataaatgatcacaatgctgagaaaatgctgtatacttatttcagtgaataagtgggtcagtacctccatttatctttgtgattcctttttactaggggcagctttgagatatgatttataaaaattataaatgtacttaattagcgtgttgtccttatgaaaggtgaaagcgtgttgttgaaggtaaagataaccctcactctgaaactcatgcatttctttcatgcccttatgcatggctggttataaccttaatttcatgccaacttaaatagatagaatacaatctaaatttaaaggattggaacagctatagtacagcatatcttatggataccattactgcagttttaatctcttctgcacttgattgttctagcatacaactgtaaagaaatactgtgccatccagcttttctattgtatcttggcattcatatcacaaaagcctctctggttcattttgaaactttgagggaaacgatacctgtgtgatttaaagtttaattacttaacttctgcaaattgctttttcgaagtataggtatttgaaaaataaaagtggttttaaaatttcagacctaatgaatagcttaatcacttttcaaatggtagaagttttattcaaaatagattctctcaagggcaggaaagttagaatgccttgcctttgtatgagattttgcatgctctttactttatt

SEQ ID NO: 53301 - DNA, 879 bp, Bovine  19866881154686
tgtccctgttgcggcagcgcaggatcgagagtgtaggcctcgtcctgagccacttcaggtaccagcttgaccccctcccctgccggccgcgtgaccccagacggacaagaggccacggctgaggctcggtccctgtgggcccagcgtggtggtggagggtcagacagggccacgtgtaacacgcgtgcctccaagcggcgctcaaacgcccgctcacggctttctacagtgcggaggggcttcctttcacgggtatttctatggcctgccgctagtgattagaaataaaggacatggaacgcaggaagaggagcagtgggacccctggagacggggcgatgggcagggcaggctgtggtccccgggtttcccgcccgaaaccgcagcttccccaaagttcctctagctttggaaccagcaggtgtaaacagctgagagggattcaggttcctacctgccagatgctcctctcctttttggatggctggcctacttgatacttagttgaagcctgattccatttttttctcgtctttttgaaagcagaagccgtttttttttgtttgtttgcttgtagttgcatatcggtgtttacactgctgtgaactttgatctgaaaagcggctttgcccttcaaaagaatttaacttgtttgcctcttctgccctttggataaattggtgttacaaatgtctatgactacgtttactttggaaaatagccctttttccccaggataaaataatcattaaccacgtctattgtaacacggacactaaccgttgtgccaggcagccccaggataaccaggtgtgccgagtacggcatccttgggacactcagcccctgctgaattacagagcgccttctttcttccca

SEQ ID NO: 53302 - DNA, 1534 bp, Bovine  19866881241489
tctaaggtgggaatgcgcatggagcactctcatttcctactttacgacttctgggtattaagcaaagcatgctttgcaatctcttttcaagagcaataaaataatttccaagtagtaacattccaatatcaacatatgtggtgtgttttctagcctgatactggctataaaacctacacagtgtctttccctgaactgtgtcttgtagggaaggagaatccacaggctttgagaacagatgcctgacactgtgaaacatgatgtgactatttatttgcatcttttcattggtaatcaagcatgcaaggtcacttcaccgtatacgcttataataagaaattacagatatttttctctgctaggtttacaagattcatcagttaggctatgacagaggaagaccattgtacactaggcaactttagttctacttgccattaattgggggaaaaaaagcagctgtgccatttctgaggaagcattatgattctgcatattttttagacatccttccgatggagaaggtgttaaactgagaccattttgatggtccaaaggaatcaagtctgtcctttctatataacttgtattaagaacaagaaaaattaagaataattgtatacaaaacaagtataaatttatgttcctgaaaacatgatccctaaatgaacacactaatatttggagacatctaaataagagaaaaatgacgtgatattaaaattcaacctgtcacgatggagtactaagcacgtgatctgggcttgcacttattaaaacgttgtagcagaaagaagtgcgcttgagttcttggccaggcaacactacttccgcattatccccagagaaagggctgaagattaatgcaggcagagcaagagaaatcaacgcctgcttattttaaggtgtgattcttctgtgtagaaaagatgcgcacagaagtgctatgcgtttgtttgtctgacaaaggctagaaccgtggtcacaagccttgacctgtgagggactgaattagctttgacagtattgttctgggcctctgaataccttcgagtctgcttttcagtgattagctgaagaaaatgcgtttgcacacataatgaaccctcttctatcctcaagtttctatttaacggtcagggttgagcagccaaaataacttgagaagctaccgagagtgtgaggcaacgacgattattgaggcttaagggaggcatgtgacttaagccatcatggacatagccagaccttttgaagcattccttcaggaaaccctattggaaaatagcttgagggtttttgttttgttttgtggatttggtattgactccatttggaacattttaaaacatttggatgctatttttgaacaaaaattttctcgcatagaaagaatcaagatgaaagaaaggagttctaaaattattttaccaattccaaaccttcaaacaacaatggaatattttatttggaggtccacagggcaacactgcccaatttggttacaagctttccactacagtgggctgccagg

SEQ ID NO: 53303 - DNA, 1520 bp, Bovine  19866881297167
ctcctgattgcattatctttacttgagtatcagaagagagtctgttgtgcttggtgggatgtacagggtacatcaggacgtgctttacgcgatgtacaggttcaagcttgggccaccctacagtgggcatttcacaataatttgtttttagagcgactgctgtgtctgttctgcatcaagcgtttgaatgcatgttcctaaaggctcatcttccaggcagcctttgaaaatagggcttttgggtgttgtgtgtgtgtgttgctcacacagggtacacctgcaagccatctttcagccattaacttccatccgtgtgtcagattgtattcagtctcttaagaaaaaacatgtcttgggaggtttctctccactttgtttcaacaacagaggattttcatttggagagataagtgtctgaccctggaaaaccaatctgccagccttgtccagctctggcaacatcatttctttgtattccaactaacttggtttaaaatgtcttacattatgagaattattctcttttctgagaaaaactcccttaatcttctaaatttccttgggaaatttttaacatgcattatttttttcttaaaaaagcaaaagctccaggctttatccatttgttacagttagattgtctttccaccatttagataattatcccacccagagtatttttccctagaaacaattaaataaataaaacactctagtactctatcaagagaggagatgtaagagcagctatcggggcaaaactttcccaagtgctttggggaatctcatgttttaagagattatcgtggtctagaaaatgaagagatttgttttaaacaaatggaaatttctggtttctcaaatgtgtatgagaaaatgtaatggttttgtaccagctgtctagggagttgggtccactgaagtcccattgactctcaatttgtgtggctcaaaagttactgaaggtattttatgtccttttttaatacaagtgtgtatgggtgaacattcacacacggcaggaagccagcgttgctgtgaatcacgtttactcctctgtctcattggcggtggcaggggtgggtttgctcttgttcatttgctgattccttttgttttgtctaggactaaaatgacatggatggcagctctttaaaacagtccagaccttttggaggactctggggattttctttgatttttgttttcattttcgtatctttgcccccttcattttaggaagaagaattagaagcccaaatttccttccttcaaggacagttgaatgacctggatgccatgtgcaagtactgtgcgaaggtgatggacactcatcttggtgagtgcagggctctggccctgggagtggtggcagcaccggccgcaggcgctggtgctgagtgcttcccacgagtgaccccgtgtcaccctcgcagatgaggcgaccagagcgcagagattagtcagctttccccaagttataacaccagtcagtgcagtagagattcagaatcgagcag

SEQ ID NO: 53304 - DNA, 709 bp, Bovine  19866881889176
ataactgctgtagtgagatactaaatttgggggatgaaaaagttacaaatggcaattcacagagttactcatatctactgcccaacaaaatgaagcaagcagaagtgcctgctaagaaaaactttcagaaactaaattcaagacgctactcatcacgtgtttcttgcataaaaagcactgggaaataaagtggagcaattactttcctactcaggaaagagaaaccttaaaagttaatcacaactaaatgaacgttcaagtacggtctctggccatgctgcaaacaagacacagatctttccgatgtacccacggttgaaccaaataaccaaactcgtagaaaacttcattcctttttaaaaattccatatgatgccccactaatacagaaactactcatttttcacagacagtgaaaatgaagtgtgttagtcactcagtcatgtccgactgtctgtgaccccagggaccgcagcccaccaggctcctctgtccaaggaattctccaggcaagaacagtggagtaggctgacatttccctctccaggtgaaaatgaagatggagtcacaattttagctatgagattatagttggctttctttttccaaaccttcaatctaaaacttcaaagtatattattaaaaaaaaaaaacggatacaaaatttgcttaaattaaaatggaaagtaaactggtgggagggagcacg

SEQ ID NO: 53305 - DNA, 1152 bp, Bovine  19866880429685
tttccaaatatcctgtgctgttcctccccacatctctgtggtggaatgcccactcatgaccccctttagcttcatcttggccatctcctcaccatcatgtgagcctcgcacaaagacctaagaaaggaacatggaataaagatatcctgagactgtgaaaattgaaaaccagcagactctggcccggtcatcatgtcatttgtaagggaaagcaacaggattatgatcaccagctagtgtaattcagtggtataagtagccaatcttgaatttctctgaatataacattaacgatcttacatagccattggaggaatgaaaaggatcaagggaatactcacatttaggctgcataatgactggctgcccaacaacaagatatatgaaaggtactgagtaggtaggtactagaagtccagattcccctggcatcatataatatctactaaccatcttaattaactgtagacttcgcagtgaatctggttagtatttaccctccttttagacttgggaacaatctaatcaatttgatgtgcaggcagcagaatgacaatgaggttttgtctttcataacagttacctttttcattgccagggtcctacctagaatctcacagcaagtctgagttcatttagacagtgcagagaaaaataccttggaatttgacactacagatttaagtcaggagattgcaggctttcatctatgcatgaaaaagtaaactttgggtttgcaatgccaaagacacacagtggagcaaattctcagtatccaactgggctcaaccaaagaggtgaatcagaattatctgtggtatgagagagagacgttatgcagaagtgaaacattacagactgtagaagtcactagtcactcaaatttatgagagatgctattgagaaaattctgagtcagacttagcttctgctcagagctttcaccttatctttgtagcataagccacgaatcagagaatgctggggaggagggtggagacaggcagggcttaggatttggaaaatgaattttgagcattctaaacttatgacaaagcaatgcttggtgctcatcaaagatgtttaaaaagggggaagtattctgaaaagcaagtagaagaaaagcttccaaaaggcttttctctatgaaat

SEQ ID NO: 53306 - DNA, 1658 bp, Bovine  19866880584004
caatgttgaattgttgaattgggagcaaataatagaggtgaaatgtggttggttcctgagagcaaatgaaatgctgctttctgatgagaataactttttctataactcctaaggaataatatattgcaaaaggtgttggagatgaatacaaattagagcaaaaaaactgaaaccttcagagaattcaagattacatttatactactaataatattgaatggttaactgttaatagacctctcaaggacagtaacggatgaaagaacaaacaaaagtaatttgttgctttctcactattaggctatagacattcttccatctagactgatatgatctccagtggggattgatttatttcttccacattcatgacactctctttcacaaccaggtgtaatggcttcttttacctctacggggaatggctgatttatgcatagacatttgttcaataacctttcttcaaagattgatgttgtgaaaaatgaaaaaaaaaatgtgaaactttttgacattttattttaatgtaatttagaaaaccatgtaaactgcaaatgaacctcatgtggaatgaaaatcacatgctgataatctaaactattttgaatactattaatctttcattaatacctggaaatttttcttagcagaattatgaaaggcactagagagactctcgtgaagttcatttaaaaaaataatttgtaaataaaagactggagagttttttatttgatccctccaatccacaatttcaaaattttccaacaagaagaggggactgctacccatcatgtaaaggaatatctgtatttatttatttattttgcctagagactctgctttcaaagacccctaaccatcaagaaatctttgaatagaggaagagaaagtgatgtgaaattttctgactttctgtgatcaaactttttctgaccttctctattcttgtttggagaagaaagcctgaaatatatagatgttgtccaggctctgctggagtttaaagaaagcgagtgaatagtctcatacttctggctatcttcaccactactccctcaaagaatgaattaaaaataactttattaattttattaacatatctataagccattgatgtgacttccaaatgttggtcagaccatttgagaaaaataaactacatgttaccgaagtgtatttcagggaatttcaatgtctggtgtctgactgaaagagaagggtcgcaagccaattgatttccccaaggaggtcattataaaaggcaagaggtctcttttccattttcagtgtagagtgtttattctcaagaatgggagtattaaggtttgtttgtacctgaagactttgaagagcttttcaaacatgagtcaatattttgactaatttaagaactaaatttaagaactaaaatctactaaatttaagaactaaatttaagaactaaatttaagaactaaaatctactaaagattattaattttttcttggttagaaaagatgaagctttttaaaaatcagagtttcaacactcatggtagccaatatttctggcatggtttcattaattcattcatttcttattaagggagtttctcaacccatatgaggattgagctcttaagcactctagagtgaaagacacattacaaaaattt

SEQ ID NO: 53307 - DNA, 726 bp, Bovine  19866880655241
caatggatttgtcttgacaatcaatctttttatatatccagacttcatttattattaggcatgtctgtttttaaaattgatacttctttacctttctgtatttagggaaatgacacaagagaatagcattaatttcctctgtcatatgggctgaattacatttgaaactttcaagagagattgtgtaatcaatttaaagagacatttgaaaagattgctgttaatatatctctaaaatgaattagtggcataaactgtagctaggtgatttaggtacagttgtaatcgttagtaatcccaggagaagatacaatgcatgctgtagtctctcaaccagtgtaactgctgaaaattctgggagactggtcctctgcaaggcttcccgatattattgctcctaggggaattttattccaatactgtatttacaacagcagcagccattaactatttctgtattactccagtcatagctattactgaattattcacctactattttgtggtttaaagaataagtggacttcatattctagggacagtgttagtcactcagttgtgtccaactctttgtgattccaaggactgtagcccaccaggctcttctgtccatggaattctccaggcaagaatactgaagtgagttgccatttccttctcctttctagagaaagcactgaagaaagaaagaaagtttgccgtagatctgtatatcccatgcatgca

SEQ ID NO: 53308 - DNA, 934 bp, Bovine  19866880681760
catgctgtgtacaaagaggttttacagacaccttcagaggtttctaaagcctagatagacagtgttgagcaggcagtgctagcaaaggacaccttcctggtttctgcgggtaagtgatgccttggggcagcagggagggggagctccaggggactgcattgcatttcttacctttcttttcttagcttccttcactggtaagatctgtagacaaagcagagggtggattttataaaatgcaaaaggagaatgctttggagggtctaagagagcattttgacattcagttcttttgcccttatgaaagtaaattattttaggaatcagcacttctctttcctccttttccccattctcagaagatgactaggatctaaaaacagtagccttttccccacattcccatatgtgacatgaggaatatgtttatttgaattggctcagagtcttatctgaaaaagcacaaggcagggagagtatgaaaccaagaatagagtattctgagaatggggggaagtgtagcgtgtagtactttcagattatgcatcctttcatctcatccaaattgtgtcttttattgaggtttccattttcatgtgggggtaaggtggtgagggatttctgaagagagacagataaaagaggttatccaagtaactctgaaaatgaatcatgtctgtcaaccagaaaatgtaaagtaagatttgttttaattgagacttcttgctgaattctcttttgtcttatgaaattgctttatctatagaattttttaaaaaataattccctcaggaaatgttggtgcccttttgatgggtgggggatgggcctgaaatgcatctatctgtcctttctgagagttcttttaaattccagtatttggtcttcaaaagcctagaagtttgccagtgtcttcctacttaatctgaaagag

SEQ ID NO: 53309 - DNA, 977 bp, Bovine  19866881097292
taaatatttaaatatattcatctacatgactctcttactaaggaagcccagatgcgtcaccaagttaggagttattcagtaataatatttgaatgaaacccattctgttagactaaattcacactatcaaagtcacattataaaagctttctcatttatgaacccattatttctttttggaaaatatataaaataaaatattcatgttgatttataatgataaaaaacattttgaaaacatttcttacattttgaaatttttgctataatgccaataatcagaatgatttgtgtagactaaaataattttcaaaataagagatgtgatttgctttttataatctgaataggaaatcttaaaatgttgtcctgagctaaataattcatatgaagtaatagaaatttactttccgaaggtccatgctatgtaatggtttccagtggggttgacaacatttacactgttggatggttggactggcttaaatatgtaaaacttttaacactagtctcatgttctgaaaatctattaggcagagggaaatcccttaagtcctacataagtctagctgatcacccacatctactttttgatttgcaaaggcccatagatacacatcttgagaatatcgagggtctgctgaattattttcaaaacaattcagtctaagatttacaatgttcagaggtgaccgattttaaagttcagcactggaattcacacaaattccttccaattctaaaattttataattggatcagtaaagaataatatatggaaatgtaatcaaacagcttttttttttttacataaaactgccatcaacataagaattcaaagttcagacgtaactcgagttgtcaacaaagacctcagtgacatgagattctgatcataaaagataggaaggattagaataagtgaagaagatacttaagcctgaggaacaactggatagattcattttctaaagaat

SEQ ID NO: 53310 - DNA, 1749 bp, Bovine  19866881098387
cttttcctccccagacagcacacatgagatcgattctccgaagccccaaagagagttcaaatagttttaagaagtctgagattagagaggagagaagatagtcatcgtactaagaaagaaggcaacttgcattttgcagagcatacctgatgtaatcaaagccatctgtgtggatgactgctacatacttagaccctacactttgatcaagtgtactggcaaaagctgggcttccctggtggctcaggggtaaagaactcccctgccaatgcaggagacgtgggttcaatacctgtgttgggaagatcccttggagaaggaaatacaacccactccagtattcttgcccaggaaatcccatggacagagaaagttggagggctacaatccatggggtcataaagagttggacacaactcagcaactaaacaacaacattggcaaaagctaaggattcagtggtgactaggaacaagggtctcaagatgagtcaagaggcaaacatctgaacacacactgaactaggataagagcaaacatggcatataccaaggatgatctagttggatcataatcagttgcagctttgtaatttcaacattgcagttttataattcacactagaatcttagtgggaggtaagggtgaaaggttttggaaacacacacaaaaaattgacacataaaatctgttttataatcagctgtatgtgactcattttcaacaaattcttccatggttttcaaatattattatagataaatgagaagactagatgttcctgcctgtttcaatcaagttttaaggcagatgtgaacaaaactacataaattttccacgttacagaatcctgtcttaaggaaatgtatttctacccaagtatactaaatgttgtagtagcatttaccgtgttctgtgtatctgtccatgggtttatttctcttgaggacagtgtctcacacattttttactgcccatacgtgtaacataacaattaatgaattaagacattagttatattaatgctatacattatatatattatattctatagcagttatatattaaccagtgtggcatgaaaactgttattctaaccattgggtagagaaggatttcttaaaatgacaaaggaaataataatacccaaattgaacattttatcatattaaaatcaaaatatctgttatattttgattatataaaacactctttgaaaaagcaaagagttaagatagagactacgtaattgtttgtaacatgtataactgcataagaataaaaatataatacttctacaagtcaaaaaaaaaattcaaaagacaaaaaaagacataaataggtattttacaaaagaggaattgtatatgaccaattaatacatgaaaaaacatttgatttcactagagatgagagaaatcaagatcacagtgagataatattctagaacaattcaattgcaaacatcaatgattataaggaccaggttctgtctctcaaaattggcattatttttctgtgtgcaatacaagtgggaagacctacttacacatgtaattcattattaactctgtactctttgattaacactggagaattaccccagttctcaatgacaaatgacatagtgttttcatctgacagaagtttcctcatgtgagatagataactttaagagtgtcataaaatttgatttgtgctattccttgtcaaacattaaattgcagtgtttaaacaaaaaagcaagga

SEQ ID NO: 53311 - DNA, 699 bp, Bovine  19866881242157
tgagttgagttctttcttgccatgttggactttccttaaactacttctgaatctccagggaagaaattttaatctgagtatctatgtggtttggcagggaattctcaatgtgtagttagtaatatgaatgagttaaagaaaaagtgcacgctagattctagaaaaagtacaaggataactgtctcttgccttcctcttatgtttcccgcagtgctgctgctgctgctaagtcacttcagtcgtgtccaactctatggctagacaaataactggtcctcaacaaatactgctttatccattttatattcattcctttcttgatgatacaacacagatgtttaaattcagggcagtgtaaatggcaaagatgaaaattagcagacccatgcatcaccgtcctatttatgcttggggagacctctcatttattcagcaaagtcttgatgacttcacaatagacataatctctaaggaactattggttgagcctgagtctctgctctaaatgcagaatgcaaaaattcaaatgtactataatttatatgcatgctgatgtagaaagctgattgtatcagtcaaaatatcttcatttgttgacaacaaaagggttgatcttaattccttaagtgtatgctctgaggcacagttttaggtagcaaacaaatcaaatacaacaagaagagtaaagtaaaagagaaa

SEQ ID NO: 53312 - DNA, 681 bp, Bovine  19866881413591
ggtgacatgttaagcaaagttgaaatataatatgctgagtggatttgcaatgcagagcaaacacccaaaccaaaatgaattcaataaaacagtatctatcatgagtgtcacttactcagttttacctattccaggcaccagattctttcattcatgtcacaggcactaatcttgtggggtctatttagccctgatggttatttataaaatatctcaagtacttctttaactcataacttggaataatttaagagaggcaacaacaggtttaattaagaagacctaagcttatgccatgaaataagaagcacaatactgtgctgtataaattttatttgtccgttgcccatctctaccgcattctccactctgggaggctaatgtgtgtcatcagtggtctcccatgtcctctggcttccagttgatttagccactgggaagtgggagttggaaatagaataaagagggcagagaggtcaggatatttattctgctagttccctacccatgaagttgcttcaggctatgtcccttgacaaaaggttactgctcttctcaaggtgctttcttatgactctcagcttctggccacttctccctcccctgatatcttgggcctagatgtagtaacatctccactgctgcaagacccagtttcttatattatctctggggattttc

SEQ ID NO: 53313 - DNA, 1306 bp, Bovine  19866880590440
acctgttctgcacattttggtgcaagtattttacatccagaaagcaagcggtgcaggctgtgtcatttgctgtttatagcaccagctgattctaaacctggaaaccctgagagccgaactggaccagatgaggctacgaggggctcccttcctccatgggtaggccgctcccccaagcagctcccctcagcactgtcgagtgtgacaagggcctgtctggtgtgcggacagtatgactgggtgttgctcatggtcacacctcaaggagcctttagcttcgtggccagtgagagagaagagacaaacattgttccttagggtcaaacttggtagcacggagtggtagtcacaggattgacaacactcaaaaacacaggcagaggtttggaactgggtgggaggggggcgaccagttgatatttgggtgtatttatttgaggggcctgacagactgtgacactgctatttctttttttttgaaggagaatctttattacttttatgtacagaaaactccctagtgcgctcagcccagcttggtggccagctctttggccttcgtcttttcctgcttggcgatgcgcgccaccgacttcggccccaggacgttgcctccccagtgacgacggatctcatcgtatctgtcattgtaattggtcctgatggcttccaccagcttagccagggcactcttgtcctccgagttgacttgtgtgaaggctacggtggtgcacgtcttcctgtgcaccaggcgccccagccgggccttgcccttgatgatgcagtagggaacccccatcttgcggcacagggcaggcaggaagaccacgagctggaagacagcgttagcgctacagttatctgaagcaaaagcgacactgctatttcttaagagtcgcagaaggttaataacctgtagtcttttttacgtgaatggagactgagacatgacttgtcattgactatggtgggaggaatcacctggcttgtgaatgaggcaagcagatcaaagtgtaacacaactgggtgcagatttctcaagcctagttcttctaaagcagagttacaccacatgtatgaaacgctcaaaccaggaccagaacttgctgctggtacaactcctgtgcgccagttcaaaatccatttcaggtccctccctggtcattaagtaaccaatgtgggcaaagtcctaacattaaaagtgaaaggtcttaaaaacgctttttccagaattctgtatgtattaaactctgccacctaatctcctgttgccgaagagtagtgtgaatagcttatacaaacctgt

SEQ ID NO: 53314 - DNA, 732 bp, Bovine  19866880619132
ttagcatctccaaatcaacagaagctcgcagagcaattaagaatcaaattctacagctgatgactctagacagcaacagtatctgttcaagttggctagaagttgatgtaacaattccagattaaggaagcccagtgcatttctcatctagtctaattagattttaacgtcttcacaccttgtcaattggttggagaaaattacactgggaaagcatctccgcacttctgtctctaataattatcctaatttgttttgctcactttgtgtcgtaacgtagcaagaggtagaaacaggagcccagcaggtcagcacgtatgacttcactactcagtacatatttgtagctcataaacatggttcattagttccccaaagacaagaaagttttctgcagcagacacttctggaagcagtaaaaattatgtaatcattcttgaagaacacataacgttcgtcattggaataaattttccatgcacataagcacgtgtaacaaatagcctagagttcgaatgttaaaaggagctctttaaccacgcaaagccacatatcaatgctttctttaattgtgatgaattccctggtcttacctgggaaggtgacatttcatggcaaataaagctgggaaatcacctgggacatgaaaagatttcctgttgtgtaacctgtttcctgtaacggcctgcaagttgtgaacaaaagctaactgggcagtacagttgttctgag

SEQ ID NO: 53315 - DNA, 1403 bp, Bovine  19866880633372
tactttctgactctatgaatttgactattctggatacttcctataagcagaataaatatttgtctgcttccgtgtgctcagttactttaattctgtctgactcccttgcaacgctatggacttagccagccaggctcctctgtccatgggatccaggcaagaacactggagtgagttgccatgccctcctcgaggggaacttccaaaacccaggaactgaaccccacgcttcctacgtctgctgcactgtaggagaattctttacccactgagccacctgggaagccccatatttgtctgtgcctaatatatattggaatgacattttaaagttaacttaatatgtagtacatttttttgagttgagacttgaaggtataaatgaaacattgcctaagtcttttaaaatcagagggagagaaagagcaaaagagagaagcatgtgtgtgtatgtgtaggtcaagacagaaaataaagaaaaatatgttctgggtggtctaaaagaagcaataaattaggtaataaaaataaaaaacaaattaaaaaaaatgtcaaagctgaatttaaagaagtagaattcccaatgagagatacattggatggcgaaccagaaccacaagggaagtggcaggaatcattacttgactcatgttagaaaaacacacacaacccaaacccactcttttgtcttttccagtttctaaatatgttgacctttcagggacccatctccatttcttctttttgttatgagaaagttgaaaagggctataatttcatgttggatttctcctaggtgactgaagctttcaggtgaaacatctccgcgttgaagagggaccacttattactcagcagttctcacagagcatgatttgttctttgtaaaattctagcctggagcctttgcagctggctgagcccctaccctgtggatacatcacagaaaaagagggcctgcattagtgacacgtgggctgtatttaaacactatgttatggcctcctgcctgtgtgtaggttttgagaaggttacaacacatctggttttagtctgtccccacagtttgagcaggaagtaagtaggctctgaagatgctggattccagccaattcaaagggggatgtgaggctgcttttcataatgaaactgagtccaaagagtagctgagcctctcttctttctccctcttgttaatgtgaaacacatccttaaaactcgtcatttcaagccacaagcataaaatcaaaaatcaggttacagtagtagacccattacaaggtccatcatggcaccttaggctactgtatttcaaaataagtagcctctcaactccaggtttcaaagctttctggagccctaggaattctgagtcctaaaataaacactttcaggctccccgt

SEQ ID NO: 53316 - DNA, 748 bp, Bovine  19866880644397
aagcacacagcatatcttgaaattttattttccaaaaacagtgttgtcatagagtattcttaggatctgaataagaattaaatgctcttgggataatgtagaccaaaagaaaatggagactacttgcatttggtggggtggggggtttgaaattttgccttggaatgaccctggtaaccacagatgctttttaatagttgttataaaaacaaagagcctgttttagaatctcacattcagtgtctgctaccatccggtcatgacctaaggaaattctacagttcttgtcatctcgctgaattaatgtgacatagaggttggaagttctcactaagcaaacaagtataatcgcatttttaaaaactgcaaaagatgaacacttttcaaatgaaaatgagtttgaagtgcagtatgtccacataatagtaagaagaccaaatatattcctagctgagcagacttcaatcctgattacatcgtttagaagaaaccacaagagaggtttcggggttttgttttttttttaaacttatagtaaaagtgttatactaagaacataatcccataatgaggaaaaatagtgcactcttcttttttatgggcagaataattattcagatccttcctaaacacacagaagtaatgacaaattaaaatgccttccaattccatacagcttttataattattcagccgttactgttattattgctggaaagcctccttcgtagtttagtcagcatcccat

SEQ ID NO: 53317 - DNA, 2007 bp, Bovine  19866880689259
atcacctttcacagtagggtagattcttttgaaatcaaattaaacactgcccctatgcaagcaatccagtaccacaggcaaggcttgctaaatggtctgtttggatggaaactgtaccactggtattaagtccaaacatagtccagtggggaaaaatgcctaggatacagatgttccagaatagcttggggaagggggaaggaaggagagggaggagaagggcaaagagaaaaggaaagtgggggagggggacagagagtgggaagctgaattctgactttctgactccagtctacttagttactttaacctccacaccaggggtccccaacccctaggtctaagactggtacctcttgtcagatcaatagaggcattagattagaaataaagtgcgtgcacaataaatgtaatgcatttgaatcattccaaaaccatctccccaccctctggcccatgaaaaattgtcttccatgaaattggtcccttgtactaaaaaggttggggactcttgttttatacaacttctcctctctgtatcatcgcctctaagatggacaggctaataatcagagtcaagaatttaaatattcttatatcttaagttattaataaaatatttcaaattaaagtacttccctggtggctcagatgataaagaattcaactgcaatgcaggagacctggatttgatccctgggttgggaagatcccttggagaagggaatggcaacctactccagtgttcttgcctggtgaattccatggacagaggagtctgatggggctacagtccatggggttgcaaagagtaggagaggactgagtgattaacactttcatttttcttttaaattaaatcacatggccaactgaaatattatggcttagtgagctctggggtagatgctgatgaacctgaatcttgtcctgatgctggattatttgtttatggaggaacactgatatgttctggcaaatgggaagaactctttttctgtgctactttcggaaagagctcagagagtacatggggagtgggcttcctttttctgtttcaacttgtcagtgtcctccagcactgacctccacagtgagctgtcaaacctgctcaaagtttgagaatcttcaaccaggaagctttgggatttctttgagggaaatggtttcattctagcttggatagaccaacatgtaaaaagaattcttgggaaaagacatctcccaaatctaattcaaaagagaaatgtggaagcaatgggaatggttatcagtgttgagttaaggatgggaagactgggggtgcagcctcaaacagagacttgtgagcttccaattgctgtctctccaactctcccttctaatggcctgtgtccaattcactttatgcctttgaagacctttgaaacacctcagacttggggaaaaagaattctttactcctttctattctgaggtaaatcacaatgatagtgattctcaaccaagtttatgaattgataagaaatgaagccctcagagcctgcagagaaccactgaaccagtgtctctgagcttagtaccaagtgtctatgtttggaatttttcataggtgattccgatgtgtttttctgatcaattataaatgtattgattaataataataataaaagtcaatctaaccattgaactctacttgtatatatctagattttctgaaaggaaagggacctagagatcactgaaaaggtcattaagatgacttcaaaccttagctacattatagggttggggctattcaagatgcaaccacacttagcttagccaagcaaaggttaaatatattaaatttgccaagaaagaatatgatagcttatacgccttgaatgctataaacttaactctagtattggatggggatggttgacagccataatgagaaagaaagagtaattagccacaagggcatcccttggtccacggtttaattactgtttgctttaaaatttgtacagcatcccatttttt

SEQ ID NO: 53318 - DNA, 781 bp, Bovine  19866880732427
atgtaattatgaaagcagataaaatggtgtttccttctgtcttacagcctgaagaataagtagtaagaacatcaatcaagagatgagaaaaaaagtcaggattttctgccttggagaaatgcttaccaaccaccagaggaagatctgttcacgaacaatgaacatttctcatgaggattcagattaacataggactaatcttagttttggggaatgaatgagcttcctttctttctattttttttaaattttgtggtaagctatgatatgtggatggattttggaaaaattctttcctgataatatatttagcacatgttctacatcataatcctatagcaaacagcaggagcatcattcaaacttaaagacagtggggaaaaaaatctcagtttccaatttattctcagatttcttcaccatgtaattattctgttaactccttgctggtggaaatgcaaaccacgtctatcaagaaataaactttattttttcatcgtgttgaacacaattggtggcaacgtgcacagagcctgaccaccattagtagaagttacataatggacacaaattctcatttcaccttcaaatatacgagccagctttgccatccgatcaagaataaggacagtaaatcaaggagaaatcctcctttttttttttttttttcctgatcattcaaagaatagtttctcaaggttaagccaagtcctcttttgcaagctgccaaaataatagcttaggaaaagaattagtttgcctgcatgatgatcctcttagg

SEQ ID NO: 53319 - DNA, 1153 bp, Bovine  19866880903533
tcctgacccagagatcaaacccaggtctcctgcattgcaggtagattccttaccatttgagctacagggaagtcctattattatgactttaaacaaacaagattatcttagggtgacttattagaccaaagccatggagcgaatctgtgaggaaattgatcctcaaactcagcttcctgccctttttccctccaccccagacagactgatgcttgtggtcaagaaactcacacttcccaccctccactggaggtctgcacccaagtttgaagcctcacagtttctcttctgcagagggaactcagcaatccattgttccaaggtcactgaagggaaaaatacatgcctttgcctcagagaaataataatgttggttactcacagtgctttttgtcctgttttagaatttaattggagctagtttttagcttctgtgactgccaaatgaccaagaggtcggctgccccgctgtgggcttttcagccaattcatgagggttattttacttgacaagggtcctgttttaatgggaagagttgtcacatcctattcgcatcctgtttttgatctcaccacagcgaatttggttgatctagtcccctgccctgcacactgtcccttcctagctttttcacttagcggccccactttgatatgcagaaagagcttgcctcctggtcaagctgtttcctgcctggttggatttcccccaacacctgagtgtggtcttccgcagcagccgggtggaaagtgccagcttcccccgcagctgtacagccagctgctttgggatcgcaggcgatgcggtgataggtcccagtttcccagccgttcccttgttcaacaagaggattctgtgtggtgctgctccactcatcaatggctttcatttcttctcagcagcagatgccatttgttctgtggcccatcaatgtcttgaaacaaatctccaggcagccttgcctgtgagcgaggaccccatcagctcagtgctcctgcccaccagaaagtacccagagcttgagcttgcttgaaattcctgtgacttcttattgccctcaggaggaaaaaataatcaagaagatgaaaccagagaaaatttgaaaggtgatctattctcatgaaaagtgtctgttctaacaaataaaattga

SEQ ID NO: 53320 - DNA, 1215 bp, Bovine  19866881169386
attataccaaggatttatgataatgtaccatccaaaaataataatttatattttacactaaaactaaaataataaatcgttttccagtttttgagcagacaaatcattaatattaatctaaccaattattcatagcagaacattaactcccaaaatggtgattctcatttcagttcccaattgtaagtatcaaaaccaaaatcatgtggcatcactacataaactgtgttaaggcgaacactctcagattttttttttttaactcttactattgtttggatttttgtattggattgacggaatctttgttccaaaatcagagtgatgcataatataaagtctcagtaagtatgtcttttgttcttttgtatacacatgatatagttaattccttgtgtcagatttgtaaataactatgaaatatttgcttgttttgttttagtattgtataaataaaacctgcaaagaagttcctttaatgggatataattgtaatgccactataaaatgcagaggaaatggggtaagctacttttgtttttgtaattctaaattttatgttattttttgagtaattcaatgtaaaaaatctatcctgtttgggagaaatgaaaatctaagttgctcttttatccaggcttgcctaggaatagctaactaatataaagaaaatcagctgattaccaatcgatcaaaacactatttagtgaactgtactatatgtgtactgaatttattgtaagcactcaaaacttatgaattggtaacacatttaaattaaaaaaaataattttctcatgcaaataaatgcatattttgcttatattgtgggcatatttcttctttctcatactcttcataattaaaatttaaagctatatagtattttacagaagatattcttaaagacatgatagagaatttctgaagtttttatgaagaggcttctactagaaagtatctttatgcaaaaaacatttttttctcaactgtttatccattttaatctggcaatacagatttgtagttacttttgcatttaatatttacttcttaaaaatgtataatttgggacccttgtttcactgctttccaaaaagataatcagtgtataattcagtcaacattatagaaatgaaattaaatttatcagtattcagttttataatattcagtgttacaatttacttggttgcttttagaagatatagaatg

SEQ ID NO: 53321 - DNA, 746 bp, Bovine  19866881243154
tgtgtcatgtcagcattctgtactgtctgagccccagtcctccgtcagactccaaatcaacgtctttgattgttaagctttctctcaatagctccggggttgccctgcctagggaagtccagagggcgctgatgtgggttggcaaatgtttggattatacttttataacttctctgggaattaaaacttttcggtggctggcagaacctttcgttttggttgtttgggaagattttcagaagctaaaagatttcaccatgtgtgtttcttcgctttgcgctgttctggtttaagctctttttttttttttccctacagaggagcccaaacctgtaattctattgccacagatgcgttaaaaagaacccccctcctcatttctgccccgtcattgaacacagctttcagtaaccctgagcacaagaacaggaaggacattggcaactcaactgttaaactggtctgtgattatgtttccttgagatcactctgatgtcaccagtgtaatctgagcctggagcttttgttcacactttaaatagcagtcccggaatgattttgctacagactctctggagagcctgggagctgaattcccgaagaatcccccatccatgaaagctaagccaagccacccggccttcagcatgtccacctcgctgcgagtcagcccgtccatccacggctaccacttcgacacagccctcacgtaagaaaagctgtgggcaacatcttcgaaaacatag

SEQ ID NO: 53322 - DNA, 1040 bp, Bovine  19866881271869
cctgtcacattgtctctggggaatagcaaaattactcacaattaacagagaacattttggaatgatatttggtgactttagttattcgtatgctgtgttggtctcaaccctagttagacagttgaggaaagaaagactattaattgcttagcctccattgtggacacaggatgaggtattttaatcaaaagattcaggaatattccttcttcaaggttaaaagaaaaattaccttcatggatagttaaaaaaaaatctgctttggaataataaagcagttcttgttatgaatatctgactcaggctgactcttttatctgtgtgctactttatagaagctaatcatatgctatcaatgcctagaaccatatgctagagctcgtgttagaagcatgaagagaaaacaaataattagaatttattttcgacagaagttggacagataaatgcatctaatcatcattccttgatcacaactgtcacttattcctaacgtaatttgcattcctggtttcttctgaggaatcgccatgaaatatcctatcaggtgttacaagatttaaatcatcatacataagacatgaggggtcttcaaagaaaacccagaaaatagggcattttgagtgaagaaagcaaaggcttttggagtaaagtcttagaaggcaaagcttctgtgacagtccagacaatgaaacgccaagtgctttcttgatgcttcaccctgttcatatctgacacccctcctgcatcctcagaccacctttgctcttcccttcccagctcaggttcccagctgctacagaaagtaaaagctgcacctagaatgcgcattcctggcgacactttcttggacacgcagcaggggatgctatgcctggtcacccagttgcactgcagttggcacctgctcagaaaatctgtcagcctccatcaccgagaagggccaccttgccctctctcttgcaatttcagtggaccctaaaatgagaggtcactacttgggatcccagagactttagtgtttaggcatttaaaaggtg

SEQ ID NO: 53323 - DNA, 1121 bp, Bovine  19866881293596
ctgctgtatcagagagatgacagctacataacagactgaactcaaaagcttttctattgcacttcaagtttataatgtgctttctattcgttatgacttttacttcctccaaatacagccttatgcatttactcacttttgcccccatttaatagaaatccaaacagtgtgtacgcttgtggctgaccttgtttatgtcccatattctccaaaacaccagaagctttctctggggcctttcacacccaggtgcagcctgagaaatgccaaattgagaagtgggtgaagtttgactttaatgctcacactggtttcttcggatgctactacagccctgacagggcctctcctgcagtgcttctctccctgatccccacgcctctgactctccatcatctcttggtccttacaacagaagtatcctcccatctaataagcacttattcacaccgtagaagggacggaaactgatttcctcctaaacagaggagctttctgaccctcctattaactgtgccacgagagagtccatcccccactgagtataaagacagattgaaggtttgttgtcggtggctgccgggacgtcttcccaacagtgcccaaattccagcatcctcaggatctagtgtaccctgcttcaccccctgacccctggcgatgggtaccttgtgtcccgattgagtctgaaaaacgaggatacctccatcccgcagtcacatgagtggttcagggcttcttcaaagcagacgtttgtccaggacttcatcatgacctgaatcgtcaatatacaccacttctattatagccaagacctggctaataactattttactgtgactttgaagggatttctgcttctaaagtttaattttaataattctctgagtcccattaatttctctctctgtgaggagacagggggtgcagaaccataaggaattccacattgacatctcggtttactttcctttatccagaccttggcggattctgactcaaagggaggaatcacacatttactggggtgtcagcctcttctagcctgagtcagcttccttgtcattaattctgatttggcgctcagcaattcccatgagaacaactggcttttcttgtct

SEQ ID NO: 53324 - DNA, 1037 bp, Bovine  19866881377445
tcttcaactcacaataatattttcttaatttttattcaactaaagtgtccttttcacttaaattagctctatttttccttagtgtcaggtcctaacatgaaataaaactcatattttgacatgtttgaatgcgtttagtaaataaagggcaaggtcttcagagattattttcatggatatttggggctggaaacagggagacacatagcaagcaggtggatctgagacagtatctgtctcttttctggactggtcatgtgttctatgcagacgaggctatagaaagaagccctctctttcatattcttttccattgtgatttatcatggatattgaatatagttccctgtgctatacaataagaccttgttgtttgtccactctatctcagacagtatagaaacttcctgcaatgcaggagacccgggttcaatccctgggtctggaagatcccctggagaacagaatggttacccactccagtattcttggctggggaatctcatggacagagaagcctggccggctatagtccatgggatcgcaaagaatcgtatatgactgaagcagcttagcacgcacgcacgcacgcacgcacacgttcgcatctgctaattccaaactcccaatccatccctcccccaccacctacccccagtccaggtctttctgatttaaattccttggtgaataagttacaagcatcccatcaatctctgaatcaccaggaggcactctgcacataaacttttcttgtatctgagcttcaaagatttgtatcatcaaagaagttcaaggggcaaaaatctgtcaagcgtttctctaaaatgcatatttcccaaagtaaagccagtggctattaagactggactggagatgttgccaagagattgggacggacccagaaaagacaacgtgaggaatccctaaatgcctttcacatatgtacagtgtccatgttaacaagggagcagctttgatctaacaacctgattacccagaaagtaatctggaattcttctaaatatctataccaa

SEQ ID NO: 53325 - DNA, 763 bp, Bovine  19866881407618
tcttgggtcaggcatccaacatggctaaaaattgtcttttaattatggggaatacatttagtccatagctttagattttatttgtttgccaagagcttttgaagatgttaaagctttttgcttcttgattccattttcaaggcttcacatttatactatttaagtaaagaattgttttagaaaatgtgtgttctttgtttaattgactgttagatatcctgcagtctgtgcctgcaagcagtgggctgaattcagaaggttaagtgtttaaacattctgtacgtcatagtgattctagcatggagtaatatgtatcttctttatttgggtctgcagccagccctgatcctaggaagtttccttaactgacgttcacaaggaagagatattccacagtgcaagtctaagttcggatacggcagcagtcctcctgttatccttgtgatgagtagcatgatgaaatgcagtgattttcaaactcttttccaccaagctcaaggtaccttattggagtaccctaagcgctatgcttggagtttgatggtctggctggtatttgaaacctctagcccccatttcaactcgagtagctgtgctttgtcaatcttatatattaatatgtttcacattaacagtttttgtttttgaaaacagggttctcctgctttctttcactcctatatttcttttaaaagccctagtgtcgtcattaagggcaatagctttgaattcagaagtaagcagtttcatgtctctttatcca

SEQ ID NO: 53326 - DNA, 1041 bp, Bovine  19866881578580
aacagaggaaggtattgagatttgggtttatagaagggaacgaaaggtcatgaataatcactgtcaaatagaacagttagcttattctatcagtttgctccaacaaaattaagcctattttctcttggaagtggttaatacataatggaggcggatgctgtcaaaaacgtgttgcatgacattattcagacacccgacttgactccttaactcagtgttccacttttcacctgcttggctgtaatgccacagacaaatggcattttaaagttcaattttgctttctctacctcctgggaatcaaaagtcaaccaaaataagtcataaaaatgcaattttttttcccaaggaaggacaagtttccccaggaaataaaagtgaaattcataatcatcattcattcaaattgtaatttttgaagacctaagtaccccagttaaaaatcatgttaatgaatcttgtggttcaattataatcatttgggtaattttaatagacatcaacctaacaactgaaaaagcatttcaattcacacaattcagtttccatgttaagctttaagatgcaacctgagaggctgtagggtgacctccatctaagtttgcccaggaatgaagcatttcttgggaggcaggacttacaatgttgaaacaagagcaaagtttgatggttggtactctaacagaaaactcaagtatcttaggatggctcagaatttagaatggaaatcttctgcaaagtgaagaaaacctaagtcattcattaagtgctcatattttattgtttttcagtaactaagtcacgtccgacacttttgtgacctcatgtactgtaagctgccaggctcctccgttcagtggaattttccaggcaagaatactggagtgggttgccatttcctactggaagggatcttcctaacacagagatccagcccatatctcctgcttgacatttggattctttatccctgagccatctgtgttcatatagttacactttatttagcactttctatacagcaactacagagaaggcaaa

SEQ ID NO: 53327 - DNA, 1126 bp, Bovine  19866881625751
gcctgcagcctaccggctcctctgcccatgggattttccaggcaagagtactgcagtgaggtgccattgccttctccaaatctaaggatccaaataaagttacaggggactgctggaaattcagcagtgttttaaagtttggaagtaaaacccaacattcagttgagctctgatacgaattggctggatacaatcacagatggcaggcacacagtctcctggttaatcgggaggagtgcagactttctgacttatagttggacttaccaactggtgaaaacagctctgctcttcctctctgataaggaaaaaaacaagaaaaaagaaaaatgactgatttaccactctccttgctgtgacggacgcccaagaactcatcaaaggcatgcagtattgtgctctgagcagcgcttcctccagagtaactcaggggctctttggagacaccttcgtataccaagcccgcaggcagtgctgggttatccttccatctaggtaagaacaaaagtcagatggaagtgcatactaggatttaagagtgtcgtttctgatcaggatacagatcaagcaagaaagggaacaccctttcctatcttcttttctctcctcttctttcaccctgattccacgtcttcatcttttttgtctgagtctccctttttctgagtcccccaaccattttactcatttcatttactcatttactcattttactcatttctgatattttagggggtcttgaacattcttggcgtgtatgtgagtaactccacaatgagacagaatcagcaaccccaagaatatgctgtgtgtgtgtgtgtgtgtgtgtgtgttagtcactcagtcatgtccaactctgtgaccccatggcctgtagcctgccgggctcctttttccacggaattctccaggcgagaatatagtttacatatcaaattcccctacattttctcacttattcttcctggagtagatccaggcattttaaaacccatttaatacagaagcagtctcaaggcgctgtctccaggaccaccattcttagtgcagcaactagaacttgacccctaaatttgtaattctctagttttacttcccaagaccccacccacccacgtgttaattt

SEQ ID NO: 53328 - DNA, 726 bp, Bovine  19866881739825
atgaattttgaacttgtgtttaagtttaccccttctttggcaccacaagtgtgttagtcactcagtcgtgtctgactccttgtgaccacatggattgtagcatgccaggctcctctgtttatggaatttcctaggctagaatactggagtgggtggccatttccttctccaggggatcttctggacccagggatcgaacctgggtctccacattgcaggcagattctttaatatctgagccacgagggaaggccccaggtaataaatatgagcatcccttatccaaaagagctgacaaagtttggacttttcctgtagcaagagaaatcacaaacctctcccttatccggttttcatttgttcagatcccaagcaccctctcctgtcttaccctcctgggttcctagtagcccagttggccagcaccaagtccgagtgaacgaggataggagggagccccaggttcctggagacctcaacaaagggcaaggcaaggtttcttggcagaatcttgcggatataaatgcagacagttagcacattatagaaagaatgcaatggaggacacaatctgtctcttttctttttattggcatataattgttttacaatgctgtgttagtttctgtataattagctcctgtgtagttagtacaggaaagtgaatcagctacatgtgtacatacatccccttttttcggattttttttaggtcaccacagagca

SEQ ID NO: 53329 - DNA, 773 bp, Bovine  19866881888647
tcacatcttctttgtgacatcttcccccgtggtaaatctaattaaactgccattaaaggctgtgttccctctattatgccaaggtgaccgcagcagctactaaatgtgaacagtatctttctttgttcacagtcaggcatttgaggaggaaactggcaacagttggtatagaaatagattttcacaattattcttatgttgcatttttttttacaatcagtatttgctgaatttgatatcattgtcaattaaaacaatgaacaaccatgagaaaaaaaattgtataactactgcatttccttgtactatataatagagtttgatggccagttaaaatcaacatttgcatatttatatggcttttgatcaggagccccagtctgtgtctctgtgcagacagctccctttccagtctatttgcttgactctaatagggctgttgctgacttctgaatacggccagtaagtttcagccctcaagtttggctcatgataatttccatctttaatgtatcttttttcatctcgatgccatccatctttgagactcaatttgaaatgaagcttctcttagaccttggcggcccaaagtgatttcaccgagtcagctgactgcccacgtgacccacagcacagatatttgtgttgtgacttcgcatctgttcattcaaagcatctctgggtcaccaacctgaggaagaagaggatagttcataattctgggcacgtactctctccatggcaagggttcacattttgctctccaggtcctg

SEQ ID NO: 53330 - DNA, 759 bp, Bovine  19866882029816
acgttactgtatttactctttgttggtgtacaacagtaggaaagagcgttagactggaagacaggactcctgggttccagcatcagctttgcttctcagcagctgtgtgacctctgggaagacccctgccttcttcggagctgattcctcattggtaaaatgaggaggctgaaccagataatctacgttctttgtcactatcactgcctgcactttgataaccatattgtaaatttaatttactgtttaaactgttaaaatggctatggcaaaaaacaaaaagcatattgtattcagtgtaggagtaatggtgtgctttctaattatctgcccaagcaatgtaaccatagttaaatttatgatgagaatagcacatccaattggggtgatcaggttgtagtaaattaaaacttacagctgccctttgtattaagttaaaggcacccttctgccaccagcaacagaagtcttatcagcatatgaatgaagtgcattaacacaacaaaagttgtgtcacataatgtcaaagtcctgtgttacacggctaaccttgtaaacactgtgcttatatctaaggagaaattcatgtttattgtctctggcgctggcccagcttctcctctatctgttgctgaattcaaaggcatggagtacaagatcagagatatataatattttctttttcattagggctgcaggcaccccttgttggcatagatgtgttacaccccagtcaaggccaactgaacatgtaaattt

SEQ ID NO: 53331 - DNA, 950 bp, Bovine  19866880347770
tctcctctgccgcaggtccctcgtgcctgctgagcgtgcgagccggcaaggacggctggtttcagctctacagccccggaggggtggcctgcgatgacgacggggagctgttcgccagcatggtacgtggggtgcggggagcaccagagctctgtgagggcgctgggttcaccccttctgagcagtgagagagctaccccgtgcccactggggcctgccccgaaatttccaggctgaaaggatgctggtgatgaagacagtgatggtgacgccagccctgagtgtcaccttcccatgtctcacccgagtgggcactgagccagagggccccccagaaacgtgaggagggacacgtcctgtcgccccattttacagtcgaggagttaactgctcaagctagtgggttcactctgcactccagcgccgtgtaggttgaggggactgagcacttgctggtacaggggccccagaagtcgttgcaggtccacccgctcgtcttatccttgcactgagaagtcaaggtcaggatgagcggcccaccttggagatgacggctctagaggtcaccaaaccagtaagcacaccctttggtggcttcccctttccctgcacgctgcggccatcacctcagctgaccacgcaccgtctttcttcgtcttcagggcaacccattcccttaactacttctatgttgacaagcgcagagaggtgcaggggcgtgcccgaggtcacacaggcctctggcctccacgaccctccctgcgctggcccatactatctggagccaccctccttccagtggcagagggagcacagacgccccttccccagggcagacgccccttccccagggcagacgcccctccaggcagccggtgctctcaccgagcctgcttcctgacacagctagctctgttccacaatcacacatgtcccagagcgtgggaagg

SEQ ID NO: 53332 - DNA, 1334 bp, Bovine  19866880362180
cacataacccagatggagcagaatttacccgttcctggatttctggggcaggtgccttcggggcctcagagagcactggggacggggagacagggctccacaacgtcccctgccctgcgtgtgcggccgggccctgtgcaccctgagcacgcacctccaggagttcctgccaggcttgaccgtacctagaacccagggggccagatgtcagcacagccacaaggacggcgggagaagggctcctgtgcgtgtatgtgtgtgtgtgtacgtgtacagggcatgggtaaaatgtacacaccgtgaatcctactacctccaccgcgtttttaggttttcctgaagtacagctggttcacagggctgtgttcatttccgcccgcctgagccctttctgtgtgtctggtctgtagcatcaagtgcactgatgccagtctgcagtcatcacagacctcatattcccgaacggaaactggccccactctgtaatcgctcactccccactggcccccagccctggcccccaccccgcccccttctgtgtctgtggtctgactctgcatccctcccaggagtgggccctgcagggtgtgtccttctgggactggctgacctcaggcagtgcggtgaccgcaaggttcatccccgtgggagccagtgtcagagaggggtcctctgaacccccggggagggtctggtgatggtttcagatctggtatccagacagggtgtggggtgcgtctggtcagtatcttccggcctcacagtctttgggccacaggcaggcactgcggggcacagcccgtggcggtcacggcccctcacctggcccgtgtctcctcacaggtccacatcctcatgggctcctgttacaagaccaaaaaattcctgctctccctggcggagaacaagctgggaccgtgcatgctcctggcactgagagggaaccagaccatggtggaggtgaggagccggccccaagccctggccaggcggccgactctcccgggccctcatccttgccgatggagcaccttccaggagcttccaggcgcacagagctactgcaggagctgggccacggcagcagacgaggcagccctcccgagtttggcggagcaggagaccttgatcaaactgtctgctcattccaccttcatttaactcgtgatcgtcttttggtctcagggattgagcaggtttctgttctgtcctgccttttgctgcagaacagactacctccaagcgggggctccaaacagtgatgctcatctgtttttctcctgggtcttcagatggttgggctccgccaactgcttctcactgtggtctcttaa

SEQ ID NO: 53333 - DNA, 2790 bp, Bovine  19866880374457
tatgtacatgagtgagggctgggatgaagacggggaagtactcccaggtgtgcgttcactgagtgggggatggcggtggtgacgggcgtgattagcaaggaagaggctccagaacaccgtggcgtgtgagaaaaaaacaaaaacgggagaaagaaaattaggatgctgtgatgtctggatcgcagtggctcgtaggtttcatccctttcaagtttctcaggagaccagctgagtgtctgagttccctctttgttccgtggttgtgatccttggactgtgcttctgagcacaactccgtccagaaaggggaccacgcgggtccaggatttataaggcttatacagtggacgaggccacaggctgttttcacgtgtcatttacagaagtggaaactgaggctcaggaggtggaatgcgggtctgtctgattccacagtctgcctgggggtttccaccgcaacgcctcactcagcaccgtgcgctactcagtccagtgtggactttgtcccccagatgttctgttctaggccctggggtccaagacccttcatccttgttaactcagaaacgcagtggtcagggagacgctggaggcctgcgagcttgcctcgggggccagcgtgagactctcgccgcctcctccccttgtccagactttggctcggaggctgtgacgtgtcacccagctggctgctggttccgtgactttaaaattaggttttccccagggagtggggcacttaatgaaggagtttatccagttagaaagagaggctcccaggcaagccgggcgtccgcgaggcaggcagctgctgggaccgcggccttcagagagggcttctgtttccatgatgtcagagggcggaaccagcctggcccctgccccagccgctccccagctctgggtcctgaggcgataaggcactgtcttactccccacttgcagtctgaggaccattctgggctcagtccctgcctggctggagctgaattccaggcgccaagcctgtctgtctggtttcccagctgctcacactctccaggtggcctcgtaggaccagggtgagcagaaacattgcctccaacacaaagaaagtaccttcctgctgtgattgcattggaatacctggggaacgagtttggcataagatgcgatctgaaggataactatcttcatccttttcaaaaggtcactggaagcatagtagaaatgactctcctagttgtcaggaggcctggctgtctgcagccgcagccttcgacttggggcaagactctgttcttccgggatgggattctgatggggagggagggaggcgtccaccctgaagcagcggagtcaccgattgtgttgtgtatttcgcccacccccggcctgtccatcacacgcgtgggtctctttctctctcccaaccagaaaaagatttacaaatacaagaaagtcctgagtaacccgagccgttgggaggtcgtcctgaaggagatccggacgctggtggacatggctctgacgtcccctctgcaggacgactccatcaaccaggccccactggaaatcgtctcgaaactgctctcagaggtaaggccaccccttggcctgatcccgctctgtgccacctgcccccaccccagcccctccaacacttggaagttttattcctttacggggtccactgagcaccaccctgtgtcaagcggcagattgaattcgagtttgtgtgtctccccatcacgggaggaggtgagccatcccccagtgacatgagggagctgagaaggaggtcaggtcgaggggagagtggttgtcaccccaccgtgccccaggacctgctttgggacaggacctggcaggggctggccttggacccgagctgggctggcggccgctgtcagaatcctctcgttcatcctgggtgggagtgcatcgtgcagcccccagaccgcccttcctccaccccctgcgccggccgcctccccacacccagcgttggggttccgggcagacgtggcttcctggtcttctcagcacccacagcccacagccacactgtttagctcacacagggtttgaaaaatcaagaggctttaccacaaagtaggactttgcaggtcgtgtttagaaacgatcagaatgcctagcagcagttggcagctggctgcgcagcgccacccagccgagcctccggcttcaccaggcagcctcaggctgtgagcatgtgctgtgtgccaggcgtggccccgggctcctggataaaggtggtcgcctccctcccggggcaggaaagatggcgggacatgaggcctgatcttagctggtctgcccaatggagagcaaggggcactcgggagcgtctcactgtcccctctgtccccgtgctattctgagtgcttcacagaggtcaatgctgcgctctttcatttgctccctggcccctgagggctgctggggttgatgactcccggtctcagctatgcatggccaccagagtggtctctctgtccctcttccttgggagtggccctggttccctgggtggctcctctgcagccccccagaccccgcacaaggtccctgctacctagaacctccgctctctcccaggcacaggctggtcactgcccatcggttcaggaaaccggcccaagccttccacgcctgctgaagagagagggtcccccaccctggggggaggtggggggcgggcagtgaaaggtgcatggcagagatggctgtgggcagagggtgtgaccgtcctcagtcaggtgggagaccagcctcatcccatgggag

SEQ ID NO: 53334 - DNA, 748 bp, Bovine  19866881024006
cttcagctcttgttccggaagaaaacgtaaactgctggaaaaaaaactaccgagcggggggaatccgtttctcccgtaggtgtgtccctagaccaaccggggctagtcagtgtccgaagaaaagggaagtgggaatcctatcgtgtaaaatatggaagttaaagccctaaggtgcattttccccgaggggatctcctgtctgactgaccggtgtgttcaagtacctggctttggttgggggaaaaaaaaaatccgtatatgcaaatcaacatatccaaacataccggaattgcttttccactgcacttggaaggagatattatgcctaactctgcccaaccattaagggtttgtgcctaaaaatgttagtttggactcaatgccagttagtctccatttaactactagttctccatcctaagaatcttttttgaactaaattatgatgaatcaaaaaactaagataaaatttctcttgtatgacattctatcttagtaatctaaagggtcagtaaattaaggagtcaggtagcagccctcctgtgactttaaaggaagttctaacttctgtgtgatttcagatgaagatgcggcaagctgtcatgtctggggttgagaaggatctcctgcagtgccattcttccttttcaactaagcagaaccattttataaatctgaggacattagtaagtaggagattttataaaagaaggacccgagtcggacaaataataaaggtctgctatga

SEQ ID NO: 53335 - DNA, 1345 bp, Bovine  19866881029280
cgtgaaagcccttggatttgaactagggtctttctcacgccaaaaaatcccatgcattcccactaaagtgacatctgtatttggcccgtggcccgctttgacttccagatccttttctcctccacatccacgcaagaccaggcttatcccacctggcaacactgcggtgttcaagtgcaggggcccagggatcagtccatctgggctttaatcctgggcctgctactcttctggcaccaggcactccagcctcagttgaagtgaagtcactcagtcgtgtccgactctttgcgaccaggctccttagtccacggaattttccaggcaagagtactggagtgggttgccatttcctcccaggggatcttcccaacccaggggtcaaaccggggtctcccacactgcaggcagacgctttaccgtctgagccaccagggaagcctcagtttcctcatctgtgaaacagggataatgaccatagtatctacctccaaaggtcacatgaagagtaaatcagttaacattttcatatgtaaaactctattaagagtctgatgcaaaataaaaaagctcaacagacatgggcttttaatcactgatgtagttgctcttggccttggctgcgaatcaacctgggagctttagaaaaatgccaaagtgtgggtcccaccccagagattctgatttaattggtctcaggtggaggccaagtgcaggtgtttgtcagagctccccaggtgatgccaatgctcaggcaaaggtgaggtgcatcggaacagagtctccacagcacagccggggcagtcccaggcacccggggcagtgggtggcaaccagcaggtgtcaggaagtgctggagggctgctcagatgccttgtgggtctatgtcactaggagtttggatcttatctcccatcagttaggagggaggtcacccactcagacgagaggtcatcagctctgaaataaagacaggctttgtcccatcctgaaagtcccttaaccctaacatgaagtcatcctggccctggccctgcctctgcccagggcagtgtgagctccgcccggaccaagctgagtccccggaatttctgagaagggacccgccccgtttctttctaagtcacatgttgctggcctctggctttcctgggttgtgccaggagaaattcaggtccagtaaggattaagggttaggcagacaggcagaggctgccgaactccagccccgggctctggtcccagccgcacctcgactccccttccgcccaaatacctctcctgcagaggaggttgatacatgttggcctcctttataccattttacaaatgactgcaactctca

SEQ ID NO: 53336 - DNA, 1424 bp, Bovine  19866881395642
ttttgtccccagatgggttgcctatatcccggtcttgtggagagctcaggctgagaagtcggctggtgaatagctcatgctcttgggtcacacttgagggttcaaatttggctccagaacctcctaaccatgtgactctgggctgcagacttcacctctctaaggaaagggcaggacacacacccgcctgccagcgcgtagtgaagagtgaatgacgggacacagcccggagcccggcacagacaagcgccctgttatagcagcggccgctgggatgttgctcatggtgtgctgttattatcaccagtgtggtgattggtccacgtggctgtggggggcggcgcaagggcagtgggctcagcctcgcggtcagcttagagcccaccacccccttcccacaccatgggggagagcttcccgtggtgatgggcatgccctctgtctgccctgtacctggtggtggccactggcttcatggcactggtgagcacttgaaatgtagttagcataactcaggaactgaacctttattgccttgaaaaattactttcttggggcttccccggcagtccagtggtggttagaactctgtgcttctgctgcaggttcgattcctggttggggaactaagatcctgcaagccacatggcatggctaaaaaaaaagttttctcccatgtcacttaaaatgttaagattcacacatggccagtggctactatattgaacaacacaaccccaggcaagtaagaccctgggccccttctccgcctgtgggtcagcctgccggttgctgctgtgaacagagcctcagtttccatggcttcatctcccactgaggtgctcatgtaactggccttatctgcccagacagcgaccagaaggtcgggttttccaccgtgaatcagccctcgtgggttgacacacccccgtacgattccttccgagagattccgactgatgtgtgttcctcttctttcaggcaatcgctcctttgctggaaaacaaccatccgccaccggatctctgtgaattcttctgcaaggtacggcatcgccgaagcggggctgtgtttgcaggaagcagactgtctccatttgtgcgttgtgggggttggttttgcgaaatttcctggaaacccagactcctccctgaacagatcagggccccagacagagttagagacgagccaggcctcctctccaccagccaggtgataagtgaggcccagggtccagaccaacaggtcaagggggagcactgagctttcctgggagtatcttcctggccgtcttgagagaagtttgcagcacgttttctggctcctgacatcagagctgggcttttattagccaggtctcccgtgagcaccggctggcccacagtgggagcctggccatggggctttccctgagctgggcaagt

SEQ ID NO: 53337 - DNA, 552 bp, Bovine  19866881595017
cgagtacctggagacccacttccgggacgtcagcagcaccgaggagttcctcgagctgagtccgcagaagctgaaggaggtgatctctctcgagaagttaaacgtcggcaacgaaaaatatgtgtttgaagcggtcatccgatggatagcgcacgatacggaaataagaaaggtaccttatagcatgctctgacttggacattccacttattcgtatgtgtctgttcttcaccccagttctacatgttttatctttctcctccaacttgaaaaacttagagttgtgatctaaaccatgacctgttatacatcttcccataggctctctaaagcagttggtttttttcagatccgtctaccagagtgagtgtagttcatcatatagcaatgaaaatattaacacttaaaagtgacttgacatccttcgaatgttgtttttaatgggaaatgtgttagaggatatcaggtttgaggtcattagggagggtgctttagcctttacatcacagggctttgaatctcatgtgtatatcctagaggctagctccaaaa

SEQ ID NO: 53338 - DNA, 762 bp, Bovine  19866881728240
tctgagaactgtcctgagttcttgtgcacctggaaatctctcttcccttacttagaccacagctcacggccatgcttacactctctcctctccacccacggtcacgatgcactccgagtagccgcggggcttgaagctggccagcatggcctccccttgctgtggctggctgagggggatgttgctgcactccttgacgatctcgcggaccaacggctcattgagcatctgctcccgtaagtagctcgagtccaaccctgaaacccacagcgctgacatgacatccttcatgtggacctgcagagtagggtggaaagcacggggaggagaaagggagagtgtgcatttagaagggacattttccgactcatagaaaactacaagtgttgatgagtcagatgatcaacaggcaaggagtaagggccagtgctgcctgaatgtgtgaggcggcccctttcctttctacttcctctggcctcgataaacagaagtttaacttaaaatagcatcacttcagcatcactttgctggatcactgcaaagtttcaagaagcttccattacaccctacagggttcccacggcaacaggaaaacctacaagaaccccgctatgatttgctttatctcactaacttggatgtgctatgagttataccccatttatacaaatattggttacagaaagagcttgacacaatatgtcaactagataatgaaaatgtaccaacatcaaaattataagaaaaatctgaaaaagctca

SEQ ID NO: 53339 - DNA, 1168 bp, Bovine  19866880072044
tgattgcagcctgaaattaaaagacgcttactccttggaaggaaagttatgaacagcctagatagcatattcaaaagcagtaacatcactttgccaacaaaggttcgtctagtcaagggtatggttttccctgtggttatgtatggatgtgagagttggactgtgaagaaggctgagcgccgaagaattgaggcttttgaactgtggtgttggagaagactcttgagagtcccttggactgcaaggagatccaaccagtccattctgaagatcagccctgggatttctttggagggaatgatgctaaagctgaaactccagtactttggccacctcatgcgaagagttgactcattggaaaagactctgatgctgggagggattgggggcaggaagagaaggggacgccagaggatgagatggctggatggcatcactgactcgatggacgtgagtctgggtcaactcaggaagtttgtgatggacagggaggcctggcgtgctgggattcatggggtcgcaaagagtcggacacgactgagtgactgatctaatctgatcttcattctgaacatttgttttcttttgcctctctattaattcatgacctcactttaaggagcttgtgtttatagcatcttggtcagcagtgcatttactaatgcagaattcaacatcaacacaaatatgccagatgcttaaaaatattttttaacacagagattatcagagaaatgaggtcattctgaaagggaagataaaattcaatcattgttcaaccaaatatttgaaagcaattatgggtagagggcatcacagaaataggatgttgtagcaggtcctgaaatgttacaggaccagaaaggaaagactcagattaaaatatggaactgaggatgggcttgaaagaatatgtgatttgggataaagtattcatagtatttctttcatctctttcctattacatagatattgtgttgagaaagtatgtattattttgctaattagactattaagatactttactccaaaaatatttcagcaacctgaaatgttataagaagacagaaaatgtaaaagtagttaagtagtcagtactctagtgggagttaaattgtgtgtttaatcagaatttttcaaagtacctacagttataacaagtaactgt

SEQ ID NO: 53340 - DNA, 1214 bp, Bovine  19866880586812
ttttttctgtgacaggcccctgtgtttgccactggcacccacaggtattgaaagttgactgctacccttcatagaaactgtgagagtaggtctctttatccttcaatgttgacttttccaaaatgcttcataagtccttgaaaaaagcatttcctgggttgtaaaactggcaagaggctggaaaaagatttacatacaattcaaagtagacgagaaaggatttacaatggcaagttttcgaaaataaatgctctaagaaaagtcagacgcctagagggaggaagatgaccgaagtttagtcaggctaaggggatggttaagaccacctcgatcaagctgtccagaagcaaagcaccctgttagctacctctgcacatggctgcctgagctaggcatcttcctaacataacgactatcagagagaaggatactttaaacagtttggtattttaataactattccaaaaaattttaggaattttagggaaaaagctgtgtttctaggaatgaatagtcaatgtcacctgaatgtttctctaggtccctactgtgcatctctgacacagtgatgtatctgtagtgagtagcatttactcaaatgcccaggaaggccaggtagctgatacagcattctggaagaggaaaattagagacattagatgaattgcttcaagttttagagatctgtacaacaaagatgacatgtagaccaaaatgtgtctgactacaaatgccttgctattgttcagtcactaagtcatgtccaactctgacctcatggactgcagcatgccaggcttccctgtctttcacaaatttcacagagttcactcaaacttacatccatcaagtcagtgacaccatccaaccatctcatcctctgtcgtccccttctcttcccaccttcagtctttcccagcatcagggtcttttcaaatgagtcagttcttcgcatcaggtggccaaagtactggagcttcagcttcagcatcagtccttccaatgaatattcagggtttatttcctttaggattgattgttttgatctccttgaagtcctaaaatgcctagctccaagaacttctctaacaagctaccctttcatgaaatctggccttgggttactttaagggatactcaaactctatcttatatattctttaacttcctggttatttctcattttccccccagtctggcatctgtgcttccca

SEQ ID NO: 53341 - DNA, 770 bp, Bovine  19866880607240
atctcctagagttttctaaactcatgtgcattgattcggtgatgccatccaaccatatttcatggaaaattaataaatcaataaatattttaaaaaatcagtgttagtaaaatcaatagacaaccaaagcctgtctaaacattgcaaaaccgccttttaaaaagttttcttttataaaattgcatgttctgaggtgcataatcaggcatatttttaaattagtcacttcagcgatgctgtcctcttaagatactaccatgaactccacaaaggtatatgtgtgttgcaggctcctgtctgttatctcttggttcactgattagtgtttttatcggtcatgtcggggaggtcttgagggctttggcagtccaagtcccctagcgattttctacactgtcatcataaaatcaaactgtgctgcctcacacagaatctctctccctagtgcagtgaactggcaagaaaaggaggacagtcagctcaacccaatgtatcttgcagaatacgttctgaaaaatttcttgtctggttttcttaattcttctaatgaactcacaccgaccatttggatacaatacagatttcaagaaattacacttttctagcacctccctacactgatacttcacttaaatgcacacatttggggcaagataattgaaatgataacaaattaaatgcctctgtttcaagccaacataggaaaaatcttaagtgttctatgcatcaaaatgtcctttctcatggcatgtatattactgcacctaaaa

SEQ ID NO: 53342 - DNA, 1991 bp, Bovine  19866880646864
gttttttttttttttttcttccaattttattttatttttaaactttacataattgtattagttttgccaaatatcaaaatgaatcctccacaggtatacatgcgcttgttgctgatgttggttgacaattgtcaatttccagaagcatgttctgaataataatagcttatccaattattgattttaactgttttttagaaacatgttttgagcagtaatcctactttcactaaactatctttctgacatatcaaaacccttaatgagaagttacatagaaagctgaaataatgtctcttaggtaactaaaatttttaagaggacttacccacttaattgctaccagaaataatgttagctcttctttttgggataaattatctcacaaaataacagtgaagtccttatgttttctgctttttttttttttttcctcctcgctttttcacatcccctagtagtgaagagaagactctgacagcacactcggcttgcatgtttcagaggaactttggtctcaagctgatcaaagatattttttcaaaacaaaaaatcactcaatgcatatgtacttaatttggcaagagaccatttctagcatattttcccttaagtgtcaaagggatattagaattctgtgaaattatatgttgctctgttcctgcctaactctagccttgattctcatgaagacttttctctagaaagaaaataacttcattttatataatgatgctgaaaatgtcttattgttcatggtaaaaaacaaaattaagatgcttttgctgagatcaacaagctgttgaaaatcttgacataatctattcattgttttgtgtgttgaaaaataataaatagatggtactgcttttttgtgatggaaaatattaatgattgacatgtggtacattttaattgacttggaatcaggacttacatttttaattgacttaggatcaggacttatatatttgtcacctttcagcaaatctggtggctttccagcatttgtatacccttagttgagaatgtggaaattaagagtgataaaataagtcaaagcatttagggtgactgcagttgttaggcagataaagaaaaaactccaagaaaaaacaacttccgatgattttttcatttaaaagtggttaaagaagtaattttagttagatattttcgttatcattcagaaaagtgaatgacaatttaattttacatataaacatgtagaaacaaagagtatcataaatttattttctcctcctaatttgagactatctcatcttacttgcctcactgactcaatggacatgagtttgagtaaactctgggagttggtgatggacagggaagcctggcgtgctggagtccatggggttgaaagagtcggacatgcctaagagactgaactgaactgaacatcttacttgtcaatacatattattccccaaaggatgtggtttatcttttatcaagttaagctacagagtttgtaaataatagcttccatttcttccctgtagagagtattatacactcattatcattaagaagttttttgctggcattggcctaaatgtttgcttttattctgctactcagggttctgatacgttaaataatgtcattttagacttgatgtttacactttcaacactggttttccattcacttaattctgtctgtaacttgctttccagcatctatgtaaatgttgtctctcccatgctgggaataaatactaatgaagatgcaccttgctgttaaagggcaagagaacagctgagtcaaggtctgttttattccctctgctaatttactgagcaagaactaggctaaaatgaaagtcagggcagatgtgtaactcatggttgatgtatggtagaaccattacaatattgtaaagtaattagcctccaattaaaataaataaattaaaaaaaaaagaatgaagtgaaacttaagttttaagcaattgatacagaaggtta

SEQ ID NO: 53343 - DNA, 1988 bp, Bovine  19866880708052
aatgatataaatttctaaatccccagtttcagagttttgaaatggagataatcatgacaccattgttccaagaagtattaacaatacttcttaaacatctttcatttagtaatcaataaattctagctattagcaaagttatatactgaaaagtcatttcatttacaatttgaagaagtttaaatagctttatttatgtctcagtttagttggtaaaggtgaaacaagctataaaaagaaaataataagtgacaaaggcttgtaaggaacatagttctcttaattagtgtgtctttaacatggaaatacagtcatttttacagctttaatgaagctacatattttggaaacagttttgattaagtattttccccaactgccaaatcacattaataaaatttcagaaagtttctcaacttgatttgaaaaatatcagagaactatttaaaaatataatattggattcatcacattagtagtttgtaagcttcatcctaaactagatttaagaagattaaactttccaaacagaaaagaattttgttataaaaatcctcactggaaaagatatattctttatatactaatataatatttgcatacttttacttttgaagaaatcaggattttttagaaatttaacagagcactaaactatctctatcaaatttcagagaggcagaggtagtctcactattcagacttgaataggacactttgcaaccagttcaattatttctcttttctctttttaaattaatcttttctctttgccttgcttaatgctcaacaatacataaattaaatattcattgaatagatgttatgttccaggaaccatgaaaactatgtacagatagagcagtagagtaagggaataaagacatgtgatgttaccatcagaataatttctaaaacaacaatgatttctacaatttaaatagaatgaattagttgaactcagtctcaaaagcctgaaagttttgaataagacacaaattgaaagcagagagagaagcaaaggcataaacaccatagcaggaagcacatggcatgtttctgaaatgacaataacttggggatggttagaaaagagggagagatgtaatttccttgaactaaaaactttgtaattcaaggaactctgtgggcataggctccttccaggaacctgggagatactacagcatactctcgtgggcctatattttttaaaaattacaaaattgatacagtatgaatagaactaggcatggtcactgtctcttttgactatgacttctctgctgtgacatgaagttaaaagacgcttactccttggaaggaaagttacgatcaacctagatagcatattcaaaccagagacattacttggcgaacaaaggtttgtctagtcaaggctatggtttttcctgtggccatgtatggatgtgagagttgggctgtgaaagaagtctgagtgccaaagaattgatgcttttgaactgtggtgttgggagaagactcttgagagtcccttggactgcaagaagatccaaccagtccattctgaaggagatcagccctgggatttctttggaaggaatgatgctaaagctgaaactccaatactttggccacctcatgcgaagagttgactcattggaaaagactgatgctgggagggtttgggggcaagatgagaaggggacgacagatgatgagatggctggatggcatcactgactcgatggaagtgggtctgagtgaactccggaagttggtgatgcacagggaggcctggcgtggggtcgcaaagagttggacatgactgagcgactgatttgatctgatctgatctctgctgtgacagtttttctaatgccagctggcaactgaagggggctgtagccattgttatctgactaatgggaactaagtgagagtttatgccgtttgtaagtgtatgagacttaaaatcacttctgcacatcgttaagtaactgtca

SEQ ID NO: 53344 - DNA, 1934 bp, Bovine  19866880708888
acatttaaaatagtacatttgaaccacaacaataatttttcactaataaaaatttggcaagggaatttccaactctttaaaacctaccttttaatagctatatcatagtaaatgggctaagtgacttactgattgctcaatgactgttgcttaggaattacatatctgtttttaaaatattaggagaagagatgattgttatatttaattcatgttcaataacacccactaatgatgatacctcatagtctaattgatgtcatttcatgacttacgtattgacagacacattctagagggttgaagtgaagcccactggagaagcaatgattataatcacttgaaccatggtttaaagatgtaaatgctgaactttccaatctcaataaataattaaagatgtatccattgaatccattacttatgacattttggtttgacttgccctctattttacaccttgctagctaatgcagcattcacctgaatctatcaagtttttcctcatgaaacatgaaaagaagctactgattttgcagacatataacctttgtgaaataaaaatatatttatctctttgtggcagagataaacaagaagcagactactgctgtgaaataattatgaatcttgctttcaggaaaatgacatcattaaaaaataatagtgtaaaacattgaatttttttaatttaaatttatttttttttaattggaggctaattactttacaatattgtattggttctgccacacatcaacatgaatctgccatgggtgtacaggatggggaacacatgtaaaacattgaatttttatttactatatgtataaaaatatattactaggaaaaagatagtcagctattcattaattactctccccatctctctaacaagggtggagactcaaagaagttttgctaattgaattgactatcaatcaaaagggtggttttaactttgagtgcaacaataactagtaatgtgagaatatattttttctaagatcattaaatttctgaggtttttgttgactgcttattttcatttaaaaaatttcatttatatgagagattatgaccaatgtaaaagagaggaaactttctaccttttaccaaataagttaatcagattttactcttctccatagaacattttttgatagcaattagcatctgatggaaaataaatataaattcataagacattttatcaaaatttgtatataaaaagtttataaaaatccttgtgggaaatcaataaggtatcattatattaactttcatttagagtaaagcattaaactatgattattgagaacacataaatattttatttccaaagaaagaaatgaaaaggggcactcacaaaaacagttaagaaaaaagaaagaaagaaacaaacaattttagaagtaaatattcagttttagcagaagataaaaattacaaatcctaaacaagtgtagattctgaataaaagttgtgaattacagatagagatttctgtattgtataccactactaaatttaacttctaagttatatgatacttcatataactaaagtcagtttcaatggtaaatgcatttgtttctgtcattaatgttcaaataaactgcctttcagcaatctaatttcacttataagtgtgtaattatctaattttaatacattttggaaatattatccataattaaactggtgtaggaaagggaaagaaatacagcattacagctttgtgatttttactccaatagtcctttgatgttctaggcagaatcaacctcgctgatatttgcacaatgcttgagatactgggaacaaacaacctattggctggcagaaagacctctgatcccttttaaaaccaggaaacaagaaagtattataagaattataaagcaagtccctatgtccttatcctaatccca

SEQ ID NO: 53345 - DNA, 1538 bp, Bovine  19866880730655
aatgatgccatttttgtagagattctgtcagctgttagatttactatttcccctgacttgctcatttctaagcttgggtgaagcccatgaaagcagcaatgaactacggttctgagtgagtaatcttgccagtagcaaataatctcctttatctaggaaaataacattctctatgttgctgtatatgtcactctgcaattttgtcagtactatgtaaacatgactcctgagtacattatgggaatatgagagaggcagggttaggtaacagactgggtcaaggtgttattttagactagagagagagaaagatcgcacaccagctgtattctccctgaggggaatagagaaagactgtatttctttaccaagttttctagtgtcaatcaacctgagcccatacttcccccagtaattgtagatttgctttgattctgaaaataaaaggcatctattaggacatctgaggcaaattcttaatgatcatcattgtgagccttggtgacatggccttaaaacagctggtggcgaaactcctacctcatcttgttctgagtcactggtgctaattatacagaacttgaaatcaagttctggaaagcttagtatgggaatcaggaacagaaagtggataactaataaaaataacagattagagaatatgtatttccttcttctatgagcttaatttaatccattttacctcaaaactgttgtcaaggaacagtttgacattttgaaatgaaggctatggtgtttcaaatgggtgaatggataaatgtaatggattgcactgatcacagtggtctttcaataatatcagataaagagatgttaattgcttaatattaactttttccttattttaaaataatgcagtttcattgtaaaaacttaacaaatacagttaaacaaaagtaatgtaatcattatccataatttcattccagatatagccagttttttgttaagatataattgattctgaaaatatagaaatatgtaagtttaagatatacaatgtgttaatttgatatatttatatgttatgatatgattaccatgttgcattagtgaacacctctattatgtcacataaattatcatttctcttttgtagtgagaacaagtaagatctagtctcttagcaaatttgaagtttataatacgatatgttgactgtgatgctgtgctgtgtattacatatccagaacttatttattagttgcaagtttgtaccctgaaaagcatcttcactcttctcccatccctgagtaagcatcattctactttctgtttctataagttcggctgttttggaagccacatgtaaatgacatcatatggtatttgtctttctccaacttatctcacttagtgcaatgccctcaagatccattcatgttgttgccaatgacaggatccttctctgatggagacttatgttgtttccatatcttgactatgtgcttatacataggagtgcaaatatctttttgatatcctcttttcatttctttggtggctcagaggataaa

SEQ ID NO: 53346 - DNA, 1500 bp, Bovine  19866880760791
catatcaaaccaatcaatcttaaagaaaatcaaccctgaagattcattggaaagactggggatgaagctgaagctccaaaactttggtcacctgattcaaacagctgacacattggaaaagatcctgatgctaggaaagattgaaggcaaaagcttgaagggggcaagagaggataagatagttagatagcatcatcgactcaatggacatgggtctgtgcaaactccaggagacagtgaaggacagggaaacctggtgtgctgcagtccatgaggttgcaaagagtaggacacgacttagcgactgaacaacaactgctggctaatcttttgattattttttgtttttgaatctgtccttgactaacattgaaaatgttctaatctaatctaaacctatagaaaatcattagcagattcaggtggcagaagataatccagttaacttaggaaactgaggtagcattcattacctaggaattaatactacatttcaatctgtttttcatcatttatgtaccaccaaccagtcttggtcttgctaagcatggattctcatcagagtaagaatgtctgaaattccaaataccaagttggtttgttagcatgatactcttcatactgtgcctgccatatatccattccttctatattttcctgtttctcaatttccctaactctactgtttgtgatatagtttatgttgactttgcacctgtgtttctttaaatcctactaaaacttgagataacatgaatacacttttgtgatgaatctgtgccaaataccttgcttggtactttgtaaggcatcattttcaaatcttgacaaatgtagagactttttgttctctctatttttatagttatctctgtcctccagatttttatgtacttttctgtttgggaatgttttgatgtccttattgcttccaactcttatttcatctgcatgatagttctgttattttccgtcttgcctctgtcatcttgccttagtcaggagtctcagtcaaagtagtctttcattgtaacctgtgaataattgcttagggaaagtcttagagtctaattaaatttgacattaattgctttctaactttgtgagcagcaataaataaaagtgagcatctcatggactatttgagggttcttatgatgaaaaatgattcaaaacaccaagaatcacattgtgatcttttctctgacagagtatgacatcacatagtgtaatataaatacaatgaaacacaaaaatggaacaaaatataaaatattggccaatattggtcataaaatgaaaaaccctaagtaaatgcaaagaaaaactctcttcaattaatcattcaataaacatatatcaaacaaacaaacaaaactagtataagccaagcactttccttagtgttgtaatttttaagatattggtataaactttgacttttggagaatctactgtgtgacaaaacttgatctatatcaaacaacaatacattctatt

SEQ ID NO: 53347 - DNA, 1149 bp, Bovine  19866880773344
ctcacttttctggacactatagggcttccctggtggctcaggtggtaaagaatctgcctgcaatgcgggagacctgggtttgatccctggattgggatgatcccctggagaaaggcatggcaaccctcttcagtattcttgcctgtagaattcccatggacagaggagctgggttgactactgtccatggggctgcaaagagtcaaacatgactgagcaactgagcacagcacatagagactgtaacctatgagaccttagtgttttttggtgtgtgatggctgataaacatgacttgcactgcatctaatgttaccttcaacaagggaaaaatatgaccaaagtttaataaggaaggccaacatggaccattatgccccacatgtttttttcctactttatgttgtgtattatcaatgcagccaagctctttaattcttatgaacctaaccccacatgtccaagttgtagctgtgtaatgtagcttttctttttagtgactgaatgtgagccttaaagcagagtcataaaatgcatgaggaaatagaatctgagttacgtagctgcaagtaaatagataatacaattcatacaaaattcacaaaaggactaataaagctaaaagatacaaatcagatcttaggcaacctatattggataagtgttttcattgaagatacacttttcaaaaggcattagaaaaaggtttggtcacttagctggcagatcaagaaagtgcattgagaacatatcagaaggaatcagggaaaaggaaagacagaattgacttatgaggttgtttaccatgatataggcaaaggataaatggaaacaagatatgtgaagtatataagataagaaacacaaggcaaggatttgaacacattttatttttatttttttattttttattttattttattttatttttaaactttacataattgtattagttttgccaaatatcaaaatgaatccatcacaggtatacatgtgctcccatccttgaaccctcctccctcctccctccccataccatccctctgggtcgtcccagtgcactagccccaagcatccagtatcgtgcattgaacctggactagcatctcgtttcatacatgatattttacatgtttcaatgccattctc

SEQ ID NO: 53348 - DNA, 1201 bp, Bovine  19866880795499
ttctatatttccccactctgatgacttcagtctgaattttaaatctgttggatcactcagctttgcagcttttgtaaattgctttctgcttgcctggggaaactctttattgaaggcaaaaattgttgtcactttctaaaatatttaatacaagggaatatcaattaatcctgatctgagtttcagagccaaacactccttaggtagttaaagtgaaaataatagtacaattaaggatggagatggggccttcttcaccatacaggtgagagatttgaaaccatcactttgaataaatcaaggtcataattgagaaaatatcatatctgtatatcatcatatctgttaatcatttatctgtaattattttaacaacataaaagaaaagtgaaaacttttaagtaattaaatgacaatgcacatagctataaaaggataaaaattgcccaataggctaaactttgtcctgttaaagtattgaattagtccagagcactaaatataaccagaatgattaacagcataaaatatgagtgaaggtagaaaagggaaagatttgattgagggatgaatttatttacagggcaggaatggagaaagagacatagagaacagacttatggacatgggggcagaagaggagggagagggttagatgtatggaaagagtaacatggaaacttacaatgccatatgtaaaagagatagccaatgggaatttgctgtatgactcaaggaacttaaacaggggctctgtgacaatctagaaaggtgggatggggagggagacgggagggagtttggggagggagggaacatgggtgtacttacgactgattcttgttgatgtttgcagaaaacaagaaaatcctgtaaagcaattatcttttcaattaaaaaaaatttttaaagacaaaagaaagaaaatttggtcttttctagcaaagagaaaaatataagaaataaagaaatgatccatattcactttaaaaaatagctaaatagaaagctatacacccagcttattttaagaaataagtttcctaaagatggtatctcattgcctttgttttcttcccttcctggttccccttcctcataagaacaatttcacaggctttaccctggacatgtgcaaaaatctaaagggcgggggaaaataattaatgtaaatcctccattctgaagcctacaactaata

SEQ ID NO: 53349 - DNA, 994 bp, Bovine  19866880950545
cctaaagttattggtatgttaattgaatgtggtttggggaaaagtgtcatctgccttacagcattcatttgcatattaataacaaaactttgttcagcagagacattttctgattaaagcactaatgtaagagcttgcttagagattatatgatctcaaattgtgaattgaaatagtcataatttcataaaggaacatacatttcataatgttcataaaggaacaaagaaacagattgaaacttctgatagcacatctatatgcaccaaagggcaaagagagcaatgctctaaggtgtattactgaaagtttcttgttcttttgaaaaaagaaaaacaattctcctatagtataatgctttatggtggccaggaggagtttccagtgtgcttgaaaggaaagctctcttgagagtttttccccaagcagttggcattaagttgggaatcttggaacacacatcaagtctggccagcagtgactctgagacattgaattaacgatatcaaatactaagaaatatttaaactgcttaatatgtctggtaatcctaccagttcatatatctggagcctactgacaagactctcctctagattctatttcagtgaggtccatttctaatttccttagtcaatcctgcttaacttagattttttaaataagtgcataaagctatgtagactactactaacttctacaaaacttctcagacagctatgttttctaaaaatatttcttttttaagaatgcccaatgtttaatccagttgattcagataccactttgcaattatgctgtttctttggctgagcacaaactcatcttatctcaggaagatcataattttgcataattacactatagttttgtaacttgtattatgtaatattccttgtgatttgataaccatttatttttttatattcattatttgatttttcttccaggaaagggaaaggttttggactcaatttataaaaatttataatgg

SEQ ID NO: 53350 - DNA, 1398 bp, Bovine  19866880975731
actgcatttcagactcttttgttgactataatggctactccgtttcgtctaaagattcttgcccacagtaatagatataatagccatctgagttaaattcacctatttcagtctgtcttagttcgctgattcctagaatgtcagtgtttactcatgtcatctcctgtttgaccacttccaattagccttgattcatggacctaacattcgaggttcctatgcaatattgctctttacagaattgaacctttcttgtatcactagtcccatccacaactgggtgctgtttttgctttgtctccatacctttatttttttctagggttttttctcctctgatctccaatagcatattgggtacctattgacctggggaggtcatctttcagtgtcccatctttttgccttttcatactgttcatagggttctcaaggcaagaatactgaagtggtttgtcattcccttctccagtggactacgttctgtcaaatgggattaggatatgacattttttctagtaaagtttattaacatatctgaagttaagtctggaaccctaagtcttaagttagaaatttggtacatgcttttgcttttacttttttcccccagaaaagtggaaatgccattttcagaaagagtgaaaataagagtttatttagtgccaagcttacctgagttctatccataggtatatgattcaatcaatgtcttgccataatcattacagatgctcctgaaaatagtacccatttttgcagagttctaactttgaagataagattgtgggtagaaaagtatgcaaaattttcaaaattatatgaattattgtcgtaggctagaattgagagtgacaaaagattttcctgttttcagcctgaaagctgaaatttacaaaaattttaaacactgcagaattcttttgaaggcacttctgatgagtttaaactcaacatggagatgtcttattattttcttcctaaaattgtcactaacagtattacatactttgtaaggatgacagttggattgagggcaaagcaaatgatttcactctgtctcagtttaaagtctcagaggctgctggtatttcttgacccaagatgaatcgatttctagcaatacgagctaggagaaatctaattttgtttaccaaaatttatatttgagaattagtgttttatactaatttatatatatataaaaaaaaaaacagaaagctgaaatgactgaattttaaattattatttaaaatttttagtcaaaaaccctaacataattcagctgcaaattccacccgaattatgggaactaaattcattttaaactaaatataatagtgttttgtgttctagcaaaacttattgattttctcatggatcatctaatagggtatt

SEQ ID NO: 53351 - DNA, 1466 bp, Bovine  19866880976000
tgggaaagactgaaggcaggaggagaaggggacgacagaggatgagatggttggatggcatcaccaactcaatggatatgagtttgaggaaactcagggagttagtgatggacagggatgcctggcgtgctgtagtccatggggttgcaaagagtcagacatgactgagaaactgaactgataaagtaaagaagattctaaaattattcttagtgaatggtaaactctggcttttgccaacatactaacatttcaatttgcattttgtaaatgattaaaaattgttttccttgggctacaatctatggcatagtcttctaataagaaggttaatgacaagtttcatggtaataagaatagtcaaactattgtcagcaaagacacacctcagattattatttaaaaagtcttgctttatgatctttttattgtaattaagatgttcctgagttatgaccaaagctggtatttagaattgtctaatgaatgtgaaagatgatgctgttgactatgatgacatgctggatcaattggtgccaagtcaaagcaatcaatagtgttaagaaaacatgatgggctgatcatgggatgaaaaacctttagcttttatgaatgtttaatcaggttctggatgtccataggcttctgaattaagtcactcttaaccacacccatattttctctctttacaatgtttaagaacaaacatagtgctgtctgataaatattatataagtgctttcataaccagtataaaagtgtacagagaaataaattttgcaggtgttacatagagaagaatttcaaaaaatatggaacgtggtgatagaatttgaaactaacaatatttgtcaacttcactaaagcacaggagcaattttcaaagcaggaacatgttacattctgtggtaaacagcaggacagcaagacttgagaagttattgcgctaaccctactgaattttgctgccttaaaaacccaggtaccttccttagaaggtccttctaattctatatagcacagtatctatattgctttgttcagaggtaattacttagggcctttagtttattattaactttcttctgcattcttttggttacacttcccaacagagcagtgggtcaaacgtagacattaccaagtgatggcacatgtaatctgagctgtgatctcagcagtagaaagggtagaaataccagaagccaagaaagcaataggagctatagtcatttatgctctgtgtggtgttatacccaactcaaattactccaaattgcataaggccattttttgtgtctttgtcattgccagggcttctgatttcaccatgtcttaaaattttgtaggcaatgtggggtcatgtctaccccagagcatgaagcaaaaaagcagagagatgactcctgcaggtgttgtgggaaaaaggcctccagcactttctgatatcatggtagagaatttgt

SEQ ID NO: 53352 - DNA, 1506 bp, Bovine  19866880989476
accattatgttttgaagttagaaaatataaactttgcttatttatcatcttcattctgattcattattctaaaaagagttatacaaaatgcatattttaaagctgatttttctaatcattattattttaataaaacttgaaaagataactttaagaaatagctaggaatatgatcattgttatgtaaataaaacttttaatgagtttttgcacaagttaaattatgggagaaatttccacgaaatcgcatttattttcacagtatggtttcctctttttcagttacacgtttttctttcatctctatgtaatttacaagaccacaagtcaactctccttctcacctttgtcttttgggaattctctatactgaatatctatggcacaaatatactgagaaatagaactctgaattttttgcccctctatggcaacccattccagtgttcttgcctggagaatcccagggacgggggagcctggtgggctgccgtctatggggtcgcacagagtcggacacgactgaagcgacttagcagcagcagcagcagcaagttaaggttaaaaaaaaaaaaaaatcaagatctaaagctttcagctttctagattttatttctttaaaactgactcacatgttactaaactggctttattttctgaagctattttcaccttaaatatcccatgaagtgtttatctttgagtttccttttcagtgggcacatacacaacctttccaaatcccttactcaaaagttcaagtgaacattatgtttattcttattcaattgatcaattttctccaaatcatatttttaagttcatgtctaccacaagaacagatttgaaagtgatattcctggaaatgatggcttcatatcaaagtcaatttctttgcacaaattttgactcatgagagtcaagtcctgtgtgactggtcacacacaacacagaagctcaataatgacacctgaatagaatgcatttcagggaaaaaccttcttagcaaataatccattgtactttcagtctttttcagtgtcacatcttttatctgaagggttctattatatcggaccagtttccaatgagaacaaaaaatagtcttttaagtattctgatttttattatattctctgataatctaagagacttatgtaataataatctggaaaattttgaaactatttttttccttttttttctcccacagggcttgaaaaataagtagacatttcctcttaggttaaaaaaaaacaaacagataaacaatatattcatatatttccatataagttgaaatttcaagttctaagagtttgaaatgaaagttattacaaaaaaatctcctttaccagtttagatgggtgaaaatgcaatattttatttaatgactggtttgacttattccctaagtgcctagatttagtttcttattttccaaccaaggaaaaaggaggaatttaaaaatctgccatatatacatgacaacattaaaaaaaaagt

SEQ ID NO: 53353 - DNA, 1582 bp, Bovine  19866881243499
tcttatgttattcctcaggattttatttttcttgcagccatcagaatttacctccagatcatcatgacaataaattgtcttccttcaagtgtctaaccaagaaaatcaaggaagcctacaaaacacataatttactgacatgtgggcataaaactaacctaaaaagcttatgtgtttttttataaaaataaaatcagacaaatataatacctcatggggttatataatattagagcagtaattttctttcagagaaatttggtcagattattggttagttggcttaaccaagtgcaccagctattcaatggcagcactatgtttaaaactcatgtctctaagcctgcagccctctacagttttactaacatgatggcacttttgcaacaatttacttcattgtatccaaatctcttgacatatttggacaatatttatctcctatactttactgcaaaatgggtaattttgagataggttggcaattccttgccactgctaagtcacttcagtcgtttctgactctgtatgaccccgtagatggcagcccaccaggctcccccgtccctgggattctccaggcaagaacactggagtgggttgccatttccttctccaatgcatgaaagtgaaaagtgaaagggaagtcgctcagtcgtgtccgactcttcacgaccccatggactgcagcccatcaagctcctccatccatgggattttccaggcaagagtactggagtggggtgccatcgccttctccgagcaattccttagaagcagttaaaaatactagattgagcatgttttcctaaaggcttatttacaatgtgtgccatcttctctaagctagaatcaagcacaatgagaatttatatgagatagtcacttcatcctctaagaatataattttaaaagtatgtgatagtccaaattttgtaatcaggcagcaagaccattcacaattttcaggatagttttatgtataaatcctgacatttcaaaaacaaagcaatcaatatatttatctacattaatttattttctttctttttacccaggtgtgtattctctgtagtcccactaatgcttacatcaataaaaatatggaggtttcatgattttttagattttaaaagttagttcacatgtttggaactaatacttttagaaacttctgattagtttcttgcaacttatggagattgatatcttaagacaaagtaacacggtgtcttaaacatttctccattgagaagcgatactttaaaaacctgttatcctctccactgacctgagaaacctgtttacagcactgctctcaagagtgagggtggattaatagattcaatctttttttttgtttgtttctttttggaattcagtttaactcctattttctagacactgttatctgtttaagattactggtgactttacattttcacttgacaatatagttgtttgaaaatgaaccttcatttgttgtaaatatctaatttaaggtacactcaaaacccagtgtggggaaaagtagacccattaataattgcattaatcattctgctatagaattagagacagt

SEQ ID NO: 53354 - DNA, 1656 bp, Bovine  19866881296372
aatattataaagtaactagactccaattaaaattaaaaaaaagtgaaatgaatcctataacctctcacattcagaaaagcagaggaattttagaaagttctcaaaaatgcttggtaaacatctcgcatgtaccttacatgatgtttaacaccgagggcacaagcatacatgtgaagcgtcttctcttttggtctagttgagcagtctgatggagaaaacagacatacaagcaaattgaaacacaacatgaaagcactaaaaattaggcataaacttctgttttatcaaacaattgtttgttgaaaaccctttctattccagaaatatttaagtacccttcatggactattatctttgcatgagttaaagatacaggggaaaacagactggaaaagataatccaagtagcccttcaaaatgtattcaactaaaaagccattaagccacgtaataaaaatgaaaaaaatatttttttgctcaattcccacatgcaattgcttttacattattttgtttttctacttcatgctcttttctgtctctacctttacttccacttgtaacatatacttcaccacttcatcaagttcttttgtattttgaaaaggcagcacagagtgtgatttgtggatcagctgagggttttataaactttaagcatactctaatcatgaatgacaatttttttttccattgagtaaaatgggtatttttaaactgaagtgtctgttaggtgtgaaaagcaaaataacagtgaagtaatttattagacctcagttcatagaaaagttcatttgcattgtgctttagaaaatgtaagagtaaacaaaattgtgtgtatgttaaatgaaagaatacttaattaaacttaccaagtcttgatgaattaacgcattatagtattcaactatttagaaacaattgctgagttttcaatatgtttagtaggctcatctgtttaactttccgcattaatattattagccatggaatgactagaattagaatcctgatggtcactgaagagtgactatgttgatcttcattagcatcgttatctttacaacacttgaagcaaagcatgagttataatcaacttaattacattctcctctgtgtgaagggaacagcttcatgtgagcttctcagactcagtgccaggtatagacactatgtttgatatcttaatctacaggacactgaagtaacaaaaaactgacttcaaatcaacagaaatgaatgtctgtggcagtgaaattgtggctccttctcacatctttatttctcacatatttagtttctttattgaatttgcttcctctgtcagagatatggtatctcctggaagactgacatggcagctctcccattcatgattaattgggtaaagccagtcacattatcaaatggaatttgtctccaataagcaggggtcagtaggaaggagcagtaaatatttcagcaatagtccattctatctcaggggcaaagagtagaaaatatctggttggccgttgtgcctctttgtgtcacaggccagtcttctcctggaagaattataatttttaacctattcaattactctattaatttactgcggatgtgtggatcacaataaactgtggaaaattcgaaagagatgggaataccagacca

SEQ ID NO: 53355 - DNA, 1435 bp, Bovine  19866881349322
gcaagaatactgaagtgggttgccatttccttctccagagtgtcttcccgacccagagatcaaacttaggtctcctgcaatgcaggcagattctttaccgctttagctgtgagggaagcccaaattgttattgggggtggtttagatgagtatgttatgatagtttatatacatatgtaagcttataggatatattatgaactcttactcaattctctagtgaatagcactgccaattagtagacaaaatgcaaagtaaaagctagaaattctgaatttactgtgatctttgctgtcaatttcttttagctttgcttcctctatctccagttcttaaatgtgagtgcgaggggataataatcagtttggtaccttgcactgttgtgaagtgtgagtagctgttttattgataattttctaagaattcatatgtatatgaactttactgaactttaattaattttgtttaaaatgtattaaggaaatcaacttgaatcacagaacaagattacacagattactttaaattcagatactctattacatgcactctgcatagtcccctggtaataaaatcttcattctgttttcccataaagctgattacaatactttctgggtacaatacaatataagccctctttggaataatccatttggatattactactagtattagaagcaggacaagtaaagggaaggagttcctaccacagaaatttttaaaccctcctttggtagcaaaaactaaagtcaagcccttttaatagcagttacttggtgacccaacactcaaatctagcctttattgtgactctatggagacctctggattaactcacttttcaattttcctattggtatagttaatttagtaattattgtatcataaatataagattgtgaataaatttgtctctactatttcatttccacaataaaattatgttgattttataaacttgtggttagttcttcagttttggctctcaccacagattaaggcttcagatcagatggtagcacactgacgtcagggacataccacctctacttctaaggtaacagtaaaagtcaccacactgagttcttaatatagctgcctgaattgcatttaatctattttgaacgttattctcactgacccatatgtttggcaaccaaaactaattacaagccttaatgaagcttgatacaatagaactgttatcttattagcaccttattttgtgcccatgctacttcagatttgcatttcttcactatggaacatatgatgccctatcatggggaaaaatgaaacagaaagaaaattcactgaatctacttgagaaaaacaagagtgcaatttgccacacagcatgccctctgatatgcacacacatgaacttgtcataaccatctgtagctctgcttacacgaagatacacacagg

SEQ ID NO: 53356 - DNA, 682 bp, Bovine  19866881702556
taagtataaaaggctcaattttgaataaatcaaaagtgatatccttatttacatctaaatgagacgttgatcagaccatttgtagaattccatatttcgggaatacatatcaaagccattgaaacaaatttgggagccaccagcatatagatagtatttaaagtcatgagaatgggtagaaatgagatctgaggttggagccttggattaatctatttttggcacgctggtgtactctgtcacagagatcaaagagcaactattggggcagaatgaaaagaagaatgtgtggtcccctggaagcctaggaacaaacatgtttcaaaaaacaagaggaagagatcagttctgtgcatttgtttcttcatgctttcattcattttatcccagtcttaatcaatataagtaggaagaagtaagcacattttatctattgaagagctagaaaacgaagttgaaataaaaacagaaaattcatgaaaaatatagtgttacagattctattttctgatcacaatgcctgggatatacaagagcacaccccattttcttatttatatgatagaacctgagggtagaccctcagatgagcaacacatgtgtgaatatatatctaccttcattgctatgttcaatggcaagactatcattttctttttttcccccatttccagactaccag

SEQ ID NO: 53357 - DNA, 796 bp, Bovine  19866881775797
agacattactttgccaacaaaggtccatctagtcaagggctatggtttttccagtagtcatgtatggctgtgagagttggactgtgaagaaagctgagtgctgaagaattgatgcttttgaactgtggtgttggagaagactcttgaggatctcttgggctgcaaggagatccaaccagtccattctaaaggagatcagtcctgggtgttctttggaaggaatgatgataaagctgaaactccattactttggccacctcatgtgaagagttgactcgttggaaaagactctgatactgggagggattgggggcaggaggagaaggggacgacagaggatgagatggctggatggcatcactgactcgatggaagtgagtgtgagtgaactccgggagttggtgatggacagggaggcctggcgtgctgaaattcatggggtcgcaaagagtcagagatgattgagtgactgaactgaactgaacttttagaatgtatcattcataacattgtaatcaaaagtaccaattcatatcataggtgtaggagaagaaccactataatgatccatgaattttttactcctatttgtgcagttaatttatttcatggaaatgatggatttttcagttcattgtccatttacactcagggtaaaagcataaaggtcagtaaagaatgtttaatgaccagaaaagttgctaactaaggaatatagaagatgtgaaattgtacattttcatcctgtctgggaacatctatattgttaagtctaatttaaaaaacataacacagt

SEQ ID NO: 53358 - DNA, 1085 bp, Bovine  19866880478399
tccatgtccagttctaactgttgcttcctgacctgcatacaggttttctcaagaggcaggtcagggtggtctggtattcccatctctttcagaattttccacagtttattgtgatccacacagtcaaaagctttggcatagtcaataaagcaaaaatagatgtttttctataacattaggttactcctattgaagctattttacctttataaaaaaacattttaaaatatatcaaaatatggaagaaagatgcatacaaaccatatcattttattcctaatctattttaatgaaagtcaatgagagaagtttaagggcttattttgatactttgagggattttatctgtaagaaggggatgaagttttaattagtaacctaataaatatttgaaaaatacaaagaaaattccacttcatagggttaatgtgtaatgaccaaatccaataagggtaaaaacagatatcataatcaagttctggaaaggaaagaaaatgaagtcactcagtcgttactgactctttgtgaccccatggactgtaacctaccagcctcctccatccatgggattttccaggcaagtgtactagagtgggctgccattccttctccaggggatcttcccaacccagagatcgaacctgagtctcccgcattgcaggcagatgctttaaagttctggaaggactatgttatttgagatttgcggaagtgaaaaagcaatgccaattattctgtttttactgaaactactttggtaattaatccatttccccagatatttgtccatttattgtgctatagtacagtgttaatatttctctttacaactgcaattactatagctgtgctctgggaaaacctattaaaatatgttcttaattaatttgcaggtctataattctatttttaagggttcattaaaaatgatttgttcatttgtattttcaactcattaatgttatataaatgattttgcttttattatttatcagttaatagaaaaatattttagattgtaaaagtaccccaaaattataaaggcaaatttaggaattaggtaagagcattaatttaccataatt

SEQ ID NO: 53359 - DNA, 1646 bp, Bovine  19866880592718
ggaagtcatagttgatgagtaaggaaacttgctgtacatcggatgcctctggcctatgtcaagaaagaaaggagcttcagtgtgtgagtgagaaagcacaagtctatccagaattaagcatacatgtacacggtcaaaggaaggaaaaggaaataaaccatccccctccctcagaaaccggaggtttgccagattttattccaagttgctactttccaaaagaggggcactagtggcccccttcgaaagagggaataaacttggatcagactttttttaaaattaatttttattggcgtataattgctttaccactatacatgtgttagtttctgctatatagcaaactgaatgaactatacatatacatatgtccccccacccccacctttaaaaatttctttcccatttaggtcaccacagagcagagttccctgtgctatacagtaggctatcattagttatctaatattttatacatagtagtatatatacgtcaatcccattctcacacttcattccacccctcttcccaccttggtttccatgtgtccattctctatgtcagtgtctgtatttctgctttgcaaataagttcatctatatcattttctagattctacatataagcaatattatatgatatttgtttttctctgacttacttcactctgtatgacagtctctaggtccatccaagtctctgcacactgcacaattttgttactttttatggcccagtaacattccattgtatacaaaccacatcttcatatacattcctctgttgatgaacatttgggttgcttccatgtcctggctactgcaaatagtagcacagacttttaaaacttcttttaagagagtatggaagaatggaaatcctggaagtagagaagaaatctggaattctcaaaacagttgcaaatcactggtttttgcaaatatattaatagatttatggaaaaatgaatgtagtgttttcaaagactgtggttttgcctattatacagagtgaagtaagccagaaagaaaagcaccaatacagaatactaacgcatttatatggaatttagaaagatggtaacgataaccctgtatgcaagacagcaaaagagacacagatgtatagaacagtcttttagactctgtgggagagggagagagtgggaccatctgggagaatggcattgttttatctgttttgataagcagggttttatttgtgagtaatcagaaaatgaagaaatgggactttttttggcttcaaattgaggttgatatgaattctgcttttttcttttttttgctattctcttttttgttctctgcttttcaaaaataccagaccttaggagaattcacatacatttgagctgtcttataatattatggagtggaattgacccataggcccactggacctgcagcaacgaaagctactgtcactttcaaggtgtatgtgaagggcatgttacttctgccctggttgtttaaactcgatgcgtatactgcaagttattcttgtcctgggtgaaccagtgaaaacttctctgagatttcacatactagattatcttcttcttagatttcaattggaccagtttagaccttgactttttaaataacaggcaggtaaacttcaa

SEQ ID NO: 53360 - DNA, 762 bp, Bovine  19866880670968
ttggatgatttgcaagggaaatcagacattcatgtactgcatttttacacttggcagcttcactttaactttaaggcattctgctatacagaatggtgctctgttaaaatggtgcgatgtttaaggttaagaaacatctgaggtagagttttaaagtactcatacatatgttatcatttagcttataaactttttggattacttttaaaacgcctttcaactacaaaatgtatgaaatgttcaaaagttcaaaattcagaaccttctgtgaatttaaaaattagtcttgaactatatatatgaatatgtatgtatacatgtaggtacatatatagtgaaagtaactacacgtgtagaaatgaatactgacatgccaagaacaaaagagaatgttctctatatttttgtgaagaaataagataaatgcatttctttatcttcactatcatttatccattaagatagtgaagctgatgcaaaagagaaaattaatttaatccaaaatatcaagaaaataagtgaactggttgtgtcacacttggcctccgaacacacatcttacacagtctcacttacctaccattttctcatcttcttaaagaagagtttaaactagatgacttttaaagtgatctttaattatgaaattctccacataaaaataaatccttatgatttattggtatatgtcaatatataacctgggttaagttctttcctagtaaaatagctcacattcaaatgaggtagaaattcacatat

SEQ ID NO: 53361 - DNA, 993 bp, Bovine  19866880720030
tgtattggcagtggtgcatgtaacagatgggactgagtgtaggcagtcaagtgttcaagctctgtctctgaattgactaatggttttgatggcagaaattcaaggccaaagtactgggatgctggtctctgtgttgtattgaatgtctgcaattaaagctttgggaccactccctttctgctctaactcaaacttaattaattttgaattaaaatgaatagtttccacgaccacatgaggtccattttgggtttggctgatcaggattactgtaatgatgtccccaccccttgaatattccccacaaaagacccctaagaagccaatttaaaatgccgtccaaagtggcatgttgctgctaaatattttgatatgtatagggcattttcatatccgtgtcctctgtagagactctgtaggtgtcctctcggaaaatgccagtgtagcatagaatcagcatgggcatctggcactcaacagcaattctgagaaggtcatttgtcagggctttcagaactatttcagatcaggtcttgctctaaattaaagatctagtcccagatacagttttcagatggaagttttaaatcataccttgtctggttgtttttatcataattagttctattgtttaaagttcagacctaatacatccacaatgatggatttagtttccacgtgggttatttagctttattctattgtattattgcagattgttcttttaatcctactagaggccttgcaggtgccttctgtcaggaaaaaaatgtgtactgttgactcttgaacaacacagatttgaactgcgtgggtccactcatatgcagatgtttttcaacagtaaacataccttgcaacacaaactgtaatggatgcagaacttcagatatggaggaactgtgtattggaagggctgactgtaaaccacatgggaatttttgatactaatcaagagtcagtgcccctaactgcctacattgttcaaagtca

SEQ ID NO: 53362 - DNA, 2555 bp, Bovine  19866880739412
aatttattaggaaattgaggaatctctcgtgctatctttactgcctttataatcaatgaaaatcacactggatgagatgaatatgggaaatagtcatcagtcatgtaaagagaaggtcattatctgacagtggctgggtgactgcaagcaattgctctcagttgcactgaaaacagaactggagagaagtacaaacggaaacaagaagaaatttaggttaggcatcaggaagttcattaactgtacatgttttgagtcatggatacgcaccactaagacagttgcaacatatctgatgatgtaagagatccaatgatttgcttaaaacacacacgtgggaaaaacaggatttcaaattagccttggtcctgggtttatggctaggtttttttagacagactaaaatgtcaacatactgagaacaattgtggtttggagatagagattatcagtagtcaaattcaaatggcatatttggatgaactattaaaattttgttatccaccataaaaaaattaccttagtagtggcataggacaatttgttaaatggagaagcccaaaataccaacagcatgctgctgctgctaagtcacttcagtcgtgtccgactctgtgcgaccccatagacggcagcccaacaggctcccctatccctgggattctccaggcaagaacactggagtgggttgcccattttcttctccaatgcatgaaaagtgaaaagtgaaagtgaagtcgctcagtcgtgtctgactcttagcgaccccatggactgcagcctaccaggctcctccatccatgggatccaggcaagagtactggagtggggtgccattgccttctctggccaacagcctatatacaactatttccatttgttgtgtcctatacacagtctgtgtctctcttcttaactgagtgaaatattttggattgttatagtaaaatttatttttattttcattataaaagtgatatgagttcattgtagggattttaaaagcacagacaaaattatctgtaatctcattgatacattttcttttagtcttttttctctgcacaactttaaaatgaattgcagtaatactgtggataaaatttggaaccttgcttttcatttaacctttaccaaaacattttccatataatattacctagtctacatagatgttattttagattgctaacattcttccaagtgaatagatataattttattaatcattgttgaacatctaggtgctatggtgtgtgtgtttgtgtatttatttattttaaaggtaatttccctaagctctgtttttaagtgtagacttgtcagattagggaaaattagagttgaagacaaagattgtgattttttaagaagatggcttttactggttttcttttaaggttttgtataattctttatctaccaaatgaaatatttattgagtgtctgtgagatgcaaaacatagttattaggcacagagatagcaatatatttagtatttggaaggatcttctctagttacaaaatttctccttatggactttcacaggtatcaacaaagctacatgttgaaaattcttcatctctgcccgaaaccaatagacagtattattgactacttacattattttggactttaaaacaacagaatttataaataacttttgtagaggattatctatatgttgttcatatttatatgaattttatgatctgtgacaaagaaatagaattaggaagaacaaatattttataatagaagtctgtggaaattagaattatttggaggaaatctaggcagcaaagtgtaaagaaaaagtatagaaggtgcatgttaaaacagagtttcagttttcagattttctgcttatggaaacatgagaatggagtatggcatgagtagggtgggaattagggaagatatgaaattttaattctgttattggtgttgaatttgggaattatggttatataaatagaatatattgaagtaaaaagccaagaaattgctaataaataaaacgatttgattttcagaggtagtggctggtacagagaagtcaaaatggagagagtagaggtatcagtatttggtgggaggtaaggtatagggttgtgaatatttaaagaatatattttgcctgcatcaccttgttttaattgtagaattttattttttcagtggtatttagagaaaaatcatagctacggagggatgggagttccattctttgttcactctgaacttctgctagcatgtttctattttttctttgatataggagggattaagacttaagtagagaagttggcagcccaatcttgcctgaagagaaactatgtgcttcgtaatgaagacttaaaaatagtgtttatttatggatcattggctcatgggaatgttactctagagactcaaaaagaatgattttctaaatcttgtttcgatactggattttaagtgacatgatattgtggaactttgggtggaagtccagagttttgccaaattgcaaacctaaggaaagtgacagataattgagactatagaatt

SEQ ID NO: 53363 - DNA, 1336 bp, Bovine  19866880795447
tctgccctcagttatcttaagtgcggtcttggtctagtatgtttccctgaggcactaataatctagttctttcaagatctctctaacttttctgtgagcaacacacaaatcaatccaggatgtcatttccaatagcacagggaagtaattgttttgaagagggaaatcactaattgcttttgaatgtgctcctgtcaacaactcacattattaaaaacaaaaccttcctactaaaggctcaccacaaatcatctggaatgagagagttgaaaatgaaagcatgagtcaaggaggtttattttaagattttccatattttgatcaaatgctggtgattacattatatttttttctgtactttgctaacaaagagtaagtcacacattatgttcttccagaatgattcttttcttaaaagagccttaaagaaacagttatgaatcacagattatcttaatgacagatataagcttcaaaggtacattacctcataaaataataaattaaaaatactgttcagagagcttcatctgtttcctacttaataattccatctttgaatcttcaaataggcatcatctaaattgtatttctggcatgttctatgactggtaacatgtcctcctaagataatattaggcaatgtaatttttttttaaattagtcaaaggtgtcttcagcctttgattaatacagttattaggagtatagagtccagagatagctccattggttcaaatctcaaccagaagagccatatgaccttggataaacaaccactctgagcctccatttcctcttctataaaaccaaaataatactagagcctactccagaaagttgttgagaatattatagcagtttatagatagaaaatgattatagcagaattgtcacacagtaggcactcataaagtattagctgttatttcctctctgtgtatatacattataatttttaacttaaaatatttgccaacagtagaatggaattctctgatattcaataattcaagcttcacagagtcaaagcttttatttaaaataaaatttttctaatattcaacttggaaaatacggatttttcttagtatacctcagtactggattgtatggatcaggcatgaccatacattctttgttagacagacaaatgtgaatcattttgtaaataatgtattttcagtttatcctaaatttgccttatgtctatttgaactaatattaaaatcaaggttgctgcaccaggggctctttttgcacagctccttggtaactaaagaagggaaaaaataacatagaaacagctaaaaaatgtgacaaaatttagtgaaag

SEQ ID NO: 53364 - DNA, 3106 bp, Bovine  19866880898908
tccagacaaaacatgtaatgtactcaccccttccaagatatcagagaccaatgtccctgggctccaaggactaacagttcaaaaatgtaagatgagaaggtttattaccatcatacttatcagactcaatctcttgtgtacaacttctgttatcttcaaattttcatagcttcaattcactgaatccctacctatgggttcagctggactcactttcagaactaacccaagttctatgatgtgcaatgggtcagaggacgaaatctaggagcaagccccaggaagttcaaagactatgaagtagaaagtacttaacaggtttgagaccaaaaaggacattgtgacgggagggttggtggtcaaggaaatatgagatatattgtaggcagatctgatggcctgttagtctgtcctctggaacatgtgaacccataacaaaagggattttgtggatgtcattaagggtacagattttagacagaaaattatcatggattatataagtgaattcaatttgctcactcaagtccttaaaagtagagcacctattagaccgcagttaaagagaaatgagactacagaaggaagctcagtgagatagcagcctgccaagagtaagatgtcctcttatggttctgagatgtaaggggacaagagagagaccttgagaggctaagggtggtcccccgttgggagccatcaaggaaatagaaaccagtcttcaactgtgtgaaattgaattgtgccaaaaccttgaagaacaagaaaaacagatcatttccttgaaatgtatgttgatctaatgttaatcttagtctattaacattattgtgatgctcacataagagtttgtaatatataaggctcaaatgagatatgtgagaaagaggggaagagaagttgaacaggagagagggagacagtagtgagaggatttttacaaccacagaatgctatacaaatatatttgtatcatttaacttatattcagagtacatgaactgaaatgcaagtctggattaatcacaagctggaattaagattgccaggcgaaatatcaataacctcagatatgcagatgataccactctattggcaaaaagtgaaaagaattaaagagcctcttgatgagggtgaagaagagtgaaaaaactggcttaaaataacctgaagaaaactaagatcatggtatctggtctcatcacttcaaggtaaatagaaggggaaaacatggaagcaatgacagattttctttctcctgcgatccaaaatcaccgtggatggtaactgcagccatgaaattcaaagacttgctctttggaaggaaggttataacaaacctaaacagcatgttaaaaagtagagacatcaacttgccaaaaaaaggcctatatagttagaactatggtttttgcaatagtcatttcaggtgtgtgaacttggaccataaagaagggtgagtgccaaagaactgatgcttttgaatcgtggtgctggagaagactcttagagtcccttggacagcaaggagatcaaaccagtcaatctcaaaggaaatcaacactgaatattcattggaaggactgatactaagctgaagctccaatactttggccacctgatgtgaagagccatctcactggaaaagaccttgatgctgggagtgattgaaggcaaaaggaggaggggcaacagaggatgagatagatggatggcatcactgactcaatggacatgagtttgagcaaactctcggagatagtgaaggacagggaagcctagagtgctgaagtccatgcggtcgcaaagagttggacacaaattagtaaacaacaacagaaacaaggtcactactaaattatacaaagaagtttccatttcagtacagcccctggactcgatattctgagttcatattttccgagattctacaaattgccatatcacagtatagaaagttcagacaagtgaaaaagcactagactggatatccagaggcctgtggtttagtctcagttcagctgttgccaaacatgtaactttgcgcatgtccctacacctctctggtttatattgatttatggctttgtacattgtataaaaatatcaagagcaacatgttaaaaatatcaaaattataagacatttatttttataacagaaataattgcagttcctttccatctttcatttaaaagatgagaacccttatttaaggaaaggagaagaaaagccttaagtacaatggcaactcaaatggcaactcaacaaggtgaaattgcttccgaagcgctgatcttttaattagagagaatgtcaaaacgcaatctgttctcttagcttcattattttgaatctgtttcttgtttcccaataaactgaagaaataaacagcgatttttaaaattaattatgtagtgcaattttcctccaggaaaaccaatatagcttaattttcattaactatattgtaaattgcattactcttttggaaaacattcaagagtgcttttatttataaaccaatatatgagaagaataatacatttagactgtgtctggccacttccaaggggggtttcctgtttgaaaaacactaaatagaaatcaacaatggtattgttccttctaaactttttaaaatgaaaaactactcaatatatcgttaaatccagaaatagtggcagccagggtaaaactgcagaattcaggatgctaattagctaaccatgactgtatatataatgaagatattaagctttctctaagaacattgcaacttgaaattcaaataactaacgttacaggataattgggaaatatgattaactgatttaaacactactgaaaatgcagcacaattccctttcaaaaggaagagcaaacatattctacagacaaatgccaaaatcagaattagcgtgtagtcaagaaaggagttgactaagagtacatgggtaaccatcttgaataaatcactttaaagggagtcacagtgtgaatgaggataattatatggctctcaacttggctcatgtttttttctctttcaattgcaaatcccctcaactgtcaagtttagttgtctctttgagatgttactata

SEQ ID NO: 53365 - DNA, 1347 bp, Bovine  19866881147793
ataaatgtaaattagtatgcttaataaatattattttctcatttactcagtaaagtatgaagactgtaatgaagaaacaaaagtctatcaaaattgatcaggcagaactatctaaaatgacaaacatattgtgaaaaattcaatagttaggcaaaacaagagattagatagcaaattaatgatctgaaagatgtatttgaagttatttgcaatacaccacagagacacaaaatgagatgtttaaaaaaaagttgagatggaggatagtgtgacaagatctaaaataatctgatataagatacagaagaagagaagtataaaataaatcctaagaatttcctagaactaatggaagacaacaaaatccatagttaaaaattccaataatttccaggcaagatatatagaaagaaatccatatttataaatattgtaatgaaactgaagaacaccaaatgcaaaaagaacattttaaaaagaaaatagggttagctttattctcagcaaaattgcccctggagaaggaaatagcaacccattccagcattcttgcagtggcaacccactccacccaatcccgtggacagaggagcctggcgggctacagtccatggggttgcaaagagtaggacatgactgaatgactaaaccatcaccaccaacagcaagattgcagaataggaggctcctgacttttccctctacccataaacacactgagtaaataactacacatctatcagtcgcctctgagggaaatccagaaaatagttgagagatacctgcatgttggttaactaagaaaatgcccacctcaaaagagtcaggaaaaactgagacacactctcatcataaactccattcttaacacaacctcatacagttgagaggaatctcccagcttctccttgaggagaaaagattttgccacatatctagcactccaacttttctggctgttatcaaagggactgtcttttagcttgtctatatttggcacctgatggagcccagtgtttgctagacctttggggccataaagaacaaaaaggtagttttcaattaattcgtgtagctctccccactggctcagtttagaatgagcaggcaataaagtccagcttccagttctccttggaagggattagaatgcacgtaacttttcttgcctggaggatcccagggatggggaagcctggtgggctgctgtctatggggtcgcacagagtcagacgcaactgaagcaacttagcagcagcagcagcagcagcagcatcttttccacttgctgaccagattctggcttctaactcagctgtctttgggaactgatgagataggcaatca

SEQ ID NO: 53366 - DNA, 1368 bp, Bovine  19866881243543
taataggacacaaatttcattattactggattgtttacctgaatgaaggatcacctaataaagatgacagttctttccctaaaaaattttttatccctacagtcaattaaattatataagatgggatgctctagcaattttcttaggattaattacataggaactaaacactgctttgaaaagtttaaaaatgttagggatttaatttatttcccacgaggtaaaggatataggacacaacataaaatattcaatctcagctttaattaagattattaagataaaataaaggaggaaatggagcaatacagggaggaaaacagcaaaacttccataacataaacattcaaaatatctaacagtatttttatgaaactcagaacaaatttacacatttaagactgaagagtttaaatagctaataataaaatgtcaaaatacaaattctattagtatcttcttttaaatttttttaaaaagcatccttgctaacatttactacatatgaggcattatgcttacatatgagtcatacactttaccagtttacagctataaacatgtttgtaattttagaattctgatagcaaataatcattttataatcataaaataatatcaaacaacagctatctaaatagttttttgaatcttcatggatgcttacacagctgggctttttaagaccactgtgtgcatgataattgcatagcaataattctaagcatgttgttttaaaaacaagcagactcttggggagttaaagatggagtttgtgcttttttaactaaaaaaataatctagaggataaagtgtataaaggctcccagagtgcaatgctgaaaatacaaatttcagtttaaactagagaaggcaaaagctaatgttctcattgccacgtaaattttctcacattatacctgggtagtgttcttgctctaattatgttcctacatgaatgccttattacatataatgtcagaatattacagggagataaagtgtgtctcttggcttctgtttgttttgtatataatcttaatgttttattcagtgaggttttgtatttaataagaatgctccagtacactgatacacgaaacacaagtacaaaattttttaaacagtgggtggactagtgtttcataccttttttttcataattatgtcttttaattgttcattcagtcccttatttttatgcacaatttttgccttcttttgtattttttttgttctgattactgttttgagtaaggagaattgaacttgttctttaaaagcaataatgaacaaataatattacagagaatataaaatagaatgtcgaattgaggttttatgtagatttccatatatatatatata

SEQ ID NO: 53367 - DNA, 1311 bp, Bovine  19866881345347
attgtgatccactcagaaatctagtaaaatgcctctccattccatactttcagtatccattcctccctgcgtgcattgttagcatcacaaagtatttgagagagatatccttttacatgtggtattgggcatgcaggccttgtcaagtttgaggctgccaggtaattgccaagtataaacaaataaatgatcatttttgtacagtataagcatttgaaatatacacagtggtactccagtcatgtttaattctgcagttgctgccaaacaaacaaacgaaaaattaacctaacaggtcctaattattacattggatttagtaatttttatattggatttagtaatttttaaagggaatgcttaccatggaattttcaggaatgatgttttctaaacaaattaatttttttatttggaaagatatatttaaataagagattacataaatatgactattctgtcatagtctggaataaatttgttcattttttttgcaagacaatatgcttttttccagtgtgtcataattaaatagctttaacagaaaggaaaaaaaatctacaattttaatttatctgaactggaattatttgtttgatctaaagattaataatacaggcattaagagatccacatttgacatgtcctcctccccatttcgcagagaacatttccactggaatatgtattggactattttgtcatatgatttatagattatcactgaatttctggaaattgttttacttaatttaaatagtgggatcctagcaatgaagggagtaaataacaggttgttatttaatattttcattattgtcagttggggtcattgcttatgtggattaccagtcaagggtagaataccccaccattgtggtattcttcctgtagatataaatattagaaagaaaacgatctattctgtagcttatggttaagctccataaatcaatgactcttggataaataatgcattaatcaaatcttcccaagcagaactctgagagccttgaaaataagaatggaccagtagttgcaaaatatcatataacaaattttataacagctctcttgaaaactaaattccatgttttctcacaagtaatttatcttttatcctgttcttgatctagattttttcctagacattatctcattctgtccattttacctgatggaaaatatctttagtcaatgcattcagcaaagctttataaaaaacctttgttgtgtaatgccttatacatcctgtgcctcagaaatgagcttctcagtcattccgttgacagccaaccagtgtggtgtaat

SEQ ID NO: 53368 - DNA, 1274 bp, Bovine  19866881448453
tttgtctaggtagccatcagccttttactgttttaaagatcttccttgaaaatcctaaaaggtaaccactagaccacatgttcttaggagatggattcctaaggtattcttaggagatggattccacatggcttcaaggtacagtagtttaactgcattttgatagatggaggtgaaaatgtgaaaaatttttattaacactcagttttaaaagctttattcctgtggtacactgagacaaggggattccagaagttacttttcagggtttggtccttagaaattggtatatttttattaagttttgttaagctttggtacatttttgttaaattcatttatgttaagcgcattatatatataagtgaacatgggatattctatataaatactatcatcaatcatcaaaaaaaaagccatatggtggaaataatgcaataatccatttctaggttatatttctcacatagagaataattaattttcagtcatttgtcatgggtacacaatgtataattagaactgcttcatggtgaactctctcaaaagaaaaatttgtagtatccagaaaaataagccattcagtgttctaggctttatggtaaaggcttccaaaataatagaatgtattgtgtacatttttactggtataaaaagctaccagaaattcaccattcccaaatcaagacaacttatgcctaacacattcaaaacttactgggactaattatgaatcatgttaaatataaagtgttattttcttcacataatttcacaaagtcagataaacttatttgccaaagggcttacaaaatactgttactccacacctaccaacatgcaaatcaaagaaccaccaataatgttggcattagtggttaaaggggcagtgaaatttttatatcaacaaggtctgaacaggcctctcagacaggaggcttgggcaaaatcatttatcaagttaagtcaggtgaatctgtaatcaatgagcagagttctgctggaactgcagggccccagggaagcaagttgagttatgtgctacagaagaaaacattgattattgcttttacttgtttatttctccatgtagaatagaagtgagtattactaattttgcaactatttaattcagttttcactaagtactatataaaacataaataaatgataagaactagaattgaatgtcctatgttattaataaagctttggaacttagcatttttccaacaacaatgaatgaaactaaactatgatttcagggacctgcg

SEQ ID NO: 53369 - DNA, 1110 bp, Bovine  19866881526652
aaatctctatgccaagaaaggattgtattttagccctcttgtgcattcagtacaaattttaaaatcccaaggaagagagaaaaatgaaagcaactcctgctgaataaaggataatagaaaaaaaggaaaaaataatttggagacattgtttgtaatacacctaacactgtagttgatgctaaaaagggcagataccttgtgcttccctaagaaaatgaattgatcaccccagtgactgataatccaatctctgtttgcccaattggataataggactttcttcacttgattatcatttataacataccctcttccaaaaatgtatagaaatgtctgtagcaggacttcccaaaggtttaaaactaagagaaggttcccttttttatgtttcttactgtccccatcccttcagagctgctaaatctttttgccatgaaagaaagaggagaaagaagagaaacagaaatgggtttagaaataggattggagaggataagagaatataaattagctttttcttttttttttaaatagttttggagaatgttctggaacagttttttcaacttcctgcagctggggtccttgacttccaggtataagctcaataatttcactatgaataaacctttgtgtggcctcagaaaggacggactgaagaagctcaggtccaaagatctgtgactgaatgtcaaataaatctaatggctatttggtttcatagccaggtatcttcaccccatttccaaacccagtctccaccttgataactcatgatacatgaattctgtgttttagaatctcagaagcaaggttctgcctcagtttgcctacatccccactcccagtgactatagatttctatttctcagcattgcctattcacagattctccaccaacacattgaaccctactctcagaaccagcccattcatttttcttctgctaacatcttcacttaatcaataaccttaacaggtgcaaactttcagtagctagatttttccagaaaggctatgattgtcttaacacctcatcccttcccaggggctctaatgataaagatcccaccttccaatgcaggagatgtaagagacacaggttccatc

SEQ ID NO: 53370 - DNA, 1016 bp, Bovine  19866881628778
atcctttggctactttcagatgaacttgtactttgctaagttcccattacctgatcccaagctcacttttaacatttgaaattcaagatagagttgcaactaaaatgaagtctgctaatttaggttgattactgacatctaaagcaatttggactaagtataacatatatgttcacaaaatcttagctctattagctacaaatgaccacttgaagtggaataaataatttagtaggaaggatccaaaagagtaaagaccaaaaagcccctgagcaaagggaaaaaatgaaaaatgaatagacatgaagtgcctgccaacactctctttgactcttctccaagcctactataagccaatcaactggcatatgtcatatcctgcagatggaaaagcagcctgtgtaaatgtatacaagtgcagatgcatggatctgtcatgcagtttccagaggttatatttgttaagcagcctgcaatggccatgagttttgaagaagtgaagttgctttgagggaggccaattattcttgtttattgataggcatgttagtgtgttgttagttgctcagtcgtgcccgactctttgcgaccatggactgaagcccaccagactcctctgtccatgagattttccaggcaaggatactggagtgggttgccatttccttctccaggggatcttcccaactcaaggatcaaacccaggtctcctacactgcaggcagattctttaccaactgagttgcttcttcaatgcctagaatgagtctgaccatatttttcttcttacattacttagtcatgtgactattggactggtatatggtctcagcattatgaagatagagggaggtcagaggtagagttggaattctggtgatagatacagcagtgtggtaaacagatttagccatcaggtgactggtccagagattgaagaagcatcagttgaaagcaactcacatcttgatgaaaaacagatgaggcacttcacactgtgacacatcatacagaag

SEQ ID NO: 53371 - DNA, 1651 bp, Bovine  19866881681473
ttccttcctccctgccctcctccctccctctcttccttccttcctttctcttttcttcctttcttcctttcttcatggactgcatttagagttgatcgttattggatcagttcactgttttagatgctttatattttttatccttaaatttgtcaattatgccatcatagtgactagtttttgagtatgttggaaaccatgtggtttagtttatagatctgaattttactacctcagctaatgaagaagtaagaggaggaagataagcaaatagtttccttacaggtttgtacaatagtagatattctaaaatcagagagatgaaccaaactcatattataacatgaaatcaaaattcaagaacatagaaaggaattgttaaaatcaaggaaactggagacagattttgaagttgtgatgtataagccaagaattcaacaattagggagttgagagaaataataaatggtggagttctgattaaaagggctaaatttgattttgtatttcttgctttcttttctgtgccttttttaagaacaaggaagtgggaggtatctagtctatgaattgttttacaaataagatggtattgtttcaactgctttgggttttagtcttactcttcccaaaggttcctgagttactggagggctgattttttaaataattactcaatctttcttaacaagctaattttggaattatccaaatctggctaataaagatcatttttatatttaagaggaattcatgcagtgctcactggggaaaaggaggcttatagattcttctttcgagggaatgaactcttcccatggatcttttatttgtgaactaatgttttagtctttcttaaaagttaatagagagatccctgcagagatgtaggctacatgattattgaattatttaattattgaattaaaaagaaaagctaagataaaaaaggtagatagctataattatttttaaaaaaggggaaggagaagtacctggatagagccagagcacaggaagagaaagaggtaatttgcataaaataaaaataactagaaagtaatagaggatatcataaagtggcaatatagtttctgtgcaaagaagaatatacagatggacgtccctaaagattatataccctagaccagaaagcctgaaggctgagaggcttttgttttcatcttttgccttccagcagagacagtcatgatttctaatatttgtggagcaggttagtcattcactctgtggattgtttcaaatgtccctttctcaagaaatggattcctttacccgccaatgttcaggtactgctcatatagttctcaaaagtctttgctatgtgtttttttaaaccctgggctttattcagatttctgttacataaaaagaaaaatgggttaaatgatagaaaagaaaagagcaaataggacgcaagagtcctggcatgcagtgtcagttcaaacttggacaaaaaataagggtcctgagcccagcatacttcatagccaggagaggatactacaaagaagaaaaaggagtgctatcttaggtcaggtaacctggaggttaagggtggcatgaagatttattgggagtgctctcttgggacttatacatggaaggcagtgaagaaggcaggattggg

SEQ ID NO: 53372 - DNA, 1120 bp, Bovine  19866881776973
gatcccaaaaataccctttggcactatcttgcttctgcaaacgtaatactatgaaataaattgatgtagtaaatactctttgggagtaagtctcattaaatgtttatagtgtagaaatgtatcagagtgcttactcaacaactaccaagctgaagcttcgttaaatctttcattctggtccatagctggttgtggaaatgaaacctgagatttattgttggagaaaatagaagttgaattagaacacagtctaggctaaatcaattaatttatttgaaaagctaatgtgaattatagagtgttatttctgcatttatgactgaatgagaattgagaagtgtccaattgtagattaacagaattttgaatgtattttaagtcagaaactttgccagtgaaaattgctttgaaacttcaagtctactaaggtgtatttgctcttgtgtgtaaggaaaacacagcttttataatcataatccacagaattatccagattctcttgtgataaagatgataatgacaaaggagttttgtagtattgtgtcattttcaaagagctgtcaactttgtattcttatcttctttctatgtattcatttatgtgtcatcattcatatattcctttattcagtgttgtatccccaacatctgggacaatgctgtatatatagtaaatatcaatgaatgaatgaaggaaataatgagtaaagaaatggtgcctgtcattttgcaatataggagtgaagagtattttttccttatccttgtttttgcacttttctccaacttgtagtgtatgttgttagagtatgtactctattttgcctaacttttaactgggctgcaaatttatagtgaagaaaaccacagggaaaaatagctggatgatatgctgctcagattcctttctgtcataagagagcccaaaaagaaaaaaatcttttcccagtagctttcttgctttagtttatgttccatgtaactgccaagctatgctgccttttactaagagtaataattctgagatatgtagaccctgtattatatttttacctgagagagaaaacaggacctctattaatcaaattagtgtttaggagctaaagaaaaataggcatca

SEQ ID NO: 53373 - DNA, 1113 bp, Bovine  19866881875126
ctgactttgatgattgaattgggggtaagaaaaagaattacttgagagtttaacaaaaaataattgtgaagctgtatttgcaatgttttttagtctttaatactagaccttttgttttagcacaaacagttagtgagctactgattttgaaacagaatcatgcaagaaagagggtattactgagagaaggtgagatcaccagttatttttcagacagaagttgttttttaaattatacttttctgagtcctaaagatttctttctcatttgatgttaagctcttatgtgtcaatcttttttttaaatttaatttattttattttttaactttacaatattgtattggttttgccatatatcaacatgcatccgccacaggtatacatgtgttccccatcctgaaccctccctccctcctccctccccgtaccatccctctgggtgtgcaccagccccaagcatccagtattgtgcatcgaacctggactggtgactcgtttcatgtgtcagtcttgatctgtttgcatgtagagtgagcaaatatatattgtataactgttaactagcaaaccagcagagcatatagaatagagccagtgatgtgacaactttcctggtctggtgaaactgcacagatatctatcacctggtattttaatatgcagtacagccctcagaaacatcattgctatttgcaactaaacattaatttgagactagtgaatcaattaatcaatcaaaatctgtcttttaaaacagtacaatttttttaaagacaaatttgactcaggatttgaagtttgatggagtgaagaagaaaagcttttccctatttataacctgaaaaaaggaagctttccatttcattccgttgctttacattggctagggaaaacgtatctcaagatatggcctgacagaataaaaatggaatgggcagtctaaaatgggataatacctgaaattaaggaaatgggatgcaggtgtggaaatggatgaggtgttaatacgtgtgtgcatgctcagtcacttcagtcatgtccaatgctgtgaccctatggactgtagcccaccaggttcctctgtgccatggggattctccaggcaagaat

SEQ ID NO: 53374 - DNA, 666 bp, Bovine  19866881879278
tgcgttggagcccgaaggcaggagagccccgtatcgcgcacacgctcagctcacttctgcagactgtcattctgaaagctgctcagactgttgctttggtttcagtgaatgcagtcttatgtaaagctgcccccagtggtgaagaacattatgggcatgtgcagaaatgtctctcttttatcttgcaaatgagcaggctctctgctggaaaatgaatgattcttttgggtggctcaataggaactgaatggtcaccgtaatcaataactagcaacattttctgtaatttccaagtcttgttttacaatttggcaacgtctttattgtctgcatccacttaatcgctaaacatgtgctgcccagagtttttctggagcttgacatgaagttcacagaccgaatgtcaatttttcttaacctcaacgtaggcttagaactgaaatttataaaatgaattattgagcttttcacagagaagcattaactgcctgcccatttgacctcttggagtcacaatgattatattatacaagatgtctcaggatgctagctcacatacattttgaaacagagaggataactaatgacatataaagtaatgtgtccaataacctttctggttttcccacaaaagacataattgatttaattgtttatgacttggtt

SEQ ID NO: 53375 - DNA, 1795 bp, Bovine  19866880472294
atgtcatttttcttaaataaaacacatcctacatttttttctccccttcactactcccaagaacttttgcttggttaaagttctgagttaaacaacaaaagaaattctaggcttcctgcaatgtaggcttgaacaaagtcataaatctctagttactggcatttttttagtagcagacacaagggagaggtttatttgtttaatagagggggagattaggtctggttgtgctgtctggacatagtgatagatctaactcccagggttatctaaatgaggaccattattttgaataaattcttctcccatgtcagagaaaatggagcccaatcccctgtaatacagacaaaggagaggaaggacatgggactgtccactcctttttggacagagatctgtcacaggtgaatggaagattgattaaaacatccattttctgactttctgccaagttatatcacttatagataaagagaactggccagaagagtaatccagctgcagccattaatcacgcattgctgcctcccccttggtgtttaagaactcccctttagtggaagagactgacggctatgtagattcatggtacatctcttaaagcaatcaagtatcagaaacataaaaattctgtactcataacacactgagcatataagacagtcactgaactagtccttgaaggaattaaaaaatactctgcagcctttctggttgaggacagtccctaggtctctcaagagaaaaatgagtgagcattcatggattccactgaaatgcggaggttaatgataatggtcatctgttcttgtgtcttcctaaagcaagagcacacaaggcagaaacgatctatttttacaaaaatgactcaagcctggagctgaatctttgaactaccacttcatatctgtggatgacctgggaaaatatacttaatttcagtgactttcgatctcctcttggctaaaatggagataatactaccagcctcacaggactgttggtacccagaaatgtgacaaagttagggaatgcacacagcacagtgccagactagcaggtattcaaaatgagtttgtttcccattttttctaatctttgtattcattattattgtttataaacttcccatatgcatgcgtgctcagtcgcgcagtagtgtctgactccacaacctatggacgagagcccacctctctccgtgggatttcccaggctagaatacaggagtgggttaccattttttcctccaggggatcttcctaacccagagatccaacccacttcttccgcaatggcaggcggattagttaccactgagccacctgggaagcccaactacctataaatgtaacttatttctctaacttaagctcatttctctaacttaagctattcaaggatagaaaaatcatgtctccttttcttctatactaatatagggcattgcatgtagtaaaccaatatagcatgtctttttttctaattataaaaataaacaaatgggacctaattaaactcaaaagcttctgcacaacaaaggaaactattagcaaggtgaaaaggcagccttcagaatgggagaaaataatagcaaatgaagcaactgacaaacaactaatctcaaaaatatacaagcaactcctacagctcaactccagaaaaataaatgacccaatcaaaaaatgggccaaagaactaaatagacatttctccaaagaagacatacagatggctaacaaacacagaaaagatgctcaacatcactcattatcagagaaatgcaaatcaaaac

SEQ ID NO: 53376 - DNA, 1564 bp, Bovine  19866880705973
gcctattaatgaaatattttatgtgtttttttagttttaagtcttcaaatcacccttcagatatgtcacatttcaagtactcaaaagccacaaacagctggtggtgaccgtcctgggcagcacaggtcaagaggctgaaagattttggagtttgacacctctggatataaaacctggttgaatcatttactattagtcattgaagaaatttaaacattccaagtgccagttccagcaactataaaaggagagtaatttatagcttgaatatttttgtgaagattagaaataatatatataaaacatcaactacagtgctgggaactcaggaactattacttcctgaagaagctgaagtttcagtgcttgaaatataatttctattaaatgcagctgctattaccatcatcacttcttcacctttgaaattgcagaaaaaaatactcttagtttaactttctccaccaagaagccaattttgcattgatacatggaatagaccatctgactgtggatcatctgcaaggtgacctcattagcacacaatacaagagataatactgttggcacttactgttcaatatgcatttatcatgaaggggctcaccttcttcattatagatcacaagaaaagtgacaggagatatattcattttgtgggttattatctttatcaaaaggcacacaatgccttggtaaaataatacatttcattctgggatatattaaaacttttctacacgctctgaaaattcatttcctcttgtttcaattcacatctcccatacctcagttacttcagtctagttagataagcctgattcttctggccattactctcaaagagaccaattgtgattttctttggggaaaagactgtatttacatttctagaaatggtagaaaagattggcgagaaagaggctgaagattttgcttgaaaatgatggtgaaagaaagcgcactttccaatcatacttgaataccagttgactaggtctacattatggaatgctgacagtcaatgaaagtgaatattttatgctactttttaaagctctcaaagtgttcttttgccaataatttcacttaatcatgaaaagatgtataggaatcaacactagctgaattatggtgaaacttgattgtttgatctgtatgcaatttgttttgcttgctttacccagagtctttgctaccccatggactgtagcctgccaggctcctttgtccatgggacttcccaggcaagaatactggagggggttgccgtttccttctccaggagatcttcctgacccagggatcaaacctgagtctccagtatctcctgcattggcaggtgaattctttaccatctgagccaccagggaagtccttatccagaaagttagctctatacagagggaagtatttgtttttcctatgagaatgccaaagcaggtaacacattttagaaagtcctaccattcccatgtaatgataattcaaaggaaaacagattttaagtggatcttggtcagactcagtctatggaatttaacatcaaaaaccgggttttaaa

SEQ ID NO: 53377 - DNA, 1977 bp, Bovine  19866880736235
cttataggttactacaaataaagcatatatgcattttaatttttgtcttaaatttacttcatttcttgggtttaagacattgaaatatttctacagtcactcaccatttgcttcggaaaaatgaacttctcataacttggagtgacccctgtatacaaaaagcacaatgggaccccagacaaagggacaacagggacatcaaggttcctacagccagagggaacagtatcttcctttcagagtaaggtgtgaactggttctgtaatgcctttgcaaggcctgcataaatctgtgaatctcagaacaaagtaacaatatagaggaggacatgttccttgtgagacatccagaattcggctggttattttcttaaccagtattcatctaatccatttgctaagcattgtggctttgcagctacccatgagggaggaaatggttgtttaattgcccagaagaatttcctagagatgcttcagtagtaataacttgtctttctctacccatgatccatgaataacaaaacaattgaaaatgaaagtcaggctggaaatatgacaatggcatctctagtcaaaataaagcacagcattgaaataattatttgaataaatcacacctctctcactccaaatacccataatttccatagctcagtttgaagctttctagtacttgagaataaagcttaatttaattatttttttacttcattatttgtgagcatatttagccaaagggataaaatgtcaagaaacattcttcttactctactcaactatcttccacctcagcttatgtatcattttcctcagaggtgttggggaagggaaaatttctccctatgcttttcttttttttttggttgatctaatagttatattgacataagaagggcatcccttatagctcagttggtaaagaatctacctgcaatgcaggagacccctgttcgattcctgggttggaaagatcccctggagaagggaaaggctacccacttcagtattctggcctgaagaattccatggggtcacaaagagttggactcaactgagtaaatttcactttcacttgacataagaaaggttaacaggagaaaataaaatttaattttttatgtaatggaggtctcatagatataggacctaagcagtgaccaaggcaggcagcttttatactttttagatgaagaaacaatagatttgcaaggaattgacaagacaaggaaacttcagcttgggtacttaattagtgaagaatctaagcagagtttgtttgctcaaacttcttggccctgaatttgtgtctctagcaataaggatgtctctatatgtcctgtgatgggagggtatttttcatgtgggaaatttatgtcctgctttctggggacaaagtagagtcagggtgctcttcttgcactgactgtttcttaagtaactttagttcaaaatcaatatatggggcttcccccggtggttcagcagtaaagaatctgccttcagtgcaagagccacaggagacatgggtcaatccctaggtcaggaagatcctggaggagggcatggcaacccactccagtattcttgcctggaaaatccccatggacagaggagcctggcaggctacagtccatacggtcgctaagcgtcggacacaactaaagcaaccgagcatgcacacagtcaatatatgactttggtgcatttgcgatcaacctatcctgagctctaacagaagtcctacattgagtcaaattgctcaggttcactctctatccttagctatcgctttgcttatggcccagtcactccatttctctgaatctcacctataaattgaataagatgggatagttcagactttcaactatagctatgactctatcacagttctatcccctcctaagagaaaactcctaagtgtaagcttcagtgcagcatccaggatgtaattctccattttaaaacccaggtt

SEQ ID NO: 53378 - DNA, 1172 bp, Bovine  19866880800054
tgataaagaaattacctcattacttggcagagagtggtggagggaagctagtcttaatttcacaacctcagtttaattcagaatacctacacaaagtatctatgtaggctctaaaacatatagctatgttttaaagcacagttcttttcacatggatgattttataccctcttcatttatgatagttaagactctgaagaaatgacatgtttaagaaattatcacaataataattaagataattaaaatgagttatttccattatgcagttgtaggtatcaaacctttctaagaccaatttatcattatttggcatccagttacattatttaaaaaaggaagagattcttacagtcaattaaggaaacaagctcagtgtgtagtgttttatggcatctttttctgagtgtgattataaaattacactacaaagaagttcaaatctaaccagaataaatcaaaaactttccagtggaggtcagaaaagaattctcatatattctggttcagttgttaacaaaaaagatttattcattttagcatattgactacatatgtattttaaccattaccattattatttgtattattgatgacttccaaatgagagattgagtcataattaacacggctgggctggtagtcagttcaaaacggacacagctgcaggttgaaacaacttttcccagtgcagaacccaaatattaagcacttaatatggagtggctttgtgagctgctgcctcttacccgaaacaaagcatctaagagattatagacgtgggtcaagcagtaccataagggcccagggtaagggagagaacaattagagatcgatgcaaatgaattcatgccactctgttcagtcttgtgtattgcagagcatgatagatatccagctacacaatgtgtccaactggttcatgcgaaacccacccagtttctgtgacagttggctctcatgaatgaatctcaatttccacatttgctttggatcctctgcaggggccccatgcatgtttgtttgtcttgagcagatttttgcagctcttttactgagtgggatggcaggatctgcagagtgtttagatgctagatgccaggatttcttggcctgtgattatggcacaacttcagtacatacttggtagggcccatttcatcaagattcac

SEQ ID NO: 53379 - DNA, 1249 bp, Bovine  19866881040378
acttgtgtgattttggtaccaaagtaataaagacaaggtcctaataatttccagagagaaaaagatatgtcatctacaagggagtgatcaaattggcaccagctttcttatcaataacactgatgctagaagctttcagagatctgaaagaagagacgtacaaggaaaattctgctgctgctgctgctaagttgcttcagttgtgtccaactctgtgcaatgccatagacggcagcccaccaggctcccccgtcccagggattctccaggcaagaacactggagtgggttgcctatatctagacaaactgtcattcaaatgtttggaataagcacattttagacacacaagttttcagaaatatcacttcccacacactctttgctctagcaaaacaacttggtaatccaagaaaggtaaagataagttccaggaaagatctctttcccaaaaagaaatcccaggatgaccacctggaagctatcttacaaagtgacttgtccagatgacaggtgagggacagagtgtcccacgggacggtcagtaaaaaacaaacactccatagaatgtgataagctaaacaatttcaatacaatatttgcataaagagaaatagtgggtgaaaaaggaaattagaaactcctgataaatgaaaaagttgtacgagaataaactgtttggttttcaagtaaactacatttaatagcctattgacttaattaaatataatgatttaactatactagaagtttggaggattgagacagaagagtaaataaataattttcaaaattgaatagttgaaaaatagttgtccaagacagtattcagggtatggggattaaaaaaagaatcagctagaatcaaaaattacaaacttcaagttgtaaaataaataagtcctgcatataatgtataacatggtgactatagttaataatactgtattatatattttaaagctgctaggagaatagatctttaaagctttttatcataaaaaagcaaaaaattgtaactatgtgaggcaacagatgttaactagacttactatggtaatcatttcacaatatgtatgaacatccaatcattacatcatacaactaaaacaaatataatattatataccaattatatctcaataaaaaataaataaaaggattaaacaaaagaattaaacacggttccctgtcgatagccaaagtgggagactgggggaggagcctgcataaagctttactatattatt

SEQ ID NO: 53380 - DNA, 1107 bp, Bovine  19866881109854
ctggttcatgaaccagcttatcagtgagtcatcattctttccttcctttggcttcctttttagccattaggatctttgcaaaataatttacatgctttcttcttaaccaaagttttgactgtatttatctaagatctgtagtattatatgttttgtaaaccaaaacctctagctaaagctgagattgacatcttattacaatttaattttaccaaaccatttgtaaatagtaaatgctatacaatcaataaatcagctaaatgtatgctactcgggtgactaggtctagtgcaggcaatcagcaggtatattaaagcaactgttgccacagacataacttagacagtatagtgagtgcaaagaagggggaggataatagtgggttgaaattagacagtgttgtgttagtggaatgattaatatcttgaaatatctcaaatgagcaacatgaatgaagtcagggagttgctatacatgcagtggttttcaagctactctgaaaagatctgctattcccattgcatcctagaaaattatagcagaatttcagcaatgtaggcactggtattattattttttcactgtccagatgattccaaggtacagcaaaaggttccagtcactactgttattcaaactgacctaaaaatggcaaaaccctggatttggagaacagcatatggtgggggcgagcagacacattagaaacatatagaatggcttttgataatctttcctcaaaaggtaggaatctctcacgtgtgggagagctacatttcaaactttattaatggtaaactgtttctgttagagattttatatggtctatggtgaaaaaagaaaatgatctgattcaggaagcagcgggaaagcatagaagttgagttagatatctcaaagggcaagcgagtcccctccccctttatggaaggacagcaacctgttttccaggtagaagggaaaacacagcagatgtaatttgtgttgaataaagatcacacaatgtccttaatcaccacctttcctttttatggagtaagtgtaaattattgtcagtttcatgatttgtattggagccgaaacagatgctaaaggtttcgtttaaga

SEQ ID NO: 53381 - DNA, 1078 bp, Bovine  19866881122617
tatacatatatacagatgtatacgtacatatgaatacatatacacacataaacaccctccccgcaacatgagactgttttggacccagcacagagcaggacacttaagaaaagcaataggaattcacattaccataatcagggtgtcagggtgaagtcagagttgctgaaccatgcagtgcattaatggagtggaaaataaggatgtctgccagggtttagatttaacacaaattaaagatacggaaatctaagctaaatatctttcttccatccccccaaaacaaggtctgctcttttgggagtttaagactcttgctcactgatgggatgagagtgtatgctggcaaagcctgaggtaagacagtgcacctcacgaccacctttcctagatggctcagcagtagtggtgtctagcctttggagggcctgtgtgtaacggcttatgatttctccaaatttcatttttctctacaaaaatgaggtggtgcatgggcaaattaaacccctagaggagtgatttccacaggagttccatggataccgtgtaggcaggtgcctctgacctcccacaacttcagtctttgtcacaggctgaaatggcagcagaccctggaagcagaggacagagctaaccttgaggaaaagggagaaatggaatcaattttcctgaataacagaatgagagaaaagctcttttctttttggtaattgtctccttctatatgatgtgttttctttataatcacattctaggtaatgcacctctgtttgcattaatcacaactcttctttttatcatctttttccttttccattttctttggttgactctagtattcattttctaaattctaaaatacgtctcagcacaattgattcaaaatgtttcttcttttctaataaatagttaaggccatacatccctctcaaaggaccaccttgaccacaatcataggttctgctgtataagcttcaatttaccagcccttggaaaatttggaaaggaatatgtttgaaagtgactatgtaaaagtatttctttttttaaatctgaagctcaggcacaggcttctcat

SEQ ID NO: 53382 - DNA, 1903 bp, Bovine  19866881190116
aaaaaaaaaaatccgataacattgtcttaattctccgggcaagagttggcatcctgcagagccttcaaatttagaaaagtgttggtttccttcttttcttcactgtttgttccgcattcaaagcctttagatttattgaaaaagaggcttctcatttttttaattaaaatttttctttacagaaagtctttattggttgtatattttaaatattgcttgttgtttcgtttcttagttgctaggtcatgtccagcttttgcgagcccatggactgtagccctccaggctcctctgtctatgggattcttcaggcaagaatactagagtgagttgccatttctttctccgggagatctttcaaacccagggattgaacccacatttcctgcattggcagacggattctttactgctgagccaccagggaagccctattttgaatatagcacctctccttttatattgattatactcagcgttgttacagaaattaggcatcaagagacttagattctggtgtgttacctttggaatgaaacataaaattcatttcagccaacaccctcgttttacagcatgtgaaaggaagacatgagagaagagtgacttatccaagagcagccaactgggtaatctcagaggaagctctcctagcttccctccagtgctcccaactctacagggagcttctcttctctcaacttcttggtgactccacctgtcacagagccaaagactcatcttcctcatctgtgaagtagaaatggcagatatttcacagcactgtcataaatagaaaatagctttgaatgtccactgagcagtatactgcctcacatattccatatattcatttctcatcctgtagaagggatcagccatgttcactgcctctaaaacagagagcctgggtcagagaaggcctttcagaatttcttacattttcatgtcatgaacagtttttgctaatggatctgattgatcagactagaattgagtttattctgcactatgtggtaatgaattgtcatatttgtcatgtctttcccctgatgtttttaaaaaaatgtttttgagtatgttttgagtgtggctgaaaaatctaagtgccttaatccagttttggcagcttctctgatgtaatcattttgatctttggcagcataaggggcatggcagattggggcactagtctgtaggcacaagccctagatgtttgttctggccactatagtgtgaccttggctacattctttacctgttttaatactccatttcttttcttgtaaagtgcagacagggatggatggtttctaaattcctttctaattctcagatatagacaaatctcagctatagtaatcataaagagaacaaatgtttgtggagtagtatggtattttctgcaaaaacagattgcctaatctgttttttgaattaaagttactaaaaatcgaagcaaaagagcagaaagtcttaaattagtggcagagggccttctctgacaataaaatgtacttgctggaaatttacagtggctgtggaatgaaaacaactattaaatcaaaattgacttagtacattcagagacacaagaataaaacctattaatagctcaacagaatttaattgaatactatgagtaatgcaagagaggtccaggggtgaatgcaaacacttatggatgattctgagttgtaatatttgactttctgtgagaataaagagctgagttccagctgtgtaggtgctgggttgattaaagaagctaaatttacattggcatggtggtgtagatgtatcattgtgattttctctcccagaatgttccagacagcctaatgctgtcggagaaggacaaaataagctctcatccagcactggctcccaggggtctctccct

SEQ ID NO: 53383 - DNA, 1343 bp, Bovine  19866881243681
tgagaatttgatagcaaatttcatgttaatcatgactttgttactttgctaataaaaaagtagtgaccaaattatcctgcttttgtagcttaaagatgagagcacaaaatcatttattagcaagggcagtaaactaaactacaaaaaagagtaaccttgaccaaaagcatctaaggccccagcttcacctgactcatgggagctgtgatgcaatgcagcttagatgtatttgattactgacaatctgagatggacaaaaaaatcagatgagtaaccaagggttgtacattaaataaataattaatataaatagtataagcaattacattcagtagcagtgagacaagtgaaatctaacaaatagaatagcctgaaaatgggtcgggagaaaagataagaatttgagaatgttgcagtatttgttgtaataggtgacaattaactaatataactggtgcaaatagcgtcgaagtagaaatagcggtaaaagaagtggtcacactggtttaaaggcaacattccccaggcaaccagttgctaagccaaaaccacgccaaataaacaatttgctttggcattttactgttgaaatttgataggcagaaaaaaactagaattctaattttgcttgagaccagggggtattgaaatagaatgctttcaaggaaattctggtcatatgtaatactgtacttaattttcaacccgaggttattctcagattcgttgattgtataactcctaagtaatcgcctcactagagtaaaaggaaatgacaacgtactcaagggaagagggacggaagaaagttatttcctctctactctgtaccaagaactggagccagcatctaatttaattaacaaccatcctggtagtcgaataatattgttattgctttgcagaaacaaggaaagaatcccaaagcagctaggcagcttgccagggctccaatgactgaggccacaattggttccatgtctctccaggtggtgtctattcagtaatggtgatggcattctggaaaagcttagaggcaaaagcccactgatgtcaaacacttgtttctcaaaggacgacccatgaaccaacagaattggatctcctgggagctaatgagccagaatttgcattttaagaagatcctgatatgtacattaaagtatgaaggcaagttttacaagatataaaactgcctgaccctttgacttgatagggagaaaaagggattcttagaggggcatcttgaaaactttgattcgtggaacactatgaacctgatgagcactaaggacctgctcttgaaaataatatatgcatatggatacacacttagatgtggg

SEQ ID NO: 53384 - DNA, 1621 bp, Bovine  19866880393830
ggctttcatcgagaacactaggctggaccctgaaggcctttcaaagtcttatcaaggaatttagatttttatctcaagaaagatagtggtgagaataaggagtctggaatggtctctagattttggttgggcagttggttgggaaggtagtttgaatcactgaagctgggattatggggaggagagggcagaggtgacagatggtaggaaagatgaactctccttgcacatatcacagatggatggaggaggcatctgtgggaagcactgcttagctcaggagagaggttggaggagaaatgatgactggggagccctcaaaacatcagtcaggtcaagtcataggcatgaataggtcatccctggtgaatgtgaatcttcaaggtcaacttttaatctcaggaaattttcctgcttcctattcagtgtgttcacaggaaacaccaattaaaattaatttcaacctaagcaaaatataattagggagataaacttactgccaaaaatataatgaactccagaatgaaatgtgaaattgatattagctcacttatctgatacgtttataagatgctctgcaaaacctggtaagttagggtgggaaatattttagacattttaaggagattgataacagaaaaagaaacaaaggtatgtcttcctcttccttcttaggactctctcccatttaggctgggtgatttggactctgaaagtctctggtcccttcgttcagttaaagttttttctgacatactgcatttgcctagaaggaatatacaaaattcatttctgctccctcttgctgcagaaattacacttagccactattgttagtctgaagtatgcctgcccacaatacattttaaaaatacatttaatgtatttaatgtataatttttctatgatctagtgatttaaatcttagtttcagtggagaaagtcaagccgctggaaatattggccaattaacctatgaagagaggagtcgttggaaagataatctttggaagttatttttagtagcaataacagtgtgttcctcactacttcgagaatcccattactgcagttcacactaactttgattttcaggttgcttgccactaagataatttaggttatgttgctggtttttaaaatagatgggagtcattactgtttctgaagacaatatttatcctgcctttgagccctccctggggagggtgtgggcacagagattgattaggagcttttattttcctgggatgacctgtcatttagatgactgtcaaagcaaaatgtccatttgtatctgacagtacaaaatatctgtactcccatgttctttccaggtgaaataactgagaacactctgtggacagagtcttatttaagaatttagtgctgaaaacaatattcataacaaaaaacaatgcaatcagaaaatgggcagaagacctaaataggcatttctccaaagaagacaacaggcacataaaagatgcttgacatcacaaactattagaaaatgcaaatcaaaactacaatgaggtaccactttgatgatcagaatggccatcattaaaaagtccgcaaataacaaatgttagagagggtgtggtaaaagggaagcctc

SEQ ID NO: 53385 - DNA, 989 bp, Bovine  19866880394969
gtgtgttgtgaggaacatgagtagtccttgaaatatgattaaaacaaagatcactgtggctaagtacatttgggtaatgttgcatattcttattagaccttatagatatttataagtacactaacatatgctaaatgctctaagaagcccttcagtaaagaaactttaatccagagttttaccaaaataataatttggtcctttcattatataatacctgtttacatttaagggaaatttaaagatgacactttgggaaacaatcataaggaaattatagactacatgttttcaggcaactctatgtgaatattgtttttcatttcttaaaaaaattctattttatcaaagtatagttgatttacaatgttgtatcaatttctgctgttccagcaaagtgactcggttacacacatataattcttcaccttcttttccattatggtttatcacaggctattgaatatagttccctgtgctataccgtaggaccttgttgtttatccatcctatatgtaatagtttgcatatgttaacccctaactccatctctccccctgcctcctccccacttgcaaccacaagcctgttctctgtgcttatgagtgtttctgttttgtggataagttcatttatgtcatattttagattccacatgtgttatcacatggtatttgcctttctctttttgacttacttcattttataatttctagatctacccatgttgctgcaaatggcattatttcattattttttatggctgagtagtactccactcagagaaggcaatggcaacccactccagtactcttgcctcgaaaatcccatggacggaggagcctggtgggctgcagtccatggggtcgcaaagagttggacacaactgagcgacttcactttcacttttcgctttcatgcattggagaaggaaatggcaacccactccagtgttcttgcctggagaatcccagggacgggggagcctg

SEQ ID NO: 53386 - DNA, 1479 bp, Bovine  19866880550594
tccagtttcctcccgtttaaacaaacaacacgttgctatgtttcaccaccgcaagtctggccccagcctctgccactgctcacctccttgacctctcctccaaagcctggccctcctcagcctctgcagcccacagccagccccaaggtccggttccccaggcttatcctcatgtctgcagaagcccttctgagccccaacaaccgggtcataccctacacagatgaggtctcagcacttcccagaaatccgcctgttgggctgcaccctgaacgtctatcaggcctgtccttccccagctccaagaccaaagaacaagcttggcaccagtaacagagatatcagtggtttaaaacttaaggggagcttatacgtcggaagcagtcctgaagcgacaccccaccaccactgtgtgctgctggcggccaggctgtgggcagaacatggtggccgtcctcgctcttcgcagcatggggaggttaccagttggggaaattgatatcagattggcgcatcagttaccgtggaaaccagaaagctgcaccccccctcaccaaccctttgataagcattggagagttctgagctaaagctaggataatcaccagctgaggcaggggcaaataggtaagggtcagtcaggtgagcaggatgtaggtgaagcaggttctgggcaaaggagggatgcacagagagcaagataacagccatcttggatggcctgaacttccaccagagctttgcctctcccatcactgcattttagaagtcagggctacagtgggtggtgtttcttcctagtattcagagtttctgtggacagcaatccatgtcactcattcacacagtaaagcagcgtgttacagcccaacaccataataaagcacagaacacatgatgatagctcttagcctggccatgcccgtgctctaagaggcagccctcttatcaagaggctgaaaaggccctccaaactcaggagcctaggagggagggacaggacaaagcctggcctatgctggttctgtgttagttaagacacctggcacagaagggccatacagagttattgtctatggaagccatggaaatccactgcccccggcctccaacgcccaccactcctcaataatccagttccctgacattaaatgtgcaatgactcacagctgtagagaaatagaaacttaactaccgtatgtatattttgcatgggtttgtgtgacaggcagaataatgcccccccctcaaagatgtcccctgaccctgtggatgggttaccttacacggcaaaaaaaacgctgcagatatgactgagttacggatttatgatgaggagatgatcttggctcatccatgtgggcccagtgtaataatgtagatccttaaaccagagactctttcccactcatggtcagaaggaaatgtgactaccgaagaacagtgaaagaaaatgtggctctgaagagacacaaccca

SEQ ID NO: 53387 - DNA, 3341 bp, Bovine  19866880570009
tgaatattcattggaaggactggtgctgaatctgaacctccaatatgttggccacctaatgcaaagagctgactcattggaaaagactctgatgctgggaaacattgagggcaggagaagaagggggcgacagaaaagagaggatgagatggtttggatggcatcaaccatccaaccatggacatgagtctgagcaaactcctggactccatggacatgagtctgagcaaactcctggagatagtgaaggacaggggagccaggcatgctgcagtctataaggttgcaaagaattggacacaaatgagtgactgaagaacaacacaaacgtgactaaaaataaataaatgatgtagaaagtgaaaaattactggacttgtcattctaattattcatacatataaatctaaaaattaaatttttttctaataattgccatccttcttcaaaaaattatgtcaaagttgttttaatgtattacactttggtagtgcacatgcaagaagaatcagagtaacaataagccagcatctaattgaaatgtatttgaaatctggagtcactatttacaagatggctattttccagattcatgcatggcaggtaatgaccagttagttaccttcaactgacactgtccattttaagggtctataacttcaaagtcaaaaaaaaaaaaagaaataaaaattgtgttcactatgcttgaattttcaaagttctaattagaccatgcctttatacttctgtaaaattattcataaagtgacttaaatatatattgttaaattttaagattaatcaatgcaaatggtattttttcctggtatactgaaagttaagatatatttttcaaatatgaagagctttgtaaaattcatatgcctaatggtaactttataatagtacaaaagtaaaaaaagtaatcagatatttagataagaatataaaatcactttacaagcttgttttttaaatggttccaagaaatttaaagacatgaggtcactttcccacatactttctctaggaaactgtagtcaagaggaatgaataaaatcatgagaaaatccttggactgcaaaatattgacatgcttctgttttttaaaatagtaaacatttaagttgctggcaaactgctttctctatggaaaaagttgggatactttaaaaaaacaacccatccttattggacaaaatgcctcaaatgttctttacttattttttataactttcacttcctggtaagcacagaactggctgagaaatttgatttattctaagtactattttcgtgtctttaagtggcctttctgggatgaccttaatctacactgctaccaaccactagaaaaaattttctaagttataattaaaagttgtaatattgatataagtttagacgatcaaacagaaggggttaagataataatagatctttgtcattccaaaattatgaactatttcaaacatacagaaaaatacagacaataatatatgaatcatttcccactgctcagaatcaataggagttaacatttgccatactaacttaaagtttttacttttagacgaaaaggccaagtagagatctaatgaaaatcaaatcaatctctctctcacagagggtgaccacagtcctaacattggtatgcatcattttcataatatttcaaaaatactgatttgtttttagcacgttatgttaatcgtatcctacttaaaacttgctgcattttactgaacacagttttgagttttaaccatattgactaatgtatatctactttacctattttaactgttaattaatatttcaaatatatgaataaactggagtttatatgttcatttcccaactgagggctatctaaattgcttccactcttttcatgtcttggcggataccctgaattacgtgtggcagcctctggcatgggtaggtttccaaaacacatagcttccagccttggaaaacaagctcccctagagatacgctggaatgtaattttaaaagagggatgtaggttaaccagttatttaatataggtagaacaagatatttcaagtggtatacaggaaagtttaaccaagcataaaacatatgctcaatttttaactgtgaaaattctgtttcttcttgtaccactctagtcaatttaaacatttagagcttaacagcatgggaaatatccttttaaattcactgttgctaaagaacttcagccttcatatggcagcctattaaacagcttctattcaccacctcttttttatcccttgttattggaattgtgatctcattttatctgtttcaatagtaagacaagtatagatgacctctcgtgccaattaacaaatctggtgggagaaaaaaaacatgactgatgcttgaaaagtcatggcctctacttttatttgcctttataaacaaaatcagaaaaaaaggaatagaaaagacattctgttaaccttattctcttgcctgagatgatcagcctaatataacattatgatataaaaggaactgttcaaaattcatttattcactcaacttgtattaaaaaacaagcactataaagggcctgggtatatagtgatgcacaaaacaggtagaacttgtgccctcagaaggcttaagcagtatatgtccttatacactgcattgacaacagccccagttacttcttttcaagaaaactcgggggatctggaatgccaagaagcataactaacatgatcaagagaatgaaaataaccagaaaagctaatcgttacggtctgtgtatctattatgctgcttttgtatacaaattacagaaaacttctactcaactggcttatacaatgggacatttgttattgtacaaaaagagaagtctgagtggttaatccattagtttcattgaagagacaggtacttcccatctttctgctctgtcacccataagccttcatggggcaagaaggctgccacacatacaggcatcacatccaggaaaaaccatgtaggtaggacagcagaagatgttttctgatactcctcaggtgtctcttttttctgagacttcctctttttacatttcattgaccagaactgcaacacatacaccttcctaaacccatcactaccaggaggaattacatttgcacaactggcttagactaatttagttcaatttaaaatactgagcacccacacgccaaatgttctctactcttagctaaaaaaaaaataaatgaacaaaccaaatagatgacaagtattgtgtaaagctcagggacatacaggcagtgatgtaaatgggaaattaaaatctcttgttaaacaaatgatca

SEQ ID NO: 53388 - DNA, 1286 bp, Bovine  19866880626397
cccacgttttttaactggagattacaatatgatgaggaacatttcaaataagcaagaaagtgatgacctaatcaattaaaaatattacataattaattgaaattttttaaaaatgaaattaatgttctgcctcacatcataccctaataagttacaaatggattaaagattagttattaaagtgttggaaccttacattatttgaaatttgtattttcctcctgcatttgttggttgattggtttagcatggggcatggggtggatgctgcctcctgtaggacccaggtactgtttcctcactttctggggtgttgactgccaatggctcacagctgcattccttgggtaaaatgccctcagttcagtggctctggactgcgagtacttatgcccctaggagacatgggcaatgtctggaggcattttgatgactggtggtgaggaggagaatgctactggcatttagtaggtagaggccaggaaggttgctaaccatcctgtaatacacaggacagctcttcccctcaacaaggaattgtctggtccaaaatgcagtaatgtcaccgtggagaaatcctgacctggccaaaggaagctgtcttgcccagtgtcccacctccttcccagggccagtccacacccagcgcagtgctacaaagccctggcccctttgcctcgatttggaataactcagaagggcctggccagcaccagcacatcttacaggactgactaaagtctctgtggcacctgcattgcagtttaatttcccttctgccccatcctgcttccctcactttcttataggtgttgttttgataaattccccaataaacatcctgcaagcaaatctctacctcaggggtttatttctcaggaacccaagacaccaggaatggtcctaggaaactgcaataggattttgaggttggtttatgcactgtccaactggtaattaggatcccatgactggtgccaagtgaaggatggacaggcctggcatgatactaatgtgattgttagaacttttacaggtagtgagctggagcatgtgccagtggaaggggatgcactgacaggtacaaaatcttaggcattgtcaaggaacaggaaaagtgctccttacaaagactgtagaattggctgactattgctggctattatcaatactttagagaaagacaatgaaaggcagagagataaattatcaccaattaaaggcaaactgtgaaattcagagggcctccttgactgttcttgtagctggagggcagaaaatgctga

SEQ ID NO: 53389 - DNA, 1063 bp, Bovine  19866880728676
cagaataactattatgtacacaggtgttgactaccagcagatatacaaaatgaaataaaagaatatggttgttttgactttcctggtggctcagctggtagagtctgcccgcaacgcgagagaccaagtttcgatctctgggttgggaagataccctggagaaggaaatggcaaccctctacagtattcttgcctggagaatccaatggatggagaaacctgttaggttaccatccatggggtcacaaagagtgggacacaactgaatgactttacttttgctttcgctctacagctctaaattcaagaatgtgaattgtgactgttatcacatcacataagcttaaaatttccttttgtccacttgctatctgttctcttggaagaaaaacttctctggcaagaagtgttagtcaatatggaaaatactcattcgcataaattccaacttttaacttagaaagcaagaaaaaatatatctatgtctccaacttggttgggaccagttgaaagttcctcataaacccataaatggacataggctttggtttccttgagggtttctgaaatgaatccattacattaaaatggctcttagtagcaaaagcaagtaatgatttgcattataagctaataaaatgggggattaggcatatctgtacaataagatcttttttattcacttttatagagattctctccctatccctgcttaaatgaacttggaagattattcaccattcagtattgtttaaattataaggcaccaagctgtcatctggtttttaaatatttttcccctttggtaatgtagatgagtaatgtctatctccattctttaagaatacactaatataatgacagtctaattttgaaaaaaaattagtttttcttaatatctcacagctaaagatttcctgacatattagaaacagaatattcttccaaactacacttttccagccatcttgaacattcatagttcagtgaattgtacttttcattcctattcaagaagtgctacaagtcctctcacataagtaaatctcctgggagaagactt

SEQ ID NO: 53390 - DNA, 1633 bp, Bovine  19866880916735
caagggtgtctcttagctgagttctgtccaggaaatttactctttctactgctttacagagacagatagctttgatgagaaatactttagaatgcttatcttacaagtacaagaaaagactatgttaggatgtgaatttttttctgactatagagcctattcaatgcatagcaatatttgtgtttacattttaaaaatctgatctatttgcttgtcagctttggagcattcgctgcaaatgttcactgctcccatgaaaagcagtttcaataaataacagcctgaaatgggctccgttgcagttaatttgatttataggaattagaataataatgctctaaaacgcatattaaaataactctgcttatctctaacattgttatttcttaaagcaaacaatttagatagaaacgtcatttgataaaaataattggttcacgtaaaatgggactcacattcttttgccagactcagcagctactcttcagtggtacttcattagacgcgattctcattcatcttgaagtcttaagaaaagagccaccttctttatttttaaaaattatttttttaaaagtaaacaaatgcagggaagatggaataaaatttctaacagaatttacttactgttattcaattctttaaacattttcctaggggacaggaatgtcatatgtttagtttcaggacaaaggcacctttttaaatgacaagctttaagaaaatctatgaagaagtttgtttaatagaaagtaggctaactaaacttttggttataaaaattatctacattacaaaattagaaaataactaatatctaatgaactttagaactaatgtaaggttaatctttaataaagagtatccttaaaaaaaaaaaaaaaaggcagttacaagcaacttctagaattcattttgggtaacatgtccagggacacattgttttattgtttttctttggttttctatggtaaagctgattaaagttgggagttaagaaaatctatataacttgagaacgttttcaggtagtggttttatgcagggctagtgttatgcagtttaaaaccaaaaccttagagtcatataacattaattaactcatttattaattgtggattattattactgctattattattttgcctgagaaatgaccaaactatatacaagccaggaattaattcaggttcttggcaatggtttaaagtttctttaatagattagaaattaattaaaagccccttgtatgtgattcattaatattcatatttatattttgagactcaaatgaatttaaaaattgaagatcgttaaatgattttagctacatgttgtgttatggcaaaaatatatattgtaaggtttttcatttaagagagtatttacatttatgttgctttttaatagaaagttgctaaatgtaaaaacatttgttaatatgttttatttgttaatgaaaatgatttcatagacattaataaatcttcactttcttgactactttctaacattttaaatttattttagaatacagatatttatttttaaagggataagtaaatatatttagaattctcattcacttcagtgaaagagagtttaaaatctccaacaggatagtgaacttttt

SEQ ID NO: 53391 - DNA, 1077 bp, Bovine  19866880937501
cgttgagtctgtggtgcctaggtgtctggatgcatctgtagcttccctctcactcatcagtgtaattgttgccatgttattccattttttgattagtctagtccctcaagctcaatgcttttttctggcccaacggtcttctgctggttgtcatggtgactgaattgttagcgaggagaaaggctctgttgtctgtcattgttctgttgtggtttaggtaacgcaggaggcaacacaagtgaagtggatggaccttttttgctctgcatcatttcatagtattgaaaaatctcacataaaaaaggagcaaataggcccaaccaaagaaataaccaagctctttctaaaggaaagtgcacattattataaagaggcaaaatagcactaatgatgaactgagtaatctatgaaaatgctgctgaatattacatttattactagaacaatcgctgcaacttaaacatcacatacaatacctaccattttgcaatttagagtaaatatagtttttaactatacaattgtagcatcaactctttgattctcgaggctctgctactttaaccttacgttctgtttaaccccaagatagcatggtggaagttaggactgaagccaaatggaagagttgggcaaattttcttttggtggtgagatagtgttggggccaatttctactttgggaatgtggaaataagtttttaaagatgagggattactaaaaaaaaaaaaaaatttttttatttaaatggttttttgaagctaaccaatataaatataatcattcttaatttttaattttctagatttttaaccagaaaatggagagatatagcatataaataagggatacattatagacagggaccaaattaataacagttcctaaaaaaaaaaaacactcttaatctttgttcatcattacattgctagacatatatctgcacaaatcagcaattactttcattagcattggtacaattttcctgtgaactttttcatttgttttatttgaacttgaaatgatctagtttaatttttatttaactgtttaatttagttcttaatgatataaag

SEQ ID NO: 53392 - DNA, 1117 bp, Bovine  19866880978254
actaatcaatagccgcagacaatgcaatgtgccaaacaaattgcaaatcaattagaatccttgttttctttgaaatggttcactatatctaaagcaattactccttcattagacctaatttaacagcatgactgccctggctacaactggcagcgtctggctatcaaatggaagaatggcagcttatttctgtctgtctagcaccaatcaaaaaaaaaaaaaatttgaattcctttatatgagagaaacttttaatgaatgggtggatatttgtcttaatcaaaatatcagtacccaaatgacgatacctccctccaaggaaaattaaaagagaaaagaaccacaagaattactgaataagaatctgtgattaaaaaatgtttttcttcttattctactaagcctcatgtaaagacgacatttaagtaggtaaagtctttttagcttttcaacctaacacatctcttgataccagtttgaggacatttgagcagagaagcctcctgaaaccttccagaattcagaatactcttgtaaaatgatcgctcaaaaaagttctagttcactttatttgtaaagctatttaaaaaacagctttattgtgatatgatttacatacaataaaattcacccacttaaaatgtacatttgatgaattctgacacatgtgtacagtcatataaccaccgcctcaatcaagatatacaatatttctatcactccgataagttcccatgtctcctttagcagaaggttcctgcccttcatccctggcaccaggcaacgtaggtctgctttctgtcagcccatttcatttttaggaataggttcccatcctgtggaggatatgggactagaaaaataacggaaataaggtttttctgctgttacagggggaaatgattttatatgactggaacagcaagtaacaatctctcagaactgaagaataagatgacaaatttgggaaagtagatatgcttaaggagatcaaaccatttcagaagccaaggtaaaaattcctaaatgaactgaaaaactcttaatagtcccaactcccattattaaatcattaaacctcagaggctgatcacagctccaagaattatcttttaat

SEQ ID NO: 53393 - DNA, 1309 bp, Bovine  19866881008557
ttcctgcaggaggcagggctcctgtgggtttgtgtatagaatacaggaatccgttaatttggatgagaaaaaatgaatctttatttttattacccctttcaattatagatacaagcaacaaaaataatgactatcagtacctgtgattgtgttaccaatggaaatcacaggattttaaaaataacacactaaattattatcgatattcaaaacttcagtattcattatgactaaaaaattataggagttgctacttttgtgcatagaccttattattaatatttaaagcagtaagttcattaacattaaatcatcatagaattgcttgtatacaaatttgctttttaagtcttttgataactttatttcagtataatagattttctttgtaatcctgagtgttttattttatgcatgtaaaagcattctgagaagagatccacaggtttcatcagtttgccagaggattctatggcacacacaaaagaaaaagttatgaatttggactaaaggaagatctgagctcatgtagatataatttactttcccaaatcaatggtctccagagcaagataggcagaactctcctcactttgtcttctcaatgcctgcttccaactgaagacggacttgttatgaattccaagttgcttttaatattcctcttaacctgaattttggttggttagaattgtttcaaggaagtgtgatttctggaggagaagtgtgaagtcttgaggaacacccaggagagtataaatggtaaaagaaaaagagttaagaccagagcccaagtttgccttcacttcttggctccattttcaaaccctttgtggttaggatcactgtaaaagccaatagggcacaaaaactatattacataaaagtgttgttgtttagtcatgtcccacggactgtagcccaccagtctcctctgtccatgggattctccaggcaagaatactggagtgggttgccatttccttcttcaacataaaaatactaagtgtataagtatgttgggtcagatagcaaaattgtgtttatttgatatgttagatgcaatccctgggcattagctcctgtgaattctgctcccctctcccaccttgttggtgagcttgggagctcaggaaaagatgggctctggcttaggaaggaggtaaccagtgcagagaaaagggaactttttactgcgcacactcctttgttatttgtgagcttccaagggctctgggaaggttgtgaggaggcaaggggcctaaagatgggggattgcatgctggaaaacaggtgccttgctgggtgg

SEQ ID NO: 53394 - DNA, 1498 bp, Bovine  19866881053262
cttctttgatcatgctagcttaaaattgctttgaacccttcctttgtcctgcggtcaaataccctggtgcccatcccctgtcctaccttgcatctgggtgtggcaccccatcacttcattgctttgctggttcctcctgttttggtgctcgggctaatgcctgctctcattttcctgctaggagattctgcaaaccatggctaaacatacctagccttggctattctgtttccaacaacccactgtctggagacccttcagtatccaatgaactagacatagccaaagagagggtacaagagggaagagaagtgtgagaagacaggaaaattagttaaggagggatccagaggagtagccgtcagagacgggaagcacagagcagctcagggtcatggacgccttggaagagaaaactcttaaatatacccaatgctacagagaattcaggaaggtgaaaggttgttatgcagccattggatttgatgatgcgactggtaatgacagcctgcaatgagcaattttagcggagtggtgaggatgcaaagagctaaggattgtacagtccaatgtgatttgggtggtgaggcagtggaaacatgtatgggctcgcttcttaacaatttgggagtcgaaggaaagcgagaggtagggtggtgccttaaaggaatagcagggtcaggagaaggttggtgcctttttgaatgaccaaatgcttcacccatacacatctttcatcactaaagactgatgaaatgcagttatgctgcggttgctgggcactgggataatgcatacagtcaacattctgaaacacttcttgaaagagcacttgaatcataacctaaatttttaggaggggcagtgatttcttatccaccatatcttgatcaaacttcagatagccttaacctaatatttgaaaagcgaatagtttaaactcatttgttgagttgttcctttgcagtggggtaatagccaaacagtgacaaccaaacagagaattttgcaagcagagcacctctactggtggcggcagctgctctggatgaaaggcatggacttgacactgagaaactagaggaaaggctcgaagggagaggacaaggaacttcttggtgacttctacacacacacacacacacacacacccctcccacaccacatacacctccacctgctcaccctacacccccctcacacacacacccacactcccacccacccatcctgtactactggtctacctccctgtgtcacacacaccaacccacccacctacccatcatgtacttctggtctacctccctgtgtgtgttgtgcctgctgaggcttaagcctgcccacactctgcgatcattctgcttccagtggaggatacaaacaagagaccctgacctatttctccagattctttgcctgactgcctctcagagtctgctgcccagacaattccagaccctttggtaccctctcctctactcctttattgatgagt

SEQ ID NO: 53395 - DNA, 749 bp, Bovine  19866881088812
atgtgtaacacctgagagcaggaaaagacagttgttccagctcactaaaggagagagaatttgtctttccattctacttgggttcccaatggattggatgatgcctacctgcattggtaagagagatctttacttaaacaccttcacagatacactcagaactagtgttttaccaataatctgggcatttcttagcccaggcaggctgacacatacaatttgctatcaaagagatactgtaacttcttgatgcctgtattcccaaactgggatacatttaccaccggtcttcaaggacatatacataaagatatttattttaatggctataaatttattttgtatcagaaaaattaatgatcaatatattaaacatgaatattgtttcttaggatgagtcttagatatgaagcagtaactaatttggtttaaagtccttttaaagagaaccataaagtaaataatgaacaaacaatgtgtagatatggccagaaatatggtatacaaaagttcaagatttgggaaatgttgctccatacaatatacgtatttctaaaaagtacaacgtgttttcaaattaaattgctttaaaacttttagaaaaagtcaccaatttaaaaaaaacctaaaagaagtcttttcataacttgaatcatcaccatagtataatcattctttactgtaaagatctcaaaatttcatgttttggtttcaagttgctttaagagaaagacatatgtattcaagtt

SEQ ID NO: 53396 - DNA, 885 bp, Bovine  19866880163656
ctgtccccaatccctccaagcatcagagtcttctcaaatgagtcaattcttcgcatgaggtggccaaagtactggagtttcagctttagcatcattccttccaaagaaatcccagggctgatctccttcagaatggactggttggatctccttgaagtccaagggactctcaagagtcttctccaacaccacagttcaaaagcatcaagtcttcggtgctcagccttcttcacagtccaactctcacatccatacatgaccacaggaaaaaccatagccttgactagacggacctttgttggcaaagtaatgtcttggcttttgaatatgctatctaggttggtcataactttccttccaaggagtaagtgtcttttaatttcatggctgtaatcaccatctgcagtgattttggagcccccaaaaataaagtctgacactgtttccactgtttccccatctatttcccatgaagtgatgggaccagatgtttagcaattcttgaattcaaaatagctatccagtatttttttgctttccaagtgacaaaatgttttattgcccctttcaaaaattgtgtctagaaattaaaaataaaataaaaatttgggtggtatattctttgatacagataaaagtcctcccattgactgtctggggggagaatatatatagtttatttcattgtttatagtatttaactgaaagttctacatttggggaactggcttcttaacttgaagaattttccaattgagatgcattcatttcattttggtggaagaggtgattccagtgctataatggctttttggataataaccaatttatatctaactcagcaatattatcctaacacttatctgctaattttcctcttaatag

SEQ ID NO: 53397 - DNA, 1765 bp, Bovine  19866880424295
ttcccaagaaatgctgattctacttaagagatcatattctgaaaaccaatgatgtagttaattgttgtcagggaaaaccctattactaagtttatgtttgacattctctgttgttataataactaaaatttctttgaggttttaattaggttagtaatgtggtcatgtgtgtgccaagtcgcttcagtcgtgtctgactctttgcgactctacggaactcaggctcctctgtccatgggattttccaggcaagaatactggagtggattgccatgccgtcctccaggggatcttccacacccaggaatcaaacctgtgtctctaacgtttcctgcattgacaggcagtttctttatcactagcaccaagaatcatagctaaatctttttcttcaagacacttgaatatcaagctagtgattacacagtgatgatggcagatcagaagccagaatggagtttgttgcctaatgactcagtgacttcatatgtaagagactcttctgttggtatttcaggcccaaagtgtcattctgaagccctcccacttttaagggtagcaacctcttttgtacattcaatacttactctgcttctctgtacctccttaaatgaactaattactattcctcaaagatttagaggagtctgtgtaaagaaatgaaaaatttcttggtttcttctaagtggcttggatcctaggaatgcaaacagatgactacagatcacaaatggtgtgatctgccttgatgaaactgcaaagaatcttgagaagaataagaattctaagataagaaatgcattgaaacacatctgttagttggagagtgagagcatggtatatacatggttcttcttttcaggatagtacccaaaagaaaggtggattctagaagttataagagaaatatttccagttcaagcacatctccaaagaatagaaaaaaagtaagctcctatctgatacttaagaagtgcctgacaactcagttcatctcaaactgtgcttttgtatctaaaaaagcccagctacaaattgcctttattaggctgaggggtatttagcccaaactagagtgcacgttcttttatgtgaatgaacacctttaggaagcaagacaaagtgaaattttaaaaatagagcttcaaagtctaaataacgaatggaaagcccattagatttggtcagttctctatcttcaggatcatgcaattgatctactgcacacagattaactctgatgcactaccacttattgtctagataatcttgtatttgcctgcacagcactccacctggcttcttggataacaatagtcagaaaatgagagaggctgtggcaaagccctggataaagcgagacagggctgtttgtttctcatacctcactgtcttctcaggttttcctctctccgcctttcatttttatgtttgccaaagaagagaattaatagagtggaagttttaaatgtgaggcaagcttcagtggcatcgacggttttttgcgaccaactcttagctgaggggcaggtcgctgagggtctgtctaaacgcaagttggtctcggtggaaggcttttctgagagggtaattattatttgccaactgctggaaagcagacattttgcatgtctttactttagaaatctttttcatctatttattctcctgtttggacagaacagcgattttaaataaccaggaaaataagtcattctctgaacttatacagcaagtgtcattcattatatgctctgatcttcag

SEQ ID NO: 53398 - DNA, 1871 bp, Bovine  19866880480977
aagagaagtgaaaaggaaaggagaaaggaaaaatatacccaaatgaatgtagagttcaagagaatagcaaggagggataaaaatacttttttttttaaaattaacaaagcaaaaaatagaggaaaacaatagaatgcaaaaaactagagatctcatcaagaaaattggagctatcaagggaatatttcatgacaggatggggcaataaaggacagaatctaacagaagcagaaaagtttaaaaagaggtgtcaaggatacacagatgaagcatacaaaaagtcttattgacctagacaaccacgatgttgtggtcactcacctagagacagacgtattagagtgtgatatcatgtggaccttaagcatctttactacaaagctagtggaggtgatggaattctagctgagccactgaaaatcccaaaagatgatgccgtgaaagtgctgcacacaatatgtccatatatttggaaaacacgcagtggccacaggactggaaaaggttagttttcatttcaatcccaaagaaggggaatgccaaagaatgtttaaatttcaataaacttttcaattactttgtattattactgagtaaatttaagctttcatcatgacccacgattccttctataaacagggtcccagtttaattctccaaaagcacatgccactgctttctgatcttgcatattttctttaataacagttaacataaataaaaagtgctttaaacaaggccgactttactaaacttccaggccttcaaatatattgttccctctgcctggattttcaccccttccctggcttctcactctcttccttgaccccttaaggagtttcccatttttcaagggttgatttcagtgtcattttccctcagcaactttccttgtgaacctcaatggagcaatccctctttcatttctttatccccatagacacttacattccacacttcataaagtgtgcttttgtctaaatggcttttccccactcctgtgtctttataaatatgtttcctattagaaaacctgacatctagtaggcactcagtaatttgtacattatgaattgtattgtagttggtcaaaccaaaagaagtgcttgaaatttagaaatgagaaggtaaacagaagaatactccactgggggtactttgctaatggtaaagcagtggcagtgacgataataataacaacatatattagtgatatctaatgctcaccctagtcatagtgtacaatagcacagatgctcatcacttcctgtgtaccaaatattgtgtaatttttggaggggatgtgcatgaaatatcccatttcatcttgacaacagataccacaactgaaacgtaaacagttaaaaaaaaaaaactttcagaatcacacagctaggaagtggtgaagatgggattcaatccatggctgtctgatcccagagttcattttaataactattaattatcccaccccctgaatccccattgcccagtacaacttaaattatattttcattgaacatctattttttgtttaaaataccaaattaatgagttctttgtatttatttagacccagaacatttatctctgtattgacataatcttagcctgcagattttctttaaaaaaaaaagtcctcaatactttgaaaagggactgacctcaacaaagctttcatttgaaacatttaaacagtcacatatcacatatacacaccaaacaaattttcaaataataccagctccttctcccaaagtaatattcatcaatttctccacttgactgtttggtctattcaatacaattatgggagatttgaaatacacaatagatattgattcagcctctcacatagagaccatttt

SEQ ID NO: 53399 - DNA, 1160 bp, Bovine  19866880481912
cttttcgcatgaggtggccaagtactggagtttcagctttagcatcattccttccaaagaaatcccagggctgatctccttcagaatggactggttggatctccttgcagtccaagggactctcaagagtcttctccaacaccacagttcagaagcatcaattcttcagtgctcagctttctgcacagtccaactgtcacatccacacacgaccacagtaaaaaccatagccttgactagatggacctttgttgggaatgtaatgtctctgctttttaatatgctatctaggttggtcacaactttcctttcaaggagtaagcgtcttttaatttcatggctgcaatcactatctacagtgattttgaagtcatgtctaattctttgtgaccccatggactatacagtccatggaattctccaggccagaatactggagtgcgtagctttcccttctccaggggatctttccaactcaggaatagaacctagttctcccacactgcttgcaattctttataagcaaatcatttatttaattttaacttgtatcatagctgcttaagtagatttgcttgactcagttactgtgattttcttttacctttacttttacaaaatatctctcaaataaaatcctttgaaaatgctaaagcacaaatcaaattgcattattatttctatatcatgcatacatacatatacaccttcaaaaaaaaaagagagaattaatttaatctcatgcttgtttcagttaaatctgagcataaaatgtatcttttacatctcagaatcaagattatggtcttagttgaaaatcatttgggttctgtaaaaaggtcacagatgaagatgctatcatacaataaatgctaatttgttttgtaagctgaaaatgtatgcaccaaaatttggtttccaatgtgagtggagagatcagaaaagaaagcaacagcggctaggtttttgctaaaatgacgatcttagtgctggatatcagagcttacaaagccaaaatcggttatagtcatgaaaatgtcttctttcgttttttagatattaatattattagcatagaatcatattttaacttcatttcaaaaatcaatgaatgcaatcttattgaagaatacaagtttctagcagtattaaaagtagat

SEQ ID NO: 53400 - DNA, 1472 bp, Bovine  19866880624058
tatgatccttcatgtcaatgatccacaattgctttaggtagattcttaaaaactttatatccatttctttatatttgtagtctctttcactcttctacatccaggtaaacagtgatgatgtgatcagctttatcacctaaatataaatgactctgataaaaaacaaacaaacaaacatgtgtccctagaattaaaagttcagcctttttttgacatatgtgtcaagacaatccaagagttgcccttgcgatagataattagggaaaactgtcaagcttgcagcttaatcctgtgtacgtctgctcaaagtcagctctgaaaactatggaatctaggaagacaatcttttgtaattagccaaggccactataatccataaaaacatgtgatcaaattgatttctagtccatcaagtggtatctgtcaacaacaaccttcccaatcatcttggagctgtgaatacctcatgtaaacttctaggtcatttaaagtttcctttcctttgtaaatataaaatcattttcactttttgacagactttctgttcaagtgggacagttgggtagagggaaagtaggaaaaatatggactgtcagtagcattcacaagcataaacattagagaggcagaaatacacaaaatgtcttcggtaaggttagtgctataactaagtatctaacaatatgtgtaactttgtatatgaaggctgataattataacatgtccatattgagtctgttgcataagagactttgctcttatggtgcgcattgctgaatgatgcacctatgcctgtcttgctacttggaggcagtactttcatcttattccacatctgttattctttccaagctctagtctctagacagtctcaaatataatccctaaatctttcttaaactcaggttttcagaatggattggattatgccactttcctgcctctttcttgtctgccaggtgcattctgattcttttcgagcctggttgtcctacgcacttcacgttctaaactcagtgacttccccctcttactttcttgatggttatatacagtgccgctcatatagaaaattaaattatcttcatttgcctcaaaatgccaaactcagatcagcttcaaatctcccccacctcttctggatcttaatttgatatgctgttaattacctttatactggagaagtaaatggcaacccactccaggactcttgcctgaaaaatcccatggacacagaagcctggtaggctacagtccatgtggatgcaaagagtcagacatgactgagcaacttcactttctctttaattacctttcaatgtgtatagtttagtgaaatagttgaacactttgcttcactttgttttccctcaaccaggctctctgacaactcctaagaatgtgccgcattccttcttgcaactttcctttcttatcctatgtgctaagacatttttctgccatctttttca

SEQ ID NO: 53401 - DNA, 5030 bp, Bovine  19866880680649
taaccaactgggcattaatttccaaatttgatcatctgacaaagtcatgatgatctttttgagtactatttcatcttataaaccaacaatcagaaacaaatcatattgcattatattgattaaagtccatcaatctaagtatgtcagctattttttttaatcaatgaatgatttatttatctgttgcaacaaatgacatcatttgatccccttaacaattttctggggccagaacattcacttatcatatgacatgagatgtgtgaattcctctgagcttgaggtgtctttaaattttttttttaatataaatttattttagttggaggctaactactttacaatattgtattggttttgccatacatcaatatagtgaagtaagccagaaagaaaaacaccaatacagtatactaatgcatatatatggaatttagaaagatggtaataataaccttgtatgtgagacagcaaaagagacacagatgtatagaacagtcttttgggctctgtgggagagggcgagggtgggatgatttgggagaatggctttgaaacatgtataatatcatatgtgaaatgaattttcagctatttttaatctttgcttctcattcttgtttgtttgttttggttgattgtttctttttccagaaaaacaagttatgacagatatcaaatatttataatttctaagagaagcaactaaaacttgagaaaatactgtccattctgaaaactatcaaactctgcatattttgaccttggtgggagaatatctgggactaagttatacaatatataatcttaggtatacctgtggcggattcatttcgatatttggcaaaactaatacaatattgtaaagtttaaaaataaaataaaattaaaaaaaaaaaaaaagaagcagagctttgttaaatagtattggattgaccaaataaatgtgtgttgtcactgaggtgtgtctgattctctgtgaccccataggctgtagccccccaggctcctcttcccatggaattttccatgcaagaatattgaaacagcttgccacttcctactccaggggatcttcctgacccagggattgaacccacatctcttgcatctcctgcatttgtaggtggattctttaccactgtgccacctggaaagcaaccaaataaataccattgaccaaatattttgatgtttttagtttggtactcagaaagctggagatactgtctcctattaccctaagataggacctctttattcacaaagaagaaagtcaaagtctcattttcattaatgtttcaccaggggtgtcttctgcaggtaaaatatcacaactctactaccttaaagagtgtaaaatttcaaacagttgtcccaatgctgcacttaaggagaggtggggagtatcgtgtgtggatccctttatagtcttgacactccccaagagagaaggcatcctactatctcatccttctgttctagtagtcttttcagatttgcttcatccagtatctgccccctccctctcttttcaggtgcatcatttgccctacaaaataatcaatgaatacattcatgacttcagtaatagtgtctgtgttttagtcctttcctattcttcctgggttttgtgaattctatacattcaggtatcaagtatttatcttgttttagctttatgctggctccaaagaagagctccattgcttctgtttcctgcagcctcttcctggaataatacatggtagtgagttttagatcctaggaaaattttattcagtaatttttaagacaccttatttttttgttctagaagaataatataagtatagcctaaaaaatgggataggttataactgtttgtgaatgtctcatgaaaagaaagaaatgagatcttattatttaatcattttctgtgcataatcagtgcaaaggcaatcaagacaaactgataattcagccctaactgatcttaatattttcttcactggttcccaacctcatccactgcattatagttctgtggaataataataatactatattctaaaggtactcatagagggaaggggtaataagccaatgtaaattttaggagaaaagtgcatttgagttcatccctaagaaattaagatggcacacaacaggaggaaggccagtctaggagattcacagacacagagattctcagggaagtacaaatagtgtgtgatttcatgacagtgacatcagaccaaggtttcattttaaaattattgaagatttaggatggggccaggtgacagaactggcaaagtcaagtatgttttggcttttatgtcaaaaaggtagataatcactatagacttttaagaaatggaatgacaataaaaagttgtgttaaagaataacttgggacagttctcacagcagatcacagaagagagaattcatttgaggaataaataaatcttcagttctccagcactaacctacgatgttactgcagaataattaagtgtgttgaaacttaaccacttttgtggaaatggcccgttatcttcagtgtgtatttaattacttgaattttcttgagaatgtcacattatttttctttatttccttaaagttttaaattcttatagctttcttagagactttcatgatggtctctgcaaagaaatgagtgagatgaagggactgacttcattaggtgtggttcatttatatctatcctggtaaaacagggacactgagatatcaaattcaatggtgtgtgaattaggatcagcgagggacagagaaccatgtaaaaccatgagatgactcagcatgctcattatgttcagggtgcccttctgtacacaggtcacccgtggttaaagaactgaaggctctaccatctgaccatgcaaagagcaggctggacattgagggacttgggcttttcatgggaggggagttgacaggttactggggactgattgtgtgggacaaatagtaccagggaaatggtgatccttttctcccttaactagcaattgctattgtgtgtaaatgattaatggaaacttattcttggaaattgaagagagcagttttcttgaaaaatgttaatcaaaagaaccagaaagaggatggccatgtatctgtttcgtcattacctgctgcaatttacaatgtgcctctgttttattcagaatgtatcataagtcttgtgcactaataaaatttgtatcattttttccataaaaaaaaagaataacttctatttcttcctttgaggctgaaggtttatattctttgctttgtgttttaattatttagatgcttatttattttgtaattgactttgtaatcgtctcagatacccttgttattccattgtgtgaatgcctataaaactctgcagtgtagatcactggggtttccttgatggagctgttgaagttatcatttacagatgcctcctagcagccttgacaatagttgccaagaaaaagttcagccattccccaatagcagccacagggaaaagccagaaaggtgagctgcactggtatgaagaaggagtggtcttctcagagtctgcattaccagcaaagcaaagttctcttgtgccaattctgaaatgcattaattagttgaagaccaatcttgggtgaactttcctttcttatcattttttttctcacaatagtgtatgtggtgagtccctcagggagcaataaaacacttggataagccagttgtagattaaatatagactccctatggcaactcttatctcctgcctttcctcctgcttgcaaagatgcagagatgggattattgccacagctgtgcttcctagaagactaatcaatgcagctataagaaggtctgaaatgcagcaggattttcaattctaagggtaaaatttttaaaaagtgaggaagggaactgtcctgaaagttataatgccgctaaatcaaaacaccttttaaaaacagaaaataagactataaaaattgcctcattgtcctattttgagtatatatcaaactaggatctataaatcctatgtataatacaacagggaaggataaaggcaaaaggagacgaggaaaacaaaggatgagatggttagatagcatcaccaactcagtggatttcagtttgagcaaactctgggagataatgaagaacaaggaagcctggcatacttcagtccattggggcacaaagagtcagacacaattgagcaactgagtaacaataatacattagaccaaatcgtgaagtcaaggtcccagagaacatagtttctttactagaactttgcttatataagcaaaattggagttaggacatggttattctcaaaaaccatggatatacctctagaactgccaagttgactttgttgcctcttccatgatttcttggttgagcttttatgtcatggaaatatataagacaaattccaagtcatttgaggtacaaaatcataaagaagagtatggaatgtgcaaaaggggttctgaggaatatacaacctaaatttcatatagtagaaataaggattctgcctatacaggggctatttgtcaccaccatctttagggcttagaggttggttcccaatacctaagagcactcctcttttttcggtagggtgaatgaggccatcgtggagtgacggcagtgcaaaccagcaatgaatttggggatattgtgtaagtgaacaagaagttgtcagtgtaacttccatgtcattgatctaagtcaatctgcatatatgaattgggaatcccaatgtgcttgacattatgccgagcaaaccagacatggccctgtcttcttggagcttatcttgtagttgagaatgtaaatattgtaagcataattgtaataattccgatccaggaggaacagagaatgctaagatctaggaatagcagaaccctgggctacaaaggtggtgttaggctccctatctctccactttagaaagaacaagggatgggggaaatgccaacagatttgagacaaaaacaatagaaata

SEQ ID NO: 53402 - DNA, 1497 bp, Bovine  19866881198411
ctctcttccctacagtgagctagactttcaagatgtaatagaacattaaatgcagaaatactttgtaatgttttcagaacagtagatatttcaatccaaaagtgcagctgaatattcatggagcttttttatttaaccaaatgtatccttggaaaacacaaatttgggacaatagtcataatatctaaggcagcacaattatcatatgtataaatgtttgcttctttcatagctgctgtgttatatatacacacagacacacatgtggatatgcacgtgagattaaaagcacatttacagctctaattgtattccatgaatctttcactatatcctggctatgaaagctttcttaataaagaatataaagataaaatatccccatattgaagtcatttaaagattttctattgtgaacttatccctggtcagggcactgttgtggttagaaaaataatagaaggtgcttcttaaggactgagcacttcagcagagaatcaagaaacacatataagatatacgtgtgtacatagtcaatagggcatgatgagtgttttaattagtaacatagaatagccaattctgcacgtgttactgattatgcacatgtataaagtagctccagacaaatcactgaggccattcacaaattgccctccagattcctgacctttggagtttcaggaacaattctgtggctatttattcagtgcacagagaatttcggaataacactggcccagggtttttcagagcagcttgcattcctcctttggactttgccatgggtggaattgtgtagctctaatattcataggtaaaagctccagtgtgcctgttttgggagataggtaattaaatttaaatgaaattgtcatggtgcggccctgctttgattggaatggtgcccttctaaggagagataccagagagctctctctctttctctctctctctctgccaagtgaggacacagagagaagatggcaaagcaggaagagagtgctcctcaggacctgaaccagccagcagcttgacttgggtgtgccagcctccagaattttaagaaaatacatttctgctgtttagcctcctctcagtctgtgatatttggtatggcacccctacctgactaaaataggctttatcactgaaaagaacctaagggcatgatctactctttgactaaacttccctttgatgtctccactctggccatgatgattatatgtgctgggccaagacatgcaacacgccactgggtttgctctgtctccaaaaccagcacagctcatgcctcaccttcttcaagctatttaataaatgacaccttcctagtgaagacttcactgaccattttagatcgcatccctcttcaatattccctgtctgttttccctgtttttctcttttaaatttatattcaatttacatactgtatgttttactagttaatcaggtttattttttttttctttcctaacggaaagaaaatat

SEQ ID NO: 53403 - DNA, 1729 bp, Bovine  19866881422444
aatgaatgaacaacaatgagtggatggcaatccttagcatttttgagataaaaagagaaggggcaagcacttcaatgacttattttgtggataaaataactgacatccataagaaatattacttaggattacatggcttattagtccatgaaatgaagctaggtccagaaaacaccactatatcttctaggagaaaactcttaaatacatggatagtacttaaattccagcattatcaaaagtagatagatgggtaagaatagactttgaattatgatttaaatatcattgatgggatagagttcatgtgaaaaggaagagctaagcacaactttgttcaaggcttttggaaattcacaatttctgtatttctgcccgcccacttgtttatttgcaaaacaaaatttgcattagctctctcatataattctgtgattgctctaagcagtagactagggaatctgagaattgaatcaaagtgttattttcacaatgggatatgaaaatccctagctaaatgtatttgctggtagaaatgagaaagaaattggatatatcaataaaacatgagagcagtgtaaaagagcttatggtgtcaagacctggggatttcaccagtggaaagaccacaacagcagagagagagagagagatggacatatttatcataaattcatattttcctccaccctatgatgttggttgcctttgtgattttgttgattggtatctgagaacctgcatcatagcaagttgtaatctttcagattcacaattccatccccaattattacagcgaggtctaggccttagttttttcttcagttggaaagatgtttaaattaactttacttctttccctgtgctctttaccttaagggttctaagtgtcctctctattctatactttaaaggactagccagctatcatcataaacgtgtttaactttattttgttttctgagttttcttgtttagtaataattcaaattgcctttgctaccagaaaaatgaaaagataaactgaagagagactgagaaccagagcaagtgaagtgactgactctcctttctcttttcctaataggtgaattctatctgtttctagtgagagttctggtgagtgtatgtgagttcacacttgtgaatatatccatgtgtatgttaaagaagaaggcagtggcatatgagttttatagtgagctgtgaagctggactcaaactggcaaaagaaagcaacctagacaaaattgtaaagttaaagagaattccagaaaaacatctacttctgctttattgactatgccaaagccttttactgtgtggatcacaataaactggaaaattctgaaagtgggaataccagaccacgtgacctgactcttgagaaatttgtatgcaggtcaatagttagaactggacatggaacaacagactggttccaaatagaaaaaggagtacatcaaggctgtatattatcatcctgcttatttaacttatatgcttatttaacttatatgcatcatgagaaactggctggaggaagcacaagctggaatgaagaattgctgggagaaatctcaataacctcagatatgcagatggcaccacccttatggcagaaagtgaagaagaactaaagagcctgttgatgaaagtgaaagaggagagtgaaaaagttggcttaaagctcaacattcagaaactaagatcatggcatccagtccca

SEQ ID NO: 53404 - DNA, 1772 bp, Bovine  19866880340258
tttgacatcctctcgagtggggataggggattcttcttcatcactagaggaagtcttcactaacacttcagtggtttttgacttgttttttaaaccaaaatacagaagtggataaagatcttgaataaagaacctcacagtcaaattctactgagtctatgtgaataaggagtcaaacaatccagaagaatgtgaattccagaaccaatggttaattgtttgatctagttcttagagggttaggtgccacatcaaattaaaaactgcatggttcttgttctccaggaaactaaagatctattttggcctttgttttaaaagagaatccatgagacttcccttggctaagactctgtgttcccaacgcaggcaggtggggttcgatctctagtcagggaactagatcctttatgctgcaactgaagatcccacataccccaacaaatatcaaagatcccaggtgcagcaactaagacacagtgcagtcaaataaataaatattaaaacaacaacaacagaatcctcaagtggaccagcgttcatttagttttctgttttacacggaagcaatactcagcttccctttgcggggtggacattgtgaatgacctgaatgaatgctgggagcaatgactccttctgtttcagttgaatgatgtttagtgactttctagctgtctgactaccagacctaaaacagtgaaagatcctgtttgtgcctactttctgaaaatagcttccccaaaccctcagttttgatctaacacagagagtagtagagtagtcattcctgtctgaagttacattgtaacccgaaaagtagaggtcagttccacctgaaaaactgaagaagtctgaaaagagtaaaagaaaacatgtgcaaatagataatagcaacatatacaatgagaacatggaggaaatatttttaactaataattctgagtaatataaaatgaataaagaaacaatatttctaaatattatatgaaaagagaatttttaaaaagagaaaatgtctactatgagaataaagaaataaaagtaaaataaaagcagtgaaataacacccagcacattgactgaaaaatgccaaccaaagcagggggtgcaaaagcgtggttgacattttacatctagcatgtgagctttcctaaatttttctttcctatattttttctcatcaaacctttatagtcaaggaccaagactacatcatgctgtgaaaatgagagaggagaaaagatttaatgaccagaagctaataataataactacatggaatgaaaaggaatttggacaaagcaaactgttatatgacaaaatcatcttctaaaggtataagttaatctttttcatcattttattggaacaaaggacaaattgaaacataagcattagctactaaccttctgtcataaagatctgatctgtctctgtaattgctttaagaacagcttatttcaaagagagtaagaggaatataatatcacaaaccacaaaaatcaaagtaacttatttgttaagcaggtatgctaacaaaagaagttggaaagactcctctaaacactaaaatcagtggggtggccttctgagcctttatccaaagaaaacaaaaacactcattcgaaaagatatatgaactcctatgttcactgcagcattatttacaagagccacaatatgggagcaattgtgtctatcaacagatgaatggataaagaaaatgtgagaggataaatacatagaggttgagagggaaaaaatttttt

SEQ ID NO: 53405 - DNA, 3416 bp, Bovine  19866880473151
gatctttgttggcaaagtaatgtctctgcttttcaacatgctataactgattcattttgctggacagcagaaactataaataatacaatattgtaaaacaacaaaaactcattttaaaaaatgaaaataaaagagggatggaggcattcttgtgtcaagtctgtcctaactaaataatccggagaaggcaatggcaccccactccagtactcttgcctgggaaatcccatgaacggaggagcctggtgggctgcagtccatggggtcgctgagtcggatacgacggagcgatttcactttcacttttcattttcctgcattgcagaaggcaatggcaacccactccagtgttcttgcctagagaatcccagggacggtggagcctggtgggctgctgtctatggggtcgcacagagtcggacacgactgaagcgacttagcagcagcagcagaagctgaataatcagaatttctacctaggcggagagcaaagttttgctgggcttctgtggctctcccacactctgctcttctattgggctcacactgcatttagaactttcttcttaggttttgtcatgattcactgtgaggttcactggacacgcaagacctgtacagacccccaggactcccactgcaagatcttctcactgtccaaaagataaacactgacactgatactttgaaaaatagaaacatgaggaatggaattgaaaatgacttaatgccttcagaacttaaaaaagatttttaacaattgtaatcattatattaacaagatctgtaacttttatttgtgaacaccaaagaaaaatcctgtcctatagcatcattatcttgttaacaaactttgttggaactgattcgtgtataaggaattgagacacagcagaccacttgtgattttaacagaaattattttgctgatggaggctttcaccaggatgttacctacacatacatgccacatgcatgtttgtctactagaagaagtatgatagatactgtgttaggttctcccttctcttacggcccaaagaaagagaaaaaaaaaaaattctactgtcttagcagtttgaaagcaaatgaaaccagcttttcactttccaaagcattcctcttatttagaacactgtgcaattcaaattcacttgccagaatataaaatcagatcatttaagaggtgggggtggaagggggaacaattcaagggaaaaagaccgaaggaagccatgtgtcattaattcagttataaattattagccaaaagcagcctctcagcatttgtatttgatgaacaaaaattgattgcttcaagggcatttcagtccttttgatgttcccatcttttagcccaccacaaatctgaatccttaacagaatattatagcattatagtaatcctgagagccaatactaaaggatttgcaagagcaacggagatcaatagtttgaaaaaagaatgtctttttgaatcgacagtgctgtctcgcctgatcgtgaacctgaacaaaataagtgggggctaaatacacaagcaatcacccaggctgcgccaaggggctggaggagccaggactctcctgcttgaataggactgagcgctgaatatttctaaaggattaaaccctaactaatggcaacccaaagatattttgcaaacaatcagcctctccctcaaatagttaagataatacattatgggtcttggtttggtattcaaaagactgggttcagctacaggttcaacatttgcttttgcatagagtttgagattatgggaaattggattagaggtaacgttgtcttaatggctagctccttcggaccactttgaaacagagaatcccccgcagtatttcaggacagactggagagaaccatgttcttaacacacaacacattagaaaacccaatgggccagaattgtttaaagacacaattgcccacatctgatgggatttccaagttgtaacatcatttgatacctcaaaagacagcgaacggcagctgactgttaaagtctccttgaacaattcggggattagcataaaattagacataaaggaggtaagtacagcagtagcacttgcccaccacagtaggggtattgttagcaaacgcaaatggactcagtgaaagtgtgaaggcatcttaacattgtctgaggacctgcatgctttaacattgatgtatatattttccagttctttgtttcctcaacaagaggccagcttagtccactggagtgaggagacttcagatggcacacatctggagaacatcccatggaaaattgtgaatggctaagtaatctctttcagtaccaagacaaggagtggtaatttatggtttaacagactacaaaacctgccattaattctaacataacaaactttaaaccaaatgattcggaagactgagataggcaatagcaattaacagaaggaaagcagctcttccagatgacatgagtgtcacactgtctttcgaacacacaaaaaaacttttctccatcagagcttatattttcggccattgtgtgggatagtcttgttggcattacactgctcgaatggcattgatccccacatttctggcatctaaaagagtggctcaaattaaaagcatgttaaagtcacaatccctgagtgttgtgctggagcagatgaaacattttatttggaggctgtgcatgataacatgtgatccttaaagttaacctttttctcaagctgtttaaagtgttttgtagctgttcttgtccaaatgaatcaaaagaaggataagcaggaactggcataaataatagcggccttaaaagggggcagcaaaattgatagctctacaaatggtagccacctgtaccaggaaaactcaaagaaagagaataagtatttgaagagaaagaataattggagatgtgacagcaaagaatagaaatcactccccaggaggtgtttaaaaagctcttctctctcctacttaatcacagttcccttaagcccataaattaaaatgcagtgtgtatggtacacgcattataagtatgaatactcatgtaatctaaagcatcttaactttgcccagcttgttttcctactgccagagtcaattccattaatgatataagaacaacacaattttacagtgaactgttctctatcacattttcttacactttaattaaattatcatattgatggtgtgttacttaagacctcaacaaaattttggtttccctaactaataaagatttaccattcttccctttagcaaaagtataacagatatttcactaaatttgaaagaaacttgtaaaagagtaaagcacttgctggcaatttatcccccaagagttaaaatggtgcagcttgatgttgccaggttcagttacagctttactacattaa

SEQ ID NO: 53406 - DNA, 1623 bp, Bovine  19866880495721
ctttagtcgcgtccgactctgtgccaccccatagacggcagcccaccaggctcccccatccctgggattctccaggcaagaacactggagtgggttgccatttcctcctccaatgcatgaaagtgaaaagtcaaagtgaaatcactcagtcgtgtccgactcctagcgaccctatggactgcagcctaccaggctcctccgtccatgggattttccaggcaagagtactggagtggggtgccattgccttctccatttcagtagggtttaaaaagaattatatatataactatttaattctataggctctcagccttgcctacatttcagaatcacctatagagctctaaaaatcaccttcaaaatatagatattatgcgtcccacccaagagattatgatttaatagggatcaaagcatttggatcttgaaaaaattctacagtaattttgatgcaaaggctgaatgaaacccactaatataagtttcaatgaaaattttagcctactataaaaacttgtaggaaacttaaaattctaacaataagaaactggtgtaaaagtaatgaggacataagttggaataccacatagtgatttaaaataatgtcgtaaaaatatgtctattgacatagaaagatgtaagtatatatatatatataaacacacaaaaaaagtatttatggatataattctatttttgtaaaatcaaaacacatatgcacccatatgtatagaatggaactaattttggttggctatagttactccttatgctgctccttttgtatgcctatattatttgatatttctgaatgacttcatatgacttacatatatataaaataaagcaacttcactttggtgatgaaaaggctaaccttaaataatatatgtactttaaatgaagaaatatttcattctgagataaagcagttatagcaaagttttaactaatggtaaatcaaaacagaagggaattactattcatgcatcttttccatagggctgcaattattcaaaatttaaaagttgagggaaagttagtttagaatttggtcctatactcaaataatattctattttattataggctgaccatttgatatgtcaatacatgaatcctttaaaacaacttacttgagtcagcttacataaggtaaatcaaatatgagctaaaatagctaaaataaacatataattatagaaatatacacaaaatttttgtaaatatgttcaatgtgtaaagaaatacatgtatatgtattttttaatttaaattcccctatttcattagtaaccaactgcatgtatctctttactgtattaaccgacttttaaaaataatttttccaatacaaatgcattcaaaatcataccaagcatcaaaactatcaactttataaaatgaaaatcttacctcatctaagtcttggatataaactggtttttcctcaaagccaattggcattggttcagtataaggaatctttacttcttcatatatccttgggtgttctctctttggattccttctggtaaaatcatctacaaacatcaaaaatttaaaatccaataataatacaaaatagaataacgtctctggtaaagattctttaattaa

SEQ ID NO: 53407 - DNA, 1168 bp, Bovine  19866880542421
tgtgtctgtctgtctctctctttctctctgtccctcttccctataagaaagacatgataatgaaaacctattccttcaggaggagctggtttagaaacaaatggattccatggcaactcctgactccacatgacttctaataactggcatttcagttggaaattgtctatgtgatattctgtccaacgctggtgctttatgtggggttttccctactttacatctcagaaatggagtcttaacctccagtttcatgaataagcagcagcagcagcagcaatatgtcaccacctgtaaccataatgtggccattgatttgtcaagtgtttctggttccaattttcagactagctgacagagatgaacactgaatgagaaatgttcagagctggtattacatagtgtagaaatctgggaggtgtgtttcacagcaaattgacagcgagtcaaatgttattcaactgaagagaatgtgtgtctcaaagcctggacagcacgtcatgactgttggactgaccacagaggaaagctgaacaaggacaaaaatagccagccagagttccctcttcctcattaaaggaaaccaaaatggtttgagcttggctagggctcagtgatctgctgatctcccaatgagtattggcaccacggttgcagtgactgttgcgggggggacaaaaaagaaatttgtaacaggatgagtttgtaataccttgtgtctaagtattttgtattttttcctgtgacccaggaaaaaattgtgtcaaaaaagggtcaagtgattgctcttagaaacaatgcaagtcaatgatggaatcagtgcaaaggtcaaaaggagccaagcttgtgttcctgaacttggtggagagcttctgggtccaggtggggggcttgtgctccacctgggcaggtcaagattgaaattcagctatgactcagtcccatgtcctacccagggaagataccttttcctaagttgcacaaaggtgctctgtggagtagcctcttgttgggctaacactgccccacttgttgaatctaggctgtgtgacacattcgaggaatgtttattatgaccctttggaaatcatcatgcagggggtttcagtggttaactccagttgccagtgttagtcagagcaaccagcaaataatgatttactctagg

SEQ ID NO: 53408 - DNA, 753 bp, Bovine  19866880562620
catggaatacatatccaaactaagccaacgtaattaatgactggaggaagactataattctgagttaaattcaccctttcttctaattttgatttaccaccagtgaatatcaatatgatggtggtgaaatagtatattcattagagaataactggattttatctgcaattaggaagcatttacagggtataaagcagagttctaaagaaaagacaagatctcacagaatctgtaagctatgtggaccacacagctgtgaagtttgtaggaagagctgtgaccacatgcatttgattctcagtctatgttctcagcaggaccgattcagcctccaaactgttaagatagtaactcataaatgctatctattaacttaggaacaaggacttagaaggatttgataagaggaacatactgtatacaacatcaccctattattaaaagtagtctataagtttcctcatgtctaatttattccaaaaactaaattaaaaaaatagtttaaaaaaatcatagcaaaatagtagtatcaaatggaaactcatctgaatactaaattgattaacaacataaagatcattagtatcagtagaaaagaggtataaagaaagtaaaataattacaggggataaaattaattttccttcagttcagttcagttgttcagtcgtttccgactctgcaaccccatgggctgtagcatgccaggcctccctgtttatcaccaactctcagagcctgctcaaactcatg

SEQ ID NO: 53409 - DNA, 2828 bp, Bovine  19866880569397
cagtctgcatctgtgatgtttttttctcatggttcagacacaaatcaagaggaaagctgttcatgcctgatagagtgaaagtttttcatagaaaacaggactttaccataagagggtctcatctatatattttacagctaaaaatgatattaaaaaaaacctcagtgagctgccagaataaaaatagataatgataacatctatcgttggaacatctggcatttttcctgagttgccttgttgctgccacatccagatgaatgcagagcacctgtctggaacatgctgttgaggcaggagagactctcatgactgttatcaaaaggggaatatctgtgctgtaactgttgtggaagagtgcttcagtactaagaggacgtcaccgaggctgtgtggagatggtctactggaatgtagaggttggagaaagctccctttgtaagaacatgcttggggacctgggatccattactgctgcatacagggtgggacactgctgtttttgttagctaggtacctaagtctagatgagtccaggattctggaaagagcaaagactctggaattgcatctctcctcttaaatatcatactcatgtgaacttgggcagtttaggttttttgtttttgcttcatttgttgcatcagtaaagggattaatgatacttttaagatgttgtgagcatttaataagatattgtctgtgggatctcagtacagtgaccagagcaaagcaagtatttgataaaggtagtgtgatgggttgctgtgtggtgggtattagcatatgcaaatgatatggtaaactgcctcttagtcattagttcattttcccttcccaagtagctacagtgttaatagagagtaagagctcccttctttgaactccttaactacattgcttttctctttgttcagcccttgccatttttgaacttgtattaaagttatgtcttgtgcattatttatactgcttctaatatgaacaccttgaagatggagctgcatttctcaaatcacttggcatacggccttgccaatattagatgttcagtaaatatcagaatgaatcatagagtaaattgttgtaaatagtttccattgaatgcatataaaaccccagctgatggctcagatttttaactggatgaagtgtcagtctcttttagaaggaatgattctttcacgagccctgagtctcagaggaaagctgggggctgtgactggcatctgacatccattgctggcaggcatccaagctctttgctggtcgatgttagcccacctttggtgggtgacatgtggtttcaagtttattagaaccagggcatcctacatctgactcattttttaaatttaccaacatgaaagcctgttttgaaaattaaattttaaataagaaataggggtaaattaaggtgcagagtattcataataataaattttctaagaaggaaaaacagaggtttctgcaaaattcaccaccgggagttggtgatggacagggaggcctggcatgctgtgattcatggggtcgcagagttggacacgactgagcaactggactgaactgaaactttctttcattgttgataaaatctaattaaaatagggaatcgaatcattccgtttcttatctttaaacagaggagaaagtgtcattaccttttcaaaagaagaagagcagattctataggttctaaactgtgattttttttttttttacctaaaaatgatctagatatcaacaattgctgggagaaccatccacaggcgctggctaatcgatcattaagtgtcctctcccctcctttgaaacagatctgtgggctttctgttaaagttaagtgataagaatcattggtaccaaagggcatttgagccttgaaaatcagagcatttggaagaaaaggccatactgtttaggtgattggccagtcacctgatttctttttgcgtctgggatgttgatttcttttttaaaatttttatactgaagtatatttgatctgatctgatcgttgattcacaatattgtgttggtttcagatgtatagcgactgtgattgttatatatacatgtatttcagattatttccattatagtttattataagatattgaatatagttccctgtgccttacagtaaatccttatttcttatctattttatgtatagtagtttgtatctgttaatttcatactcctaatttatccctgccccctccctttgccctttggtaaccccgtttgttttctatgtcagtgaatctgtttttgttttgtgtatagatttatttgcattattttttagatcccacatataggtaatagcacataatacttgtctctttctgtctgatgtacttcacttggtaggtattttctaggtccacccatgttgctgcaaatgacaatatttcatgattttttatggctaatattgcattgtaaatatacaccacatcttcttaaaccagtcatctgttgatgggcacttgggttgtttccacatcctggctgttgtaaataacactgccatgaacactgaggtgtatttcttcgaattagagtttttattttttccagatgtatacccaggagtggaattgctagatcatatggtagttctatttttcattttttgaggaacctccctatgattttccatagtggctgtacctatttacattctcaccagcagtgtacaagagatgttttctccaaaagagatgttgatttctttattctttaacctatggggttttatctctgacatgcctataggatggaactgaaaatatgacctttagatgatataatctagg

SEQ ID NO: 53410 - DNA, 702 bp, Bovine  19866880589054
gcggcacccatttagcacaaacaacagctgggtggttttgatccaattacggctactaatttgcaagtggctctaagcagatcttagctatcctatgactttctctgagctgtgtgccttgagttcagaaagtggagacatgacgtgcctctggcctcccaggctactatgagagccttggcttaatgcggaactgatttcgtcctttgagcagtaacagcaaaccaagcacttcaaaaagaccaatccatctcctctacataaaacgttaataccgttctatgtacaaaaacaaacaaacaaacaaacaaactcaacaggctttcaccctttgcatggcaaacaccaactgaaaaaagcaaaaaggaccaagaacatttgaataacttcttttgccatccatccattatcctttatcccatattgtaaaagctggagaaactacatcctttctgtggcttgcctgtaagcttgaggggcgggagggacagcatctccatggagtagcccccagctctctccaggaagctggctatgagggactcttgttgctgggccctggctgtgtgacttcacaccaaaaccacctccctcaattggaattgggaccacagatctgggctagaaaatttgttcttcaagatgcacgtgaacatgaacttctgaagagcctatggcactgtcatcttaggcagcctaatc

SEQ ID NO: 53411 - DNA, 2406 bp, Bovine  19866880608089
tgtaaaaaaatactatacttaagcattttctgaacatcttatatataataccttgaactgtacgttgcatagatcttatagtgtggacaaaatttatacagtgccattgaggctatgacttctgtctgactcatataagtagaattggtccatttaacattctggacaaagttctgacaggttggagagtaaatggatgtaatataccaaaataacattttcctagcagacagttttgaacctgaatatatagtagaacaaaagaacttcttgtaagaatagagtttgggtttaaatatttagagcatgaaagatgtctggagttataaacaaaattgagttggaagggcaagctaatccaaaagaacttgggtaacgtttctggaatgttaggaatataatgttacttggggtttccctggtggttcagatagaaagaatctgcctgccatgtaggagacctgggttcaatccgtgggttggaaagattccctggagaagggaatggcaactgactccagtattcttgcttggagaagtccatggacagaggagcctcatgggctacagtccatggggttgcaggagtcgaacatgactgagcaagtaagacacacacacacacacgtaatattactttcgctttcacgtataatttctaatagatctggtaaaaggtgctaaatgctccatacttgtggtgggtaggcgtgtgttaggatttcctgaatcttactctccccttgagtttgaattggaagagcaaatacgcacaagtatatgccattgtaatgaccctgagctgggaaagactgggagaagagggcagcagagatgagatagttagacagcatcaccgactcagtggacatgaatttgagcaaactctgggagataatgaaggacagggaagcctggcatgctgtagtccatggggttgcagagtcggacatgacttagcgactgaacaacaacaatgacatgccattctgcacagtgtgttctaatggttcactcatttcaggcgaggcaaccctgtgaccattttttcataaagcagagaatgctatgacttaggaattataatcctagaataccttgtttgggcacagcattcgctggaatctacacagacttacatggccctcagtttgagtaggacactacacattttagtgtgccacgcttgttgttttcctgtgttggggatcaaacgttttatattaacactgctggcatgtatattgttaaatactacagtaatgccattattttgttagctattacacaaaagcagctaaaaggtttgtgcaccttgtaaagtatgcagttatgtaaaacgtatgcagttattaaaaaaataaaaattcggtgagagagcttcctcttctataaaagttagaatgattcttgacgactctagggcaaatacattttatgagtcttaatgatatggcatgtgcttttcagatattggtatgtacccagtaatatatgatagttctggggaaactgtactgtcttggcataatttactttttaaacagtcaatttctctaaaactgaactgccttgggtagagcatagactttataattcaagtacatcttcaagtttcttctcctaaggcatccacagaaacataaggacattctatatactcattagcatctgagatattgtgagtttattcttatcatttacctctagaattaaaaaacaactctgcttaaaagagctgatgaatgaaaatattcaatgttaatctgaattcttacactttcttaaacaataccaagtgcttgtgctttctccagaaagctatagtttgatctggtatgatatcagtgagaaaatacagccctataagatcctgagaggttgttagtttggggcagtttcttacttcttgatttgaaagcaagttttctgttgttacgagtgctttaatcactcttcaaggaaattgttgtcaaaaaggcccatttctcaaactctgccacagaactataaagttgctataaacctaaaatgcaagtgccgagctggctaattttagggcttgtagggaactgtgttttctgtaatttctgtgactgatctaaataccttctcttagatgtattgttttcattttcacattattgtaaaaaaattatctttcctatatcaaaactggaaatacatgaaatcttatttttgcagagctttgtgctgctacagccataaataactttcctaaaggaaactaattgtacttgggttcatcatttatttgagcctttgttaatttgaattcattacatagaaatatttactgtctgttggtttgtggataatcaaagtcaccacaaccttgtaaggcttggtgctttgtatgggaatcagtcatattacagcagggcc

SEQ ID NO: 53412 - DNA, 2547 bp, Bovine  19866880642849
tgagaaaaaaacatcacagatgcagactgcattgtactaagaacatatgcatgcttttaaatcacttttatcttactttttactaatgtaaccctgaaacataaaatatgtccttttttttttttcattcactgttatgggaagaacagatggtaaaagggttagattaaagtaatacagcatatccattaaaatagcccccactgctgggggtgcttccctcaaacaggagttgtgtttgctatgaagaacgcctttggtttatacacgttggaaattgctgggggttttgtcaaggataaacataagcgtaagagaaaaactagtgtcaaaatcaaatgcattttaagatgacaactatgcaagttattttgctaatctgaagggctgactgaaaacatttgcctgtgaaaatgtaactgaatagcagtcaaataataaagtcaatttctaacatgaaaaactttactacctagaaattgtaaataaatggaactgcaaagaagatatcaagaagacattatttgtttcattcctgcactcctattaatagtagatagaaatttttgcttttacttcatgtgtaatttattgtctaattaatcaacagcaagaataattcaggaacattcaggaacataattcaggaacatacattaaaaaaggctaactataacatgatttctacataagtctcgcacatgtttagcattggaaaagcatcctcatgaaattttaaatgaaattctgttcaattacatacaacttcaaaagagttaagcttaaggaaaccttcaaggaaaattagagaatgcattttaaaagaaaaaaaagtcagtcttgagtcacattccagagtcaaggatgactccactagaggaactacacaaaaaatatttctgcttaaactataattaaaaagcaaatactgattcaaagtttaatcattaagcattttaaatacttaggccatttctcccttcattttagaaaatggtataaatcgtcatcttcaatcagatgaagatgacagttttaaagaatgggttcacaagacttttcacttattatttttatgatctgcttcactcatagtatataatctgtggtttttgtgacatatttagctttaacccacattttagttatttttagttcaaagaatcttttggtgagaaatctttcatacctgtaagttcctgataaatttcatgaagtagaaacatgggaagtttttttatgtacctcaaatgtggtttgaaatgtcataggccttctcttaatcccccccccacagttacaaaaatgtcgctgggatctggttcagtcatttttctcacagaaaagtaagtacagtcgacatctcattagcggtcagggtgacgtgcagctggaaccagcactcggaaccagaggctgggttttctccaggaatcccctagacagttccatatggagagagctgttcccaaccatgaaatccacagtccacatccgtctataaatccaaaggtaaagtcccaaaggctggcaggtatcttcactgcactgaagattttaaacaggtaataaacatttaattaggccctttaatgtcctggcacacacagctgtaaatgatcaaggagatctcaactttgcattgataatacagaagtggctctagcccattggataaatcctgggtttccaggaccagtagcactagttttaacggtaatcttcttctctgatgggctttgagcatgagccagaactacttccatcttttcactgatactgtgactcactctctgatttttcacatataagtggcagattagatgagcttgaattagatgggtgcaggtggtgccacctgctccagccccttattgcagctttgtctggccttccattggtttattctgagtctcgacaaaggacggctgcccaagctgctcttggcactgtcctagacttgggccaacagattattggcaggcatatcactggccttctgcatgctgaaagaggagatctatcagacttgtaactttgtgaaaagaaactaaagctcaaaggctctctaccgaggtaatcaatttcaaactggtgtctgtaaatggaaggatggatctactttctcatcttctaagtcaagtacaataaggaaaataataaggaaaactaaaaaagcacaaactgttaaataatacacatccagaccttgaccttccaggaaaacactgcaattcaatgtgccataatgtgcttaaagaggtttcgtaaaaatctgtgaaggatggatgagttaaggaaatctaaatttcttagcaaagatattcaaatccaacttaactctacaaatttcacattatgactgggtcagatcccaccaaaaactgtcaagttaggcattgctctcttgattttgactatttggttttaataagattttatttgataggttttcttaaaataaattttcctgggcgtattttgatggtggattcagccatccccctgcttcgcctctgttcagctgtggggcagaatcacaaattc

SEQ ID NO: 53413 - DNA, 1233 bp, Bovine  19866880697017
agtcagaaatgactcagtgactgaactgaactgaaccttgtcttataactgactgtacacctggacgagtcttttggggggcctgcacttataccctcgtatatcattaattaatgaatcatgtacattcttgactctgttgtttatgaacaaatgatcattttctcatgatctgtgatcaattagctgcctaaattgtttcacctatagtatttctcgcttttagtgtgtgatgttgtatgtatctttatgctcacaaaaattttccatgtagtcagattaagattatggttcaacacaccttattgtgatcatcaattggtgtacttataaattaagcctcttttattgctctgaataatagacacttgtataaaaataaacattgatgacacaggaaatagtcttcatgtctccttacaggcagtgattaccaaagttgatcctatacttttgaagatggtggtggtatggttagtcactgaaatgaataggaggcaagggtcaaacttaatctagaattaaaaatagcatcactgaaccctgaaatctatattgctgtgttaaaatggagctaaatcaatacggagccccaatttgtcagatcctagtgtcaaggtaacaatcagaggcccttccttttggaagattgatttgggttcaggggatatttgaatggggtccagaaattcacgtataaggtgtactcttctcgttgtcattctttttctcagaaagggcattatctaacaaaatagcttaacataaacaaataactttccacacttttagaccaggctacatcaatatcttgccatttcttttaaaattagcagctgtatttacagctttgtcagctaagtaatcaagtatgtagaagtttaagtatggaactttatctggcatgagaagattaatatgtgctttgctaataactacatttagcaggatggatttcttcaggagttctatttgtctattgtgcaaattcacaattacattccccaattaccctagacactgctgtcattatttttcttctctagagggcttcaagttttaattcttggaattaattatattgtaaattactttataaaagaaatttggacaaattttcttattttggaatagcaacataaattgggattttagcaaatatctcttttttagccccaaccagctcttttatcttaagctttagaaaagaaacatattttttccatctcttgt

SEQ ID NO: 53414 - DNA, 1712 bp, Bovine  19866880698037
cccgtggttttgctgattactgaacaacttccacctcttaattctcctattttctcctacacttcagaattttttccctagttactttcctggtttattatccttctgttggtatgaatgtatactttgatgcctgtctgttcagttttggagaagattcttgagagtcccttggactacaacgagccaaccagtccatcctaaaggagatcagtcctgggtgttcattggaaggactgatgttgaagctgaaactccaaaactttggccacctgatgtgaagagctgactcatttgaaaagactctgatgctgggaaagattgaggcaggaggagaaggggacgacagaggatgagatagttggatggcatcaccgactcgatggacatgagtttgggtagactccgggagttggtgatggaaagggaggcctggcgtgctgcggttcatggggttgcaaagagttggacacgactgaacgactgaactgaactgaactgttcagttttaacctatctttttctgacatgtgccaaacacccttgttctaattaaaaaatgctcaccattcccaactaccaatccacttggtggccaactgtgagattcagtgagggacaggctaattctcatgcctatccaaaagtatgttcaccatactaccagctccatctctaatgctgctactttccaacctgggtagacatactacaatgtgaaggtttcaggaagtacacaaacatagatatatttaagggaatccatgtccagatctttgccttttgaatatatctaaaattgatctgataatatgcctgtgatcagcctttcatctttcctaatcatcctcctctgaatttaaaacagaaagttcacagaaataaacccatgtatatatggttgtggtttagttgctaagtcatgtctgactcttgaaaccccatggactgtagcccaccaggctcctcagtccatgggattctccaggcaaaagtactggagtgggatcccattctcttctccaagggctctttccaacccagggattgaacccacatctcttaagtctcctgcattggaggtgggttctttaccactatcaccacctggcaagcccaggctcatgggtactaaaggccaatttgactattccatcatacccagtaaccagcgatgtggatccatttccctgtaatacgtataaagttgaccattgcatcataccccatacccagcgatgtggatccatttccttgtaatatgtataaaaagaccacagattggtttagccagacgttttttaaactattttacattttgtaaattagaaaacccagaataggaaattcaaaacttggaaggaaaatgtgtctgactcaataagtactaagtaatatggcagattaattttactaacataataaagctttaagaaccatttctaaaaatatacttgtaggttttgtacattttataaatattttacaatcagtgagatggtgaaatatcattttaggcatttatgaggtacatctgatttctcttaccttcatttcccaaaacaagagagtgcactcctaaaactgtataaactagctgcctcagatcatggtattaacttatgtgtctttaagtcagcattcactagaatctaatttaattgaaatagctttgcctgtgtaaacttctcctttgtttaaataagatttca

SEQ ID NO: 53415 - DNA, 5772 bp, Bovine  19866880706842
cgtttgctttagcataatgatggtgctaggtcaatcactgactgagttcctagcacatggactactgatatgtagagatcagaaatggaacacagtctttgctttcagggagccatgcgtgtagacagaaaagggaacagcctttgcagtgaattgtcctaggacgattgtcctcaggtaaacagcgggtcctctggggcgacacaggggaaaagcatgacatcagggcaaactcatccatttctgctgaaaggaagcagctcagtactgccatctggaatcctgcattctcagaaattttaaagaaaagaaaataatgtagcttctcaaaagtcttatttggtccaaatcactcttatattattgaagaatacttatttttcaactttcttgcattattgctattatgtgttgcttcagtcagtgctagctgagtgcctacactagagcgatgctatgctggccattgtggtgaatggggatagcagttgagtaggtgctagactataaaaaagtggtataagaaacgcccttaagtgtttcagtacagttggaatgataagttatgaactagaatgaggggcatatagaggatgatgtatacaaaaggcttcaagagagatgtcagtctatatgcctggggagggttgttgacctagctctgggggtagaattcaggtatatgcacataagggaaaggagaggacacttcagaaagaccaggattctgaagagatgcaggaacaccctgagtgtgactggtgaagtgggggagagtgggtccctgtggttaaggacaaggggttatatgtttggaaacattcattgattggtgccaaatatctgtgaggtcaaggcatttggattttgttgtatggaaaaccaggaaaggttttgaactggaaatgaagcattaaggtggctgaagcaaggcagactactcgggaggctcattttcatagtcctgggtgagtctagcgggggtctgagctaaagttctcaactgcagtgaaaaacactgtagaggaaggaaggttaaattatttttatccttgactgcttgtacctcttctcattatagatgtattttgatcattatagatttatttttgaaattatatatatttggttgcactgggtctttgttgtggagcataggctctctagttgtagtgtgaggacttggttaccccatggcatgggggatcttagttcctggactagggattgaacccttgtcccctgcactggaaggcagatttttaactactggaccaccagggaagtctctgaaattgtattttaaagcttacattttgtatttagtgacaataatagatgcataataaatatatttttatttacaaaatgatgaagattttcatagtatttaattttaaattcttcttcctcctctcaaaaatacaatcttttactttttgttatttccatgtttacatatttttagtacacaaattctcttcagatttttcaagaggctgtttccagagcaaaaaaaaaaaaaaaattgagctcataaggtaacatcttgtgcattttattaggtatgaaaatgatgtaatgatgctatcaatattatttattaagctctttgctctattatgtattaggcatatccggaaatttctaacagacatttgatgaatagcaaacagcaccactgctttttggaattatttaggcaccctaacttgaagatgtgagacatgcacaaattgtaattcactgtcactactcaatctgcagtcgtagatgaactttcaggtccccacttggtatgagatgcccttgggaatgattttaggcttgattacattatagtcacttaatgaatgactcggtcacctttgtacctctaatgtattactcgggacaagagaggtcaaaactgttttgaatggttttgaaagatttgttgtaagaaatattagagataactccccaaagattctgcaggtagctactgtgctgctgtagagctatcttaacaatatgaaagttgtattttattgttactgggtttatattcatgaatatagcaacttatgtttttcacagttctgttgaattaaaaatattgagtttatggaatttatttttcagaccttacctctagcaattgctagagtctcttccatctattttgaaggaactagtcatggctactccaatacagttgtgagttatcttgacatagtgtagccacatcaatcatgaataaattgcctcctgattctagtttcctttgaaacttttcctcttggcatgtttatagttgttacatttattagagacagtgcgtgccctcctgttttattgcctcattctgcccttctcttgctttctccctagtcagtaataagcaatacactatataattctataataacagtgcataaaactatgtatacttctgaaatctgaaagcatttaatatcttgttacagatacattgtaacacctggaggtttaactccacatctgttaccttaaataatcccacagaaccctcttaattttcactgccagcaatctggcttcctttcagtgaaggtagaagctttcttcctacaaaggttctttctggcctcaaaaaatacaccggtgactcctatgctgacttttaagctacagagaaaagaaggaccaagaatttcccttggtgatactattgacacatagtatcaatacttttatcaatactaggatagatagcccttcatttcatgttttatatgttacatgaaaacatgtaatccttgaccattaacaacaaaaactgtaatgcatcttgcaaaaaaaaaaaaaagttatcttctctgaaattcttatactgtacaggctttttatgttttatggttatgtcggaacttcagatatcacctgttctatagaaatatcaggagattattattagaagatgaaaggaggaaaattcggaggcagtaaatggagactttaagatccttgaggacaggagattttgcccttgataaccagattgctttgggtacccaaaagcccttagaacatattgagtgagtaggtaaatgaattgatagatgagtgaagttgataagataggtggataaagaaacaggagaactgagatgacctgggtatatggccctttccccagaaggcttacagattcagtgggggagataaaaatgtaaacgaaaaatttaaacacagtgtagcatgtatgtgataaaggcatcattggcagtggtgaagctctggtggtgtcttgggggctcctctgtccttccagcagtgaactggaggtggaagttggaagctgacaatagcctctaggcctagagaccctcataccttggggtgtttccagcaggttcaaatttatttctgttttgggacttcgtggtggtctgggggctaagactcagtcctcccaatgaaaagggcacaggtttgatcccaggtcagggaactatatcctgtatgccccaactaagccaaataaataaataaatactaaaaaaaaattattcctgtttgcaaggtttgcagtggggctgcaggctgacagtgaataaggccctgaacctcttgggtgccccgtcaaagaccagactcactctccacctccagttgcgctttcgccccttacccgtttatccttcttctcccactgcctgtgtcccaggagctctgtcacgctggagatcggagctcatcttaattttctgtccactttggaaatttttcattttcagcctttcctgcttctcaggttgaccttaaaggaccactgatcatgttagtgtttggagaattgccacagtcctagctgtcactcaaggttacctataattgagtcctaaattacatgaaccctgtgatccagccagacttctctgctccctctttgctgaatgccttgtcctttcctgcccccatgcttgtgcttatgcatttattctgcctgcgttgcctctatttttcaaaattctgcctatcatctaaggactgaatgctacctctttcatgaaatataactttctcctttgtgcctctatttagaataatctatcttctactgccttctggatatgtcagagcttctcttttggactataatatctttgaaattagtaactgtgtctatttcatacctgccccctaccttgacccagcatctgtgtgtcctccacttattcactcactgaatattaatgaaatgaatgaatggataagtaaagactttaagaagaaggtggatactttgttggttgcctatagagacattaaaaaccccaaggagggaaaatattctgctgctgctgctgctaagtcacttcagtcgtgtccgactctgtgcgatggcagcaggttccccctgtccctgggattctccaggcaagaacactggagtgggttgccattgccttctccaatgcatgaaagtgaaaagtgaaagtgaagtcgctcagtcgtgtccgactcttcgcgaccccatggactgcagcctaccaggctcctccatccatggggttttccaggcaaaagtactggaatgggatgtcagctactatggaatttataacctatgtaaagaagcaaaagatacacatgcaaaaaaacctaaggatgctttcacaaatacaaaatcttgcagtacaaatcaaatacctacctgctaaggaggagttaaatgtggtagaatctagaagctctttcaagggcaaaactttgaacaagtgttctctggctcacattctaaggcagagaaccatctgcatcttgtcctggagtgggctttctagtctccatgtctccactgtcatctccagtgcaaccacagagagaagtgacaactgatatttactctgtgtgtgtatgtgtgtgttttgattacaaaatgattgccctgaggtatctatgcagtaagtccgctacatacaaaccttcaagttgtgaactgtctaatagtgagaacgtgtgttcacatgtccgatcatgtgagttagttcatgcacattgtcacacacatgcatcctctagagatggttgtgcttttgtgtactttactgtacagtactgtatagagtacagtagaacagtatctttatttcaagcccaggatgtccagaagcaagcacaaaagcagcagtgacgtagctggtacttttcaaggtactgtaccgaaagagtaaaaatgttttctttcttatttgtttgttttttattatttgtgtgaaaagtattatgaacatattacagtacagtactatatggctgattgtgttagttgggtacctgggctaactttgttggacttacaaacgaattggacttataactgtactcttggaacagagcttgtttgtatgtacggaacttactgtagaagcaatgctgtttggccttccatctcagaaacatgtctttgtttatgggctcagccctagttccagggtccaattcccatgatcagtagatactttctagataactctcttattcttttaataatctaagtgcatttatggtactgtatagttgtcttccataagaaagggaaaagtctcttaaaattttggtttctttctttgtttggtttggtttttgaccaaacctctagacacaaaaggccttgtgcaggtcatgttccttcttgatctttcctgacccttagctcctcctctatcccatgcccactatctttgtccagttctgggctcttcagaacacgtcacatttacactacttcatcagcctcctatt

SEQ ID NO: 53416 - DNA, 2337 bp, Bovine  19866880805813
taagacatactttcgggggttgggtggtaggagaaaggctgtgggttttaatttggagccagaaacaatgagagagtccaccttaatgttcacagatggtaaatgtatagtttaaaatcagtgattagaataaaactcactaaaaggagaggaagaaaaaaggtaaacatattatttttaaattctatgttgaaaatgcacacccttactgcttgcctgccttcagggcaaaccactctcacccactctgcacatggtcaccccctggagataggatctggcaaacatgatttggtaaagctccctgctcaccaccaccaccaccaggcttcaccccaccttatgtagatcctactgagaaccaaagtgtgacatgacttcagaaagtaaaatatccgaacaaggaacctacagaaatcataggatcatctcctagttactgtgcctggactgaattggcatatgaaattggggcaaagagtaaggactagaatgtaagaaggtgatttctatgggaattatattttcaaaaattggtatttcttcaagaaagaaagtataaggagacaaaggcagaaacctagttctcagatgtgggttaacacccttaggtagggaaagagaaaataagagaggagccagtaagtagtttgaggtttacatttttaaaaaagaaagacaagtaaaaccagaaaacaatgatattgatgaaaaccaagggaaatgggcatttagaaagaggagtgtccatactggtggactctacagaaaaccttaggagaatggggagtaaaagaagcctttattttgtccaggagctctttggtgatttttaagaaactagttttaaaagaataatacaggcagaaacttgcttctacatggaattagggaatgcattaaatggtgccaaggtggaaggcagagggcttggatcactcactacagagtttgatccaaaattaaaggagtcaatgatatagtgattaaacatacgacagtacacaggttaagattttgtttactggcttagacttttttaagataagacacatgtatactataaagaggccttcccaagtggctcagtggtaaagaatccgcctgcgatgcaggagacacaggtttgatccctgggtcaggaagatccctgggagaaggaaacggcaacccattccaatatttcttgcctgggaaatcccatggacagagaagcctggtgggctacagcccatagggtcacaaaagagtcggacatgacttagtgactaagcaacaacaatactataaagaaaggggaaggagctatgaataaagtatgctagtgataaactgggttaatactacactgtgccagtcattcagtggatgagcaagtcaagggagcagggggcaaaagcattgaagttgttgactgggacttgtagacaaagtaggttccaagggagacagtggtgaaaggttgcattaggttggagaaatcaaataacaggaggcttggtgcagacagagagaaggtttaagagctatgaaagttgggaacatgcaggttgtggtcatggaaacattcatttcaagattatggagtcggagacaacatcagctgatgatatggccagatggtaatccaaactctaagaaacatctgcatttgaaggctgtgattagggaagtgaataaacaagtgttctagagagatcctggtgaagcagaataccagacatagcctaaggtcacatctgataccattcctatagagagtgtgcggtgaagtacttttcagacacgtgctaggaaatatatgggattttgaatctgggtatctttgaaccttaaataagggatctgtagggttcaagatagttttcattgagattcaggtggcaaagtcctgaacacttttttttcttattatctctagaattaactacgtctttggctggagatgagatgtacagattttcaggataaaataatactcagaggctgaccagaatttatgaaacctatcagcaaggcacttaccataattaactttaccgggaaatttttccttaactttttctaattataaaaataaggtactataaagaaaggggaaagacaaatggataaattttggagaaaatacagaaatgtattaagaagaaaacaaaactcttccttaactccattgcctaaagtccactcaacaatgctcatattttgctgtatatgtatgtgtatgtttaaatattttagagacatgacggttttgggaaattgtggcattttacttgatagacatgagaacctcttctaaatacaaagatataaaaaagtggaaagggaaacaag

SEQ ID NO: 53417 - DNA, 1035 bp, Bovine  19866880818672
ttttataagcttccaatatgttgattacatctgctgacacttgtttgttttgagatatcatttcctttttctctgcttctggtcttgtccatctttactaacctatttccaatagggcaccccaggcttttgatgtgtgtcccaacactcagtgtttttacttagaaaaacccctaacgctatgtcagtgtgatcctgttctttgtcgaactcaaaagtaaggtgcaaaatcacacttcctgattgcttataatggataccaggtgaaaactcattcttgtattagattcagagccatttccttaatttatgcctaaatcaaatgatttggatggttgaaaccacaaagaaaaactagtttatgagatgtatctccctctttcttagttatttgggaatagaaatttctttccaatgttctatgtgctagggttaaggaaagttacccgcttggggtgtacttatgaaatacagtcagtatgtgaagtatatacagcagattgtggatagtggtctatatgcatgaagttcactggatcattataatgcattgtcatccatctgtcctttcatgtggtaaacaagctcacttaatctacacgggtatttttcaattaaaatttattctgtttcccatataaatagaggggcaaatctgtgtattcactttagctccattatctatgtataaccctgaatgcagtgctctgtctttgatttcacaagaacatatgtcaaatacccagtaacttaaattatccattctaacaatctgcggcattgtaaatgctggtagtggggcattaaatgataaatatgtttcagagatccttaaagaacaaaatattttagaaaaaacatcagcttccattggttattataacagatgttcccttatgtccttgtgctggatctggctgcatccttagatgggaagttacatcaaagtgtgagccattacagcccagggaatagttcctaatggtttcactgtcatataagtgctccagggcatatccagttaatgtgtaagca

SEQ ID NO: 53418 - DNA, 1811 bp, Bovine  19866880825205
cccagccccctcccctccaccagtttaagcaccaacatttaagacatgttcacacagctgcaagctgtaagcatcacctatagatcattattttatttagaacatctaatattttaccaggattcaaatgcaagctactttctttactagaagaacatctttcctttgattgattgctaaatagatagagcttgtgaaaagatctctctctctctctttttttttcctgggatttcttgttcaaacagaatttgttgtatacacatcagaaagccctgctaatatgggctgctggccagatcgtggaaacagcctcattatattgaactggatgtcataatggtacccattaaggtggaattccctctgtgtttgtacttttaaacccaagtcccttgccacttaaacatctctctgagaatagcaacattctctggaaacatagtctgagaatgtgctggctctctcctcctcctgctgaaaaccacgataaaaatagaatcccgggttcagagcatttttaggggttttcagtttgctgctgctcctcggccattcattccactctctgcgcttgtgatgactgtaatgtgttctgatggctgaaggtaaggacctacaagatttacttctttcaacactcccgttaattgctattggagtccaaatatacagcaggaaaagagcagcattttttttttcctccagaattaaccaaatgcaacacaagagtttccattttaatttttaaaagccgttaagagactaatagcatcacagcatttctattagctgttgaaatctcactatcgtcctggcaaagtgaagttatttgctgtgccggatttgggtaatggacccctgcagggttacagctcaggaatgctggaaggatgaagcccacaaaggggagggcagagtgggtgtcaatctcattcctccaattagagcagttaaagaaatagcaaagtgcagggtggcatttattgtgagggctaattgaaaaccagaggaaaatattgagacgctacatggcatttcacattataatctcttttctatttgtgtctcatctccattgactcaataggactttcattataaacaaatttctatcattagattcaggttaatttctgtggctgtaattaagaggatggtaagaaacagttgagagcatagtcctctctactgaaaactgggcatggttcttgaaatttacctggcaagtcccaatgcctcctacatgtcaagctctgtggtgagaccctgtcatgaccaagacagacaaggttcttaccctcatggaacatgatttagtgggaagaaatagacagtacttataaacaaagaaatatgttgtgtgatgtcaaaaaatgaaaggaaaaaaattaagcaggacaaagagatggaagtggtcagggaaggcttctctgaggactcttaaatgaaggggaggcagccaaatggaggcctgcagggagaacatttccacagagagaagcaaatgcaaaggcccagaggtagaaaccatcttggtaagttgatgaacagaggaggtgtggctggagcagagaaaaagaggggaagaacagaaaaagataatgctagaataggcagagtcagatcatgttgagttttgaaggccttgggtagccattgaagagttttgagccaaaggcatggcatgaagtaatagaagctttgaaaggatcatctggctgatgtggagagtaagcttcagggtgggtaatgggaagaggcagggagactagataggaagtgattataatcacctagattaaggaaaa

SEQ ID NO: 53419 - DNA, 1396 bp, Bovine  19866880884896
tgtttgttagcctttacaacaatctagtgatactattcctaatttaaacatgggaagatgagtgctgtacaggtgaagcaaatggactgagagcctatctagagcagaagagccgttctggaaagtaaccagagtcagaactgggaagatgtcaggctaccgaggccataaatccaaagacaaagtgcttgtattataccctgcggagatggacagaggatgatagacagaggggcctggggtctagagtccatgcagtcacaaagagtcagacacgactgagcacgtatacgcacatgcactgctgtgtagatgcgaggaactctgtacaaagaatgtatgtacacttacagaaagattaacacattttaaagtatggaccacacggcactggcacagacgaggtacccagtcacgtctgctgaataaattttcataagcctcaaacatgcttcagtgtttctaacagagcagaatgaaatggtatatatagggccggaacttctgaccttttggcattagttagtattaggcggtcagcccgattagggatcaattagcaaagatgcctcataaaatgtctgcattaaaatgactgcttgatggaatactttctccagttcttctaaactagtgttcaaggatagcagtctgggcaacattcctaatctaacatgaccttggtgttgatcattgttgctatacagtctggcaaagattttgggaatctaaagactgaaaaactcattaccttgagagcacagcacacattcattgtataaactaatttcacacttggcttccacagattaccaaatttaatttcacattcaaactataatttaagggaatttgtttccttaagaagaaaatttactttaattgggaactagtctagtagacaaaataagatgaagaaaatttagcaatggctatacttcactatattagcaaaaaatttcaaggtatatgttttgttatttgaatgttatttatagtattaaatggaattacggttccagacagttgacatttctgaaaatgacaaacactaataagtagtttatgaatatgaagtgaatctgtgggctacaattcatttttaatttctcaggaattgaccaaatagtttcactgatgatggaattttatagtccataagaaaaagaattcctgaggacaagagttactcatctgtgtcttttgcataaaagcatcactatttggtgtctaccacttacaaaaagctatcaaggaaaataattctaagtttacaaagatgtaggctttcttaatatgcttttctagaaacattatataaaacactataactatataaacattatataaaatgcttatatataaaacattatacataaaattatatcttgctttt

SEQ ID NO: 53420 - DNA, 1001 bp, Bovine  19866880894508
tacctgtggggtcctgaatatgacccatgtggcacttctcaagaaagcttgaccagggctgacttcttcctttattaaaatcagctaagtcaagctccatactcatttcaggggctaagatctgtgcacccacgtattttattttgtcctactgcccagggaagcactgaccgactttcctgggtgtacacctacctttaaggatatgtgtgtgatactagaatgcatctctctaggggatgagggggaagggggagccagactcttctttgtgtctgagtttggaggaaggaaatggaactcgtaatgtgattcccatcagtatctagacctttaatctatacaaatgaaatactcagtttaatagaattgtaacagtaaaacaaatgctttgttctcagtgaatccaccattcagagcggctcttggcagcacatcaaccgtatttgaaaagtctttaagtgggtatttttttattgtgcttttcatcctgacacatcttttgagctgttagagtcccgaacagagaagcactcatctcagaatgccgcgtctgtgttgtgctatggtcttcatttggtgacttagcaataaaaaacttaattaacttaataaatattttggccacactataatagagtttagagggtaaaaaggaacagagcaaatcaaaatgagtttgggatagaaaggaaagaaatatgtcatagggaggtgtttggaatgaaacgtattacaattgctatcaaggtgaaccttagctctggggaaagcgggtgccaaaaagtgccctagggggtggaaaccagactatttattaagcatgtattatcttctagcactgtgcaatgagcttttcacagggtttcatctgaacctcagcacatccctatgaggtgtaaagaggaaattgaagtctagacaggttatcacacagtaagaggctcacactgtgatctacttgacttcatgatcttgtgctcagtttgattaattctttt

SEQ ID NO: 53421 - DNA, 1436 bp, Bovine  19866880978378
tcctcctcgcaaggaatgttatgtttttaaattttattgttttgctcagaaattaagcattttgtatcaccataatctgaaacctatcctgccaacctattagtaccacgatgaaattgatgtggcaaagttttaattcatgcagtaattttagcatttacccctttagctttaaaagcacaaagaccagaggacatgcaaaaggccacatgaaatttttaatgtaacacgttcactgtcattttgctgcagtgtttattctcatgtgatagaagctagtcaaattgggtctattaaaaatgaattaaatgccattattaaaaatacagacaaaatagtaaaattaacagtgctacatgttatggaaactgtaactgttagcaaaaggcattataggaagtgtaatagcattaaaaaaaagaaacctacttgaagcaaccaagcattaatcttgtcccaacaggggcactcagtataatctagacctagtgagactggattcacaaattatttatgccccacttgacagtagaatccatgaaatttacgtgatactaagaaaagtagattcatcctatccaggatccctcagtactccttcagctcatacctaacaagcctaaattcatttctgtagtttgtaagtatgctgtacagagaaaatccaaagagtcaacctcaaatagacctcctttgaaaaaggatcaaagtatagtacaaattagagaagaaaaatccaggattaccatctacagaaagtgagtatgacagtcaagccaaaaattcttacctgtggatattacagaaaataaaaggttttcattgggaagaaagtcaaagagtgtaaaaatactttattctttctgcacacactaattagttattgtttcttggcattatgttaactcttattttatttttcacatgccagtcacggtgctaagcattttgtatacgttatccaatttgatctctcaaatagccccatgaggtaagcatcactagctccattttatagttaaggaaactgaggctttaagaagctaaactgggatgtccctggtggtctggtggttaagagtttgccttcctgtgcatggggtgcaagttcaatctctggtcagggaactaaaatcctaccggcttctgaaacataaaacagaagcaatattataactaatccaataacaatttaaaaaatggtccacattaaaaaaaaaaaagaagcagaaactcctttgaaaataagcaacttagtatctggaccctgtctaggattcagtgtctataccttttaaccccatgtgcacaactgccctgaagtatactccttcctttaatgctcataaactactcaaagccatgccaagtctcactctatgctacttgagggcaggggataacattccacattttagacaccatgcctcacctag

SEQ ID NO: 53422 - DNA, 1448 bp, Bovine  19866881077315
cgggaccgtgggctggggctccccacaggacgaggcgggagtcgctctggctgcgggaaacgtttgcccagaggccaaccagccggctgctcccttcggccggcaagtcgcggggctcacggcgtgcttagggccggtgggttatattttcttgttcgcatctctgaattcatcgccagagagaataaatatacccatctttaaattaatcccaaagaggagcttctttttcgagatgggtcgaatatgggggctgacttgttcaccgtagaaagctcagtctcggggttttcctatgaggagcagttaggggacactagaggaaaagaggttacacttcaggccaaaatagagtcgttgacatagagatatctcacagcgatctattaccctaatcctgggcgaagatttttgttgttgggttttgtttcaggaaaccaaagtccaacaccagtattccttaacggaaggatacagtctgcatgaatgaatttacagcatttacaatcctttacaggaaccgtttaaacaaacgcttgtaagtactattgctgacaagttatttttaagagaacctctaatttgaatcgccttctctgtcatctgtggatttaaaaaacaaaacaaaacagcaacgggggaagttccttcgctctggaagatagttattgctacttgcaaatcactctctacagaagcaattccttgcttccttttggtgctgctagtggctggggtcgcacacagtcggacacgactgaagcgacttagcagcagcagcagcagcagtggccacttaaaggctcccggaggtcggcttggaggcagttgtttcatcagcgataaaagagaacactagtcatgttgcactcctcctttgtggcgataattgcctcggagaaaacatagactctgaagaggggtgtgtgtggcatcctgctgatatttggaacaaatttaagagtgtttgttcaaaaatatatacatccaccgcctccttgcagcccaatggcagtaagcttgaagaaccacagtgggagagtcctggggatatttacacatctgggaaacacctggcaggaggaagtggtgaacgttctggacaggaggggtgaggaacttttttgtaaaagaactaaatgtagagacgttataggtgttcccaaactggaatccagcaaatggactctaatctagaaggaggagtcatttccccagaggctgtagccacttagaaacctggctctgggcggttcaaccaccaagtaatgctctcttatgaataggaatacacagagagatgtactggagctcacttatacacaagattctggaaagatcagataagatcaagctgactcgtgccaaaaaaataaaaaaagaaggtgtttggaaagggtgaaagaacctttcttgagagccttctttctccccacttccccagcccc

SEQ ID NO: 53423 - DNA, 1128 bp, Bovine  19866881105186
gcaaaacaactgtctttaggagtcaccatctgaaaggctctttgcaggcaggtccctgtgtcgcttgacccggagttttctaagacgcctgagtctcctcctctgagcactctcctctgatatggcccagggggacacacaccctgttttagcctgatgccaatttcagatgggcttgtgacagctgacctctgcagaacaggcacccctggtagcccgggtgactccactgtgttcccaaacaccaggattccatctcaccctctgtggccgagcctcggcgttcactggaaaagggaagatgctcgtgtgctttattttcggctgggtaaaagaggcagacttggaccacaaggaagcacacagatgcctcaagtgggcgcagggagagcatcatttagaaataactttatcctttttcttcctgtaggtaccaccctggatcttgcgccagaatatgggagaagttgccacaggaaccgagcaaaaggcactcataaacattgtgggtgtagaaaaattttgtctttgtgatgagatggcagggattagcacttgataaccttgatagtcatgcacttttgaagtaaataaacgtctcctaatgagcttctaaattagagaggagaggaggcccagctaacctccataggttattggcatcagaaacatggtaaagctataacgtaactctaatcttaacagcttataaatgccagaaaatgctgtaaactaaagaataaatctattgggcaaatctacagtggctcatccaccagctaattagttctgtgggctctaattttctaccccagaaagttctcaaaaaaataatcactgatcccaggtgaaaggagacatagtatcatcaagttgtaagtggttaattaaaactttgtgaaaagcgactaggaaaaaactcaatactgagatttaggctcaagaaaactagagaatgacttttcatacagctgagtgaacatccagcttggcagggcaagctcctactccaacaggctgctgttgtggaaaacacttttttagacttctctttgggaactagtttcaaaatcagtgtctctggaatcatagtctcattttgttttgatcaaagctgtttttaccaag

SEQ ID NO: 53424 - DNA, 1563 bp, Bovine  19866881120119
cgttttgactcagtggtaattgtttatctataagctgtctccattagactgtgagcctcttgaatatgagccatagagtcatgtcttgtggagttttctgttgcttaacgcacatagtacactctatacatttgtatccaatgaatggatgactataactaccagattgtctatcaaatttgttcatagttttagcaactaaagcaatgagatactatttattatttatcaacttgacaaatattcaagcattttaatactcatttttatattactatatgttggatttttaaaatgtaaaatgcttctggaggataatttaataacatgtattaaaagtctttaaggaataatggctaagatgagatgaaaatgatcagaggtaaaacactgccaagtttatgacatagataaaacatatatgtactttgatgcaacaattctacttctagtggtatgagggatgcattttttgagacattaaaccactgtgctgtgtggcaatcccccttttagagttgtttggcagctgccccacccaacagatcagcggaattcattgccacagggaagtgggtgggagactgccaaaaaaaggggactccttgcccaactttaaatttcaaaacataagttattgaatccacagtgaattaatagcctaaaagcaaatacttttgatttttcaaaagccagactttaataagaaacgggaaaagtctgtatatttcaatgtcagaacttaaagacctgaccatggaatagatgataaagcagggaaaaatctagaatattatgtaagcctttcctggggctaaagaggagaaaccagagagaaagggagagaaggcaaggagtcaaaggcaaatgttctttttccacccttcctgttggaacatcacagaaagcgagtgttttgaacgggaagccaaagcgtgtgctctgtttttcatttcctgccctttcaggagacttgcagagtgccctttgccagtgggagagtaaaagtggcaacacaactagcttaaagtagagagggatcaggtctccatgggctgtatacagccggcatcagacaaagattgtcaaaggcccagggaagaattctgtccatagctgggaagtaaagtggtgcctctttcaaggacggtagctggtgaggaggaaacttgaaggtgggcatcactgtgctgagggtgaggagtggacaagcttccagacctgtcccgggaatggcccaggccagagaatagagcaagggttttattagctgcagactttgcaccggaggctatacaacttcacactggtgcccagtgaccagtagaatgagaccttcccccacagaatggctccatttacaagctacccctgcactgagatggcatcttgggaaggaggagggaaagtttgaaaccttcaagagaagaggtgtaagttgtcccttggtatctgtggtgggattggttccaggactcttgtggatacaaaatcctccaatgctcaagtcccttatacagaaagacacagtacaaggaagacagttgccctccatatctgtag

SEQ ID NO: 53425 - DNA, 817 bp, Bovine  19866881127779
aaattttcccgcaggtccttaaaaccaagatgctggaggatatagattcataaagtattataaaatgccacatataaatatactgccaaagtatactttaatatgaagcttttgaaaatcttaagacttcttttccttttacagaatatgtcatttattgaggcatagacagaacttttattatcaaatgtcgatgtgccaaatggaacaatgactataggattgtttttactttaaaattaaaaaaaaaaaaagtgactaccagaacaactgtctgaatatcagaatttatattctattcattttttccccttaaatgtcagtcatttttgaaaaataaggcaaaagttctctcgtgtcggatatactcatacctggcaagtactcagatctctgagtcctttttccccaagcacagtaagcaggtttcatgatggattttaagggtaattatttaaaaaggcaaaatgatataaaactactaacatgcatttactattatttgtcagagaaatttttctcttgaagtttggttcttatttggaggaaacaaagtgtcacctagaattaaaagactaccaaatggtgattcatagtccaaatgtattggttcacatactctaaaaacagaatgttaagctaagtctttaaactgcccttatggactttgtaggctaaatgaagtttaggattgaactacaaaaggcatcagggataaatttcaccaaatgtgttgcttccaaacttagtgttatcaacttccaacccttaacttacaggattttgtataacattagggaaccaacatttgagctca

SEQ ID NO: 53426 - DNA, 847 bp, Bovine  19866881174423
ttaggtactttataagaactcttgccaagtatttttttctaacaccatgaattaataagcttcataattaaggcagctgcttcacacttctattgttaaccaatgacattaccatctgtcttgctccattgatgccctcctcctacttattgaagcatttagcagttttggcaacagggattacatggcatggagtaagtactctaattagatataagtgaaaatcctgagggaaaaggacctttaaaaagtaatttgaagaatctcttaatgatgttggcactgacagccaagtagagtagaaaatgcctgtcatcatggcaaataatggattgtgatttgatatgtgcagtggagttttagaaggagcctgttttaacagagtaatagaatgaagagatttcaaagtcaggggaaatttgagtgaatttttcataatatgcttgctatagtattaatagttttgaaagaaagcaaaatatgccccaaatgtattctgatctaaatgaaacaaatgaatttatttacaaaacagaaacagacttaacagatatcaaacacaagcataaggttaccaaagaggaaacatggcggggagggataaaccaagagcttgagatgaacctacacacactaaatataaaagatagataaccagcaaagagctactgtacagcacagggacatctactcagtattctgtgataacctatgtgagaaaagaatctttttaaaaagagtgaattatgtgtataactgaatcatcttgctgtacacctgaaagtaacacactttaaattttcaatagattgtttttaaaaagatatactcagtgttaaggttctag

SEQ ID NO: 53427 - DNA, 897 bp, Bovine  19866881240623
cagtctcctggtttactttttgccaacttgcccattagtacaatggaacatgatgaatttaatctataaaaacatgtgcccttgttatacagagtacagaactttatactctcctccaacagtaaagaggagatgtctgttactgctgaaggggattggtagttctgtatcttgggacaaggaatccctgagattgcctgttgcttctagacatttgaactttttcaaaaaggaccaggttcatggacaaaagctgcctccagggaagaagaggtggttactctgagagaagccaagaagctaatctaagcagagaaagcaaaccttaaagaaggaaagaggaacataaaatgcttgtatatgtgttataatagtcagtctaagcacagtcatttcatagtgtgtatcactaggagtatctttattatggcattcccttttcttcttgtggttgtatcagcaacctgatctttccctcactgcttccaattattgtaatttttggtggagaacctgaggaatcaaatggctaatttattgggcaaccaagaaaaatataaaaactttgggaaggatcataagctgttgaaacaaaaaacatattgactggcaaacagtatatcaattggacatttcagataatataataaagcaattacaaacatcagtcttattaagaagtccctcttagaaactggttaaagtaattataggcagactgttgaaagggaactagagtaattaaagggaggagatttgagtatactccgaaaagaatggattaattaaaaaatattattcatgttctagtgggaattcttggtctaaaaagaaaagtagaaattcctgtgaagttctcatatctaaaataaatccagactagaccaagagtacaat

SEQ ID NO: 53428 - DNA, 2257 bp, Bovine  19866881246791
ctatggtttttctagtagtcatgtatggatgtgagaattttaccataaagaaagctgagtgctgaaaaattgatgcttttgaacttgcgtgttggagaagactcttgagtcccttggactgcaaggagatcaaaccagtcaatcctaaaggagatcaaccctgaatattcattggaaggactgattctgaagctgaagctccaatactttggccacctgatgtgaagagctgacttattagaaaagaccctgatgctgggaaagattgaaggcaggaggagaaggggacctcagaggatgagatggttggatggcatcactgacttgatggacataagtttgagcaagctctgggaattagtgatggacagggaagcctggtgtgctgcagtcgcgctgcagtacatggggtcacaaatagctggacttgactgagtgactgaactgactgactgaacttattttctgatactaatgtgatttgaaaagaaatatgatcataagcatatttctgatggaatgataaaatgtatttcagtaagtttcatggatacttagaaaattttttgatttccttattttcaaccacccctgccaaaaaaaaaaaaaaccaaaaaataaatctgcttttcataggctttctagctttctgaggagtcatctttacctcagaggatgccaaagatatgttgacattatgttcattatgatattttcataattcctgacataaattgtttaatactaatttagatagaatattctgttaaccataatgctgtgctgaagcttcaccaatttataatctgtcaaattccaccatcttttcttcttaaaggtaagggcatttcaactatgaatttctttttaaagggtaagtaaggcagacttttttcttttacataaaaatatatttgaccacacacaaaatctcatttaccccaacattaaattttaagaaaatctcaattagaatgaagttatattttattattttatttatttaaattacttatattttattaatttgcttaaacatttctgggcatgcagtcactaccaagccctgagaaaactgctgtgaaaaagacacaaagtccctatcctcatagagatgggaatcttatgtgatggattcagttcagttcagtcgctcagtcgtgtctgactctttgcaaccccatgaatcgcagcacgccaggcctccctgtccatcaccaactcccggagttcactcaaactcaaactggatttaataagcacaaaatatttttttttacttaatatatatttattggccatgtgtgtgtaaaatactgttgagagacatatgaaaatggataaggcatggtcccttctatacaatttaaggagggagataaaactggaaataatttagggaactgatccaaaagacagatgaagtgtggataacagcaatggtaaacatggagctagttggtttcctttattcatccttgccaggatgtatacacatacctactgagtgccaaacagtggccaaagcaccagggaaactatgaaaagtctgtccaagcaccaaattggagctgcactgttatggcaagacagaatcactaggaactgacccttcctgggtgtagaagctgggtgcagtctgcatggaaaaagctatggtagtctatagagtatttagcctttgtggtttcagtgtgttagcttgaagaagtagattctctttcaaagtttcttacactgaggcccaggggccacttcctcagaattactgctggggcttgttaaaatagatttctcagtccttccctaaaaccgactgagtaaaaatatcaagtggtaggggctaaaaacttaattattaacaactattgagatcaccactgtattactgtgtgaaaacagttaatgattaccaccaacttagttttctttttctaaattaaaaggagttcaaaaggaaacataagtaaaatcaccactacaaagattccctaataacctatctttatttacctatacatatgaaatatcagatattattaagatattttatataattagtattgccccagggtcgttttccagatgggcaagagttttagaatacaacaagatttctattctccataactcaaatagcatattatgtaaatcctgttaaaataacagatatggaaaacataagggaaaataaaatatgaccctaaatcttcattaattatttcagtctgacttgtcaacttatcattttgcaaat

SEQ ID NO: 53429 - DNA, 1352 bp, Bovine  19866881289162
aacattcattccctggaacaaggacaaatagaatagaaaaactgttcacctccagattcaggcaattagttttgaatatgtctagatgagtgctgagatgagaaataaatgcactgaatagtaactatgaaaaaagataaattgcaaaagaagccaaggtacaagtaaatagcctaacagaaggcacttgaaaataaatcctccctaactaatatcagaggtttcaaaatataaagatctattaagttttatttctgaacttctataactgtccccatggtaacgttccaggacaattcagatggaaaatttaaattgagaaccgcaggttggacagaaagcacaaatgtccataaatccctaacttaattgagaaaatgaattctagcgttcatctttttaaaataataaagcaataggccttctgtcatgatcaggagatggggtaatctgaagacaatctgataattcttcttttaaaaatgtgaccataaaaatacaaagtggcaaatattctcaagataatatttatcttttctcagaatggcagctattcctttccaagtaaaaactcttattttgctcctattataagagtaatagatgcacacagaaacaaaagtttttaaaatatagagggttttaaaatgaaaagcaagtctttcttcctgcctcccatttccaattgcattccccatagatgacaatttttttatacactttctgcttttagttcttttatagattacctttgttatctcctaattaacaaggattacctacattctaggttatcttctaggggctatctatataagcatataacaatattgctgataccgctatacctcttatcgaggttgtctctagcagaaaaaaatgagacattagtcaggctttccacaccttcccccttcccattcagtctttattacatttttgttttagtaagtttacttgagaattttaagtaaactgcttaaatatgtcattctttaatttatatttcatctcactgaaatatgaaaaatattagttattctgtagttcattctacttctcctaaattcagatataccattattttactgttatagaatttgcatcttattttctaacaaacataaattccttcactttgtctatatgttcaattctgaaactgaaaaccaacagaaagcatttccatgatcattcattacagaatcacattctatttttgaatttagaaggaaaataaatatagtctacaaaattgaactttgtaaataaaatattccaagagcacagatcaattggattctcagtgtttacttggctgcttctcaaatcttttgcctaggaggaaatat

SEQ ID NO: 53430 - DNA, 486 bp, Bovine  19866881313197
aacatgactgtagtatctgtgctttaagaagatagttttgtgccagtgtaaaagatggactgtagcatccagataaataacaaaacagtaagtaacagtttaagagaacaatagatttgtcacaaagcagtgcatgattaattactgagaagattgtacagacaataattactattggaatttttaaaacataaacttggataatgatgatttgtgaaacagttctaataaggccaaggacatgaatttgattttttttgtgtgggtcagaatgttctatggctgagttaagcacttaatgacgaccaatcatcttccagctgggggttgggaaaggcataaagagaaatcaagtgagaaagccaggtagagtaggaccaacatttcatttctactgagaaaaatcccagtcttcctgtccttctgatgataggcttgtactttatatgttaaagacagtatattattcatataattaaaaattcc

SEQ ID NO: 53431 - DNA, 1659 bp, Bovine  19866881350274
ctctccttgtatctatgggccttttgccaacccctgttctcctcagcctgcctcccttcatgcgtaaagcttattctattcagaatctgaaacattacctaatccgtgtttgttcaacagaatgttaaggcacatggcaagatatgcagggataatttttcagaattatgtggaaagcatagaagaccaaatactatttacatactgataccaacagtatttaaagatctatacatatataatgatgaggctcatttagaatctgaaaaattgtacagtgtattgctgacatactttttttattgaaatactgttgatacacataacaaaaggcaatgaaatgaattaaatattgagaaataatttgagaataaatgtcattaactaattctcattatttgtagctaagattgtatctgtaaaataatcaagggtatgacaacctaaactccattttaactaataatttcattgagtaactacataaaatttaaagatttttcagaagtttaaattttgcttgagtttagatcaattaaaaaacaaataaaatggtaaaagtttatctgtagtaaaatgaaaattcatagtgctttttgtaacattaagcaaaatattttaattgcatgtaagagttacattaaaacatttttgcttccttcttacctatttcatctttcctcatatctttcagcttatccacagtaagatttttttcttctaatcttgttagaatgtgtggtggtaagactgaaaattgtctcaaagggctagtccaaccccaaagcctcttgtcaatgactttactaagattcaggagcctgtaggtcatggcaggccagcgtttcctcaaagcaatttcaaaaagagcacggacaattctagctgcattctgaagaatgaaaagggggattggtggttaggtccaacgtcatttttaatttatcaatgaaattattattcagactcagtttaaaaagtatgtcaaactgcatcctttaattgtgggcaacatctatcctcatatacctctaattatctttattatttttacacaagaataatcgatccttttatgtggatgctattctggttaattctccaagaatagctttatttccaagttcttaggaagttccacatcacatctccctaaacaggaatgaagcagatgagacaaaaggcatgtgaaatatttaggaggttatggaaaccatttagaatctaagagacagcagtggatgtccttgggtatacagtgtaatgatcaaatttgtaaagctgtttggagaaatgcagaagacttgggatccagtcagaaaaaaattagtgagaaaagaataacaaaaaatgttgatgagtgcaactacccatattaatggcttccttacaaaccagacaatgcgctcattgctttatatatatcatctcatttaatttttacgacaaatgtatttggtcttgatattatgattttatagatgaagatactacagtttagtgattttaataatttggaaagttgctgtcagagtatcttcttaaagctagatctaaacattaacaaagttaacaccaagattctaaattcagtgacctgaggaaaacttgattcacagacatatagaaagacacaataattgaggctctttttcacat

SEQ ID NO: 53432 - DNA, 1014 bp, Bovine  19866881410280
cctaaaactcatgtgatatggaagggggtggggtatattggaagaaattacttatcattttgaaggcagaacatgactttgagcactcagggattggtactatatcttcatcttttaacacagttatttgaaagtccagaggcaggtgacaatctgaatgatggtaatctgagatgaatactgtttgtatatgagaaaggaggctacatgaaattaaatagttcttaaacagcaatatttgtgctgtaaatgaaaaaggtgcaagtgaatgagacagtcagtgtatactttaaaaaatgttcaaagaataagaaaaactaaaaattgaactatacaagctctcaacacttaaactgaatttttgatcaatttgcaacatgaagtaaggttttaggaatgctaaagtttttgttgaattctgtagatggacaaatggttcaaaggtacacatagctcaaggatatggtgcattttggaaaataaatctatacaggtgggtgttactgatggatacatgtcctaccaaaagtgctctaaggacagatgttatcaatataaaaggaatggaatctcaagaatcaggaaaaatgaactgaaatgaaagaaaacattgtcaaagaaatttcagtgggatttttatatgaaagaaagttaattgatgaaagaaaatatgaactctacaaatagggggtactcagaaagagtaatgcactttaaaatggttataactaatattgttaagtgaagacagaattaactgaatcacatcttgactaaatttttgctagattgatccagttttacataacccatttgtataatttacaggtctaaaattttatggtagcagctttataacgtaatacctatatgtgtatatgtatgttcccatttaaaactaaacttaaattggaattagttttaaaatttgattttcataactttgttaaatgctgagaattggtgaaagagagagagaagtacgatttttctatcactttggggattcataaa

SEQ ID NO: 53433 - DNA, 667 bp, Bovine  19866881480039
gcccatagatcaaggagaggctgggatagttatttcccctgtgtaataagaatacttctaagatggaatgaaaaaagggaggtatcaataaatgaactagaaagttgggattactcgcattttctaatgtaaatattttattaaataagaggaatcaccttagtttcaaactttagtgtacataaaacattttggtttacttataaatgtgctttaaaaaaattatattatgaaccaccaggacacataagaaatactgatcctataaaaaataaaacctatttccacttagtcgcttgaattagagtaggaaaatgtttctagttagtcacatctgtttgtgagccccccaacgccaccctgatgctttcctgcatatctatatttcaggatctcaacatttatgaaaatatgtatatataagtggttaattttgtgctagattggccatattttatattttatctgtgtttcctataatgtgtcttaaactgactaggagaaaagtagaactgtttatagtagtttaaaaactatcaagtttcagtaattttaagaaccctattaatagctgaaaaaagaaaaaatcctgatactggttttcagagctatgaattgctaattcaagttaactattaaaaaatattcaaacatgccaggtcaagaa

SEQ ID NO: 53434 - DNA, 1416 bp, Bovine  19866881537861
gagaaggaaatggcaacccactcccagtattcttgcctggagaatgccagggacagggaagcctggtgggcagccatctatggggttgcacagagttggacacgactgaagtgacttagcagcagcagcagttaagagctactagagtgtcagttttcttctagcttcagttggaagggagcgagggagacaaggaaagttctccctgtttttcctagtcatggttgtagcctctggacaggctgtggatgagctggggtgtgctcattcatagatgacctcacattgctctcaaacagcacctatgctgtcaatcagtacgataattttcaaagagatgagtctgctcttaacttgacagccctatctcctgtccatggaaccccaaaggcaacaaaactttcaaaggctggggtggagaaacaaaagttataagattaggagaaattaaagctggaaacaaattccaggagagttccacaggactgaactgaagtgtcatcatcaggtaggagcagaaacctgaatatgattttcacaggaaagaaaatcatatcttatccttgagcttgactggaatgtgagaatgaagaatgcatggtgggaagccctaaaatatccttttcctctctggtcctcagcaaatgagccacaacttcagtcccagagaccagagcttgaaaagctccacttcaagatgagaaggaatgagaattacagaaactcagagttcattgattataaaccattcgtagccttattagaaatgaaatgccctgtttcataaaattaacccagttaccatgtataataagtatggattattagtttccaaagatgtgtatgcaaaacattacattcattgcattatatggaataaacttatttgtcccttagtggtgtaggaggccatggaagatctcattctgcttcaagcacattatttaacaccatttatcactcagctaaacatgtgtgaaattgctagttaacacaattcctttctatggtctgccagattacaaagcagctctcactgtttgcaatatgtgtcctctctataaattaatataactggagtcagaccacagctaatactgacattgctatatgattagacgaaggtccgttacgtgttctaaaattccagatttcagcctttcagagataacattcacagggactaggtccacattccctcccttgcttgctctgtcttccccttccttttctccagaaaccctttgaggactttctcattttgcccttttttcactcggtctgctttccgttttctgcctttcctatgtccctctggattgcaggacatcttctccaaatttgaatgtaaaaatcagttcagagagcgtcttgatagaatttgatagcagtactactggaaagactcagaggggg

SEQ ID NO: 53435 - DNA, 1719 bp, Bovine  19866881793267
cttcacaattccacattctcaccaacagtgcacaagggttccttttcctccacaccttccctttcactgggtacttcttgcctttttgataatagccattctaacaggtgtgggatgatacattattgtggtgttagtgtccctggtggctagtgatgataagcatcttttcatgtacctgttggccctctgtatgtcttctttggatacatgttattcaaatcttctgtccattttttactggatttttttttttttgctaatacgttttatactcttatacactttggatattaactccttttgggatataagacttgcaaatattttctaccattcagtaggtggccttttcattttgtttatggttctggctgtgcaaaatattcttttgaaatgtagatcagaccctggcctgggaggagagacagtcacacattagttactagttacttatggaacctcagactagtttctgaattttgaagggcttcagttttacaaatctgtaaaataagaggttgaattagaagatttctaacattctatttcacttaaaaatgccacattgagttatgtttttatttggtgtcagtaatgtgcatattaaaaacatcattgtctcctaaaatgtctacctaaaaatcaatcagcaacacagtgtgggagggatttgattagattcaggaggtcccctggtcctggtaaagaagattgtgacttaaacatgtgaagaaagttagcaaatgctgctagcctaggacttatagcatttaaatacacaactggccctgagagaagtaaaaatattgtttcaagtcaactttctgggacaatctgaatgtctaagttactttctcataataaagcttccacaaattaaaaaatattctgttttttgttgacaccaaagcattctctgacagtattacctgttgcatgttgtctcctctatcggaagtgtaaactcctggaaagacaagctagaaccaaacacagatttgtattctctacagtgctgcattctctactgccttccatatattacatgctcaacaaatatgattgaatgaatgatgctagggtaagtgaactggtattggaatatagcttgaaggaagacctgtggggtaatgaggtaaaacataaatcaatatccatcatctcagtctgtctactgctaagatcagcattttaaatcagattttggaaatttggaaaagatgaagagaagaagaggactgatttcagctttgagggaataggctttgtgagaaaaatctcaaggtgatggcgttacctaaaaaagaacagattatttgaagaaataaggatagactacactcaattaggtatgaaggcatgctctcatcaccttttataaaggtgggcaaagttaaaatttggttaatggtaaatatttttggaaatgattttaatttcatgtcatatattaattcattaggctgaaaatatgtcactaaaatcatgtgctttcagtttacaccatgctttcataattattatttcatttgttttcttttgattctcaaaaaatatccagaaagacaggtagaatagatactcatttcatttcaggaaaaataaatctgcagctcagagaggttttgtactttttccaaggactcatgataagcaaggggcagatggaaccagaacacacatttccgacttcaccgtaatatccttgcattaggt

SEQ ID NO: 53436 - DNA, 814 bp, Bovine  19866881350841
atgcacgcagtctccaggcaagaatactggagtgggttgccatgccctcctccaggagatcctccagggatcgaacccatgtctcttatgtctcttgcattggcaggtgagttctttaccactagcaccacctggaagcccctcatttctgaccactttgatacaaacagatttccctagaggttcaatctgatgtaaataataggcaatttaagctagctcaggaaatcagaaaatggtggtaataataaaaggtatagtcaaaggaatggtttttccagtagtcatgtatagatgtgagagttggaccataaagatgactgagcaccaaagaactgatgtttttgaactatggtgctggagaagactcttgacagagttccttggactgcaaggagatcaaaccagtcaatcctaaaagaaatcaaccctgaatattcattggaaggactcatgctgaagctgaagatccaatactttggccacctgatgcgaagagtcaactcattggaaaagacctgatgctgggaaagagtgaaggcaaaaggaggagggcgcagcagaggatgagatggttagatagcatcactgactcaattgaatctgaacaagctccgggagacagtgaagaatagggaagccttgcatgctgcagtccatggggttgtaaagagtcagacaacacctgttagaagccttacaaagcattttccccgaatatgaaacagttccctgcctctttttataatcttctgggcaaggaaaaaaaaaaaagagtcagacaagacttaggactaaacaacaacaaccaagt

SEQ ID NO: 53437 - DNA, 980 bp, Bovine  19866880561945
aatgaaggcaggaggagaaggggacgacagaggatgagacggttggatggcatcatcgacttgatggacgtgagtttgagcaaaccctgggagatgatgatggacagggaagcctggcgtgctgcagtccatgaagtcatgaagagtcagacatgactgaacgactgaacaactggatttctttgagctgccattctttacaattagaacggatatagtgccctgccaactacaaggttgcctcgaaggccagctaaagccatgctggggaagatgcagtggaaagggcaaagccctccacgctggcgaggtagggctcctgcatttctgcagcctgtctaactcagcaagccagcattccaggcccctttctgcttctctctccctcctcaccagatttcagaacacacctgatctgactctagcaacagtgccatctaggctttgaaagcttgtactgtaggcttccccagtggctcagcagtaaagaatctgcctgcaatgcaggagactcagattcgatccctgtatcagaagatcccctagaggaggaaatgacaacccactccagtattcttgcctggagaatcccacagaggagcctggcgggctacagtccatagggtcgcaaagagtcagacatgactgagcaacgaaaccaccatcaccactgtaagtgaagggccttcttggcctgaaaatcttcctaaaagcctctgtgagccaactgtgtgcagactttgtggccatgcacagtggggagacagaggacagtggatatagtcactgtccccagggggctccctgtttaatgggatgggagtgatatgggaggaatcccgtgccagttcaggaatgtgggttatcctgggagtgagcctgggtgggatttgaggaaaggaatggtatatctttctcaagacatgtctggagctaagcatagggctgaggtgactacaacggggggaaataagcattaa

SEQ ID NO: 53438 - DNA, 1267 bp, Bovine  19866880612075
atgtggattgttgcctggacctaaaatagaagaatgtgctccaattcagttagcagttaggaaaagaaagatgcagtttccccttccaagctcttgggtgaattctagccaaacataccttgggagtcagagaatcttggatgaacccttcatttagagacagtccacctgaattccaagaaaagatgtagtgtttgggatcccaccctgctccctcggttcagacctgaacaacccagttactccgtgcttgactcaagaaggcaagctgttacctgctgggttgttctgcccattgtgccagagaaccagactgggctttgaatatgcatgatctgggttcgtgcttgtcacttctcccagatcatcacagaaggcctggcggcacagatggggcctgctctgtgccctcaactctgcaagcctggttcccacccctgctcccacccccatctccagccccagcctgattccacacccgccccacctacccttgcatccttgaatctatgtgtccaaccaaggaccgccatgggacttccccaatagctcagctggtaaagaatctacctgcaatgcaagagactcaggagatgtgggttcaatccctaggtcaggaagatccccgggaggagggcatggcaacccactccagtattctttgcctgaaaaattccatggacagggccttccctggtggctcagtgataaagaatccatcttccaatgcagaagacacaggtttgatctctggtccaggaagatcccatatgctgtggagcacctaagcctgtgtgccacaactattgagcctggagctcttgagcaagagccctggagccgcaactactgaagtctgcgcaccctagagcctgtgctccacgacaggagaagccgcagcaatgagaaatctgtgcaccgcaactagagaaaagcccccacagcagcaaagacccaacacagccaaaaataaataaaatcactaaaaacattccatggacagaggagcctggtaggctacagtctatggagtcacaaagaatcagacatgactgagagactaagcacgcacgaggaccactgcactcttggaaggatgagaaggaagacaagggaaccagccctatacacctaacatatgtgggatgttatgatacggacttagcacactcttgtcaccacaaccctttgtcatgggttatcaccccatcttgcggatgggaacacagaggccctaagaggttaagctgcatcacttgaaccccag

SEQ ID NO: 53439 - DNA, 2363 bp, Bovine  19866880814810
attccttggggaagaactttttaagcagtcaaatctgcctgccagcaggattgactgcatcacactgttcagtacaaggctatttcccccttcccctaaggactttgtagataccagaaacttccaatggcaggattgttatagaaagaacatgattttatgcctgcgcattaaaaaaccctgctattataaagaggagacggagctgctgtcatggtacgtggtgggtgtgccttgccaagcagggagtgactggttggggatgtcacagaagccacatggctgggggcgggtgccgactgccatggctgcgatggcaatcttgctaatgtaggagtcatgagggatctcagacatctatgtattccggcaagtagatagtgctttgaaacacttaattgcagttctgcaaatgtattatatgtcatgaatccctcatttatttttttcctttcaaccttttgtctcttttggctgtaagactgaaaaactgcaaaaatagcatgcatccttgtcgggtgagatcctgggctttctgaataaataatctcccatggtagtgagctccccacttctggaagtaatcaaacagaaggagaatggctatttccagaaacattaaatgagggctgtctgctctaaggggttagaggaaattgataatatgcttttaaagttgtgaaatattttgagcacacagaaaagtctaaagaataaatgaatgaatacccatatcattatggcacagttttgccataaaggacattttgtcatatttgccttagatctttttgtttttaaatgtcatgacagatacaagtgaagcgtttgtatggtccttctttctacactcctactgcttctctctctgaaagtaaaagtcacgctcagtcatgtctgactctttgcgaccccatggactagacagtccatgggattctccaggccagaatactggagtgggtagccgttcccttctccaggggaatcttcccaactcagggattgaacccaggtctcctgcattgtaggtggattctttaccatctgaaccactagggaaaccctagtaaaagtatatatacatgcacatcaagactatatagtattatttgcatgtttttaaactctatctgaatggtatcacactgtgcatgttatttggttgatgttattttgctcagtgttgtttttagatagattcactttgttgttttttttttttaatttaattttatttttaaactttacaatattgtattagtttagtcaaatatcgaaatgaatatatgtagctctagtgcattcgtttttacctgagttactgtatttcttagatcagcacaccatcatcacttacccattttcctgtttgacacattgaggttgattctttgttttctgctaccaactatgcaattatgaatcttcttacacttgcatttgggagcattcatgtgagaattatctaggaatggaattacttactctgaaaggacacacattttcacaggataaaatcaaattgttctctaaaatgacaactaatttatactcccactaatttatacatccctaccagatcttgctgaaagcagattttaatttttgccagttgatagttacaacatggtatttctttatagttttaaatttaaatttagttttgtattttttgtgtaaaaaatactttatattttgtttaagaaatccttctctactccatgaactcacagagatattctaattttttctcctaaaaattttaagatactgctttccacatgaatctttggactaagtagaatttattttttgtgtgtagcaggcagtagggaccagttttcatggttttctacatgatgtttttattttacactttctgagttactggtgagaatgggcatcttttcctttgttcgttggtcatgggaactatttgttcttttagtttgcccattttcctgttgaatatttgtctgttgacttataggaattctttatatgtcatggatactagccttgttagtcatatgctttgcaaatatcttctcccagtctgtggcttgttttaccataatgttttggcttccctggtggctcagatggtaaagaatctgtctacaatgcaagagatggggagactggggttcgatcgctgggtcaggaagatcccctggaaaagctaatggctacccataccggtagtcttgcctggagaattccatggacagaggagcctggtgggctaatacagtccatggcgttgcaaaaagctggacgcgacttagcgactgaacagcaacagcatgttttcttctgtacttgaaaggggtcttcactactcgtgccagaagtggagt

SEQ ID NO: 53440 - DNA, 735 bp, Bovine  19866881841076
tgctggcctggagaattcctggatggtatagtcatggggttgcaaagagtcggacatgactgagcgacttttgcacacacgatgctgtcaggccatgcatgggaggcagaccctgtcactgctccactttctcctggggaccctgagggactgtgatgctcgttcgatggctgagatcagccgaggagccagaggaacccagagccccctaccctcagttctgggtctgtgtcatcacccccgctcacccaccccgggtgggaaccctccagccggggcctctcttctcatccttcccctcaccctcccagaacctggtgatgttcctgagtgtcctcgtggactggatgatccctgacatcccccacggacatcagcgagcagatcaagagggagaagagcctgtttgtggacttcttcctgaaagaggagcacgagaaactcaagctggcggaggagccggcccggaggagccagagcagtggccactgcagcaagaggggcccagcagccagcccggcgccctcgggccggagccagctgggcagcagtgcatcctcggggtcccagcacaccagcgtgtgagccagggcgtgggggcagcagagaccagcacgggcctgtgcgcccacacggcggggtatccgtccttccacagggtcgtgaagacagagattcgagaaaggaggcggaggatgtgtgcaggaggaaagggaatattctgcttctcagaag

SEQ ID NO: 53441 - DNA, 3166 bp, Bovine  19866880356533
tgaagccagtgttcctggtgaactaaaatagatttctattttattaggtcataatcagtcatgtaaaaagtgttttcttgttttgtgtgtatataatcccttttaatggttgtttttcacatccctcacagattctcattcagttcactaaccagttttttagtttattctttacattaaaaattctcctatcagttgaagccaactcagggatctttctctccctattttccttaacgttgttccatttcctgacaaggcttcagccttcatccaaccatatggaaaaggcctctctaagtatttccataacaccaagagaatattatttgcaaagctcagatgaggacatcttttccctttgactaggccacttcatttctaaatttacaaaaataaatatcacaatcctggctttatgccagctgagaagtattttgaaccttgtaaatatattttaaaaaattcaccacaagggacaccttattatcattctcctgcctttctttttaaaccagtgtgatcatttattggttgggtatcagcagccagtaacctgtcaggctccagctctgtctgcgtggccagcgggtgattctcacatctgtttggcgggtccctgggactgtgtcctctccctgggctggagatggcactgccatcaatagccccggggggtcaaggtcccagctggacactgaggctactctcatcactactgatagaaaaacaaggcccttcagaggtcccgctggtcctgggtcagtagcctcaccttggggatgaagggcagtgaggcactgaactgtatgtagctcagtgtccaaagctgaagacactccctccagaggtttcagagcttgattgttaagtaaaacacagtttgtttcccaaattgttgcttaacctctcagggcttgttccaaagttttttccccctgagtgtatgtcctggcaacttcattaagtggcacaataattttgtatattcagtacctgaagaaaaagtaagtagagcctttttagaatatttatattgcataaaaagaataagaattataggagattttgcaggttttttgcagttaataatgctggtcttaatcattatatgtgtaggattttaatgctaatctaaataatacataagagtttacttgagacaaattgtttcaagtgcctagcagtcaacttcttgattatttgaatcaacaggatgggtttgaatctttttctttcagtatatttatgcagtctgccttttaggcagacataaaagaggacagaattttattctgtgtggtaactttataaaactttttttcaaatagacttttcttaagttctggatattctaagattctgttcgaggtagaattccttcttcaaatttggatacaaaaatggagatttcatctatttcatatctggaataattgttccagtatattaccacttacttttttttttataaaacaggctcattgcttaatatatagatttatgattatacttctctctcacagttgagatggtgtagtagcttcaaatatactgttataataatgtgaccttgtgtgtttttcaggcattatttgactgggtagatatcgcaggtggcaaattggcttccatgtctccaattggaacggatcttgaaaccgtcaagcagcagattgaggagctaaaggtatggtaagggctgagaaatccaccaggcacgttgcgttcttaggttcttgattcatgggacgctttgtgcagatttttctatgttacataattgaagtgctttattttgattatgtaactggtttactatagtgcctgcacctaataagctgtgtgtaagtgctcattcaataaaggatacaaaatactagtagtatttcttaccaaagcaatactggtttattatagaaaaattcgaaaatgcagataagcagactaaaatgttatataccaagtggcaggcactcttaaattttgatttatagccttacagatgtcctcatgttgagagtaggataaggtatgcgtgtgtgtgtgtgtgttttacatattacctatgtatactatactgttgggctttcctggtggctcatactgtaaagaatctgcctgcagtgctggagacctcggtttgatccctgggtcaggaccatccactggagaaaggaatggctacccactccggtattcttgcctgcaaattcccatggacagaagagcctggcatggcaggcaacagtcagaaagagtcgcacacgactgagcaactaacactttcacacactatactgtaaagattttagaactgaattatttcgtaccatgctgtagtcactgatacatacactggcttccccgatggcttagcgggtaaagaatccgcctgcaatgcaggagacacagtttcgatccgtgggtcaggaagatcccctggaggaggaaatggcaactcactccagcattgtgtggagaatcccttggatagaggatcctggcagactatagtccaaagggtcacaaaagagtcggatatgactgagtgactaaccacacacctgcctttctgacgtcatctgcctcagttggccttggacgcccatcctgccttcagaatcctgccgggctcaaaacgtgaatcttttcaggaactcagcaggttctgtttcatttcagtttctttcttatctgtcgagttccagtactggaatcctctttactaaagctgctgtatggtaaactcactcttaagctacttcttacctataaatctacccctcttcctacataaaaccactggatagcggccacataacttagtgatgggtgtttgatgggactcagagtttcattttcctcttcgggtttttctgggttgttgacaaaaacaaattaataaatatgtgccattgctccaaaaggctttagaaaagcccctgatgctgggaaagattgaaggcaaaaggcaataaagtcatccccagataagcgaacatttcagtaagcacatgtctcagcccaaccgaggtggacactgaagacgctgaaggtgaagagcccaaggtctgtgccggcctcacgctgtctgccgttgatgacatctcttgtttgcttgtggcaggatttcattccaatccactgtcctacttcccttcat

SEQ ID NO: 53442 - DNA, 786 bp, Bovine  19866880387240
tccctttgaggaaaggggtgaaatttacacacatacacaataataccaacttaggatgaggcaaccaattttccccactgcactgtttagagcaatctacatggcaaaacattcttttcagtacacaattatcttctgcatggctatgaaggaaatgacaagacaaggcagttgtgataaactgaggtaccaatgttcaacctctggaaatccttcatgtattattttagatagttaaagatccggttttaatcttgtgtgttttcctttaacagctaatcctggaatcataatggaatgattcttggagagtaaagatactactgctctttgatcaacaagaagggcaagcggttttaaatttagtatgagtccacattggacagcctttcttctcttgtgatgaataaacacgcaatcagataagaatttcaaagtgaccttgagacgtacaatgacacaatgtgcttcctttagctgcccacccaccttatgctgtgccagttgtgttttgattttgtctgggtcgttggcaatttccagttcagaatccagagacttttctgactcttccagccactccataagcttactccaagcgtcatggaactgtaaaagaaattcacatctttgtccagtcgggcacactcactagatttgaaatcgaatacatttttaaacagaaactaatagtaacagaaaatgtaagaaattatttattcaaagttttccttgaagaagaaggagaaagaatattttcatcagcagattgcaaaacatcttgtt

SEQ ID NO: 53443 - DNA, 1029 bp, Bovine  19866880435748
cacttccgctgcagtggtcatagattcaattcctcgtcagggaactaagatcctccaaaggacccacacgaggaggcaaaaacaaaaaaaccccacacaaatcttttttgtaaaattttattataggtggaaggttcttatcagctttcattgggagtagagtgtactgagaatattcttaattatcagttgtatgtggaatctaaacaaaaagtcggactcatagaaacagggcaggaaagtgtttggccgggaggtgggggagaggctggtatgagggtacaaattttccagatataaaattaataaggcctaaaaatgtaatgtatgactgtggtttatatatgtatataaatatgtttggttatatatgtataacatacatatgtatatgtatgtatacatgtatatatatatatgacatgtatatatgtgtatatacacacacacacatatatatacatatgtatgtatatatgtatacattatatatacatatatatatatgacatggtgactatgattgataacatgtataggttggaatttgctggaagagtgaaacttactcttaccaaaaaaaaaaagtgcaaaagataaatatgttaggtgatggatgtgttaactagatgagaggaatccctccacagtgtacatatatcacattattatggttgcaccttaaatatcttgcagtttcatttgtcagtgattccctcaataatgctacttactattgttttgaaactgttaagagttccctaccagccgcctggagatgagtgcagttgcagacatcttcgacagagatggtgacgggtacatcgactactatgaatttgtagctgcccttcacccaaataaggatgcatacaaacccatcactgatgctgacaaaatcgaagatgaggtactgcttacctttatactgtgtgcagaggtcacctcatgttctgcccagataccctgcacgattgatgctgcagctttatttccacgtttcgttgttacataacggttttaaggatg

SEQ ID NO: 53444 - DNA, 882 bp, Bovine  19866880566117
cccatggactgtagccccccaggctcctttttccatgggatttcccaggcaaaaatactgtactgggttgccatccccttctccagaggatcttctctgacccagggattgaacctgtgtctgcagtttctcttgcattgcaggcagattctttactgctgagccaccagggaagcccataaaagccttaggaacaacctaagtctgcattcctgtttccttttagtgggagggttaaaaatggaatgatgaggactgcagaaagaaaagagtaagcaagctgtgtttgggagatttgcaagctttattgcaaagagtgccgggtgagaaggatccctagggaggaggtccaggaagggaggtagtgtgaccctgaggagggggtgaagggcttggaggagcacttggatcttcttagaaatagaacaaggagctgcaggagggtgctggctgaggacatttgtagctaaacatgatgtgacatgagctctttcgcctccatcatcgtggcggcagctgcggtggccgcgcagtttagtcgcgcatgtgcagtgtgtggtctacgcctgggagcggcacacccttgaggtgactggcaggagatggttagtccctgggctgaagatcaggtagcgtggcatcgctccagaagctcaaaccgttctcctggttggccctagaggctgagacagcctggggtggagtggagcctctgacaccctggaagcagcagactgcgtgcttggaggtcaaggtcgtggttccctgacctgggctgagagagaagacgtcagcacacagggtggctaaacaggagaaaagaagacctgactggccaaagaggtgagtgtgatacagtgggcactgtgtcaacgtggtacc

SEQ ID NO: 53445 - DNA, 2689 bp, Bovine  19866880614165
tgaaaagggcagaggcatttggctgcgtgactactgtgctcaaattacatatacaacatgagtgtgattcctaacgatcctctagacaacaaaaattttatcttatatgatatgaacgttatttttaatggtcctctagaaaaaaaaattgtatcttatataatatgaattaccattatttttaatgaccctctagattcaagggtccccagtctctgggatccactgcttgatgagctaaggtggagcctgtgcaataataacagaaatcaagtgcacaaggaacgtaacgtgcttgaatcatttctgaaaaccacccccccccaaccccacccccggtctgtggaaactctcttccacgaaattgatccctggtgccaaaaaggctggggactgctgctctagatgacaagaatcctatcttacacaatatgattaacgctatttttgatggtcatctagactacacacacatcgttctttccaagagagacatcgtcttgcaaagggggcctcgatgcttaccctgtaaagtttatttcattactgccactgttctgttctgtacttagcagaagaaacaaaactcaaaatgtcaaaaggaaattttttggtacagcaaactcattctctgtgcccctggggagcaggcccagctcagcacgacccatttaacccctcgagctctccgccaccaggcgctctcaactcccaccttttaaacattcaccaactccagaatctgaaactctaagagcctcagatcagagtatgtataattaaaagatctgcattataaatgattacagttgctaggtgatgctgccagcaaatgtgtcaaaccagacctttacctgaggcggcagcttttgattatgttacaatgtatctgtttttgactttgatcccttaaatccaaagcccatctatcaggggttttttcgccataaaaacattcatacttgcagcattaatttcagaaatattaataaaatatgcactctgacatcaagagtttatctattaccagaaatgttgaaaaaacccaagacgttggcactgcgtcctggtgaatgggggcaaatgccagtatgccccacacgagcccctcacctcctccagcctgtccaaggcgtcgttcagcttccgcctcctctctaaggcgagaagccagacttgctgccacttgctcaccagtaagttgaccctgggatttttggtttcaatttgcgtctgtgatccagaaggatagaagcttggggctgggaggcgtttacctgttaaaacacaacttgattaggatggcaaagtctccagggttctggaaggtgttaaggtctgacctctcctgctcctcattcagagtgaatcaagttccctactgactgtgatgagtagaaactctgattgaggtgaagtgcggtatcagggtccaagtgcgttttacttaacagggatcacatactgttcagagacagaggcattttaacgtgtcttgacaggagccctgaagtactaggatgctctctcaatacactgatgcttcaaacacttttcaacctaaattctgtgccacttgagttccaaagaagcaccctgccaccttcctctttgctacctaatcagggcactgctgtctgtgactcggttccagaagcctggctgtgactgagaggctaaggccccgaggatggcagttgcgggcaggcgatgccgggggcgccacagtcagtgagacgcccgacagccccaacctgaccacccggtgtgaggcagcacggccttcctccaggcccgcttcctgctgaagctgagccccgcacactggctcatgccccaacttaccaccctcctcgagcttccgccctctttctatcacttacaggcttctataacctcacagagctccctgatccaactaaacggctcgatgtgagctggaaaaacacatcactggcctcagcttacataggaaggtagtgtccaagctgagatttgcctagatttcctaacccccatgcggctgtacagagatatcaatagctaatatttaatgagcatttttaatttaatttaaaattaaatttaaaattttaaatattaaattaaaaagctaatttaatattagctcataatttaatgagctaatatttaacaatggtccaggaagtacgctaaacacttcacacacagcagttaaattaaatcctcaccacagcccaagaaggttataatcctccccttttacaggcgagaaaactgaggttcagaaagggtttagataacatgtccaaggttgcatgatccagctggtggtgggaaggggtatggcacaggacagccaagagtctgtgcagagtccctaaccactttcttaccacggcagacccaaaaccattttttctttctttttttttttttaactaatagagcattcagaaaatcaacaaattggtataaattatgtgtcttctaaaccttatccaagctattattgaatttgatgtcattttgttgggtcaagacaggctgggaagtcagtaaatagagcctgaagtcatatgaccatgagcaaaatcaatcagattactggttactagtgaacagttaggtcacggtcattcctattccgttccacttggaaggttatttacatactagaagcagaacaagtcatttcaaaggaggt

SEQ ID NO: 53446 - DNA, 3103 bp, Bovine  19866880764315
tttgggcttccctggtagctagctggtagagtccgcctgcaatgcaggagactctggtttgattcctggatcaggacgatccactggagaagggacaggctacccactccagttttcttgggcttccctggctcagctggtatagaatctgcctacaatgcgggagacctaggttcaatccttgtgtggggcagatcccttggagaagggaaaggctacccacttcagtatcctagcctggagaattccatggagagaagagcctgccaggctatagaacatggggtcgcaaggagtcagacatgactgactttcactttcgtttaacaactgtttaagtgtttatagatgttctaaagtgaaatagatgttcagtcaaagtaatatagggccacgaccacaatatagacatacactttgttatatagctgtattatttttcatattctttgccattgtggtttatcacaggatactgaatacagttccctctgctataccagtaggacctttggtgtttatcccccctgtgtttgatagtttgcatccgctaaccccagagtcctagtccttccttctcccacctctcctccccctgggcatccacaggtttgttctctggagacataaactctggacacttagcattcactcatcatcatccaagttcaggagttggtgtttggttaagggaagggctctggagaagaagtcttgcggctccttctgtgcccacgtaggaggggtacacacaggactctggtactcaaacctgacacctgggggctttgctggcgtttcgtacacttttaactgccagttttcatcttttgctagtttttcaatgatgccaaagaagccacagattacttgaggaatctaaaagatgccatccagcggaagtacagctgtgacaggtccagcagcatccacaaactggaggacctcgttcaggagtccatggtatgagcaggaagaccccctgcttcgtcagcgacgcgtagtggggctggatgcgtgcctggttgcgtttctgtgcatggagcttcgcattttattggtactcttggtgtttccgcctcactcaaccacttaaacgttgagttttagcatttttttctttttggcacacagcaagagtgttgtttgatgtgattgccttagtattttaaaatgctctcactgtgctttgtgtgtgagtatgtgtgtttagtcatttattccataaagacttgtcagtatttctagaccctagacactatttttagtgctgggactgaacacagcagacaagaaccctgccagggggggatgcaataaacatgataaattagtacagcacaatacatgtagtctgttaggtactggtaaatgtgaaggaggaaagaaagcaaccagacaacacagggggagagtgggcggcgaggggctgacggttcagacggaagactctgctggggaagctgcatttgtgcacagccctaaaagaacagagagtacacactgtttgcttctaaaagccttctgatttattcctcaggaagagaaagaagagcttctgcagtataaaagtacagtggcgagcctgatggggagagcaaaaacaatcgttcagttgaagcccagaaatgctgactgtccactcaaaacttctcttccgatcaaagccatctgtgactacagacaaattgaggtactttaactcctagaaacagacctgtttctggcattattcatatatctaaaaaacaaggtcatattgctcactagtggtaaagtttcccactttaaaaagacaaaaaaaatacccaagattgggtgtggaaagagacaaataccgcagtgaccacatctggttgttctgttcttcttttaaaaccagataaccattttcaaagacgatgaatgcgttttggcaaacaactctcatcgcgctaagtggaaggtcatcagccccactgggaatgaggccatggtcccttctgtgtgcttcaccgtccctcctccaaacaaagaggcggttgaccttgcaaacaggtttgtgtgctttagttccagatgtagggctggctttgggggtttctgaaggtaaaagaaacaatcaatgctttggcaaggctaatagaatatgagtttgagcaaactcccagagatagtgaaggacaggaaagcctggcatgctgcagtccatgaggttgcaaagagtcagataagacttagcaactgaacagtaacagcactggatcagaaggacctcgagctagtaaacttgagatatgtctcaaacacagaaagaaaccgtcacacatgttggtggggaatggaagggctgaatctgagtttcttccttgtgtttcagaattgagcagcaatatcagaatgtcctgaccctttggcacgagtctcacataaacatgaagagtgtggtctcctggcaccatctcatcaatgaaattgacagaatccgagcgagcaatgtggcttcagtaagtgcagatctgcacgtcccacccaacctgtcccaagatgcaggctcttgtcatgaagagtggcctttgtgttatcccttgagtcagatgaggtccagcagatccatgataaaattcatttactcactgaatatctgttacatgcctgttttatatgaggtactttctaagaattgggggatctgaaaatcccatacttcattcagtgtttctgttttcattgggaggcatagtatatagtgtttgggcatacagacatgggtatagtttcattcatctatgaaattctgtagtcttgttttcccttgtcttttaaaacctaaagttgtgaatgaagaaaaaattaatttccagtgattttctattatgattatttaatataaactcatgtcccataagaaccacttgagatcagtcctattgaaatttcacccttaatactataatggatcattggtcttctttagataaagaccatgttgcctggtgaacatcagcaagttctgagtaatctgcagtcccgttttgaagattttcttgaagatagccaggaatcccaaatattttcaggtctcagatataacacaacggaaaaggaggttaatgtgtgcaag

SEQ ID NO: 53447 - DNA, 1739 bp, Bovine  19866880776279
tttaggaaaaaagtatctcacaggtggggcttgtttggggtggaagggctgtgcacaccagtctctggttactgtcttcctgtgtctgtgaaatcagtccagtaaatacagcgcgcatcatgatgcgaaaccatgtggtctccaggccctttaaatcaggtgattcaagcataatgctaattaaagaccaaacctagggatagtgtgtcctcgttactgactgcattaactaatgtaacgggtacccaatcccacagccacagaaatggccaccagggtcctaagctgacaccttcaaggtctggcctggggttgaaaggaagagcttgtgcacaggtcaatggaaattcatggtaagggaatgctagaagggaactcaaaatacgtgtcctacttcgttacattccagggattgcatggacatctctattcttgatttggagagcataaagaatagactaaacctcttttggaagtaaggccagcctcggtgaactcaggtctcccctgagctccggtgcctctgagcattgtcctgtgtcaggaggacttggttcataaggaacaggacaccctcatgaactgcatttgtctggaaaggccactgggcccagggatacccactagatgggctcaacccacatttggcccaggtttagacccttggcagacagaattgtgattcctgtgtgagctagaaagttgtgcttttttgataaggaagtgtgtcttctcgatactcttctgctcgtagctgttcaggataagctcggaccagatggtgttcatctggggagaacatccacgtgctggtggaggagcgggaggccaagctgctggacgtgatggagctggcggagaagttctggtgtgatcacctgtccctggtggtcaccacgaaagacacgcaggacttcatccgcgacctggaggacccgggcatcgacccctccgtggtgaagcagcagcaggaagcagcagaggtgagccgagtctcccttaaagttaagagaacaaggcgtagcggcgtgaatgctgggttcctttagtgtaaatatttggaattatgctgttaagactgatacttgactctgaaagtggaatgcacaggatgtagtacgggaaagagtccccccctcaggtttcccttggagaatgtgtatttagaaagtttctctccatccccactgcttctgcctcactgctgggccttgtcatgtcctttttgtctacaaaaggaatctgagaggcagccccacctgcagtctctctccctccagcctctaagcttactgcccattgtcctctagacccgctcttgctatcctgcggcttcagaagcccttggaggattgcatccattacccagtatccaggtcacctggaacatgggatcagccctttccaccccagcctagcccaggcctatgtttccaaagccacctttttctcctttcctttccccagctccttctccaaagcagctttgttctttctagcatctgcattttgcacattttgtttcctcgccctgggatgcctctcctgacacgcctctggtgaatctcactcagactccgaggctcgggtggattgtcaccctccaccctctcgtatactcagctgagtcagtctgttcccatagcactcccctcactcccaagactgcagagggtgacttcctgttggcggtacctctgtctttcctgaggactggagccccttctccctgtgtctcc

SEQ ID NO: 53448 - DNA, 1244 bp, Bovine  19866880832517
tatgctcctcctctccacacttctaaatatgaaagttaaaaaactgtgtcctggacttctgtggtggctcactagtaaagaatctgcctgccaatgcaggggacacaggttccgtccctggtccaggaagatttcacaagactcagagcaacgaagcccgtgcgccacagctactgaagcgcgtgcacctggagtccgtgatctgcaacgtgagaaggcaccgcggtgagaacctcgtgtaccacagctagagaggagccccactcaccacaaccaaagaaggcctgtgcagccaaaattaaaaaaaaaattgtgtcctgaaaatttcaattattttgtatctgattgatgattgaaaattttaatcctataggaatatcttttggcactttgaggataacccttagcatctccaatttctttggtcaaaaaccattttctggcaagaatgcaacttgagataattatggctttaggcactgagtttgttttctgaaggttattttgatttatgatgactcagctgctcagtctccgtggttaactttggtgggggactggtcttcatggattaccatgctctgtcttcaaaaggcatgaaattcaaggcactatagtttctttccttacctcaatccattttactctctctgggtatttagtattaaggttctcaaccttagtattaaggtttctctgtcttagtattaagacaggaaagttcctgtcttactaaaagggtaattgtcaaggcaatggattattgtctacggcttgtttttttagtgctctagccaaggattagaaatatagtgtttttaatttcttttcttcagactagattccttgatcttttctctgctgcagggcacttttttttcctgaaggaacactataagtgaaaactcttatttgcccttcctctcttagtgatagaggcatgggtgtgtgtattggttactcagtcatgtctgacttttttcgaccccatggactatagctctccaggctcctcagtccatggaattctccaggcaagaatactggagtgggttgccattctcttctccagggaatcttcctgacccagggattgaacccaggactcccgcactgcaggcagattctttacatctgtgccaccagggaagcaccgaggcatgggtagaatctttgccattgacctaaccagtctaaacttttatttatttattttggctgtgttggtcttcaaaagtctgcag

SEQ ID NO: 53449 - DNA, 1505 bp, Bovine  19866880983848
ctgaataaggaccttttccgttcctctcggattgctgtcgtcacaaccttgtccagctctttctttgactgctcccgcctttatagtcagctgttcacactttatcttagcttcgttcagtttctgttcaatcacagccttatcttcttgtgacagcttttcaccactctcttttaagaaattctctgtgtttttcactatttctgccaatgcctgtgcacttccttgcatatctttctgtaattccttttaacacagaagaaaaaaaattattaaattagtaaacctatttaattctttcaaaaccatcattctgaaagtgggggtaggtgtgggcagaggagaatgcatacaatgcatacaggttgaaaaagcatattcaatacaatgttcatctgaatggttttatttaaatcataatatttaatgtaatttgaaacctcaaagaatattaaagaaagatataagatttgcatggttaataaatggatgtggtttgtaaaacactgaaaagaaatatttagtataatctttacaaatttgcacacatcagatttttttacattatgtgagtacataataaaagtttttaaatacacgttaatattatcaattctgtttctaaacattaacatctatctactgctcaaaataaaaacaaataattccctaaattatgagctaagttgttcctaaaataatttccaaagacaatttttttctactaaatgccagagttctataaaatgtaatgtttgcttctttgccctggctgctaggaagctcagagttaagatctctcctcaagtaatatagctttcctctcgttagatttctctatgtaattcttcctctttttttcacccattataatttcattctctatattgcactatgtttaactcttcatgcctatgttcccccataacttaaggctccccaaatttttctgggaagtatctgaattgaaagagacagtgtccagttgtcccagcaccaccgagtgaagagactttttctccttgtatattctttttttttttccttgtatattcttgcctcctttgtcataactaattgactgtagtgtgtgggtctattttgggactctattctgccccattgatttctgtgtctgttttgtgccgacaccatctcgttttatggcaatagctttgcaggacagtttgaaatccagaagcaagataactctagctttgttctttttcaagattgctttggctattcaaggtctttgtagttccatataaactttaggattatttgctgtagttctgtgaaaaatgtcatgggtactctgatagggatcacactgaatctacagatttctttgggcggtatggacaatttttacaatgttaattcttccaatctatgaatactatgtatagaatacataagatatacgaatatattgtacagcacagggaatatagccaacatattagttttaaatggagtgtaatctgttaaatgttgagtca

SEQ ID NO: 53450 - DNA, 840 bp, Bovine  19866880986810
aaattaaaataacattgtaaatcacccatacttcaattctaaaaatacatttaaaaaaagaatgtagggcttccttagtggcccagtggtaaagaattcatctgccaatgcaggagacacaggttcactccctggtctggaagatcccacatgctgtagaacaactaagcccaggccccacaactatcaagcctgggttcccgagcccgggggctacagtcactgaagcctgcgtgagctcacgctctgcaacaagagaaaccactgcagtgagaagcccacacaccgcaactgcagagtaccccctgctctctgcaactagagaaaaaattaaaaaataaaattatttttaaaaataatttgaagtaagaaaaaaatatatgacactcttcaaagaacaatatacgtgtaactcacaataaccatacatttactataaagaaaccacaagccctatattaaaaggaagaaaatcccagtgttatatctcataaatttattattcatttttgataattaatgaagtaaaacatgagattatagataaaaacttctaaaattctcatttttttaggcagcttcactcaattactaacaaacataaaaatcctgctcttgatttaaaaaggaaaattgtcagaaaaatttaagaattgttaagaaaaatgtaaaaagattaagaagacacatgaaagcagatgatttgaatttttaaatttcattaaaataagtaaaagatgataatttccaaacagttggctaattacacaaagtgcactcaggcatgagaaacttttataaaaagggaagaatatttctattgagcttgaactataacag

SEQ ID NO: 53451 - DNA, 1891 bp, Bovine  19866881008655
actctcaggaatattttaaaccacttacctttctcccaaagtgtatttttctgttacaaaaaggcaaaatccctaggtctttaacaggggcagcattcaaatgagctgagataaaattatgttcttaaatttgtctctgaacacgtaagcatattcaaagcaccaaaggagtaacaacttcaactgccttctcagatgacgtttttacaatcaaaatgcatgaattataacacatgatctcttaggttagaactatgcttcccatcaaaggcacacatttgaggcccatgctttgagaaagaagtttttgtcattgaaagaagtactgaatttctgtccgtggagattccaggtcctctgtgataaaggtcacgtgaggaaaacatgattatcaccttgaacctgatcaccaccactcccacttgtgaaataaattgacaatgtcacgagggaagtcataactggtcatggttccaaaggaaccatttgctatccttctaatcatatttgatgccattttaaataaaactctaccatttgattcttaaatgtacgcaggctaaaaggatataactatattaccttgtcatacattccctgctttcagttcatgttttttagtgatttaacttttccccttttgaagagaagagggctggggaccctgtaggctcagtgtcaccaacagtggctggcacatggttggcacttttgaattaaaagtagaatgactgttattttatcatttgttcattatatattatatccttgtgtttctgtcccccaaacttagcctatcacactgttactaaagagagatcatgcatataacatttatttaaaacaaataaatggaaaaaattcactttaaagaatcagttattccatatgttcatgtgaatatgttttattaaatgcatactataataatatctttctatagtatgtgagtatacataataaattaaaaggtatatatttattaaatatagatataataccagaacatgattatttcagatgagaaaatcaaaataaacccatttttaagtctcttttggtcactccaaatggatatttgctcataaaaaaatacacagatttgttttttttttccctggggaaaaaaattaattccatagcaatgtagttaagggacatattttatttcatagcttttccgcaagcaaacttgctttgatacaaaatgagttcaatggtacaggcgctactgtccactcaagcaaaagaaaacctcacatttagatgaatgcactttatgatgatactcttacaggatactaggtctcaggtccaggtggcctctggcctcaggtgaagccatgggcgcagaaatgcacaagagtctgggagtctcagagcatgggaaggcgcggaaaggaacctcctgtgagttctgtcagcaggaggataagaaccgtggtgggtgtgtctgtctttctgccccccatctcgcagttcacactgacatcatctcggaacagatccctgggggtgtctgttggcttttcggggtctccagagaagcaggggcgtgtcatgaggtatccttcacattagcgcccagtggagggctggctgccaggaggctgtggacttaccttcaggtaccgtgtgctcagtgtaggaacctctgtgcctgtcaaacactctctcctgcctcacagaggatgtgagtccaaccccagactatctgacccaaaatcatacagaggaaagaaaaagacaaatacacagataaggccatctgcagaatttttaaactcacctcttgcaatatttcacaataatctctacatcatatgttacatctctcagacttaaatagtaaaggcttcaggaagggccgcggcggaaccaactgcactat

SEQ ID NO: 53452 - DNA, 1077 bp, Bovine  19866881073626
ccatctccagcatcagcgccacggtcatcgtcgtcctgctcgttagggccagacacagattcctcataactgtctttgctttgcacagaatctaaatgatcaggagcagattcaaatccttgtccagccacacagtctttttctctcccttcccagcagccagcgtcctcagattctaccgccatcgtgaagctctcttttcctccctcagtttcatagtcagtcaatgaatcagactcatcaccttcaaggtcatctgtgctgtccctttctgatacagtttccatcaacggtccactcacttcataggactcaaatgaatttaactggatttcttcaccagaacctaactctgctttctcagcacctatgagaaaatcctgcagagactgtgctcctcccctcacacataagctctcagccagccctgcctgggtccccacagaatgttcctcctctttagaaacatcatagaaaacctctccaggaggagcggcccattcgtcctcctctggcagcgagtcatagtcctcgggctgcagacaatcacagtcgtcaccttcaaggagcagggaatcatggtcgtcgtcttcagacaagggcgtgtcatagaagtcagcatcgctgtctgtgtctgtttcactgcaccggtcatccagcagggacgtttcatagtcgccagcactggcgccgacagttccttcaaaagatggggtatgggtgggagccaggccaacatcatgaccaccagcccttggggtcggggcacctgaggacccttccactgtggactcacggttctcatcttcaggttcctgctgagaagcagcaagcgcattttcatcttcaccacaagtatctgaactaaattcatcactctgacactctacctgaggattactacaaccaacattgaaagatttctcttcagcctgttctccctttaaactgatgttaatagctgcaattcccagaaactggtcttgaaatttttctcttattctttgacctgatgactcagtttggtcattgaatggcaatgtagaggtttcacatttctttccattactctctgcg

SEQ ID NO: 53453 - DNA, 1221 bp, Bovine  19866881198843
ccccaacctcatctgtaagaggggagggtggggccgggctgcctggatgcaccagttctgaagttctttctcagatggactctgcctcaagtatcaaagaggcttgtcaggtgaaatttactcagggttcccataaaatcgacgttgcactcacatattaactgcttctgagaatgagcccctgtcactgcagggagagctgagacatgatttaaatggaagcaatttatttaaaattaactgctaattaatgaagcaattaatttacaccaatgtaacctctaaattatcagtcattatgttttacatacatcccaccagtcagtgccaaaaatttgtcaccctgattcagcctaccccctatcaaaacagaaatatgaattataatgggaattatttttcaaagtctgcacaatgggaatgagtcaatgctccaattcataattaaaggcattaaagttttattttaaagcagcataattccctgataagaaaggtcaagcttacattagtagttacattagtagtcaaagattttttaatgtacaatttctttgatttgggttctgtttttctccattattacagaaaaatgccaaatctgtcactcctccaagtttaccttacagctgacttgattggagccataacaatttccatatgaacgcttcttcaaaagttgtaaatgaatcactagaaaattgttcattatatcattttctcttcacaatttagcaatgaatctaattcaaaaataaattttttatggtataatcttaacaagaaagaagtgcacctacttttaaaaaacacagaagtgataaatctatcatctgtgttaatgctgagtcaatttcatttgatagtgtgatagtgaacacaggatataatattatatataacattaaggactaaaacccaaccagtcactataaaacactttttttgaacaattgatgcatcctttggtttttttattgctatgtcattaagatatcaaaaaaatgaaagagattttgccctctataagctgttttaaaatatctttcatcttctcaagtacttttctccagttcacttgcaatcattcaattcctttttcttagcttagtcatcttcaaggcacacaattccattcaaccattaaattgaattaccatcctaccaagtagggtatattctctcaatcttattcctaacaagatataatatgtacatttt

SEQ ID NO: 53454 - DNA, 2407 bp, Bovine  19866881247964
aaataaataggaacactagggcttgcggagtaagcttggcaggggctggggggataattagtaataggacccaggaggcaagctttttatgcttttttcttttcagactctgaactgaatatggtaccaattgtgtactcagtcatttaagagctgtgaggacctggaggctgggtgctgtggagatgggggggtctggaaaatgggagatgttagtgtacaagtcaaaggaatggctgtgatgtagtttgggaaagagaatgacgggaggtggacttgttatgaagtgttggggacgttctagatggaacagtttctacctgagctctcccttcccctcagtctgtgttccccgccaagcatgctcatggtcgcactgtcttccgctaccactaaacacacgcacgcacacgcatcctcaggagtctcactgataagctcaaatatggaccgtttgcctcaaatgaagtatccagcgcctgggcagtttatcttcctttttctaataaaatggtacataaaactcacctcttctataaagctttcctagacaatgcttagtggattagctacttcatttttttttttcaatacaccccttatgtaaatctcacatatgaatctttccatgtttatctcatgcatctcttaagtagattacaatatattttatatattataggtagtgtgtacaataataataattgtgtataatcattatagatgtgaaagctatttgtatatttaattaaattaaggaattgatgacaccaagcacttgtgattttttttaaatttaaatttatttattttaattagaggctaactactttacaatattgtattggtttgtttttagcacttgtgattttaaaggccaattcatgcctgtgttgtatcttcttctaattataatctgtctgattataatgtctgattataatcagagctgtctgattataatctgtctgattataatcagagctgtttccactattatttttagagccctagttagtggtgactagttggacacaatgtttatgtgtttgtttgtttatttggtttttcattcttccactcacatactaggtatttcattgagtgttccagggtaagggaatatagcaatgaacaaaacagaaaaaataccctgctgttttggacctcacacaccggtggggagagacagataataaattcacaattacgaaataataaaaagtaagcaatattatatggtgggaagtactatgaaaaaaagttagcagcagagcaagaaatggagtgaggaactattggtcataaagcataacttatagagattataatagttactttgagattataacagttactaaaatggtaccagttacctttaaaagttgtgcattctcctttcgaaataagcttagtataactttaagtgtaacctcattcagggagtgaagtaatttacgtaactaagtttaattgaatctgtgaatctgagaacagaacagagctgtatctgcagagattatttgtcaaaggaaggcagtggttagctcaaggcgaattataatgggaaagtggatggtgttgttttatgattatcaatcattcctttatctgaggcagggagaactagatttagattaagtttcacttgcagatgttgctgcccactccccacctttagatgttttaatgatttttcaactttttaaaaagttgaaagtgctatgcaaaagtaggtacaaaagtactatgcattcaatagaaattatactttgaattttgatcttttcctagactagtgagatgcagtacaatggttttgcccaactgtaggctaatagaagtcttctgagcatggttaagtcttccaggctacccatgatgttgagtaggttaggtgtattcagtgcattttcagtttatattttcaatttaagatggttttttctggacataatcccattgtaagtcaaagaagatctgtatagtaaatgtaacttgctttcatttgaattagaaattctgttttttattcctcaaaagcatataacttcttttctttataagtcaattttatagagatatagattatttacaataaaatacaaatacactcatttcaagtcttgacaaatgtatacacctgtctaatcagcactctaatcatgattctaggtttccatccctctaaactcttctctcttgcctgtgtgcaatcatttctccctttctgccctgtattaaatagttccattgattctacgcccttcaatgttagccaccaacctactaaaaatacttctggaagtaggtggattataaaaaaacaatcttcataaatgaaataaccttttcaagctctaggctttcttcctgtgactgtcattcaatttacttttcttttagt

SEQ ID NO: 53455 - DNA, 840 bp, Bovine  19866881387700
attgcgttagaagcgataatagtatattacaaactagcaaacatagtgttattggaatgttttcaggtgctcccagaatgatgtgttagctcatcaatccactgtggaagccgtgaataaagcaggaaatgacctaattgaatcaagtgcaggagaagaagctagcagccttcagaacaagctggaggttttgaatcaacgctggcaaaatgttttggaaaaaacagaacaaaggaagcagcagctggatgctgccttgcgccaggtgaataaggggataaatcctgaaaccttccgtagtcttcaagatcaagatggcatgaccttctctgactggatttcagacccctgtttcgtttttataccttggggagaggagtaaaaataagtgggataaaggcgcagagctgaagagaaggcagctttgtagctcttagcctggtggtctgatctcctgacgaagaagggcaggtggtccaggggcccctgccgttgttcagagtgcatggcgaggcttagcaggctgcttaagctttgtttgtggcttcaaagtgaccatatttgggacctgtcttgaacctctctctcactccaggccaaagggttccacggtgaaattgaggatctgcagcagtggttgaccgacaccgagcggcatctgttagcatccaagcctctgggaggtttaccagaaacagccagggagcagctcaatgcccacttggtaactctgttgtttcctccagctctggcctcaggttaagaaattgaccattttgtataggccctggtggtaaataaaccgtaggtaaggtttaaaggctgtccagtttgagcaga

SEQ ID NO: 53456 - DNA, 662 bp, Bovine  19866881432522
aggaaggctttcttatctctccttgctattctttggaagtctgcattcaaatgggaataccttccgttttccctctgttagataacagcaattgttgttttagaagtttgcatatgctagagagatgctgatatattattagtctatactctttcctttggttctttataaaggccatccttaatttacatacatagccactctagacctgagccatctgtgtatgagattatgttattttttactgtattatagtattgatatattattgattttttacattatattttatgagccaatactaatttagaaaagtatttttctttataaaatcattgcacctagtatgtcataattatcacttgcggacttatattcttcatttcctactttctggttattttagaatgacagatgaagaaagaaatgaattggaaaaacaagtgaaaactctccaagaaagttataatttattctttagtgaatctctgaagcaactgcaacagttgcaaaccttaggagacataaaggtagaggagaaggtaatgttatttatttagaacgcgaggctgtttcaagactctcagtctaactgcatggttgtagaaatatatgtcaatgacaaagagatgatcttgagttgtgtacgtggaagaaacatg

SEQ ID NO: 53457 - DNA, 1395 bp, Bovine  19866881537938
ctttaaaaaaaaaaaatctgtatttttggtaaatacagacgttcaccatggagattttgcgacacaaggacattattgatgagcttgttaaatctggacataaaatcatgagcacgtgcagcgaagaggaaaagcagcctatgaaggtacaatcttgtccatgtgactagtgtgagacccgtaagcagacagtgtgtgtggggctttcactcggagaaaagctcttttcctttatccacagctgctgtttaaacagctaaatcattagttttaaataaaacatttttcaagcttacagaataacagtgaaaagaatactccttaagggaatcactttggggataatcttttttaatagacagaaaagctattaatgtttgaatccttgagtaactgggacccattaagcatccaattaatgtttgctgtattatcattgctattatcagagtaaattgttattctatacgtcaactgttgtttataggtttcaggaacattgggtcctctggagtcgagacaaaacctgaaatacatagttctctctagcttaaacccattctgtataaagttacagtaatccatatagaaaaaaaggagtggagtcattaaggaagtattcagtttatgtagttttaatgatctttacattggtgggaaagcagcctcaaataaaaatgtttagttcaattcatattcagacctctgagcagcataaagaaattaatgcttctcataggaaaatagcccatggcagaaaaacatatttgttatacaaatgtctatgcctaggatcccattgagaagatggtgcattgcttttaaggcataccataggcaagtaatagaatgcacagtgtgtgttggtattttttctcttttatttaaatactccacagtggcacttggttttaatataatctttattatttttgcaaaaaatcttatgtggaaaatatagatgatcatgaaagaatctctgcgttattctgtggtttattaggttatggttgtgctctgtcttttgctattggattatagtgaatttataccataaacaagatcactgtgaccacccgatcaaatcagtgtacagcataatgttctactttgcttctcaatctatgtaattaattttcctgactaggagttccttttagaatttcattcttgaaagacagtccctgtattttcacagaaaagcagtgttcgtgttggacttgccaggtagctcagtgttaaagaatccacctgccaatgcaggagacttgggctggacccttgggtcagatagatcccctggaggaggaaacggcaacccactccagtattcttgtctggaacatcccatggacagcgaagccctggcaggctacagccccatggggtcacaag

SEQ ID NO: 53458 - DNA, 667 bp, Bovine  19866881975628
gagaagctggatgcgctcatcgcaaacaacgccaatgccaataagacctgcaagatgatgctggccacggaggaagcctctcccgacctcgtcggcattaagcgggacctggaggctttaagcaaacagtgcaacaagctctgggaccgtgcacaagccaggaaagagcaggtcgaagggaccattgtgcgccttgaggaattctatagcaaactccaggagttttctactctgctccagaaggctgaggagcttgaggagtctcaaggccccgttggcatggaaacagaaacaattaatcaacagctcgatgtgttcaaggtagggagtgcttcctttttattccgcgttttggttattcagagatgtgaatagagatttcctggtggcccagtggttaagactctatgcttccgctgcagggggcacaggttcgatccctggtcgaactgaaatcccacatatcttgcagcgtgaccaaaaataataatgataataaaataaaaaataaaacttccattaaagaagactggttgacagagaaggaggtggcctgttttgcagcatcttcaagtgggaccaccaggcagtgttggagctcaaatgagcatctgtgtagcgggtatctgggcagggcaggtgggtccttctgcttctgctttggcct

SEQ ID NO: 53459 - DNA, 748 bp, Bovine  19866882203652
catgtctctttcccttctggtttcctcagtgtgtatgcccagcagtgggattgctggatttttaatgcacatgttcattttaaacaatgggatcagtagatatataaaaaataaacaatgaaaaagacttactgagttggcagacttacttgtggaatatgttttattttattgatgtgcaaaatctattaggctgaactttacatataatattgttattttttttttaggtcaaagtacagccaaatatgacaattttataaggttcaacctaatgtaatattttgtatatgaaatatattctttccattgtctgattttatgtcagtcatttgtaaatgagttgtaaaattaggcaagtgaagtgtttacctggtgagcaccttacacatttttataactttgtaaattgttccattttagcaatggagatctgaagtggatgaaaagagagaggtcttccatgagctggaggatgagctgcagagagcaaagaccatcagtgatgagatgtttaaaacctacaaagagcgtgaccttgactttgactggcacaaagaaaaagcagatcagttggttgagagatggcagaatgttcatgttcagattgacaacaggttagtagccttttcattcagttttagctcagatttaacctctctattctgggtaaagtctaaatatcttcggctttctacccccatatgtaattcattccatagaacagttacttgtgttaattgcaaga

SEQ ID NO: 53460 - DNA, 958 bp, Bovine  19866880343255
tatacccttatagagagtttattgcatgccaataacttgacatattttattattagttcttacagttcacttcagttcagttgctcagtcatgtccgactctttgcaaccccatgaatcgcagcacgccgggcctccctgtccatcaccaactcccggagttgactcagactcacgtccatcgagtcactgatgccatctagccatctcatcctctatcatccccttctcctcctgcccccaatccctcccagcatacaaatagatattcttagctccattttagagatgaggaaactgaagcttgagaagcccaagcaacttgtataagatcttatggctagtagatggtgagctggaatctgaactgacatctcaatctctccaaaaccaatgctttttcccccaagctatgtagcctgttagtaagacgttctctctccccttctcttttgctcaggtccatgccttgagtgcccttctcctgaaatattctcctccagggaggcctctggattcctttgcatcatcacacgctgacctgcaattttttccttaccttcacccagtctaatctgccctctaatctccaaacccagtgtgtacttgaacttgtctgctgttagtagaagctccaagcaagtatgtgcaatgagaagtaagtgaggagcaggaacaaggcggctacagacaggagccaaacttgaatccttggcagggctcttggagacagtatgacctgaggtcagccacgccttggccctgaagtgggaaaggcctctgaccttttccctcaacttgatgcccagggaacaacccagaacatgacgactctggcagaggtagctgttctattcctcaggtacttgtaaacctgaacaatcaccgtcttcctccccgactcctcatcaaaagcttttattaaatagcctaattattaaacaagggcaggtggaaaa

SEQ ID NO: 53461 - DNA, 3193 bp, Bovine  19866880384500
tctgtgacaccgtggactgtagcccgccggctcctctgtcctgaaattctccaggcaaggatactggagtgggttgccattcccttctctgggggaatcttcccaacccagggatggaacctaggtctcctgccttgcgggctgaattcttgactatttgagccaccagggaagctcctggaagttgcagtgctgaagttaaatatcacatctccccgaatttctccaccacattcaggaacaaggggcatatcacaccatattatttgttctggagaaaatggaatctctcctagctcccacttgtcaatggttagaagtcaagatgggtcagccccacccctccctcagggtcttttggaaaccctagaatattcaggcagagcaaggtcttcggggcagggcctctggtcaccacagctttagggtcactcctgaggataagacggggtggctcgctgcttctgggtcaggtacgctcttggctgcgactcccaagctgccaggcctgatggccatcttcagagcatccacgtaatggcggtcttcagagaaagggatcttaccattgctaggggctgtgtgcaagaggaggctccagttcctacctcctgtgttatcgtcatcctttcctacccttcggctttgaagaaatcacccatttctctttctggaaaggccgttccccctacttcatctccatcattgaccaggtcttccctaccaagtgcttccacattaggggtgtttcatagatgggggaggggaggaaacgtgtgcctgcctgcctgtgtgtggctgtctccgtggtggttacaacttctggctacagttcagagtggcaaatgccagggaaactccctggagactagggagcccagctgtttaacacaaaggcctcgggatgggagaagagaaagtgtccgccatttctgactcttactgaagccaaaccaacgaagtaggttattccacacatgcccatttgcatttgatgcttgatagaactgtctctattttcatcttcctggctgtataagggcaaagatgcttgagaaagaagagatcagggtcctgagagagaacttgttctcaacccttcactatcatcgtgataactactaacacacacacacacacacacacacacacccacccacccagaagcgcaatgacagaaagccaggtctgacagttttcttcaaccagacaatgaccacagggtcccttagagcagcaatccccaacctttttggcaccagggactgattctgtggaagacaattttttcccagacccggggtcggggggatagttttgggatgattcaagagcataacccaggtggcgatagtggtaaagaagccacctgccaatgcaggaggcataagagacctgggtttgatccctgggttggcaatatcccctggaggagggcatggcaacccactccagtattcttgcctggagaatcccatggacagaggagcctggctggctacagtccatggggttgcaaagagtcagacatgactgaagcgacttagcgtgtaagagcattacatttatcgggcactttatttctaatggaatgccaccactgatctgacgggaggtaccggtccaactctgggagttggtgatggacagggaggcctgatgtgctgcgattcatggggtcgcaaagagtcgggcacaactgagtgactgaactgaactaaacccgtccgcagccagctccagcaagggagggggtggtgcctctcctggctgggcctccggagctgaggcatgttctatggtacgtttagcaggtagccccaaatctgtgttagctagcatgtgatggagggaaaccccctctacatctgttaggttggagtgggcttttcagcgaccagggtgtgtcccaagcaacgtggctgcagatgcatgagcaggaagagctgtgccctcctgggagctcaccctgagcctccagggtgagcagcaccctatgcagtgggtgggccgtgtctgggtgaatgctgagtctgaacactgcttctgtctcctccacccgagctgggcaggggggtgcctgagacactgaactcctttggaggagctggtgaggaagagctagggtgtggagcctccaggggcccctctgggttcttggctccgcagcaggctacagtaaagtgaggggccctcagaacccaggcagagatggctcctgctaggaaactggggggaggtcggggctacttcaggagcttcagactgctgcttattcacaagacttaccaccaaataccacgtagatcaggcgcagcttcattctcagcggcactgagttacccacaggtcctcaccaccctggagaaggcaccacagtggcaggtcccaaagataacgatgactgtgtctctggagaatttcctcctaatgtataggctgccatctgaagcatgtgggcccatttagtaatgagcttagcaggtgatccaaatgatgtgttaattgagcccatggagaaaaattaaatagatccaataaaaatcatggaggaaaggtttctgaaactgctgagtattgaggactcactgatggcttccttctatcaagtcattaagctggttgcaataatttcttttaaaagataaacgtttttcctactttgtatcgtctgtgtttacccttgctgttgtcaccaccattttcacagctgtcagtcacttcagaaagcccagatggaaggaaccattgagggcatttctgatctctctctgggggacagtttctccttccagcatgttcttctaggctttgctagggctagttttaaaaggatcctgaagtgaggtcctaccacctcccctggggaaagacgattccatggctagatctgatcacacagacaactctccccttgttattcttccccaactttctgttctaaatgtcatcctggcaatcattcatcacaatgaataggaagttataattaatagaggcccaaatcattcaagtggaagattactcttttgaattcttgtatttttcttggaagatgtccttgagttaattatttagtgtttttttttttttttttttttcttcttcacagtcttgtttccaaaaagaacaaattgatcacagtaatgcaggggatgaagggattatgtacaatgtatgtaagagacaaacg

SEQ ID NO: 53462 - DNA, 3491 bp, Bovine  19866880409830
ttttgcctgtaacaaaataggtccatctaaatgtggcttgaatgataaggaaatttaattttcttgtacaatacaaagtccagcagtagaaagcttcaggaactcatcaaggcatggctttgtgtcagcttccatccatgatcacatccagatccaggcgtcatggcttcaatgcacaaaatccagaacaagacaaaaaggagtttctcccacttgtgtcttttatgttaaggaggaacatatttctcagaaaccctcagaaggtcccgctgatcagaactgggtcatacccctgtgctctagtttcaaggctgagagagagaatatttgccctttttgcatcttttccgggaggtcagctctgccaacaagggaggaggctgtgggggatgactgaggaatggcaacgacgagcacatgccaaggatgggtgttgagcaggtgaaccacgtgataagatgggcacctggaagatggctctggtggcagcttggcagaaggacgaggtggggagataggaaagtggaagaggggcactttcagaggctgaggtgctagatgaactggtgacttctgtacagcccctgtaattccatctcctcctgccaatgagaggcctggggaaatcagggctacacaagacccactggaattcatttaaaactataatgacaattaatactgagtagctttatgttggaaggctcaaaaaggcttcctcggggcaaactgatgcaaatatttaaaagggtttatagaactggatccccagaaagcctttcagctcagcctttcaccagatgtcatacgtacaagttaactggaaaaggttttcaaaagactaagactgtaaatgtctgggctttgagacgcttgttcctggtttgaggaacaaggtctacacgtgtgtatggtacgagataatgttctgattaaggatgctgttgttggaggggactaaagccaataaaaataaaggacagagggtaggagactgaaacttcatgctggccaaaggtgggaaataagtaaaacagagcccacgacactagaaatcaacaagagccaaagcccttcttcccgtctcccagtggatcatgggtgcttatagccatgagtctgtattgataccattcccccgcttctttaaaaaccaaaccaaacaaaaacaaaaactagggtaaaaactagttgcttaccattactaaaaatagatgcttactatttctgcacaaattccaatatggccacctggatccaagtccatcacctactgccaagaaccacactttcagtatctggaaccaggccatgtcacgggcagatgaccagtctgcgaatggggctgcccagggtcaggtgtctatctcggggtttcccgtcagctgtacctggggtttccataaaggtgggagagagggggcaagactggatatgtctagcagagtcggcccggattcagtgtatgccaacagggacgcccagaaggcccaaggcactggaaccaggggtggagggtatgtggagccagtgagggaccctgaggtggaaatagtactctctttttcacatcctccatgtttggttgatgtccttccaagatgacagagtcagaccccgtaacataaagagcatgtaactctccccaggtcacagagaaggggcagtggggtcagtgggaaccacatttctaaggtcacattttctgaaaattcaagtcacttcaccctctgaacctcattccctcagcttgaaaagcagagaatgatttctaaggttccttccagccatgtcattccatgactctgggctctttccttagagaggggtcagaaaaataaagaagtgagcagaacattttccatcatagaaggagggcatcatcactcatctgaggcggtacaatgttcggtcagcatcaccccctctccttttagagaagaaggtgatgcaggagaaactaagctcttaactctgaagtgtaattaaacaaaacgaaaactaatgacccagaaggaaacttctgttccctactgcggtctgttctgatggtaatggaagaggatatgctggaaaatcatctacacgtgacaatctgaaatgataaccctccatgtcactaggcagaaaaggctgagggcagttccagggtctggagcctgagagaactgaggggctgggttgctcccgagtgcctctgcaggttgaggaaagcatgaggactgggcggatggggttgccatgagctgataatcaggaggttcatggagggggcagctactaccatgggccttggaactttcatttggactcagcctctcatcctgaggcagccaggccccctggtcacttgctttggtggagatattgcaaccacttgacgtccgtcaaagccctcagccactcatgacaagcacactgggactgtctcacgtgggagcaaattagcttgacccctatctgcaatgtgggagacccgggttggatccctgagttggaaagatcttctcgagaaggaaatggcaacccactccagaacccttgcctagaaaatcccatggatggaggagcctggtatgttacagtccatggggtcacaaagagtcgggcacgactgagcgactttcctttccttttcctttaagagaagagggaaatatatcaccctccttacacaggcaaatagtcagatggctcctgttattaaaaataacctcactgtagagtttttaagcaagtagagagaggcccttaaaaagagctgggaatgaagcatcgagatcagagcaagggtccatggcatgaagtttaattcccacctgctttccacagtgttttgactggtaccattttcttggaatctgatttctctcctttccttctaacctttcttggacatgtgattagcttagaaagagagccagggtcttttgtgtcactaaactggatttggcagggaggtcagtaccacccttataggggatgggatgcaaagggacagatttctttctaagcatgtgtctaggacagcgtccttggtggtccttcgtgggaaggatgataagaaggggggatgtcagatccagggatacactcaccccctgcaacctactcatgaatgagcatcaagagacacatggaaaacaattcctcagactagagaggagactgtcccaggtggccccgaggtggtgccgtttccgtcagcttactcctgggcttgaggctctgctggttccttgatgtagctgtgtcaggtctcggggcaaaaagaggggctaaggccccttggtgagaaattcttctggcctgatgaatcaagaaaggtcgcccactgtcaggatgggggttagagccatgagaacaagaagagaacatccttcccaggctcacctcttccatgaaagctcctctgaccacttcacctctgaattcctaatggaattatcgtctgaacacttatgggctcacagagctgggaggatgttttt

SEQ ID NO: 53463 - DNA, 1977 bp, Bovine  19866880412583
tgtgagtctcagtgaactccgggagttggtgatggacagggaggcctggcgtgctgccattcatggggtcgcaaagagtcagacacaacctgatcgactgatctgatctgatcagtgaaaaatacacactagatttcaaagaacatctgaaaaaatagatctctcctgaaattatttttatattttttcatgttgatataatagtattttaaacatactgaattaaacatattattataattaatttcacttttttttacttttaggcaatggtaccccactccagtactcttgcctggaaaatccccatagatggaggagcctggtaggctgcagtccatggggtcgctaagagtccaacacaactgagtgacttcactttcactttcactttcactagaaaattttaaattacatgggtggctcatttattttccctgaacagcactgctctaagatcaatcctgtctttcccaaatcagtttgtaggcttttatgccaggttggaagatgaatagaaatgggattggagagtgggaggaaagtgggaggaaaagtgggaggaaagggaagtgaaggatgaagagaggaataagcacgtggcctgggtccaagggacaatctgaggggttcggtgagcctgcctaatgcagattaaggagagaaaaaggaatttaataaatgtctctgggctacgaatcagattccctttaacgttcttttagaggatgaaatagttagataacaccgacgactcaatggacatgagtttgggcaaactctgggagatagtgaaggacagggaagcctggtgtgctgcagtccatggggtcacaaagacttagcacaacttagcaactgaacaacaacgacaaacaatcaaggaccttgctggtagactgtctagtcatctgaaagagaaagccaatgtgctttaactggaaatgataccctccaagatgactatggcctcaaaggatagaataccctggaaaaattctttccaaagagattagaatagagtgagggagaaaagattaacgtgaaattgagcactctgaacctcaaaaggtacacactgtacctgggaacacagccaaagcacgagggataggtgtggacggcaaaccctcaggtgcaagcctgggatcaaagaaaaggcatatgtggcccaggaaggatgtgacattgaagaaaatgaaatcaatgggatcattaatgatacagatgtacctagatttcgagacggacttggacctattaggagggtcactccagatgccttttgggcaagattacagactgaaatgtgggcggtcctgtaacactctgctgggaaaggcataaacctaggtgagcctatctggaccaagcagacaaaggcatgtcagtggagcttctctcccttcaaatgagtacctgcaagtgcttagtggggtgggggcaggatgctgtcagctggggtccactcccttgaggcaagagaatgctaaggaggatgagagtgccttgcactagtatgagctcttcacttttcaaaatggtgtctcattttgcttccatttctaactcatcaggttgagagggtagttgctgttttcctctccatgtataaacacagagactgagcacagtatgtttgtggctggcctagaatcaacttgtttaaaatggtgctttctcctggaacctgcatcagaaccacctgaggagtgtattttacatgacccaactcagatattcttaatcagaggacctctggggccagagtccagaaatctgtgtttttattttgaattccaggtaattcttttgcatatgaacaattaagcctggcataccatactcaaatctgaaacattttattatcccttgagctcttagctgaattctgaacccatcttattcccatattctttttctcaaatactccctttttgaattggaaacatagagagttccttagaagacagggtg

SEQ ID NO: 53464 - DNA, 4082 bp, Bovine  19866880535614
tgtatgctataatttgggacagcataaaaagaaaatgggcattttgtgtaatgttaaaatcaccagagacaaaggtctattttaattcttatacttaaacatcttggaaattaacagtaagacagcatatgctacatacatacaaatcctctctattcgtacattcattaaaggttatttctctaatttttggttgtcctttgtccattatttgtaatacggcattctaatttggctgcctggagttaaattaccaccctgtgaagttgtatcccaagttcattataagttctgcgtaagacagcaaaagaaactgggtattttgggtctctttccttttgttttcagcaaaatattattacttaacatttactaaaaggcggtgtcaagaaacaaaatgtatttaagattgaactcaactcacaaaaaaattaacactgatttacatcaacttttcagggcccaaaattttttatttccacatattttttcaattcctacatacattcacagaacctaagcacaaaataatttttaaataattattttaatttggaaaaggcaaaaaaataaaatggcatcactgactcgatggacatgagtttgagcaagctctgggagttggtgatggacaggaaagcctggcgtgctacagtccatggggttacaaagcgtcggacatgactgagttactgaactgaactgaaaaaatgaaattttcaagtaattaaatcattcaaactttaaatattatatcagaagagccaaaatttatcctttaaaataccatatagtctgctcaactcaaatcctcttcagatctgcattttcctaaaaaactgcagttagcaaagcacacaagcacaaagctccaaataacagaaccatggtgcccagaatcagcttagggtggagaagctttaaggacagaatcagtccatatttggtttaaaggtctaagtatggcctgactgcaagttaggcaaaaatttcaaagggactgctgaatctgtggcctagtaaatcaatgctcttgaaatttatgctatcttaaactgctgtagattcactaatactaaaatgattccaataaactgacagattttatttgtaatttcacttaaaacagcaaagcaatattttaaaataactacaatattgctgatatgttaatatatatgaatctctaggttgtggggtaattcttttcctcttcacagtggtaggctgtgttaatacaacaatttttcttttattgttcactaatgagacagtaattgccatcagaatcccactgggaatatagacttgcaaatataataggcctacggacaggttttacatatctataaagattctcagatacattttgttctgcatgaacacaccagaccaaaatgtgtcctttgccacggaagataaactccacattttcagaaatatgcaaacaggagaaacaaacttaactaggcagattttaggttcttctttctagcaactaaatggaagagcaattaacagaatgctcctttttatcaaaaacttattaacctttcactagaaatcttaaaaagttgctgaagttttcagtgtttcaattcaaaacataactgccagccttagtatgtgttccaatgaatgtactataatgtaaactgcacactccgctccaaatgtcagttgtataacaaggagatttaaaggaagatattttaatgtactgctagctgactgagcactacctttggagtttattcagggcataaagatttctagaaattcatttaaaataatattttctggtgatgaactacattcagtgattatcgtccactgagccctcaggcactctactgcttctaaacattcagttcagttcagtcgctcagtcatgtccaactttttgcgatcccatgaaccgcagcatgccaggcctccctgtccatcaccagctcccagagtttacccatattcatgtccattgagtcagtgatgccatccccaacatctcatcctctgtcgtccccttctcctcctgccctcaatctttcccagcatggaagatatcatttgccattcagcagggaaattaacaagggtttccatttcccattcttagattataatctttactaaatcccaaatgaaatgtaaatgaagtacctttcatgatgtcccaaatctgacagaaattcatctgcatgtctttggagttcatttccttctaaattctttaatttcttcaactcactttgtaaaaaaaaccaaagctctttagctccattttcaatcctcctccttaggatttcatgatccttccccaaacctgttgtcaagcaatggagagtattagcatttccaacattctgatgaaaggaaactttcaattatatgtactaatatcagtatattgaagaggagaaacaatgtatgattacctaccatttctagtttgtttcttgtaattttcaatctgttctttggccttcacaagctgctcttctaaagcacgaatccttcctgaagctggcccctgatcaatggggccttctggtattctgtagttcaaggaaggaaacgtaaacatttagcttatacattatgcaagaaaatacatgcttactttgctaaaacgtatttattggtaactctagaagtcactggaccgtaacacatattagaagtaccaaatgaaattttctcttcaaaggtaagggtaagacataaacactggaatgatactgaacacagaaaaaaataatctagctcagagatgtatgatctttgaagaattaaggaacctttagaactgtctcctaaaaactcatcatactactctgaattacaccgttagtgccaaagtgatcaattctttcactagtgttgagaacaacaaaattcaaggacagggtgacaaaaaggcttaaaaggagtacaaaagcttgtaactgaaaacatgtctatgttcaaatatcaaatgcaaattatttctaaattaatcacaatatcaggccatgtaaacctgtgctccagttcatgaacttataaccttagattactaagcattggttgtataaggaagggaaagccaagaatagaagatgaagaataccagaaaaaacacctgacagttaatgtcctgtttatgtcaggaatgaaaactaccagtcaacaacataaaatgttggaacatagcagaggaactcctgcttatattatcaacctgtacaacttttttctaaactgtacttatttctaacatattttgtttttatgtgacttttgacagtattctatactccaattttgccataaaagctattcacatcctaatcctggaatctgtaatactatcttaggtgacagaaaactgtgtgattaaggatcctgagaaggggaaataggcatggattacccaagtgagccataaattgtaaccacaagtgttcttgtaagagaggagtagaaggaaattttattacaaaagaggagaaggtcatacctattactttgaagatagaggaatgggtcatgagcaacaaattcaagaaaggcatctttaggagctggtagaggcaagaacacagattctcccttggagtttctctagtgaatgtggccccacaggcacctaggttttgctccatgtaactcatttctgacttcccaaactgtaagataataaatttctactattttaagccaagaagtttatggttatgtgttacagcagcaataggaaactaatacatacacatgtatttacacacatatatataaatatgtatatatacttttggaaaaatattgagattaaaaaatggctgattttttcttctataatctatttaaatgatgaaatgtctctaaatagctagcacagtgtctgtcaataagccttatcaggactactctatctgggctcagtcattttagagatgagctgtaaccttaaaatgcctgggatactaatttgtaccatcgcaatcattccaatttttagactatacttgacagaacttaaatttagatatcaacctgatgaaaaaagtaatataaaacttcaataccttttctagcat

SEQ ID NO: 53465 - DNA, 2229 bp, Bovine  19866880561050
gtggtgctggagaagactcttgagagttccctggacagcaagaagatcaaaccagtcaatcctaaaggaaatcaaccctttattcattggaagagactgatgctaaggctgaagctccaatactttggctacctgatgcatacagctgactcattgaaaaagactctgatgctgggaaagattgaaggcgggaggagaaggggacgacggaggatgagtggttggatggcatcaccgactcaatgaacatgagtttgagcaaactccgggagatggctgacggacagggaagcctggcatgctacagtctatggggtcacaaagagtcgtacacaactaagcgactcaacacaagtacactctttacaaatgagataagcacttagggagaaggttgcctacagcaaatcctctaaacaaccaacaggaacaaaggcatctgcaatttctaataccagtttcacaaactgaagtaagatatgacctatgaaaaaccacatcagtttccttcctacccatggcagtttttcattcttttgttgtatcagacaaatttttccactggaagattcatgatttggctctaatccaactgaggagtatgtagctcagaaatacagatactctaagttaattataccttcatggtctgtaaaatttagcttatagctaatatctaaattccagaagaaatattttctttcctagaccaaaaaaaaggctacagattcacacagaattttttaaaattatgctcccccaaaataaatggaagtagaataaggaattaagaggaaagctttcaattaagcactccttaaattttacaagttctgtccagttctgacatctgtcaatgaggttcactgctcacagggtttcataacaagtttcagtaattttccaggtgttttctgctaatttctactctgagaggcagaatggcgggttcaaatcctaagaataagaagcaaagattctgtgaactgatagcaacttcacattagtaaaagttgagacaaaacaaatatgaaatttgaaaaggcattcctgtagggtggcatgctaaaaagcaatgacttataagcttttaaagaaagatattgcgtgtatattcaagatgctggcaatcaacaagtaagaaaaggatgattggggaaagccagataaaagcatgaaggaaacatgggaaaataagcagatgtaccttggtaccaaagccatgcaatttaatcattaattaaggtcagcaacacctcatgtctagattaatactgtatttcccagttaatttcactctagtcaagtacaaggcaaaatctacctgaaaatctaaatcttcctcaaccattttcacagtgtcactcctctgctgaaaaaccaattatgatttcttgttatctatcaaccaagcctacactaaactctggctgtttaagaccactataatgtgacctaatctattcaacattacatctagagatgagaactgtgggtcaaaatggctacaaattctttgcagttcctacttccattccctacatgtggaaagtccctttgacttgcaaagattaacagaatgtggcagaagtgactgtgtaacttttcatgcttggcctcaagaggatttgcaatttctacttttgcctgcttagaacactgcaaggtaagaaaccagggctatccttctagagaagccagatagggggaaccagctgacggtcccttaatcacgaaacatttgtgaggtcatcagactgcccaatcacaatgaagccaccagatggctacaaccacgtcaatgatcccagatatcattagaaaaacagtccagctgaggccaactgaaatagaataatcagaagcaaataaatgtttactggtttatgctactatatttttattttatatctacacatatatacataaaatacattttgttatatatgaaaccccagtttttaaaaagaattcaataagaaaacaaataactcaatttataaataagcaagaaatctgagtagatacttcaccaaagcacatacatgaataggaaataagcacataaaaaaatgctcaccatcattaatcattacagaaatgcaaactgaaactatatgagatgacactacagatctattaaaacagctaaagtaaaaacacctgacaacagcatgtgccagcaagggtgagagctgtaaccctcaagcactgctggtggaaataaaa

SEQ ID NO: 53466 - DNA, 2348 bp, Bovine  19866880896783
ttggctcaaatggtttgaactgagtttggtggtctttctggtccatctaagctttatttctcagcctcagggtacgtggggtacttgaccgtttctatcttctctcgaactttgtaggagggatacaggcccgtccttcccagttttctgttgacacctttagaatagccatcccagtgatttccagccacgccaatgatatctccaggttccatggggatttcatccgcagttcgaggttcgtgaggataaatagcaatctggttgtgggcattttggcctccaaaatagtagatgtcatccaaagaatggaagtttgcagaggcatcgggatgcagcgtctgcatgatctcataagcaactcgacagaccttgggaaagcatgaaaaaaaatctgttagtacatgtgagatcgccttcgtagcactctgagagcccttgccaaagagacagggactaaactaggaccagggctgagagaatgagtagattctagtcaaagtccatttgctctcagatgatggtacaaagtcattcttcatttctttgcctgtatcttttttctaaacataaaagacaattacaattaggatccggcagagaaaaaaaaggatatgtacatgtagtgcaaagtattttgagaataaacacttattaagagccacagagtgctgggcaaaaataacacagtctgtgcccttggtgaactttaagattcaggattataaatactttacacaaatgctgctgctccctttctttcattcagtgttaataaatcacatactcttttccgctaatttagatctggtctcagaaactcatgtaattactgacaatcaactattgccaaatgagctaaaacatatctgccacttctgttctgaagagttttgtgtgtgatgtgtagatagcagcagtctagattgaaacaagatgaactagctttggggaaggtgcatctacctgatgcatttaaggctacttaaaagattcctctgtccaaagaacacctaccattctcactggatggcagctgaaattacacagtccttgaactttagacttgctaacaaaggtaaacgatcttaatggaggtataacattttaaacaactaacaaatatattcattatctagtaaatgggtttcagaaacttaagaataagtgaaaacaaaagagaatactattttacttagaaaattcttccactatatactatgaacagaggactcaactgaagtcaaatttttctgcatctccacttgtagttatctcagttaatgaaggtttattgcccctgctactgctgctgctgctaagtcgcttcagagtctgtgcgaccccatagacggcagcccaccaggctcccccgtccctgggattctccaggcaagaacactggagtgggttgccatttccttctccaatgcatgaaagggaaaagtgaaagggaagtcgctcagttgtgcctgactctcagcgaccccgtggactgcagcccaccaggctcctctgtccatgggattttccaggcaagagtactggagtgggatgccattgccttctctggttttattgtccctatatcaatacttttggacatttttaaaatgatgctaataataactcttaatcttctcagtggagcaatttaaggtacccagtagtccttaaaaactttggcattcacagtatcaaaactgaattcttaagtgttatgagtaaatagaatctaattaggttaatgatcaacttaagtctttaaaaaaatccgaatttcaggaactggaggggcacttcttaaatgccaaatgtaatttgcaaataaaactgaagtttagatagtatttttaattttgcagatagggactaattctagtgctaggatttcaactagacatagaaccaagagagtaagtttgctttcaaatctgctactttgtcaacaaactaattttatatcgggaatgtcacagtatgactgacatcactggtagaatactcaaactataacaaaatgaagcaaaaaagattttgaacttgaacttcatatttagtcagaggcccatatagggtacgcaaaatccagtgaagactttggaaagaatctaaataattaaagcagctccaatagtagcaaagtacagtaacaatgacagaggttaatatttactgagttttacttagtttttctgtcgggcattgcttccaaggtctaatttaattgtcaggagtcccataatattctatcatgtttgttttatggacgtcaaagatcagttaaggaaaatggccagagttatactattattaagtggcagattcaggttttaacctaggcagaa

SEQ ID NO: 53467 - DNA, 1620 bp, Bovine  19866881004679
agcgtgggctcagtagttctgaccacaggcttagttgccccgaggcacgtgagctcttcctgaataacggctcaaacctgtgtcccctgcattagcaggtggattcttaaccgctggatcatcaaggaagtccctccccttgttttgttactatcaacctatgtaagtcagactttgtgatgtttttccatgggtcattgaaactttgttcatttttgttcattctttttccttggtgtgcttcagtttcaatagtttctattgctgtgtttttaatttcactaatatttttcctttgcggtgtctaatttttcatttcagatgttgtattttttacttctaaaagttccatttgatttctttttatagtttctatttctctcttggttatgttttccttcaaatcctttagcatacgtataatgctttaaaagggtctcacctgctaattgcctcatatctctcattttttgacttctctctctctcttttttgtatgtcaagtaactgctttaagaaatgcgggacattgtaaatgttacaccattgagggaccgatttttttttttcttccttcaaagagttttgaattttgttctggtggtcaaagtcttttacagatcattatgagtttgcaagctttgttgggggctgatcttgagtgacttttactgcagggctatttgggtctcattcccaaggtcttgcttttctaaggtctttacagaatattccagatgttcagagtggtctctttattctagctgattagagctcagcaactccaaccatgtacaagcttctggaggcgttcagtctgcagctccccggtacttgttctttcccccgtagtttcttttttcccaaaatcatgaaaactctgcatgtgtcctaggattcagccaaatccttttaagaactccggcaaagctttctgcagttcttcctctgagtggtgctcttcttcctggttctctgtctggcaaattccaactgactcagcctcccctggtctttgtctcctccactcagtaagattcgattcctacgtcctgcttgtttccatccctgcactgtggtctggaatgtgcttctaggcaagatgcagaagcaatctagggatcacctcattttgcttccattctctcggcaaatgtctgaaatttgtgaaaacagtagtttcatacactttgtctagttttctaaatgtttaccgttggagagctggtccaatatttgcctgcttggtttttgatcaagtgaattgacaggtacactttctccacttctaagcagttccacctgctcctctttctccgtatgtacataaatgaaaataaatgcttaaaaccaaaggtcctggattttagtcctttggaaccagtccggctggtatgtgagccctgttctatctaagccccataaaagaaattctctgaggattaccatagagctaatcataaactctggtgctaaaggatatatccttcagacacttccaaaagattagatggcaccactgtatttttttagcatccataaataaagttttattggcacataaccttgctcatccatttacatatttgtctctggatgatttcatgctacaacagcgga

SEQ ID NO: 53468 - DNA, 851 bp, Bovine  19866881029536
ataaaaattatttagaaaaaagaccctcttctcctctctgtgtacactgacctgtcacatgccaacacgagctgggaatacggtagaaggctcctatttgtaaatatcactcgtgtttttagatggattttataaggtcagagagtgaggtccaaagactgccaacaaatctccctccaatgatcttgccaatattttacaccctaacaaggggcctggctagaatactgaaagattggacatgcttctttcaagggaatacagaaattataatggatgagggctgaaatatatatgtcagaaaggtcaacacaaaaattatttatcattactatatgatttagtgaattaatatattaatagtaccaaaataaaatgtcaacttgtcatttgcaataatatttagcaattgtcattattccaagtaaagtagttattcattcttctgctgaatcatgcgttagctaatttaattggccttaaaattttataactccttgtaatttaaacatttcaattagttacaaggacttttttgtgattcaagtctattaaaaacaatttaataatcaaactctaaatacagtcttattctaacttcaaagctattttaaagacttttcttaacaatgcgctgtgctgcgcttagtcgttcagtcatgtccacctctttgcaaccccatgatttgtagcccgccaggcttctctgacataaggattcttcagcaagaatactggactgggttgccatgccctcctccaagggatctccccaacccagggatcaaacaatatcaaagcctttatattaaccggttattcctgttaatatgaaaacattctgatttgct

SEQ ID NO: 53469 - DNA, 649 bp, Bovine  19866881066878
cctatcctgaatgacagaggtcatttttttgcaactgatctgtgtgggtgcaggcttctaattgtttcctgaattacctgctatctattagccatctggccgcttgccagaacatgctaatgtctccagagttcctggcctggagttttgaggagcagatttcttgttctgtctttgggaatgtaggacttggagtgcaggccctgtgagccccactggcagaagctctgtcctctcctctgcccttagctgtgctgagggcaatgcccaggcacagcgcacagctcccagctgtgcctgagagaatgcccaggaacctagtgcacagtcatgcggatgcccatgaggaacctggcagcatctcctctttctcctggatcctggactccacacctgtaggagatttagctttatcagaatgtcctggaaacccttctgagaaaaaggttttttggagttgatgtcatttgcttagagaataaggaaactcttcaaataatcttttgtttggggagaagagggtaagaagggtgtgagaattcaataggcccgttcttctgttgagtaagggcagagcttggccatcacccaggagggctgagtatcctcaacgtcagttactcccatgaccttaaaaacacacagtgaa

SEQ ID NO: 53470 - DNA, 943 bp, Bovine  19866881135221
tagcttgatcagattccattaaaataatgtatgatttctttaattccagcatgacttagctacagatttatttcatactgaacttttaaaaaaaaaaatggattcaagaacaggtgtctcaggctagatttggggctgcataaataagctttgtgttaggggatgataagaatacatttaaaattttaattgaagaatgccaggcaccagaggcaaagagcgtgcaatttttaaaaatgctaaataaagccagctgccaaaaagggcaagctcactgagattacagctgttcactatcatgcaacaataatacaaaagttctctatttcttgaggtatgtcttatccacttggtggactatggctttgcacatcatttctgtaccctggggttaggttaccacagcatggcataaaactattcaaagtgaaggaaaaatgactttttgcatatctaccatttaatattatgtatattcatatctcttctaattaatttaggagattgaaaatacgtgttgtctctcattccaataacaaaagagactgtaaaataacaagtaaggggggaaaaaaaagagcctgagcttttcaccttctccttatttctggtagtcactaatcaaaccacagaaaagagaaaggacaggagaacaagaaatggcctttcaaaaattccacaaatcaaagtctttttgtaagtagctcttacctgtggtctctgttacaaattatttaaacatggaattgaataacatattcaaaacatattatgttttatactaaaaaggcaataactttaaaatgttagtttgctcttgacaacagataattttctcaaatacaactcatggaataatttatttccgttattttaaagaatgacataacaagatagaaggttcaggctgtttcttaggcacaatgcaaagatttcattcaaa

SEQ ID NO: 53471 - DNA, 1654 bp, Bovine  19866881178403
caaaacacagaattcaaaatgtaagtgaaaagactctacagactatgactgaaaaaaattaaaaacctctgtaaacaaagacaaataaataacagtagattaagaggaaatatttgcaacatatatcataagaaaaagatgaatatctagaatatataaaacattttaacaaataaatacaaaaaataaattaattctataagagaatggacataggacatgaactggccaatcacaaaagaaatacaaattgtcagggagcatatgaacagatggttttaggcaaatagatatcaattgtggtttttggactgcagttggtttcagaaccatctaaacaagagtattaaatcataggcaagggatggtcttcagggaaatgggctttccagaaagctggaaaggtttaggcaggctgtaattcagggaaacctggccttgttaaatttgtttctagaaccaagagagttcaagtttgataaacttttccttaggcagaaatacggcttgtatgtataaaggtgatgaaaactctgagtagagaaaggttaaggcataatcagacttgaattgtttcacatctggcttgattctccttgtaggcattctgtgcccggccctgaggcctgggggccagggagagctgtactgagacagccatgtttgttccatgtggccagcccactgctgacaagattttacatcattctccaattaaatccccaccttaatttttttctacattgagtgtgtgtgtttttgtgttcccttcccattaactgataaatatctgaaatgcagcaatgtttatcctaattaatctaaaaaatgtagatcaaaatatgatacatctgtttttatctaactgaacagaacaaattaaaatacctgtgatatccagtgctgacaagaggtggggtaaagtcagttccagcaaactgttcgtatggaatggaatggaattgtcgcttcagtcacgtcaggctctttgggacccaatggactatagcccaccaggttcctctgtccatgaggattctccaggcaagaatactggagagggttgccctgccttcctccaggaggtcttcctgacccagggattgaatctatgtctcttacatctcctgcattgacaggcgagttctttaccattagtgctacctgggaagcccaactgttggtaaggatattattaataaagccatttgggggtcagtctggcagtatctcttaaataccaaatatatttttccctttgacttagcaattgtaattcaggaacatgtgcctatgcttaagccgcatggaaaaagattttactgaaatgttatttttattgaaaatcagaagcaaaatggcatgaataagaaaacgattaaataaactggaacatgttcatacttagtttatattcttccagaaacagatcttgtgactgggattcaagtttgaggtgtctgggaagtgtaagtagggaactggggaagtgatgcagggaagagcagatgactagtgaaggatgtgttattgagccagtgagggaccagagtttaatccttcaggaaaactcagaaggtagtacaaagcacatatctcagaattatcctagccaagggtccagggggctgggatatttatactgctataaatt

SEQ ID NO: 53472 - DNA, 2059 bp, Bovine  19866881248315
aatcagaggtttaattatatttcagtatagagtgaataaattttctcagtacatgtgatagatcagagttaagttgtcaactttgggaagttacatgcaaaagggataatcattgtacttactttatataatttttaataattaaattaagcactgtaaacggcttagaagagtacctggtatacagtaaatgctcaataaatttagctaatcaactagctgtgactgtcaaacattctttcctcagacatccacttggttttatctcttacttcctccatgtatctctgctcaaatgctagctcttagtgaggagtttggcaaaccttaacccttctacttgcttaatttttctccatggctcttatcactcgacataatatttatttactgtttattttgggcttccctggtggctcagtggtaaagaacctgcctgttaagcaggagatctgggttcaatccctgggtcaggaagatcccttggagaaggaaatggtaacccactccagtatttttgcctggagaatcccatggacaggggaggctggcagggtacagtccatggggtcacagaagagtcagacatgacttagcaactaaataacaactgtttactgtctgcattcattcccacctccatcatccctaattagaatgtaaactctataaaaagagaggtatttcttctgctctgtttactctgttattctcagcacctaaaagtgaatctagaatgtaacagaagatcaataaatatttgttgaactaacaacactttctattcataagccctgagacagcaagtgccactttaggtggcttttcccacacagtatttcccaaaggttagaactatgccttattttcctttgcatcacagcatctagaactccacatagtcatgtggataaacacatgaacagtgagtgctacccacgactgggacgttttcctaattccctaacagctgcttcagatttctcttcattccacagcctccaaggagctttctctcactgcctctaataatgactgtgaagaaaaagtctctgagcactgtttcagactggtattcagtgatcagatccatttggcctcattatttttgacattttgccctcccagctctgaatcagggagatgaaggaaatgtcacgtttgttctataaagaaaacaaccaaagagacttttaatgtgattcctgtgaagatgcatatatccaggcatggggctaaaacagaaacaaataaatatgaaggctggagggtgaaggaggagggaaatgggttaaaacacaccagcacaggttgtatcctagagtaaagactaactctgtcagcgtggtatgagtactcagtggaacaaacagagtgatccttttactgagaagtgacactaacattatgcccttccgaacttaaaggcctctttctggcaccaaaccaaaagggcacctaagttcctcaggccttatctctatatgcaaaagagcttgatgaaagatactgagtgttgaaaaaaacacaaacaatggaaataatgaaggaaggagattctgtactttcaacaatgagcaaggaaaacgccacacaaacatgcttctttccgtcttatgcccacaagtatgcagcagaggaggtcttccactgtaaggctgcagagactggcagtgattttaaaaagcatcttttcttcctccatgttgtaaaaatttattttttatatcacccacaaagaactaacttgaaattaaaaatagcatcaaattttcttttgtgaaatctttcttcagactgagggaaagactcctcttgacttcactacctagcatacaactccttcaggacaagtactgatatatgatgacactgtgattaatggttacatgtatactgcctatcagctagatactccttgagaggagaagccacatattatttttggtttctttgtgtattcctaatgtgagaaatgccaggctggatgaaggcacaagctggaatcaagatttctgggagaaatatcaataacctcagatatgcagatgacaccatc

SEQ ID NO: 53473 - DNA, 1334 bp, Bovine  19866881265077
tatcacacattatacattttctcctgaactcctttaagtgctacggttcatacacgtgaaaataacctgttctcataaatgccatggagaaaagaataacatttatgaaacatcctgtttctgtcactcacacatcttacatgatgcgtaatcctcaccatgactctttgagaaaagtactgttctcattttaataaaagtccctggtaaacagatgaagaaactgataattagagaggttaagtacgtgcccaagaatttcaaattcggtcatcagagctggtgcaactctggttgttgctgttgtttagtcactgagttgtgtctgactcttttgtgattccatggactgtagcccaccaggctcctctatccatgggatttcccaggcaagaacgctggagtgggttcccatttccttctctgggggatcttcctgacccagggatggaatcatgccttctgcattggcaggcggattctttaccatctgagccaccagggaagccccgctgtgactttggataagttcttaaatactatttcagggctagggtcagaaaagttgcaacttgaggagaacaaattaaattttttgttaaattgcaaagacccaaagtgttgattttctgtccagattattcttttcaactctttctcaatctactttctccgcttaaacaactcatccagctggttgctcaggtattgacataaagctggaagcagatttatgtgcccaaagataggagggctctgggaaagcctaccggcctggctggtgagggtgacagcttggtaatgggcctctgagagtgtgtgtgtgaattaagcaactttcatctcctttgctacaaaaacatcaattaagcttgaataatccatgtgtttcccccattttcagacagaagaaaatcagcataaattggctggtatgttttttcctctagccttagatcgttaatcatcttcagccctttcttgcctttcccccaacccttaaaaaaaaaaaatccacactgccatttctgggcacccactgaaaacatttaccaggtgatttgttcagtcttgaatgtaatgaagacatgcattcagcgttttggaggctggttctatggggaaggtgccagtctgttctgttcaaggttggaagagggctcattcagggtcctttgtgcaggctggcaaagctgatgggctttgatatcatagtctggtccctgtacttgagccaaacagatgtgtccctgcaggcctctccatccaacaccagccagaggaagcctcatttgtctttgtaaggtgtccgcaacccacattcttcttggaaa

SEQ ID NO: 53474 - DNA, 1409 bp, Bovine  19866881280824
ctcttgcccccatccctcccgcatcgagtcttttccatgagtcactcttcgcatgaggtggccaaagtactggagttccagctccttccaaagaaatcccagggctgatctccttcagaatggactggttggaaaaacattcaattacctaaatattcaggtaaagagattgttcttacagatttactcttttctgtatgggatttggaaagaaaagcccttattgtgttcattttttgcattgagttttctattacttttctttttttttgtagttcttttttttttaatttttaaactttacaatattgttaatttagttttattttattttttaactttacaatattgtattgattttgccatatatcaaaatgaatccgccacaggtatacatgtgttccccatcctgaaccctcctccctcctccctccccataccatccctctgggttgtcccagtgcaccagccccaggcatccgtttctagtttataaaccataactagtttatccatagttggattacattattacatataaatcactaattcttttctgttctattagaattagatcggatttaatgcttaatggaactctgctgaaaagaccttatgctgtttttccatgcctgttttcccctaacattattgcataaagaaatgagataaaaaggagaacctggacatatctttctattgactgaaattttgtatcactaaaatgtattctggaaaaggacatcctaatcctatggtatattgctgccataataaattacaagagggggtaattttattttattttcaaattatttcctacaaaccagccatctaattcggaaagtggttaagagccaagttttaaaaattatgtaccaggaaatgcctcatttatgaatgtatacgtatttgtgctcataaattgggtaattgtgcacctaacaactctcttcattttaccattattctgttgtttgtatacaaatgaggcttcttttaattcaaattctgtagcctggaacattcacgattagtggatgactatcatttctgcttctattcagtgttaatgcatacaatttcatgtgaaattatagaatattttatttactctggtataactgtagcttccctggtggctcagacggttaagcgtctgcctgcagacgatccctgggttgggaagatcccctggagaaagaaatggcaacccactccagtacttttgcctggagaatcccatgggcgaaggagcctggtaggccacagtccatggggtcacaaagagtcagacacgactgagcaacttcactttttctttctttataactgtaacaagagcttctttactaagcattcattctgaagttaatttggctttatctgttatataaaaatgctagaaa

SEQ ID NO: 53475 - DNA, 777 bp, Bovine  19866881405684
ttaacatggatatgcattttacttctgattcactaactgaacttgcttcaagaaatttaccaaatttgttttcagacaaggtgaaaggcaattttatattacagtaaaatttgaggaagtaatttttaaaaacacagacatacagtttttcaggtatttccaatcaacgtgtaattatgtgaacattagctttaatttagattgaaacctattatccctctaaatagtcttagtagatgcctaggccttggtaaaaatcactaacctgtgcttggaatactcatgtatctataaaattcaacgcagaaacaggcagaacagacaacaatcatataactgtgcacagagaagcaggaaaatgaaaaagtttctgggaaccttcataaagagtcacagataaccatagcatctatacgcagttaaacacatggcactccagtttcgggaatcctgagctcaccaaaactttgacaactaaatttgggttgcttggggtgagtgaaagagatgcgaaaggggactgaggagcctttaaaaacccctattttgactaagactgcagctgtaattacagctgttctgaagcttttcttagaactgctaaataacagttttttaaataataataaccaaaagtaggtttaatgaactgaagaatttaataggaggacttcatagttaaagggtttttttttcttttttactatacaattaattttctattgtttttgctctgcaactagtagataagaattgttacaaaatgcaagaagcttt

SEQ ID NO: 53476 - DNA, 2226 bp, Bovine  19866881465827
ccaaataaataaattttggaaaaaatcatatgggtgcaaagaagcatatggatgggtacatattaggttattaacacaggttatgtgagtgaggcataggtatatggatggaaaaaaagaatgggaggatggttaacaaagaaaaaggacaaaaaagactacactttaagaaagaagacattcctaatatatcagttcaactttgcgggcaaaagaaagcaaagaggatgaactagccaaccacatttatgcttttatgtaaaaatttacatatatatgtcaagaaattaacagagagaagaggtaaggtggataaaaatagtactgtgcccatacagacattcagcaatgtctgtacgggtgaatacattcacaaaaaatatctggtgaatgaatgaacactggctagtctgttggatgtgataattttgtagattgggattttcaaggaccaatttattgactaatattaccatgacccagcagtgcttgtggtgtgttgtcataatcagaaccacttacgttctctggttcgagggtgaaatgatctgcccgggacagtcccagtttactctgcggtcaccctgttcactgaccgtctggagtgatggatataagtggaaatgacaggctccagcctgggattcgaaactagcatcggtggggggaggggtaggactctggaatctgtgttgctgtgctcattaccgcttcagaactgttgctctaggcattgttagctgccaaagtgatgtactgcttttataattaactattcttcaaacaaaacaaaacaaagagagatttattatttgctacatataaaaaaaatcatgcctcggtgtctgaccttccttcgctttattgccagtataagaccgaattcatgtgaactttgtaatgtgtacacagaacttgcaatgaagctgtcattccttgaactgaaaacaccttagtaccttttcttgtcctagctttgtgcaggtgctgacctatcttggcaaaagaatcttaagtcttctgtcatcccaaagcaagtttctgagaacaaaatgcgatatatcaaatattaaaaatagattggcggctagccctacatgctcttacctctcagcttcacccagttgtaacattttgttatactttcttcgaatatacatttttataaataaaacactctagaaaacaattgtgtacccttctgtgacccatccttcctttccccttcccaaaggtaaccgtggaactgaatttagtgattttattctcataaatatttgtgtatgactgtataatgtattcatacacaatttggtttgacattttaaactttatataaaggcatcatagggtgtgcatttctttgctaacagatatgttttgcttagtgatttaccgtgttggcatatgcagctccagctcattcaactgtcatatagcatggcctggtgtggtgtaacactgtatcatggggaatggtaatacataatggtattaccagtacagtattaataggttgctgttgtatgaatgtagtactattaccttttcttccccgcgaaaggacatttaagctgttttcctttttttaacaattacacaatgttgaagtgaacttttttggtgaatttcccctgctctgtggtttttctacatctaggactggacctgtgggttgccctgtgtgtacatctgcagctttgatagatcttgccaaattattctgcaaagagatcgcaccaattcccataaccacttcttgaatattccagcaagttttcctttctgagggctcaaattgaagaacagaaaagagaaatacaagccaaagtaaaaaaacagctttgagaaagcatttaatgatcagtggaacttacctaaggcttatatttccatccaggggcgcttctcccatggaccacctcccttcaagtataatcagtgcatattggctaagctctggtgaccaggcatttgggattcaaagctatacatgcaaggagacttattttctgagagtctaaagattaactgaggagctaagacaaactataggctaaagttaattatttaaataacaatttaacaggaagaaagaaaagatctcactggataatgctgattcatcattgaatcaattgtgcctgcattaattctccagagttcccaagacagggaagtcagagcttaggcgattctaattggtttcctagcaaccaccactag

SEQ ID NO: 53477 - DNA, 638 bp, Bovine  19866881495537
aataaaaagttggactggataaactttagttgtttgtcagttctaaaacaatacatctagctagcttgacaccccattggcaggaactacaacaataaaatatggaaaaacagtccatacttccaaatccaataaaattttaagtcacttttgagccatagaaattccaactacatccactcattaaagagccgaagtcaatctttccaatcaaaagaataaatgaagtgattgatttaaagaccaatgaaattagccaaactatccttccctatgacttgcctccatggctgaaatttctgtcttctcaattaaggtaaaatgtcaggtagttcacactgttggtttcttattcagcatctactcttgttccttccttattaatagagttccttgtttttgtttttatcggtttgttttttagataaccatccaacctccagctacaaaagggcaatttaactagtctgagtcaagagattacatccctgccacctaccccaactcttgtagttggctggaccatgtgactaattaaagtcacaagccaagagttggacacgactgagcaacttcactttcacttttcactttcatgtactggagaaggaaatggcaacccactccagtattcttgc

SEQ ID NO: 53478 - DNA, 814 bp, Bovine  19866881806357
gaagtgctgatcagagaaagtggttgagtggtgagacttcacaggaggcgcaggagttctccaggcaaacagaggaaaggggtgttgcagacccggagtgtgaacaaagcttacagccgtgaatcagcaccagtgtctgggaacctgagtggttctaaaggcagaagagggggagagggagggtggcagtgtgacaggagctggactcaaacatgtgctccctgtttctttatctctacaaccctgcttctcttttctctcaaactaccgcgtctcctttgtccttgattccagtgtaagcttttccagtcctcagtggtctcttttgactgccttgactctcttatcttcttcctatcttccacttaattctccaccatgacagtttcaatgaaaatattgtctatttactattttcctgcaaatctcttgtcaccctctgttaagtctttcccactgttattgccagttttgcaaagaatgttctggctcatctctgacttgttagctttcttaaactttttggtagctaaaaatccagaggtcagcgttatgctaagttctgctctctgcacttgaccaaggacaagcactgattagtattcaaaaatgatacagcctgtatttttctctgtaatgttttaccctcaccaagacgacagagcaagggggtcctgtctcatggggcatccatgagacgtgactatcgtcctgtggttccaggaatctccagggtcaagtgccttttacttggacaccaaattcatcaaatgaataatgtgcccaaagtacttttaaacttctaaccataata

SEQ ID NO: 53479 - DNA, 1110 bp, Bovine  19866881949936
attgtgcacatatcattttgattttgtggcagaagagattttcatcttccttcccctgtctccccaattacaacttaccactttgctcatcaaaggacatgggataaattttacattcatcatagcaaatctagaattccaatatcatgtgcagattcagacaaattttttaaaaaaaaattttattggagtatagttcatttacaatgttgtattagtttctgctgtacagcaaagtgaatcagctctctatatacatatatccactgtttttgagattcttttcctatataggccattacagagcattggccagagttccctgtgctatataatatatccttattaggtatctattttatatatagtagtgtgtatatgtcaatcccaatcttccttcccaccccccatttcccccccagtgatgtttgttttctacatctgtgactcaacttctgttaaataaataagttcatttgtatcgtttcttagattccacacataaatgatattatatgatactcatgcagtaagacaaattttatagatttttacagaaactaacctgtgtagttttgaggtttttttgtttgttggttgagttggttgattggttggttttcggcttaaatcagtcatgctctgacagtatcaaagaccatataatgtctgaagattcctcttgtatttatgactcataattttccacatatatagctctaaaaaaaaaaccccaaactgctaggtatggatgctcattaaattgctttgcacaagagaaaggatattgcttttattacagtcaaaatcaaaactgaataaatatccctaatatccctacaaacctctccaactgctagaataaatatcccctaatatccctacaaacctctccaactgctagaatcatcttccaaagctttctagagtcaagcacaccacaagttattgtcctcctttatcttccccatcctctttggtagtcaggttggagccatgttctagccaatggggatgtggtcagaacttaagtcacttccaagtctggccataaatgaccctgtaagaatctccagctctttcttcccccaaccccccaccttgggtgat

SEQ ID NO: 53480 - DNA, 1200 bp, Bovine  19866880113118
agaatagcattgaaacatgtatatcatcatatgtgaaacagatcgccagcccaggtttgatgcatgaaacaggtgctcagggctggtgcactgggatgacccagagggatgggatggggagagaggtgggaggggggttcaggatggggaacaccatgtatacccatggctgattcatatcggtgtatggcaaaaaccactacagtattgtaaaataattagcctccaactaaaagaaataaattttaaaaataataataaaataaaatgtggagagctagtcaaaggaaaattatgtttaaaattaatgtataatatcaattaaactgaaatagaaggctatttaatagttggtctagttaacccattctcttgaatatggataacaatgatagtatcctactttaactgcaaatcaaatgtcaaaattagaatttgattcctttacagaatccaagataatattggaaaataataaagatagcagcagataaaaagctaagttgctataacctgaatatgtaattttgtgatttgttttgtaattttatccatacttggtgggaatttccagcactggcgaaaccacactgagatcgatctttgtaactgcagctagtacaacacagatgaaaaataaagcaccagaaagggtaaactgagtgtctggggagggctctttgcagcatactgagaaaagtttcaagatgaccacattttaaaaatatttctatattttctgggcagagaaatatgtacctgtgtttcttaatgtcattgattccattcttcagatttcccagtctttctgttggattttgcctacaaaaagagttttcaatcagctcataataattatgcttgagtgaattttacattcaaattttatgctttttctttatccattcattgattttgtcagtaatatgtataaaccaggcacatttgtgtacagggagacagaaaacatatgccctctctggaggagccacagtccaattacagtcagaaatatgaatatatgtatttatatatcccagtatatagctataggccatatatgggcttcctttgtgggtcagctggtaaagaatccgcctacagtgctggagatctgggttcagtccctggattgggaagatcccctggagaagggaaaggctacccacttcagtggtctagactagagaattccatgga

SEQ ID NO: 53481 - DNA, 3717 bp, Bovine  19866880382365
ccctgggcctttatcctggctgagagactgaagtagatttactggggacacatacaaccatggccacctctctggaatgccctgcagtggcctctgccctatcttgagtcttcaccagtttcttctcctgcctccaaccaccttcatccctcccctccctaccaccatgatttcctcaagagttcagacctctagaaacaaaaatcaggaaggcaggttgtctaaggaaaacttctgctttctgcaacacacccctatcctgaggcaaaggagccccagagccttgctgtttggaaatggtttagagaaaaatgctttcataatcttatcatcctgggacacaaacatctctttatcatctggggaagctgatcatttcaaaggggcaaatagtcagtggccgcccacttaggaaaattccttctgttcctctgggtttttcagagttctggattctcggaaagaagaactggaatgcaggggtgaccgatgaatgctttcagagttctttttagaatcttcactggtagcacagaacctagcccttcacagtgctcagaagacatctaaatgttgccatgttgaagaagaaatattggaactggggcttaaaaaatttcaattgtcaagagatgagtgaggattagggaatgaacaaaagcatggggaaatgaaagcatatagtttaagtaccaagaaagcgaggactttatccatatcattcatctgatgttcttcaccaccagccttgggagagcacccagctcagtgaatatttaatcagtgaatggatttatgtagagaggagagaggaataagactagaagacaaagtctagcagtcaggtctcagcaggaaacagaatttcctcctaataactcaagctccacttaactgaagggatgacttaaggagagcaataagaaaggatgggactagcaacaggggtttctctggtggctcagacagtaaagaatctgcatgcgatgcaggagacctgagttcaattcctgggtcgggaagatcccctggagaaaaatatggcaatccactccaatattcttgcctgggaaatcccatggacagaggaccctggcaggcaaagagctggacacgactgagcaactaacactcactttttttctagcaacagaaggctgatagcagccctgaggctgaaagagcaagaggagtcacttggcagaaaagatgcagtaattaccagagacaagtactgaagtggggatgatgtgaggaagaaatactgcaatctctctctcctccagccctcctttctcctgccagggcctcccattggctgaacccaaccagaggccagagatggtgagagcaggagagaaaaggttggagaactaaaaacagaatcagcagcccattggaactgagctgaactgaactgaactgaaactgaaagctgtttttctttttattgagatataatggacacagaacattatattagtttaagacgtacaagctaatgatttggtatttatatatattgtgaaatgatcaccacaataaatctacatccatcaccacacatagctacaaattttttttccttgtcatgagaactttgaagttttactctcttagcaactttcatgaaaggtggttaaaaaaaaaaaaaatagcgccttcccttccctgtgccttcattcattccctcttctcccaagatagtgccaaagaaaaagatatatcatctcttatcatttggattgaaaggctattagttgccattggagattttgaaggaggaagtgacaaaaaataaggcatggggaaaccttatctgtgttcacattccagcccttccactccctaactgtaaacgtgggctagttattaatatttaaaactctctgtgcctcaacttccttatctagacaaccaaggaaatgatggtagctatctcgtatggtagttatgaggctcaaaagagataatctaagtgaagtgcttgggcctaatattattgctttttaaaagcctaccttggatcagatttaggcaaatttgtcttatattgaagtatttactatgaaatcaatgttccagcaaggttttagtgaacgtgacaatcataaggaaaaggctagagtttgttttaatgacttcatgactatgtgattttattatttttgtctacccagctaagaaattcccttccctaagcactgatttttccacctttaagtaacattagaacgttacagaggctttgggtaacacagatgaagtccacctacctgggatttcaaccatacacctgtgatttcactaccaatgcatttctgaaaattgcttctttagcatttcagtgtgtttattcgaaagaacaactgaagcagaaagaaaatcaagcaaaaacaggaggtcttcatttttaaactcatcagttggcaagccaaaaatttgctcagatctgttgggggttcagatgtaaaattggcttctgatagggaagtcagtagctacagtttaaaactccgaagcacgttttcttctccttcccctacccacttccttgttgttctaataagagtgtcacatgcttccctaatagttaagatgtgcaacccttggattgcaaagtactcctgtttataccaccattaaaatttaaacagatatacacttaatggaaagactggctataattatggttctttaaacccccttcccaccattgctaatttttagtgctgctataaaagaaacattacttttactgagttcttgatgaatatttggggaaccttctaaaattataaatgcatttacaattctgatgcaccaatttaacttgcttaggttaaacagcaggacgatgtaaaagtatttaaatataattttcatacccaagaattctagttatttcaacatgtaggtgagccttcaagatgagtcatacagggaaattgcttatttttgtaatgtacactttatacaagtaaatgaatacttccccagtgaactaaggtttttttaaaggtagtgtaaaaaatagtatctctcgggacatgaaaggccttaatcaatgattttcaaggacttcctctgtcattgcttaataacattcaaggcttacagacagacttctgaattacatatttaaaattgtatgtacaatataattacacttgtttcttttaaagcagcaaaaccaggcacatggattggttgggatgagaggaaattcaccaaactcttaacagcagtcatacatgggtgcgtgcatgctaagttgctcagtcatgtccgactctatgaccctatggactgtagccctccaggctttttgcccatgagactctccaggcaagaatattccagtgggtttcaatgccctcctctatggatcttcccaactcagggatcgaacccacatctctcatgtctcctgcattgcaggtggattcttcaccgctgagccaccaaggaagcccagttatatatgggagtaggactaaaccaaagttttaacaaaagtgctagtcccttcccagggatgtttgatcctctttctatactttcttttagaatatggtgtcagaggcagtggtgaagagcgttggaatacccactccatcatctactaccgtgtgaccttgcactggtacatacagctctgcgcctgagttcagtcgtgtgcagaaaaggataacaataacgcataccccgtataat

SEQ ID NO: 53482 - DNA, 5326 bp, Bovine  19866880413905
tatataagtggctgaaggaatagcatctcactataaactcgtcgaatcatggcaggtgacatctctccactcaagccctagatgaatcaaccaactctgtggttacacttggcttatcttctcatctcctcttttcacacttaaaactctctgaagacgtcagggtttatcaaggatttattatgaacacaggagggctgagaagaagcccaggcacaagactgtctggctcccttgcttggttccatccaattcttgaatggctggatcctgttaaaaagagattggacccaatctggccaatacagatagcagcaatcccctttatgaacttccatgacaagaaggacaaaaagccatccatttggccctgtatctgaaaaagatttttaaggtattcctttggaaaaaaacaaggcatcatttctaccttttaaaaaggcgatagagaaaaaggaagctgactgccatatcaacttaagtatctaaacacaacttaactgaaatgaagcactgcctgactcagggcttagcctcacacaagaaaaagtccttatgatgccactaatcttttgagcagcttgtcataaacttaggtcaccaagacagccctgcttctgccaagcagcatagcagcttagcgctctaagaaaagatttactaaaaaacagtgatgcctaacttttgcctttatgagtgatgcacataccaattcctatcttgctagaacctgttacacacaaactagcaaaatgattagaagtgtcagaatttgcaaaaggacccagggaactactcattcagtcttgtagcagttatggctgttctgagcaccagtgttcaatataaagtcatatgtgcttatgcactcagccgcgtccgactctttgctgccccaccatgctcctctgtccatggaattctccaggcaagaacactggagtgggttgccattttcttctccagggaatcttcccaacccatagctcgacaaagtcataggggaactgtaaaaggattaattccactttcatgagaacataatgtggcaagcatgtgcacatttttcaagtgttaatcttagaaaaatttgtctgatttttttaagtttggggaaacagtattaaaatgtattcaccagaagcagacagaatagatagggtgtcttgttataggatcttgacggcacatcactgaaagaatgatttctccagttagggtatccataatgggaaaatgcattttaagacaaatgaaacaagacaccactggctttgccaaacgcttcatctatcttttttgaatgttgtatctgggcctaagtaatgtgttccctggagcacaccagcaacacggaaactaaaaggcctccttgcccaacaagcctcaacacagaacaccagtcctccaggcttgcttcaaagaggataaccttgaatttgtcatagctagttagtgcttatcaaaggctcaattgaggaacgtgatatttatgaaagattatctaacagacttattttccatctccacctagtctaggtgctagccttgaatcaactcccgggcacaagacttgaatccttttttctctgtcttttctactcctaaagaattacctttactaatttataataatctaatggcagcagtttttaccaaggagtatttgttgtaaacactacacagaacagtttccatgatcatattcaccaagtccttgcaggacatttttaaaaagttttatttaattctttgaagaatttatatggttttgctcctctgatagtgcaaattatataaccaactgtgttttccttttacctagagatttacagtgaaatacaacaatcttgtcctagtcaactggttcttaatattagactattcgttttctcctttccatgatacaaactatttccgatttagtattcccagatattcccagatattccttattatctgttaatatataaatgttattttatatgtattagtatttatatctcctactgtgatattctttatctaacttgctagatcaaacctttctggaaggaagagaggtatcaataaaacaacatgaaaacatacttgcaacatgaatctctgcatgaactgacatgaacatacccccaaattaatcacataaaactttagatcacatccctttgaagtgggatcatctaatcagctctgtctggaacaccaaacagaacagtactctgtggagaggacttgcccaaaggcagaaacccagaggaagcagaggagatgccagtgtacaagtcagcaccacttcccaactaaggccctgcctggaaatccaaatgactctactcaatttaggttaccaacctcctcgccactggctattcggtgagccagatcttttaagtttctcatcattctttcatcccgaaaatcataaggaaatgtttctgtccattctgtcaggagctgaagaattttcggtgcaatttttcttatctgattctagggaggaaaagcaaactgaattcagcgatatccatcaaataaataattacaaacaatgctactgacaaacttccagtgcaaagtctttgagtctaaagaagctctagtgcccctctcccaagtcaatgtcaagtgctaccaacttcaggaaggacctagggatcttccatggcactggacttacatttcttctttataccattccccattccctttgcatagccgtgatactcttcagcccagggagaagccacggttacttcaggagacccacttcacaagatttaagccataatgctaccaaacccaatagaaaaaaagtaaagttcaaaatatatcattaccttatcactgttgggatcacttagtctctggtgctcaacacataagtggcaaactttggccattagctcatacggatgcataaataaccgagaactcaacaggaaggtaaatatgtacgttctctgtggcaagagaaaaaaaaaagttatcatggttagagcctacatctgaaactagtatcttccctaaacctgatacatcatatatcaagttctcctgatcaaagtgaaaatgctgtagtttcaaaagtgatgcttactagtaggaaaacaagatggatttctcctttaccttctggtacatcttttcccttaaaccatactaaaaataacagaagtacaggataagttgagctactaaattattcacaccacatttttatatctaccctctgggagcctgcataccaggacatataactcagcccagtaaagaagaatgaaattcagcccatggagatcaatctaacttacatacaccacccatacagaatcttgttctgtgtccaaatattatggtaacccaatggaaattaaaaaacaaaaaaccacccaacccacatcagttcaaggattctccagtgggtccagtattacacactggggcatttgtgtgcttgtcagaacattcaaagacaggcattcaagtcatctgtttacttgctcaaaggctaagcaatttgataaaacataatatcacactatatacttttctttaagcacactgtctcccaagaagccagtaatgaagtaatgcttatttgttataatagcttcagactcccaataaaaagaaaaattccatgggttttttctccccctgaggcacccttttatggctcataaacacttacagggctgaacaagggacgcctttttacttttgattacaagttttccctgtgtggcaacatatttgaaaatgctatgtaacaaatcacacacagagggagataactcagtaacaaacactatggtgaactccaagtggcaagcacagactatcgtttgcacgccaaggtcattattacatttataaaaggatttgaatccagtgtctggatattttcatgaaatctttatcaacaagcagctgttgagaaacggggtcagccacagcacaaaggaagtggggagaaacatcacttgctctagaaatagaaaacccgggtttgattgctgatgtcgagcgtgagaccatgtgccaaccgaatcccaaatttcaatttttttcctctctgagtctcttggaattgctctaaagactgagaaaatataaatggatttcctgaattagaaaggattacctatacaaatgtcagggatcaaaggaaaacataagcaagcatattatctgatgtccaggctacaaagaattgcatcttgaatgtaactcgtgttctcttttctaggaagcttccctgtgtcacttaacctttctcaacatagtgatggtcttggaaaccaaaaaggcactaaacatttgaggagcatccaaggttttctggcatttctatttaaggatcatggtacacgcacgagtcaaaccttacagttatttagatggtctctgaccgtctacactgtgatgccaaccctgaaaagaaaaacttaaattatgcagaactattgtatccaggctcaactgggtctcaaagcactcaataatcaacatgcaacttcttgttagaaaaattcttagcaacccagatataattctggagcatccagggtccctgtctgctgctgctgctaagtcacttcagttgtgtccgactctgtgtgacctcatagacggcagcccaccaggctcccccgtccctgggattctcctactctattgtaatttctgctggataccaaggatgtgtttcagaaacatgtgaatacttacatccggataataatccacattgggtaccaagtgctggatgagcgcttccagagacccggagagggaggttgttgtcatggtaatacaaccccccacagctgtcctctgcagactgatagaggtttcggttgtaaccactgctgtcaaacatggcagaaaagggaggagtctgaggcatgctttcctaaaatgaataagaaaggaagaaacacggtgtcagtaataggcagtcccaaagaaaagcaaactttaataggcatgaggctttcacagttatgaagaagcaggcaagttttaacccaggttagattctgaaacaatctcagaactcatcaagaagtacactgcttttgaacagcacacgaatgcatattttttgagtagcaatcgtgtccaataaagtaccatgaaatacgtgaatcaaaggctccaatctatgcctaaagtcaagtctctggctgctgtgtttagatcttatgccttcacatttggttaggaaggcagggagaggggttgagctttaaagtgctttatcctcccagtcaagtatcatcctaaggggaaacatgcaccttcaaagtggtggggaaga

SEQ ID NO: 53483 - DNA, 1375 bp, Bovine  19866880415772
tttaagggaaagtaacctgagaaaagagatgttcaattttctcacagtaataagcagatgtgtgcatccatttacctggttttcagattagatattgctctgtaaaaactgagcagaaatttgagtatttttctgtatggaagtgaaggatcaagattattcatgtactgttgattgaagtgaaagtcactcagttgtgtccgactctttgtgaccccatggactatacagtctatggaattctccaggccagaatactggagtgagtagcctttcccgtctccaggaaatcttcccaacccaaggatcaaacccaggtctcccatatagcaggcggattctttactcgctgagccagtctttcagaaattgacatctcctcgaggtcatagagtagtagttacagacagcagatcagtagatccaggtccaaacaaagaccagtttttggtcagaaagatttcagtttaatgaataagaaaactacagatgttaattgaagttaacctgaaaaaggacctattaacttctttattagcagacaaatgctatgtttgtgtcaaggggagggagtagattcccctctagtcccactaagacaggacaggtcatggaggttgaaatagacttaagcaggaaaaagacagctgagtatatgtcgagctgaaggttgatctaactgtgaaagatggcattagcacagtttatttccataacatctttccagaaagttaagcagtttttcttccattatgtcaatttttccaaggctagtctcgaaatgctctatgaatcagaagacagactcaactggaataatttccagtttatctgatgaggcttatttgttatatgatataggattttaaaccccactagaaattaactagggtgaaatacttaatataggaaaacttaactgagacatcatatgtttattttttaaaaatcaaaatgcaaaatattggcagatccatttatttcttacttagcagatgctgtaaggcaaaatggccgggaaaaaatattcaataaaattccagaatttacccaaatagcaatgactttaaaagggacccataactttaaaagggaccctagtccaaaaaaaaaaagacaaaaaaacaaaacaaaaaaaataaataaaagggaccctagtcatatggtcttatctgagtacagttttctagaatgacctaatatcaatcacagacatgcagattagccttcattgatgccaatattttagacatttggtaagatatttatcttcattccactaaaaaaacagcttagtgcagtatattaaagcagagaagtaatttatttctgcagaatttccaagacaaattttctgtgccatacgttttcttaa

SEQ ID NO: 53484 - DNA, 1126 bp, Bovine  19866880418787
aaagaaagatattaaatgagtaggggataagaaaacagagttctcacaccttcagttgagttcagtcgctcagtcatgtccagctcttggctaccccatggactgcagcactccaggcttccctgtccatcaccaactcctggagcttgctcaaactcatgtccatcgagtcagtgatgccatccttctcatagcttggcccctgttaaaatagaaattatatttgtattaaaaatttctaaatcttgatattcaattatcaaatcccaatcaccaaaaaagtttaatgaagttacttgtttttaaaaaattacctaaaatttttgattctcttgaaaaagtgctaagactcctttggctataaggattgaaaacgatatttaaaagtattaaacctaatctagatgcatgggatgagggggttggagagaagttcaagaggaaggacttggatatatatcagttcagttcagttcagttcagttcagtctctcagtcctgtctgactctttgtgaccccatgacttgcagcatgccaggtctccctgtccatcaccaattcctggacttcacccaaagtcacatccatcgagtgggtgatgccatctagccatctcatcctctgtcgtccccttctcctcctgcccccaatccctcccagcatcagagtcttttccaatgactcaactcttcgcatgaggtggccaaagtattggagtttcagctttagcatcagtccttccaaagaacacccaggactgatctcctttagaatggactggttggatctccttgcagtccaagggactctcaagagtcttctccaacaccacagttcaaaagcatcaattcttcggcgctcagctttcttcacagtccaactttcacatccatacatgactactggaaaaaccatagcctatatacatatatgtatatgtatacatatagctgattcacttcattgtactgcagaaactttacattgtaaacaactatatctcaatttcaaaaaagaagaaatatatttacattaaaaaagtaataatcctagatgagagtccatttatctacactggttttaggcagaaaatgcagagagatttactggtgtgtgtcttttttt

SEQ ID NO: 53485 - DNA, 1615 bp, Bovine  19866880597978
aagaggggaaaaggtcatctaatgaaccgtttaaagaactcagtggaatatataccagacaaacagagaagaagagaaggaaggttgtgtgtgctttttcgccttgactgtatgagaattgctcattccctcctgtttgtgattttcctccatttaagtatgaaaacatctgttcatttaaaattttgtaagatgctctggtaaaacaaattaccactgttgaaaaaataagatggttcttaggcttgtaggtaagatgccatttaattttcaggtaattaatctcagcaaatgttattgtggtactttttgaaaaggagctgattagttagtaaagcatggatatagggttttcatctggaaattcactggggctgtccctctttggagctttaacctaaggaccactctagcaatgaattagcctgtatgcctttctttgataccagcgtcacaactgacttagatggctaagtgtttggcaatttttggctggaaaaggaagaataaaagaatacccctaacttacatcatgataactgccccctagggattgattgtggagttatttttttggacttaataactattttaaaagtcaagaggttacatttatctataatacgtgcattgcttttaatactaatttatcttagtgcgtggctgtagcatgatgtagtcacaaaccaggcaccagctggtagtagcattacggggagaattgccatgtgaaagaatttgattgtaaacattagcgctgactcatgagtgtgacaaaaacagacacgagccgaatggaggtcagataccaaaaaggaatatccaaggcttcttttgggtggggacacatgttatatgtagaagtcaggaaggtggttaggggctgagtaggaagtgatggtgtatttctgacaaatagttgtttgtacttagacaaatgcgattgggaatgttagaagtagaaaaatcaagaaggtgggcctaaagaaaaagaattaggaaaaggatgctctgacttgagatctgtgcatcttcacctcccagaagaaaaccaataggttcctatttcactccagagaacattagttgtatgtggttcctattatatggaattccctcagtagctcatctaaaataccactgtagttgtttcatggcccaacttgagtcgcactcccaagagcaacccaaggaaagaactaaatcttgcaggtctgaaaagacaccgtatgtatatgtgtcttttaaattgttagagcaaaactgactgcctctaactgccctccaccaaggtggctatccagcatcaaagtaagagcatcaagtgcagatctcttgagtttgtggcgtggatgcacaggcagagtgaggaggtcatcctttgcttgtttcctggcagacatatcggaagaatgtccagcagatgatccagtgtctgatccgcaagctggccgcactcagccagtatgaaggaagttctggccaaaatcagttccacgtcgacagatcgactcacagttctcaagaccaaaccacagtccatccaaagggacatcatcactgtctgcagtgacccttacacgttggcccagcagctgactcacatagagctggt

SEQ ID NO: 53486 - DNA, 1436 bp, Bovine  19866880641823
atacaaagttttcagttcttgtctaacatttaatgtcctttctacctagaatacttggccctgtttctttccatcaagaaaatctcattaggaacatatcttaccaagatacatattcttttttgacagaatagtccaaaaataccttacacaaatacctattgtatcatttctcaggctgtattataatccttttttatttttgatgtgttgaattgaattgaatgacacttctgactacctgtcactagggcacttaatattttcaattattttaatagttgcaatagattggtcaacagttatctatattttcctaactggaatatgcattcattaaatagctgattgagttagagatacattgtatagctatgaataggagccaagttaactaacttttgaaaacactaaactttaggtttcatatccttaccaaccaaaatcactgatcaaacctatatttttacagggaatatgatatttcaggaaattagtttgttatagaatgttttactgctttgatattatttgaaaaatagaaaaagaacaggagtgtttattattctagattaaatttcatgtctctttaccacaattgcaatttcatataatttttccacagcaataaaataaaaaggatcaaccataagaaaacatgttttagcattttttaaacatctttatcatagttttggcaaatctatggtaaacctttggaaacagtttagacaaacattggataaatcagctctaaaacagcagcatttaaatggtctgtaggtgtggcgaccacacacctcagttttcctggcattgtctgagcttactcttattgtcttggcacaattgtcagcagcttctttttttctcagtaagatcctagtttgcacagtagaactgtagccatcctacttacagactgtctacacagagattaaaaaggagacaataatttttaatgcctaaatgtccccatgactcagataaaaccccctgaattttcatttttcaataaaatctttttatttcacaaaaacagtttttgtaagtttttaagtttatttctatttttacagatttcctttaaatatgattatctctcctcctaaaaattgtcttataaatattatttatttttctctcaaatgaaatgtgttttaactttataagcatattcaagtattaggtactataaatgcctactggtccaactcttcaaaacccaggaagattccattattaatggagattgaaataaaaactccctcctattcattatgaactgttggttatactcatagggaaaatctcttaggagctaataggttctctttcagtaatgtgttctctgtgatgtcaaatttcctgttcatatgataatgatcttttttttttccccctatgctttaggtagtggagactcaattgttaca

SEQ ID NO: 53487 - DNA, 1461 bp, Bovine  19866880677438
aaaacctgaagatctagaaacctattctgctgcattcatggcagtgccttctctcccaggaaactaaattactctgggtgagaacagtcctcagaagtaccattcccaaatatatatatatatacatatgtattggctgcattctaaaacaatcttgaccaattaataggggtgtgactacctactgctattcacatagcatggaggagctgagagtatagaggtctagaaaattttctcttaagattaaatctaggagataattttggaacactgtgtagcaagaaactagtatattccaaggtaggtaaagcggaagtttacactatcccggtttttggagagtgggtgacatattgttcaaaagcaaaaagaagttaagctcatctcagagttcaaggccaagcttaaacaggttaattacacccctctttccttccttccaaatgaggcaaacaaaaaagtccactagcctctattgcaaaacctgatcttcacttcctgtactgagcgaaactattctaaggccggaaaacagctgctgcccctactctgaaagaggagctttcattagtgggtgatacagtctttgcctaatactcctggaggtaacgcgaggaaaagtttcttatgtgtgtgtacaccagccttacagccatgtctaccatcaattgctgaccatatgggctgcactcaggcaacaaacgtgccatgagggatgcaccttaaaacaagaggcagagcagtaaagacctgtccttagcacactggacatgcatcctgtctttaccgcccctgctactgttgaatcatgaacagagcatcctcttgtattttctttctgacttaatctgctaaaaccattatcctttctctcctaccttcatcattacaaatgcctgcatctacttgcttattaaatttcccaataaggagagagagagagaggacaaaagttggtgatagggtaagaatactgttatggcacttggagaccacactcaagaataaaaatgcaatgaatcagacatggctgaaaaaaaacaaatctttctgagggagtttcctggtgatctagtagttaagattaagactccgtgcttccactggagggggcacgggttcgatccctggttgaggaactaagattccacacggtgtgtaggatgatcaaaaaaaaaaagcctcgtgcacaaagtgcaggcatacctcagagatattgtgggtttggctccagactaccacaataaaacaaatatcgcaataccatgaatttaaaaaaaacaacttcctgatctttaaaacctaaaacaaaattgttccaatttctgtctctcatacccactatcatggactaaagaattccatttccaacttcagggctaacctctgggtagacccattaccttgtcattgtccaaagggtccttctgcacaaaggcttgtacaaattcttctggg

SEQ ID NO: 53488 - DNA, 1809 bp, Bovine  19866880732751
gctctaaaattacatccagagaaatttaaaacatgaaatcaggaagatggtccagttggcccttggtattctcagagaactggttgcaggacccttgcagataccaaaaatccacagatgtttaagtccctaaaattaaatggcattgtatctgcatataatctacatacatgctcctgtatacattaaatcatctctagagtatttattattcagcaaaatcaagttctgcttttgagaaattcctgaagtttttccctgtgaatatttttaatctgtagttggatccctggtacccagggatatggaaggctaactgtacaatgccaactggactcaagtccaaaaactaacagtgtaagtaaatatcctgagtaaacaaatgagaaatgagatagtgttcagtcataagattcacttgaattttgcgtatcttctttcttgagaaattaggaagaatctgaaccagtgtttccccagatagatgtctcagaaccacaattctctaaagtactctcatgaggagaaagtgatccactctttagagggttcatgagctttttaaaggccctgaaaggtcccaaagtaaactgataacttttcccaaacttacttgatcatggaatgcaattttatgtaacatctttcaacgacttttaaataccctcttttacaaaatcttctcctagaaaatcagataagatgattagaaattttgagatgagctcagtatgtttgaaaacttgtctgacaaatatatcatgatgtccatttcttcttccatttaaataaagggttgggcttgctttctttatagcctctttcaaacatgaaactgtataattccaaaacgtttaagatcaggtctgacattcatgtctctagctaatttttagaaaaacctgaactgggtcaatcaaatgcttataaacttccaccacttagataaaatgtctgtaacccttttaatatattctcaattatgtacatagttttaatgtataaatattccctgagtgaattatctacttaggggacttttttcattgatcctcatgttctcctggtctctctgagtgtgtctaaccatactaaagagataaatttaaattatttttaatgtaacagtctttttcttttccattagcatagataatctagaattcatggcattatggatttttaaatgtcagagattgtaaagctgtcttgattgttacagtaaaaacttcattaagggctatcatgtattcaaagtagagtgtaattcaaagcagctgcacatccagttctccctctccagatgtactattgtcctctgaataaaaacatcagataatctaagtattctttaatttctaggtgccagaaatttctaggtaactctgttttaatactgttgtaatagccccttgccatcaaacccaccaacaatgatgcttccccacccccagtccatgcattttacaaaactgactcctattagaacgattgttcagcccatcactacatcctttctaaagccttatattttagccttgcacttcagaaacatgtcacattttaattcttcatttttaaagatttttggttacagtaggaaagactctcttctttctcactgaaggaaaatattcactttggggtctgacttttctcaactttcttttctttctgtctataaagtctgtgtcatttttcttgaaaggtgacataaatccactgaaatgcaatcttttgtagttatatgtcataaattaaaataatgatagtttcctaataagaacagctgtgcgttaatcactttcc

SEQ ID NO: 53489 - DNA, 1517 bp, Bovine  19866880825875
tcagatcattgtattgttgaactgaattaagatatggtagatactatatatatacatacacacacatatatatacatgggtttcccaggtggctcagtggtaaagaatccccctgtcaattcaggagacctgggtttgatccctggcttgggaagatcccttggagaagggatcaagcttgcaatttcagcactaataggcccaagaaacacgagtgtggttgtcacagtcacatcacagaggctccaagctgactttactgaggatgaaaattcattttccaaatcaaattgcagaggaacagatgagttaacattgttttatgggcatttgacgttctgacatttgagtcagaaaggagaaaacacccagcctctactttatatgttatttcctcccttttatctgagaaccacaatattccttcttcagtcagtagggatttcagaatgtgcaaactgctccctgggctattgggtacttttcgaaacagcatttaggttattatagcaaaacacaatgagatttaaaacacaacaacaacaaatggatgtgctttataagtaactgtcaaaaattactttatttttaagatttaaattagacatcttggactgttttcaagattttttctatagagtactttgaaagatacaacaaaaacaactcaaaaccctttcagtaatttccagataaatgcctccaataaagtgtgtgtttaggtctttcaggctatgttattaaactggcaactcttctctccttcaaatatgctagggttttatttctctgtctctttctccgactctccctgatctcttcctcccactccttaccttaacatttcagagtgaagcaagagatacctttatgccttttaggtattcaaaaggcatatattggtttctttccctaggaagacacattttgtttttactgattaacatttccctggaagaagttgttgggaaggagaaaatttacctcttgagtaatgataaaatcgacccaagacagactaataggagaaaaggaaacacattttatttcatgggagtataaatctaaaaaaaaatggcacctaaaaattggcaggggcttccctagtggctcaggggtaaagaatctgcctgaagtgcaagagacctgcaacaaatgaaactccgtttcgatgcctgggtcaggaagatcccctgaagaaggaaatggcaacccaccccagtatccttgcctgagaaatatggacagaggagcctagtgggctacagtccatggggttgtaaagagtctgacatgacttagtgactaaacaaccaccaccaagaagtggccaaagtaagcagcttttatacttttttgacaaaaaaattaaaaaaaaatttgtaagaaactgacaagacaaagaattgtagggtttgagtgctcaattaatgaaaaatctaaacagagtttgtgcttgacgtaataaatcttaaaagtaacaatgtcttatataaacatttatgtatagcctttaa

SEQ ID NO: 53490 - DNA, 1189 bp, Bovine  19866880837583
atgggggcaggggatgttggtttgccctattgttgaagtgaaaagggaaaaagaggaatgagtttttctctttccctttcctgagaacaaagaagataaacagaacagtaagtaggcatgaaatttcttagtttttttttttttttttttactttaactggttctaactctgtaactaagtttgcttttctgcctcctaactctgtaggataagatggttggatggcatcaaagactcaatggacatgagtttgaggaaattctgggagacagtgaaagtcaggtcagcctgctgtgctgcaaggggttgcaaagagttggacatgatgtagcgactgaacaacaactctgtaggagctacaattcacatttttccctttgactgtatgctaaatacatcccctatctgttatttacccttaaaacacccttccccttgtagttacatatcagaaagaaggtcacagggcccccaaactgccgggctcaattactgggtcactgatgccagtttatttgtcattgaaacactgtctttgaaacaatgcaagaggaagaaatcaagatcctgtcacctttgttcctcatcactggctcctgacaacaagtccttgtcttatgtaagctcctggactcctcatggcagggatgtgtgtgtgcacagttcttgaggcatgagggtactgtgttccccttgccgctggctgagaattaaaaccacctttctatttcctccaaaagctttgatgggcagagaaggccaagattttggtcagcaacaccatcacctctcctttcaaacttcttctgggttctattttatctgtgttggaatagaagagaaaaactaaaggttacaaagagcaaatgttctttttttttttctgtgaaagtggaaatgtaatttaatacactgttgtgagtcactttacaggagacctggttaactgaaaccctatgtgtgatctggcatgacagacatttaaaggctgactctcttatagggtccttgtttacattctctgaaatgtggatcttcactgcataatgcatggatgaactcctggatcaatctcttccaacatttctcagttcccacctgcatgggggaccctacagcctcttgcttctagggattcctcatcaattcctcccaggtggggagttgactcaaatccagtgatcttca

SEQ ID NO: 53491 - DNA, 1822 bp, Bovine  19866880861151
catcatgatttatgatagttcagtaaggctgaggacctataaaatgggctacgtgcccacacggctgtgtgcttctgatgatctcaaatggtcagtgggcacacaacccgcatccctatgaaagactgtgatcaattgcagatttatgcagttgaagatgacattgtatccaccccaattcaaccagctcattctcattttctatgactctgtcatgatactgaacacaggtcttatcttgtctataaagttctcccaaacatcactaggtcattattccaatctcaggagatagcggtcacagttgaaaccacatcagccagaactgcagtatccaatacagtggtcattagacccatgtggctatctaatcttaaaataagttgaaactaaaaattcagttcctcagggcactcgccacatgtctagggctcaacagccacatacatactattggctactgtatcaggcaacacaggttataggatgtttccatcattgcagaaaattctctgggacagcactgggttattctagaacctgatcttaaaaagtagccctttgaattttgcaaaagacaaatttcaagagttctccaatgccactagagcatataagttcctccaaatacagcagggaggtgtaactataccatgtaagctaccccttcaggtcctacaagtacacagagatggcatgatctgcacagagatggcatgagtgggctgcctggcaatcgcttaggttcacttgccatttatttgagcccaggggcctcagcaaactcacagactgcagtgacatgggtttgagagtctctcatgaattcctgaatccgaacctccaagttccacatgtgtcatttccctcagatgttgttctctggtttctctcagtactacctgtctccctcatgctgttgattgcaggagagctcggagtctcccctcactttcttgctcactgttaagtactcatcagagaccacctttttgacaaaaagacaaaatagacaccgagcggctttcagattgagggtgtagagggggacctgatccaaaatgtagttagcacatattagcagagacaagactagtcatgaactcagccagaaaactttataaagttcaacaaataaatcatgagaacctaaaaataccgggttggccaaaaagttagtttgggtttttctgaaccatcttacagaaaaactctaatgaacttttgggccaacccaataaatgaaggcaccattttgactgatatctgaaaattctctaatgtctaataggagttgcttggaaaagtagccaaaacaatggatactgtccataatcactgtatcagtgaatggcaatcccatcttttctaacttctagaaagttatttcttacaaaatttatgaattaaaatatccaaactttacttaaagcctttctctcaagctggaactactggaaaatggaaagtgaattgtaatactgagaactttcaaaaaactggaatactttaaatctctgaattggtgatgttagctatctgtgtttaacccattattccagacttaaagcaaaagactttttggaagggaaaattgaggcataaatgtctgcaaggggaaataaaacaaagaccagtcaatgaaaaagagtagctcccatatttcaactaatttttccatttagaaccaaaaggctctatgaaagcataaagggattatgaagacataaaggatttaatctggtctctttaggacttaatcattacagaatcaattatcgtgtttctccatcatgtccctaatgcaaacttgtactcctgg

SEQ ID NO: 53492 - DNA, 2224 bp, Bovine  19866880905627
tggagcagtccaagcaatgtctttcctacagctacgtgtttttgtaaatttcacaaaaggataacatttaactgtcatcttcccagactattgagtcgtttctctctgaccttctctgttcatatttattctcctgtcaggaggccttggagtgcctgtgaacattttggggatcttgagatgagagcagatgtaggttggtactgttgtctatgagccttcagttcagttcagctcagtcactcagtcgtgtctgactctttgcaaccccatgaatcgcagcatgccaggcctccctgtccatcaccaactcccggagtttactcaaactcatgtccatcgagtcgatgatgccatccagccatctcatcctctgtcgtccccttctcctcctgtccgcaatccctcatgagccttacaatcagtcaaatgacagctggcttttgctacgtgatgtggttttcaggcacgatgtgtgacacgaaggtgcagttttgcaggtgtgctgtgacacaccagcacttagcacaggaagcaggtgggtcctaaggagaagcacggcttgaaattacagactcaaaagctaatttgtggaagattatttccatcattgaatgtgtacagttttaagcagaggatttcattcatgttgattgctcagtcaaagtagaagttcttacaggtccagaatagactcaataaaacaacatatacaattatcaacctaccatacatttgatagagctactgaagtagaatttgtcagaattaatctgcatttactggacaaaaagctgcagtcattttacaaacaggaagaaagcctgtggcgggggcacagggatggtggtggtttattcctctcagtcattaattaaagaaaatattttaactggtcttattagaagaatgaattatctctttgttctttctatggattgctatttttaaaaatcatcaatatataaaaagctgataaaggaacatgcaaccaaaaactgtagagaaaaactattacagaactatgttagtagttatttccaaaaatctttttgctgttttctggatttttgcaacgtcctaggtatttttcaggttcttataatttgtaatttatggtgatttattttctcattctgaacaaatattcactttgttacctaactttggtattgtgatcttttattctttttcttaaatacatctcccacaaaccccaaatctctcttcacaacccaccgtatttctcactggggtattctttattattttcacagaagaatacatatcaagtattatttattgagaagttatgatgtccaaattgtttcatagctgtggtttgacttggggaaatttgctcagattcccagagctgaagattacctacaaaacaaagcagtttggctcatagcactgctttccagattcagtgaggttaaatgatgcacctgggaatgtgttctaagtcaagtgctatttaaatagttgacctggcatataggccacaatgagaatggaccaccctctgttatgttctggctctgtcttagtaatgacgctttcttgaatctactcatttcttcacttgtaaaaagggagaaaatgtatccaattcataggactctttgttatcagcattaagtgggtaattgacattgctattattattaatattattgaattggcgctcttactcattatcaaaatcaatgccaaataatgcctctaaagaacttcagggagttatacagccctttcaaaatcagtgtattgctttttattaaaatgtattaattatcatttctgtacttttcatttgtatgagattcacttatttttgcagccatgaatattctaccagcttttagttttgtaattgatggtgttctgactttttagcttcagcaatatgaataagaaatatagtaatacagcatgtagcagagtcttaaatattttgtcacatcacttatattgtgaagacatatcaggtcaaagagacaatagcaggcgctattaaatatccagggccttataggcatcaaaaatttttgcgcatgatttggcaagtcaaattaataaagcgtctttcttttctaccaaaattttaaaaatgttttttcttattttttcatacttatttcaaaataatagaattcaagagtaacctttataaagacaggtttccaaacttaggctctttttctttctcaccctgtag

SEQ ID NO: 53493 - DNA, 1589 bp, Bovine  19866880910262
aatggcctttattttattgagttgtgttccctctatgccaactttgatgagggtttttatcatgaatggatatggagttttatcaaatgctatttctgtgtctaatgaggtgatcatgtgactttctttctttggttaatgtggcatatcacattaattgactgcagataatcaaccatccctgcatccctagtaataaattccacttgatcatggtgtatgatactttttatatattgctagattcagtttgctaatattgttgaggatttttacatctgtattcatcaaagatattgacctgtaatttttcttcttctgtagtgtcttttatggttttggtatcagggtaataatggcctgctagaattaatttgaaaaataggcaaactttctggcagatacttgggtggtatatatcagatagcttagaacattcatattcttttatctatttgctatttctaaatatttatggacaaagatattcatcacgtgtgtgcctactaagtcactttagtcatgtccaactatttgtgaccctatggaccatagcctgccaggctcctctgtcaaagggattctgcaggtgagaatactggagtgggttcccatttcctactccagcggatcttcccgactcttaaagtcttcttccttggcaggcaggttcttaaccactaacactacctgggaagctcattcatcaccatcatacttattttaaaaattgaataaaactaaatgtccaaagaaaggactcattaaaaagctgtcttcatttggtgaactatatatgatgtagctattaaaaactttgttttcagaacaactgcatgagaatattgcttagtggaaaactaagcagtaagcctatgtataaatatgcttctaatcaaaatgaatatgtaatatggagagatatatttgtaagtataaaagaagactagaaactattacatcataattttagcatctcagggtgctagagttatagattttaaaatgtgttttacttataaacatatccaggtcttcctcagtggtcatatgttatcttaataattataaataatcaatgatttaacatttaatcatacaaataatggatattgaattttatataatcattcattcatttacccactaattcatcactacaccttttccatctttcacacattgtgtttattttcttgtgatttggctctgtttagttgatatatttttagatcatctagttaataaatttggggaatgaaattagaacacattcttccaaattccaaccaagcattctttgcctgagactacattgcaaaaaaggaaataatttgaaaattaactaaaagaagcaccagaacactaaaaatgaataaaaagaaatcagtgcaaatatggtttgtaccgaaagtttcaaatcttgggcttgtaagaattttggagaatatttttgaaaaactggtatccaaataaaacaagtttgtgtgagatgtaaattcataaacaaaatggttatatgaagtgagaaaggcatgagtctttgtttgcttcgatattatttttaacacgttgaaatattccagtaa

SEQ ID NO: 53494 - DNA, 807 bp, Bovine  19866880917605
ttttttccccaaagatacagaaggtatagatctcactatgccaagtaagggacaaagtatagtctctttgtccctcacttcataattctctttgcccttgtgagtttagatgatttttatccctttactgttacttcttaggctttccagaggagcagaggtagatgggtgtgttcaatctgccaaatttatccagaagcttggactcttcctgtatgacatgtttaaattaataacattacaatttatatactgaagctgtctgtaattttcaagtgtttgggtaggttttctttggccattttaaaaagctgttccattcggcaatcactaatacctgttaaatttaacttagaagagaaaagaaaatgtctcttataaagcctccaaatacattaattttctaccatacttactttaaatatacttaaaaataaaacatatgtttatacaacctgtgttcaaagttgaataaataattatcaaataatgagggttaaaagtaaaaataaaatgtatcaagaagatacttttttttccccacacacttcactggtgctgaaatgtgttatgagctatctttctttgtaatgcttttggcacttcagttcatgcagatcaaaactagcatatgttctttccctgattttccatttcttcactaacttaaacattgtgggggctgactatattactcactgatggggactaaagtagttagcttaaattgatttaaattaaatcggatatttcaaagatacaagccatgtcttgacagcattaccacagcacccatgagatattata

SEQ ID NO: 53495 - DNA, 2195 bp, Bovine  19866880946364
cattagaaagaatttagaaacaggtctttggtaacttgccagagatcacatgtcaattcaggaatgggatttaagccaaaatgctggctttttaatgtcaagattttgagccacgtttcagaggcacctcaagcccccagttacctggtattctaagtttatacacctaaaactcccaggaggggaaactgaaacatatggaaaggttaagagtacacaaaagccaaaggagaagcaaataagtagaaagttggcacattgttaaaaaataataggattttgctggggggtgggcaggaaaagggcaaatccgatttgtctcatctcatctttcaattcagtgaaaaaaattatccatgcattagacttcaacatggttgctaacgggcacaaattaccttaaagttagtattgatgatggccagctcctttatctactcttttttcctggaagagtagttaacctacaattaattaactttgcaaagaagggtattttctccgcttaaggataagaagtctgtcttgttctattctgcatctcctgtgtcctgtggcatcaacactatgcatgtaattgacaaactacaattgtactataaccaccgtaccaatggccactgtttgctctttcattaggatcaggcgatttcttaagaaaacttttgcagccatccacttatctctattgatttatttttaaattcagtcatccaaacagcatatgataacaccccaaaggatttttttaaagccatagattgtctgacactattttgttactgttaatgttttactgactcctataccatttaattttcatacatttaagtagacaaggacttgatccataaatccagctgtgcattgcttgtcctcggtgcttggagcagagaaggttctctaggcactgaataaatacttgccaaatggatgaaatacttataaataataacataccctccattgcacctatttctgtggaaataattcccatcaacaaaaataaaaggttctgagctaatgacccagcacagatatggaaaatattcatgggtgttccctaggaaaattcctgtcctttttaaaagctctaactcacaaatgagcagtttctggtgggctcactggaatccagcaagcccttgattgtcggcggtgtgttttatcaggaacctctctgttttctagggagttgtcccctttctctttctcactgtgaaatccagctgccatgatcaggaataattaagccaaacacaaaagatccatgtgaccatttgctggtgtggaacatttgccagtctatcattttcacttgtttttgccttccgattacgtttctcaggtctctcttcacagcagcttaagaatcccagtgatgacaaatgcagacctgtgctttttttcccggtgcacactcagttgctcagtcgtgtctgactctttgtaacctcatggactgtagtccagcaggctcctctgtccatgggattttccaggcaaaaatactgcagtgggttgccatttcctcctctgaaaaggtttattaatatcactaataacaaccaacagtaatacattagtagcttacatttgtatttcacatgaggaatttacacctgcagagaatttgatgtttaacaaagtatatctcatacatttcctctctccctggcaaataacgtaggaagcaagtgaggaaaacaccatggaatcagataaacctggtcccaacctccctgctgcagggcaaaactgcgcctcccactcccctggaggttaggtgtggctgtgtcacttaaaacctgcctgaagcctttatgttctgagtcacctgttccctgccacgcagcaacaccgcagagtccccagccagcaagcgttgggttggtacagatggaggtaaccttgcagcttcttaccaaactgatgctgaaaacttagcttctgtgcactggtgctgaattgaagctcagagttttgggtgaagtagaaaaggatagcgttattgctttgccagggagggggacacagcaggctcctgcctctcaaaacgatgtgtgcgaacctgggaggattgggagaggagcttcctaatgagggaggggtctgctgaccaggatgaggttacatgcagggcctgcactcctttcatggtcttctctagaataaagaatgctagcaccttccat

SEQ ID NO: 53496 - DNA, 1225 bp, Bovine  19866880951415
ctggtggttgagactcagggagttttggatcctgcaaaatagttcaagaatgtgtttcagtctgatctttagttttgaaatagaacctgggaatctttacaactgatttattgtctctgatatggttaagttatattctggcctgatggagagcaaggattgggaccaggcttagatcacaaaatggtttaaggcttaaaatggcttctcttatgtcaacaaagtgatagctggttcgcttctcctgggggtccccgaccctgtctgcttacacaagtgttcttaaagcaacccacaaagattaaaggcctccagtcaagttagtttgggcaccagtctgctctattttgatacgccctattcactggtaggaagaaaaatggtgcttcctggcttcttctaagcagagttgagtggcgcttatccgtttcattaatattcaccaggtgctggatcctcagagttcaggcctgtgtgaaaaggacacagagaatggttttgatctggtgatacagactgtgatatatctggaggggcacgaatgggttccaaaatgagcacagtgcttctcaaggctgcgaactgaatatcaagggcaaaggtgggcaagaaagagctcagatcacatttctgtccatgtttgacctgcctcgaacaccaagacaaccgtgtctccagaggtcagaccttttactgcaattaaattttctgtctctgtagatgttgtttagcaaacttcagcactggcagaacaaaattacaagctcatgcagaatgtctggtggaacacgggcagattaatcagagacatctggcaagttgctggtatgactgcctttcactaagaacacttagactatcatttgaaactattgttcttcggaaaggaaagataaaacaaagacttgctgtttgacttcacatgttgactctagtgttcggaaggacaattagtctcatttgtcactcccaccccaggagcaaaataggtaaaagtgggacatgctcgtgagtcacccttttaaacaagatatggaaaaacagcaaggaagagtatgtttgttatcatttgtccttcgtttctaaagcagtgctgaacatttcaatctgccttctaaaaatgcggctcttctactgagcaaaagtatttccatggaatgaaggggcagaggagcctagtgggctgctgtctatggggtcgcacagtggacacgactaagcgact

SEQ ID NO: 53497 - DNA, 1159 bp, Bovine  19866880966133
gaaacgtcagctgacttacattgcagcacccccttgttttgtaggagatgtgcttcttttctatataaatgttaaggagagggaaattatttcatcaagtgtgtggattagttggattcctctgagaagcaggccccaagaagcagactgaatacacggtttatttgggaggttcatgacagatgagacagagcaagtaaggcagccaataggggcccagaatgaagagagctaccttgggggaggagacatgaggtgggcaaccagactttaatccaacttagaggttctgggaaaagatagcactcacacatcccagttatcctgccaaatacagggaatttggcttggatatttatattcccaccctcaagtaatttgtaaggatacccctagagagtcattaatttccaggcatttcaaaaggcaaagcaggttctagcagtccaagggtaggtatttgacattgtgcatgaaaatggcaaaggacccaagaaaaaataaggagaacacacccacagcctgtcagaagatctcacatcttcaccaaggcttaatcaaaacaagtcagactggggttgtgtatggttattctgtctgttctgttgttttagcttattcctggaaaaaccttacttttcttggaggtaaagaatctgccccactgagaaacctgcactatttcatctttttctgaataaagcaacctgttatcaaagaaagaaatagcttttggaatgctcatgacattgtttccagatgtgtgatttccagatatacactggccagatacagaagagctcaggccacggtgcaggagcagatgcctgaaagtttgggggatatccctgattccatgaagatcctggctttgtggaccactttgatgtcatctttcatggttcattgtggtgtatgttactttacaagcagggggagcatctgggctatttcaactggcttcacttttttgggatagtgtttgagatcattgtttggaaaggcctgcactggaaattgccagtgataacatatgtgctggctttgttcttcccaacattctctcacattgctccacctcacatctgagccatgagagctgcccagaaaaccctttagatgttagtctccacatgcattccctttagaagcaaagaaa

SEQ ID NO: 53498 - DNA, 2653 bp, Bovine  19866881025059
ctatttattaatttattcttctcccctgtttcacactatttctactgatttgctattattacacatgctccttatctcctttatttatataattggtctctagacattttcaaggaacattactatcttagagtattattatattctagataaccttgaaaaacgagaacagtcaaactcacagaaaatatcatgtaaagagatgacagctgccttgtttgagaatttattcttttatcacttaatctttcctcatccccattattatcatttccactttatagagacaagaaactaaaatacagagaagctaaactttacattgtcattattaaaatttttcattttgagaacacaaacaaatttcagggtgtaatgtgtaggttgtatatattaaagacatcttgagaatgggatccattatagatgatattaagagacagaaaaattacatttacatgtcttcactacgctctttgtaactgtcttaccagagtgcaattttggtcaccacacattttaaaaaagaaaaaaaccacaaaccttcagaggaaaagtgatataaataaggtctttccactgaattataatgcttcgtgaaagcaaggactacatatctttaattcataaaataaatgattttaaagtaaagcagaattacctttaggaaataatctttgaatgcctattcagtggatagtaatgtgctaaaagctctgagaatacagacaaatataataatctctgcactcaagaattccataacattcttagggagaattgtagtaattaataacatgtaaaataataatcaatcagctataagaaggaagtcttaaatgccagaacagtaaaataccaaatagcaactccaggaggctgtgcactcacttctctctgtatattcttaaaaatgaggccaatcaaatcatgctgattgatttagtgattgaaaatgactatttattgaatgcattctgtgtgtcagtcactagctcacagtcattggttggcacactgccaatgatattatttagcatcaggtcctgttaaagaaattaattcataattcttcatcttatgcctctgtttacattatcagaaaaagactctttgcttgctttctaaaaccatgtcacttaacttcagtctattaggtatttattgaacatttactttgtagcagaccctgtactagggtctggagttgtgaaaatgtccttgaagaactttcctatggcagtaacacactgaatcaaatataatgtgaaaatactaaggaattcactaatgagatttttttcagatgtttcaaagctttcataccggggagcctcagttcagtaatgatacatcttggattaaaatgaaaatataacccatttcactgcatcacaattaaaagtcaggattgaggacgggatgtaggtagggggaacctcattggtaggaatttcccctatttcaaaaattttcatgcagatgtcaaaaacgaaaacccaggaagagaaactgctcctggactgcaaggaatttaaacactgtcagtcaggagcaaagaaaacagagggggaaattggcactttgttctataatatggaacttgaaaaaaattgtatgcatctattaaaggtttctgtatgtaaatattgaaaagttcataagactgcattccagtattttcattttgatactgaaacgctgaagtattgagtcgaaccaattaatttggccattaaaatttcctaagatctacatgttcaccattatgacaaaaccatattcattgattaccaatcagaattctatctgaagaaggaatttggcgctcaaagatcctcatatgctgcgaccctggatgacctttgtgaaggcatttgcatgcctaacggtgggagcattagtttaacctgaaataccaacatggtgatatgtttgtcagcctgtattttaaattattttcctatagaaaagcacctgaatctcatgaaaaaaaagaagttcaacttaatattgaattcaaatgtatcctccacagtattctaaaatacattgctgattctgacatgcaggaaatttattgagttttgtgaagtaaagatctttgatttcagtatacgctatgcggtcagctctaatgcttttgcattgagtatgtagtgatcccttcctgtctttccataaaataagcatctcaaatgctgctaacctgccacttcatgcgttgcacatgttagacattaacttatatgataagcatctcttacatgtgacacatttaggactagaggcttgcgagagtcttgattctaagagccacaattataggttagaacttattctccctttttatttgtggttaagttttaatgtggtcatggtacatagtcccatgatttacaatcagatggattagccactgacttatgcctcacataagcattataaattcatatgcataccttccagatgcagggaaaatgcagagatattttcataatggattattcagaccattttgagtggggggcggggggggaaccaatccaaagcaaaaacagcttttacatatggcatccatggctgtaacactcactacattgcagaaaacgctccgatgaagcaaaaatgtcctgacaaagaccaaaagaaa

SEQ ID NO: 53499 - DNA, 1821 bp, Bovine  19866881161328
caagaagcagagcagtattggtactagaagacccaggcatctgttaactcagtgactgctactgctgcaaagtcccttcagtcgtgtccgactctgtgcaaccccataaacggcagcccaccaggctcctctgtccctgggattctccaggcaagaacactggagtgggttgccatttccttctccaatgcatgaaagtgaaaagtgaaagtgaagtcactcagtcgtgtctgactcttcgaaaccccatggactgaagcccaccaggctcctcttttccatgggattttccagacaagagtactgacagcttgtcttaaatcccaacccagaatgcggccccaatccacactgttctcccaccccagctcagaagcaaaacgttattctgtaggaaacttcaaaggaagcaaagtgtgaaagtctaagagtcaagtctcccccccaccccagggggccatcatgtaccattttactgcaatttctctttgctttgttttttccaacgatgcatttagctacagtaagtaggaaaaaaaaaaatccctattcaagagagtggagtcattatccacacacaaaaggccatttagagaaagaaaggctcagtcagttcaagctgtggctgccagagtccagacctattagggaaaaaaaaggttagctgtttaagtgggaatgtgaaacaaaatgtcataattagggctaactgggcaccctccccccctgccgagaaagctgcctgggatcataaactaattccctgaaagttctaggcttagggggaagcaaatcatcaactctaaatgacagttcagtggttaacctttaccctggaggctaggttttcattctttcttgtttttcttttaggtattttttttttaatagatgtcacttttataggattggactgtttttttttcctagctctccactactggcatgctgcagatcactctgtgtgtgtgtgtgtgtgtaaaacccatgataaatatctcccaataacagtagtttcctttagtgatgaactgtatgggagaattgggaattaattctttgtctctctctctctgtacttcctaattgctctttttaatgacaagtaagtagacaagctggcttaaaactcaacattcaaaaaaactaagatcatggcatctggtcccatcatttcatggcaaatagatgggaaaacagtggtaacagtgacagactttattttcttgggctccaaaatcactgcagatggtgactgtagccatgaaattaaaagacacttgctccttggaagaaaagctatgaccaacctagacagcatattgaaaagcagagacattactttgccaacaaaggtctgtctagtcaaaactatggtttttccaatagtcatgtgtggatgtgatacttggcccataaagaaggctgaataccaaagaattgatggttttgaactgtggtgttagagaagactcttgagtcccttggactgcaaggagatcaaacgagtcaatcctgaaggataccaatcctgaatcttcattggaaggactgatgctgaagctgaagctccaataattggccacataatgtgaaaagttgactcattggaaaagccccctgatgctgggaaagattgaaggcaagaggagaaggggatgacagaggatgagatggttggatggcatcactgactcgatggacatgagtttgtgcagctccaggagatggtgaagaacagggaagcctggtgtgctgcagtccacagggtcacagactcagacataactgagcaactgaacaacagtgcttccactttaa

SEQ ID NO: 53500 - DNA, 1315 bp, Bovine  19866881206304
tgcttcctgaaattcgaaaacacctccagtctaaaaaaatttttcttaaataagataactttataaaagatcagttagaattttgaacaacacacttttttttaactacatgtttttaaatgaatgcttgaaattagttaaggaaacacttaaaatttgttattactaaatactttttatttcatactttatgcttataaaaatgagtagcattctgctcacatttcttcctttttaatttttgtctgtggaagcctacaagttctgctgattgacatattaggattacattaagtacagagcaatgaaaaaatcttcataaattacctgaaaacaaatttgattctttaaaaatcataaagctcttagtttttaaagaaaattaaactacttaaaaacttagtaagctaagttatggttattttgtaaacaatttaaaaattgaatttaaagacaagttgaatttttgttttccgttttctagctggtaatgaacttgtttcaataacagggaaataatccttttcttgtttgcttttttatgacagaatatgaatacactcgtaatacaatcatgtaatattattcaagacttcaatgtgtttgttcttaacattagcacattacttttgtcatacccccaagcaaaattactaaagtctaaattactaaagcaaaattactaaaagtgcagagaactttataaatacaccacagactcaaaataactctttgaaaggaaaaatgctgtctggttatgctggatctgaaataatttatgttctctgttgcagccagccaattatagtattttcccatgagaaacatgggaatttatatttaataaagacactctgctccccaaagcatttaaaacgtaaagctagagtcaatgagaaggacagttggatacatatatttttttcatttttgtgtatttttatgctgtctctctttagggccactgactgattcagtattccttatattctgtgtatttccatgatttgatgttaaatagccccaggagttccttcagcattttatgtgcaaaaataaatctatgacacttacacagttattatgaaagaaacatatgtgtatttgtaaacatctaatatttataaactttttgtagaggatattcctagtcaaaatcatgacactgacaagtgaaaaggatgccatgcctcttttttttttgaacttacaaatcaaataattgaccaatctccaggatcatatctgtatagatatctacacacatacaagtcgagaataagctacccagctcccaactcaaaagcacattaag

SEQ ID NO: 53501 - DNA, 1453 bp, Bovine  19866881248954
tagcttttagagatgctactaaaattcatagaagagataattttatgcttctgatttgcttgaaaatagtatggagaagataggaaggagatggcaaagcagtacaggtaaggttttaaatgataatcgctatacttgcatgacacaatatcatcttattttttaatatgtttgaaacttttcataataaaaagattttataaaataatccaaagttcttttcagctctaaatctctatgatgctatgttcaataaatagtgtatttaattagcaatcacttacatactcctgtgacactcgtcattatcctatttcatatcagcatttcataacagtatgccctgtttctttgactacaggtggcctagctctggtatacttgaatttccttttttatatctagatttatatcaacaaatatccaactgattaatgacagattgaaggagtcagattcaaatatgattcgaagtgagttaaggacacaaactgagatattctaaaaaataacctcagacacttagagatgaatgttgacacacatctcttccaaattactacaagtgttaaaacttctctggaaatacatctagctaataagcatttcatattttgagagagataggttttgttaaatttttgactgcttagagcattttacaaataaattatgaaactcttcagtgtgcggtgtgtggaaaaatccatgagtcctaacaagcttgtttctctggaagatgcagaatttaaatcagtctattgctgatatttatgtacaaactctgctcacaaaatatttagcccgtcagcatctgccactgccacagacagattcagatcagaaggcctggttccttcccatgaattttaatagaatgtcctcgcagctgaggattggccagcgtttccaaatggtgatgaatgggaagacagatgggcccttggagtaacagaaggccgagtcttcaaaggtggcaattgctggcattctctaacatcagtatactcactctcgatctataaccaggcatgcgacatcattttcctcggcgataatgttagctgatctgacatcttcactgcagacaaaaacaggaaaagtcaattttctagtgagaaattagacatctatttttattagcgaatctgcgactgatatgaaacaccatcacttaaaccttccaaagatgatgtgtttctgtaacatcataatttacactccaccccttcccccccaaaaaaggatttgaaatgtgtcctaaaaatatgatgtgcacgaggaatccagaggagaataagataaatgctctgggaacatcaaggagttggtgagcgcaaccatgtatggaatttcattctgtgttctgtgccagtgcaactaaaatagctctcctgtgatcaaacaggaactgctaattaataagcagccaaaattgaaatgaactgatcaa

SEQ ID NO: 53502 - DNA, 987 bp, Bovine  19866881264749
ctattttatgaaggcagtgttttagagtgtttctgcatattatatcctctaacgcttacaaaagttgaagtaaatgatgtccaagaaagctcaggaaatggtagtcatctccagtgatagcctaaactttagctttgtaagttactggttttctgggcccaaggcctcagaccgacaaatgttcttttctgagcacaaggacaggccatagacagaataatactttatcttttgagggcacttagctttgtacatctttggtagagtggtaatccatttggtctcacggtgtgtgaaaggttaaaattgtaatatatcctttgaacactggatggcaatattctgaataggctagtccacgtccctgtgtcggggacagtcttacacagggtttatataacaaagcttctgaaatcctattcagtctctggctttctgagccttgcatgctgtttttgccaatagggaagagaaaaactaatttggctaaagtgccagtcagtccatccaaatgcttgcaaaaggtcaatcatattatcctgaatgatggaaacaatacacatgataaattaactccaggaggccaagagctaagttttctcatagtgaaattaagaagctgaacacattcaaataatttctgcctcagtgccaaatgtgagcttcaataattttgcagcattcacatctgatgagcatattctgaaaggggtatggtttgggtgtgaatatgtttcactgtcccccaaactggggagtctgtggaatcttttatcatatgggtgtctttgggacagcataacaccagattctagagaaggacatggcaacccactctggtatttgtgcctagagaatcccatggacagaggagcctggagggctacaatccatagggtcgcaaactagaaatgtgaggtgggagatatgagaacagtgtcagttggctgaaatttggtattaagataaaaggagaaggattgtgtg

SEQ ID NO: 53503 - DNA, 829 bp, Bovine  19866881668309
tgggctaagggcagatgttgggtaagagcaagaacaggcagagaagacaggaagaagggaggaggggccgggaaaggaagaagtagaaaagaccagtgtggacatcccatgagagctgattaaaaagtctcagctgagccagactttgtcacaattcaagaaaagcatcccaagatttatgggtggaatggtcaactactgagaatggaaagactttccccagtagaagcctatatggtcaagctgatcttcctgcctttatcatgtgaaatgatatatatcccctccccataaagtaaaagttgacttggaaataatgcagccttagagaacccagatatggagcagaatagcagtatcacttagagatgaaatagagaagaggcagaaaaggtcatatctatgtaatatttgattggagaggtttcccactaatcttcctcacccactgactggggacaggagaggaaaatggaagacttactaggaatgggcctggaagaaatagggaaaaaccacataatcaaactccgattgtttcatcactttcccactgtaagccatacttgaatatgaataaacacagcagctaaaaacaacacctacacaacttcgtgactgaacaatgacaaactgagacatgatcattcatgaaccgttgctgtttctggataattcactatgtaaaggcaaaatgctaaggaaacttgaatacatacaggtgggctgggaagcaagaacgagaactaaattcatacttctgtgtctctgatagactccaagtgcctttgtgtgtgattccaacaacgttactatagatgtcacagaa

SEQ ID NO: 53504 - DNA, 700 bp, Bovine  19866881743557
aacagcttacaaatatacaaataaaaaccaacttagagtactacaagtttactttggctatgactggccatgccattatataatctccacatgtggttttattgggtttcctttagagtactttataaagatgcagaaatgagagacctaaccataatataaacccaattctattctgtagctggatgaccttgggaaaatgacttcacttttttgagtactagctttctcacctgtagaaaaaggcacactaaaataatacctacattaggggcttgttttggggagtaagttgatagagagtcctttaccaatttcaacgaaataatcaatgctgcatagatggaaagtactgttactatctgttagaattaaaggggccttaataaccatttaatcctgaactctgtgtatcattggtatctgtatgccaaccatatcaattaaatataatgtcaatcttttctttttgttttaaatcatgaagtaaagatagttaagctttagtgcatatgaagagttaatcctcacaaaaaatgaagtgcttattaagagctcactgctcacctaagtttctaaattctaactttttataaattagatatgtaggtattcttataaaatatagaaaattattcccctatatacatatccttcatattcctaatcattaaatcattcctaatctggcttttctggg

SEQ ID NO: 53505 - DNA, 1608 bp, Bovine  19866880484415
ttttgaagttttcaggatttttttaatgtctcagatataataaaagaaaaattatattttcctctgatctccatacacatgcaaaaaagatgtgggggctggaatttttcataggaaaatagcactgttggatatttctaattttccatgaaatttttccgaaaatgaactatgatctgaagttttcattttatatgaattattctgaaactatcaggaggttgaagagctaattaaaaaggttttctgtagaaaatctctccttggcctaaagctggtagatcagaaaaaagaagtaaagaagagagggtagtctctgtactgatgaatttctaatgaacattgaggggcaacaggtcaagctacaaaagtatgatgtcccataaatacttttttactaagttgaacttgcagtcacatctatcctattgctttcttcaaatgcaaatgtctgtaggttttaagagtggaaaactatcaatttatgattatataataagttgactgattaaaatgatgcatgtcaatacaattattttgccagaaatatgataagtagtagacataatataataataggtgtggaaaaagatgaagggtaaagagaaagagtaaaaaacaatagtattggttagctttagttggtttgattcaaagaattgagtttaggctagttaagagattttcttttcttatgttttgttagcttttttttttttaagttgttttttaaagaaagataaatcaaatcctataaaaattcaagatccatgataaagctaagctcatgtttggatctgaattagaagaaactcttggaacctcagtggcagattttgtggctcttcatgtaaggatttctcccttttcttgattaatttatcacatatccacctgggccagaaagccaggggtataatttgttacaaaaagttgcctgccaatactgtatcagttgatagaaagtaatttataaaataaatcttcaaaggtgccagaggttattccctacgtctgggaatttggaggtagcattagagaaaaactgtatttaaattaagaaggacagtataaggggtgtggtctttctttagaaagatatggaaaggtaacagacaaagagcaattatcaaagattaaagtggtggatttatgatagtgaaaacagactcccatattctgaaacaaaattccaatacaaagatcatggtagtgccacattcacagttgttggttagctctgtgtgtgtatgtgtgtgtatgggcaaaccccactaatttccaacatactcatggtccctgttctcttgtctttcctccaaaggtaaagaattattttgactcattattctgtctgtactttctctcttcacatcatttcgtgaacctatttgcgaaacctattaggattttaccctcaccctttctactttaaagagtttttttttgtttgtttgtttgttttgccaaagttagcaataacctctacttaatcccacaactaaatttcagttggtgttttaactttctagcagcctttaacaaaatttattacttcttcccttcagtaaaagtaattttctttacttaactttaacagtattgcaa

SEQ ID NO: 53506 - DNA, 1875 bp, Bovine  19866880561486
tataatactctttcattgttggtaatattagaaaccaataaaaaaaaaagtggagccatgtgtttgaagctatgtgaaaagttggtaggtcttatacctatcacttgattatctaaacagaagtcagagaaataatttgatggaaacaaaacaaaattaaaatacataacagcatgaattattttctcacaacaattttccattattctgatgaaactaactgtttaaaagattttgtatttctttctgtcattttccaaacatctgttttataactgactacctccagaggttcacagtgacaaagttatacccaagaaataaaatgaatagagattttagtttccaaaccatgtcattgtgtttgtttttcatacatcaaactaatgatatgattgccttttttggaaatatattcagcatctcaatgtgaactaactgaatgtcaatctaagttgtccatatcagtgctctttttaaagaaatatttctagagtactaattataagccaggtcatcagctaggtactgcacatacatttaaccctcacaacagccctttcaggtaagtcagaagcctttctccatttcatgtatgaggcatcagaccatgaaaacattagtaataactgaaaattaggaaagcaagtttgaaagcacagattcatctggcgttagagaataggttcttcacccataatacaacaaaattcagaatatgtaatagaaatagtaaattattccgttgataagaaagcatgaaacggagaagggattgtaaacagctcacttatcaaataatctagacttgaaaatgcataaaaattcaccatggatacattcctgataatcatgtgcattgagacttcaagaagaaaaacaattagatattcataatgataatgaggaaaccctgttagttgcatgaattgaattaaataaatcaaccactggaccattactaaaatttatgtaattatattatttttaagatgtagattaataattcacttttcgatgattataactcgctgatcattattaggctgtatacacaaaagcagtcaggtgaaaatgcaactgaccattttgagtccagccctggcaggggtcttcctgatgaatattcttcaagacaataggagcatgcagcgttcagttcagaagccagggaaagcttcattctgagatcagagaaagatggtgtaaaaagctcccgctggtgcagccaagctgccctctggctccaggtcctagtgccaggtgctgtggctctgttggggccaccgccatcttgaattgccttgtggtgctcaacgcttctgcatacgagctgagcggtttcgcccagagagactctggtctgaagcagtgcgtgtgaggcctctgcacatagcaccttctgagcaagtataactagactaagccacaaaggaaaaaaaaaaaaaaaaaaagtgagactttattttattactcagaatatatttttatttcctgggaattattactagtttttgctagtgacaaatccctcctctttcttttgttctactcctcattcttgaattcttctgtacttcttcctgctgatttggtgcctcatcgtaaccctgggtggaggagcagaagttttccccaactgcatttagacatatttaattgtccccagctctcagctgggctactcatatcccttagcgaccaactttgtctaattgtttggaggcaaaggacacctgacaatttaagatacacagcccaaatattagcaaaaggagaatgatcacagatcaaatttttttccccaaaaatgaaggtatctagatcttgtgcctgccctgatgttgaggctcactgcctcattgtttttgaaaa

SEQ ID NO: 53507 - DNA, 753 bp, Bovine  19866881018535
aactgtaaactaatgtgttctatggaagcattattttcaagtaatgaaagaggtgttttaactatgaagcttggctgtttcaactttttaaaattagaaaatgaaaaaaaaaataaaagaataaactcacagtagtttaattccatgcatgctcttaatagatataaatctactaattatgtgttcgcccttgggagctttgaaaaagcttacagtccttgctcatgccaacagtcatttcattcatctgttaccattttggttgttttcctgtctactgacttttaataattgagattgtatattgcgcccactctttcctctgcaaacactgacccttagcttctgtggcactagccctctggaactgtctgccctcttctcttcacatcactggaaacctaattcactgcttgctaaagtacaaaactcccatttagctcagcagaagtttaaagaaagatgagtggcagattgaacactcaagatcttctactcacttttgaaacgcagccaaaatatgaccactcttgtgaaagggatgtttgccatgttaaaagtgaacacacattcaaagcgaatatcaaatcaacagtatcatataccctattcatatatatcacatccatatcacctattggaaacatatccatcagggttgcatttctctgacaagcaagcattttacatttaagagagtcacaatgttcccatcacgtaaccaaggcagtaatgccacaaaaccattacatt

SEQ ID NO: 53508 - DNA, 687 bp, Bovine  19866881159781
actgaacctgggcctcctgctttgggagtgtagagtcttagccattgggccatgaaggaagtctctattttcatggtagacttttatgttagtttcagagtatcttctaattatcaaatgtatttaaaattatgtatactttaatttcctatccagaatataaataaaccttttcaattaatgaattaatgcacaattattgtaggcagttcagaaagttaaattctattacactccctaagtgttaatcaattagccattttcattagctataagtcagaatactggagtgcccccaaagaatgaattctttttaaaaattaaaatatttttataattcaatttaatgaaatatgtcatatctctggctaattttaccttttccttttcattctcactcaaatcctctacccttgccctttgggcatgcacagaagcccagctctgtacatccacacatgacattcgattacacatattcctaactgctggcatgagctgtatactaaatattgtacctatcaagctttacatgttttcattttaaaattcccatttaaatgcaaattctgccatttaaatagagtcttcgtgtgctttattacactataattactatttcccatcttcctggaaccaactgcaagaaaggccataggtcactttaccagccctctaaaagtgcaa

SEQ ID NO: 53509 - DNA, 1203 bp, Bovine  19866881250664
tattttcatttttcttagcttctgtgtaacatcaaatcttttttagtggctgcagacaggtctgggcttttggtgtgccacatgtatgatgctgatataaatttatggctgaacttgtctagtgtatcactccgtgaatcaatggtctgcaactggcaatcaacctagttcctcctgctttaatctggatgttttgctatgattgaagagcagtggaaaccctggatttttctaatctgctatcagttgttagggtcacaatttctgaagcctgtttcttctggctttatttccttaacttgctagaatgcatcctctagtagtttccttagtaagcacacatgagagataatttttatgaatcatttaatttctttactttgtctttatactagatgagtatagctagatataatttccaggcagaaaatcactttcctagcatgtattctttgtattctgtcttccagtgttggtcttttttccatgagacacatgatcttcagtccttgaaaagttttattaacagctattttagtatatcagtcttttcttttttatgtactgttctgtcttaaaagatagatcattctgacattggaattcttctaataattttctgattattttgttatatatatttttgctgtctttgggagtttactgagtttcaattcttctattgagagttttacttccttttccttttctttttttgacctcactacccagcttgtatgatcttaattcccctaccacagattgaacccagccacagcagtaagagtgctgagtcctaatcactggacttgccagggaattcctgaaaagtttcatttgctttgactattaccttttttttttccctaagaacatcttttcatttctctctttacaaaaacctgcatttgttcttaaattgatgccagactttcctttgtcgtcctgcttttcatttatttgttttctgttttgttttgttttcccgttctttcaaatagcattttgtcctcattttatgtttgtacactttctttattccatattttagaaagtttaatgtttgtatattttcataacttctgatccttatctctttaaattaaaaataggaaagttctaagtgatgacaggtatttggggctgtattttgagctagtcaattgtttgggttcatttcatagaggcgctgtagcaccaaat

SEQ ID NO: 53510 - DNA, 2239 bp, Bovine  19866880424691
atgaggcaaagaaaagcgtggctttgaaacacaaggaaccacacgtgcgttttgcattaggcgctgttgtaatttgctcacagaacgtagtacagaaattatcctaaaagttatagcttgtaaatttgatatgtaaataggcatttaaaattagaaatctccatggccactgaatactaaaagagtaaaaagaaaacggggaatgaaagataaaacacagtttcaaactctctgggatatagctccctcctgcctgatcactgggaggccagttagcacattcagcgtactgggtaaacacaagggtttacggaaaatggacctttttatgaaaaatcatgggtcaaacaactctgtgacatatctgctgttaaaggaaacacatttttttctcctacctgacacgatgatgcatggtgtacttacccacagagacaactgaacacggttcccatcccaaagcttagtgaataccttttttaaactttgaaaaataaatccccaaacatagttcttgtaacatataaaatcctgccaaagatggatgttttcagggacacagtccaaagaaagcttttcatttatttaatggtctctgagctaatggtatcaagaaaatgtgtacttttgttctaaaatacacaaatcactgatgcttatacaatatatagcaaccacttgacttagttactgctgttcagctttaaaagagtagcgttttacctggaactgaaacctgagactgaaattctgcaaaaagtctgggatgacatcaaacttagtattttgccaagctgctgctgctgctgctaagtcacttcattcgtgtccgactctgttcgaccccatagacggtagctcaccaggctcccccgttcctgggattctccaggcaagaacactggagtgggttgccatttccttctccaatgcaggaaagtgaaaagtgaaagtgaagtcgctcagtcgtgtccaactcttagcgaccccatggactgcagcctaccaggctcctctgtccgtgagattttccaggcaagagtactggagtggtgtgccattgccttctccatttgccaagctagtaaaatgatttctcaaaacagcatgctggtatattagcttttagacaaacctaaatgaaatgtcaggaagggactaccatgtttcatcctcttgtccattaataaccatcatggactataataactgacggtcccatgttgtcaatccaacagattattggcaccaacaaatccccttagaaatttgctcataaccacccaaagtccaaatagatgtgacctctcaagttttagattgatgatactaaagaaatgcatttgtaggctgaaaagcttatggtggtaggtggttcagctgctaagtcatgtttgactgttgcaaccccatggactgtggcctgccaggcttcgtctgtccatgggatttcccaggcaagaatactgcagtgggttgccatgccctcctccaggggatcttcccaacccagggatcaaacccagatctcctgcattggcagaaggattcttcaccactaagccaccaggtaagcccttgaaaagcttttaattcaggctaaaatgctccagagtaccaggagaaactctttaaataaatactcagggaaaatctgcatctatgggtgactcagtggtacatacaaaatttatccttgagcaaaccaaacagaaatttgaataatctccctctatttctcctctttacacttttcaaattcaatctcagcattgttcaatctctaccctttttactctttgccctttgtttgaagttttcaactgagttacttgacaatactgttgtagttatggagggaaatgttattattcttcagagatgatgctgaagtgtttagggttaaaatgtcacaaggtctacgacttactttcaaatgaaactttaaaaaacatgaccccctttccccagtagtggtggtagtttagttgctaagtcatgtccaacacttgcaaccccatagactgtagcctgccaggctcctctgtccataggattctccaggcaagaatactggagtgtgttgccatttccttctccaagggatcttcccaactcaggaattgaacctgggtctcctgcattgcaggtagattctttaccaactgagctatgaaagaagtccctttccccagtacatatacacaaagacacaatagcaaatgttaacgatcaggag

SEQ ID NO: 53511 - DNA, 1222 bp, Bovine  19866880436513
ctgctacctcatctaatcctactactccatcacaactgttcatatcaaagccaccaatgatctctttagtgcttcatttttctcagcctctcaacagtatccagtacagtcaaacactcccttcttcctaaaattcactattctttgggccttcatgacagtaccttctcctggattttttccttctcaattgctactgctgtcttctctattcagtgtctgcattggtatcctagggcacagctctgagcctcatcttttctctctgcagtctcatttgatattttatctgcttccagaacttcatggtactaactcgccagcttatatctccagttctgattcctccctttattatcagattcatatgttcagtggtatacctgacatatccacttggatgtttgataaccattgcaaacttaacacatccaaaacagaatttagacttccagttttttcacacattaagatcttgtgtgtgttcagatgtttagacgtgtctgactctttgtgaccccatggactatagccagccagtctcctttgtccatgggattctctcagcaagtattctggagtggggcaacatttcctcctccagggcaacccagggatggaacccccatgtcttacatctcctgcattggcaggtggattctttaccactagcgccacataggaagcccattaagatcttataaattctcaaagaaagattgtcaaacaaggaaacaaaccaccagagtgaaaattagcacaaaaaacagataatattttgattaccccttccccaccaaggactttggatgtttcattatcagattaaaaaaacaaaaagattacctctatatattttaattttttaagtaaagatagaatacaaaagttagcaaacaacaatggactatcaaaattgccagacgcttttgaaaaagaaacaaagagaacttttaggaatgaaaaaaaaaattcactaacaaaaaaataagtggatatgcttatttttgtagtggataaattcatgaactgcaaactagaactcaagtagtttcatttcatacaatagagcacaaatagatgaagagatggaaatataaggaagggaagttaaacagtatggagagaagaatcaaagggactaacaaagccaattcagagtcacaaagagaaagaatatgcaacatggggatgaaacagtagaattcaggctaagaattct

SEQ ID NO: 53512 - DNA, 1164 bp, Bovine  19866880654087
ctgtacatgagacctgggtaatcactgcttcaaagccaagaaaattcaatatctaattctaaccaagcttaaaagtgactgaaagaaaattctgcatgtaatttatactctctgaatttctagaagcagatgttaatgaatttcagggttttaaaggagaaatctagacatgttatttcctttttgacatatgtacttgatccatttaaaaactatggcccaacaattaactgggaagtttgttcaaaaacctggcagagatgactgatgtcacaattccattcaaagggacacactggtatcaacacaggaaaggtgggcacaagaagataataacaaacagacaaggattcttgagcataatttccccaaggaaaccccacccagttccaatcatccccctatccccatgccctgagaacttgcttacatagcttgcagtaaactaattttggatcctctcctgtccgccacgcctgccaagtgttcttgtatcgttttcatgtatgtcggttttacaacaaagtcagaataaaaactctccaagggaaatattaatcacctagaaaattcttaataaatatcatgaacagattttttttttctttgctctcactcatcgggccgagagtgatgtcatgactcttaatggaaggccttaaaaacaatgttgaaaatcgttgcaaatggctttcaggattttcttagaagaagaaaatctttccaggtccaggatcacaaatctttttttagatttgtgatctaaagaatgtgatactgttaagaataccttacacagtgctcaaaactgtacaatgcatttttatattctttagtactgggatcaatttgagtggtagttttcctaattaggaaattggatgcagagaggaaaaagaattcttcttagtaatgctgtagtaggcagtagaccctgtgctggaagtgacttcaagacactatagaattaaaataagttcaaaggccacaaataaaagaacctcccgaaataaaacatacacacacactgaaagatcacaattaacacaaataacctcagccaacaaatgacagaattagaaattggatcagtctgcttctggacagcatcagaaaagactagccttattctatcaagttatttcaatctcctttgaaatacag

SEQ ID NO: 53513 - DNA, 2240 bp, Bovine  19866880670519
ccatgggattctccaggtaagaatactggagcaggtagaatactggagtgggttgccatttccttcttcaggggatcttcctgaaccagggattgaacttgagtctcctgcttggcaggcagattctttactgctaagccaccagggaagccatctcttttctcagaggggtcagcaattcccagttgtctcagccatgccctgtgggcctgtgttcctcatatccgtatcatcagctgtgcactcttggtgccttgtgaacatataaagtgccatagatagacacgaaggctggacagcctctctctccactgatgaatcccatgctcggttttcgggacctctcagctcaccaccaggcacaaaccattgtcagttcatgttgggaccaggtgagcctcctgactgtgccctttgtctggagtagtttatgaacccatccatccaacattccactgctagacagctattccttaaatttctttttatcatgttccatttgggctcactttttggctcacaactattggctactcaatcaagattaaattctttgtctaaactttattctttcatagaaggccccatggaatctgaccctattttgaattacttctccaaacctaccctttgtgctaatcagagatgactcctcaaggccctgttactgcctctttggggacctttgtagcatcagcatcctttcctgaaggatttctctcttctcattccctgagaaagtctgatcaattctgtgagagctggttttaggagatggaaggaaaatgctatcccaccatcccattggaacctcagcagcaaaaacaatggctaacacgtggcctggcatctacaacaaatgcttttgaattgttcacaccttctgacttctatggtttgccttgattattcaactattaatatactgtaagctctttggaggagatggtcttatttgatatttccaagttaaggcccccaagtccattcctctttttctatgaagtactgtccttaagccatcttaaaggcttaaaggacccatttgtcctttaaacacacacacacatctctggaggtgattctgtgtttgcttctaccctaccccagtgtccagcatcttgcactattataaaaatttccttgaaaagagctgagatcccctacatgtagccaggatactatttcttctgctggcgagtaagaacatctggtcaacgtctaccgaaatagcctcaaacaggaggcaaggagcgactgttgaacagaaaaggaaaggtcatctcatctcgccccatgaatatcctacaaatctgaaggattttagtcacctgccacccaaatccccagagttacaaaaggtgtgcttcaaacatcttctcttagaaccctgcatattttttaccctgaatcttggaagtccagatttttaatcttcccaccttcctagttgtagggtaccacttaattcctgggacacaacagctctgcttggcagaaagaatattctcacatagtctagggtattccttgggaggaagaatgacagcgaatgcgacgatgtctcacgtggcacaagactcttatcattacagagcgagacccttgaggatcctctctctcagcagacattttcctggtcttttaggaacttccccgttttccccacccttctcttttagtaagtaataaactaagagtagtagatacgttgtgagaagtcagagggtaagtaactccatctgaacctgtgccattctgcacagcttggcactcgtgcatgcggccgcactctccgagacctgctctattttccctatttctggtcactgatgccacctctgcaaatagcatcatccctatactacttctaggaataataacctgtcattcggttttgcatctggagaaataaaaaaataaacaaaccaagagaacaaaaatggagactcagaaataaagaatcgggaaaaaatgagtagcgatgacatttatttaatactcttccccatacagcagaagacaaaatgatatcattacttcaacaagccggaggcctgtaattgtgacctctgtatccttcctttgatttccttctaaactcaggaatcttttgctggctaaatcccagcctttttttttttttttccccatccccgggccaacttcttggcttgcttgggaacagctgccagttctctgtgctgccaatcagtcaagaaacgtgctcacattgagag

SEQ ID NO: 53514 - DNA, 1710 bp, Bovine  19866880746453
caatagttcctatactaaatctgctcttggggtgctgagggccagcactcactgggacacagcatctccttgccatctcccttcccttctgtgcatttttgtctctgtctgctccatccactcaccccccaaaccctcagctcaccaagcatgaactctcgctgccgagcagagctgctgatgttgaaaaaacccaccttgagagcaataagaaaaaaaaaaaaaattgaggaagaggatgtttctgggggcatagagaggatagagatgagagtctatttttgatcaccatctctttagacttttcatgaaaagttaagttattaaagtcccagggtaccaatctgaatgcttgatcccctgaaccctccgcaaagcacagaagcaaacacacgcagacagggattaatatttaaaagtcagttccaccaaataatgaagacacgaaaagagtcaacactgagaaaggcatctttacctgtgcacttgctcattatccagaaactagaggaaatgttgtcatccccggtagctactcgcgccctgcagagctcacaccttcttcccagagcagtgctgatgagatggatcagaaaatctttgaggggttagagtccactagcatcagatctctgactgctgttgtaaaaacacgggtaattaagtgttacgaaaaagtgggtcatccacgactgaggtacaaccacacctccccacactagactccaaatgactgtgctgtgacagggtgggaggggtctgaacgcagcgaaagcaaaactttcatgtggtgagcagtgttttagttttcactagtttaggttagagaaagttaatctcaatgtcaactgcaaaccaactaaaagtttttgaagtttgacgacaaatgctggctgttcgtgtcacgggaaatttcagagacagtgtcacaaacagtccgagggacagtctcaggtttctgagacatgcctgtcgctgatgagcgaacgccgtgactcagggaagtgaagaggtcaaatcgaaaccgaaggtagggaactgagtgctcagtatccacacaagcatctccttctccaaggaaggatcaaggcactgcagaccacttcccacactggtacccgactcgggcgttccacacaatttaccaaagcatctttcgactgtcgtcagaagaaggcatctttcgactactgtcggaaggaagcagaatatacactgagctcggcacatttgttcatctgtcatgcaagagccatagcacagaaattttaattcaagtcagcacactgtatccctattatatactaggacacaaaggatgtgaaggggaagcagaggaaagaacctagaaaaaactgctattaagaacctaaggcttatacagacgatgatgagacctcattacacacaatgtctaatatggatcatttaaaaattttattttttattttttagctgtgatgcatggcatgtaggatcttaattcctcgaccagggattaaatctgacctcctcccacccctactccaccacattggaaatacagtcttaaaccattggatcggctgccagggaagtccccagataacttttgaaacataaaatctcttccagcagctgtttactatacatttaatattccattgacattaatgtttgtggatgacattcctacagctttcctcaggcgattcctttaacaatcccctt

SEQ ID NO: 53515 - DNA, 1700 bp, Bovine  19866880840252
aaaatttactaatcctcttgcttgcaaaggaacatcagatggaaaattctgaggaggcctggagtgggctgggtggggttggtaggggcattccaacccattgctgtggccagtttagggctgtgagtacagtgagtggtcaagacatgtccacaagagacttggttccgggggtcctgggttggctccacatttcattagctttgtgacttggagcaggttacttggtctcttttagaggcctcagcttcctcactcttagcatggggggagtgatacctatctgtcctgtctctcaggattgacggctcttgagggatacagggcttgaaactgctgccaggcacatagtaggcactatctgtttgcttcagtgaaagaggcatcatggaaagagatcaaagctggtatattattctagaaccgtatgacttgaaggagctagcgttactatgcattaacagtgacagggaggaagtgaaagtgaatggttgcaagatgaagaatcacccaagttagggctgatcgaaagaggttagacaaggctgaaacacaaaatgaactaaaactggtaaaaacagctaaagatagccacagacctttgtaaaacaataggcccagagttagatgatgaacaagatgggatagtatcactcctcaggaaagatgacactgttagcaaagaaacgaaacagaaagtgagcatttctgtgttttctctctgttatcacctagaatgaccctcttcggaatgaaaaaggatagagccagtctcttgcagggaattggagaatcattttaaaatgcatttctgaggccaggtgggctccttggcagggtcttgaaatacagtgtggatgtgatggtagaattgctgggggtagtcttttgattgatggttctttttattaggggttgtatttccaagctcatttgcatgtctggtaattttcgattggacgccagacatagtaaattttaccttggtaggtgctggatattttagtacttctataaataatcctgagctttgttctaggacacagttaagttacatgaaagcagttttctgcatttgggtcttgctttcaagccttattagatgcctcgagtacatgccaactcactttagccatgtccgactctttgcgacgctgtggactgtagacctccaggctcctctgtccataggattctctaggcaagactactagagtgggttgccatgccctcctccaggggatcttcctggtccagggatcgaacctgaatctcttagtctcctgcattgacaggcgggttctttaccattagcaccacttgggaagcccttagattccttaatctaggactaaattttttcccactacagaggcaataccagtctgactacctggattaatttgctagagctgccataaaatatcaccaattgggtgacctaacaacagaaaattattttctcacagttttggagctaccagaagtctgagatccaggtgttggcagccttgtttcctctgaggtttctctccttggcttacacatagttgtcttcttgctgtgtcctcatgtagtcacccctttgtctaatatctgtatcctaatcccttcttaaaaggacatcagtcagggcttccctggtggctcagtggtaaagaatccacctgccaatgcaggagacagggattcgatccctg

SEQ ID NO: 53516 - DNA, 1615 bp, Bovine  19866880976942
atggtgcactaaggaccaaaagtctcgaagctcttgaggagcaactggtgtgtgcttaagacaaaatgtgatgtgacggcttatctcctcatctatctgaggctgctggtgtttgcttgacctgctcaagaaatagagagggggagagagtgagctgtgggctttccatgcactgttagaaaactgccatggaaagggagatggaacacacacaaaataggcaaagaatcaagaatttctggctttccaaagtggcaaatgacctccctctgcttcagcaactactccccctcaagacatggctgtgctttgtttttaatgtaggatacacagaataaccttccaagaaaataagctgccccaaaggaaaaaaacctgaaggatggctcaccttctcagacaagcctgtgtcataaaatcagctgtgactttatactgccaaagcacagccaggtattccatcacaggccacagctgaacactcctggtgagctggattaaggtgctaaaatctggctgcaacaggaaggaagcttcactgtgcttcttctccagaaaaccaagtgaaattcctctggcttttagttctaaatgctgagcattcacaagattcttcaatgcatctggacaaaaagatacacagcagtcagtggccaggctcagactcccaacagccagttatgtgactatgagcttgagttcaacttcacctgagcttgagtttctcatgtgttaaataatgctattaatacctgcacaattccaatgacagaattaaataatgtatgtaaagtttaaccttatgcctgacacttatttagtggtcactacagtattcggggttgggtgggtgggggggaatagaaggagaatatctaagggagaactttttaaaacttacaaagaaaaacttattggctgcagaggacatgcttagaaccactgtcagctagccacacacctgaatcgacatcttccagaacattagctcggaggaccaacccccaggcctggaggagacttttctttaatgtcccttcagatgcaaccacttggagccgactaatgtcttcctgccatccactctccccaagagcaggcatccactctctgatggtaagagctttgttaaagaccttcagttgtgaaaaacactctacgaccagctcgtcctgaaacaataaaacccaggagagcctattacagaggagaaaagtggttttctttagaagcctattcatgtctgaaaaagtttttatgtttcctcgatgcttctacaaacataaagttggtttactcctattgctctaaggatattttatggtaataaacttataagtctgctcaaccttaaaagtctcaagactaagtaaaacaataacacttaacaaatcagtaaatagtgctcattgaacattcaaaaatttgcaggcagggctgagtctagttgaatggcagtgcccacattccaagagagcttcagaagaggtcaaacctttgtgtttactacatggttccagactataccttaaatgggaagggtcgtcccaggaacttctgcaacttctttacacctgcaaatccaccagttgggctctccaagcaattctgaata

SEQ ID NO: 53517 - DNA, 1449 bp, Bovine  19866881016571
tgggttgccattttcttctccaggggatctttccaactcagggatcaagctcatgtctcctgcattgacaggggattctttactactgagcccaccagtgaagcctgttctaatcagcagacttttttcaggcatgcctcaagatatggttgtaaatatcacaggttcatggggtcgcaaaaagtcagacacgactgagcgactgaactgaactgaactgatcacaggttcattagatagaacaagagttatcctcttaaggttgggttattctatcctcacattctgaggaatatgcctaagttctacttaaaaaaaaaaaatcccttgccttgaaatcatctcaattccacaatttatccttgtctggtacatctgaatataacacaatatcacaaagtaggtgcctaataaatatttaagtgaatgaattaatagataaatgtgtttcatttagtctaagtcacattagttaacgtattactcattcatcaaaattaaacactactatgtcatctacatttattatgaggtggtctctcttctctgttttaaaattaactgatatttgggagttatgcttgctgtcagttacagtattaacattttaaatacacggaggattttatgaacattattatgaataatggtcattagttgcttttaatatcctaggcagagtgagagaaagtatacttaagctacagcatgagagatttaagttagataagaaagagtgttctggcatctgacccaattaaacagtggagtagattaatgagagaagttatgaaatcttctttcttgaaaatcttaaaaataagatggaatcccatcaatatacatctgtgtccctatttagagacaaaagaactggttccaatcttttttttgaaagacaggtatatttactaggtgtatatctagaatagtacaattttccagagtataggcatttcacataagatattggtatcaattcataaccaaagatatgaatcatattccaaagaagtgacttccaattctagagtctcatatgttatatggctttgggccatttcacctctaagctaaagattcttttctaattaaataggaatactaaaagaacaagaacatgcaattccactcccttgtctcttctgcaataccgactttgggccacaacgtgtttttgtcaacagcccaactccttactcagagataccagtgcaaactcagtatttcaggtgaatcctgactaagacccattcatggagagttgagaaggataaagagtgaagaagcagaagagcctcatgatataaaaaaggccaatttttaggagaaggacagttaatagtgtccttgaaaacataagaagtggaaataatcttgaagtaatttggaaactaaccatttccttttatttttatggacttttatttggttatggctgggctgggt

SEQ ID NO: 53518 - DNA, 1783 bp, Bovine  19866881092621
caaactgaagtgtgatgccttgttcatcttggaagaacctttcattaatcttcagaagaaagctcaatttggcatgaccggcacctgttgaaagcaatctcaaggattcactgttgatttctgctttcctgacactcaaattctgtcctctgaacaccagcttctccacagtgtggcttgttcttcatgagggcaccctgtgtccctaatgtttgcttctcccagggtgctggggcattcaatgctcttgaatgagttcagtgtcatcagaatgaatgacgttctcatacctcgcagatagtgcacctggggacccccagagtcattcaaacatcagaacactgggtgcccatctccccacccctgtgcccccaactctcacctggagagccccacacagactctggggggaatggcatcttgctgctttgggtcagcaattcctgtgtgagtgtaaacacccactgcagctcctagaacctatggcccagtcggtggtattaatgttttcccatctgggaacttccctttcctgccttcgaacttgtgctcgtgcttaatcactcagtcgtgtccagttctttgcaaccctgtggactgtagcccgccaggctcctctgtccattgaattcttcaggcaggaatactccagtgggttgccatttccctctccaggggatctttctgactcagggatcaaacctggatcttctgcactgcaggtggatttgagctcacgaggcacttactatttccaatttccaacatacctaaggatttaggggtaggtagagtggggctgggtgttagaagggggccaggctgcatgacctcaggattctactctgccagaaatgcctatctgggtttccctaacctcagttctgtcatatccagtggctatttggctgtacttcaggacagagccagaaatacgttctttgtagctgatgctgtattgttatgactcacagcctgacttttcctcatagcagagccatgctgggcgaggaagagcttaaggattaggtcaaacattgagaactgtgctcccagtcagcatcagcagcacaggaaactaccccgagagagcagtcacctcccagtgctctttacacccggctaagtctgtcctgggtctgaggaaaggaatgtgcctggtgttaactttccaacgatccagaactgggtgaccgcacgctgacgttttggtagcatgagaggcaaacaggactaggagggagaccaggacgcaaccagctccccacatcacaactgtggtctggagaggggccgagttctcccacagcagccaagagaacagccacagaaaacggctccagccgccgacctggaggcctcgtcccgggggatcctctgatctcattacagcagtcgacactagtcctcacaaaacaaacagaggaaatttatgcctgccttcgcctggggagagctccgcattcctcacttaacgagagttccagcttcagagaccacagccacgggctggggaggatgtctgctttgctccaaagaaagaactgaggtcctgcctcttcccctcattctggggctggacaggaaggaggtgagcctggagagagcccctgaactgatgaagttccctttcttcttctgtcaaccccaccctgccaggcacagtcagtggagccactggctcttgaacggccctgggaaagcgcagccttgaagggttccacctgctaaggccagaagcccaagagagaggctgtactcgggaacaaaactcgacatcgtt

SEQ ID NO: 53519 - DNA, 1609 bp, Bovine  19866881206414
cgaacagtgggtgatcttgcttgctatgggaagagtgatactcaggcatgacagaatgaattaagggtggggtttaaatattaactcttaatgtcctaaatcttgtggctctaaattagattcagtgctgttataactgggagagtgtgagcatttatatgtatgtgtgtctgtcaccaaaaccatgtttgatcagttgaattgacctttttatttttctcatgaaacacatcaactgtattatgaaacaagccacccaaatgaaaaaaaaaaaaaacatttcacgtatcttgacaggtatttcatgaggacctctgaaggctgatatttcccttctgctgccagagctgaaatgagaaaaaaagcactttatttttgataagtgggacgttgtgttttttctgaacctttttgcctccaagatgtcttatgagagttatctcagtttgggttaaacttcccaataaatgatggagagtctgaaggggaggctcttggagccagtgatatagcaagtggtttgtaaaccaaagactaaaggaagaggaaattccctggtggtccagtggttaagattctgtgcttccattgcaaggggcatgggttcaatccgtgttcagggaactaagatcccccatgccatgtggccaaaaaaaaaagactaaaggaagaaatatgttaacatataggggccaaggaactttattgagtacctatagtgtgcccagtgaatatgaaaataatttgagcaatgtaaagattttagtatcagaggaacaatagaagaagttcagtggacatacagggctggctttcttttaatgggacactgtgttttgtattaggatgtgaagattatatatagaagtatttgaatagaagaaagaaaaggggaaaagagaaaaagaaaaaacttagttcaagtctctctaaagagttaataacaagatggaaaaattccagccactatgatagaattaaatcagcctgttttaataccaaagtgtgcttagtcatgtctgactttttgcaaccccatgaactgatgccctccagactcctctgttcatgggattttccaggcaagaatactggagtgagttgtcatttccttctccagaggatcttcccaaccagggatcgaacctgcatctcttgcatctcctgcattggcaggtagattctttaccacagtgctacctgcgaagcacaataccatgaaatgtattgttcattttcattcctgtattctattagcaacatttctgcctctccaaatccttttgaaaacagagaagtctgcatctgaagctttgcctggtctagggtctgcctcacccagaaaacatcttcaggaaacctaaaatcaatgggattttttttttcagtggataacacaagccagttttgagtgtgatttaaaactcactatataaattcctcctggcttgcttcagctataagtgtcctctattttttattgccaactctttctgtaaaacatacatccactccactttccacacttcagatttcaagtggaagagagctatttgaaggcctactctcaaaactgactcattggaccttgtagacgctttaaaagcta

SEQ ID NO: 53520 - DNA, 839 bp, Bovine  19866881217429
tactaggcttacaaagcagagggcagtcaagatgaaaactaactcaatacaaaatgacctttaggaactggatcccgtgtatgctgcactgaaatctgcttggtcaattcggagaggaaactcagaataaatatttaccatgtttatttatttctcctactgagaactatctaagacaagaggatgtttagtgatggaagagatttcaagatttctgctttgcgctgtgtcctgcccatgcggcatgaggatagatacaggtcccagcttcataatgaaaccagacacagttcacttcctttttttttgaaaccaccccctcacctgggggatgttttgagatgacacagagttagtcatgtgtcactaacctgagataatgaagggaatgattggtgctcattaccattgacggggtgagtgtgtgtgtgtgtgtgcgtgtgtgcgcgtgtgtgctcagtcatgtctgactctttgcgacctcatggatggtagcccacaaggctcctctgtccctggaaatttccaggcaagaatactagaatgagttaccattcccttccccaaccattgacaataataatatttaaaatatccttctgggaagatggacagcatttgcctgggatagaatatagccctgactaagctgacctgcttcagctgctgatccctacaataccaaaaggagacatttcaactccagagctgctttctcttataactggcctaagaaggaaaggtcaagaagtggactcaggcttacaccttcatggcttatttactgaccatgaactaccaagaaatcaccaacactctttgtccaattccccttgctg

SEQ ID NO: 53521 - DNA, 1485 bp, Bovine  19866881249846
ttctaactgttgcttcctgacctgcatacaggtttctcaggaggcaggtcaggtggtctggtattcccatctctttcagaattttccacagtttcttgtgatccacacagtcaaaggctttggcatagtcaataaagcagaaataggtgtttttctggaactctcttgctttttctataacctgggcgcatttataaaggtgagcaagtgtgagagtatgaattagaaaccagttttaaggaaattaacatgagttctaaagaactctaagttagtctcatgttgttgtttagtcactaaatagtgtccaactcttttgtgaacccatagactgtagcccgtcaggctgctctgtccatgggattcccagacaagaatactggactgggttgccatttccttctccaggggatcttctccactcagggatcaaattcatgtctcctgcattagcagggggtttctttaccactgagccaccagggaagcccaagttagttacacactggatatttaagaggttttctgaatctgaggctgttcctttatttagaaagtggtagtctactgaagtgttagcaagaaaaagttctacagttgctttaatgatgagatgaaactgatttccagccactatcttaatttgttcatttgcaaaagacttgttctttcaagaactaaaacattcatcctgggatgctgcatttactcttagtttagcaaatccacacaatacagttcaaatactctatgaggcaatgtgacagaatgaaaatgtgcctgggttttggaatcaataaaacccaaattcaaagaccggatctgctatgtctagacaggtggtactgatttaacagttaaattattaatcaaatatctacaaaggataaacgtcatcctagattctaatccaaaatctgaattcatgacatctaagtgaatgaggacttagttcattctttcttctggtttctctttctactggactttgtgatattggtggcttttgaactgggcattaaagagttgccctcagtgtacaaaactggatatattgggtagaggaagcttaaaggcagagacaatattgtgctgacgtacagacatacagatcagcaaatgatacatcagttcatgctgaaaatgactcaaatatttgtgttaatttattttgccatattataaactataaccactgaaagttaaaaggctattgttcaaatgactatctttctaaagtatcactgtcaggttttttgaccaaaaggaaatctatagtaccactgctggattttaaatcattagagaacatcagtgtttttaagtaacaaaacaataaaacaacaagagaaagttttcttgacatgggatttcatgatgaaaatcttaaatattatgggtcaatattcatgtgttttcacactacctaccaagttttcaaactgtacctacttatccttttcaaattactatttctatcttttt

SEQ ID NO: 53522 - DNA, 728 bp, Bovine  19866881467989
ggtgtagatgtctgctcggtagtggcctcctgacactcttgttagcctgaataaacagtgttcccctgcctgaacctccatagtgctgccacgttgataaaatctgacattctgcttaatcactttttaatgatactcttccttttcttcttggtatgtgagaaaccagccttttaatttttttaacgtgtgggaaagaattaactttcagttcctaattcagtaaaatgggctggtattacacatataattctagtggggacgggggcgaaattatctaatttctgcttaccactgtctcttcttaaatttaaaaaaaaagaaaaacagttataaacttcctgaaatcatgtaaaggagaaaatctgagataaatacctgggagacgttgcaagaaaagtgcctgaattccgatagtctgtcccctgtatgattgtgttcaatgaaaatgccaatgtcaataagcacaagttttgcaaattatcagtttgttgaaaaaggctgtgggctcttattcttctgaggtgggatctctttcagtttaggctctgtagggaaagaagaaagaaagaaaaatacacacttgggattgaatccttgaggacagagaaagaaacagagtcctttccttgacttggttatttgtagctggtgtgtcatcttggtgagactgatgtcatgcgaattgaatgcagaagcaaactcgtggcggggcggggggcgaggtg

SEQ ID NO: 53523 - DNA, 885 bp, Bovine  19866881678662
tattgtgcaatagaaaattcggtaaattttgcctctagatttcctccagatctctcaggtgaccacacccaagcctcagcatggccgtgttttcagtaagagacttgagttattactttagaaagtgaccttagtttcttccctctggaggtttttgctggcagagtttgtcatctttttttttttttttttttttggacatcatgcttactatagggaaagaccatgtatgtgcaacagactgaaaagtggcgtaattgtatctacctgttacttgatttcacacttgattggctccctaaagtcaacatggccttcatggttaagagttttcagcctgggtatcgtcagacctgcgttcagatcccagctctgccacagaggagcctggagaccttgggcaatctccctgacctcttctaaacctatcatttctaaaatactgatgaaaacaactaactccctggccgcctcggaggattatgttagatcgtgcccataaacacttaatgctcagcatctgctgagcactcagtcaatgttagcccttgtgatggatgtgaggttaggggaatggcagtgttctcaaaagcgacgtctctatttcaattcaataagtgcctggaatttcacatttgtgtctctttcatgatagccttgaaaagaactgacttatttgcaccaaatttggtatattgtgttttaaatttctagtaagaatatcagctccacagactgacaatcatctgtcttcttgtgggctattgcactaaaaaaataaataaaataaaaagctactgtttgtagacagcgagatacatcctgagagtgacttcaaatgttacagtaaccatgctcatactggggtggagtggggtgggggtg

SEQ ID NO: 53524 - DNA, 877 bp, Bovine  19866881684154
ataggcccaataatattatttgtcttcaagttgctatgaacagtcattcctaagatttattgtctaggccaagtccacaattcaaagtccagagcaagccaaatgttcagagctaggctttggaaactgatttaatttattttctaatgctgaaaacatactcagagggcctccttctgcattatgttttcattgttaggaccacgagtccttattataggtatttaacatgaaactttcgtgatgataatcacttcagagttgtttgaggtggattggtagtatgaagcaatcataaaaattttcagcaggaacagaaaacaatataaaatgttatcacctgtattctttgacatagtttcttaggataggtttttacaaattatctgtgtctcttttagtcatgagtgagcacacagtatggcacatggttttataccatgtatatttatgtatttttgatagatataaataaattagtgcccaggtaccaaacaatgaatagcctcaaaatttgaatttcaaggaacagtggcagaaaatatcatcacttgaaactgaaactttcagacatcaacagaaaaatgactgagattagctatgtgtgaaattcccagaaggtaatccacactcagatcaacccatggtttgtctacccactttttgatatcctttcaataaaaataaatgtagatacttagacaagtgaacaaacagcactacatggggtgaataacctgacaccaaatgtttcttgagatgataagagtatgaaggtatcacctgggagatattctcaccaaacgtgtaatcaagcctctagacttcattccactttaaaggaaatacaggggggttgagaaaggaagttaaataa

SEQ ID NO: 53525 - DNA, 1948 bp, Bovine  19866881720789
caaaggcacaagctgggatgtctgggcatcctctgtggcgctaccttccaatttttcctggctttggggtgctcaggcagtttggctccaaggaatgcgcttcagattgaggattcttcatattatcaaaggaagtgttagcagtctttttaatgtcatgctttattgtgttactattggaattcttttgctcttgatgtttttcctcagattttttacaacctactgaatacttagaagaaccataatcttctgatttgggggatttctctttcaacatttctttgcccaagttgtttatattccccttctgacagtgtgaagatcgtgctttctctttacttttcttttcaagctttccttcgtcactatcactgccaacattcatggagtcacaaaactttacaaagattttcttaagttttgtaaacaaataatcgagctgttcatctacaaatttccacaatttttttttcatatctggcagctgctgttcaaataaacgatccacgatgccattctttttaacttgcttgagtttggattctataacatcacagagattcttctgtaaagtagtcactgacttagatattttggacaagtccaggtatttaattagtgatgtaaaactcaaaattgctgactcaataattctatgaaattgtattaatgaaaattttaccttgaatttcatataatttttccttacatgttttcttatcattcgtaacatgtgcataatctctcggacagaagagggtgtgacaatgattggaactattttttccaggctggaagtgctcattgacctctctttcttctctgtttttgaagatctgctagattcacttcgtcttctgttccatctgcttttggtctgatgcattttcatagaggatatcttcctattgtctttatccaaacgcacagagcttttcctactttctgggctagtttttgtgttctgcacttctgtagaagctcttggtttggcacttttgtcaaaacttctttgtggttcaggtttttcattgtcacttataatttctccttcttctaattcatctaaagatgaattcttatgggagtctgcttctgcaaatttgtcagatttgcatattggcttttgattttccttgttgagatcagactgactcatggaggtagaatgagctgaatttggtagaaacacatctgtgaaagagaaaagcatagtattgccacatgaccaatcagtgtttgtcatttaacatttccacgttaaatataacaaaaaattaaatgctgaggcaatttgttattttaatagcttttttaaaaaaaaagcagaatgttaatgtctaacacttatcatatgattcatctttactggtctgagaaggtgcctgataatgatagtgcagtttgatcatttgggtaaccagcaaaaccaactgttcatttcttgatgttagcagcatcacctactctatgccatttgatgatggtttttaaataagaagtatctgaaaacaggcaaagaatatttgaaacaatctgtcccaccattctcttttttgtataaataagcattacctaaatccagactaaaggctcaatgtacattactagttaacaatagaggtctaaacactagttatattatcaaataaaaagcattaattcatcttgctggtgtatttttacattctcacataaagataaattatagaagataatataaagtattacctttatgatgattattatataatggaacttgagatgcactttccagtctaagaacttttgctacaggtctcactggactattcagaggactgatggcttctggaatagggtctcagttgatttaaagtcaatgctcagaactgagttctcatcatcatgatatactggagtttgtttcaccaacttccactgtgtcatccattaactcagtctg

SEQ ID NO: 53526 - DNA, 1635 bp, Bovine  19866880438779
taaagtaactattgatatatatgttcctattgccttttcttaattggggttgatttttgtagatcttttttcttctctacatcctgtcatccctcagggcttcacacatctaaggacacatttgcttgtcataaagaagaaatgaaatttacatgttttaaatcattattttataaactgacatgccttgtatgaatgatcacactacatccgaagaatggcagtggaaacagagcagatgttacttctctcatcaaaaaaaacagttgtaagttttctttcggaatttttttttaaccccagatttaagtcatgttcaacatcttcacctctaaatagcattttcttattcattcccaaattttgagtggttttattgtttatatgtcttctgccagagatggattctttaactattaattcatataatatgcatttttatgaacaaatgctttggccattgtatatagtgcatctaaatggcatagtgtaatttaatgccagtatcttgaattagtctattggaggacaaagtttcttaagttaggcatgtgacatggaccataacagagctggaagtcttgctcctatttaaacctcctcatgtgcttactattagctttccctaaccatgtgcccatctgatgaacaagttcctaaaaaaaaaagtgaaaaattccaacacaatttgtgttatgaaaacaccaacattaaaagaccacagaatagggaattccctggaagtccagtggttaagactccatctccatgcttccactgtggagggtggaaggttggatccttggttgaggaactaagatcccacatgaccctcattgtggccaaataaatagataaaatgttaacctcttgaaaaagaaaaaaaaaaaaaaggccacaggataaaaatgtgctcagagtctttaagctctgagtattgagaaatggagatttttactataggagtctttgtacacagttatagtctttaaccacaaactatccttgatatagctggataaataaatgttatcaaattctctaagtgttaattactccccaacactttatttttacttcattcttgacatgaaaattctagaaacaaagatccttaatttcgttttgtttttcctatccttttgaactcattgttctcaaacatatttagtgtaatttaaaactcaatgtttctcaatgaaactcaaatgaaaataaaattacgcccacatcccaattaattctaaaggaaccatttaattagagttgattgctaaattgggaactaggtcttatttgtaacacatcacagtgcaatatttgtcttttaaagtattatttatgtatttaaagtcaacttaaatcatatgatgaatgcttatacttactttggatgtctgagccttaaaatcgtaaacagcttttgcaggcagtttctgaaaaggaaagaaatggttgatgctaacttaaaattttggatttcctattaaaaaatcagtttcatatgaattaaagagaaatgaaacttgaaggatttattaaacacatacaatgtaaatgatatatgcaatttataagcaaatcaattggttctttttagatagttaaactataacagatgacctattcaccata

SEQ ID NO: 53527 - DNA, 1912 bp, Bovine  19866880450418
taagatagatacttgcatctttactttataatgcaattaactgtgtatattttgttttaaggcaaacgaaaacaatgcaacagttcataagtcattggccaccaatacaacactttctgtttagaaaatttttatcctttggtttcttgggataaatattcactttctaataagatagttgaacacaaaggaagcaaatagatgatggcctattaagccttaaaccttaagatgtcatcttcagattcaataggtcattaaatacagagagaaagagagaagagaacggtcacgatgtagttctgccatcatcatattttttttcattactacatccttaaattgttccataacatgctccagtttttataaatggttgctcccgtcttcatcttctataggctctatcatagtaattataaactggtggcaaaaagaacagcaagtattaaatctttgagatgaaaaatccctgtaactttgaattacctatgctgcagcataaattatatcagcagtgtaacaattaaacctttatatttataatacttctgaaatcttagatacttttcctctaaaagtgctctgttttgtgtcttacatcacatctttgtaattccctatgagttttaggcctgtgttttccattgtggtatctctccacgtttgaaggggaatatagttgccaccaggaaaaatgcttttgattacgtggatactcactctggccctgtcctttccaacagaccatgagtcccctaggagttactcggccacactgactgatcttggaagaaccacacccagggaaagaagaggaactccagaaaaagaggtagtctgcttagtggcatctgagtctttttcaacaatatacttgagaaagcatttgccagccagagttatgtctaaaaccagtaaagagccctgattaaaaacattaaagtgttgatggagaaactagaaattagttttccctggagcccaagcaaaggatttgaagccacggcattctaacctgagcagcacgtctcccccagttgtagtccatttttgagagtgactttctgagtcttgacctgacctatagattaatagctttgtctgaaacagtcttgagctgggccaccccttggaggaagaaagctttccctatcgagatttctggcccagcgatgaaggggacggtcctatcagctgtgctgcaaatcaatacaaattccatggaaataatttttgctgccctgcttttgttggggaggatccctgaaaaaaaaccctgctgttcctgggaacccccagcctgctggctcttgtccgtggtcctgagccaggctgacggtctggcttgtactatcttggagccatgaaggtttgatagaaacagaaggctggtcctggagtgtcagccactccagaaagttctctaccagtgtctaacacaatccagtgcctatggatccaggatccaaagtcaggaatgatccaggatgcccaaagtccaccagagtctcagggaaagagtggtgagaggatgattggcatcagagaggaagagctacaggtgccccaggcagatctgtgggccccagagcgtgagtgtgggctcgtgtcgaatctggtcaggactcaaagataagcggctggtttactgggtgctgaagagttcctggactccccaggcaatacaaaatgaccaagcccatgcttttggccactaactagcctctccatgataactaggctatatttctttgctacgatgttaacaagtgtttggtaaaaggagtaatgacttcctttgtgactttttccagtcctttaattatggttcagaagctgtgtcaatacttaggacacagaacaattgaccttccatgggttatcccaggaaaagccaaaattatacgta

SEQ ID NO: 53528 - DNA, 1073 bp, Bovine  19866880468280
tagaaattctagctctgagatgagatgaacataattttgaaaactgaaaagtaagaccagtgtccttttttcccagatgacttgaaaaatttaagtacaagtcttcacacatagaaaagatatcttttcatatttaaaagaaaaataactagctgtctcttaattactctttttctaaagctaaactttctgatctcatttccagatacaaaacgtacttagtataaataaaactgttggattataaacatgaaaatacttcggtttttattttctatattagccacatgcataatgagggaagtactgtgcttgaacgtaaggctctgtgaatcttctttgcttttagggttactgaacatttaacacacttgcattgtgaagattttagcacttctaaatgtgtgataattctttttactatgcaacttttttcaattaattcttttcatcagtgtgaaatagtctgcatttactataaacctctctgcattatataccctgcacacataaatgctccaactcaagatcctgaacaaaacaacacagaagatttgggagtgggaaggcagatgtgtgggaccgctgggctctcggcaaaagatctgaaataagtacccttcagcgagacgtaattgtggaggcagaataacacagagacacaatcacctgggtgacgaagccatgaaaactaaagcagtgagggtgagactttaggcatgaattattcatgatgagtaatgtctttataacttaaaattaaacacccagtctacctactgtctccttagaaacggccaaaatggaaaagcattctgtttcttgaaattacttttatatttaaaaaacaaaaaaaaggagggtataagcaatctgtgcatgtctttgcacttgaaacaagtttatctttgtgatcatagttcataatactttcctgcatatttgaaagtttctaatcaatcttaaaggttctcatcataagaaaaaacaggtaactatatggggtaactgttaacttcttgtggtggtcattttaaatatatacaaatattatgtgtacatccaaaactaac

SEQ ID NO: 53529 - DNA, 1900 bp, Bovine  19866880515742
tacctgctgtccatttgctgtcccatccctcttatttagcaaacctgctcccctatcctctctctcgtgtgtctaagacagtctcaaatcttatgtaaactctatcaaaatatcaagacatagccaatctctgcaatcatgccctatggcaccacctgcccccccccccttttttccctggtttagagaggcaattggaatggattcagggttgatgaaaagaagaagatactagactagctgagccctataataaaaagcctggccaaaatgatacagatgactggctgagatcatcttgcataaggctggccctcagcaaaattgtttaggaggcataaacattttggttctttctgtttcttcatgagatatccattctcacttttgcccaagtttctaggttcctttcactgcccttttcctgtggcagcagagagctatcaatatccaaatcttcaaccacacctgccctccagatctttccattccttttagaactagttcagtatactgggtgtattggttttgtgtcttaactacaatactcagggcccaggttgctggtcaaataaatccaggacacgaatttattataagtgaacaaattaacttatactataaaatagttaatcaaatcatctaattaaggtgataatgactactagctaaatgtgtttgcagtttagcattgtgcaggtgatgaaatgcaccaggtgtgagtctgtgggctcagctcccaggtgcagtgctaaccagccacgggaagctgggcaaggttgcttaacaagtgttcagtctctctacctgtaaaatgggaattccatacatttacttcatacaattgttgggatcattatatggtaataaggcatgaattacaaggcctgacatcttaagtaagtgctcagtaaggagctacaactattgctactgcttttgtcattgctgtttttaaacttggagtcttcaaggcattaacccaaagacatgactaaagggacatttcattcacaatgacagggactgtgaataagctattgaggggggcaaattcattctgcgtgtctccgttttaaccacactggagatggtctacttcttacaaatgtgggtctactctgcatattggttaaacagactccaggttccttgaggtaaagactatgtcttgctcattgccatgtcccctgcacctaatccaatgtctggcacataggtggtgcttcataaattttgttgcatgagtaaatactagaaatatcctgatggacagcttccaaaatcaatcctgtttcctgacaccaaagctgcaaaagcattccgggacagtaacaacccccatcatcctaagggtctcagacattgttagaatgatcattaatgttttggtaattacatttaaatctgaggctcatattgcatgatgattttgatcttttccattttatgcaatggtgaattcatggtctcatcctaaaaatttcaaagaccatgatattagttctcatcctaaaaatttcaaagatcatgatattatatcatataacttagtgaatgagttatatgtttgcagtggaacctgcaattcagtggtgttcatttttttttttttttctttcagtttttctggtaaagtcctgttactctaaaagatacaagttaatttgaagaaaagctaagaaggtttagaaaaatatcctgtatgaattatgtgattataaggttctggaacatgtttctcaagaatataagcataaatacagggtttgaaaactaaatcaaggacactcatcttgggtgtggtgcgcaacggtttctaatcaaatttcagggctgaccttatatataatgatgtggcttcctgggtactcttaaagacactaacaaagaaaactct

SEQ ID NO: 53530 - DNA, 1467 bp, Bovine  19866880557374
catgtttagatatgcataaacaaacggcatatactagacattcaatgcaagcttcccttctataaaacagaaaataaaatataagcaactcagaagttccttataaggaaccagcatttttatgtacagccaggctcctctgtagacgtttcaaagtttacaaaaaaggtacaggtctgaagactcattcacatttcttatttgtcagccccgcacagcacatcccccaagtatagctgtgtttataaatgtggagtcaggccatctcggagccacagcaggccaagaatctccaaggctgttttcccttctcatccgcatagaaagcaatgattatctgacttacattacttcacatgggctttccgctcagggtgcacaccaaaggcagtgctgtgtcagtgtaccattttatagtctcacggtctcagttagacagtttagactgtaggctcattttagacatattctaggtatgctgctgctgctgctgctgctaagtcgcttcagtcgtgtccgactctgtgcgaccccatagacggcagcccaccaggctcccccacccctgggattctccaggcaagaacactggagtgggttgccattgccttctccaaggtgttgtgctaggtccctttatacacattgtctctctcgatttccatagaccaaggacacagaattttgtaaagtcacctagaaactctagaaagccaagagttaaacaaacgcacctttgagctatttgcaggaaggggagcagctccccagactgccctctctcatgtgacctgggacgtctgtgccagccttttactgccatccttaacgacaacaacaaaacccgctggggtccagctcccacgagactgtgtaattaaggccaactagttaagtgaaatacaagattcttttcttctacctcaaatataacaccagtagagccttttcaaagctggaaaggggcaaaaacagaacagaacaatgaacactggtgggtagaaaatacgtgtctttcccctttttggaaatctctgcctgataaatcaatgtagaattctgatgttttgtaaactagaggaatataaattttcaggtttattcagccaagttagagaaaacaaccaaagagtgatttactaatagctactgtcaatgcaaaaccattttgaagaacacataagacagtaaacttttcaaattcaagtagacttctgtttacttaatctcaccatttgctgtaacaacctacattaggacatatataaaaggaactttaaatgcttagaggacttctttgagaaagagatggagaggttaagtgttcccatttaccaggttcatattcctctttgtcaaccaacttgggcatttcctggttctcagtgctcaccatataaagctagcagatggcacacgaagatcctgcctgatatgtgccctctagcaagtgaaggggaaaaaaaa

SEQ ID NO: 53531 - DNA, 2012 bp, Bovine  19866880699215
aactctggacacatgtctacgtgcagatgttataaatgtgcaataaaagcatttgttctacgttgcaaaaatgttgtgttcaagaagtgattttgctattgatttggtgaattgacttaaaacaagtccatttaaccttctcagatctgtttgcttcctctgtaaaataagtgggcatgatttctaaaggcctaaacaactctaaaataaatacatgaatttattttacactcaaattacatattacttgtgtggctatgacagtaagtcaagccccagttataatctaaagaagctctagaatccttcatgattactaaggatcattgccaaaaatctgtttgtcatccaagatgtgatgtgtgggcttccctggtggctcagcagtaagagaacccacctgccaatgcaggagatgcaggttctatccctaggttggaaagatcccctggagaaggaaatggcaacttgctccagtattcttgcctgggaaatcccatggacaaaggatcctggtaggctacagtccatggagttgcacacaatgactccatggtattttgaaatgtgtggtcagagtataatgaacaaatatatgcagaacataatttataaaattgtttaccatttactacagttttaaaaaatgtatcctcatcatatcatctaacagtatggaaaattagatgtttataatccttatctaaggagaagacaactgagtatggaggagacaggaaaggcaagagtttctcggcctgtaaagtgacctagaattatttcacttaaactttatacattcttgaatatttcctcatataaaatgatgcagaaacaagttaaaacaatttcatgaattatggtgcttaaaataaaggataaaaaatttatcattactatttcactgaaaaagaaactactggcataaaatattttggttgcataatgtaaggagatttaaaaaattttttcatttggagaataactgctctacaatgttatgttggtttctgctgtacaacaatgtgaatcagctccaagtacacacatatgtcctcccttttgagcctccctccccacctcaccgcctgtaaagagattcttacctagtgggtctttccaggcttctgtctatagaggattgatacaatgaggcctgttaagacagaagggtagttaacatgaaaatttttaccttggcaaaattttgtgtatccctggacattaagttaggtattctaaaaagaatattgtcaaaattgacattaaaaataccaattatgggcattaaattgttttcccaaaaagaagtcatgaagcctaatttctactttcctcttatctactttttcatctgatatacaatttgaggggagttggttccaggagctccccaaggataccaaaaatctgaagatctcaagtaccttatgttcaatggtgtactatttgcatataacttacccacatattttgtatactttaaatcatctctagattacttataatacctaatgcaatgtaaatgctatagaaatagctgctagcatggcaaattcaagtttcgctttttggatatttctggatttttttttttttttttttgtggggaaaatatatttgtccctaagttggttgaatccatgaatgtggaacctacagatatggagggccaactgtacttttctctgtgtaactaaaaatattcataaatcaaacattgcctagggtgagaaaaagaaaaattaccccttcatgtagaaacagactataaatagaaatttctcacataaagaaatggtttgatgtttaaagaagtatttgtagccatcattcaatccttataaagcataaatctttatacgtttttgtcatattgccaggtgtaatttttatgtagacataaaatttaagcaggacttctttcgtctgtcaacataaacatgactttttaaataaaaaaaccacagaattggtttaaattaactacctggccctgaatcaggtacaga

SEQ ID NO: 53532 - DNA, 883 bp, Bovine  19866880737195
cttgtacagctcctgatatttagcccgaggcacccctggggagacaatttggagctcccccagaggaaaagtctctgtgcaaagctttgcatctcacaatgacctcatcaggaaggacacaggagaggtaggtagcagtgactcagggcagccttacagggtcctttgcagaaaacgaggaagatgcaaaaattgtctaaggaagaagatgacctgtcttagttttgaaactatgcagcctttcaaatgcaccaaggaagaaagccgctgacctttctgagcgatagctccacattggtgtcagcactgaaattatatttggcgacagcttctccgatttcaccaggctgggctgggggaggtggtcttgcaggctgtgctttttcaggaggtgtgagtttctacaaaggagaacagttctctttattctttgttttctttttaaaattttattggtgtatagttgctttacaatgttgtgttactttctgccgtacagcaaaaggaatcagctatatgtttacatatatcccctctcttttggacttcctgaccaatcagggcaccaaagagctcaaagtagagttcctgtgctgtacagtaagctctcactagttacctattttatacatcgtatcaatagtgtatgtgcgtcaatcccagtttcccaattcctcccacgcctctccccacccctctgttggtgggagtgtaaattgatacagccactatggaaaacagtatggaggttccttcaaaaatgaaaactagaactaacatatgacccagcaatcccactcctggagatatacccagagaaaaccatacttcaaaaggatacgtgcacccgagtgttcatagcaatactattcacaatagccag

SEQ ID NO: 53533 - DNA, 1534 bp, Bovine  19866880775444
gtgtttgtccgatcgcaaacttttcctgtcacttaaatatgacaaccattggtgccaacatagatttttttaggtctttataattagccacattcaacattcccagaatctcatgagtctaaagccctagcaatgactctacagacttaccttctggcttccctttctaatacagatgcttggaataatcactttttaactcttctctcagatcgtgggatccatataataaatgcaaattcaagaagagaagaacctcacccaccctcactctctcgttcattttgagcagattccaattgccccagatctttttctaatctaatgcccgtcttttcctctctgcactctcgtctttggcccagcaggcaggtttgcattccaaaccaggagccctccgcaacctcccagccaggtatgcggacccgtgtatgcagatggcgctgcggtccctccccgccccccagtttcacctgcagaggtgctgcggctctcatcctggcgcccggtcttcttccccgcaggctagcacaaacctcctctccaagtggactggctcagcaagcagctgcctgcccgagctcggcctctgccgctgctgaactttgccagaaggggctgccctgacgcactgagcaatgatctggcagagtttacagactggaggaaaaaaaaaaaaacccaacccaaacacttccactgatcgccccgggagagctctcggcaggcacagccgacgagggacactcaaatgtgatgtgtattttcctcggacagcttttcctttctctgacatgaactcccttccctccaatcatcaggcttctcaactcccaatccagggctcccaatctcctggcagtaaggcacatccatctccagacacaaatcactggcttatttgctgtgcacgtgggaattcagtgtagccaaagaattcacatttaattctcccttctctcttctctctctgttgccttaacactccttggtaaaaggtgaaggcaaacaaagcttacttctatcatctcacagaatcacaattttcgtgctttttaaattgaaatagagaaacagattgggccattatcttcaatggacagttccttttctctgctgcacacagcataatattcacgagaactcagatggcacagagggcaatcctcattatataagagtgtaggaatgcacaaagccaccgacaatccatcctttgtggagatttgcacagccccggagcaaagcgggcactggcatttcctaccgttctgattgccgtggggattccggattcatccactggcccgatccctgggtagtggggtgccttgatgactgtcactctcttttcctcctcggaggacctgtacagtggtatcgagctgcccacgctgccgtccagagactgagcatgctgggggtatgcctccgaggaatctgcagagaagatgtgaaatatagttgatgcacagggaatcagagtaatgaagcctcatattcatgcctactataatacagtatattataatta

SEQ ID NO: 53534 - DNA, 1348 bp, Bovine  19866881516709
cgtcctgtgtttactcatgaaaacattcaaggtgggggggaaccgtaagtattcttcttatcttctaaatttgagactaaccttgacccacaaaacagaccattgatgtaccataagtgaggatggtacaactttgcacatgaaagagaccagagtaactaacatgagataagacctccctgattaagagtaattgcaataacttccatctttcacaacagagaacagaagctacttttgaaaaaaaatccatgattttgcaaagattgatttatgcactcgaaaaaccttccaatgctgtagtgattcctaagatttatgaatctgtctctctccctgttctaactcagcatgtagattctagtaactgcagccttaaagacactgaaaatgttctaacattgtttttatacatatttgaaaagcaagagaatgtcaaagtagacctacagtgataagttcatgacataattccgaagttccagaatgttggaaatggcagtcttaaaacatgcactgtttaagttacgtgatgtttactacccagaggaccaggaaaataaatgccttttcacactttctttcaaatccccacctactgatactaagtcaaaccaaccctgaaggtgtcacatactgtctttaaggttgtctttctgttccattttgccctaggaagacagtcagaggttatccacttcctgttggctgttgcctctctgagtcaggagggagccccagggaaggcgcgggtacagggctgaaccttgtcgggctgacctgaggacacataatgcgccccctgctggctggccaagctccactcccctcagttcagttcagttcagtcgctcagtccgactctttgcgaccccgtggacttcagcacgccaggctggagcagagcaatccagcagggcctggcgatctcccagccattggtccctcctcactgctcacatacctggtgcttagctaaaagcacaggtctcagaagccatctcccaaccccaaactagctctcactgggtacagctagaaagaaatttttgttaatgaaaagaaaaggtttggaggaacaaatcgtttaaaatttcatttagttgggggaaaaaaaggtttaaatataatccttttaagtctaaaggttgactttgtgttcttttttacacaactgactatgagatgaatcacagagaataaatccaagactgattaggtttactgccctgcatcatcaatgcattatattagaagcttttaatcaatttatgaattaggatataggccctattactctgtttcatatcatacggagttaatactcacatgtgtttagagctcacag

SEQ ID NO: 53535 - DNA, 883 bp, Bovine  19866881619829
catcaagaccagtatctgtaatagatacttataatattggaaatgacaagcctttgaatcccatatatccacataaaacttcaatgaatgaaagttaacacgtttcttgaatatgtaaactcaatgtcatttataccaactgtctaaatgttaccttttagagggggaaaaaagcatcacagttcattcacaacacactttcaaaaccattctcttataaatgatggctacgtggtaaaaaataaatcagaatctgaatgacaaattgcatggcaattatcaaagtaattccttattgatgattagattttagatccatgacattagacgtcagggtcagttcctggatcctggagttataaatggataactgagagactgggaaatcccccctgcaaactgtccatcgaaacccctctggttcaagaatggagggtgactctggggtttctttcagtcttcgagtctataacctgctcccttcctgcattctttatccattcccttcccatccaagctgtctgtctagcatagaagactagatgcttgttactatactactaaaacttcaagctttcaattaatagtaattggaacctactatttaccagcaatattcttagaaatttcactcaacagtctatgcatggaatatataagtgtaagattaaagagtggataaaaattgttgaacacatgtatggcttaagagtataatacttagactgtacataaatataaaataactaacaatgtatttattattaaaattataaaatatactatttaaagattgattaagactaaatcaatttcaataaagaggtaaagttaagtcattcttaagcctacatttcttcaagttttcattcaatcatatata

SEQ ID NO: 53536 - DNA, 826 bp, Bovine  19866881923862
tcacatttgaatccatgcaacaccagccaaactgaagccaattccttcttgcagttctgcaagcatggccagcgactttaggaaaaggcggaggagcgagcctgcggtagggcagcccaggggcctgggggacccgagtgcaaggagcactagcccaggccgagcagacctcccaggatcaagcaccaccctgacaaaatccttcattagttcttctccttcttctccgtcaagagcaaaaggtgagtggcaataaatggcgtgtaaataatttactagttcaagttttaaccttaggagagctggtccaatgatgaccacccagagatggttagggttagtattttaataaaatatagtttcaaaacaatagctttcctatacacagactaagtcaggatgatgaaccttctgaatggcttaaaggactctgactctcatctgttaatacttttgttgtctccaaatatatcatgtgtgttatttggaacaaacttaaagtatcaaaaaatgtatggtcaggctattaaaagattgcatttacaaacatttgcatactgtcaaaattttctaatgttactacaactagtaaaattaatcagagttataaaatagaaattagtagtagcaacagagagcattgttgcctaaaacataaattgggttggttttttttttaattatttaattctagacaaaagtttgtctaacctatgaaagttgtttctttaatcacttggtttatattttagtcagtattcatacatacagtagaatatccatgttccgtatgtaacatggtgttcaattcacaacagtccattat

SEQ ID NO: 53537 - DNA, 1680 bp, Bovine  19866880378976
ctcttggaaaagaccctgatgctgggaaagattgaaggtggaaggagaaggggatgacagaggatgagatggttggatggcatcaccgactcaatggacatgagtttgagcaaactctgggagttggtgatgggcatggaagtctggcgtgctgcagtccatgggggtcacaaagagtcagagacaactgagggactgaactgaactgattaaaggaaggatttttgctggaaaaggtaagacaagatgaaagctttagcattggtaacttacaaaccaacaacacagaatttctgcaagtaattgaaactattagcctgcttcaaaactttttggtttttatcactaggcaagagaaaagttaatgaagacagtttgcatgatatccttaaatatcagatgaagaaatttactgatgggtacagattctggcaaaacatgcagcagaaacactcagagagtttttccacaagcagctccccaggtttctccccaagaaccaatcttcttttcagtctcttcagtttcatctccacagccatcaattccccttatgctttagaacagtttcttcacagattaaggaaaaatataatcacaggaaatcctttgctattgccaatctaggcaacattagccagaatgagtacaaagtgtcttcagtgacaaatattaagtcatgccagttgctaaagaacatggcactgactttgactattttaacaatgatggagtaatgaaagacatcagggttatcataggtttatatcacccttcacacaggcagtgtgtgtagatgtggagaagagtgagtgagttgttgaatctcatcaggcagaagcgaacaaattaagacaacaaatcactcagatgaaatacaaagaaaagcacaagaaagaagattgcagcaggtgatgctaaggagacagatgacatctgaaagtttggaaaccatgtttggccctcagatgcccagaatttgtagctgaaggcagatgcacactagcagatacagaggcttgtgatcctcctccctcttactttgattttcacccattcagtcaagccacgtccaacccttctcccagggaaagtgtatttatgccttgatctcaagccgtgggccctgccaattatgctttcactaatgccagactgaagtatcctggaagtggagcaggatgaaactttgattaactcccactggctcccacacacacataaaggaatactcaacttcgaggaattcgccaatactgacatgtacccatgggggctccgggaacactcagacctcccagattcaactaaagaagaggaactcttcactcagcactgtttgtttttaattacttattcagacaatattttaaaacatatcctgggtaggggggcggaattgctttctcggagccctgaacgctcccaagaggagagtccttatgctcagaacttgatggaacttcatgtgtgtgggtcctcacctttcatcccagtgtgcagatgtcaaggcacaaccatgtatcaaattgtctaattctgatgtgattccaggatatgtggttaactttaagcaaagtaaatgataaacgtagtttttgttctttaaaataaattgggaattagagaggaagcacaagaagtctataaatgttctataatcataaatgaaaaacttac

SEQ ID NO: 53538 - DNA, 967 bp, Bovine  19866880381132
tgtgtggttgttgttagttgctaagtcgtgtccctctctttgcgaccccatggactgtggcgcaccaggcctccctgtccctcagtgtctcttggagtttgcccaagttcatgtccactgaatcggtgatgccatccagccatctcttacctgctccaaaccttgacctgccatttggctgatcacccttggctggggtgccagcattcccacccctccagcctcatcgccacctaaactagtctctttctgactgtaggtctggggcaagtggctacagaaggcgcatcgtgatgttggctgcccggggtgggatgtaggctgttgggcggcatggatgctcaggcactgacctctggaccctgacagccagtcctgctaaattgactggaagctggaaggctgagcaaccctataaagcaacaggaagtctggagggtaagaatgggaagtggagggaagcagaggacagactctgcctctggcagccacctccctagtctccttctctgcctttagtccgagctgcccgtaattagccgtctgtaggtccccacggtgaaccaagctgcactgaggttccaggaggcccagagcacttcctgccacttctggtccaactgcatctatttctggcagcttaattttggatgctgtgctcccagcgtgggaaggcaggcaggaagggcatttaggtagctggaccagaggaggaaaccatggccacatgactttttgaaccctgtcccgtcaagaacagactgcttttggcagctagatggtgtcgcccccacctacttgaaggcagtcaggccaggaggggaggggattggctgagcagaggccagatccagctgggatggaaagcactttcttatacttttgcaaaagaaccctcacgttatgagtgacttgggcctcctataaggatggggatgggacttgaagtctgatgggtccagatctg

SEQ ID NO: 53539 - DNA, 1596 bp, Bovine  19866880454814
tgatctggccccaaaatgtcacagtgccaaggctgagaaaccctgccttatccttaagatgggaaccaagcacacgatgggggactggagtaaggatttcacgaagtacgtgggaacctgacagaccccaggtgtgcccggcacacgtggggctcaagcctcaggttcctcatctgtgaaatgggtgtcctcagctccaggctgctgagtgctggcttccagtgctcagcactgtggtctgaacggtctccatttccattaaacacccacagtttgcaggtgatggagtctctcaggatcatggaaaactgccaaaaccttcgcatcatttgggctttggtatgcagcaataaaatcacccactgattcagaagccttcaactatgagaattaggtatttctagaagtaacctttaaggtctgttattctttgccttattagcaaatcccagaaaggccctggttacctcgaagaggccggcctttccaatatattagagtaatcccggcaatctgttatttctaggctatcgaggaaaggttaaaatgaaaattggatttggggagttatagccattccaagtgcaggtggaaaactcctcggcagcgagaactgggtctgggcctgggaagaagcagttatcaagggaaatgactggtgataactttattgattaaagcagcttgaaaaatgtaagggtttgcgacagcctggcacttgagcggcaagatagcccctcgcgggcatttctcattaaaaatagagaagcaggagcagacaattattaccctgtgcataagacacagttcattcaaaatggccttgttttgaaagaccgctttaaaatgtctacaaatcctgaggcttgaataacattaatggacaattcagaaaaaggggtgggggggtggagtgaagaacatgcctttgcccatcaactgtcaagagggggagacagagaggatgataacgcgggaggggataagatgcagctttgtcatctgtgctcagagccaccagcgaaaacggctccctagtgacccagggccacagaggcgcacaatgcctgcacagcacagtagccacgccaggaattcaaacccccaaccccccaccccggtccccacggccctggcatccacctgaaccctcaaagggcctcggtgccccgtcgggggctgtggggagggcggtttctcattcggaatgtgaaagatgctgaccgggaaagtacctggaaaacaccagaccaaccaacacaaaggtaggagggaaggggattaaccaagctcagctctgcaaagacagccgagaccttatcacaccttaattctcggtttttctggtcttaatttctaggcagtgacagtctgctgttttgctggtgggggaggtgggggagactgccaacagacggctgtgaccatggtgctgacataattctaaatactgatttttctaactcaaattacaacagcaacctttctcccactctataaaaaaacaatgatcttaagaatgtattctttcaaattccctatgagcaggacacaaatgttacgtagttgcttatatttaagaaatggaaagccaag

SEQ ID NO: 53540 - DNA, 4122 bp, Bovine  19866880478520
tgatcctggttgggtcgaagggatggattctctgagagggtagcactgagtgaaaagctaaaagagtttgccacaggctgtgtccccaaggaagcagactgtaagactgagatgaacatagaagaaatttattaggaactgctctcaagatcaccacctattggggaagagagagaagcagggttggacagaggaagtagtcaggctggggtaccatcacaacggagcctcagctaacaccctctcccctgacaggacactgtgacgctgggatgatccttcggaattttcaggttggattgaaggatgtgggcctttattcatctgtggatacactgaccaaatctcaaatgcttttttgcccagaaaaagaggattgatcttggacgatgagaattccaggaaggataaatccaagaaagggctgtcagcacctggaagaataattcagtcagtcttacaaggggacgtgtgggtcacacatcaccacatctagagcagagactatggagtcaacctgcagctttctgggagaagagcattccaggtgaatagaacagtgagtgccaagcccccgaggtagaatgagatagggttatccaggaagcagaaggaagtctagtgtagctgcagcagagtgaacaaaggggacagcagcaagaaatgaaggagtcagatcattgtaaggttggggatttaaccaagaagcaatgagatttaaatttaagttttggtgtgacagttttggctgatacactgagaacagacttggccgggaaagggttaaaggcagaagtgggagcacactgcctcttttcatcctcatacaatggacattctgggtgggataattctctgttgtgagggtccgtcctatgcgttgtaggatatttagtggcctccttgacctctcaccactaaatgcaggtggcatcccacgctccctcccccccacccccatctgttgtaaaatccaaaaatgtctcatttttgcctgctgtcccatggagcaaaactgcctccagttcagaccccttgagttaaaggctgttacagtgatccgggatagcttggaccactgtgatgggtatgctatggcaagttgtaggattctcgatgtatttttgaaaactgtgctgactgatcaaaggggagcatcaggaatgttccaaggttgttggcctgtgcaactgtcagaaaacagttcagtttgctgagtttggaagaagtgtgctgggaggagctctgtgaaagattacaatctcagttttgaaccttcgagactgaacgaattgaagaataatgattagaaagtttagttccttccctgaagttagttgtagttcattttcactgttatttattatttatgctgattttatcttcttcccatggatttttcattacatttgtcttctttcgtacccagaatccaattgcttcttaacacctccactgccaccagcatctcacttctatccacccccaaaccactggcacccagcgtctggactactgtgacggcgcccttccccagccactatgtcctggacattgcagccagaggggtcatgtggaaactgaaatcacatcatgttacttctgcatcaaacccaaaccgaacaagtgcctaaatcaactccctcctttatccttgagcatggcaaatgctggcttttaatactaaaaaatttcgcgtgcaaagagaaaactttggggaacgaccaagacctgtaacagaaggcgccgtgtctgggatgcgcagagcgcgagactgcacgcggaggatgcagtgctggaatcagtgatgtaggcggcaaaccttgcacctctcacccctcactccgggggctctcgggccacttggcctcacctgtcgaagacttcatgtcccagcatgcgaaggggctggccggccggaaggctccgtgcccgccgcggggcatgatgggggagttggagctttccatcatggcggcttccatttcgggctacaccttcagcgctgtgtgtttccacagcgccaacagcaacgccgaccacgtaggtgttgggccccccaccactccccgcaacccgccgcggctgctagggcttctggcctcggtctcaggccgacgcctgtggagaagccgggatcctttgcccctcgccccctatgctggccgaaggaactgatgacccgggaggctcccgccgccggcgaactcttgctgcccgggtctccttcgccccccaccccgagatgggcgtcccctcacttggtgccttccatcggcatgcccgtcccaggacagcagtctcccggtggagagggatttcccggccggccaccgacagtggcaggagtcgcttagtcctggaaacccagtgcctgcccctccctgagtcaggcttcgagactaatgaggggtgtccggagtcgggaaggaaccgagggacccccgcttcagtctaggagcggagattcccagccgcgccctctggtctgacaggttgttgtggagtgcgacgagggtaactatggctgtcactactcttgttagatgcgagcgtgtgttttcttcgcctcgatgaaaaatgcagatgtcaccaggagtgttcggtggagggtctactttggccgttgcatgtttagttcgctggcgaatgttctaagacccgggaactagtctcagtgaaaatagggaagtgacaggcctttacgtatgagtgatcggaagtgcatttttaatgtccctggcttctggatggaaattcttttatgacattagataatttttgtctttacgtatttgcccaccaagttgagagattgtgttaacctgatttgagtagtgaattatttaagttcactaaataaatgtagtgggagggagggtggtgttgtcattacaaagcaaaatgagaacactgcagaagagggaactgggtttggtttgatgtctgcgatcctagtttccatctataaaactgatttcgtagagaggtgatttcactagtaaataggatggcattaaagtattgtaccgatcattgcttcagttcagtggtagagatcaactatagaaatatacacaacatgggtttttccagaggcagctcctgtctctggacaccaaggcccttgatactgcagccagctctttaataatgtaatgcagttccttctacaggtagtttgtgatcctgctcgtgtcccctggacgtgttaaacatggtttcagtcctgtttcttaacctctctagttcttggagtgcctagtaatatcacagttttatatataaagcaaaattactgtaagcaacctgttgaaaagtggatagttttagttttttttttttttttttttatagtctacagtgagatggccatgttacctagattgttactaacttgattcaagagatatctctttaatatctgcactatgccaggcatggtgccagacttaatagaaatttttaccaatggcaatagtttgcaacttgtatcttatactctacaaggataccttttatgttaaccttgccacatgttgcatatgtagaatactttaaatgtgatttcaatttcacacattttaaagttgaagaaccaagaatttgtttttgtagtatattgttttgtcctggcaaattagtttaaagccgctcattattctgtagctctggagttagcaaactttttctgtgaagggccagacagtaattattttaggcctcctgagccttgtggcctctgtagcaactactcagccctgcagttggtaggagaaaggagccgtagacaataaatacattagaatgactgcttccaataaagctttacttgtggacccaaagctgaattttatataatttttcacacatcatgaaatattgctcccattttctctttcatttcagcaatttaaaagtgtagaaacttattctaagcttgtagccccagtaactgccattaggctggatttagcccacacactatagtttgcctactattataaaataagagtggttcagataatctagacccatagataaataagcatctgtgttatacttggctttagaatgttttgatgtcactgtcgactttttcaaactaaggcctgccagata

SEQ ID NO: 53541 - DNA, 1435 bp, Bovine  19866880529218
gtcccagcatcaaggcccacaggtctaacaagggccaggtgctccctctgtgtcctccccagcccccagctggaaagggggcgccttcacccccgcaggggcccaaggggggcctaccatcgtggacgagcaggtgtggccgcaggcctcgctgcttcaggatcaggcaggcagcaggggctggggcggtcacctcgccctcggagacgtcaaagcccagccgtcgcagcagccccaccaggtccgcccgcgacttctgcgactcattggtgcaaaatctcaccttcagccgggaccgtttcagcctgcagaggggagacaggccggggagggggctgtcagcaggcagcccggccgcccggggaggggcgtggatgggtgcttcttctccaggggaacagtccagagcaagccgggtctccacgggctcctgaactgggcctcgacagcctcaccggaccctggggtttctgagctggagaagacccttctcatcctcgctgagctcggcacacctgagacgccccgagttcccacgtgacctctgcttctgcctggctcacggccatgcccttccacccgggacacaccgcctcttcacacgtgctaatccgcccgcctcccgggacccactcaacacctccccgcacctcaccgcaccacgccgctcagcctggtggaggtcccctctgagcgtcccagccacccctccgggccctcccaccacagtgagcatctccactgagcacctgagctgacccctgaatatccacatttctccaaaacgcaaaagccggggaccacgcctgaagtgtgctgtctcgccgctgtcactgaagacaggtcggccagacggaggcatcgggtgcacgggcaagctaacgggacaggagccggggatgcccgcggcgtcagcagctccgacagcctgtccgggctcacgggaggccctgcagccccactgtacccaggcaggctctgtgaaggccaagtcacaaaagccgatgcccagagagaagccagggaaataacactgaacccttctgccaacagcgactgagcacctactgactggcacacggacacgccgcagtgcccacaggcgggctctctgaccccggaccctcagtcggtgcgtaaggtgggagaccgcacagaggaggggcgctgggatcaggacgagaggtgacgggaaggaccaaagaggtgaggagacaggacggccaggcagcgtgggcaggacaggaggcctccccggggaggagacagctctggagctgagactggaagggaagcaaggagacaaaggaacagggaccccccagaaggaaggggggccctgcaatagcaagggggccagcgggccggctacctggcctggtccggagcacacagggccctccctggatgcactccaggccatggcgtggggagg

SEQ ID NO: 53542 - DNA, 706 bp, Bovine  19866880664983
accgcgatgggggagggggatggcggcagggcgtcctcaaagcagagcggaacctctcccagcaaacacccgcccccagtcttcatctcccgtcctcgctgggggcagctggctgcaggactggccgcaggactgtccacctcggacctttgccagcccccagcccaggttcactgtccagtcgaaccaactccaccccgagggggaaccagaaatcggcccgtgaaagaagatgcctcctaatgagatcctaggcggccccacgtggcatgcagtacaagccgagatgggtacgcggctaattatgcttaattacatatcatttgaattcaagaatccattaaaagaaaggattgcattagcagccagccgctgtttgccaacacacagaggaaatcgtggactttcatgtcgtaattacgtgacgctgccgtgagccgcagctggctctctgggggcccccagtccaggcccgcccgccctgaggcccccgaggccactatgcctggccgaactggtcgggagaagaccacaggccatgccggctggtgacctgtgatcctcatggcctcaaagaggtcacactacagaagctgaaccaagaagcccagcagagacatgccctttggcagtgggaacagaagcagagggtgatggacaaaggggctgagagacacccctggcctttgagcaggccctactcgga

SEQ ID NO: 53543 - DNA, 3417 bp, Bovine  19866880764160
aaaagcagagacattactttgccaacaaaggtccgtctagtcagggctatggtttttccagtggtcatgtatggatgtgagagttggactataaagaaagctgagcgccaaagaattgatgcttttgaactgtggtgatggagaagactcttgagaatcccttggactgcaaggagatccaaccagtccatcctaaaagaaatcagtcctgaatgttccttggaaggactgatgctgaagctgaaactccagtactttggccacctgatgtgtataactgacttatttgaaaagaccctgatgctgggaaagattgaaggcaggaggagaaggggatgacagagggtgagatggttggatggtatcaccgattcaatggacatgagtttgagcaaactctgggagttggtgatggacagggaggcctggtgtgctgcagtccatggggtcacaaagagtcggacatgactgagggactgaaatgaactgaactgaggtacaaactattaataccatatgtaaaatagaggaacaacaaggtcctactgtgcagcacaggggattatattcaataccctatgatacatcacaatggaaaataatatgaaaacagtatacatatacacatatatctgaatcactttgttgtccaccagacactaacacaacattgtaaatcagctatatttcaattttaaaaaaagactgaaggtatgaaatttgggcacaggtgtgggtaacagaggactttgtcccctggcttgcaggagaccaccaagaatgatcacacgtgtctccattcaagcaggaagcaggtgcttcgtatacctgccaaactctaccttgctcccccgtctgtactctgcaggtgcctctcttccgtatagtaggacaacgacacgtgatgctcaaaagagcccaggaagtgcttcctgcgctgtgtccctgctcccctgaccctgtccttccccaattctctcctcatatgttctcagcttatcacttggcatttccacacacactccccccgccctgttctctttctcccagtgacatgtctctccacttttccagatgtccagagcaatttggctgacctggcagttcccttctcttgggctcctcctgggaatatcttaaaacattagaaaacagtgactgaaagagcttccaagactggatcccaaacctgcaccaccgtatcctcctaggcggtgcttgggctcagttacttctcaaaggtcctcttctatatctcagatcgtgtgtcaccttgagggaaagccatttgataaatgtctgcaattggatttcaccctggggcaggaatgtggcttcctgtaagagaatgttactgaaccaggctctaaaaatctaacaactaccctggttcaaatctcagcttccctacttcctagctctggggtcgtggcaaaaatcactctggagctctctaagcttggttttctctactgtaaactgggaatataagtgcctgcttcgtggggtcgtggcaagggttaaatgaaatagccaaaaataagcaaaaagcttagcccagtgtctggtccagagaaagtgcccaaggaagaagagctattattgtgaacgcttactgtcgttaccaggacaataccctcctctcactgccttctcaccttctttgatgcttcctccacatttctgaaataaaggagttgattgttttttaaacctgttgatttccaaaaagaaacagtgatttcttaaagcaaaagatactgagtaaacatttttattttggttgcagtctgaggatgggtggctactctttgagaactttcacaaatcaaagctttttttttttttttaaaggaacacttgctctgcttggctgtcagagttcaaagccctggtgggaaatgggaaatgctagcctttaattgtaaatgaactctccaccaccaagggctatggagtcaagtaaacaagtaacaactgattctgctgcgtgggttagtttctttttaaaatccagcacctccccctcccattttgcagcccgatttgagttgaagacgtctgcggttcacttctcccccctttgttaccgcgctgtgccttatgaagctgtctgtctctttggcataatgtcctaccccgtgggctggtgcaaactgcagggttttacctagagaatttaaggtggattttatttcgggaacatcagattttatctcaggtgctttgacacagctcctaagattgctctccctctgcacatactgcagattctttctattgttaacactgttcatggctcaggcggcagcttctcaaggctgtgtgagaggtataggccactttgtttgtggaatcgctcgggaagcttggcatcattgatttgcatcagtgcctcaggaatagcctttgccatctccttcaagatactatctaaactgtgaaattcattaaatagtcccagaaatggatcaggttatttaacacaacatccctaatggtgcaatatctcagctgtctgcgctgatagtgaacattgtcttggccagtgttatcagcccgggacacccgctatgaatattgatcccgagcttgttacagccatcacttgccatcaggacaggtcagggatggaacccacctagcatcaaagcaatttaaagacagcactcaggcagaattttaatgcccacgctgaaaacacaaatcaactctgagcacagggagaaggtggcttgctggagaccgatgtacttattgcataggaacatctcgcatataaatacacgtgtgaggacgtgagcaagtcaacacatctccagattgtttctctaggaagtctcactgcctttctggtcatttacaaagcaggtggccagaaaaacaattcccccagacacccccccaccctcaccaaattgaagaatttagtctgttctatgggtgaggtgtctctttttaagttgggtgaataagaaggagcattttctgttcctgcaatgttgatgggagacaccgtggtgtttctttttttttaattatttatccggctgtgctgggtcttagccgtggcattgggggtagtcagtcttccttgtggcatgcaggattttttagctgtggtatgtgaattctcaactgtgtctcgtgggatctagttccccgaccaggggtcaaaccttgctcccctgcattgggaacgcagagccttaactgctgaatcaccagggaaatcccacatcatggtgtttcttgtggcacctgtctccagaagccaagtcctgaatgcaagagttcacataactttatacagcactgaacacacatatcagaaatataggaaaaataaagggcaagggaaaaaagataactaaaaaactactaggagttcttaaagattcacagtcttacagcaca

SEQ ID NO: 53544 - DNA, 1998 bp, Bovine  19866880899253
gccttctgggagggccccgcctcctgccaccctgccccgtgcccagaccacccagggtgctgccctcggccctggataagcaggcaagagggtgccagccaggctgttctgggcccctgagccaccagttcctcctctgtctccctctaccgaccctctcctcccctcaccctccccagacacatctcccagcctcctggggggagtttgatccccgctgatggcccatcccatctgtttgtccctctggaagtcgagaggtgggcagacttgttgaacgcccacacccaccctccattcacaccacgtcctttaaatgtgctacctgattggactcaggcgtttgcccactgtcttttagtgaacagtccctgcgctttaaggaggcacctggaggaagcgggggtctcccaggcaccgtccttgtaggcagagctgagccagcctccccgggacagcccagcggctccggcccccacccagtgtcagagtgggcactcagcgctccccgtgcacctcccaaaccatgcagcccctctccccatcccatcccctctggagccaaaacagaatggctcccagggccactctgccgtgcttcagcgtgagaactctaacctctggatgccaggttgtggatggagggtacctgctagagccttaacggtagacttgtcacccccaggaaattaatggtgaaataaactccgccctgacctgcagtgactcatgctctaactgctcgggggctgggaggaccgtccctgatcccaccctggacttgaacccctacatgtcagagggcccgcgcccggagacacctcacctgcctcaagcccttcattcagcagaggggggacactgaggccccatggggaccaggtggacagggcaagcatgggcctccgctcagggtggtgagctgcaggctttctgaattcacccactgccccggtttcaggtttcagaatcagtcagcaggtcggataacttgattgctctgtttctccccaaatccacccagaagccactgacagatcttgggagacttctcataaaagaactcatgagtcctccagaacaggactcccgtgaaacaaaggcaggtgatgataaaacgttctgcctgaatccgagtcccctagcctgttaaatcaggattagaaagatggtgctgggtcttctcatggaaatgagaggtaactggttaggctcatggtgttggcttgcaatggaggcagggcgtttggcctatcagctggaaaataggcagatgccctgcccctggagggggtcccctaatcccagctctttaggcgatgagctgggtgctgtaggcaggcacgaggtggctgcaattcaccggggctcggagggtgactgtgagggagcaggcccgcagcctcccatttggcttgttcccttttttcatcttgcccttttcgtgggccacccttgcccgctgtcctcggcaggggcctgcagccagggtaatggggctctggaggaaggtggcttggtggttcccgctgcccaggagtgggatgcagagggtgtcagaggaacagcaggcacagacccctgctttgggcagagaacataccacctcctgccccaagctgtgggttcagcgaagtggacactgttacctcccacttttacaggtaaggaaactgaggtgctcgaatcaaagtccgactctgcatcccaggccctttctggtcctttccacagtccttccatggggggtggcctgtggtggacccggtggctgtgacttcccaggcgaggggcgccctgacgtcctcccccggagatgtagtgtctttcaggatggagggccagccctactctgggggcaccgtgtaccgcctgagcctcagccactttctgtgtgtgctcagttgctcactcgtagtgcccaactctttgcaacccctggactttgcaaccccaggctcctctgtccatgggattctccaggcaagaatactggag

SEQ ID NO: 53545 - DNA, 937 bp, Bovine  19866880904409
ccatcctgcacagcgcttcacccgggcagcggccgggcccagtgtggcccgttttccagccaccacgcttcctgaagctctagggcaccgacgggtgctgctgggaaagcacacgtgaccccggagacggccaacccgcgggcacccgcgcccgggacgtgggcccccacactgggacacaatttctttgccaaggagactatgctagaagattggactattctagctaggtgtaagatttctgctgtggtctgggatttttttttttttttaattaaatccttttcttttctctttaaagaggcgccggtgggaggggtccggccaccgtgagcctgcggcaagcggcggcaccatcgcctacatggaggcgctgtcctggctgggttgctgcccccagagccggggcgtgaggaccgcctgcaccccaggctgtgggatctgacacagtcatcgtgtggatgacctgcctccaggccagggtgtgtgaaactcgagcccgtggtggggcgtctgtccagggcgtgggctggaggctcaggcagcaccagccagagtgtggaagcgcacaggctgcccctccccgaccttgctctggggccccttgtggacaatgggtttgtttcctttctaaggtggactttgcattttaaaatttctttcagtgtatacaaattcacaaaaacttttcctgctacaaaaattttgttgaaaagtaaggctttctgagagtgaaaatcctcacgagctctccaggggcctgggagtcgtgtctgcccacgggcgctgcactggccctggcctccaccgcgagtaaggcaagagggtatgcggtaatgtaaacgctgaggctgccgccccgatgcccggcccggccccacgggcagcggcctctgttagtcggcggctttagtgagggtgccccaacacgaagccc

SEQ ID NO: 53546 - DNA, 1619 bp, Bovine  19866880920544
aaaaaagccacccttctccctccccagaaggaattatccaagagttctactatgcctaactttcaaaggaggcattgttaatcttctcgccataaataggcaattaacacccactcccgagtccaggcaaaacccagttcctgcgagctcggggacacagcgcaggactagccctcttgcatggcattcgctttctgaagttcttgacgggggcctgaggctgcaagaagagggcaggaactcaggaccactgattccacaaaaattttagagggagtctaggtcgatgccatgtttgaggacaatcgaggactgttactgaagggcctaacttcatccgacccgagtccgcacgtaagccagcagcctgtacaggatgaagccacgggcaggcggcaggcacgtcggctcgtaattaatcacgtccgtctcagggacatggctccctgcttcctggtctctggccctcctgggggctgacccaccggctcaccgagggcgtggagcgccttcccggggggcgtgaccctgacatccccgatgaggagccaggaataggacgggaacgctggaatgcttccgggtttctgtcaagcagccccttcccctgcatccttccaggctgcgtggggctccctgggctgttagtaggttctcattttccagagatgccgccccagccaatgtaaacagacccaatgtggcacccctgagatgcgacccagcaggacgagcctgcaggggtgcaggcatgacctcctgtggccccgagttgtccagccgagtccaggagagaagacccagattcaagtggacaagaccagggacccttcagcaaaggagatggaggctggaggcaggggtgacgggaagggtaggaaccgagctcccggggacggcagagggagcctgatgcgtaaaaggtagggggcaggatggctccaaggtcacgtgtggaaacaaagcaaatcacaaggatcagctacccgtcactgctactgaggaaagatcacggagaaatacaggcaaagcgagggctctatgcgggataacacgagggccttaccgccagccaactctgaatgcagcagcttaaggaacgttatcgttggggattaaggtgatggatactcagccccctgagtgaggtctgtgaccacggtgacttggacgctaatgcaagatcgatcccctggctgggcctgctggccgtacctctgggatgtttgcaccccttacaaggaggcgtgtctccaagctggtccacactggcatgcctgtcaacagccggccccactcctaagtccacgctgctccctgccaccaggaccttggggacggggggctgttactcccctgcttaaaactctctaaggctcccctcacagcactcagagtaaaagacaagcatcttcagaggacctaccaagaaggcccccctaggctccggtcccctgcccacctggtcctgctccgggcactctgggcttctccccgccccttcctgactccaacctttgcacacacacttctgctagtagcccccgtgagcacaccggcagggccgcctcacggcttatggccctgctcacacgattccaaggcactgagagaacatg

SEQ ID NO: 53547 - DNA, 1398 bp, Bovine  19866880950673
atttaactgaacgcaagaaactctccagttagcactgtttttcttaatcgctcattgagagagtttttgaggacttcctctggaggggagaactgctttctcgggcccctggactccccaagatgagtgtttgggcccagaccttggaggagcctcgcatgcagggggtcctcacctgcggacgcagtgtgcagggctcacaacagagtcattaagataatcaaattgtccgaattctggtgcgattcatggatgtactggtaaatttaggcaaagataaacttatcaacgtagtttctgttctttaaaataatttggaaattagagactaagcacaattagtctataaatgttctataaatcaaaaccttacctcttgcactatcatgccttgaaatttactttttcaaagggaaactagtttagcagcagccttcaaagaaccttctttctatgatgagccaaattcatctttgccagaaaagaaattttgataatttccaagattggaacaaatcagtcgtaccttcttttgtctgcatgactttgtgagatcaaaagagagggctttgtttccacttttttctactagcctgatatgtattgtcacttaaaatggttgcctttaaaaaaaaaatgtagaaatactaattaccagtaagtaatcatccaaataagtatgtcataaaataaattacttatttttctttcggggaattccagtgactgcttctgttgcactagccacgtttaatgtctctgttctggagtcttaaatgaaggacacacagcagtataacagaaaggagttctgttccagacctgagttttatgaggaacagactccagacacagcagatttagccaagttcgtacgtaagggagataattcgtgtagatcttctgacaaatcctagtgttagttttatttgtggaagaaagacatttaataaactgtttgggaagcttggttattgaatagagattcatttccaatcaaaataaccacacttttttaagttaccgttgggcatatagctgtggaatgtgtagagactttccttggggaggcacttaacattcttagttaattactgcttgctttctagttttgcccagaatgtgtgacaccactacagacgttcatgagcatgacaggctcctggtttggaaatgacaagaccccccctcccccatttacggcagggtcagcccacgaagctaatgccatggattataactgcctttctttggactcgttacgacctgtaagaataaggaagttgttaaggaagcttaaaatccaggttctgaaaaagtagtttcattttgtaagaaagaagtttagtctgaatggaaattaaacgttcaaactgccgtccttcagacagctagcta

SEQ ID NO: 53548 - DNA, 769 bp, Bovine  19866880967755
cttgtactgtacttcgtacgacggtgaacaaagaacagctctttgcagcatttgatgaatgggattctgcctcctataggccacactccgagtcttccatacgttacagcctccggactcgggggggtgttgggctagtggcccctcgcgctgggcagcgcccggggctcggggacctgggccgggcgtttgtgccgccgcctccgccagctcgccttgccggagcgggtgcagatggagccaggctgacggttgttcaacaggaacaaatgtttgttgaattgttggatggtggagacaagggactgttttctattgactgctgcaggagttggaatggcattgtttattggcctgggaagccaggcaagcgtcttgtgcagcttacaacatattagcagacttccaaatgacatactagcatatgtgttcccagcagttcccaccggctggagggagatacttccttgatccagaatcctggactctgggtgattacagtaggacgctaccaggtttgaggacttggaaaggaatggagttagtagactgggtgaaactcactgtttctgcagttggctaggttttggtttcattttaatttattcacttaacagtagcttgtctcagttacagttttgatactgaattgccgatctgtagttctttttttcccttctccccctcccatttttctcagctagggacagctagataaactgaaaacagctacttgtcccagtttataggcccatgttaggggagaagg

SEQ ID NO: 53549 - DNA, 586 bp, Bovine  19866881147563
agctaattaaggcaactgtaattaacatttatgaaaaaccttgccattacgggaatatcctttaagctggccttccaagctgatcacaaggccggccccgcactccagtgcggcctcctagggctcttcgacgtcgcactcgggcgggggagtgggactcaggtaccaagtgcctgcgcctcacctcacggggcagggtcagccctgccgtcgccgttagcaccccaggccctggaacaggcacccggctgaggaccgcggctccagggcagccgggtccgtaggactgagctgtccccagtgctcagtttgtgttctggctcaataagacgcagcctgatgacacaggtcgtgcagaaagagagggagagatccacgtgttgaactcgaggcgagcccccagactcccgggaatggggaacttcctcaccagctcttcccgcggtggtgctgagccccctgcacggttgggagggtctccctgcgggctttcctcctgccacaccccctgcagccgggctgcacctgtgctccctggggagcactgccctggtggggggggggtcaagactgccctgagcgctgg

SEQ ID NO: 53550 - DNA, 2333 bp, Bovine  19866881250912
ccctcgctctccctcgctctccctcgctctccctcgctctccctcgctctccctcgctctccctcgctctccctcgctctccctcgctctccctctctctcgggtttggcgggttagaatgactccagcggtagcgaggatcacgggaatgcttataggagactggcctgtcagttacttctcatgatgaatgagctcttgacaggtcatgcatgcagctggcttcagtttcaagaagcagctcaggctgtctcgttcccatgttcagatttgttttggctccgggtctcaacactttcatgtccctgaataatgtccttcctccccctcctcttgaaatgctacttgcttaaaaaaaaaaacaaaacaaaaaaccccagcagatccctccagcgctgtgagagtgactgtgtaaagtcccagcgaacagagtcccagtttggttcaacagctcattgaaccaaagcaagggttttgcttgccctccatcaagacagcctcatgagggagcctgggccgctttgctctgcgcagggcatgggggtcggtccctctcctgctgggtggtgtggccgctcatccttcccccaagactgggcctttggcggcttttgactacctggaggtctagcccagggaatggcaatcactctagttactgcagaaaacacccccaaggatacaccttactctgggatgagggatcggagatggggtgagcatgctatctctaaggacagcagatgctttattctcactgctcaggccccccagaatcccgggcagccatgagtcagctgtgtggtgtagccaggccgtgctgcctctctgagctgagtttcctcacctgccgcaggtggacgggagcccgagggcccatgagactcaatcatggattcgatgatctggccactgcacctcccagcgaggtgagcctgttctgtggcctggtagccagttcccacgcgctggaggagggccccctctgtgcttgaactgcgatcacctggggacctcggtctttaggggccccagcatgcagacctttccttccttaacttcccactcgagggggccgacttcttacagatcacaaagcttagcaaagtcacgcgcatccagcgtgccacagcctgcacgggactaagccgagagtgcttccgaaccttgcgtccagtgctcgtcccccagcctgttactgactccgcgaacagacacggatcaggtttctgctgtcggaggctctctgttgaggccagaggaggccagaggcaggtccacacccggacgacacgcctggaggggagagctcgccagagcgccctggaaataggcttggagagaagggcagggtgggctgtggcagcccagagagatgggggccaaaggactcagaatctgatatagcggggagccggcaccactgccccaggcctggggacaccctggcttccctggaaggcccttcacctcctcctggcgcccggcgtggctgcacctccatgcgtttggggtggggaagcagtgcccgcatgctttcacccccaccttcccgcctccccactccctgcctcggtgggacccctagtgccagttcaatcgttaagcccagaaggttgaggtgtggcctggggcacctcgggaagagcttatagagaaggggtgtcttgcaaacccagcgtctgtacttcggtatctggtccgtttgagagatcaaatatttgtgggataattatgataaatgttaacagatcctggagtagaagcctcgatggttaagacagaaactttggaatccatcagacgtggttgcatccttgcttcacccttcacagctgggtgaccctgggcctcagcttgtccctctgtaaaatgggaaaacagcagtgcccactcgaagggctgctctgaggacttggtaagcctgggggcctcactgctctggtggttcagatggtaaaagactccacctgcagtgcaggagacgtgggtcttccgtgggtcgggaatatcccctggatgcaggcatggcaacccactctagcattctcgcccggagaatcccatggacagaggagcctggcgggctacagtccacggggttgcaaagagtcagacacgactgagagattaacattttattcatgctctgttaaaggtagaccccacatcacctgttaatttccgcaaacacagaccaggaagctactgggaagatggtggataaaaggttattatttgctgtctgttgcctctgctgtggagttgccttaaatcagtgatatttggtgtcgagcatgtccttggtgttcaagtattgacgtaaaaggtat

SEQ ID NO: 53551 - DNA, 1821 bp, Bovine  19866881327892
ttaaattgtgacatcatcatccttttaacaaaaatggcatatttacattccctattcatctggaaattcattgcacacctggaaaatagggagacaaccagaaacatttaggactctttagctttggttgcagattcatggcttcattcatcaaatgcccttgcttaggggttgggggtcccaggcctgccctcagggagttcacagtttaggggggatatagaagtatttagggcagccctggaactaggactgtattgattggttgactgattagttcgttcaatgaatatttattgaggatctattatgtgcatgaaattgatacttaaattattcatattttgcactcacgtattggttttaaaattggaaagtgccttgagatgtattctataaaaacccaacagatgtgatttgtacatttctaggacaaagatcatctacaaaccgaaaattagattacgattttgagcatgccccatgatgtcctgttttgagtgagagctagacctgtgcacactgtatctctatcctggctacacgatcatctgggggaggtgtcaagaaggatctatgctgtcatctgggccccacccgcacggattatgatttgataggttttgaggcaggacactggataaaagggtgtttttaaaaatccccagtgattttcatgtgcagccacattgtaagccgttggtctataccagcagtttttttttttttttaaagtaaatcgagcacacacttttttatttattaatttttgaccaccatgtggggctggtgggattttagttttccaatcaggaatcgtcccctgtagtggaagcatgggatcttaaccactggaccatcagggaaatctctatatcatcagttcttaaccttagctgtaccttagaatcttctggggaattttaaaagtctccatgctcaggctgcacccagttcactaaatcagaaggtctggggggtggaagccagttatcagtatatgtcacagctccctgagggattccagtgtgcagccaagactgagaaccattggtctgcacctaattatgatcataaactggttggagttggcatcagagaagatgtgtgcttctcgatcattttgcacctgcagggtgggagggacctgtgctcactggcttgaggtgcccaggaggtggaggaactcctggtggccaatgtctgcttccctcccccaaacatcaccacctctggcctctcttcaaagagctctgcatgtccctggacagtggcagcaatccccccactaaaggggggttggtccctgcccagcagcctcaggtatctcctgggcttttgttagaaatgcagatgctggggccccagctgcggtataaccagctttccaggtgttttctgacgctgccaagggctggggagcctggtttcccttagggtggtgcctcagccttccttgtggctagagtcacctgatctgcttgtgacatctatgtgtcagggcctcaccccaagccctctgtcagtgtgtgtgtgtgtgtgtgtgtgtgtgtgtgtgtgtgtgtgtgtgtgtgtgtatctgggtgtcaggctgtgtgggtctctgggtgtcaggaagtgcgtagcttctctgaactccgtgtcctacccactggtaagaagtcctccctgtctgttgcattgagctgacagctgccaggcccttgctaagtgctttacacggtgatggacacagatgccatgaggtcattttcatgtcagcttagagttgcacgcctgtatcattcccattatccagagctccaggaactcaggagctcc

SEQ ID NO: 53552 - DNA, 874 bp, Bovine  19866881330381
accccgcctcccctgccagagcagagggagtggaaagcagctgaaaaagaagctttagagaagatccagggggctttgctgatggttcagattctctaatctgcctgccaatgtaggagacacggggttcaatccctgatccaggaagatcccacatgctgtggaacaacttagcccatccaccacaactatcgagcctgggagatgcaactaccgaagcccaccccccttaagcccgcgctccacaagagaagtccccacagcgagaagcctgcccaccgcagctagagagtgccccactcaccgcaacagagaaaagccccgcacagcagcaaagagccagcacggccacaaataaatacatttttttttttttaaagaagtaaaagtaaaaagaagtgctggaatttcaggatagtaattaacaaagaaaaaaaaataagatccagagttgcatatgtaatatgagaatgtccaagtttcaaacgaaaaccactcactttgccaaggaccagaaagatttaaaactgaatgaacaaaagataataaacagagctcaaccctgaaatgacagggatgttagactgtccgacaaagacttcaaagcactcatgataaaaaatgtttcaacaagcagtttatgaatatgctcaaaacaaatgaaaaagtagaaagtctcagcaaagacatacagacataaaaagggtagcatctgtgagctgaaagacaaaacggtaagaattactcaatacaaacacttgagagatgatagattggaaaaaaactaacagaaccttggggacccaagggactatgacagaaaatctaatgttttcacatcaaggcctgggaggagaagagaaagaggacaggg

SEQ ID NO: 53553 - DNA, 1158 bp, Bovine  19866881875327
tcgaccttggcccaaaaggtaattaccacggctaatggaagctgcagctcttgtcaaggacaaatcagcgtctccagccctcagaggaccagcatggccaggacaggctcctccacgcagtccctgtactgtggcccctctctaagggcactcactcacccacagggacacaggagtgagaaccccaggaccttaagccctaaccctctgacctggagggtagagctcacacactccgcttcatgagtgttctaaaataagatgcagaggaccctgagggagaagagggtcgggtctggaatggttttactgctgacagcccatcaactgccatttcaaaacgcaggtaaagtgaccactcctgctgctgacgccaaagcagaggaagtacttcaggcagactgctctgggcagagctgccgggctgcaggggaggagacaacctcatggaggatcaggtcggggaaagctttcttgctcctacccattctcccaactcatgccaatctgcctctctccttctctgaagctccaaggggcacgagctgggccctaaggacagcaaagaaaagttctctgcttcttgggaggtggccttctgagggcacaggcagaaacagacacggtaaaggcccgtcagaacctgaccccactgaactaacccgcaccccaagcaatactgagattctacatggccctgttttttggggttttttttgacatttgaaaaatgagctttattttaaaattaaagacacactgaaaacaaatactttttacaatttatatcaaacacttaaaacataatttaggaatgttgaacattaattcttaattcaaagtaatgacattcatagaatacatcttggtcccagccaatatggggttgaaaaatctaatatttcatatcagcttaaccattaatccttgttaaaattcactgattatgatccaactttacaaggttaagcaagtcttccaggcaatactctcatataactttttcaaatacaaacatttataccagcaaggcaattattaaaatatatatcaattatgctgaggggcttgattaaaagattgtctatatagagatgcgcctcaccttagaaagcacatacacacaaaaacatttaatcgaatataagacgcccgtag

SEQ ID NO: 53554 - DNA, 1527 bp, Bovine  19866880381676
agttggactgagaaaggcgagtggattagagccactctccaagtcagggatggagctaatgaggcttttcttgtcagcatctgtaaaagtttattacttacacttcaaaggcagtgagcagcagaggggctggggagaggcactgttcctccgaagaggagcaggaaacagaacatgctgctttggagagagtgtgggaggttgcccctgggtccctgctgcaaaaagagcccagctccagggggcatgggtctggatgcatgcacctttggtgatcaggagctagcagtggtcacaggggtgggggagcacagtggatcagagggacgattaatgaactttattgtggggtgggagatgggctggctgccctgcagttgccttctgacagccctcagttctggtctcatgtgctctgtcctttcctggatccggtaggaagtggtccaagtctttcttagtctcagccttgctgaacacctggctgtccaccatctcatgttctaaataaacacagaggtccagatggggtggcaggcagcttgcacagcaaggcggcttgttcactcacccaggcatggtgtggatgatgctgccttccagcttaaaccaggtcacgttggacagtttgtaaagacggggagaggaatgggtattcgtcccctcattagatgttagttgagcatttactacggcgtgtcaggtgctggggatacatcgatgaacaatggcagcccaggtcctgcactcctggggcttacagtctaatgggggacacggacattaatcagagaatcatgcaaacacagatgaacataaaatgacagccaagataagtgctacagggggaaacacatggtgtttatgtagaggtaaaataggaggaactgatctgaacacagggaagaccgctccaccatgagggaggaacatgtggaaagggcctgagaagggaaggagtttcactccagaaacacagaacaccagtgtttccggagtcagctgggaagagggaggtgtggacaggcagagctgaaagcagcctggtgtggacttttgtctgtgttgtccactgcttacccctccagctcctgctgtgtactttgacagtgcatagaaggagttcaagtagaaataccaagtgaatgaaagagtacctactatgtgctaggctctgtgccaggcttctatatcctgtcccacactgattctcatcaaatcaactcatcttactgacagagacttgataaacccagagttatggaagtggtgtatcccaagggtgagaccccaatccagtatgcttcaggaagtttcccgttttgtgcagtggagtaaaaaatcaccaggtgagttactgaactagaataatgaggtggggaaagtttgcccagaataccttagacacaattcctgctctcagaaaagcagtcaacaacagtgagtaggagatggtgcagtcaccatggaaaacggggtggcagttgctcaaaatgttacatatggacctactacttgacccagaaa

SEQ ID NO: 53555 - DNA, 1236 bp, Bovine  19866880412600
aagtgcctactacataaaatctatggttaaaaaaacagcaaaagcctatttcaatttttttttcccctacccagcaagaggtacagaatcagaatgctcactttatttggacaattaccaggaaatagattccatgcttctaaacaaaagaaaatgggcacacctatcttgtgtcaatggttttcctgatggactttcagtttcttctcagtaattctgtgaattggtattgcctggatttgcttcctctttcactaaggaggattaaggtattcatcggggtaaaatgccctccatttctcatactttatagcacttgttaatcaaattgaccacagccagttttgaaagaggcactatattctccacaatgcttgatttcactgaaatttgtgttcagcctctgctacaaggcccctggtttctgctaggctctaagaacctgggattttgaatgatcccacttgcatctcggtctctgtctgcagaatggaaggactctgcaattggatgagagagctgtttatacaaagcctttgaaatttggggagtaaagggcaaggataatttctgcatccatgtgtatgtcagaactgctagaggggatgggatgcaggaggcatgactgagtgtgaagggaggacagctttggctgtggactctcccactgacctgcttttggactctgtgtctgaggagttttctaagcagggagcaagccctgcctaatccagctcgtcttcccccctcagcaaagattttagagtgaggacagagacacaaaatacttagggttttcgggagaaaggtgctggtaatgtgacaaacgtcacatccacgtggactctacaggaaacagcgccagaggttccaaaaaacctcagtgagtgaaaacgagtggtgccacgaccacttcctgtctctctgccaccagctccgatctctcttgtcccttaaaacaaagctctctgccgggatctgagcaacaggcagacagacaaaccgaggttcatcataatgataatggagagaatgtgatcatgatacaataaatctctaccacatacctgttgtttacggcatgccagccacatttgggctggtagcacttttaagactcacagaaatgctctaaacacagtgcagattctcatcactgtgttacagggggaggatgctccaggagggtgaagtgacttctttcaagtcacaaggtagacaggctggatccacaca

SEQ ID NO: 53556 - DNA, 1956 bp, Bovine  19866880534393
ttcaataaaaattcataagaaaaggtgtaataatatggtgtctatgtccttacagtaggaaaatgaatgagatcctatagtatgaaagataataaacatttctactaagtgtggtatcagatgaatggttcctagaacagcaagcatctttcatagggactattctacacactccatttaaatacttgtatgccaaggactcaagcagagaaatcgggctatggagaggtgaccaaggactacagagctcaaaaagtgataatctctgtcctgagttcatgtaaaggtggtttttcccaaacctgtttccatgtttttaggatcaagtaggagtggggaatgctagtgggtttaacagctttacttctggacttcccagcatttctaatatgccagcatgtaatctgaacgtccaagggaggggtagaatatgcggatttctcaacctctccatccacagtttctgagcacatattaccgtctcctgcaatatctcccagaattagtctagaaaatgccagtccagggttactgcagggctgatgttcaaatgtgaatctcaaccaggctacaggctcaagtcacactgaatttatttgtagatatgcaaactctcctctactagacaatcatcttcttgaaggaaggctcttggtatcacatttaaaaaataattttctgtctcaaataacaggtattcagcatgtgctgaatgaacaagctacatttaaatctggtttctttggatggaattattatagacagaaatcatccaaacacaatattgctttccagcatgaagagatcttggttcctgacccaaggaaggctcaggggaatgaagacttgcctagggttgtagaacgccctgtatcagaggccagagcagagggttgacctacatctcatactgccagtcatcccactcaaagtatctctttcacggttatttagcaagttgtcaaatgttggtttccttaatcaccaccatgaaatttaccacggtgtccaactttgccatcaattacctttcccttacttgttcatgacccagtttgatccaaactcagaggtgagtcagtccttgaatatcccaattttgttgttctgcagataaggattcctagagaaattcttcctccctccctagagagccaggtctccatctgcctgtctctggcctaatttggagactgaaaggaacaggatgcagtttacttttaaattgttccttaaagcacatcttctggttaatgttatgtccttaatacagaagaacacgtcctctctgtaagcaatgtctgggatcctgtgcaaataagcctcctataaacttgccatcttctctcagctggcctgccttcccccactccttctccaatcacctgctactttgagttgtcttccccttctcttttttgctggtgtttgtttttaagatactcactaacagcatatgaactgaagtgggttgaatctttatgagactatcatcatcttagttttatttgtttttaaagttctacagacagctgagtgctgggtgaatgacagctgcttgcacagaagagatgatgaatagatagaacagttgggagtgaaaacatctctgtgcaaggatgtgggagttcccctttattccacctgggcagctgcagcaaggaccctgtgctggtgtctatctagtcatccacagctgctatgctttaggggctcccttaacacagaattaacacattattgactacagacatttggtcatggcatattgtcatcaccagagacatattaatacatctttgttacctgaacgttattgactggagacatatcaatacatttttagagagtgatgcaataaacatcaccatggggaagttgttagaacttaaagttgatcaacagttcattatacagcttaggattgttatcattcacatttgctccattatgttt

SEQ ID NO: 53557 - DNA, 2129 bp, Bovine  19866880633720
gaagctcatctggcaagacagtcttctctgtttctgggcatctggaataaacttggtatgagcctgaaccaagggctctgttacttcctctctctggtgtgagttctgtccttgagaccatacggccaaggttggttaatcctcttctgactgtccttctagtcactgaaggctgtttccacactgcctgggagtttctctactccagccaaatactctgaattaccctaggaaaaggctcccaagttcacaggacccctggctgggacagcagcgcaaaatcacagggtaggagctgtttcctgttacgctctgccgttttccagctgcgtgaccttgaggtagtaaatcagtcagtctgcattagggcccctcaaaggaagtggaggtcacagtggtgtccagcccctgggtcatgggaggttaattgatgcaattttacatacgagtgttgtacttgggagtgggggtcccagttgtccacaagtgcagagctactggtctcaggtcatcagtgaggaggctgcaatatgataaggacaggccagtctcccagagtggctcatctgatgagggtgaaagaggagattggaaatgctgacttaaaactcaacattcaaaaaaaaaactaagatcatggcatctggtcccatctcttcatggcaaatagaagggaaaacgtggaaacaatggcagatttgattttattgggctccaaaattatagatgggaaacaatggaaactgagagacttaattttggggggctccaaaatcactgcagatggtgactgcagccatgaaattaaaagatccttgctccttggaaggaaaactctgaccaacctagacagtgtgttaaaaagcagagacattactttgctgacaaaggtttggatagtcaaagctatggtttttccagtagtcatgtatggatgtgagagttggaccataaagaaggctgagtgccaaagaattgatgctttcgaactgtggtgctggagaagactcttgagagtcccttggacagcaaggagatcaaagcaatcaatcctaaaggaaatcaaccctgaatttgatttctaatgtcagtgatggttaacattggcactcacttttgagggatcctctgaactgccactcaggaaccaccaaccacgagtcttgtgaagattgacctccagtgtgaggataaatctcaccgcccttgctcttgcacccactccacacccacctggccctttggagcccctgccacatgacagtatcgttgtccctgcgcctgtgtttctcagagttgttctcaggaccacaggccagaagcgtgtggggcatccttgggaaagcagatttccatgtctggctccccagacccactaggattcgtccttggtgataagtatttttaaccctcccacagtggtgggaccgcagtctttgggccatgctttgcaaaactgcttgagctgcatgggagcaattctgtgcccctgtctttgcattcccagcaccttgcctgatgtaattgtttttaattgaatggtgagttaattgagttacttgattaattaggttacaaagagaacaggagttattccaggaaatggaaagttgtagtttcctaagagtaaagcaaaacagaattaatcaaagttgccctgaaagaccagaatggcgtttatgatttaaggacttgtgtttgacttctccatgtgagctttcctcaggactacactcaatgcaggtgctgtcctgagtcatacacactgagactgcaggctctggatcttgtacttggcagaatataatctcaagccagaccctcagttggagaacctcactgaaatataaacagatgcctgtactagatggattcacctgatcactgcctcccaaggcccccttccggtgtgagcatcacctcctctctcaagtggattcttctctccccaagacgaggatgagatgagaacgaggtctcatccccaagatggaccccagaacgaggtccatctctgctttatataagcactgcctgtttctagaacagacctctttaagagctttgcattgtagttatttaatatgttcatgtgtgtatctccatcattagactagaagctcttgaag

SEQ ID NO: 53558 - DNA, 1881 bp, Bovine  19866880663505
gaaggagctgagatagtataatagagctagataaagaatccatttggtcccaaatggatccccttcttttgtaaaaattctagtgaatttttgggctttcttgcctaagattagcaagctgctcagaatcatctgaacaacggaggttacgagcacagactgcagggctttgtgccagatacttgggagacctcagagcgagagtctctgctttcagggtcctcacaggctgaagggaccaggagcgaagcatcgtgaagagatagggaacaattataataggggcagagaattgccaattatgagaatgtcacaggtgtgagccacgtaaatagagggatctgagtacccagcccgtggtgacacctgagagaagccttaaggatgagttggaacttagcaggttgatgagatgagccttggagcacaggtatgagcttctgctaaggcacaaagacctgagaacttgtgagtctaatgaaccacaaagagttcagtatggctgaaacaaaggatctgtgtggacgcctggggctggaagggaaacctagagaggaaccctgaacatatagctaaggatgccgatggtccttaagtacatgcccagagaaatgaaactgacacaggctactgcatggatggaccccgaaggctttatgaaaagagccagtcacagaaagaacaaatacccaatgattccattcataggaggtacttagagcagtcaaattcatacagatgaaaagtacaatggtaactgccaggcagggggatgggagggatgagaagtcagtgttaaatggatacagaagttcagtttgggaagattagtggatggggtgatggctgcctgtagtgtgagtgtacttaatgccactgtacacttaaatggttaaaatgctgatttcttttatgtatattttaccaccataattctctttttaaaaaaagaatgcacccaggaaggatggtgtgctggtaaacacatgtttaggaccacccttctctaatctgtagaaactcagaaatctcaggctgttttgcgctgatgcgatatggaaatcatatactcgtgggaactgtctcaggctcactctttacaaataatcgagcagttttaagtagctgtcacctcctgaaagaggtgaaacttccaatcacataattttcccctcctccccaagtttttttttttttttttttaacaaatgcccctaattttatacctttgggttgagggaaggaagaagacagctgagacagccaggcttccctttgataacttgctccttcttctaattaacaagaccctgcacaactaaacatctgccaatttcaaaaactttcacagtgatgagctttgatcacagtacagcacacagcatctgctctgaacaggagagtttcacaaagcccaaatcagaccattcactccaatgccactcgacttaatccaacctcctgaagaccgttgggaaagtcaaccctgggtaaggaacatacagtcactgccaactggaaggagcaccatgggttccaaggtagcccgtcccctgttccaacacaccccacgttcatggacaagtggattggggaatcacattaatcctatccctcactatttcttggaagaattttctaaaacctgcatttggtagctctatttttagcttcttataaaaatggagccatcatatgatcctgcaatcccactcctcctggggtatatctgaagaaaaccataagtcaaaaagacacatgcaccccaatgtttcagttcggttcagtcgctcagtcgtgtccgactctttgcaaccccatgaatcgcagcacgccaggcctccctgttcatcagcaactcctggagtttactcaaactca

SEQ ID NO: 53559 - DNA, 2058 bp, Bovine  19866880667522
aatacatgtaaagcatggaagtactgcctggcgtaggatgagtgctcggtacatgcaggttctgactattaggtgcctacattacacagagttgggagatggcagaggcccctgttggcagtgcccatctgtggcctgctggggagatgggtccccagacagctagtagaaggcaatcatggagggaagatcaagaagaaatggcatctctggaaggtcagagaagcatctcttagaaggagacttagcccttgccacaagctggggcttgaagggtgaaagaggggagactctcttgagatatgcccaatcggggcagaaggaggtcctgggccagacattaaaataattgcatgcgagctggtgacactcacacccagtggggatcatgtctttgctgtgaaagatgccggtgcttgccaagtgctgagccagcaggaaggctgatggatgtgcatctgactcaggaaacctgagcttcttcatcagggagaaactttaactaaggggaagtcagggccagcctgtgagcctcccaacaaacaaattgtaacttcgcattcacaagcctgccggaaactctggagacaccgtgtccttgctctaaacgagcccatctgaatcccactgtccattgtacaaagatggtactttgacctgcccatagttaacagcagtcagggtgcagagctgagacacaaacccagctctgaaccccagactccaggttcctgagtgctgtcgtggtctgtgtcagtggctgagagttctacaggtgtggagagggaaacctgcagaggagacggtttgctcacaatcacgtggtgagcttggaccaggccagggctgcgaagaggatacgggcctcctggtgctcccccactgccttcccaccctccacttactcccggccatctctcatcccattatgcctcattctgctgtgtctgcccagggatctagatttgtgtatcatctaaggcaaaatatgaggttatataaaaagcagcaaaagttaaaggaaggtagggggagaagatggtgggtcactagcaggccaagggggttttagaaaaccctaggaacttggcttcactagtggctcagacggtaaagaatccgcctgcagtgcaggagatctgggttcaatctctgggtcaggaagatctcctggagaaaggaatggctacccactccagtattcttgcttggagaatcccatggacaatggagcctagtgggttgcagtccatggggtcccaaagagttggatgtgtctgaacgactaagcacgcatgaaccaggctgccctgtgataggtaagtgcactcaaagtctattaatatatattcagatttacctttgccacctaggatttaatcatcagaacacagaacactccattcccctttgctaggctctatagaagtaagtaaaatatctattgtttacctaacactgattatatgctaggcataggccagggctgctggtgtgtgtgtgtgtgtgtgtaaactttcacattcagtcctcaaaacaacctggcaatttttttctgttatcattcctattttacaggcaataatcctgagagtctctcagtaagcagcaaatcctaattctaaattgggtcttactcccaaatctttttctttctaccacatcattcattcattcaaaaaaatattagaatgagcaataactctgtgtcaggtactgacagggtctgtgactgcagttcatgcatgtgctaagtcgcttcagttgtgtctgactctttgtgaccccatggactgtggctctccagactccatgggattctccaggcaagaatactggagtgggctgacatgccctcctccaggggaatcttcccaacccagggatggaactcatgtttcttaggtctcctgaattggctgcagtgatgtactcaaaagatcaaagttctatttctggaatttacaactgaggggaagaggcagatattacataaccatccattaagtatgacgtgtgctttttaaagagatggtaaagagaggctgttggtggtca

SEQ ID NO: 53560 - DNA, 3238 bp, Bovine  19866880698015
cccgactcccgtcccacacatccattctctacgtctgcgtctgtattcttgccctgcagataggttcatctgtaccatttttctagattgacagtatgctttaatgtatgatatttgtttttctctttctgacttacttcactttgtatgacagactctacgtccatccacgtctctataaatgacccagtagcattcctttttatggctgagtaatattccattacaataagcctggcatgctgcagttcatggagtctcaaagagtcgagcatgacttagtgactgaacaatattccactgtgtgtgtgtatatattatataccacagttgatggggatgtaaattgatatagccactatgaagaacagtatggagattccttaaaaaaataaaagtagaactaacatatgatccagccatcccactactgggcatacaccctgaaaaaactataattgaaaaagatacatgcaccccagtgttcatcgcagcactatttacaatagccaggacgtgaaagccaccaaaatgcccattaacagatgtgatggtcttttgagagaatcctctcccacttagcacctcactgtgtgctaagcaccagggattcaaaagtgaattaaacccattttctactttgagaagcttacacacagaagaaaagagaaacgtataagcagagctacatattatctcatggatacatatgtacatatgtgttttaatgtatatatatttatgatataaaattttgactctgcattcacatatctaataattattgtaaggcctgatgacataaggtgctatggaaacagggtattaggaaaaaagtcagaagtaactaataatatattacattgatgctcatgcctcacgctagaagtgttgctcttacttattcaatagtttctggacactttgtatgttttatcacattgagaaagtgacatgaatatagccctgtgcttctggcaataatcttccatgaatcatctccactgaagtacaggactctttttaaaactgtgcagaataatgactgtagctggcacttacatagccctcttggccagtcaccacaaggcaggcattttattatggtccttagtgtctaatgagtatactgaagcatagactgtttatttcccttaattaaaaaaaatagcaaaaatagggtcttaacatgacagtctggatcttgatcctaggatctgggtccttttccaagtatctcagaatgctacagaaagagcccagttttcgttaatagaagcaaaaaacaaaaatcaacagatataaaaacatacaaacaataaaaagaaacaaaacaaagttgaatttattacttccttgtcaggtcagggaacacacaccaatggggaaaaattactgaatagatggcagagagaaaagttaagagtttttaagtgcaaaaaggggaaggtcagctaggagaatgaagtctgaagactgtgttctgcataggaaggaataaattcataggtttgcacaaagttgttcattgactagaaaagaggagaaaacatcacattggaccaagtcagagcttgccatgatgccagtctattgaaatacaaacttcagttttgatctcccccaggcaggtactggtgagggcatgaatctttcttttcctgctaaattccaagagctgcatgaagtgaacaatataggcaccgggcttgtagatttctagttgggggaaacagaccataaagaagggagttatctcagatgggagtcaatgctatgagaagtgcaagaaggagcaacataatagattgaggagtgagagttgaaggctgtaagaggctactgtttaaagtcacaaaatatgagggacttccctggcggttcagtggttaagactccagttttccaagacagggggcatgggtcccatccctgattggggaactaggatcccacatgccatgcaacactgccaagaattttaaaagattaagtcacagaagatgagaaggttcagccgggagaagataccatcacctgcaggaggaggagtgttctaagcagacaggagcgtgtgcagaagcaggagcgagtttgtgatgtttgatgaagagaaaggaaaccagggtcactgaagggaagcaaatggaggagcaggagtcagagactagttcctgaaggacttcctgatgaactgcaggcaggaggcagagagaagagaggaagtccttaactcatcctggacttggggcttggatggcatctgtgaatggagtttggctctccctctgaaccccaggatgcagccatctgcctgaaggcagcacagggagaggacagagacttcaggacagtttcctgccgtctcatgggcttgctatgtggtcctggagaagtcgatgagctctcttggctgtgattctgcaggacctgcaggttttttctaaaagcagtggcagattaaaaaggagaatccagttcctggtcttagccacatgatattcattaacctagtaccttgaagccagttctttaatctcacatttctcatctgcaaaatgagtatattagttgagctacctacctgcaaggggagttgtgattctccactggaaaaactagtgggaaagcagtttgagacagttgaaaagatacaaattcacaaggaattaatgttattgagctgaccagttcaaagtataaatggcaacacagtgtctaatattttgacacagttattgtcatcatcagctaccacttactgaacgctcactacgtggtaggcactgtagtgaacactttcatgggcagtaatctgtgttggattttagcagcagctcagccattccagtcacttatacaagccatcacgtagcacttacctagggaagctcatctccattgctttttacaagagccccaagagacgagcattgctatctgcattttacaggtgggggaaacaaagatgttggttagattcagtgctcagaagcttgcagcccataagtggaaaaattccagatgtacactcagggctgtttgtctccaaagctgatcatctgaccacaatgtactgcctcctctcagcaaagttctctatagctgtaagcattgctggtacctacaaattacctaatactcagactcagctctttggctgaagagattcaaaagcaaatgtctcctgggcatttacccctgtaccatgttaaacttaggatgggcatagccatgc

SEQ ID NO: 53561 - DNA, 1555 bp, Bovine  19866880946291
tatggatgtaccacaggtttaacatgcattcattcactgacagacattgtttccactttgggcccatatgaataatgccactgtaaatattcacatacatagtttttgtgtggatatactttcagttctctcgggaatagacttagaagtggaatcccttaagtgtcatccctaagcaaggtgactcctgtttaatattttgaggcactgccggattgtttgtgcccaagcaactagaccatttgcaaacctctatcttggacttagctgttcgtgtgctaagaataccaatgctttgtatctttgttgcatgccagctaatcagacaggtggagcaggtgataaatgtagagtggagaattgcagaatcttctcatccctgcagccacgctgggcaccagttcaaacccaatgagttggtccagtgcactgggttcaaacacagaggatcctgggtataggggtcaccagagaacagatgaagttgtttaaccatgaactaaaggcatgatgctatttaatagattcccatgtctgcgcctatatcctatttacatatcatatatcacttgcatttgtttgtctttaatttcagtgacatgtaacaaaattatttgaaaatctatcttttgcagcttctccacttgcttagatctcttttttcctttgcacaatagtcacaatcaagattcttaatccctccaatctctaattggaggttacacgctctaagctgcaaattgtgctcatactgtggccctgggatgttggttggaagttgcacaggacacagtttcattgaagacatcttttctctggaccaagagaaagaatggagctgagcatattcttgccagaaggcccagggatccctctgatcctgatagcagagcatgtaatgggacttttctgaacagagtcagggctgacccttgtcctctatcctccctgccctgattatgtatctcaactgagatggaacttccatgtttatgacaatatctgcctgacagaaagatccgaaaccaaaattaaacacgtaaatgcttcctaaaccacaagagctttgtactaaattaataaatgcttatccatctcagcagtagcaaccctgctgtgtttcaggcagattctctagagtccttcttgctgtgccaacctgagacaaagttagtagatatgcatggggaagaaaaggctactgggctgtgccttctcccactgctgctgctgctaagtcgcttcagtcatgtccgactctgtgcgaccccatggactgtagcctaccaggctcctctgtccatgggattctccaggcaagaatactggagtggattgccattttcttctccgggggatctccccagcccagggatcaaacctgtctcctgcattggcaggtggattctttacctctgtgccaccaagggatcttttttttttcaatctctaccttgtgaattttggtagacctgtgacttcagctagccagaaaaagagaaggagccttttcagaccgccaggtgcacatttttccctttctcctcacacccac

SEQ ID NO: 53562 - DNA, 1510 bp, Bovine  19866880985459
aaatggcatagcctctaggtaggtataccctctattaggcttctgacaaatggtgacatttaaaccagaaagatagccacactgtgactaatgtagtggctgtcattaagatttcccaaaatgtctgtgactcatgtcacagacagtgggctaatctcaaaattatatacaaagaacttctagaaattaatatggaaaagaccagtaaccatggtcaaagaatatgaatatatagttcatagaggaggaaatacagatttttttatattttttatttttatctgtttggtcatcctgtgagccttgtgggatcttagttccctgaccaaggattgaacctccgacccctgcagtagaggcatggagtcctaacgactgggccaccagggaagtcctggtggtcttccaggactggttcttaaactcaactttaccactatcaaaaaaaatttttaaacagtaaagcaaatttaaagataccaagatgccactttttgaactcctagtttactgaaaaatctaaaaatttggtaatacgttctgctggtaatgctgaggccctctcaggctttactggtggcagcccagatggatacagccccctacagacacctacttggcagtcttgactcagttcctggaacagaaatggctaagtgttcaccaagattcatttttcccttccatagtaatacagatgcaactggaaagtggctaggcagatacagaaagcactcttcagctcccctgccagacacattgcacgttctttccagtgggatatgagtagaaaagtagcgtgtgcaaatgcttgtgcatgtgtgtgtgcctgtttgcaaaggtggccaaaaattcttcccctccctgtgcctgggtcatgacttggcagcccctcccaggaagagaagtccgtcttaacttcctgaatctggcctgcccttattgcttactgccagtgcaacagtaagagacgtgctaggagcagagacctgaaagcgcttgcattggagctcactctcctgctgctgttggaagactgctgctgtgataggaacaagcctgggccagcccgtcaaaggatggaggaccatgcagagagaagccccggtcatctgagctgtcaggactggcatgtagtagctttgccagctggtccacaggtgctgaacaggaacagccaagagatcagccataccgggtcagatccagaccagcccgactgagtcaggccagattgcccacctgcacctataagccactatattaggagtgatttgttacacagcagtgctaactgatacaacgtcctacttccaggacaaggtttctcggaactacgtatacagatgtggacctgggaaagcagtggtggaacggaccttgattcagaactgacctaactcccagaagggtagtgggggcatgtgctagagatgtgtgttagagatgaccttgttctgtgtttggcagaaagaggtctgttacctgcgatgcttgttggaaacagaag

SEQ ID NO: 53563 - DNA, 2144 bp, Bovine  19866881107714
cacctggcacctgaagaacactccaataaatggtagatggacaaaaagaaggaaggaggataggaaagaaaagaaggagtaaagaaaggaactaaccgcaatgctcctggaatataatctccctaaaaacaacacctttgtcctttgttagctctcatgtatccaatgggacgaggacattgcccggcactggtagaaactattgaatgaagagatgcatgactgaaaaataagccaagccaccactgggaaaactggctcctaaagatacttactcactgacagatgaaactgctctcagattgctttctggtctgtttattctcccaaattattcaggtattttaatcttcatataatccaaaatgagggccagtaagaaaaatgagtgtctcctgtgcgctaagccacaaacaaaattcaggggatgcaagaagacaaggtcactgccctccaagagcacgaagatccagaaccctgcctggactgaatagcagtccagggtgacagcagctcagggagaaggaacaccaccctcggcttcaaggattgctgagaagggacacccatcccaactggagtgtactctgatagcaaggcagagactgacagcatcaattaatccctctgtgatcccagtgtcagaaatgtaagccttttatgatgcagtaaaacaatttttatgggtttttccatccgtttcatgtcttgacgtattttttaatcaaaagggataagaacaggaagtcaagtgggtataaatctcttgctcgtttctctggttctctgtcccccgccccccggcccagggaggaaaggtgagcctccagtgccctagagcagactgtcctgtcatccctgggcatattttccagaaagaaacccttattctagttgtagagtcatgggctttgctttcaacaataaacacgttctccaaaggcaattccatagatggaatcccagtaaatcaaatctcatgtttccaataactttacacgtatattacctttatttccgaggacaaaaccaaaaagtgttccttgcatgaaacgtgcaaagcagaaaaagcatagacacaaaaacaaaaactacttgcaatcttaccaccttgagataatattagactgtaatcagacttttataacatgtttggatatacagacacatgtcttgacaaaaatagggtaacggtagaaatattatgtaacccacttttaacagcttatctatgaaagactggaaagactgaaggcgggagaagggggcggcaggatgagatgattttatggtatcaccaactcaatggacatgagtttgagtaaactctgggagatagtgaaggacagggaggtctggcatgctgcagtccgtagggtatcaaagagtcagagaggactgagtggctgaacaacaacagcagcaatatgccaattctacatcttatttattagtttcatattattctgttatatgaacacaccaaaatttaacaagcctttgtttttagaagttgggttcgtctgaaattttttcttgtcataaataatggtaagatctccctgttttcttctgctatgattttctagaaattgaatgtgctatgtcctgattcactttgctgtacagtagaaactataacaattatactccaaacaaatttttaaaaagtgctatgttacatacacacacacacacacacacatatataaatatatatatatatatatatatagtgttttaaaaattagatacattttgtcaaactgtcctacaaaaatgcttttgtaatttatagtatctccagcaagaagggtctacatttttaaaatctttaccatcactgaaactgtgtatataaattactgccagtgcttaatccccgttatatttttccttttttgattacttgtgccatagaaattttcacatgtgtcaactgagttgtagtccatgacagatttagagggcaccaaactcttcttagaaaagatggcatttttacttttaatctttgcattaattattatcaatattaatatatttatttagtatgtattaatggaaatgctctcccatatgaccagtagtccagcaaaagtttgggggaggaaaggatggatggtaagcaggtaaggacagtg

SEQ ID NO: 53564 - DNA, 1337 bp, Bovine  19866881251066
tagaagctgctgcagggaacaagtgagatgggcaaaggagcctagcactccctggagatggatggtggtgatggtcgtataacattgtgaatgtacctaatgccattgaactgtacacttaaagacggttaaaatggcatttttatgttttgtatattttaccaccagaaaaaagaaaaaaagagcctagcactgtacacctgacacatggtacataccctgtaaacacagattctctcctgtttttccccagataaatgacaacctactgagggttagctgatagatggtgtttgtacaacctgtgtcatttatctttacagaaacaaagcagatcctctccaactttattatgggtatgtctttgccaatttgctttatacctcctgacaagccatatgagctcattgcagtattgctggttttaatagctttctttggcccaatgcattagacacaggtagaaactaaggtgaaggctgtgctgacgctgggtgttcaagatggggccccaggagccttcaagttcataagaaactaattgtcagaggttgcttcctcctcctctctaccctctttttagtgttgggggcggtttatgggagagacttgagtgaatggggtgattgtataggaagggaagggatttcctggtagctcagtggaaagaatctacctgccagtgcaggagatgcgggtttgatccctgggtcagaaagatcccctggagaaggaaatggcaacccacttcagtattcttgtccaggggaaatcccatggacagaggagcctggtgggctacagttcatgggtttgcaaagagttgaacagagcacactctaccacacaggaacggcaattgtcattttatacacctttgtatttttaaaaatgttaaaaacaactaaatgtattattcgggtaaaaataaattagtaaaagtctaaaaagaaaagtacattcttggcttagctgaatagcttaggagcgagtgtctactaactggttggtgagcatatgcagagaacgcacacggcacagaacacaacagcgagaaggacaccctgcaggctattgcagttaatttggtggacggaaccatggcacccatgggctcccaaatcaatcctcctcaggaagcttagctcagcagaacagtcggtggagaaaactccgggcggctgaaaaatgatcttacttgatacctagtacatacatttctaagactgttggaaagaaactgattccccaaatcacacatgaatgtcagcactgagactttttaaaaaaacttattccagggaacatattggagaaaaaagaatatttactatttt

SEQ ID NO: 53565 - DNA, 937 bp, Bovine  19866881648303
cagtttgggccgcagtgcttctgtggccttaagatggtctaatgccaatgccaaccgtctgggccagcagctctcctggcttctggtttcccagtagcgagaaggactttcggctccccctctcccagtgcgtggcagtgagggccactcacctgaatgtgaagagggtccccatgtctagcatcgagagcagctctgcctttgacttggggaaggagagccggtagcgcagtgtctcaaacgcggggacgatcatggccttcttggtgttggcgaggtccagctggatgacagacttcctggagagagggtaggcagagagacagggcccctgtaatgccaggtaggggctgccccatgtgagggcgtggaggtggctggcacaaggaggggtcagagagaaagccaggggaagcctctcagtttaaacacaagggaatccaagacccgagggaggcctggaagcttgtccagcagcactcaggagcctggctgtctctgggccagaaggcagagtctttctggagaggaagtggagggggttgtacattcacagtgtgtgcccctgtcagagccaagtgcaaaagccaagagaccaggattcaaagatgtgcagaccagcctgcttgctgggtcccctgggctggccacacgcctgatgcatcactggccacaaggagagctagacataacgctgatgagatgattgtcaacctgggcatctgtggtcccatctctgggactcttcactccttggactccttccgatgctaaaccttcaaacttgcctgacacaccccacagagtcagcacccaacatgccagtgctctggaccccgccatcctctctctcactcttgccttctgcatctccgagacccagctcctgtcttctggatttgtctgcctggggccagctctgaggccatcatttgaa

SEQ ID NO: 53566 - DNA, 773 bp, Bovine  19866881818488
aagcgggggctgagttttggaaaaactgcagagtgggtttagctgctgctgaaggaaggaagtgccacagctggtatggagaaaggacatagggacaggaagcaaaaggaacgggcaagtctttctttctccccctcctgactgtctccctctcatgaataggaagtggctggcagagcagaagtagagtttgcagagccctggcttcagcatcacaaaacaggtttggagctgagaggcaaaagcttaaaagactgatctcagctggagctgtcactattcagtttcacagatgaggaaactgaggcacagagagattcagcaatctgcccaagattaaaccactacctagagcagagccaggatttgactccaggcagtctggcttcagcaccctggctcttaacccctggaccataaatgctgaatgatgaatggatggatgaatgaatgggcaggtgggtggatggatggatggatggatgggaaggccccaagatagtgcttagaccagtgcccagccatgcttcccacaagcacaggtcctcctggcctgactgtctttgttgcccaccaggtcattcactggaactcccccaagaagctgcgggtgaagaacaagcacgtggagtttttccgcaacctctacctgaccttcctggagtatgatgggaacctcctgcgacgggagttgtttggctgccccagtgaggctgacgtcaacagtgaaaacgtgagtggccccagggcttggccatgcaggcaggggggcc

SEQ ID NO: 53567 - DNA, 725 bp, Bovine  19866882003357
ttattaactagctgctgacaagtggagctggaaggtgaattatgggccttcacagaaggagatggctgaataaactatcttctctggacatggacatgcaattgctagcttttggggacacactcaagtcactgtgacccgacttgaaatatgatgatggaggacaatttccccctcaggtttaaaacagctacctgggtaatttttaactcatccattataccatatctcctgtatgaaaaaggaaattagtttctggctgcttgggaaatactgaataataacaatgctaaaaaaaaaaaatagtaaagtaaccctacagagtttcttgttttccttcatactagaaaactctgtaagaattcaatgaatcaggcagctgaatgatgagcaaaaacaaggagagtgggcttgctttttggttgaacaggaaagaataacacgcaacgaactcagagatatctttacattctgagatggccacatataacatggggatctcagaatcaagatgtgtgaccctagtagattcaaagtcaaaggctcagcagaaatgagaaatggggggttttaggaatttatgttagttgcttgctggagttcatggactttttcagactgcctggattaaaagctgatttcaccagccaaggaggtttgtcccttctatttaaatccattcccccttgaggatgggggtcacagtacaggaacctaagcaaaag

SEQ ID NO: 53568 - DNA, 3940 bp, Bovine  19866880600976
tttgaaagaggaagaaataacatatttataaacatgtacatttgcattctggaatagtttttttgtgtgtgtgtgaatctttaaaagttcttctttaatttaaaataaaaatcaacatctgatcttgccataagaatttctctatcgagatataattgatatagaacatgttaggcatacaattcaatcatttgctatttgtgtataatacaaaatgatcatcaccaaaagtctagttaacattcactataatgcacactcacaaatttttttttcttgtgatgagaactttcaatatttactctgggcaacttttaagcatgcaatacagtattatcaactgtatttaccaagttatgtgttacattactataggttattttttataattggaaatccataccctttgaaccaacttcattcatgtcatctacttcctacctactacccgactgggcaaccaataccctgttctctgtatgtatgagctccttgtatttttttttttttaaagattgcacaaataagtaagattatagattatcttactctaatttcactttgcataatgttctcaaagtccatcagtgttatcacaaataggttatttatgcaaaatattttgacaacattatctaaccacttgatatgaaatatggaaaaataaagtatgatagatttctgttgtgttgttcagtcactcagtcatgtccactctttgtgatcccatggactgtagcacaccaggcttatctgtccttcaccatctcccagagcttgctcaatctcatgtccattgagtcagtgatgccattcaaccatctcaccctatgtcaggcccttctcctatctttaatctttcccagcatcagggtcttttccaatgagtcagctctttgcatcgaatggccacaaatattggagtttcagcttcagcatcagtccttccaatgaatattcacactgatttcctttaggattgactggtttgacttccttgtagtccaaaggactctaaagatcccaggaacctatgataaaactaaaagtacatgctaaaattaataaaatatcatcattattctgaaaaatattcccttatttgatttgttgcagtgtgtcctataacagccaggaactttgggagtaaatacagtcctgtcctgacttagtcaccatggcatttagagacattggcatttacttctgagttcctcatatttaaatccaattagtatttcataagctggaatcaagattactaggagaaatatcaataacctcaaatatgcagatgacaccacccttatggcagaaagtaaagaggaactaaagagcctcttgatgaaggtggaagaggagagtgaaaaagttggtttcaaattcaacattcaaaaaactaagatcatgtcatctggtcccatcacttcttagcaaatagatagagaaacaatggaaacagtgacagactttattttcttgggccccaaaatcactgcagatggtgactgaagccatgaaattaaaggccgcttgctcctaggaagaaaagctatgacaaacttagacaacatatcagaaagcagagaaattactttgctgtcaaatgtcaatataatcaaagctatggtttttccagcatcatgtatggatgtgagagttggaccataaagaaagctgatctcagaatatttgatgcttttgaactgtggtgttggagaagacttgagagtccattggactgcaaggaaataaaaccagtcaatcttgaaggaaataaaccctgaattttcattggaaggactgatgctgaagctcctataatttggccacctgatacaaagaactggctcattggaaaagaccctgatgttggaaagactgaaggcaggaggagaaggggacagcagaggttgaaatgactggatggtatcaccaacatgatggacatgagtttgagaaaactctgggaggtggtgaagtacagggaagtctggtgtgctgcagtccatgggatctcaaagagttggacataactgagtgactgaatagcaacaaagtactgcatatatactccacaattttttttaaagcatgatttagttatattttacattttaatactacagaaaataaaaattatattttaatgtacaaattaaggtggacatcatactcttatgactctacaagtagagaaataaaagctcagcaatggttttatttcaagaaggtaatttgacaaatgactaaaaattaattagtgataattcctaaacaagagctgtgaacttgcttaactttcatgaatgattcttcatgttttcttttgagaaatacttaatgaattttcttatgctaaattgatgcagtcatcaatatggatagtcatttttcatgcctgctctttaaccattaatataacacaaacccatgaattatctcacattttttacatggtaaacaattgcctcaaatattatattttgcaaagtaagataaattgtaatttcaaaagtgtattcctttcctttaatttagtgttgttaaaatctgtgtatctttccttttgaaaagaatagaatcagcttcagttctgttcagtcacttagtcatgtccgactctttgggaccccatgaaccacagaatgccaggcctccctgtccatcaccaactcctggagttcacccaaacccatgtccattgagctggtgatgccatccaaccatctcatcctctgttgtccccttctcctcctgccctcaatctttcccagcatcagggtcttttccaatgagtcagctcttcgcatcaggtggtcaaagtattgtagtttcaacctcagcatcagtccttccagtgaatattcaggactgatttcttttaggatggactggttggcttacttgatagaaataaatatttctcatgtaaaagtggatattgcacagaagtagttaatttttttctcaaagcttttccagtatattagttgactgtatgttccattaagtatgcacattgaggagtagaatgcattcatatattaatagctttacttcattagtaaatttatattcatacttaccacaagatttcataaaattgcagttttagtacaaagaacaaaagcaattgtgtaacaagggcattaagctgtctagtgaactggaatcctgaagttaaattaaatagtgtagcatgtttacatgccaggaagaatatgaaaatgaagtccaaatatacagaaaaacaattgcaaatgcatcagcaaattaccagtaaaagaatgttcgcatgttgcataatgcaaaagtgttacttattcatgcatttaactattgtgctactaattcataaatataaattatgtatatcctattcctctagtgctataagcacttaatgttaaatttgtgcagaatacaaatattacctatgcacttcaaagtattaaaactttgaaatattttgcttcacttctttttgtcagcagagaaattatttatttagtgtctttgcttaaaagaatgaaaattctatgctaagtcacaaattggcttttgctaaggggattataactcttagacattccagtcaatctaagcggagtgtatggctataatttacagtttgcagtaaagattcaaaaattggtaagttatataattggactagttgcttgtgattaaacatttcaaaaaattatgtatgtacattgtttttgttgttggtcttatccattttttaaatttatttattttttattgaagggtaattgcttaacagaattttgttgttttctgtcaaacctcaaacatgaatcatccctaggtatacagaggttcaaaagggaggggattttgtatacttatggctatccattttaaatataactgtgtgcatgtttatctattacaaaccatttccagtactttt

SEQ ID NO: 53569 - DNA, 799 bp, Bovine  19866880617946
ccccttttattaataactgaagtatgctttaaaaaagtggcaagggaaattggaaaaaataatttttagttgaaactgaacatcccaggaaaatatcactacttaagggtattttggatgtaaaattgtattcaaatttattcctagtaataaagcagatatttgcgggaaaatgaaattatgaaattcgggagttgtttttttaatcaaaaatcatagtttacttatagtctatatgttctaatatcaaattgcctatgaaatggctatcctttaatatatttgttagttgggagaactagtttggttttctgaaaaattcacacgttcaatttacaaagtttttaatgcagttgtttttagtaaaataatgcataccctttagctgtttatattggaattaactgttaagacttgtatttgaaaaaaaagatataagttaattaacctaacaaatgagcacagaagaagctggatacatctacaggtggtaaatcatttcaactgtgagggaaatgggaaagtaaaagtgatagccagctgttcaaagcagtgctaattttacacagtaagctggaactcaaaatccaagttaaagcttaatgcaatctcttcaaggcagcagatgcttatggggaaaaaaataacagaacaatttgttgcagaaaattacattgatattatgatctatgatccagacatcaaagatatcttgtaatcaatagtttactattacaaatacagtttgattgcactggcacagaaaattaaaattctgtattaaaaatgccatagtaaa

SEQ ID NO: 53570 - DNA, 1116 bp, Bovine  19866880728099
actgactcattagaaaagaccctgatgctgagaaagattgaaggcaggaggagaagggaatgacagaggatgagatggttggatggcatcaccaattcaatgcacatgagtttgagtaagctctgggagatgcggatggacagggaagcctggtgtggtgcagtccatggggtctcaaagagtcaagacacaactgagtgactgaaaaacaacaacaacaatgaatataccatattttgtttacttgcttgtcagtaatagacactggaccattttcattttgtgatcattataaataatgcttctgtaaacattcgtgaagatatttttacgtggacatatattttcaatgctctttgacaaataattagtactgacatatttgataactcaatgttcaacatttttaagaactttgaaattgtttttcatagtggctgaataataatcttatcatcaatgtatcaaggttccaatttttctgcatgattgcaattcttattttctggtatttaaaaattttacttatccaagtgggtatgaatgaaatatcagtgagattttgatttccatttctctaatgactaatgtgctgtggtaaatcacatcagtcatgtccgactctttgtgaccctttgaactgtagccagccaggctcctttgtccatcaaattctcctgacaaggatactggagtgggtcatcatgccctcctctaggggatcttcccaactcagggatcaaactctcgtctcttaatctcctgcactggcaggtgtgtactttatcactagcaccacctggaattttgaggattatttcatggatgcattgcccatttgtataagttctctagccaaataaatgcattgtttttcttttgttgcttgtgtgagtataagagaatgtatcattttttttcataattcttagggtagttgtattgaagaaagttctttttcttaaattggattttgcaaagcatttggttacagccttcagaacagcagggaagacttagtgagattaagcaataataataagatcaattctagctctttattatttaaatatgttttccatatttagaaggatgataggacaaattcattattgg

SEQ ID NO: 53571 - DNA, 1558 bp, Bovine  19866880735095
tgactgaatataagagaaagaccaacttcactagtttattaaactggaccttatcacaattgttaaaaagcttttgctttggtcattgcaaccacctagttgtttaatttcactgtacccatatctctgaaaatgcatatctcagaaaaagtacacatatctcataaaaattaattttaaacatgaatagaacaattttctaaaattattttcagagtttcttttaatatggtccattaatgataaattgttaaattaactttgtgataaattataaaaattaatgttagtatgtttgtgtttaggaacaattcagaataaatacagaaaaattaagtcctaatagattggtactattcaaagaataattcacacaatttaccatttcattcaaaatcacattggccatcataatcggcttcaagtttgacttgctacagtaatggctatattaaagatgtcactattgctttggaaaagtagagacaaatttattaactggaaaacgtcaacaatgtaaaaatgtttgtatgaatattgggagaacaggaatgtaaaaattattttcgagaaatcccgtgtaggtaatgaaagtcataatacaaacatggaagcagagtgctaatcttcagaaaataatttacataagctctgataatatttgataagttgctgaagtttttgacgtttgtagtaaatcagttttaaaaaatatgaatcaaattttatatgaagcagtatcacagaataagtaaatggaaatatgtgtcttgatggcttgagtttatatgaatgcatgcaataaagtacaatattcatacagatctattgtgaaactaattactgtgactacagaactaaagctatcttagaataaagatgtatctttattacattgttacattttggcccaaaggtcatgtcataaattaaagctgaaattagttcagcagggtcccattactttttcttagcatgaaactttaataatatgacttagattgaccttcttcctctattgtttcaagatatcttgttaatattcctccttggtattatatctttctcatcagcatatacttttttctctcaaactatgcattttagcttcagttgcaccttattcagcttgccatctgttgaacatttggatttcagctgcatatgctggcctaactattctgtagggaaattttgccaaatgaccattctttctccagtcattcctaaaaccactgtcatgtgcaggtgttcttactttctagaaaataagtttactatatttagaaattaatgctttcagtaaacaaatgacatgataattaaaaatatttactaaaatcattccatgtacaaagtatgtgttgaaactaatataattgctgtttttgtctgttctaactgaaatcagaaatacaatattcagaaaaacaatacaaatcaaattccctaaaacatcagttttggcaagacagctagtaattttcatgcataaaatgtttgtcctcattttctgctgtaaaaaaaaaaaaaattacataaggtttttttctctctc

SEQ ID NO: 53572 - DNA, 1598 bp, Bovine  19866880802237
tatctgaaaaaaaaaaaaaagtgccaaaatgataaactgccaagttaagagacttaattaagggaaatttataccagtttaattgcttctgatctcatattatttttatcttaattaattacctctgctttgggcaaaataaaaagaactgaagtaactgaaagaagaattaataaaactccagtcaacttaattgcttgttattcttttaaacttatttgggagaagaaaatgagtggttagactcagttttgcaaataggtctcagttacacatatgattctttactcaatttttataagcggtcaagtttaagtcattttaaaaaaatggttggtaaggggccaaattgcaatttttattggttatatataaggaaggaaatttcaggaaaacctcctcaaaggttttagttaggactctaagctattttctaccaaagctgaacattgtgggcttaattgattttccccttcccttcttgaggaagtgatgatgtgatgtaataaaaaagaaaacaaatatttgtagtgcaaattattgataactaactccaggtatttctatggttattttgtatgttttaacagaatctaacaaattatatctagctcataaatttctaagtgagatgagtgaaattatgactcggattgtccataattgattgtatagttcatatgaaaataagatagcgttctctagatctgataatgttagagggtatcacagacagagcagattaatacagtaagaaatgtaaaactaaaatggagatttcattttcttggtaacaaatgaccttttcactgaatagatgatctaaaaatatttttctcaaggaaaaaaaaagttgaattgacttgtttaatcaacagtcccaaagaactacatattgctgtctgcaaagcagatggctttcctgctgcctgtcctgctgcttctgcctgccacctttttctctagcagctgtgattactaggaagaaaacaaaacaaaacaaaaactctattgcttacatgatgtatccataactgcactcagacttttaaaaagttatttttttcatacaaaagtgagaaatatatataaatttaatggcaagcatacccataaatcttccaacattttaaaaccaaaaattctaaaacttgggcaacaggtcaaataatttattcagtgttactttaaccattctcctctcacatctctcctgctttccagaatgtccctaacacagtgagactcaacaacactctgtgttgctgtcatattaatcttttttcaatggaaagttatttggagagttaatgcaacaggataaggaaggtcatgagtagttggttgggtttaaatgttcttatagatatgtattttcatgatacatgaagattcgttataggtatgcacaagccatttcattagatttttctgtctgctatataactaaataaaccaaacacttgttgattaaaagaataaaacattggagatttatttttgtcattgaaaaatattctaatctgaaaattttggctaagactctataatatcttaaccaatttaaataaaagacattatatttcacttcctaaaat

SEQ ID NO: 53573 - DNA, 1611 bp, Bovine  19866881201728
aacttgatactcattaggttgacaaaaatttgcttatcccttaggtagaaagctaattggtggtggcagggaagtgatgcatttaggataacagggattgtgtcattacaagctagttctacagacatatcccttgtcattaacaactctctggcaattggaaaaaaaagaggttttcagttgtcattctgaaattggtggataaattctgcctacagccattggctatagctctatgttatcttcaccattaactgcaaggaagactgaggaaaggagttcagctcagagttcagaaggaatgcaatctgaattttgtcaacagataactggtttcttttatgtttgaataatcatggctttaatggatgttaataaattgactctaaagatttgtgtgtatttaaatttatattaaaaggaaaatattttctctctgtataacatttaaaaaatcaaattacttttggtaataaaactagtaatgaaaaaatagaaaaatctagtctctaaaaaatgtgaaagaacacaacctattctttttgtacgactgaattttctattttaaacatcttaaatatacagaatgtcttcctaagtgaaaaaaaaaaagatatacatacatttatcctgaaatttattcccattttgatggtatatgattttaaaatttctctcctagaaattgtgtgacacagcctacttaagttatagatgagaaggctgaagtttaagtcatagttcagtttagctcagttgtgtccgactctttgcgaccccatgaatcacagcaagccaggcctccctgtccatcatcaactgactcccagaattcactcagactcacgtccatcgagtggtgatgccatccagccatctcatcctctgtcatccccttctcctcctgcccccaatgcctcccagcatcagagtatttttcaatgagtcaactcttctcatgaggtggccaaagtactggagtttcagctttagcatcattccttccaaagaaatcccagggctgatctcctttagaatggactggttggatctccttgcagtccaacggactctcaatagtcttctccaacaccacagttcaaaagcatcaatttttcagtgctcaactctcacatccatacatgactactggaaaaaccatagccttgactagatggacatttgttggcaagtcataagacaacctacaaactggcagagaaaaaaagcaaacagtatctataaccctacagtcttgttctttttgctgcttcgtattatcttgtgacatgtatgttatcttgttctcaactatagtaatttcaaaatggcacatcaagttgtacatatttacaacagcacataaaatgtaaaaaggcccatgagtgttaaattcaagtgatttccaacataaatatgtttatatcagttatttttaatcacttacttgaaaatattcctgccagaaagggagtataagaggtatggtctattacacactgtataattgaacattcccacatgctgaactcacaaattcaacattttataattgcccatgctcattgtttacgtgaagaaatgtcagtgcattaaagaacttctattaaa

SEQ ID NO: 53574 - DNA, 1136 bp, Bovine  19866881252452
gggaggaataaaatttaattaccattattagttattccctaattctatgccacatggattgcaaagagatcctcatttttacatattggcttatgattgaaaacactacactttgtttttaggaatgtgaaattaaaagatatatctgcatgataatcatattttgaaattagatggcatgagaataagtggacagagatagtagctaccaatataaaataaatctgggacctgcaaggatttaaccacatctagaataactttttagtgctactgatatatcctcattatttgaaatgcaacagagagatgaaatttaatgttccttagctatagcgctagagagtgaaacaaacaaacaaaaaatagccaaagatccttgatgctacataatgtggaaaggatattttaatagagcaatatgattttaaatactcattaatattattaaataaatatgaatcacatttaaaaaattctgttagtactatgcctaaatctaggatctttcacactgaattaaatgactagcaatcattaatgccagccagctatgctaacactgaaaatcatgcaaacttactaaagattttgactaataagaaaggaaattttattacagaatattaaaagcagctgcaaatgtctacttttaaattggaatatatcctgttaaattaaccatcaataacataaaaagtaccctggaatccagaaataaaaccttgtatttacggtttaataaagttttttttttttttaaggaacttatttttctgaaaagtaaagatttacaaaaatatttcaaaagaaagttttgtcatcaaaggagacagcaattaaacttcagtatacttattagggaattatcatttcagtaataaatcacataaactgcatcatgccaatagataaataatgaagatgccactgtcaatgaaaagatgaaatattaaataaggtccaaaatatacctgggggtgatctaaatttttaaaaatagggttaactttccttggaggcaaattttacattggagggtatgataagggataatgtagaaacctgtgtgtaaatttaataccggtgaatattttggcatagcattattcaaaatataatccacagactcattt

SEQ ID NO: 53575 - DNA, 1871 bp, Bovine  19866880355179
accacacagttatcaagaactgcccccctgtccccgcctgctgatgctgagcagagcctggtcgacatctgatgccacagttgtcaggaaaagagaataacacaggggtgatgtctggggatgcctctggagggggaggggctggtgcccagctgaggcctccaggggtggaagagggagagtctgtaggagccagaggggacatcaggacagctgggagagcctccagggcaggctcgggcctggcccaggaccacgtcagagagtgggtggggctgagctgaggctgtgtggctgaggggggcagcgcagcagggcagggctttgtgacaagaccacggctcctgcagttgcctccacagtgccggcctgggacagagagtcctgctggctttagggaggtgacttagaccagctcaatgcccccaaacatgagcctccaaccaagagaaccttgtgtcctcctgggccagggagctggaccacccaccaacagtggcagagaaatagtgctgaagtgaagaactcttgtaggtcaaacctgtcccacccaccatcccccttcaatcctgtatccttatccccatcaatttttttaatttatttttttattgaaggataattgctttatagaattttgttgttttctgtcaaacctcaacatgaatcatccataggtgtgtatatatatatataatggcatccgttcagtgccagcccctgcagagaccctgccaagcatgataatccttgggggcaagaactctgcctatcttgttcgcagctatacccccaggacccagagcaggggctggcacagagacgttcaataagcatttgttggatgacagaataaactcattttgttctcacaagcacctgagaggcagacactgtcactcccattttctagatgaagaaaatgaagctcagagaagggaagtgagtagcctgctttcctggaactcaaactggagcctgggtttgctcctcgccaagcactagagacaggggaaaactgagctttgaggccaatcgtttcccttctctgagcctcactttcctcatctgtgaaatgggactatatttacatgttggggatgattaagtccatctgtgtaaagtcaaatgtcagacaaatgtatgctcctttcatccttctcctccttgagttagccctgatagtctaaacttccacacagccacacctgggacacatgaggattgcaagtctcccttctttctgtacaacaggaaggaggtgtatttgtctgctggggctgctgcaacaaagtgccgaagcggcttaaaagaacaggaatttattgtctcacagctctggagactagcagtctgaaatcaagatgctggcagggccacactctctctgaaggctctggggggtgagtccttcttcgcctcttcctgcttctggggcttgccggtgatcctggcagtccttgtcatatagacacatcactccactctctccctctgtcttcacacagcagtctttcccgtcccttctccccgtcttcacatggtgttatcctctctgggtctgtctcctccttatgatgacaccagccacactggatttagggtccaccctactccactatgacctaatcttaactaattgcatctgcaaagactttgtttcaaaaaaaaaaaaaaaaaaatccaaagctaaggtttcaggaagagcgtaaactttggggggtggggaacactattcaacccactacaagaggtgtactagaaaaggtggggggtttggagacctgcaggaagggcttcagattctgcctctttcaccaggaggctggactgtaaactgctctgagtctggactgtagactgcactgagt

SEQ ID NO: 53576 - DNA, 1451 bp, Bovine  19866880417018
aatggtcctaccagtctttgtcatatgtacacatgacatggtttgccacacgcatgtgaccttcacaccacagcactagcagttggacccatctgctcgatcatatatatggatgcaaatccacaaatggtgtgtgtcccattacacacgggactgggaaataattataggtggggagacttgccctgtcccttgctcctaactgccacagcccctctaatccagttagaagacagaagggtctgtgggggccgcactttatcctccttcacctcaaatccccccaacatataccctgagctgatgtcagaaccttactactcatgaccccaaaccccccacttctagagcttaggaaagctttgacccatttgaaggtttattttctttgagctgcctgacctactgtgagcccctgcttaggggagtcacagaatcctgaaatgcccctgtcatttcacagatgaggaccctaaagtccagaccctacgtctctgggtgggaaggaaggtcttgcaacctcagtgaaaattcctctgctggtctcacaccagtccagtatctgaaccctgttgatctaggaagtaattttacgtagcctctctccctagagaattggaccaagttgcttgcaacaattttgtggtccttggggaccaacagactccaggagccatcccatctatcccaccacagacaaggaagaggaagtcagcctccagcagcactccccaggggatctcctggaacgatcctgagcccttgccccaccctggtccagactccagagcccagagcgaggcagcagctgtccttggtactgaaaagagaagctccgtttgatcaaaggcaagaacagccaaagatggccctgtgtggacccagctgaaggccaggccaaaacccacctgtgtcctgggaacccaaaactctgaccccactttcctctctgctcccacaacctaaagaatgttagatctagaaggaagctgggagacagacttttaaccaccattttacagaagaaacagaggcccagagggaaagtgaatttctcaaggtccctcaagtgagagccaggactagtcctctaaagtttcagggtgagtttttggaggcctttctaggacaacatgaggaaaataaaatggaaggaacaggcaaaaagcaagggaactagaggggaggctggtgcaatcatccaggctttgaaatgaagaggagggaacgggcaaggctcaagtcaatgagaggtatggaagatcctgtgatgggcagacccagaacccagaagactgggtcccagagaggggtctgtccccactttacacagccctgcccttcagggaactgggccatcccagaaggggcagcagggtcatgctgctaggatcttaccccggcacagagcttccagggccagtgcccacagtgatcagccccatacctcc

SEQ ID NO: 53577 - DNA, 3299 bp, Bovine  19866880427346
tccctggtggctcagatggtaaagcgtctgtctacaatgtgggagacctgggttcgatccctgggttgggaagattccctggagaaggaaatggcagcccactccagaactcttgccgagaaaatgacatagtagagtttagatgcctaggatttaatatcaatgtcagttttgccctttgctagtaaaggtatcttgggtaaactatttaacctttctgggcttcagtttcctcatctgtaaaatggggagaataatacaattactttgcaggagtgctgtttggaggaaattagttattaaaggcaaagcacttagaatgatgcctggtgtgctgtgcttagtcactcagtcatgtccgactctgtgaccctatgaattgtagcccaccaggttcctctgtccatgggattttcctggcaagattactggagtgggttgccattcccttctccagaggatcttcccaactcagggatcaaacccaggtctcctgctttgcaggcagaatctttactgtctgagccaccagggaagcccaatgcctgctagtaagggctgtatatatgagctactgctatgggcacattgtctctctggcctccagaaactctgaaattgttcacatctctcttaccagcagtgtagggggaacctcctttcctcacatcactgccaatgatagacactctggtaaattttttttttttttttagatttttctctcaatttaaaaattatgacaaatatgtgaaatttatcatcttagtcactttaagtgtatagttctatggcataaagtacattcatattgtacaaccattactgtcatccatctccacaatgcttttttgatcttttaaactgaaactctacacccattaaacaataactccaaactccctccttccctcagctccagcaactaccattctactttcagtttgcgtaattttgactattctaagtgcctcatataagtgtaagcatatatttgtctttttgtgactggtttatttcacttagtagaatgtcctcacgtatcagaatttcctttttttaaggctgaatgatgtattttgtatgtatatacaacttctggcttatccattcattggtaaatgaacacttgggttgcttccacattttagctgttgtaaataatgctgctgtagacatgagtggatcacacggtaattctatttttaattttttgaggaacctccttactattttccacggtgactctaccagtttacatttctatcagctgcacaaaagggtccagcttatccacatccttgccaacgcttgtcattttctgctttcttgattgtgaccatcctaaagggtgtgagaaagtatctcactgtagttttgacttgtatttccctaacgattcgtgagattgagcctcttttcttgtgcgcattggccatctgtatatgttccttacagaaatgtttattcaagtcctttgtccatttttgagttgggctgtttgtttttctgttgttgagttttaggagtcctctacatattctggattttaatctcttatcagatatacaattggaaagtattttgttttgcatattctgtggattgcctttttactctgttgacattgtctatcgatgtacaaattttttaaattttcatgaagtctggattatctattttttcctttttgacctatgcctttcatgttatatccaacaaacccatttcagtgtcatgaaatgttgccccatgttttcttctaagagttttaaagcttttagattttttatttaggcctttgacccatgttaatttttgtatatgatgttaagtaaggatctcccttcattcttttgcatgtagatatccagttttcccagcatgatttgttgaaaagactgttctttccccattaaatcattttggcaccgtggtggccatgtgatcttatccatgcgggtttatttctggtctgtctactctactccattggtctatatgtctgtctttatgccagtaccactcttttttgattactaaacctttgtagtaagtttcaaattcaggaagtctgagtcctccagttttgttctttttctcaagattgttttggccacttggggtcccatgagattatgatggctttttctatgtcttcaaaaacatcatttggaatttgatttggattacatggaatctgtagattactttggctggtatcaacatcttaacaagattaggtcttccaatccatgaacacagtgtaagagacagcctctttccttacaccctgttgtcaattctaaacaaaaaaacaaacagaaaacttttgcccaccttataggtgacacttcatacctgtttttcattggaaagtcttcgatcagtattaaactggaacataggcttaattcttaatgggcattcatatttcttttgtgagttgtcattatgttctttgcttatttctctattggaatagttatctttttttgtattgtaggagcctatatatatatattagagattatatccctaatgtttttctacttcatcgtgactttcaatgttatttattttttgtcctttataagtacttgatttttatgtggttaagtctaccaggctttttcttcataactttagtattttatgtcatgtatagataggccactttttctttaaataataaaaatattcactttgctttagtacttgtgtcatttcactttttacactttatgtttttctccctttgaatttatttgtgtgtaaagagtgagtatgactccaacctctattgttttctaaatggttgatcagctatctcagcaaaatttgattattcgatctttctcccaatgaggactcatgagagaacaagggtaaataaataatcttccaagacagaaagggatgccaataggtcaaaagagtagttctgacaggattccccagagtctgctaccagttaatccctgagaaatcctcttcactgtggtccttcttgctcctcatgggcagaggcaggcaggatgttagagggacagagccagagtctgcactagtagaaagatatccttccagaaggctctgcatgtgcaagacagccttgttcccagctctcagcaatccaggaaaaaattctttcttttttgaagttaacagtaaattgtcttataacttcagatcattgtcagcctcccctcctgtttctctccccccatcattactcaggtcctcagcactgctgtgttaatatgtaattaatctgtgttctttttctacaccgccac

SEQ ID NO: 53578 - DNA, 2349 bp, Bovine  19866880541910
gatggaagcagaggccggtaccctggatttcgaagattttgggaagtgctgacaagattggtgggattcaaggtagagtccattgagtctgagtgtggctccaaagaccgggccagactatttcccagggcaaaggtctcacctggaaaacagtaaaaccagagttagaacagggactagtctggaagaactgcaagggcgctggctcccaagagcctatttgggtggagtaagaggcagcaaaacagagagctctgggctgggccgcaggaggcctgtgcaccagccctggctctggctctcactaggtggccttagtcaagcccagcaccaccctctggacttggatctccttagagactcttccctttggactagatggtctctgagttttcttctggtctggatgtgttaggctctttctgatagaaccttaaaaaaaaaaccaaagaagaaagctcttctgagaagagtctgtcctaacacacaagatgctagagtaggggataaagtgctgaagaagagatacatttgcttacatgagggcactttagaagtggaccctctcagacagcaggacatctcagaaatgcttcctgatgcctggctcaaggcttgtctgcaaaggacctgctcttatgctgcctcccttctttcacatttgcctcgttttatggaaatagtccaaggaagctgtggttgtactgtagtgagaacatgggcacagagcccagaatttgggtcagaatttgactctgctacttagcaggcaaagtgctttcctcagaaccttagtctcctcatctataacatgggagccccctttcttccaaagggcttgtgaacgtcaaaagagaatggctatgaaaacctttgtaaaggggtcctcaccctgacatttctacaccctggtcatggcccaaccccaggcagcagcccctaatcactggactacaaaaccagaaacagactccctcctgtagttggcttctgctcatatcaagtcagaactggccaccgcattctctgtttatgggagatgtcttgggtgctggaccacatcacactgtccttggtggcttttcttaaacactgagtattaagataatgcttgaaattcatttcgggcctctgatgaacacttaattcaaagaaattgccggggcacagactaagacctcttcggcgagatggtttaggatttcaggactactttctaattctcacttaaaattgcttggtaaactatgggataacagtcaaatctggcctgagacagctattcatccatatgaaatttggaaatttaactgatgaagccctttcctcgaaatggtcctgaagagagaagtctctgagcttccagaatacctaaaccatatcctacctcatttctgcagatgaggtttcagattcctgtttttcaggaaagatgcttatagcaatgtcccactttgagacacgcacaggagtccaatataagaaataggatgcctgggttccatctctcagctcctgactttcactatgtatatgagtcaaggtaactcgtttgtcttttctgagtactagtctcttcatctgtaaaatggggaaaactcaccctctgttatgcttagaacattaactgagaaaacagaatgggatggctgttacaacagtatggagttgcattttattcttcattcagagttacagtggtacaccgaagttctctgtagtagctcaagaaaaagatgaactctactttctgtatttatcggcatggtggtaatctcacctttctagtactccttttactcagctaagactgggttagtaccactgacttcacatgagctaacagatgtgaagaataattatgatgacaatgccaggggctcaccagatgctgatgcaaaatcagttaagtgtctctagtcttggcaatgctaagaatgctaactgaaatctggattctgagttgaggggtctggaaatctggactggtggcacctggactaggcagggtcattaaatcttaacctaatgagatgaagaaaaatgaagcatagtgcccaaggctctgggaggttctagtctgcttaaggctgatcaaatgaggcccaggctgccttcagtagaggaatgccagggcagaagactgcaatgctttccagctgtgctccacagagccctgcagtacacccagctcctgggtggagtctgggcctcatcccagcgtctatcaaaacaactttggttttgacttttttagaccagagtttcatataatcttacctttgcaaaaagagatcaatttattcccatgaaggggaaaacatgcttctgagcattgagtccttgaat

SEQ ID NO: 53579 - DNA, 796 bp, Bovine  19866880558521
agaaggaaatggcaacccactccgtgttcttgcctggagaatcccagggacgggggagcctggtgggctgctgtctatggggtcgcacagagttggacatgactgaagtgacttagcagcagcagcagcagagatacacacatacccggatggaaagaagagaaagtagcctaaatacattttatggtaaaattcttatggaagacaagagacaggaaaattcttctgattgtatttatcagagaaattttcacaaagcagatagcactgaattgagccttaaaagatgtctatcgtttttatggaagagttgggaaaaaaatacaaaagtggggaccttgaagagtggttcagagaatggagactgttctagtctcactgagggttaagaatgtggccagtgcatgtgtcccacagataaagggtggtggttagaggaaactaatgctcggaagatacgcttcaggcagattgtagagtgccatgaagtctgtgggtagtgtgtggatttttcttgcttgtaagtggggaacctttgaggatttctgaacagaggagtggcctggtaggtcagtgtttttggaccagcattgaccattgggaaacattaataccccagtcagtgcactgcagggcctcctcattaaggagactccagtctgctcttgagtcgctctgaatgtctttctttgtgagtgtattcagagaagggctgttttcagcagaactgcaggcagtttttctgtttaatggggtaaggtaagatgcaaactttctgcctcttttccttcctcag

SEQ ID NO: 53580 - DNA, 1116 bp, Bovine  19866880586211
ctctgctgactcctccggagacttcaacaagtggagaaggaaagacactacgatttgctgagcattcacacacacgctggcactcaacagtttaagtcttactgagtatctgtaacaaacctctgagttagtttattattctgattttacagaggagaaactgaggcttcagggaacaattgacctgctccagggataagtgttgcggcaggaattcacaccagggtctgtgctcttccgcctaccctgagacacctctaggcgagcctaggccagacagaaactctcctggggaaagggtgccaggaactgccacgctggctcagcaacccctgcacagatctcctctctcttccaggattaaaggggatccccagttgccaagccattcaggcccctccgagcccctcctcattctgatcccctccctcactctgctggcagcacctcccacacccctgccccaggccttgggagcagctgcagtgacctcacccggccctgccctgagcccagctctggggagggcttagcagctgtgccccagccctgcaggtggctggggggcagggggtggaaaggaagagtgggcatggtgccaagagaaccatctgctctcccaggggcatggccacccgcacagacactggcctcacccccaggggctgcccttggccctctgtccccatgccaaggggctccaggaggcctgagcagcccacccagactggggcaccagccctcatctgccatctgtcttctcccggagcctgagaggtccttgcagggcacattggagcatgaatgtccgctggaaaatgaacaagtgcttggggtaagttctagggggcagaggccagaggccagggctgggtgtgctgagcgctgcccgcccagccccagtcttgtcaagccaagagcagacaatcccctgggggatgagggcctccatcccctcacatctgctcagctggcaggtgccgctggcagagggcaagccccttcccccacagccccagctcaggttacaaaaggaggcaaggccagctgaggacagggggaggggacaggaggggtggaggaggcctcacagcttcccagggtattgggggaggg

SEQ ID NO: 53581 - DNA, 1538 bp, Bovine  19866880588500
tgcttacctgagataactgcaccaccgtggccctgcttgaggaagctgaagacggttttctggtgataagcacagtcgatgcaagcctgcacagcctgctgcaacaccacggaggctcgggctggcccaaaatggtcagggagctgctggaccttcttcttatctaagtgggggcctgtgctgccattcttgttcaagtaaatacaaactgcaggagacaaagaatcaaagcagtttaaagagtttcagagtacagaagtcggagaacagagctctcttcgtctttcctaccctgggctctggcctctacaggattcccagctgctaggctggtgaaacactgtgggagggagtacagggtgactatgcccagctgctgccagcccaaatgcatgaccacaggctctgggaacgcagcctgctgggagaagagcccagaccagcaaaggcacagaacttgcactttgtcttctttacactgaaaagaaaatctaagcaattttccagatggctgtactttcattttcagttcttggctgctttacgtattcttggtatctctcacatgctctgtgtaccaagctgtggggctatggcaatattagcatgagtgtgcttgtgtgtgcctggcctgggacctagagtggttaaaccaccagttacttcccttgctttccattctaggctttagagttcctttgtcatcttttacattaagacttaggctcaaagatagtagtggaaatagaaaaaaattggaataaagaaaaacatgcaaagggcctgaagggcccatctgtatatttgtttcagtcgtttcttctgtcaagatagctgggcactctcccaactgcaaccccccaacctggcactgtgctgcaaggggagaatcagggtgagcacggaagaaagagacagagctccccagagctgcttctcttggtctgtcgagaagactcatgtgcctgaccagctacagcattctttctgctgatctgatttttaggcttccacttgagtagggggtactctgcttcttcacactgtcctggctcactaactgaatggcaggagggcaaaaagtctcttttgttgttaaaggcaaaaagataaaagcagtagctgtgtgggctgtggatggactggtgtcctctctgggcctcaggtctgccgcccacatcacagaggggctgagccagacattctctgaggactctttcgccttcatcattctaaggggaagcaagatggagagaagaaaatggagagaagcaggatgtggaaagtgacagatgaaaaagaaagacagggaaaaaaaaaagaaaaagggtaaacaagaggaattgaaatatacatttaactcttttctctcttaaaaccacaaaaatgagccagataacaagaaaggagacaacttaaaactctggaagctggaaagcagagtggctttcctaaacagcagacctaagaaagctgaatctttaaccaagagtggggaatgatgagagccaagctgttccatctgataagtcacaaaa

SEQ ID NO: 53582 - DNA, 999 bp, Bovine  19866880590879
gaggacgtaggtgatgctgttgactgctggcaggttgagcgtgtgctgctctcggtcaaacacggctgtggagttaagtaaacagggcccagcatgtcagctcgtagcacagcgcatagctaaacaggaggagtccggcccactgcttgcctcaggcttaactggttacacagaggtgaatggtgcccaggtttccctcctcccctcctctccctcccctgagggtttgatttttgcctccaactccaaagggtttgcaataatgggagtggccaggctaggtctgttgcacctggggctttggaatgattctgctcaggctgtgaaacaactgtgaacataattctatctgctccatcagttggctgggcctcccaaggaaatctgctcatttccttaagaactgcttaagaacagaggagctgggcagcagaggagaacacagctattgccagcaatggctgaggtgtacaatctcatctggataagggcaactcgaattttggcaacattcatgtctttttttttttttttttctaaatccctatttatttctattcaaaacatatcatataatccctgggcttccctggtggctcagattgtaaagaatctgcctgcagtgcaggagatcagtgttcgatccctgggtcctgaagattctggagaagggaatccctaacaagcaaaaggcctctgcatccgtctttgagggcagcaagggaatgtggagataggtcactctcaggaacaaatctaggggacaaagaaagaaccttaaagaaggtgtgggtggcagtcactaagggaaggtggtaaagatggctgggtccctgcagactgcagcatggaagcaaatgagaagccaggcagaggccttagcctcacaaggaaagaaaggcttgatttcccatgcagtttttcagccatttctagcaattctttccctgcctgtccccatcctctgggcaggcaattaattactctgtgtctgggctc

SEQ ID NO: 53583 - DNA, 1492 bp, Bovine  19866880656336
actttatagcaagaggaagacagataaaaagatacagagattcaagcagttacccagaaacaaacactgactgtcttaggacatttggcaggcagagtgcaacagttcagaaacagtcacggataatgcatctttccaaaacattgtctcaggggatcccctcaagatttactgcccagtcatccactttctcaaatgccacaaaactttctaaaagtctgaaggtaacaaatcctgggcagaaagaaaaaacaaggcttctcttgaataaaaaataaaaataggagtgacctactgaaaacagtttttttttcccctgctttagcataaaaggtgccaaaaattctctcttgtctcccctccaaagggttaggtgtggtatgaggtagttcctccatgacccacccttactttgctcccacaggtgaactgttttgaatttctaagttctggccctgcttcagggcaattcaagacctattattgttcaggaggagttgcctgaatctttagggcttgagggtttgagaaagaaagtggttgattcagacagtggatgaccagggactgagaggagtatagcctgagaggtgaccaggctggcatggtggcagggggtgggaggtgacgcctactggctctcggtgtttggagcaggggctgagacccagaaacaggagttcagcgtgaggatggcatcctggagcggtgttgcctggcaggggtgctggcatcacgagactgcctctggactttaagactctctctccatcttgggagtgaaagtcaagtaggtctacatctcttgggttttagaaactctggccattcctgaatgatccaaagaggtcagagtggtgggggaggggaggcactgtccacaaagggcgatcttggactctgctgatctacctgggggatgctcaagacgatgtaaattcaatttggatagaaaaattttttaaacacctcacaaattcttcctcagttacagaagggtaacaatggccttctgccacatctccttccaggggacagtgactgttgggacttggcaagactcagcactcttggtcaccaagtttttctcgtctccatcactcattgtgcataattcaccggaactcacaaagcccctttgtgtgtggtgagccggatcccgggcagttggaagggcccaggctggcgctgtcctcgaaattaactgagagaggtacctctactgatgagtctggagccagaaaaaatagaaggtctaggaggaaaaataaccttccaccaaaacgctccagtcttgtggaagatccgtatcacattggatgatcactccagggacacaatgggactttcattattctttgtgtttggagacaaaagatctttctgttcagcttaatactgagccttttaaaaattacctggaaatggaaacctgttttgagagaatagcctctgttggcaacttgcacccacttttaaggagaacctagca

SEQ ID NO: 53584 - DNA, 1713 bp, Bovine  19866880658559
ctgagtgtttgatggtgctcttttcctacttcccagtgctgctaggtagctatatactttctcctatttttagaatcttcttctgtcatctcagtgcacgtcttttaaatgagttttaatcagaaggaatttgcctttgtgttatgtggatttccttaataagctgtgaggactgtattcagaaaactctttgaaaagtaaattatattcatgattatgtctatcaactccttacatcccctcattacctttatgtaatgatcttgtcagatttgagagtgacttacagatactaaaggacccaacttgtttttgttacatttttagagattttttttcttaactatttctctctcagaaatcaactatgagttttagttacaaaccatccaaatacattttttaaattcagaaagtagtcactttctggtcatgtcatgttttcattttatgctcggttttttgttgttgttgttgttaatgattaggtttcatttatttcattcaaaaatagtggctcctctattctaggcaatattccaagtgccaagatacagtgctgaataagtaacacagacaaggccccagtggaggagacaaacaaacaaggaaaatactaactagtgctaagttgctatagaaaattaagagtggtgtgatagagtctaggtgactactttggattgagtggtcagggaaggctgctctgaggaggtgacatttacctgagacctgtatgataagatgccagccctatgaatactagtggagtgttccaggcagtatacaggccctcaggtagtaaggaagtggacctgcagcaggagcagaaaaggccggccagttggagcagaatgaatgatgagagctgtaggagaagaaacggaagaggtggggtcagtcagggtaaggtacttggatttccttttaagtgctgccctggagagcagttgaagattttaagcaggggaataacatgctctaatttatagtaatgtgtactctagatggggccatataatggagaaaatcaaccagtgctgagactccctagccaaacataggcaagggttgcatttactcctaggacattctaaatataagtaactctgttctcctagaaaaatcctaagcctcaagacaagaagtggaccaaattaccttgctatgaatccagctccacagtttaactgtgacttcaggttataagtcatttctctacactggttaccttatcaataaaatgaagatattacctacctttgggtagtaagtattgagcaacttaataccagtgaagtgcttagaacaatgcttggcacatagacagttcagttcagttggtaagtcatgtctgactctttgcgacaccatggactgcagcacaccaggcctccctgtccatcaccaacttgtccattgagtcgatgatgccatgcacccatctcatcctctgttgtccccttctcctcctgccttcaatctttgccagcatcgggggtcttttcccgtgggtcaggtctttgcatcaagtggccaaagtattggagcttcagcttcaggataagtccttccaatgaatattcaggactgatttcctttagaattgattggttggatctccttgctgtccaagtgactctcaagagtcttctccaataccacagttcaaaagcatcaattcttcggcactcagctttctttatagtccaa

SEQ ID NO: 53585 - DNA, 630 bp, Bovine  19866880660449
ctgtgaggaaaggaatgacagtgatgcaaagtggcagccaccatgggcttgggagtaaaagttccttgcaatttccaactgttggaagaaggccagaaaggtgtaggagatagcacagttggcctaagtctagaagatgatgaagacatggcacttacaagatgggcagggatgattgggcctccaagaacaatttatgaaaactgaatatactgccttaaaatagaatatggacccaaatacccagaagcacccccccgttgtgaaatttgtaacaaaaattcatatgaaaggagttaatagttctaatggggtggtggagccccattagagccatatcaatgctaccaaaatggcagaattaataatcgcatcaaagttgtcctgcaagagcttcaacacctaatgatgtctaaagaaaatctgaaactccctcagccacctgaaggacagtgttatagcagctaatgaaaaaggagaaaccacaggccctcccctacccactgttcgatttcagcagtcttcattttgtgcggtagtaaactttctagaatagtaactttctacatcttgtagacctcaatgtactataaagacaactctcattcaaaaacagtttatcttaagata

SEQ ID NO: 53586 - DNA, 722 bp, Bovine  19866880728178
ctgcgctggtgaccagaagacccaggtggagggtggggacacggtgggggtgggctgaacgcacgtgccatcggagctattgctgttggtgctcccgtctgtggactcccggctgccctggcgagggacccgactccgcatctccacggcaacgcccgtctctgtgctccgccggatgttgctgcgcagtttcttggtggccccttctgtgaccccccgaagcacagagagggaagaaggtcagatcgctgatgaggtttcgctgagatcactgctgaagtcaacctcttgggagggtacagaatagacagggctctgactggaggcagtggcaatctgagatgacctctagagccagcccacagcctgacccctgatcctgctcagcgcagtgacgcaaagtagatgagaaggatggctgaaggcacaatggagatgttggggctatgggtggggagtcagcagaattcagcccttgtccctcagcctcatcctcaccaggatcccctgacccacaccttcccactcaatctcagcccttgacccaaagggttaagtttcttcttctggaaagtttgctttctccagaatcctcagatttgtttttcattttccaagtactgtcatgagccctatcactcccggagatcacaaaccacctctgtgaaaccttcacaggtcctatataaaaaaaaaatccacacaaactcggccactcacaa

SEQ ID NO: 53587 - DNA, 861 bp, Bovine  19866880734014
cccgttgcacgtgctcaaacaagagggccagctctctgcaggagagggcgccgtcagcggcaggcaagggccctggcaccgccccccacctgaggaccctgagctcccgatggattccccctgggcccagcctgtctggagatgctcagcgaacacaccaggcccgcataggcaggggtgggaacgggagagtagccttcctctctccttctctcttcttagctcctgggaaaccctcaaggatgcccggtatgattgtgctggatgggcaccactagggggcaccctcccaagggggaaggcagagacctcaaatccacctcactgctcagcaagcggagtgcctgcacgcggagccgtgcccacctggaggccagcagcagccctgaaatcctgccctccagatctgactggagtttaggggaaactgaggctgaggagggagatttgataggcagcccacttccttctgcagccctcatgctgggttctccaagactagattgagggctcagcttcttttgaactctccaggccatctcctgtttctctaacccaagaaatagatcttgcctctctttgccttcccattgcacggatgaggaaactgaggtccagggagcagaaggaccagtggacccagaattgcccaaccaagctctgactctcttcccagaggacccaagaccatcacccccaaatcattccttcccatcacacacatatttctaacaaactagcccctgccctacttcccagggcctggcccttgagtcctgaggactgcttctagaaagaagggctctttctattaataatctaaccaccatccctgtcttttggggtgggcgcttgcctctg

SEQ ID NO: 53588 - DNA, 5571 bp, Bovine  19866880753767
ctatgggattttctaggcaaaagtactggagtggggtgccattgccttctccggtgtctatctctatcaattaataattagcattagagatcattattcatttttccatccatcaagatgcttaacaaagtccctgtctgactcttgaagtattaaagatgaactaagagaccccatgctgctcctgctactgttgctaagttgcttcagtcatgtccgactctgtgcgaccccatagacggcagcccaccaggttcccccatccctgggattctctaggcaagaatactggagtgggctgccatttccttctccaatgcatgaaagtgaaaagtgaaagtgtcccgactcttagcaaccccatggactggagcctaccaggctcctcccgtccatggaattttccaggcaagagtactggagtggggtgccattgccttctccaaagagaccccatgagatatgctaattcctctgtccatccatctatcctgacccggccaacaaatactgtgtaaccttggacatgcttcccactgaactcaaaacagttcaaggtaaagtgagagtagccaagcatgtcattccttcctcctagcgggagaagaaaagaaagaaaaagcattggtttgggactagactgagactaataaaggaaaaccactggagggcttaagggggtagaaacctttgactctaatgtctgtaaatcacacttatacagctgctggtggggaacaccctgaattctgtcttcctgtcctgtgtttattcaaggacaggagatgggagcagcatggagcacacgtcgcagggacccagtgcttaagagcccaacattttctcacacagctatctccttccccaaagccccaagcacgagccccaggaacctagtctctcccaattttctccccccccagagaccacttcaatgatgtttgtacctattttccccaagcagattgagaacccttcttcctcctccatcccccatccatcagcctattctcacctcctccttcaaacatcttggtcacatcctcccacaggggcgccccctccttggcgttctctggatggtgcaacttcacccatgtgctggcctcggtgggcagggtgatcaggagctgctgcagcatgacgatgcctcctgactgaccttgtccacttctggtgagcaaatggccagagcctctgcttagatgcctcacagttgcgtggtcctcctgtgatctgtctcctgccctcaggattcttgcgtgtgcctgtggcaccagaacctaggggctcctagaggctgatgtggctctcacagctctgaaaaactgattcctctctaaaattaagtcctgcctgcttgcaggtggctggttgagtaggtctgagtatacgcctcttcatattcttctagaggagcaaaaggcagggaggagggatccacaaaactgatcatacagatagaactccagaacttgcagaaacatacttaaaactgaaaaagatccaaaaacaaagatttagtatcaatgtgaaaataagtataatctatgctgtagatgcagctctaatttctagttccatacacactttcacaaacagcacaaatacacacaaataccaaagatacacaaacatgcacagaccttgccttgactttcctctttggaagctccaatactttggccacctgatgtgaacagctgactcactggaaaagaccctgatgctgggaaagactgaaggtagaagaagaagagggcaacagaggatgagatggttggatgacatcactgattcagtggacatgaacttgggcaaactctgggagatggtgagggacagagaggcctgacatgctgcagtccatagggtcacaaagagtcggacacgacttgacaactgaacaacaagctgcatacatcttctgcttggacacagacttgggagttaagagggcaagcttaggaatcagacagtctgggttagaatcccaacacgggcacttaaaagctctaagacacttcagttctctgagtttccatttcatcatctagaaaatgcatctaagaagtgtacttcttttaggcttgtaacaatgttgggaatacagtaccttaatagacattattataaaccttttgctttaatgtgcaaccacaacactactttttaaagtaatctttaaaacaattatagatctgaatttaaagtttcaagtatctcaaatatagtacttcgaatataatgagaaatattggagaactgctcccggcaggaaattttggaaaccgcctatcttttcgcggaagcccttgacatctgaacaggcgcctctacagcgaccaagtacagtgtattagggcttcaagaacaatcctagtcctagctccctgaaaagggagctggcccaactttttgaagtttgtggggcagggtgtttggcttcttgttttcagctgtgactgatgcagagaaaggagctgtattggagcatatgaaaaatatcctgtccccaaatatatgaaaagtaaaatggtttgttacccaagtggagaaactttccaatcttattcccgaaatggttaacgacagagaagcttcatttcgagtatgccccttctcattagtcccagacatgcctctgtcggacctaagaaactgcagacacagacagcgtagcttcctactcaccagagaggccatggacgctggtacgaccagagatgggaggcgtgagacagccggttcttgaggctttcagctccagagggtgtctctttagagaaggaccggtaagagattttgttttttcccagccttttatagacagaccacatcgacatccaacacaatgacttttttaaaaaacgccgaacattcacgcaggcttccttctgaagcccaaaggactatcggcctccagacgggaccagggctcctttctaaatttctgagaggaggcctagggcgggtgctgaggcaccagataaacccacagcccctccaacggcactttcccagccacacccccgggagctgggctttggggacccgcaaggccaagggaaccctgaaccggcttccaacggacccgggctaggctaccgctcgcccgccgctgctttgatgccaggccggcggcagtggcgaggcccaccggcgccccgcctcctgggcctcaggccgggtgtcccggcccctccgcagtagcgaagcgccgttgcccgcgcccctgttagccttcgcccaggtccgggtgctgcccccggcgcagccgcagtgctatcaaccctggtaccctcgagtcttccggcggctcggcccgccccgccgccggctccgcccatcaggaacggcgagagtccgccctctccggggaggcaggcgctcccgaaaatccggaacacagattccgcggagcgcgcctgggcacgccgcccccacgactgcagtcctctttggtgggaccctaaatgtgtttttctaagggctgtttcaaagaacttctcgctcaaaagacaacacatttttttaatttaatgccatacatttggcaattggaaagtaaaagacaattaaaatgccatccaccaatcttaataaaaagacatcaatatgtattaggaattatggtctaattttcttaggtgtaataatggcattgcagttaagtcttaaaagagtggtggttatcttttagagatacatcccaaagcacttgtggataaataaaaaaaaaaaagcatcattatgaactaaagtctacataaatatctccataaataattcctaggcttccacaacagcattacaattgtgattttaaaaaacctttttgcaacaaaataccaaagagattgataaggaaacaagacttttggcatagatacaagtgaacatacgaatatgacattaaatggtagtctagtgtcagtattaatcattgtacatatattcattttacatagtgggatgggcaaattacaatccttgggctaaatgcaaaccaacacttgtcttttaaataaagttgattggagcagttacaccaattcattcatgtcagtggttcccaactaggaattatcttgccctccccaggtctggggaaatttctggttgtcactgtggagcggggaactactgacatccagtggccagctgctactgctgctaaacatcctacaaagcaagatagccacctacaacaaagcatcccaaaacattagcagtgccacagatgagatacccatatattgtctctggatacttctgcactaaaatgatagagttgagtagttctgacagaggtcatatggcctacaacacctaacatgtttattatgtggccctttacagaaaacatttgccaatttttctctatgaaaccaaaaaatgtaagtacctcatgtttagctggttacctattaagtctagaaaacgctctttaacattatttctagaatgagacaattgacatttttatttctacctcttctagccatataaagggctatagtaaaggttatattttattctgattcattaaagggatatttaaatccgtgactctcaaagtcaatcacagatcactggcttgtcatgatgatttcactgccccacagtgaaatgagaaaaataaagacaaatttgggagatttccataaaactaatttaatgtaagagactgttctctataattatagtcttcctatattttaaaataataaaacgccctttcttttctgaagcaatgctgataataggtagtttgtttttttaacacagcaaaattagtaattgtaccattgggtcaaaccattaaaaaaaaatgattcgttcttgaaatctgaaagtcagaaaatccaaatttagaggcttttgctccaattgggggattctttgatgttgaacatatttcacataccattgctgaaggtgtttcttaagtgtgttttgcagtgtcaaataagtggtgaactacagctgaaggcttttccacattcattacaatcatagggtttttctccagtatgaattctctgatgtttggcaaaggatgaatcatgcctaaagcctttcccgcaatgactgcattcataaggtttcactccagtatggactctctgatggatagaaagatgtattctctggctaaaagcttttccacattccttacatttatatgttctttccccagtatgacttctctggtgttgagttaggtatatgctgtggctgacagttttactgcatacactacaaatagagggtttcacagcagtatgaataatctcatgttgcctgaggtgtctaatatggaaaaatgcttttccacagtctttgcatgtaaaaggtttctctctgacatgagttctcagatgctggatcagtccaatgctttgactaaatgctttctcacatacaccacattcacagggtttctccccagtatgaattctgacatgttgagtaatagatgatggatggctgaaggttttcccacattccttacactcatagggtttctccccaatacggattctgtgatgtggaataagggatgag

SEQ ID NO: 53589 - DNA, 1872 bp, Bovine  19866880757031
gactgtcttacctcctttcttgaaaactggtgtctagaagttaacagaagacttgcgttaatgccctaggggtgtgctgttgggaggggcacgccccctgtgatggaaacaccacactcaagagtcatcagttcggtgagtcggggttttctctaaggtgagaggggaggaggaaacacctgacaggtggtacaggacctgggagttaggagtcttgggttagagctctggttttgttgacagctttctctgtgaccctgggtgtgtgtctccttccccttctgagcctttatttcctcttctgcaaaatgaaaggcttgggttggaatagggaggcaaatcagtttgacctcatgagctggttctcatcaattggtgatgcagcactgtgttaagaagaattctgaagttaactatggccctagtgagaaggagagatggattagtgatgtctagggagagtggtaagagccttagtcacttaccattccttccagactaacagtccaccactctgtgacagattccttggtattttctgttgaaagagtgagtaggtagtttcatcttgggcttttgggtagccttactgacactcacgggcttccatggtggctcaaatggtaaagaatctgcctgcaatgtgggagatgcgggtttgatccctgggtcaggaagattccctggaaaaggaaatgtctacccactccagtattcttgcctagagaattccatggacagggcagcctggtgggctacagtccatggggttgcaaagagtcggacatgactgagagactaacactttcttctttcactttcactgatgctcagagaaggtttattacttggttagacacgtggtccaaaggagcaaggggcccagggtggccaggcagaaacttgagttctgcttttgtcaggattcaggggagggtgtggggagcctttagggtactgagaccccagggcagaggtcaaacattgaaggctggaaagaaaacactccttccttggggagcttggaaggtatctgctggcatggagcttggcaggtacgggggacagtgggaagggacccctgaaggggatgtccaagctgtcaccacagaggcttcagcagggggaacttaagagtgattcttccatgacctggcaagatcatgggacggtttccttccatcaggaaccatgacctgggttggaaaagggacagtcctgcttggaggcagggcattgttgcagtgacttttgcagacattcctttagccgtctcttaggaccaccaatatgtgaaatgctgtgtgtcggcccctctccattctgctcccatctccacctgctgccctgttcctacccctgtgctctgatgacttgggggctgctgtgagcagcactgcctccctcatagaggccaggtggttggctgtgactggttctccatcttgtccatcttgagctagactggctgcccaagaagcaaccggagctctgattctgagcctgctgctgccttgcgtgtggaaaggactcaaaagtcagactttatctgaccctttcggtttacacacagatgaggaacccaggcccagagaaagtcacacaaagaatctgtatatacattatcatctagcctcctgattctgaactctccccagctgccctgctctgcacttgggaccagaggtcaggccctgagaccctgggccctcctaaacattcaacagctctcccgggcagttaaagatgagaacgcagctgtggatggtgcagagtcctggatgtcaaaccatctgcttgtcagttccattcattattcatgaggaaacacgagcccctgggttggcagggtcaagaattttgtcccttact

SEQ ID NO: 53590 - DNA, 804 bp, Bovine  19866880769378
accccaaaatgcccaacaactggggcaagaattgagtaatgatatattcaaacaatggagtacaataaaggcatttaaacatttttaatgtcaggaaaaatgcttatgataaatattaagcaaaacaccaatgatataaaactatattacagtagtataagcttaagtaaaaatgggtgataacgattatatgaaatatcttctacattactatactttttcatactttccaatgatttccatcacaaatatgaataactttcataatgagaaaaagatagtttttcttttttagagaaatagcatttaatgatgtttagctaataagcacaactgtcctgggaatctgttcctatcgatccttaatttgagtcacttgtgtcagatgcctattcacagacaaggctcaaaaccaagtcagaaggctcaagggagctgagctggaatcttcctgattccaatgctgtatttaatgatgcttcctttctctcacaggagagctaggaatgttcacacaacactcacactaccagaaagacctcaaaattcccctcagtctgaaacagttcctctaactcatctcctgacatctaccttgggagagaccaagttcccagtcccttacagctattctcacaataaaaacgctttcgatacagcagaagaggctgagtcttttcattctttctttttcaaatcggctgtcacacttcaaatggtctccattaagtccattgtttccagctattttgaacacaagcatcatgataagaatagggagtttccttcctctttctcatcaga

SEQ ID NO: 53591 - DNA, 1188 bp, Bovine  19866880792351
acgcactggtctagcaaacaccctcttccacaacacaagagaagactctacacatggacattgccagatggtcgacacagaaatcagactgattatattgtttgcagccagagctggagaagctctctgggaagggaaggtctgaatttgctatcattgtgggtatagaagtagaggtaagataacctcttggtggaaacactaaatcataagaaggaagagggaggctggactaggtaacctttagaggtcttgcccaaatctgagagcctataattttatgggagtatggacctcctgctttcatcattacaacacagtgcaacttaaggtctgcataatggacaatgtacattatttgcaacgccaactttctctctgaaagcttacagaagagtgacagagggacagaagaaatactaagatcattatcatgatcttacttcccttctgcatcttcatctaccacatactggcactgtggtggacactttacacagtttatccagctaggttattgtgagactctgagctggtaagacattgtctttgggttttactttcctcatttggaaaatgaatgggttgaacttcattattcatgaaaggggacatcgaagttccttttaatttccttcatatcatgagtctggaggaaagtagcagcagggacctagatcaattatttcctccctatgcaccacgatttaacctggcagatactctgaaatatcttccttctttggagtaatgaacaatgtgtgccatcttcattttatacagtaaacacagtcctaaaaggttaagtgtaaatagaaattttaataaaaaatgaagtacattttgtacacaccaaaatggttagttaaaagcaggctttataaaaataagtgcaatgtttgctgcaaagcaacttgttctatgagaagagctcactggaaaagaacctgatgctggaaaagactgaaggcaaaaggggaaggtggtggcagaggatgacagcattaccgactcaatggacataaatttgagcaaactcaggggtatggtggaagacagagcagcctggcatgcaacagtccttggggtcaccatgagtcagacaagacttagagactgaacaactagttctataaatttggattttatgtatggattttctgttatcacttgtcttccacttaagta

SEQ ID NO: 53592 - DNA, 1728 bp, Bovine  19866880876833
ttgataataacactttcttgcctttttatgggactttgtacttttcagggccttttcatgcttgttatcttatttgatacagaaacccagggaggatgggcaagaaggagggatagaaggtaacacctaatcatttctcccatgccatctatccccttaaaacaatgtattttaaaagaatttagaaaaattatcccttcgttctttttaattttgtttctgccacgccacccagcttgtgggaccagggagcaaacccacgccccctgcagtggaagctcggagtcctaaccattggactgccctttctgctctttaacaaacagatggaaacgttgagattgaacttgatttgcccaagatcacagagcaaattagtggctcactgggtttaggaggtttccaatcatggatcatacttgagtaggacttgcccaacaccatcttgcaagatgctactggccatggcaaggtacctctgagaaaagtggtgttttgggcacggctgctcctttgaggcttccaggagtcatccacaatcttacttctccaggccctggagagacttgactaccccccggtggcctggatagcaacaggaacccacggaagtaaaggtaagacataaggattcagtaacagttcctctggtatcagtcaggataaatgccattggaagagtctgttttcttgttttgattgcagagcacttgcggaagggtaagacaggaaacattgagaactgcgggtttatccctccatcatctcctctggaaaagaggatgcagaggggatagttcctacccctcctcccttccaaaaccctcgttggtggccagagcacacccttccccgacctgtccgtgttgggccccctaccaaccgtgctcgttttcgattcccacctcatcattccagagcccatcccttccagccacagcatggagtccagttatcttaggaggcaggcagtaagttctccatcacacggttctgatagggaaagatgaggaagcagaaggagcgtgagactttctctgtgctctctcaagggtcccctgtgctcctgccccagtgccccagcagggagcttaatgtgcttgcctgtggcatcacccagctcaacactggcaaacagcacacctgggcagttaatcatggcagtcagcttagtggcagggcaataccatgccagtctgggtgaggacaagaaaacagaaaaggtgcttggaattcaaacagaggtagtttatttcggagaactggttggcttgagggagcaaaaaggtaaggtggagaagactagagattagtggctgcaggaagcctcttccacccccagatctggaggagcagctggaaggctgctaccagagccagaagtgccactgatgctaccgggttgttgcttttgaagtgatgctgccggcagaactgccaggggtcactggagcctagagccacctctccagtaccactgatacttttggaaatactgaaggcctctcaacccataatcaacagctgctgccagagtctccagtggatacaaagagaaaatgttcacatctcctccagccatcccatctccagccatacagttgcccacctgtacttcccactgactgaatctgactggaagtcagctagcaagaggagactgggaaatgtagttttcagggccctccagggcctggcactcttcagtacaaagaagaacatgagagt

SEQ ID NO: 53593 - DNA, 1019 bp, Bovine  19866880894865
atttctgctgtgagcaagcatccctttgtgggtgctgtggtggctgcagaatcagggaagtaaagcgagtgtttggtggaagccgatgaataaaccatctgaattctacagggacacctaccagtgacagaagtggaagcagctcccctgactctgaaatcactgaactgaagtttccttcaataaaccatgactgatggtaacgtaagtgatactttgaaacttgttttcttttaaatggtggtgacaccagaatcctaagagcatcatgaaagttcagtgttgaaagattgtatctgccagaggatgtaagtggtcagatcatggtgggcatcaaatgggtgaggacccggccccccagttagagtacatctacccaccctgctctggggactccactggggtgacaccaggcacagggcaattgttgtcttgctgattgctgctttcaggtgccaatctgacctaacctgggggaactggattcttagagccatgttatttcatgtagccataaacttggagatcttgaaggaggtgacaggtgtgacaacatgctgtcatttctgcagaccctcaagttttcaccagaaagtgctttaaaaccaatacatacagcacttttgtgttgcttgcttattctggaagtccattacaatcagagcagttactggataaacttggaatgtctgtcttttgtgaccagttggaaagtttataaagtgtagtagctgtgggcagctgccgagaattgtctaaaatcccatgaagctaactgcgtgaacgctcggcagaaatacctgctcagaagggggctggggtgtcagccgggtgtctggggggtctaaaggagaaccgtgggtgtgcagggggtcccaccacagggaagctgaggtcctgcctcaggcatgggaaggcggcctccccgaatcctgcacactttgcctttcccaccaggggacctctccactggcagtgggtctcttgggcatgcggtcgtgctgagcagccgctggcct

SEQ ID NO: 53594 - DNA, 1908 bp, Bovine  19866880903343
tgacctttacagatcccagaataagttgctcaaactggtggtggtgctagtagggcctttaattacacctgaaccccaagccctcacttcgggtatgatttctccccacttgaaaccaagaatcacctcctaagatgactcagagtcttaatgaatgctggtcttcaatagatgttgttatcccgattgctcttacattctgaccgcacaggtctactctgcagtaacgttacctgggaaggggaaggtgttctgggaactgtagatgagaaatgactacaaactgtaggagggtagggagaaagatgacagagggtaatgcatgcacgcagggggccaggtcaacaggaaacatctcccattctgacaccatgatctccaacttagcctgctccccaaacctccataaaatgtttccaattttaggacaggaaacacaggattcacttgaccaaaatatacttcctcccaattttaatatgtatcggtcctataagggtatctgagctcaacttgaaagagccactcctgtaggcctagggaggtgtgacaaagcatagccacaaggccttcctgagctagtcagacaggggaacaagagttgggagatgctgggagggaccaagttcaccatcctcacaagccttatcagctccaagctgaccaagttcagtgtggcagagaagaggtagataaaattctcgctgacttaaaaaaaaaaaaaaaaaaagcatactgccaactcatcactgtactaccaactcaattttcccaagaggacttccaaggtatttctaaatcatttcaggaaaatgagggctcatgttagcctggcagatgtcaaatcacatatggcgtgccctgcagttggggcgcaatagtcatgagcttttcagaatgattagccaatcagggacagctcttggcagactcccttgaagtttcccggtgctgggataaagccttaggcaggcaaagcgctcaccactgcggaggcacaagcaccggccaaagaaggtccctgaggcatcatgctgcagtgaatgcctcgaggcagggactgggatatggtcatctgtaaacccctcctgcctagcactgtgtctagcaaagagcaagcactccataaacttccaaattatggataaaaaagtgagcagggaataaattccaaaaccatagtaatttaaatctagctctgtcccattgttttttctttaggcagacctagcttcaatggcaccccactccagtactcttgcctggaaaatcccatggacggaggagcctggtgggctgcagtccatggggtggctaagagtcagacacgactgagcgacgccactttcacttttcactttcatgcattggagaaggaaatggcaacccgctccagtgttcttgcctggagaatcccagggacgggggagcctggtgggctgctgtctatgggatcgcagagtcggacacgactgagcgacttagcagcagcagcagcagcagcagctccttactagaatacacacggctgtttaggatgggtcctctgcctgtcttttcaacctgcctagatgctcccctgtgctgactctaccctccccgcctaccacttccagtgctgtttctccccaccttgctcatgctgtgccctctcccaggaaagccctccttccccgctttatttgattcatttccattattccctgtaagactcacattaatcctttcagagaactttcctctgacattctctgctaccacctccctcacatcttttgtcgggtaccccttgtgaagcactcccataacaccctctacacaatcctaagaatatcttacacttcccacatggcaagtgctgtaatctctaagtatttgtagccccaactagattcttaaattcttaaa

SEQ ID NO: 53595 - DNA, 3966 bp, Bovine  19866880906980
aatgaatctcactgaattctcacaatgctggaggaagatatttattacactgtttttatactgaggcccaggaaggagaagtgacttgcccaagggcattcagctgagaagtggctgatatggggctggagcccaggtgtctgggcacctgtctaggacctctgatggacacgggtcctattttgagctctcagtgaaaagcagctggtgtcccaagcaggctccgtccgttggttggccaaagtgtgtgtgtgtgtgtgtgtgtgtgtgtgtgtgtgtgtgtgtgaagttaggctggctggcaggctggaactcagctagcatcaacccctgtgcttctgtgcttgggccaggctgcagctgctgccccattgggaagggacctttccacttgccctcctgcatcaaggtttttttctcgtggcctgcctagctggagagaagagctggtcatggcatgactaacagggcacctgccagcccctcccacgctggagtctggccatctaatgccttgcacatgacaggcatggggtgggcacagggtggggagagggatttgtacttttctaatccaggggctgcagccctcttccgtcttggccagggccgtgggagaggtttgtccctggccgccacccctccatgcctagcagccccagctcaaatccctggcaagtgcctggctcctctgcttggggcctccccttgccctgcccatgctccccgccccacccccacaccaactgaggccgagttgggacctatgggggcagatgctggggtgtctgtgactggtggagatgcagcgccatgcagcatctggggctcaaggatggggcaatggcagggaggtttggggcccaggctggggcagagttagggagaggacctgacagggtgcagagttttgagtgtttggggctaatgctgggccaccccttcctggagaaatttggctacaagtcagggaggcaaatgtgtgggccgtgcccccccctcgctgggcggtaaacacagccgtctcccaggagacgggcccaaacatctcggccccccacggttatttataccaggactccctctccttctcaggcctgttctggcctctcaatccactcctgaactgagcgttctgagtggagggtccagcccctgtcaaggcaggagggcccagcagcaggcctgcttaaaccccactagggactgggcactcaccacctcccagtggcatgtctgctagaggcactgggtcttactgatcagaaatgtgctcatgaaggccagggcctgcggaggaagtgggagtcctgggatggagctctgcctttgctctaaactgctgtatgactgtggtccctgtaacctcagcttccccacagttcagcagggggaaagggtcctgatggtacaaacttttaagcagtagatctgattctttaaaggaaatgtgacacaggagtacaatatacaaatacattaaagctgagctgctctgggtgaaatcaagggtgggggtccagacttctgcccactcagcctctatggccctgcatgccaccaacctggagcctatgcatgaccctccttattctagaacacacttcaggggaccctggagttcccatttcagggctagcacaggcctctttactagttcaccagcccaaggtccagtgttgtgtgagtgctcctagcatcaagagcaaatgtttgcagccagtgtagatcagagcaggcttgagctgccacaggaatgtacccgaggcccttccagtgaggaatgagcccagtgtgggaggagaagagggcacaccaggggctgggcactggaggggagcaggggctggctgtcccctctctgccagattctagcatgggacaccaaggagtcaaagattttaaacctggccttccagatcggtacgaaggtgaatatgtcaggaaggatagaacgtattttatttaacagcttgttggctcttatagtgtgtgggtctccatttgtactctttcccagtcccaccagtgttcaagatggacttgcattggctctccctccatccacccacctctgtaggaacgccaaggtgcccttacccagaaatctcaggctgcagaggacagtgggaaattcctgtctcacggatgctcaaggccctggagacctgggtcttcttgtttcctcccagatactgtctgagcttctacttggccagcctgggagatgtggaagagtcagaaccggctttacccttgatggatagatcctaatgagctgttgttggtgggttgggagtggacagaggtagaaactgtctctgcacaaagggatcctggggtcctcagagggggccaggaatcccaaccaggggctgagcaagtattcctcaaagcagatcagggattcttgggggaaaaaggggaccatcctgaggagaggagagaacacaaaagtcaccaaggtagaaatagggtatggaagggtggagtgtgggcaatgcctagtgtgtgtacagcctcaaactctgggctgagaacctcaggtggaggtaaatcagtgaggggtactcagactgaaggggtaattgaactggggtgaggatggggatggagtggagtcatggtggtcagtgaagagggaagaagggaggaggaatgaggtgagtgcttggcaggacaggagtgaggggctgggaagaaagagttggtttcaactttgccttctggaacctcctctcctgtgtcctcctttgctctgtcttggtttctgcctctttctctcaccgttctgctggggagaggagcacctcttcctacacccatctccccagataggtggcaagtggaagcccacagctgtgtaagagggaacctgttcattcattcattcactcaaccaatatttattgataatctgctcatgcaccaagccctgtgtgaggtgtgggaaagatagtggtgaacaagatagagaagtcgcttcattcatggagcttacatcatggggggctggggcctagaaactatacttttccctgatgttccccctctggctctttggcccatgcccttggatgcccaggagtggggcctctctccattacccactcattcattccagctcacctggcattagcacccatcttcagaacattgaggaggggggttcaataaccatggtcccaaccccagggaccacccatctccatgatgaccctggggcctgggggcagcacccgggctcaggccctagtctttttcacttacctgtgactttgagcccctcacaagaaatttcctggcctcagttctttataatgtggggctttgggaagtcccaaggaagcgaggggagggaaagacctgccagctccaatgttccccattggtagacagctcctctggctgtgggtagaggtggagaagtgccaagggttcaatatcatcatcattatcaaccaagataataatatctactgtctactgtgttcactgtggccaacctcatgattcctctcatttaatttagtcctcacgaccagctcccgatggtccgtgtatcttccctccccatttgccagatgaggaaactgagtctctgtaaggtgacatgcgtggtttgatcagttcacccgcgaacctatctgactctgggagcccttgaggacggcgcgatgagggtgctgcttggcaccgggctgcccctcctgcctcgagaatagtaacccagccctagtgcctcaccccaccctcctcgggggctggcaccaccctgagtctgggcactggatcgacaacactggccagagcagtaccaggggcccgatcagtccaggacccgatttaggggccttggcacctctgggtcccggggctctcagtgcccagcaagcggccttagtgggtgggctagccgtgggcagtcagggtgtcgcgccccttttcggcccccgtcgatgggga

SEQ ID NO: 53596 - DNA, 1327 bp, Bovine  19866880960742
tctacttccgtcgatagcggcatgttaacacattcatatgtatataccaacactatgcaagaccacagaatgctcttgttagacaggaatgcgagttccagtcctaaagcgtcagaaccagaatcaactgactgaacagcagagagaagaaatttaccctcgatataatttcaaagtcttctagaaaacatgaaattttaggcagttttctaaatctccccccaaatactccttgaaatgtattccctaaacccccacctgctcccctcttgttatacactcccactctgcctttgggtccacacatgcctccactacacacacagagggagacagaagctgacaactatgaggtccgcattacacagcaccctgcactgctgctgcaaggccagcctactggaacatggccttataggcagataatccaattgttccatacacactggtcatggcaaccaaggagaaaatatacaaaagatgccattttgaagttgaaaatagacactctgagaggcaatattccaaaccgttttgaaagcaaagaggaaagatagtgacataaactgggtagtgattagcacaacataagaacaaagtcataggtaagtgaacatattcaacaggggcctatgagcaggctcaggaagcattaagcaacattaaaattaacaagtaatcactctgcaataagggatcagtaaaaataaagaaagtatttggatctggctaatctgtcaagaaatcggctctaataagtaccagcccagtatcagggaaatctgggcttaccctaactattttcacaccttctaacaagtatctcgagtgtttatttctccatttgtaaaatggaaagcatataagtaaatccaatttacattcaactactggatggcttctacataactgagttaactactgatagttggctgcaaatttttcttgctgctaaaatttccctcatcacaagagctgctgggcctagaagtgttgtctgggcttgagaaatcagcagagagaagagaactagacttacagatagcttgaagtcactattataataattataactcatgaatctctaacttgtagagttccaaaaaataaatgttgaggtgaaaaaaaaaaaattgcaaaatagatggttacccataatcagacctgccagcatcttggagctgttgaaaagctcttcaacaggaagggtccaggaagggagagaaactctcttccatcttccatccaagccctgttgaatctaccttggaaactttcccagaaactatccatttctacctagaccttctcctatctcacccataag

SEQ ID NO: 53597 - DNA, 2025 bp, Bovine  19866880979077
cggcaggcgcacatgctctgttcgctggctcagctctgactcccctcctccctgtcctaggccttgggtgggtggcagggcccttcctgctggccctctgcccaccctctctctctctggccctcctcagcccctgtcaatctgtgaacctccccagagcctcggcctccccgagtcccctgggaggccctgggccaggctgagagcccagggccctgggaggagcagcccgcggtgaggaatcctagaagcccctccaggggaggcccctccagagactcacaggaagagaccaccaaaacacaggcacacccctgacctccgccatggagcccccaggcaggcagcccctgcgggagctcccccccagaagagcccccgcctgaggactcaggtgccaaggcagctcccagcaggcacattctctacgtgggccacctgaacccccagttctcggtgccagtcctcagctgcctgctgagagacgccctggagcggctcgaactgccggtggctcgagagcacatcgaggtcgtccggcggccacgccaggcctacgcgctggtgcaggtggccacccccgaagacaccctggcctccctgccccggcgcctgcacagggcctgggggcagcaccagatcatcaaggaactggtggcccgcgggaaggagccagtgctgggtgagggccgggagctttcaaaccgccgagaggtaagccaggcttcccccagcagggggcccgccagccccagagcctccctcgggagaggcctgggtatggatggccttgcttggtgggcgtgaggggtgtcttcaaggaattggggacaaattggcaaatttggggctgctactcaaataaccaaggtcccagagggacactgacccttggagcttgcctccagcctggaagcaggtgaaagcctgagtatcagaccctccctacgcctatctacagccagcaggtgggtccggccaggccaggcccaagcatatacaggggtcctgaccttctccttggccgagctcatccactcagttgacagacacctgctccggggggcagcgcagcagagagcagggcttgacctcactgatctctgaggacagattccccagggaatgaaacccaggctggggcttaggcaatgggaccgactcagtggaaggacatccctagcagagggatggggtgcataccaggggcccgggtgtggtggcatttgcagggtggttggtggctgcccagggtggggactgacaaaatcaagccggcgggcagggctgtgagaccacagcagtgccagaaaaagtgggcttttgtgggggaggagggaacagtcaactcacttttgaggtggtaggctggtggtcttgaattgtccttcttgaattgaattttgaatccttgaactgaatttccttctggatgaaggctccatgacatttaaactgttgcagagctaaatgggcttacatttcaagacctgtggcctgatggcatgtttatatgacattgaggcttctctcgagtctctgctaagcttgtcttctctgggagctgctggtagggcttgggagtggctctcatcaccacaccccaacctgcactaagctcccagccctggaagccgcttttgaaggctggaaggcagcagggaaccagggaagggtttatcaggacagagtgactgcgggacttatatctggggtcagcaagagaatgaggagagcctggaggtagggagtcggtcggtgagacccagatcaggacagtggtcctgagcaggctgctcctggagccctcacacacagcagaaaccacgaaagggactcaggaaggcccaggggtgggagagactcaggccctatcagccaggttttcagggagactaggaagagggtgtgatctttgggaggccctctcaattcagagacctgcagctgggtcacaggggacctcagggcgctgaggcatcttccagaatgatcaaaccctgtgtttctgaggccgacgcaaaa

SEQ ID NO: 53598 - DNA, 1882 bp, Bovine  19866881072357
agtacggggctagaggtgacagcatagataaaacactcccaagaaagagaaagccctgccctgattaagtgttctgagacctggtgcagtataactctggttacttggagaatcaaaagcaaaggactcgaaatagataggaccatatggggtagctttggcaaagcattgtttctaggagagatgaggatgacttagaatgagggggtgctctttggagaccttgtggtgaagaagtaaaaattgagaacgacaaaaccagatctactatcctcctccccaccaaatagtcatttcactttactaacggaagagggcgctcttgaactaaaaaattcagtaagtctccccagatcctttcacctgtgtgtgttattgctgattcaggaaaataaggtactacaaagaatccgcctgccagtgcaggagatgcaagagatgaggggtttatccctgggtggagaagatcccctggaggaggaaatggcaacctactccagtattcttgcctggaaaattctatggacagggaagtctgaggggctgcagttcatggggtcacaaagagccagacacgattgaacacgcatacacacacaaaatgaagtatcaagtgacatttatgtaaaactattatgagaagaaactaaaaaaatgaaatctaaacattttgaggaatgaaaattctttctccaaaaccagtcacgaagtggaagaaaactgttacacaatcctgaattaaatgtcctctaacaaacacttgcaggcaagacaaaacagcttgaatcaaaaagtgaaaaacttagaagcaaaatggacaaataactgaaagttgtgaaatgaaagttttctaaactcaggaaacaaattgagaaacaacacaattatcttaaaaatagactgaattacaagttagtcagaggagaatagattcaactggaagtatatttggcatagaggaaaggcatgaaatagctcagagaaaggaaactaaatatagagagcactaaaaagaaggaaggaaaggaagaacttaggcaaagaagatctaacataaatatgcttgtttggcgacccccaaaggtggcactaatgctaaagagcctgcctgccatgcaggttctcttatgcctgggaaggtcccctggaggagggcacagcagcccactccagtgttcttgcctggagaatcccatggacagaggagcgtggaggactacagtccatagagtcacagtcagacacgactgaagagactgagcacccacacaaagaagaaagataaaatagtggggcaggattaatatgtttaaaacttaatataagaacatttcctagaaacaaaggacttgaataacatgttgaaagaaactactgtgtgtatctggaagaactgactcagaatggtcacctcgatcatatcccagtaaacttttaggctttgtatggtaagaaaaaaaatccatgagtccatttttttttttttttaatgggtgtgggatagagggagagaaagccttctttgcagaagaatgacaactaataattatagaaagaacagggtattcacatatttgcaaagaaatactcttcagattacttattaattacaatgaaagaacatatgatggatacaatcttagataagtgatcaaacgaaaattatcaacagtggggcacatcagtattatgcatttcttggtatcttatactaagaaggatataatatcacttacatagaattttgggggtcttccctggtggtccagtggttaaaatttcacttccagtgcaaggggtgtgggtttgatctctagtcggggaagctaagattccacatgcctcacagccaaaaaaccaaaacataaaacagaagcagtat

SEQ ID NO: 53599 - DNA, 799 bp, Bovine  19866881173226
acttgaaacactagagaactcatttctaaatttacacacacaaacacacacacacacacagaggggacttccattaagataagaaaagaggaagaagttaaaattcactgtgtgtgcattcaggaaataacactgtaggattaacatgtaaacccacatctcaagatgtaagctctgtgacagaggcgcggggatatttacggacttcccaccaccagcaaccgccatgaaagacagggtggctgtttgcaataaagggaaagaaaaggtgctctatttccgcacatctctatgcggggacaggcttatcagctgcagctgagactaggtctctcctcctcctgtatttgctctattattttcactacatcataaaatggaaaaggttacacgtttgttccttgggtgaggagaaaggacatgaagcctgagggatctggttctctttgtttctgattaagacagttctttttgtaagttttgacttgaaattaagtaaggataaacaaagcattttccaagtggacttatgaaatccagtactttctaaataaaccatatccaacagctatttaaaaagcaaaccagaatacccataggaaatatacaaatggggaaaagagggctatggtcaacaaaaatggttaaaaagctacttaacattgtttgaaaacgagcagcaacaacaaaatcccagcaacaggctgcagaggtgggaacccgggacaagttccagccacacaagagggagcatgggggtttcaggggcgtgatgcacaaactgaagacgaccaccagg

SEQ ID NO: 53600 - DNA, 924 bp, Bovine  19866881261077
ctgaggtttcactcttaactgctgtgtcctgttctttacttccttccccaaaatgtggagggaaatgttggtcagggtgaggcatgcagtaacagggcccatatctgcctgtatctcagtaaagatctgctatttcccagtagatgaaggctccagttacactgtgggtgtgacccaccaccttggctggtgtgtaaattccctggtgggggccaagggggaggtcaggtgcgcccttgaatgcccagcttggggccgtcctggctcagacttaggagacagagttgggccaggcaggaaggggcagcggggggtttcctcagggtgggtcggcttggctcttgttgtgctggaagccagcctgaaaaggaatttcccagtcatgtcttaattccatcttccttgcagagtaagcacagcattgaaagatgggctggactcttcacttcctcagaaaacagttgttcaaggaggaagaggagacgtgaggtacctttcttttggggaggaaacaacactatctcataaggtttcagggtctgattcttctctcctaggaagagaacatacctcaacaactccagagctgattattgcccagggaggaaatcttggcttggctgggtgatcatcagctgtttatccagagttgtgtaatagaaacacaatatgagtcaatatgtgaaactgtaaatgttctagtagccacattttttttttaaagtaaagagaaacaagtgaaattaattttaataacaaattttatttaatccaacatatccaaaattatgatggcaacccactccaatattcttgcctgggaaatcccatggacagaggagcctggtgggctacagtccatggggttgcaaagggtcagacagactaaagagactaaacatcaatcaacaacatgtcaccaat

SEQ ID NO: 53601 - DNA, 1337 bp, Bovine  19866881364648
cacacacacacacaaacacacgcacacgcgctagagtctccaaagacagctgggacaggcccaggagccaacaggcatgcagcagggcaagggagccagaaagacgtggagactatgtacagggggaggtgggaggcggccatgccccttctcacatcgcacccggcctctccctgaggtccttaggagcacgaggggctggtggcgctctccagggaggactgggacaggcgcctggtgagggagccgagcgtagagtctgccacggaggacgtggggaagagtttgtaccagccggtgactgcggcgctcaggtccagctcgtccagcatgatctgggccatgcccatgaagcacttgtgatccatgcggccgtagtctccccagacgatcacctgccagtgggcggaagagagagcagctgagccagctctccaactccagggctgggcggtggccgaggaaccgtgtagagactgccagggcacacgggactgcgagacgcagaactcagactgactgcaggcaacaacttattaagcacttgtggtgtgccacgcttattaagcgtttatggtatgcattatggtgtacagactttacatatattctccccattgttacaaccatctaggtagaggtgctatacggatcatttccacaaaaaggaaatgtagctcagagcgaacaactaacccaaagatacacagcagttggtggcacagctgggattagaagctggccctgacttccagagcctcctagcatccaggatgacaggcttccagagctggaagcaggctgagagtccaggacccgggccacagctatcgctctgctgctggatcatgatgataaacattaccacctggtggaagaaggtggtcaaactctgcttctaggggacttccctggtggtccggtggttaagaatctgctttctactgaaggaagtgcaggttagatccctgattggggagttaagataccacatgtctcttggccaaaaaaaaccaaaacataagacagaagcaatattgtaacaaattcaataaagactttaaaaatggtccacatcaaaacaaaaaaatcttaaaaaaataaaacctgcttctacctaccagctgtgcaacgtgggggcaatcaagttatccccccaaaccttggtttccttatcaaccaacaggaggcaataacacctcattaggttgtaacaaaaaatgggtaaagggtattaaagtgctggcacaggataaaccgtaagtaaattttaaatgacagtctgtagtctttgagagttgccccgctccccggcctcatgatgctcacctgcagca

SEQ ID NO: 53602 - DNA, 862 bp, Bovine  19866881405746
gccctgaggtcactgggcactccgccctggggaagggcagacggtccagccctcaccccctgtggagtggagcaatgccccatctggcccccaacaccaaaaataaaactgggtcactttccagtctggcgttttcatttccttatcactccaactatatttggcttctagagtcctgaggctgccaggggtcctgggtgagatagaggccacaggccctggcagtggccaggagaggaaactgccagtttctttcaaaaatatctgtgagttgtgcaattgttctgtcataatctggaaggcaggggctgctgccaccgggtggcaaggtaacccaagggcaccgaaggtggactccccgcttctgggaggggtgggggaggtggagcttaggggtactgccctcactgttcactcagcacggaggccagagtgtaactgggtgtccctgagggttcaggctctggtttggaaccgggactctctctcttgtttgtgaggccatctattcagatttctgaagccatttcctcagagacagatacagacggtccccatcttaggtggtggtgaggctcacatgcaatgtgagacctttagcacagggccagacccctaggcagcactcaagaaatgataataatgactactccacaacaataatcatgccctcgaggagtcacagtccaagtgggagtagtagcaggtaacaggcctggaaagttgtcaggatgagttggtacacggaagagttgggatgaggactaggaattaggtaggacggcccagcaggcaaacccagagaagggagggtttcagctggtggtggtggtgttggggggggtgggggtggcgggagggt

SEQ ID NO: 53603 - DNA, 1157 bp, Bovine  19866881406132
tggctctcactaagaacacggagcctgcccacagggctacggtggtggtgtcctctgcatggtcttctaggagttggggtcacggaggaaaaatcctgaaggctgaggagaagtagcacaaggagagatggctttgaccttcattcccacaccccctcaccctcagtgtctcctcctgatgggcccccccccagccctgaggatcaatgggggttcactttcgctgagctcagtgacactgctccctccccacttcctgtggctctgagctgactggcccaggagaccagcggggtctgggccagggacagctcagtggcacacccagagctgggagagaaactccccagatccctccagcacctctacctgccaggtggcctcagtctcttgtcctctgtgggaaaaggaagcaggcttgatctttctctcacttcctcctcccactgtcagtggaggtggatccctggaggtcaatagggtcaccccctgagaaccctccattcctactggaaagacttcccacgaggagaagggctgctaggaggagggaattctcacagcatctcctggctccatccaaacacatgcctgaaaaacggtaagatcggcggttcacatttgtgcagctccctgcacagctgtgactttttcatgtattgttgcatttagtcctcctgatagccagagaaactggggcagaggtgaagtgccccagggcaccagctagtccagaggcagaatcaggaagcccagacttgacctgttgctcagcgctctttctaccgctccccacagccccccactgccaatctctctcagtactgtgcctccaactccccttcctgagctctctcctacagagctccagcctctgcggcatgcctaggctcagcccccgcaggctccctgtttcctatcaggcctaatcggacccttcagcccccattccaaggtccctttgtgtccccctcatcaagcttgctcttcctccccatgttctgtaaatcctcccctttcccactccacccctcacctacacacacattcactacagcacaggggtatttactaggcaagactcttcaccgagtctcagtctccttgtctgtaaaatggggggtgtgaatagtattacctcagaggctgctgggggt

SEQ ID NO: 53604 - DNA, 1123 bp, Bovine  19866881593534
atattatttaatgttttatttgagcatgcaaaatgtatgaggtacttaaattttttaagtaaataaaattttgtcatagaaataggaggttgagatattgtgttaaaattcttatcttcctgtcttatctcttgatatttgcccttatagtgatgttttcttcttagtccatttcctcttgtagttctcatggatgaactcctctcagttttcaaagtcactttcacatacatttttaaaaagtctttcattttgtataactcctcagagctccatttatttacttggctgtgttagttcttagttgccgcatgcaggatctttgttgcatcatgagggatcttttgttctgatacatggactctttagttgtagcatgctatctccaattgtgggctcagttgcctggtggtatgtgggatcttagttctctgaccaggtatcaaacccatatgccctgcactgcaaggcagattcttaaccactcgatcatcagggaagtcctatctcgtattcttttaacagcttctttgttttgaccactttgttattttcatattagctctctaggtggcaggatcctatttgaagactattcagccctcctgtacctagtatatattatttttccctcctctttgcactgtggccatttatttttgaagtgcagtgaatatgggtcatttatatttttggatttctttcagacttggaggatgaaacagaaaccaaagagacaactttaaagaatgacatttcatgggaagaattacaccatgccctgatgatggaaaggttcctgagaggaagcaccttgatttccacattgggaagaatctccaaatgtcacaagttagaaaactaccaggagaacgaaggaatgggtgagagacaaatccccttgatccacaagaaaaggctcactcaggagagaggccaagaatctaacaaatttgagaaaaatattaatataagctcaaaagttataggaccagtaggccctccagaaaaaagacaccatagatatgacatatctggaaagaaaagtagatgcaatttagatttgattaatcattcaagggaattatacaagaatgaaaatctttgaatgtagtatatgtga

SEQ ID NO: 53605 - DNA, 1356 bp, Bovine  19866881596931
taattgtgttatttcggtctcagttactgtttagggcaccacctgacattcctgacttggatttcaaagtcatagtcaactcaacctgcttttggaacttgctccaggcattgaaatatctgacctttgtctctggttcttgccattaacacctctggtgaggacacaaaagtatctcgcaagtcctgccttttcagggtcaccttagaaatcctagcacttgaagatttgatatcatgatggttagtctctttgctcaagtgacatcaaagcctttttctgtaacgtgcagaaatgaacagttctgttttccccagtcacagtggcatactttcagtatgtccaggggagattggggcacagagggagtacccagtgccccaggggcagtgctactgcgtcccgccacccagatgccctcacatactcctctgcccccttcttcaggttcatcttccccaccacccggcttggggccgaaagccagttcagcgatttcctggatgggctgggaccagcccagattgtggggcgacagacactggcaacaccgccgatgggtgagtcttcttcttttatttattatttattgtaatcttggctgcgctgggtcttcattgctacacatgagctttctctggttgcagccagtgagggcagctctctagatggggtgctcagacttctccttgcagtggcttccttgttatggagcacgggctctaaggctctcaggcttccattgttgtggcgcgtcggcttagttgccctgaggcaagtggagtcttcctgcaggagggattgaacccatgtcccctgcattggcaggcagattcttaaccattgaaccatcagggaagtcctgggtgagtcttcttaaaggcagggtgagtagggcagtggcagccaagcagcagaccaggtgagctcagcaggggccccacatgatgcagtacaagccgcagaaaggagccctcactccagctcttatgccagtgaggaggcgtcagcatagcgagcctcagtccctcccacggcagagaggagaggggttccagcctttctctgctggccacactgcagcagcttttctggcacattcccgccctcacatcaccactctcacccactatctcaccacctaccatgcgcccagcagtgctagtgccaggcataagatggtgaacaaagattatcatggcatcgacgtccacggagtctgctctgtcactgattctttgtgggaccttgggcaagtcacatcccttctgtgagcctcagtttgctcatctgtaagatgggaataataatgcctgccttagttctgcaatctgaagactattttttagtctctgt

SEQ ID NO: 53606 - DNA, 1140 bp, Bovine  19866881656435
tccatgtaggatgaaggtagcacttcaggaaaatgaggggaaattcagtataggccttttaacaaatagatggactatcaagcaagttatttgggaaaataagagagagctgtgttcttaccctacacgggtataaattccaggtgaagcccatatttaaataataatgccataatgtaccagaagaaaaataagtgaatgttttcacaacctggggggatggaatggaaaagacttttctaagcatgatgaaacctgtacgccaaagggaaaacatcgataaatttgactataaaaattataaaactaaaaaaacttctatagagaagtgtgatcatattcaagtttgaaagacttgaaatacaaactggaagggctgcattccagttgccctcttctcttgcccctctggcctgccagcccctcccccgagccgcgaagggcatgagcagaagggacggatgtggcagtgacactcaaggcagagtacatcgaaaaggctcctcccacggcaccctggccagggtccacctgttcaggggccgggaagccccggaaatcccagcctgaccatctgggtccacagcaggtgccttagcacagcggagccagtctgtgccgaggctgctcaccacttccctcgtgtggccatagcaggaactgcaaccttcgattccgcttatgccgtttcccagagttaaggcaggaagactttttcttaatgtaaataagagttaaatttttgaggaagctaataatgttccagaccttgtgctaaacacttaacatagactatttcctttgacccttaaaacaactcttctaggggggtccactctattatcatctccatttgacagaagaggaaatagaatttggacgaagtgacttgtccagtctcttaagtggtgccatcaggattcaaggtctgactcctggccctacttttaatgcaagaaagccaaatccttggagaaaccaataaaacaacgtgttttttttttaaaccttgatcccagccttatcccaggtgctggcaatttagaattgagaaaaccagccattaggagagacaggcagagaaacatttctgactcaatgaatccggaaacagcagagaacatgttaatcccaggaagg

SEQ ID NO: 53607 - DNA, 573 bp, Bovine  19866882053232
ccgtgaatcctgctgtgagggagagaggaaccctccgtttccatggcaacatagcagccctgcttctcagcctgagcccaggctcctctgagccatggaagaagtgggaagaaagcccctccttgggcttttgagcccccaccaagtgcctcagctcaccccatatatctggtgctcctgaccccactgggactccggaagcatccacctgccccgccccgcacctcctccaacgctcccagggtctggggacctgtcttgtctgcacagaactggatctgagcccgagctctggagagtggcaggatgggtgaattccagtctctgcctgtagaatggtgctcatgttactacctctcagggctcttgtgaggagcatttgaaacagtgcttgtggaagtgctttgtgaattcagagcatggggtcagagtgggccactgtggagtagagattggcccaggctgttcgaagggacggcctttcctcttacaactccaccgtagtccgccttcctgtagaaacgcatgtgtgtgggctcctcggtgcacacggggtgggggggcccctgtaat

SEQ ID NO: 53608 - DNA, 2489 bp, Bovine  19866880116020
ttactccttgatagaaaagttatgaccaacctagatagcatattgaaaagcagagacattgccaacaaaggtccgtctagtaaaggctatggtttttccagtggtcatgtatggatgtgagagttggactgtgaaggaagctgagagctgaagaattgatgcctttggactgtggtgttggagaagactcttgagagtcccttggactgcaaggagatccaagcagtccattctgaaggagatcagccctgggatttctttggaaggaatgatgctcaagctgaaactccagtattttggccacctgatacgaagagttgactcattggaaaagaccctgatgctgggagggattgggggcaggaggagaaggggacgacagaggatgagatggctggatggcatcactgactcgatggacgtgagtctgggtgaactccgggagatggtgatggacagggaggcctggcgtgctgcgattcatggggtcactaagagtcggacacgactgagcaactaaactgaaccgaactgaaactttgaaaaaacaggcgtcaaatcttatgtgtactaaaaataagcaatttattcagattatgtatgtattgctaaaatattctagaaggggaaacttctgtatatatttctgatagtaaatatcattgttccagattttctattgtcaatttggtttacctggaaaatacagttctcatacagtcattagattcttctaatctctatctttaaaatgttattttatttcattttttatgtgaaccatgacaaagtataaattattagaacaaaaaactaccataaatagtttcattattgagaaactgaggggagggataaagccatatgctaataggtatcttggggctacccaggtggtgctagtgggagagaacctgcctggcaaagcagaagatgcaagagacttgggttcgatccctggattaggaagatccgctggaggagggtatggcaacacactataatattcttgcctggagaatcgcatggacagaggagcctgatgggctgcagtccatagttgtatagatttggagatgactgaagcaacttagcatgcaatagaaatcttgggaaaaggcactctaagaagtgattacactatttggaaaagaagatacaatgtggaaagatagataggtggataagtaacttacttttatacttggtagaagtcaagctgtgattacactatttctattattttaattcatgaaagagattaaattttacttatcccatactgataatagtaagcataaaaatatatagaatttttactctaattgaagaaaagttttggacatataaatatttatctttatatataacagaattatctttacatcaaataaattcccttaaattatattttaaaataaatatcatatcataaaagcagtacaaaactgaagtaaaaatgcataactggtataaaaatctgtaatttcaattatacttacatttgaaagccataaggctttcataattaagcctcttaattaatataaaagtattttcgtttttggtcaaattgttaagacaggcatattataagactgaaaatcgtttaatcataaaataatagtaaagtatatctgggcattgtctgagcatttatggtctcctaataaatgagttaatagagattctttgaacaaatatcttggcttaagatttaattaggtaactcctgaaccacagctgaagtacagtgtagtacacagtgtgaagcagaatttttaatgtaaaggttaatgagttaattagccacatttaaaggtttaattcaaataaatgctcaaccagttaactgtaaagtttagtcatttttgtcccctttgttaaattcttccaaattctttcccctctaaagtttgttaaatggactaacacataagactgaggagaagaacacaagaatttggttatgttactataaatgtgtatgttgtgatgaaacatatgatcaaatgtggtaaatattaataatcagataatgttaaatgtttattttctcggtctccaaaatcactgcagatggtgactgcagccatgaaattaaaagacacttcctccttggaagaaaagctataaccaacctagacagcatattaaaaagcagagacattactttgccaacaaaggtccatctagtcaaagctatggcttttccagtagtcatgtatgaatgtgagtgttggattataaagaaagctgagtgttgaataactgatgcttttgaactgtggtattggagaagactcttgcaagtcccttggactgcaagatcaaactagtccatcctaaaggaaatcagttgtgaatattcattggaaggaatgatgctgaagctgaagctgaaactccaatactttaaccaactgatgcaaataactgacttattggaaaagaccctgatactgggaaagattgaaggcaggaggaca

SEQ ID NO: 53609 - DNA, 5175 bp, Bovine  19866881216923
ctggcagcttttaggaacaaattctatgcacacagtgttacagattttgccaagtaatcctatggtccaagacattaaattaaatatattgaaaaaaatgacttatttcctgacacatagtggcacatcatattttaactcattctataaagctattttcttcattatacaatttccaatgtgaatttcattttatgaaatttactctttgtaaatagtgcttccagctggtgtgtaataagatggttattatttttcagcaaaagttgctaattttttcaaagacttttaggagtcattggaatcccaaacgggacttgttcatgatacaaatatggagactttatatcgggttggcaaaaaagttggcacagaaaaacccaaacaaatttttggccaacccaatataacattataagaaaaactacctatggttccagaaaacttaaaatcacaatatgtacgttctctcttaaaaaaaaaaaaaaaaagccaaccttttgtttctcaagaaaaaatataacaaaaatctataccatgaaaaatactttttacttgtcttctttggcttctggtacatcattaattgtgttagaaattctgaatcatagattcagggggaaaaatgccaaatgatataaggaatggtggcagctgctgaacaagaataaaacaggctcaatatgtagcaagaaaaagtaaaggatctatggaaggttgaagaatttaactttctctttttcaggtcaggatttgaattctggtttctcagctaaaccttcatatgatattgactctgattttaagacattatgaactgcaatttcttcatctgtaaaatggggctattaagagtactcaccatgaagaattgttggaaatactgtgagagacagtatatttgaagggcttcccaggtgacttaatggtaacgaatgtgcctgccaagtaggagacagtctcgatccctgggtcaggaagaccccctagagaaggaaatggcaacccactccaatgttcttgcctgggaaatcccatggagagaggagtgtcgtgggctatacagtccatgtggtcgtaaaagaatcagacacaacttagcaactaaataacaacaacaatatattttaaatacttagcatacaatctagccatcagcatactgccagtcataatttatatatataaattttatatattataaaataataattaccatatgtaatgtatttactattttattattctcaccattattagtgacataattaatatgttcatagtcatcaatactacaagcagatgttattatttattttgaatttataaggaagcaaagggggagagaatttaagtaatttgcttatatttccacagttcacagttaggtagtttcagagctacaatccgactttaagttttcgtgacacaaaactcacgctcttttaatgcaccataacacttccgtctctccttttagaccagaatagaatccatcaattcctcggtagagtatggcctagctaggctgatggtgaggtggtcagaaaagatataaattactcagatagttatctttttaagtagatagactttgaagagtgaccataaaattaatgtaggattgtatacagtatctctctatattttttaaagtcagatgaatgacaagcaagatatgccaattgtggcactgacaaaatagacagtattatgacagcttaaaaaaatccagaatatatatttaaaatagtcttttcaccatctgtctcacaagtgtcagacttgcttaagtgactgacatgcacatctggtgagaggctgctgtgatccatctgcatatatgccacttgccagttgcttgactggtactaatttgagaagcctatgctctaaaaaatattcatttaatggctagtaagtattcattcactgatatgtgcatgtgtgttttcaaaatgtctcatataaaactatgccattaggaggatgagaacaactggaatttgaattttcattcttagtccttgtagcatatggttctaactagtgtaagcacaaatttttcacttgtaaaatagtactaataaacttccctgtgtattggtggattcagcaaagtaaaacaagtaattcactaagtagtgtgctttgcacatagtaaatacacactaactaccaccgctgttattactgttctagtactgttactactgcggttagtacacaaagcaagacaatgaattacctgtgataggaaaagtgcagtcacttggaggcaaattaaagagtttaagatacataaagtggaaccagaagaaaataaggatgctgtaatctaaattgagtggcattgtaagtattaaataagaggaagaaattacaaaaaaagtcaataggaatgtagatataaaataagacaaaatttctgcccaggaagaattactaaaatctagtctacaaatggcaaatgcttgagagggtatgaagaaatgggaatcctcctactcctacactattggtaagaataccaattggtacaaccactatggagaacagtatgaattttccttataaaatgaacaatagaactaccacataacccagcaatcccactccagggcacgtatctggagaaaaccctatttcaaaaagacagatgcatcccagtgttcattgcaacactgtttacaatagccaagacagggaagcaacataatgcccattgagagaggagtggataaagatgtggcacatatatacgacggagtattactcagctataaaaagaataaaataatgccatttgcagcagcctggagggacctagagactgtcatactgagtaaagtaagttatactgagaaagacacacttgctatatggaatctgaaaaaaaaaaaagatacaaatgaacttatttgaaaaacagaaacagactcaagagatttcaaaaacaaacttgtcattgccaaaggggaaatgttgagaagggtaatgaattaggatcttgggattaacatacacacactactatatatggaatagataatcagcaaggacctactgtataccacagggaactctactcaatattctgcaataacctatgtgggtaaaaaaatctggaaaagaatgagcacatgtatatgtataaatgaatcacttagctctacacttggaattaatacaacattgtatgtcaactatacagcaataaactttttaattactaaaagctaaataaaagatacaagacctagaaacctacttcataaaaattatttgcaatgatgaaagaaatggttaatactcctaatatgtaaaaatcttttcaatcaacaatgaaaacactgaaacttccttttaaaaacagaaactctacctaaacaacgtacctaaatagtaaaaataattgttaaaaataggaaaaatgtttatcctcattaatcagaaaggtagtcaaattaatgcaatgattagaatttattttcatttaacactcagaagctattgtcaaatgttgttaatatttttttttagagtaaaatagatcaggttgttaatatctgcagggtgtaagaaaaatatctgacaatatgtatcaagaaatttctaaaatattaacctagtaatttaactggtggtaatctatcctgatttactagcatttagacaaatgcctgtgttcaaaatattgattttagtattctttcatttcaaaaattgaaaacaagttgaaaatcaaaaatggaaaacaagttcttgaataagacacttaataaataatttcatgtaaatttacattattatatcatagtattattatattacattacaaaataaaattgttaatagtcatgaaaaattatgtgacaaattaccctaatagaaaattgctagaaagaattttaagataacagtagggtcagttctttgtgtttctgcttttggcaggaccaacttccctcactcagctcatacttaacctttctgattcagtagcattctgtagcagggctcatggtggtaataaggattgaggtcctggccctggggagaaatactcagaggtgtactgtagaacatgtggagggcagagttcaggagtcctagaacccaggtaccaaaacctccctttccagtgtctgtcaacccagcctccataaacttgccctgccttctctgggtcgcgaccctccctgcctagatcagcccctgggtccactgtgtgggcactcttgcccactgctgctctcattaatagtgaatgtgaaattacagagggtgtttacttttttacttttcatttatatatttgagacctttatacaggttacaaatcttgttttatatataggttatacttagaacaatgctacttgaaatccatggaggctatgcaaacttggggtgtcgtataaactctgtacattaaaagtatttttaaaacttggtgttgatgatttcttattgtccacgttgtgatcccttaatgagtaactcttcatctccagtggaatgagcagtcagaaggcgatcaaacaagaacaggtatacctgtcctcacttgtgtccagtgagagtcagctcatctccagcttcactgaagagcaaccattgatttccttacaaaggtggaaatgcaacaaaatctttgactatttttgtttctttctgaaaaccaacgtaatgaatcgtttgagtctgctatgctgcaaggcaattacacagtgacaaacggtctcgagataggatccaggtgctgtatttgatgtgtgatacagagacttagagaaaatgaacagttttcattgttcattacagttatgtgagccaatgattagaacatcttaaatcttctttctctctctcttgctcttccttctcgctccttctctttaattaaggtagtttagtcatgacacattttcctttttccaagaagaaatgtgtatctagaaacaacaaaggaaaacaaatttaaagatgctggttttaaaaatgacttattctgtttcagaaagaaaataattgctttagttggaggaaagtggaaagttctaaaagtttgcggtaattgaaagcaagtcaggcaaactgcgcatcaaaaggaactactatatcagcaacaatcagtgcccacttgaaaaatagattaaataaataggtaca

SEQ ID NO: 53610 - DNA, 1481 bp, Bovine  19866881261278
taaaaagcaaatataactgagtgttaagtacagctccagtacaactgaagctggtcaaatgaatgaaagtcaaagtaaaatacatgaaagaacacttggggttcttccctcagttctgcttgctgccaacaaaataccttgagtctatgaacggaagaattaaaaatgttgaaagtgttaatatttaatttataacaaagtgatacctaacagattcttcaaagaacccaagggaatttctttttattagaactatctgagataaccttactttacggtttatagtagcaagcactcgatacctgattttaatgtatgtataaaatatgtgtatctgtatgtatatgtatgtgctgtgctgagctgcttcagttgtgtccaactctttgtgactttatggactgtagctctccaggctcctctgtccatgggattctctagccaagaatgttggagtgggttgccatgccctcctccaggggatcttcccaatccagggatcaaacccatgtctcttgtgtctcctgcattggtaggcaggttctttaccactagcaccacctgggaacccattccaggtgcaaaattactcaaatgtgtgtatgtatctctctctacatattatgttgttgtaatatatatgcatgtacctttctctttccattataatacatatattcaaatcaaactaaacagtgacatacataataatgaaaaatttactttactaatactattttaatgaaaatatgtgaatgattatcatagctgatgaaagtcaggctcgacccaagaaagtcctggaaggatggtaagtgtgaagaattggttatacacctggctggatggtgaggtgtttatgtatctagaatgaggtgttagttgaaactttgtgctcttctcttgtgttcagtcactcattcatgtccaactctttgtggctccatgaattgtagcctgctaggctcctctctccatgggatttcccaggcaagaatacaggagagggttgccatttcctcctccaggggatcttcctgactctgggatcaaaccagtgtctcctgcattggcaggtggattcctcaccactagcaccagctgggaagcccagatgagtctgtatctgatgcttactgctcagtcatgctatcacttctccaaaacatgaacacaatgcctcaagatacataaagtattatgattacctttcttaaatgtatttaaaacaaaaaaaaatgttgtgacagatgttgtcatgctgatatgaagtttctcaggagtcttcaagaaattaagtagttaattcactaaaaatctgtttggaggatattttaatatatttatacattctaatttaattcccaaaccatacacaatgaaaccccagtgccttttctcataggacatgaacataaaagatttgaacagataccataatgtgatagcttcttcaattaggaaacatcttgattccaata

SEQ ID NO: 53611 - DNA, 1866 bp, Bovine  19866881802530
cttgcctggaaaatcccatggacagaggagcctggtgagctacagtccatgtggttgctaagagttggacatgactgagcgacttcactttcactttccactttcatgcattggcgaaggaaatggcaacccactccagtgttcttgcctggagaatcccagggacagggaagcctggtgggctgccgtccatggggtcacacagagttgcacatgactgaagcgacttagcagcagcagcagcagggcagtatatatgagtggagtgtcccttgccaggaaagaagaaacatagggaatgttgtttgctaagaagatatgaatctaggagataaaaatgtatgattgacaaattgcccaaactttggctaggcagaaaacttacacccaacagaaatgtctatgaatattaacaaaaccaaagccaaattcagaactacataaattggtatggagttttttttttttaagtggtaagaaaatgattcaaataactgcatattttattaacttcctcatcttaaaaggcagattaaaatgtgttaagctgcttatattgagatttttatagttacctctcctcaaattcatgtgccttatcaaatataacttaaactggagcaccaaaggtctcttaatgaatctagatgtttgtagattaatgcaaggccttttgcaatcatttgctatttttctacaatgaacacacttttatttatggtaatgacaattgttgagtaggcaaagtataacttatggctttttataaagagaccaagactatatttttaacattgcaagtgagtttcaagaacaatgaaggacaaggacagatcccaaaccaggagggataataccctatggaactgccaatttatccacaatttaattaaatagtttcagtgatcccacagctaataagacccacaacagtaatataatttgcaaactctcaaacatttttaagtctttaatgttaagaaataataaaaacataaaatgattagggaaaaaaatcacattggaattttgaatacccagttaatccaagttaatttacattatggataataacatagatgtatataagcacataattatatacatataaaatggaatatttgtaatataatttgattgcataaatttgtaatttatatttgtatgattcatatttaacctcactaaaatctaatgctcataaaaactgggatttcttctttttctactgtattctggtgattaacacagtatctagcatatgctaggacttgatatgcatctattcagttaaatctgattccctcactgtatcaaattcaggtcattaacattgtcctgccctgcaggaaattcatcattttgatcgacgtgtgtttgtgtgtatgtatccacaaaactgggtttccctgttggctcaaatggtaaagaatctgcctgcaatgcaggagacacaggttcaatccttgagtcccctggagaagggaatgacttcagtattcctgcccagaaaattccacggacataagagtctacagtctctggggtcacaaaagtcagacatgactgagtgactaacacattcaaaaatgttcatccacaaagctataacttttccctagccacatacctccctttcatgtgctgttctttcttcttttattagtttccaataatattaaataagattaattatcctgcatttttatttcagcagtacttgaagctatactcaactgttttcaatttttatttagaaaattgaccaaatcaattaaatttaccagtttatactattgtataaatatggaacatatgcacttttctaggtcaataaagaagaactaacttcacttgcaagacatt

SEQ ID NO: 53612 - DNA, 1018 bp, Bovine  19866880357443
ccaaggatgtggatgtaagacctgagatataaatgatggggttgtttattattctcttccttttccaaagagacagatcaagcaagagttacaagcaagaattgtatgaatgggaataaaaaggacgcctcaatggaaacattaaacccattaattttagatgtttagtccattaatttctactgatccaccctttggaatatcttctgtatctggtcctctgtttctattcccacaactttcccctccttccaaatgtttttcaattcacgtaattctccctgtgttcattccctctcacctttaattcattctacacatggccttgaaaattaactttttaaaatgctaatcctatactgttgctttaaggctaagaaaaaaaaaatctcaaatgaatattccttatgtcaggatcaagttcttactaaacaccatggcattcaagttttccataagtttcatttatctttaaaaagattcaaattcttttagtatttcccaatcttattttttaaggctttgctcatgttttatatctacaaactcatctggttgtcaaaataaatggactgttctcctttcaaagttcagtctgggccatcactccaactagaaccgtctttggatcactatatttaaattgctctaaatatatattttgagaaatttattttaattaaattaatactaacttttaattatttctgtcatatttataaatagattgctatctactggaaaacaagaatcaggttgtgccacaacaataaaagccactatgattccttatgagtactcattatgaccagggtatgtgataagcaccatgtcttttattttttaatcttcaaagtcattgcaaactagtctttattatttcatttgacacatgagaaaataaaggcttatagataggtgtgaaatagctttactaagatactgcaaataatatttggtagagctggacttaaaacctaattctgtggaaaactaacaaacagaaaacccttttcag

SEQ ID NO: 53613 - DNA, 2291 bp, Bovine  19866880455103
tccctgccttcaatctttcccagcatcaggaccttttctaatgagtcggctcttccccaggtggccaaagtattggagcctcagcctcagcatcagttcttccaatgaatattcaggactctcaagagtcttctccaacaccacagttcaaaagcatcaattctttggtgctcagcctactttatgttccaactctcatatccgtacctgactaccagttaggtgcagtgctatgtctatgcatggggaggaggtgtgatgctcacgtgtgttgcttggtgccaggctgtgatgcacaaagagctgtatcagttcagaagaccagagtgttcctttgtcttgttaaccacgggatctgcagcaccaagcaagtaagtggataataaataaatgtttggtggttgaataaaaagttagtgaatgaatcaatgcaactaagtattctagaacaaataacacaaaaacatgtacacaggtgtacacaactttgagtgagaatatcctttcaacacagcttgaatctgaacggaggccaataaatttttaaaaattaaaatgatctaacatatttaggccatagttgactttttcaagaaaggctttggtatgaccataggcttaaatgtaaaggccaaagcaagtcagcatatgatatagcttttaccggactagtctatccttctcccaaaagagtaaaatatataaacttatagttttaatcagttttaattttagagctgacatccatcaattctcttagcttaggaagagttacttggtgaaagaatagtctttaacgaactgaaaacagaacaactaccatattacccaccaatcccactcctgggcgtatactcaaagaaaaccataatttgaaaagacacattcaccccactctttgttataacactagttattgcaatagccaagacatggaaacaatccatcaacagaggaatggataaagatgatgtggtacataaagataatggaatattactcatccatgaaaaagaacaaagtaataccacctgcagtacaatgggtgaacctagagattatcatactgagtgaagtaaatcagacacagaaagacaaatgtcacacgatactgcttatatgtggagtattaaaaaaaaagtacgaataaacctacatgcaaagcagaagtagagtcacagatgcagaaaacaaactcagggggtgggggaggggtaaattaggagattagactgacatatatacactactatacataaaatagacaataagaacctactcggtactctgtaatggcctagaggggaaaagagtcttgtaaaatagagtggatatattgaagttgaaatagttgataatatagtttttaaaatggcgcatggatatggattttagtccacaaattcggatgtgcaaatgatgtaactgttttttattattctactaggtggcaggataaaaaaaaaatcaactcttcctttcccaatgtgttaagtatatgtgtaaatatttcactttgctgcacacctgaaactaacagaactttataaatcaatgatactccaagaaacatttttaaaaatcacactctcgtctttcctcttgcttacctgtactttgcagttttgtagggcattttttttttggtcaaaatgtgatagattctatcataccatcatcaatgagagggtgctaaataagccatctgaagcactgtccccaagccccaccatttctgctccctctcctcgcagatgggaatgactatagacggatttatgctgctgtgcctttaggcttcataatcagcattcaagtgtaccttctcaatttaggatttgtcaagtattatcaaaactcaccaaccctgacagaatatggcttatactcacagctaaagtttattttaattcagagtataaatagaaaataaacagaaaaagagccaatattttctttcttccttttttattagaagcttagaggtctgataccaatcagtgtttgataaacagagatggcagtgagaaaacaatcaaataatgaacataaaatccatcatcagtgcacagccatattaagttacctacttcattgtgctgtcctaagacttgtacagactccaagtaaactttgggcttgtaaatgagagagactgttgacaagtaataggagacaattaggaaaggggttttttccttgtctaacttctctattagtgagttggaaacactatcagttgcataacccatatccattcctgaagattccttactaacattatcctgatt

SEQ ID NO: 53614 - DNA, 928 bp, Bovine  19866880489085
catatatatgtatggctgagtccctttgctgcccacctgaaactgtcacaacattgttaaacgaatgtacttcaatataaaattaaaagttttaaaaaactgaaaaaaatttgtgaaaagagcacatacttccaatgtgtgtgtattgaggatggaggcatacaggtatgtgtgatcttaacctcaatcagcattttatattgttggaaatacatgggaatgtcatgaaagtttaacagttaccttcagttaaatttggagtacagtgaaggagaaaaggaacaggaactaagagccaactacacaatactttgtgcagaaaggatcccaactaaagagctagatggcatttatgaaaatgactaggatggaaaggatgatgttttataaacttgctatatacatatatctgcagattttaaaacatatcctctattgctgaaagacaatttagagatagttggatcaagttattttacaggtagggacaaaagcctgagaaccctagtaatatgtccataacgtcatagctagagaatgccagagttggaataatatcccaaattatcagattcaagaaaaaaaaattgaacttgtaaaagtcagaaaactcagagaaccttttataaggtctgtagggaaaagtaaggtttatatgtatctaattctcatgtttttggagattggaactggggaaaagctttgcaggatacttaaaatcgagaacaggctctaacatggggtttgaactctactgggttagttgttctatccacaaagacaagagtagactgaacttaatattggaaggtttagaagctgtactgcatgttagaaatgtgttatctctagcctttttcctggtgttaaataaatgagttttaaatctataaacctatttatcttcctatggctttggacatatatc

SEQ ID NO: 53615 - DNA, 1366 bp, Bovine  19866880524904
attccgtcaatttcccaaggcatagtatgcatagtacttgaatcaggtgggatcctaaccccttaattctgcatttcccccctattattgctccaaagcaaagaaattctcaggtgcatcatataaatgtgaacgaggaattgactgtgtgcctaattccccactgttgcttttctattagtaaagaagttttatgctgagatccttatgcagaaatgtacctaaaattggtgataaagaacagaaagttaattcagaatcctttcacaaaaatttagaaaatatgattatagtctgtgctaaaaagcaacaggccagacctatggtggtttattatccaacagatatttaatgagcttctcctttaggccagagactatgctagacaatgggaagatattagtgagtagacaaagaatctgctcctaacaaactgacattctcaggaagaacatatccagcgaacaaataaaaataagtagtgtgttggcttactcatgttatagacttcattgggttgcttatttacatactagatatgggagtgctttaaaaataaagcacttacattggtacaaaatattgttagttgggtcaatattgaatcaaaagtttgatatcagtataattcttaggacatgaacctgagaagaaatattgagaaggtatatgaatttaggagtgtacctcaaagtcaaaatatgtctagttcaacactaggaatagtttcaaaggcaaaaaaaaaaaaaaaagagagagagagagagagagactatttaacatttagggaagaaatcataaataaggtcccagggcaggaaatcagagacagacacattgacaagaaagagcagtgatcttgtcacaaatatgttggataaattcaaataaaaagtgaacaacacagctaggaaacagaaggtaataataagcaaagctgggaatgtgtggggtatgaactaaatgtttggctttctcctttattagatttccatctgttgtccaaactttgcagattctcaataaaccctgttatcctgacatctttttcctacaaaattatgtatttttcttgggtcaccatagcgtctgtaggggctgtccagagtggcagttcccagctacagtgcttcagtgctaagtcgcttcagttgtgtctgactttttgcgaccctatggactagggcccaccaggctcttctgtccatggggattttcagacaagaatactggagtgggttgccatttccttatccaggggatcttcccaagccagggatcgaacctgcatctcttacaagtcttctgcactggcaggcaggttctttacctctagtgccacctgagaagtccctgttcccagcca

SEQ ID NO: 53616 - DNA, 1447 bp, Bovine  19866880527034
atatttagtgttcttgggttccctcaatctctgatgaagatgtcatgcaagaaaagggctgaaaaagacacaaagcatgttttactcttctttagcctcaatgacaaaggacatttagatgtgcaattaagtatttttcaaaatactgtgcctatttatttttctatcaacacgtggtaaaatatgaataccccctgactctatctaattacacaaagaatattgaagaagcaagttccttacatctcactggaaaggagcagccacactgctggactgcattcaagaagtcaccgctttcctatcaccagacaattgtgctactttacataatcagtattcaggggatgctactttgctaataggcaaaatcctacaatgacaatttaaatggtttgaaacatgtgcaagataatttggagtcacagctctgccaattgctaaacaagtgcagcaggaatggagactctgagcatcaagagtgctgctgggagaacagcctgtcctgtttgatcaaggaaactttgctcacatcaagtcaggagctcaagccagctaatatcatcatctcagactcttactaggggagattaactgtcttcactggataactccatcgctcaccatggtggaaacaaagaataggcagatggttttcagtggataggagtgcaaactcaggctaaaatacaaaaagatcttggtttgagccctggctatgtactactaattagctctgtgagcttgggtaagtcagtcggtctctcttaaattgactattcatctgtttgaaaagtaaaaaacaggacttacctcctagagctatgaggattaattgcaatacttcatgctctctcaaagtctgacaaatagtaagtactccataaaagttaacatctgctgtttaaaatgtggaattaacataattttgaaatgatgaaccccacatgaatgggctttagggagtcaatgaatctccaggaaatgtgacaaaattctgaattttctgggaagaagtttcattgctgctgttgttgtttagtcgctaagtcatgtctgactcttgtaaccccctggactgtagcctgccaggctcctctgttcataggatttccaagcttgccatttccttctccaggggatcttccacatctcctggcaggtggattctttgccactgagccaccaggaaagtccagaagtttcatagctttcattcaagtctcaagtatgtgaatagcaacaacaaaaacgtaattaccactaccttatgtattttccaatacagaaaagatatgttgatgaaccttcaacaaatattcttcaagtttcactaagtacaggcaccacactaaattctgaggatgtaacagtgagttttaagtgccttttctcagagacgtgtgtataggagagtggagaatggacatcaacaattaatccataa

SEQ ID NO: 53617 - DNA, 1364 bp, Bovine  19866880602370
atatttgttcatatactttatacacacatcagataccagaatacgtactgtgctgtgtggcatccctgccctttaattgctagtgtttcgtgctgtccttgcacacaggaggtccccagcatacctgctgagcaccagacctggggaaaaatgtcagaactcttttacactgagtgcttgtctatccacacaacactgagatcagcctttcccagtgataaatgtagcttgcatgacaccacaacatactgcttcctttttatggatgggaacaccgatgttcagaaagttaaatgatcattcctgggtcgcgtagctaatacacttcagaaataagatttgagtctaagtcctcattttctaaattctgtgcttttgtgttttaagttgagtgttcttccaagctacatcacagtttctccaaatttctttggtttccttggtagaattactttaaaaaataaaatacaacttatatgcatgaattcaagaacactgaaatacaaatgaatgtgtgtgtgtgtgtgtgtgcataagaagtagttagtctcttatttctcacatcaaatttagtaactttcttctgggcacacatactgtagttgtgtggttactgtgattctacatggtgtgagtgccaagtcacttcagtcatgtctgattctatgctacctacggactgcagcccaccaggctcctctgtccatgggatcctccaggaaagaatactggagtggattaccatgccctcctccagatactacatggagttttacctgtaacagtatatacctctgagtagctatgtcatatgcagaaaaaagccttacatttagatagcatattgcattgtgagagaatgttgcaatggtaaacgttatatatgaaatacctcttagtgttacccttatttgggaatgaaaagactagctatgtctttagaagtaaaactgagatattgtggtttactggaactcaaaatcaggaacactaacatggtgtttctggaacttatatgtctccttgccggtattatcttttgttctcaactcataattttggagactattatattatttcctttatttttaatgcttgctgtaaatggcacaacttctgacattcaagacagaaattgagtataaatctgttttccccaaccgctcttcattgacctaaattcttctattctggcttctcatcacccgttttcagcctttcaaattttatttctgaactctacagctgacttagataccagcatttcaattttttaaacacaaagttagtgcatttgtctgctttattttaccaagaaacagtaaaaagcactaaaagaggattaataaagagaaattatccct

SEQ ID NO: 53618 - DNA, 1545 bp, Bovine  19866880603129
acaagctaaaacacacgagcagaccatgtctccatcaataaatgaataagtaaaaaaatgtggcatatacataaactggaagattgttgatccttaaaaaggaatgaaattcctcaatatgctttaataagaatgtaccttgaggatattatactaggtaaaataagctggtcattaaataagacaattattgtatgattttacttatatgagtctcttagaatagtcaaaataattaagacaaaagtgtaatggtggttgctagaggttggtggggagggagagtggaaatgtggagctattatttaaggggtattgagtttcaattttacaagataaaaagagttagggggatgcatggtggtgatgatagcatagtaatgtatttaataccactgaattgtacacttaaaatggtgaagatggtaaatgttatgtgtattttgtcacacaaaaagctaaaacaaagagcaaaaacagatctacttctataccttaatactttcagtttataccactttactactttctacaactttatgaaactttcagtagctttctaaaatttataagcactggattttctttgatctgaaagatacataaaaacacattatatcaaaattttagtttccactactgttaaaagtgcactgcagggatctatgaaaacactgtctactaaatagatatatgttggtttcgtgtgtaattgcttccatggggacactaaatatagtccatagactgcaaggcaatcataagtcagaagcgacactgagtgtctaaatgtaaatgcttgtcttgcgtcgtgggggaaaactctagaaccactcctcttaccattatttcaacagccactgtttttgtctgagaggcaaatcgttggagcaacaaatgaatgtcatgttttgctttgtttcagaatccttgtgtcttgtccaggtaaaaccacataactatacatcttggtttttagttctgggatcttataatcctggaattccagtgaccttgcatggcagtcagaaagtcccagagaaacatttgtacccttagaattagttcatttggagttatattagctttagcttttgggagtgtatataggaaaaagtacttcttatcatatgaccaaaggattttgattaaattcttatccacaatttcagaaatatagctaaacagagaaaagcagcttctagtatttagaaacttaaaactagaaaaaaaaagtaatcatgttgataaaaagaataaaatataatcaacattttttagttaatgttttctgcagacatttaaataaggatgaagagttatacatgacatagttataggggaaaaaatggtaaagcaaactggagtttttatcctcaacttggctagtaaaactgaaatatgaaattatattagaccattatttaaaggacttttattccaaattatctcatctaaatttttacaagtcatattacttttgtgtatctcagtaacaccatctatgaaatgtgaaaagaacccagatcatatgctaattttatt

SEQ ID NO: 53619 - DNA, 726 bp, Bovine  19866880604134
ctaaaatgtaacatgcaaactttcttttgcaagaaaagcactgatgttattttattctcgttcatcgatgttgcctttcattttggatcagtttcattgcctctctcattttgtgtacaggaaatatattctagattactgaattcagtaaatgcactttgttcaccctgcttctctttgtttcacatctattagttatcttcctgcgccaattttaaccccctgaggttagtattctgactgttcaagtgaagagaatatctaatctaaacagtcaagtctcatcatactttgttctattttgacaagtgtggtttagcttttatttattaaaaaaatgcctcccagtaacctgtaaatgtacagtaatacattgtgtgaaaataacagcatctgaataatatgagccaatgcaatttcctgaaaataatctggtgtacatgttggtcagaaagatgaatgcggtttgcataaatatgcaaaattacattgcatatttaaatgtcatgcaaataccaccctactgtattcctgagagaaataaagaaaataattagaaattgaggtaagtgctgaagaggaaataaacaaagggctaaagtagaaattaaggatgagtggaatacttagagcaagtgatcagggaaagatcttgctgaagaggagacattaaatccaagacaagaaaggatgagtagcatctgggctatgtgcaaaattcatgtg

SEQ ID NO: 53620 - DNA, 1720 bp, Bovine  19866880619872
tgggatgggatggtagcaccagaaagtctttcaaagtaattaaactaaattttagtccttggctttgatatatttgaagggcaggccagtagaagcaaagtagtagttatttggacagtcatttctattgttctgcttaactcatattaaaatgcttagcagtaatagttttgaatgattaaatgggtctaaatattaagaagggtcttaattaactgaatggacttgcttaagaagcagatgctaccattacatataccattgtcaaaaatacctgctctttacccttaggaattacattgtctaacgcaaggtccctgttacctttccaacaacccaaagtgtcctccgatgaaaggatgtttgagggagctgtaattagactcgacaggggtttaatgtagtgaagacctaacactgatttggttttatatttgcatttatggtatatgcttatacttgatttccgtaactgagtctgacaactatattggaatattagcaaactagaaaggaatggcttgcatgaaatatgacaatatggttcagaccagagggaggttttctgcattgatgtgatatggcacctgaggatctggtaactgctagactcaatacgaccattaactgaatgggaaagcatttcactcttgagatgagcctatctgactcatacacttggcccacgtacttccatcctctctttattcacaacagatttgaagccttgcggtatacaggcaactgggttcgtatcatctcaagccacacattaacattagctaacaaaaatgaatgcaggggaatcgttgctgtgagatgagagtaatactagagagaacatgatgactaaaggaagaaatgatagaagctggagtaattaaatgcaaacattcaattccacatttctgtgaatgtattataaatacaaggaataaccagttttttctcccttcctctgtttggccgtcagttcagttagtcgctcagttgtgtccgactcttcgtgaccccatgaatcgcagcacgccaggcctcgctgtccatcaccaagtcccggagttcactcaaactcatgtccatctagtcggtgaagccatccagccatctcatcctctgtcatccccttctcctcctgcccccaatccctaccagcatcagagtcttttccaataagtcaactccgcatgaggtggccaaaatattggaaaatacaaagtcaaggaagccagattaatacctttttttttactccttgccttttattttgatttgcttggtgccttttttcttttcattgtttgaaccattcaagtttggacttctgtaactttcattttaaggcattttaatacaggaatcaaccactgtattctgtttaaagaagactttttatgatatgtaactcttgagctgggatttaaaataattatacaaatgtatttaactttttgagaagttttctgagggcagagttgctgcagagtatcattgttagttgaaggaaatgtgtataagcaaggaaggtgtttgtttcctccagggaagccgtgcctggagaacagagttccaatagttgtattttggtaatttgtaatctaaataatactaaactatcattctgagatttatttctgaaagttcccatatcctgacagttgccttccacaagaccatatcttttatagagtcactgcttcatgactgacaattatagtcc

SEQ ID NO: 53621 - DNA, 1892 bp, Bovine  19866880691210
catgtcccaggaaaggtaatttcaacctaatagatttcattagactgtgagttttagcttaaaggcatttctacaagcatcgctatggagtgaaatacaacatagtccaaaatgttccttagtacctgccttacttagtatagtcttgctatttctggttatgcgcctttggaccaccctaaagtattgtgctcctagacagtgcttacatccttccagtgacttgaatttgtttagtaaaatctacaggaggataagaccttccttactatgttagcatatttaacctctggggaatgtctgttttgacataattatgcacagattttatatttatacaaatattttgtgcctgcagggggtgtaaaatggatctccctcatgaatattcaacattgccatttcttctagtaagacacaaacatctttctttgtggatactaaacactaggctgtctatatattttccccgtcattcttttcttgcataaacctgatgagattcgggggctgccaaaacagacattaattttcccaggtacttcaatattctaatatctccacccagttgattcaatagaatttttcagattttcagcatcatatggatttctccatatataattctagatgcacaaaataaagtgatacatttaaaaagcttggctttgaactgtgatagaaaggagctaggagggatagggtgcctgtaatgcagagtctctatgtagcatgagttcttataagacagtcttctcacgctcagatttcaaatctaacagtaacgaaagacaagtgagcagcctctggaaagaaattcggaaattcttaaaagtgagcaatttctcttatatagtaacattgttcacataaagaagtatcattgcttccttcacacattcaatcgatgctctgagcatccagtgtgccaggaagtgttctaggttctgagaatacaatagagaacaaaagagataaagtccctattataatggaatttacaatcctagaggaggggagacaaaacagataataaatgaataaataaatgaatgaatggggaaaaatggatgaatgaatgagtaagtagtggtgagcactataaaggtgataagacgacaatttgacatgttacttgtcacagatgtgtgtgtagtgttttatagattacaagtgcattgctttatttacaataatagcataaaatttagcatgggttgtgtcactttaaaggttagacacaagaaaagattaactgaatacaacacttgcccactatcaacacagctactatggagcagaaatgtggattcaatgcattgcaactaattccagctccaagagtttcctttctcagagaccgtgatcttagggggttcctctgttcactcattttatcatgattcttaaaaatgaccttcagaaagtcaaaatacaaaggataaaagtatggttgagagtttctaaactaaacagtaacactcaaaagggattgaacagcaagaaaattgtagccagctaaataaagactgtggtaaaataggaactacatcttgggaagttgttccatcacttctcaaccaatttcaaaggattgcctcatacacatgtgaaagtgggagctttggtgagaggctgaaggaacatgtaacattaagaacattagtggaagcctggattccaggcctccttctcgattagtccaacccagatgatgcaaacagaattggaggtcatgcccagaaataaagattatacatttcccttgcattgtgtgtgtgtatatgtatgtttccttctggggtgtgtgtttccttctggggtaaggaggtttaggattccaaagggggaagtgaaatctcatcaagggctccaagaaactatcaaaaagg

SEQ ID NO: 53622 - DNA, 1117 bp, Bovine  19866880724694
attagtagtaaagcctgcagaatttggggtgtttagatacattctgacaatagctggactgtggccacttaactgtaggtcaggatttttcattaacctcttaataatcagtacattcaccattgccctgattcttccccttatacaagaaagtcactgtttattgctctctgatagatttcaatgaataagctaagctgctttcaaattatttaaataattgtccttactttcagcttgctctatcttgagacttttcatcattttatccatccaaagcaatcctcctgcctcacacagagataagaggattttgttctgtgtcttaaatatgaacattgatcacaataatttactcattcagtcagtagaagctctaagtcctactgcaatgcctgatacatagtaaataaggcacagattttgccctcccagagcataaaaatcatgaggtgtcaaaacctgtgatgattaatgtgatataaaatcatgttcctaaagacagcagctacccctatagtctggggcttgtggcaagatagccatctctcatctagtcacacagagtttgggctctgatgaatgattgaatacatcccactaaattggaaaataagtgtgtatgtcagtgtgggtatgtagaaagggggtaaaaatttaggggagagcacagaattagggttagagaagaaaaatagccataagtataaaaagttcaggaaaagctaaagagaaaccaacacagctgcccagaacccatgaagaaaatacgtggcatgcttaggaaatcttgagtaagtttcctacaactggaagttaaaggccactatactttttctttaagaagtatctgagaggcaggaaagagacactgctgctgctgctgctggtaagtcgcttcagtcgtgtccgactctgtgcgaccccagagacggcagcccaccaggctcccccatccctgggattctccaggcaagaacactggagtgggttgccatttccttctccaatgcatgaaagtgaaaagtgaaagtgaagtcactcagtcatgtccgaccctcagccaccccatgaactgcagcccaccaggctcctctgcccagggattttccaggca

SEQ ID NO: 53623 - DNA, 756 bp, Bovine  19866881017153
ctaactgctgctgctgttataaaggatatatcttgtatctgttttcggtgtgaagaactgttcagcactcactgtttttaagagattaatagcctttggccatggctgagctacagtgactgacatctggaatccacttacgagagtttattatcagtagctcaagctcttgatcttatttttgcagtcattgctactttgaagaaaattgtattctttctctaggttcccataagtgaaatatctgagcatagatgtaatgttctttcttgggaggtgagtgttttatttgcacattctggggagtttgtatataagatatgaatctaaatatagctattcacaccttctgtcctgcttttaactcttctgccttcttaacagagactctacctgctaaataaagagcacagtttacattacacgttaagcagtgttatgtaaaaattaagtcctgagaaaaccctgctgtagttttgtaggggagctcagtatgtttgccatcagatttattttagtaataccctgactgtgcttgcattgtcaaagtataaaaattggaaagaagtgatcacttaatcatctaccaattcatattcatagagacactgggatagaaaattatcattaaatctgctgactgtttttaactgtctgagagacttggcccttaactatgtccattgggagattgtcttcatagctagttagtgcccctgggatagggtcccttaatactgggaaaattagcatttt

SEQ ID NO: 53624 - DNA, 1214 bp, Bovine  19866881020258
cgtcctcactttctctctctctctcttcccctctttctccgatcctctgtcctccccattctttgcactcaatttcctatgctggttaaagtttgttctacatttcaatatctgtctgcattagcatgttcactgttccaggaacagcatgtccctgaacatctctgctggatatgaaactttcaagcataactaatatgacagcaaaatgaattttatttaaatgaacaatacatttcttggccttcatgggtcaaggggacagcagtgggaactgcctctgtttacaatcatttgtcatctatccacaaaaacctagttagcctagaatgcctgtgtctacacaggaatgcatttctttttaatagcatattgtctttggaaaacaaaccagaaaatcacaaagagatgataatttatagttcagatcaactgcttcagtttgttattataaatagaaagcatagaaaagtgattactagattaatagtttttaaccttttaactaaatcagaaatataatgaagatgaacagcagtccaccagtcaaagggaactgagaatctcagtgggaattgaccccaagttctgggttattgactaaaccatcgttgactgcctgattgggcactcttttcccctgacatataaattcactacaccaggctgcctccctgataaatgccattgcattctccatctcttgctactgcaaaggaaaagtgttgtttgcttataaaacttcccccacacccacattttctatcaggggaaaccagtgcctctgggtatcacataccaagcccatcaccccattaaactggcagagaagcagcaaattactaccaatccctacatttcactatttcccattcattcacccattcagcactcaaaccccgttttgtgcctttagtgcaccaggcattgtgctggctcagataggtgatccaaatatgaaaaaccaagaaattacactttgagaaattttaaagtgatgttataaagaaatgcatagaatagaacagagataaaaccatcatttctgaggcagtttagcaagttttcaccaatatttgtcaattagtcagtctattggagagcagttgggcatttctttagatgaataaaagcattttagagagaacagcatgccaaggtccttatatccccatgtaagaaattagaatgtaattctgcaggcaactggggat

SEQ ID NO: 53625 - DNA, 1330 bp, Bovine  19866881033080
tccctcctcccttaaacgagatgccagtccaggttcattgcctttcattttaaacttttgttttttattatcataattacatggtgacaaccaataagctcagttcattgtatcttacaacttttttaaaacataaacaagttgagatacttggaattttactgagctttataccatgcttctatgtaactgtgtgggcctattagcaataatatgagtattaactgatacagaaagtttaaaaattaagtaaaacatgtagagataccatcatattacattagatttaacagttttctggccattaacatttttctctttatgttacagaatattataaagatagataacttttctctttgttgaattgtatcatagacccaaagttcttatagatcatccttaaaggaggagagagggggatggaggtggaagagaaagctataattttagtttctcatttctctgtcagttttattacatatccataatagaaacctgcggcacaagcaaaatatatttcaattgctggatctaatgagaaagagctactggtgaaaaaaatagaaatcttaaatacaagtgagatttgatgtattcctgacatatctgacatatgcttatttatagaatcagaatgaagtttgaaaaacgtttgaatttgaaagaacaaattttttagtactttttattattctttttttttttttaataaccctctctccacatcactccccaaatccctctctgtttctccaagaaacacacacacacacacacacacatacatgcacactacaggataatgttccttaatgtcctgtactcagttttctattaagaaaacatctattgagtgcctcaaatgggctaggtattgggctagttcccagatcccagtgcacataaagtttatgaacttatgctcagcacaggcataaacaaaatgtaatcttgttcactcatcatagaagtcctctcaggtaggatttcctcctatgccatggatgagtaacttgctcaatgtcacttcaataattaagtaagagaggtcttccaactcaagtatttctagagatacaacaagttttgaagtccatatctttttttttttcttaccatatcacacatataattaacttcgagagaaaaccatttttaaaacccaaagtttgttctgttggttcagttgtttagtactttgtatagaaaatgttttgatctgtatatcacaacatggcatttgcttttttcatccatgtgttcgttgacttatttattctagttttattaagcgcttatctgggacagattttataacaaggtaaaa

SEQ ID NO: 53626 - DNA, 689 bp, Bovine  19866881104956
tgagggtcttccctggtggctcagtggtaaagaatcttccagcaatgcaggagccacaggagatgtgggttcgatccctgggttgggcaaatcccttggaagagggcatggcaacccactccagcattcttgcctggaaaatcccatggacagaggagcctgatgggctaccttcatagggctgcaaagagtcagacattgatgtaccttagcacgtgtgtaatggatgaaactgaatcataataggtgtgagattttagctatgctacctggtgtatgcaagttccagaactagaaaaccaagcctgggttgtcttcctcaaagcccactctcctaatgacagaagcttctcttatccatatctaagccagatctggctttaccaaccaggaggacagggataaaagtagatgcttccattagaaactggcttgtaaggaacagtaacaacgcagtgcctattagagtgcttgcttccctaatgtttctccagaactgtgtgtcttcacctctgtgtctccttgctggattttggcacagccttggcttgccaggatttcttttccagctgtcagcccggtacacagtggcattgcatgctgtctcgctgtaccacagagcgaagaccgtgcagagcatggcatctgacaaagtgcaaattgtttctctgaataagcattattcattt

SEQ ID NO: 53627 - DNA, 1917 bp, Bovine  19866881168729
tttcttttcttggtacccctcattgaatgcatttacaatgatgtacttatttagcttgtttcagggacataatcaggagtcacatacaagtaaaccatgataatgccacccctgataaaagacttttggtgtaaaaaatgtatagactgaaaagaaatagaaagaatatagaaaagaattgatagactgagccttacattctcagtataaccttgaagtattaagtagattgaaatcaaagcagtggtgtttgggctttttcttaataaacagtagaagacaggaacaaagcctcacttgatattaccgtttatttctaagcattttgtactttcaactaatgttgtctaatgttaatcctttcaactaaactcagcatttcatctgtaaccctgtcatgatggtgaaggagagctctacaggaataaattcagtgtcaaaattgacaagtgggtttagtcctggctctgcctcttccctgctctgtgatttagaacaaaatgtattgtagttttttggttttttgttttttcctggaattttgctcccaaattcacagattgtaatgatcggacatgataattctttagctgcacagccctctaaaaatctttgattccaagcaatgcatgatgtaaagctacaaaactaatttacattcgttgaatattgattctatcttggcagtaaagtaataaaccataatcccaaagagttaattttgaaaagtaaacttccattcaattcactgaagtagcccgggttcttggcagtcagataaatgaaagctgaaattgtttaaaaaaaaaaaaatccaccatccttgaaagttcctcatggtttattctcaagaaaaaaaggtatttctcaaatccacatatttcttctataaagaaaacaatttggatccaactgtatatgatcacagtgcctctgtcagaggtaaaaatgttaagggagacctttctaaatatgtcttacaaatattttagaaattaaaaggctggtaccatggcaatggagaaataaagaaaagcaatgatatttggattatccaagaaattcttgcattcattcatatataatctgaatggttttctctactgaactgaggtatgttaacatgaaatacctccatattctgcctccagaactttaggaaaatggactccaggattattgctgttctaaagaggatacacagggtgatgcctgttcttccaagagcccgcactggcagatggctggcagtgtgcgtgttgcctcatattttcagttctctcttttgctttccaatgctgaaatatggaaaacacagcattgtaaatgatcctcacataactgagggagtgatgcttctaacaatttacagatattcaagttcaaacaaccaggccctgggtatatcaaatggcatccagccactagaagttttggtaattatttcaggtagctgattttgattacagcataatgagatgacctgttctacatctcatcagattgtcctctataattttattaaaagttaatacttagtggggaaatgacttaagtgtcaacagtcccttgtcttttattacttttcagccttgtgtcaaactctagtttgacaagtttggccctgatgagtccaaattctggccactcctattcctctgcaaagctttatttaccagtgacatgactaggaccacagccagcctttggaggaaatattattacctgagttctaattgcaaaaccaatagttcaaagtagtaaggctgttagtaaattctttcacacttctgaacctcagtctcctcttcagtaaaatggggatactgaccatctaaaacttgcatggtttctgtaaggcttaaatgaaacagtgcacgtggaagatctagccccgtgtattaataaagttcatgg

SEQ ID NO: 53628 - DNA, 1728 bp, Bovine  19866881214965
ttggttggttttggtacagctaatcttgagttctggggtgcacttgttcccatttctttgcggtcaattctccgaattatggcagctcaagttctgggtatagtctagtcctgatgtagttaacttcttcacctgttttggtatctctaagacagctcacaggatatggctcagaaaattatctatagccctcgagaaagaggaagggtccttgactgtgcttactgactccattgttgttatttagtcttctctgactgtttttctttgtttcagtatctctcacttctcccttcacttttctttgactaaagctttccacaggcaaaaggcaggtagaggatgtggggtggggaggggggcaaggaccatatggtcctgctccatttcaaagtcaatcctatttcagttatttaatatgtttaaatcatcatattgtgaatcataaatcttgattttttttttttttactagtacaccctttgctttctggcctgcttctttcttttacattctctttttcttttccttccactattattattttgaaatttcccctacgcccaggaagctatttttatctccctattttttctgttttaactagctagactgacagtaaaaaagttgagattcatggtcatgaaaaatatttccatctgcctaagatttctcattcttggcttgtggctggtttttccagaaatggtaccaaaatcagggtctgggcgaaattttgatgcaaaaatttctcaaactttgtaaaaactaagaaaacaggaatctggagagttcaaaccagataaaggaaaacaatgtgggctaataacacgtggggaaattagcaagatggtgccccatactctcacgccctctcgccccacgtgccataaacagtgactttgcaaggctgtgtaacagctgagatcgctacggcagtgcacatgcgtgtcacagggtacttggccactggctatgtttgttctgtaagtaaatacaagcttcacctggaaaagcccggaagagttgtgtgcagttatgttgtgtggtgttatgtctgctgctacgggctgctgtgccagccaggagagaagacatgtgtctgcggttcctagggctccttgcattttcctccagcctcttagcttgcgcctgacctaccatgggttcaggcaacagtgcgcacagtcagacacaccaagacaattggcactatgcgcaggatcggcaatacagcacaatacccaaaaggaaacgaggccttttcaattctatccacagaattgtaaatgtctgacagtgtgtgtgtcagattcagtacatgatcatgtgaggtcctatgcatacaaagacagaagtagcactcacggcctcaccaggtttggatttactttccactgaccgcgaggtgggtaagttttgtctttgtgtcttcaacatgcaaaactgtactttgcttttccctattcacctagcgtcatccttactaactacacgagcttgactacctctgtgcatcattgcgatcttagtccaggctcctcatttaagattattctcaaggcagccaagctaattactgtgcactttaagtggctgagttaaaattaactgcagccaaatatttaccaacattgggtaaacagaatcttgctcatttatccccctcacatatatacattttttcctctcaccaataaaaggaagcacagtgtagctgaaaaagaa

SEQ ID NO: 53629 - DNA, 940 bp, Bovine  19866881281159
tatcttattaattaaaaaactgaatatgtctttcagggattttttacctctgcatgtatgattaattcataccaaagtcatcaaaatacagccaagtgagggccatttgatgtcctggtgccctttaatgagagatttcaatctttttccctttaattgagaaattaaaaaaaaatctagtcataaatagaactcagcctctaaaaggaccttggctttgcactgaaacataaatgcttatgaaatcagggagatttcgagtacgttcttttctatcagtaattctgattagtctcatagatataattcagtgttgttaagattataaaattggttcattcatcttgagggtaagagaattaatgagatgatacctggtgaagcaatttcaattcagaggtagactctaaaagtgtgattcatatttgtcattattgctggttgctgtatttacttttataggtgtgatgaatatggttttaatttattatggttgcattgactgtatagccatactgaatcactaggacagatattgccatatgatccacatatctctgaaactccatctttttatagaccagagcagggttaaatccctggatttttttttttttttttgaaatatgcatgaaggattactctacaattaattttattagttacaattattgagagctatgtatcagctgctatgctaagtgctttaaaaacacttttcttttactattaaaacagccctgtaagctaagtattatacccagtggactgttagtggcaacacaggaatttaagtctgggacttttgattttctttgtcatgagctataccaggtaagggttaaggagattaaaatcataacgcttccactcttgcaagcaagatagtaaatttattttaaacttgttttatttctacattaattatcttagaaaccta

SEQ ID NO: 53630 - DNA, 709 bp, Bovine  19866881283497
tagagagccctaaatatctaaaaatatgatactgttatggtatattctccagtgaaactttctgaacatcagttacttactattaaaatattgttatgcttttctacccttgtgttctcaactatatcattgaactctcaattataaactgttgttgccttggtgcactttattctgcaaaatagactgtaagctttctatggacaaagtcagaaattgacattccactgttttcccccactcgactagtaccccattaaatccacagcaaaattttcattttgtaatttattctttgagcagatgtaatggaatatctttattttctttcataaatataaatattatccaaaatatctctacttaggataaactaagaactttattcctgttgttaacaaagggaaagttgctttggtataagcatttttcttaagtttctacaatctccatttatttcactgagacaaaatagtcacagataaaagctattttttttcccccaaaatgtacctaatgattgcatacacaaaaatattgctgaatgtattagtttttttttgtgaaaaagttcattagtgacaattttattttgtaatttacctagaagtctatctatggatactgcaataagaaggctttaatactcttcaaatttgcttccctaattatggtaaatatcattagctgtgatttcacatgttcaggg

SEQ ID NO: 53631 - DNA, 793 bp, Bovine  19866881356173
agggtgaataaagatggaggggtatatgtatacttatggctgattcacattgttgtatggcagaaatcaacaaaatattgtaaagcaattatcctccgatcaaaaattttttaaaaaatgagaaaaaaaaggaaagaaaatcatgggttgggcaggagcagggcagtaaggggtatgtgtaggggagaagagttgtagactagaaatgcatagataaccacatcaggaacctggagttcccttctgtgaagatttgtaactttatattaacctgttagtgaaaaaagggccagtatataaaaaagaaatcaaagtcctagggggttcctttttgacacactattgtattatcttcaactagcatttcttagtggctcagtcggtaaaaaaatctgcctgcaatgcgggagacctgggttcagtcctaggtagggaagatcccctggaggagggcctggcaactcactccagtgttcttgcctggagaatcccatggacagagaagcttgatggactacagtccacggggttgcaaagagtcagacatgtctgatcgactaagcacacaaaacattttaagtattctatatgtcccttccattataattaaccccaaactttttaaaaataagggtgattggaaggaagttaaatactagagaactttctgaggttaattgccaattacagagaatgctcttggaaaaaaaagttcaaaaagcactctgcttctcatttatggagctgtttgaacacaactcaggcaggtcaggatctgttacctaaatttagg

SEQ ID NO: 53632 - DNA, 934 bp, Bovine  19866881389678
tagattattgaaaaaattcaagaaatagcttagtttttcagataggacacaagatctcattaccagcataagttgggatcagcaatgcattcactctatttttgttgcccagtggtaacatgaattctaagatggtcaattccttttatataaccatgaagtcaaggcaaatgagacagagtatgaaaaagaagaagaagaagaagaaaaaaaaaaaacccacacaatgaatttggaagatagtgtgctatacaaatccaagcaagcagtgctctgaagaacacaatcttaagcacttcaaatgcagtaactagattgttgatacaaagaaaactctcttctcccacctgctctttcttcctatgctctttccaggtgttgctgtataatttttctcataaccaggcaattacacccagtgaattgtgtggttagtcagctaaccatctgctttccaagagcaatcatgtgctgtgttcacaattttcttgattcaaagcataaagaggatgtagaaatctcatgtgcaacatttgaggcttctttattttcaaataatgaactataagaacaaagaatattggaccagctttccttgacttgcctcaaatgtatttaggacattgcagaccatagtttaagaagcaaggagaggagcaataaaagtcccttaatatataaacataaataaatatatatgactattttaatttttccttgattgcattttctctcaacacccaaaactatgaataggctgtaaatgtatgcctccaaacacccagacaaaagcagcaatcttaattagccaaattaaaacagtaagacacatccgattatccctttttagtctgaaccagcttctaaagtgacaactgatggaaaataattaaaacaagacagacggaaaaagaggagaaataatgtatttaga

SEQ ID NO: 53633 - DNA, 1559 bp, Bovine  19866881402356
acttgtcacatttctaaacatgaaagttacacacagattcactgtgtttcaaggatgtctccctaaaactatgagttttccttgcacattagcaagtgaggccattgttcctataatgttcatagcatctcttatgacgttggaaattacacaatctatccatttatcttcctcaaacacacactcataagcaccatgagcaaactatctttttagataaatataagacataattttttttccaatacctttctcaatgaagcctatgagaagacataacttaaaatatacaagcaaagcaccagctagcaaaataacctcctaatttactactaatttaaagagtgcattgaaagctgttatcagagatagtttaagagaagagctgccaagcctggagaaacaggaagctagagatataattggcactcaacactctgaaatgcttctcaaagaagagaaaatcatatggttggaaatcagtaattttgtgaacattaagttccaaaatattttgcatgaactcaccgagggatgatcattacagtaaggaacactcagctagtatgaacaatgcccagtgagtagctcaggtttgccttcactggactgcagtaacaagctacacctatgtgttcagacactaagcagagaggatttgggtaggatccctgaggttatctgaatgcgttcagtgaagaaagaattgagcttactcaagctgtagtctagcctactagcaaagacttaagagtcaatattgaatctttttttttttttttcctattttgaaaaatattagcatctatatccctaaatgtctgtgactggtccagagtttattcatatggaacaagcactgacttttgaaatatggtttcactttcttatgtgaacaagaacacagacttctctgaaatacggtctcttcatcatcagaatagtgctctagtccaataaccctgaatgcaaaggtatgagttaatacataaaagtaacagcatgaggcatagtaagagtggttcattgaacaaaaccaatttgtatttggatattggggaaagttgtgcttcctgagaaagctgtgcatcacctctaacatactttgtctctaacatattttttcaatgtcatctgattctgggggacctattttacatctcccagttgtagataactggtatcactggaaagttattgagtatgaatccagcgtggtagaagaacaacttttccctgctcccattgaaaagatggttttgacattttaagttgaaaccagttaactcagcaggcctgaggtgcccaaatccttcatgttccaaacaaagactggctcttggtcagttccagggagataacctttgggctcatagaatattcttcctgataaaaatgttttgtgtactttttaaaaatgctttgggccactctgtactaggtaactttatcctaatgacgctatttatggtgaaagcctttttatgttgttctgggtggtgggctagagtctgagtcacggagcatcagttacaggacagtacacgtttacagacgac

SEQ ID NO: 53634 - DNA, 697 bp, Bovine  19866881560382
tgaaatggccaaatgcagaagtgaaaagtgttgtgctgtagtttcagtgatcagatgtttctcctattttttgttgtctggaatcctctcttaagccatgaagattaatagccctacttgacaggtggatcatttaaagtgttaagcatcagtgataagctaaccatctgatggttggaacaagctagtagggaaaaaagcagtctctgtcacagaccagtggcccagtagatatggagatcatctgattcagcagtgttagtttatccacatgatcactaaagcttcctcaaggaagaaaaaaagcaaaagacagccatcagactgcatgttccaagtatttgccacctatttagagatataaagacaagtgaaatagctcaaataattattgttgcatggagaaaatactgactctataaagttcctgtaaaaaactactcacagaaatagacttgggaaggttttattttctttacttccccctctgccattctaaaagaactaagctctggttcttcaagaacagaggttcttaatatgcaacctcaggaccagcagcaacagcattacctgagaatctgttaaaaatacatgctatcagaacccaccccaagtctgctgaattggagactcgggcggggggggtatgcttggcaatctgcttttgcagccctccaagtgattctgaaataca

SEQ ID NO: 53635 - DNA, 1109 bp, Bovine  19866881712231
tctctaagagggactcggaactgcatgtagctgtatatgggatgcatctatggaaggaggaaaattcaggggtctcaaatgtcaccatcttggtgacatcccatggtcttaggaattcaacatatgaattttggaaagatatcaacatacagtccatttccaacacctcctctcagtgctaagtccgtcttactgttactgtccttgaagccattcaaaatgattgttttatttggaaagcatattggtgcccacatgttcgtaataggaaaagcatgtacttggatagaaccttggttctgtttttaaaagtccagtactaattacaacccccatactggcttgtggttattcccttcctgacttcctggctccatcagtttatcatgttcatatacatcattattttgtgcataaaaatcaatgaggcttgaaagggtgactggtgggggtttctctctttatgtactctgctcctttccaggcatggcagcttggatatacagaatgtgcccacagggcattttattagcaaatgttgtcactttattctctttccacttccccaaaagcgcttggaaaatttcagctggagctgtgtgtacagctgccatccccactgccctgccatgtctttctcagatgttccatttggcttagcaacatttgtcatagagccacttagctgtgctgcagtctctgagatttagtattacaaagtatcatggtgccagttccacaagaattattgaggctgctacgcggatgaattacatgtaggtcatgtcctccaaaggctctaaccttccattagaaaagatgtacgcaaacgaaattaacaagggaataataaaaaagaatgcccaaggataggacaggcaagaatcgtatagcaatgagtcagcttcggtattcctcattggatcactgggctgacacagtgcaaaatctactgtaaaatcatagcctctttggatttagtttcttctccagatatactgagaagaacgctgatagggactccccatcatagatatctgatatctgatacatagatatcagagttggaggtgccttcagaattacacaatccaattctattttggaaa

SEQ ID NO: 53636 - DNA, 1280 bp, Bovine  19866880409984
tagagtccagctcagggtgaggatgcctgcggtgggattatagtattgtgtgataagttcttctgtacaacttgatgtttgaccttctgcagatatgaatttaatagaacattttaatatacatatctttattcagcacctgtcatatcatccgacgtgctagaagcttggtggactggagagactcagtctcctcttaattccttattgtctccttggagagagaagatgctaaaccaaccatcaaacaaaataatcagtatgattacaaattgtgatgaatgctgtaagtttaatttcatagcacgcagaaagttagcactacttgtataaacttaagtctttaatagagatactgcactgatttttaaaatgtaattatttgagaataggaacagttcttttcttgagtagcttgttgagctcaaacggcatgctgcaaatcagatctacaaacacaacagctgtctcatttgttcccttgttactcattttaatgaatcacttgaacagacttcaaaacgttaaattagatatataagcatgcttgaagaattatatcataatatcatatttcaaatttagtagtgatatcattgtctaaacatagtaagttttaagaaagtcagttttttagctactttgccctctataaataatgtggtagtaaaacagcagataaaaattaaccgaagaatccataacatccaagtatagaaagctggggaagttcccccacatcccttcttcctgacataggagccttgatgcttggagtaaatcttttgagggtcctcaaaggtggaaatttgctgttccttgcctttgtagtagaggtctgagcaacaagaaagtcgggaaggcattaccagcacagagttttcctctgtgttcttgatacttcctgttgccgagggtttgtccaaagggaaaagataaatgaacagaggaagatgtatttcagctgtcttctcattcctctcgcctttcataccattcacagcagtctgagaacagaaaaaaaaaaaaaaagttacatcttgtgttcctctaccctgagcatttgcttattaaaataaaccttgactgctctcatctcccctgatttgggcctctctgtttcctccatgaaaaagctggtgagggtgtttaaagctgataactgtgtcacatgtaagatatagtcataaatcactggaaatgaactgtttttagaacctgccagaactatcatactaatgcacttctacaaagggcggtaaatatgataattaagggaa

SEQ ID NO: 53637 - DNA, 1544 bp, Bovine  19866880480816
tagggaggcaaagctggggatgttccagttttgcaaatgtggtggggaaatggccatggagtgccctggccagaacattccagctttgttggctgacccaggggccgtcctgcaaagacatcctaagcaaatatttttgcagttaatgggcacaattattgaaatttcacacagcacttcaattttgctctgtagttcaatttcccttccacgttcaatattcaaccttttaaaagacacatttccagagctaaattggcattagcaagctttgaaaagttctaccaaatgagtggaaacaggctgtgaatttcttctcttttccatttctttttctccagatccttctgtcctagtttaagcaatgtgtgaggtcaggaaaataggtggggtttggaagcaggaagagggaagggggttcatatatactgtcagaaatcagaaatatctttttttttggataaaatctcatcagggaggagccacaaattttacatacgagttgacctatctttagtatatttatcaaattatcttcatttatactgagattatttctaccaaaattatttccaccaagaaaaatttgaggggattataactataatcatatacaatgaacaggataataagatcagaaaggaaatttaaaagtcatatatgcaggcagagggaagaaacctgtaatggaccattaatttatattcaaatctttacagtaaccaaagcaaaagaagaaatataagcatgtaattgttgagtgaggtcttgcagtttacccagctctgggtttagacacagaaaagcactcaagtaatgtataataatgtcaaaacaatagtacctttggtgtcttcactgtggagaaaatttagtgatgattagctttattctgcggagaaggcaattgcaccccactccagtactcttgcctggagaatcccatggacggaggagcctggaaggctgcagtccatggggtcgctgagggtcggccacgattgagcgacttcactttcacgcattggagaaggaaatggcaatccactccaatgttcttgcctggagaatcccagggacagggggagcctggtgggctgccgtctatggggtctcacagagtcggacacaactgaagtgacttagcagcagcagcagctttattctgacgatagttaactgtgattatcaaaacatgcattaagcaaaagtcaggtcccgtggttaggactccatacttctactgaagggggcacggaattgatccctgatcagggaactaaggtcacacatgctgcagggtgtggcccaaattttattaatatgtcacgtctagggagttatagactttttgtaaaacatatctagggatgtgcaaaggtgctgccaccatacgtaactgaggccaaagtcccaggtgtggtgtctgaggccccaccataggcaactgtgaaggctttagctggcaggctcttgggggaacatctgccctctgtgtacagtctggagggagttacagtcagactcacgtccccacaggccgg

SEQ ID NO: 53638 - DNA, 1198 bp, Bovine  19866880660225
cctttcattttaccagactctatgtgcccatcactcctgtgcttgattgcctcatggtcacaaaatagctgccttaagaccaggctctccagttaaaggcaggaagcagagggtaaggatggcagcagatggtggcaaaggcagagagaaacactatttgttctcattttctcaaagagcaataaatactttacagaagaccctcagctgacttcctactatgtctcgttagaactgagtttatgattgtaactgaatagaactgggttgtaggtttatgatcatctctagactggaacctcatgtttcatgcactcaaggaatcatcagctgatgctggtggggaactgtagtgtgtgaagtggatacgaatggaaactatgcctcttgatggacaagcagagtggctgcctcacacaggaaccaggagtttgtgaacctcactctcttctaacaataggttcccattggcaggaaactctaatgtctttttcctccttgtctcaaatgccagaggtctaagagaaagactcatcggctctacttggcctatcaggtagaatctcaaagtgaaggcacagctctggtgtctatgctggtaacatcagtcctcaaaaagtgggaactggagacatccctggtggcccagtgattaagatgcctcacttccaatgcacagggccagggttcaatccctggtcggggaactagatctcacatgctgcaactaagagcccacatgccataaactgagacccaacacagccaaataaataaataaaaattttttaaatgggaatggcctcagcctggagataaacacaatggacatcctttatgtctatgttaaatgaaatactatcaaaaggtacctactgacttcttaacttgtagaaggaattgtgcagaaccctatggggatacaatctgtaagctttggtccttgccccaaaagagactgtgctctatttcaggagaagtcagggtaagtagcacaacacggagaagatgagagctgatgctaaggtaaagacattaaatgtttcaaccccaacaagttctgctgaagataatcagatagaaattacttcaggaaaaggaaggaaaggcctggagatgtttaactaaaccaagttggaccataaagaaggctgaggacaaaaaattgatgctttcgaactgtggtgcggagaagact

SEQ ID NO: 53639 - DNA, 718 bp, Bovine  19866880740186
cctccctcagaaactccattccttagcatgaaggccccagtgactgttcttcctttttgtgggggagccagattaagcttagatgtgtcactctcaaggttcagagtctcctatgtcagacaaactacattttgcaaattaccctaacctattctttcagaagttttatttcaccctcccagagaatcaggcacaaaaacaaatcaaacacccccccaccatggtacctcccaaggttttttttctctttaaacctatagtttccaaaagtactttccaccatgcagattaagagaggctggggttaattctacaacatagtggatggttgctgggctaatgattgatttttttcacctcaaatgacattcaattaagaaacatgtataaattatcaactgtttccagcttgaacggtaattcataaagttgtagggatgagaacttataaaatattttgagcctggaagatgtgttccaggctggaatgtctatgggaaacagcctctccatgaagatttcctgctccaaaatgccttgattaattaccgtaaacagctttgagggaaaagggcgcagcatctcatgtctggcaggacattggtagggttcgttggaaactcgaatgcaagccaaacgcagcaaagccaggccccttccattcagggctggtccggctccagggaaacgccttgggcttgggacagctctggaaagg

SEQ ID NO: 53640 - DNA, 1867 bp, Bovine  19866880752660
atgactaaggtaatgtgaaatacttttgaattactagtcctgattccgttttggatttaatgacagttaaatgcggctctaaaccggcgacccctgctccttttgccatgccatactctccttaccttttctgtctggtttgaggtttcgatccacagggggtggttcacagtctgcaacaggaactggccttctgggaggggtcttggggctggacctgaagcccatatgagcgggaggaggcacttgcattccaaatgaagaaaagtcaaatgtccctggagtcattggaacataatttgcctcctgaattggttctgtgaaactgctggaatgttgtcgtggtggagagttgggattcatgggcacgtaattttcatccagttcttcacttgatacacttcccgctgtcaatatgtttttgattttctaaaacacacaggcatttcttttaataagcaagaactgttgtcaaacgggaaaacatatttgtaagtcatgcctattcatgtggatctgaagggacttttatttcaggatctcatttagtctccaggccctacgtgtaaaggtttggacaatgaaatacaattgatgatgccaaggtcaattatacttacaaaatggttgtggaagccttcgagtgaactagatctatcacttggaaatgttcgtggagtatcatagcagtcttgagaactagcatctgaaacagagaacaaactatcaattttctccccatctctgccagttctcagggtaagcaggcatgaccttctctctctcttttcaggtattcatgcttcacacacataaattttaaagaggatgctcacaaagaaaaatatcttgaattgaaacataaaataactagaaaatgcagacacttacaggctaaccagtactggtatttgattatagcactgagacaggttatctaaagatggaaaaagaaatacttctacttcctcatcttttgtacccttgggtccaactgacacctcactaacttataactacctcaagatacattacagccacttcgaggactaagttagaaattggtactgaatggctagacaagtattggtacaagcaccattcacaacacatcagatcttcatcttctttaaaacaactggataactctatcatgaaatccaaaagtgtcagcagcacatagtttttagggtctgtgccttttaaacttttttttttttttttaatttccagatctctaagaacctcagaatctaactgagattcaacggtacagaaattggtaaaatgactaggggtaaggggagggaagattattaacagctttaaaaataaataaaaccaaataaaaagcagaatgacttgattggaactgagtaccaactggcagacacagtgtaaaaactgttatctgggaaggaaaccaacagagccctgagtaccacctggtagacacagtgtaaaaactgttgataagggaaggaaggaaacaaagccaaacagatgtaacacagcagtggccgtaccaggacacaaatacaggaaagggcatgacccggcaaggctttgtggctggtccatttcctgttcctctgccccacgggtctgctcacccaggatacagagaaagggagaaagagggctgcaggcttcctgaagcctaaaatattactaaggccatacttcttcagggatgtaaaactcctcctcttcttcccttacagcaaaacacgcatagaggcacatgccgaacacacaaacatactttccaggatttactgagactctgacacctttggtatctcagtagatacctgcagcgctgaaggaaaaagggactgtcttttaacatcacactttgcttcca

SEQ ID NO: 53641 - DNA, 1267 bp, Bovine  19866881004731
aactaggtttatttttttctgaattcttctaagaattaaaaacaaataatcaaaccattataatttgaaccatcagattttatttcaggaaaatctaatacttttcaaaagttataattttaatgttattccacaaaattacttcttaacattaaaaaaaaaaaatttcccatccaaagattcccatatttgaattacattactgcaaggcacatttggaacgcacctccctcacaacacacagacaatatacctcctgaaacaggattttaaaatactgttaactttgctaagaaagtatattccctgtgtaacatttttaacttcagtatattaaacactaagtaatacaataaacttcacaattcttaggtaaaaatgttgctcctggaggataatgcacctttttaaaaattaattcagtacatatgtataaagataattctttcttaaacctttgtacttgaaatacagatatggtgatgctaaaaacagccttaaacaaacctgaaaatactgcagaatgatagattttatgttattgccttcatgtgaaattgtatcatttcctctagtatctccaaagatgaatttaacaatggctaactactatttccttcatctctaacatcagttcttttataagagattacaaattttatatatatatatatatatatatatatatataagccaggacaattttaatggttcttccaaatttaatgcctcttatttagggcccaaatacatatattccctatgaaaatttttggtcaagtatgtttaaccatgacagcaaatagcatttttaagatgttgatatttttcacatcatgcattttttgttaataaatatattgtcaagaaagtaaaaacaagcgctgtgttttcttaattataagagttgagtgaaaagaagaataaagatagtaatgacatttgttgcagtctgatacttcaacagtcatggtgtttgtgttttgcagtcagggcattgtgaaacatcacaatatttcttatcccaaatatcaagtcaacagaatactactttcattgcttatgtcttcaagaggtgaattattaaaattttttagctatctcaattatattcacctgtgcatggttatagactacaaggcagcatatattaatatcagaacacatattcagagcatttctgtaaagcaatcattgcaggcagagtctttactgtctgagccaccaggaaagcccagtttatcaatactttccaattacagccagg

SEQ ID NO: 53642 - DNA, 805 bp, Bovine  19866881106801
tgccctgttagagcctctccctctcacctgtacccttttaggcagttctctctgagcggacagaccacggaatgctaactcaagatctcagtttaacagcaacccgcttacccgccatgagtcactcttagtttgaaatatcctaaaaagaggttcttatttctgaaggtcaggcgggttgcagcatgcttgatttttcagtatctctggttaataatgattttagagagtagaagaggaaatggttcttatatgagtgtagcataaaactatatggcctcgtgcaaatgatctaacttcatatgaatcctggcttatagacagaagctttctttgtataactagattcaccactctgtccttctctgaaatactgagagaataatctcatatatcacatacattttttaaaaaatcagtattcagaggcaggaaaattaccaaacagtccacattcttccaattctgatttttttttttacatcattttttggtgttttaaatttgcttttattgtttgaggtcaaaaatacattttttctgtcctttttattttttgaattgaaacctacatccatgaaattatcatctttatagtggttgactcctggagtttataatcagaagattgtgagacctttggagaacaaaatagaaaataaaattaagtttaggaaataaatttttcttggacattgcaaaaatagcaaaaaaaaaaaaaaagtggatgaataactggcaacacaaactttttcctgtaagttcctttttcccaaactcttgccgtcatactaaaaaaagtttt

SEQ ID NO: 53643 - DNA, 754 bp, Bovine  19866881384082
ttcctgagtaaggaaaggaagggaaggaagagagtgaggaggttggggggaaagaaaggaaggaggaaaggtcagccagctgagggtggtgaaaagactgcagtacactctgggttcccacagtggaaacatgagcactttgacatagaactggttagagtaaagtaaacgcaaagaagaacatcttgatgaagagatggttagagcagaggcaggaaggatttaacaaaagctgatgacggtcaagtttaggttcaaagaaatagaacatatacattacacacagggagagagagagacagacagaaatttgaaaacaaaactatagtcaagcagaactattttaaggcccttttacaaaccaaccatgtctcaactaatcaaaaattagggcaaaccagacatgtactataacgacaatgggaaaaaatatctgaaatgaactatcccaggaaatctggactgtgtattaataatatgctttcagatccaataaccagaaaaaccagaacttctggcaagcagttaatcctctgtcacctctcctctccgtctctaagccattcagaaaactcaattcaggaatgtacatttcttttttccaatcgatacctacatacacaatagcttccttgatttcgtaacatctttgagtttcttggcgatggttagggtaccttctcatattctaacctttcaaaaaattccctttcacttttgtcatcgagaagaatttgatcaaaatcactgcagg

SEQ ID NO: 53644 - DNA, 2790 bp, Bovine  19866881595749
ttccctctgtaaagactcatttacaaccttattcttcaggtattctcatggttagttgctggtagtgtatgttgaagtcatcttttttgttgggcaatttttaaagcatctatcaatatttaaaatatgtatgcccttgactcacattctgtacttaggaatttatccaaaaggaatgtttgtacagatgaataaggatacatgtataaggacagtgattgtaatggtatttgtaatagctccatattatcaacagtataaaggtacattcagaagttgcttgttgagtcttagcatatccgtaatatgtaaaactctgaagctgagtagcatgaagtagacctcaaagtacccatgagataaaatattcatgaactattaagtggaatgttacctaattgtattttgtttaaaatgttttatatatgcatatacattttatttctttaatagatacatagacatgcatttatacatgttagatttgtatatgcataggaaaatgtcttaaaggtaaaaataatagtaaaagtaattatgtatactttaggttaagttttctttaagaaacttaaatttttttaaatttttttttttttaatggggttttgggagatgggaaaaggagcatccttccctttttactttgtaaatttctttatgtgttacattttgtgatgagtgcatatagcttttataatgaaaaatgtaccaaagattttaaaccttcatcatatcaaagagaaggcaatggcaccccactccagcactcttgcctggaaaatcccttggatggaagagcctggtaggctgcagtccatggggtcgctaagagtcggacacgactgagtgacttcactttcacttttcactttcatgcattggagaaggaaatggcaacccactccagtgttcttgcctggagaatcccagggacagaggaggctggtgggctgctgtctatggggtcacacagagtcggacatgactgaagcgacttagcagcagcagcagcagcataccaaagtaaattgtatcatatgccaaaattatctccagagaatttagagataaatgtaaaaatctaatcttttaaggaaaatagaaataaatatcagttgaaagtaaaggaaaaggcagagatgtttttacaaattttagacttccatgtgtagaccactagcccccctaatgaaaatctctgtgtttatttaaatatagttttcagtaattggttaagaaattttgctaaagcaaattaagcaatagttttttttaagaactttaaaaacaagatgagaaagtgctgatggcttgttgcatcataagaacatctttgctaatgttttaaaaagtcaagaaggcggcaaggaggttcttggcagtgttctctgattagaacatcataaagcagagggacttcccagatggtccaatgattaagattctgcaggggaaacaggttggatccctggtcagggaactaagatcccacatgcccagtggtgtgcccaaaaaagaaaaataaaaaagaaagaaaggtatagaagaggggcaatgtcaggaagactggggctagggggaaaggcagaaggaaatatctggaatgcagggtattgtgcagtcaagtagtttctcccttttttctatccagccacatgcaagcacctcaagggagacaaaaatggaacagccatttaaaaggaacatctggtagaccagtcactttctcaggcctcctggcctgcatttcaggataagacaaagaggctgtggtcaggtggaaagtgctgtggcttttgtcaccaccctgacactgagaaggcctaggagggcctaaagtggaaagaagactcagggccagttagggagaaaccaagcctgatgaccgtaagtatatttcagccaaccagtaataacaaggaaggaaaactgagaaaagatcttggttgcccacgttctttaactgttatactgatgttgcattcaatataaatttggcatttggaaataacagttaatcattaccctagatttttttttccctaaatgaagagctctattttgttatggtgatggtttttagaagcatgattgggtggaagaatgtgctaagatcttcatcccagtaagccacacctgtgaatgtcctcatcttgaaaacaacaaggtcacaatctaactgtaagtcctattacagatggtctggcttagggcgaagcaaaggacgttccctctgatttctaattctaatttcctcttaaactgtgctaggctgcttgaatgaagcagtcaacaccccaactgttcttttgatggttttttttttaatttgctctactggattttcatagctgcatgcaggctttctctagttgtggcaagcagaggcgactctctagttgtgctgtgcaggcctctcattgtggcggcttctcttactgtggagcgcgggatctcgggtgtgcgggcttcagtagtcgtggctcccagcctctagagcacaggctgcatagctgtgcacggacttagctgccccgcggcatgtgggatcttcccagaggagctgaacccgtgtctcctgcattggcaggtggattctttaccactgagccaccagggaagccccacccaaactgttctaatcatatttatattttgggcacggcaatcagaagatgtgttgattaatctccccctcctatttcttccagttctcctgggtcccatgtacacatataatcaggactctccctgcagtgagggagcaggagatgaaatggttaagta

SEQ ID NO: 53645 - DNA, 1265 bp, Bovine  19866880123573
agacacgtgtaccccaatgttcattgcagcactgtttatcatagccaggacatggaagcaacctagatgtccatcagcagatgaatggataagaaagctgtggtacatatacacaatggagtattactcagccattaaaaagaatacatttgaatcagttctaatgaggtggatgaaactggagcctattatacagagtgaagtgagccagaaagaaaaacaccaatacaaatagtatactaacacatatatatggaatttagaaagatggtaacaataaccctgtatacgaggcagcaaaagagacactgatgtatagaacagttttttggacactgtgggagagggagagggtgggatgatttgggagaatggcattgaaacatgtataatatcatatacgaaatgagtcgccagtccaggctcgatgcacgatactggatgcttggggctggtgcactgggatgacccagagggatggtatggggagggaggagggaggagggttcacgatggggaacacatgtatacctgtggcggattcatgttgatatatggcaaaaccaatacaatattgtaaagttaaaaaataaaaaaaaaagtccatggacagcaacgaagagtagctgccgctctgtgcagctaaagagagcccatgcacaacaatgaacacccagctcaaccaaagataaataaattttaaaaacataaagtacatattctcagataaaattttaaaaagatcaagacacttccacttctgcttaggatgtagaaagtcacaaaataccatctctcttatcctaaaaatgagtaaagactagattccataaaactgtatcttttcatgaacccatttgaaaacaggcttcaagaaaaccaagtgatctgaatttcaaagcatggcaaacctctgtaagatgagaacaggtacttcaaaagtatcaaggtaatgaaaaacaaggaaagactgtcaaagcgtcacagacggaaacctaacaacactgctgatgaaagtacaaattaaggcacagtgccaagtggggaaaaaacctcagaggaaacactggggagttacagtagaacagctagagtagagatatccccttcggcctctagactctgaaaatggagaagggattggtcctcaccgtccatgaagtctgtaataggccaactgaagtgccagctgaataaatgtatcagggtgaagctgcttctccttggttagctttttgccaaaagacgtaaaggcatataccaca

SEQ ID NO: 53646 - DNA, 919 bp, Bovine  19866881272467
aggactagatggttgcgtggcatcatagactcgatagacatgagtatgagcaaattctgggagatagtaaacgacagggaagcctggcatgctgcagtccatggggccacaagagttggacacgactgagcgactaaacaataacaatcttgggtttattgtaatgaaagagagcagatgttagcacaggcataaatccctgtctcatggttttgaatcaggaggctgaaggctgcagctcacaggtctgaaacttaaaatacagctccctctcttcttttgctcatccaggccactgggaccaggttggctctgattgcacagaatacagctaaccttggaactgggattatcatagcattcatctacggttggcaattaacccttttgctgttatcggttgttccaattattgctgtatcaggaattgttgaaatgaaattgctggctggaaatgccaaaagagataaaaaggaactggaaactgctggaaaggtgggtcaaataaggcttcagctgatataagtatggttgttaagacatgggttttatttgattgatttgttacaacatgcgtgttttgataatgttagtgctctccacaactaatggtggtcaacactgaagatgaaatatcttactgtgtcaatgcctagaacttgaaaatgggataattaatgtaaaacttttagcgtatagaaagtgctatattcagaaaatttctgagttttcagagttcgttttacgttttactttgtacactgatgccactgttaggacaaaggttacccctgttttacagatgaagagtccttaaagaagagaaatataagtgtattgttctaagcagacagtcctgttcttggttgtgatttctgtagttaagctaggcagccaccagagggcagtaatgctcaga

SEQ ID NO: 53647 - DNA, 783 bp, Bovine  19866881812025
tgtaagtaataataattgaggtgagtttgtggtacttgatgtctaaatactttaatgcatattttttccttttacagtaaagccatttgcaaatgaggaagaatataagaatactgaagcaattgtctggaaatttcaaaatggcattggagaaaaattgcagcagaaattacttcaaagagcaaaaggaagaagaaactgggtatttatgttattgtatttattagaatattgatacttaatgaaaagtaaatgtgtagctttcattttaaaattattactgtagaatatactgtagaatactattactgtagaaatatactatagaatcctttatcacggagaaggcagtggcaccccactcaagcactcttgcctggaaaatcccatggatggaggagcctggtgggctgcagtccatggggtcgctaggagttggacacaactgagcgacttcaccttcacttttcactttcatgcattggaaaaggaaatggcaacccactccagtgttcttgcctggagaatcccagggacgggggagcctggtggtctgccgtctctggggtcgcacagagtcggacacgactgaatcgacttagcagcagcagcagcagcagcagcagcatcttttatcatccaaaagaatgaatgaattgtttaactctggggagttttaagtattgtgtgtgggttcctcttattatgtaggggaacttggtaaaatgcagaattcctgggaccagtattctattcagtatctcggaaagggtgcccagatat

SEQ ID NO: 53648 - DNA, 1191 bp, Bovine  19866880393220
attctttccaggagcagaaaaaaatggattttccatgttataagaccttcctttctaagatagtagttgagggtttgtttctactataaattacttttcattatgaaaaagttcagacatgaaaaaattaaaaaacaggacactgaacatccaatacattactccatccagatctaatcattgctactatttccagattttgccatttttgcttcatctatgttttcggctggaccatttgaaagtcatggcacttttgccttgagcatcatcttcaaaaataaggacattcttgtacatatcacaatgcaatttccacctctaacctattaacaagattccttaaaagcatcgaacgcctaattcgctttcaaatttctccactttcccccaaactgttgctacttgaaagagcaattttattgactgatttatttgctcagtggaacccatatttaagatggcactctattgttaggaaacattttcatttgcttgcatgcttttcccagcgcctctccttgtttgaagtggagataaacaccagtagccaaatgctttctattatattacctgttggactaaaccagttccattaaggcgggtctctatttcacacaactatttaatggcatgagatgtatgaactcatttgttaaattggggtctgtgaacaaaaacaaatggaggggaagagcaacagagacaatgagtaatggaaacagtttccagaccatagaagccggggcttttgtggaaaatatatgcagcccagagcagaggctttccagggtccctgtgtctgttacctagcaacaagcccattacaccgggcacaccggagtccagttaacagggctcagggtgagcacgtgggaatgaggaccacatttctccttttctgctctgttaataactcagctttctctgacaggggtgagtgtctgaagagccttccctgtgtaatgctttccccgagctaaatcgctaaaggaagaaaatggttttagcttaatttactgtgcacgtgtcgatccggatttgtccatatatctgtctgataagagttaaatacaccatgtgaaacagaaagtcattgaaactcaaattagtttttgatccatgatataaggcttcaagacccatccaaattcattcctcacagcaaatgaactctgggtcacagattta

SEQ ID NO: 53649 - DNA, 1092 bp, Bovine  19866880470068
caacctgcctggcccacggatgagatggagaagacggaagcagatggggtccatctgttacccataaacacttcttcattagtgtcatcctcagatttatgtgtgttatgtttttgagaaagactctgacattgattatatttaatctatatttttaagcaatcaaaccactggccatttttcatagatgtggatcaagatgtacacgttgtacagatggacttttttttcttttttgtcaatatgcctcctggatgtaaatcatgtgatgtcagttacatccaaatccctctaacagagtggtaagtgcacacagattattcacctagctctggatataagaagcccacacagcggagtagaattaatctgcagtagaagtgaagaaacaggactatttccaggtatgccatctaccttcgtgactctcaacaaccctgcacctcaaactcataaaaaagtacagagccaagggatgcaacgtgaaactctgaaaaatgcattatggtagaattcaaaagatgtaatgcaaattactgtgtaatgtaagtataaatgatcacaattcacaatgatgttgtttttgttcagtcgctaagtcctgtccaactttttgagactccatggactgcagcatgccagactcctctgtccttcactatctcccagagtctgttcaaactcatgttcattgagctggtgatgctatccaatcatctcatcctttgttgtcctcttctcctcctgccttcaatctttcccagcatcagggtcttttccaaagaatcggctcttcacattaggtggccaaagtattcgagattcaccttcagcatcagtacttccaatgaatattcagagttgatttcctttagaattcgctggtttaatctccctgttgtccagggaactctcaaataaaggatgttccccaaataaaggatgtcctattcatttctaaatcttgacttactactgggaagattgaagtgacagaaaaatttaaaacaatctttcattcaattttctgcctgaatcttagaattactttgaggagccaagtgaattgagatgcagaaaagcattttttta

SEQ ID NO: 53650 - DNA, 2142 bp, Bovine  19866880530170
ctcagcagatgaagacaaccggcacttcttagctcatctttctccgtcggaagaccgcttagggcatcaccaggccgaaatcaaggtgtttcctggccgaacattggtctggaggatctggggaagaagtcacttccaggctcatttgtgttgctggcaaattcagttgcctgtggctctggcctgaggtacccatttcctggctggcattgggcaagcagtgctctcagcttttctaaggttctctgcattccttgtcatgcctctccagcttcagggccagcagtggctcattctgacaaatccctctgacttctgcctttgccaccagccctagacagccctctccttttaggacttaagaggatgtgccatgtaacaacatggcatcagcatgttaccataatcatcatcgtgtatatctcgataaacctaacagtgagtataatcccaggagtggcatgtcttcatattcacaagttctatacggtatggaatctgggagtgggtacacttgtagtatcccatcctccatgagatgaaggctatctctgagcacccctggctccatctgcaccctgctggaataagcaccagcctgggccattattcagtgacccagcaaacatcttatttcagtgtgtgtgtgtgtgctaagtcacttcagtcatgtccagctttttgtgaccccctggactgcagcctgccaggctcctttgtccgtgagattctccaggcaagaatactggagtggattgctatgccctcttccaggagatcttccccacccagggatcaaacccacgtctctcgcgtcccctgcattggcaggcagattctttaccactagtgccatcaggtttggctaatttcatttggttttaagaagtctgcagtcagaaatttcaactaaagtatgatcattttatcttgatgcctcaataggtattggaagttcctgatggtaatataaacctattagaaaagaccgcatcattcaaggcttttagtactgaggatatgcagactcttaatgtgtcttgcaggtgagacaaagacatgggtcaattcaccgctcgttttattgtgggaatgagtctgcggaactggcccactcggggttcctgcaaatatagttgagattagaggtcataaattagtaattagaaggttatataaatgggcagctgcagtgttaccttgttgatcaggtaccgagtcttagggcgaaaagcagcaacacccaccttggattcagttcaccgaaagttattgattttttttttttttaagtttgcctcctaaggagtcctcagggccaccaggcaaggtcaggcaataattcacgtctgggaagagcccctagaatagagtcaatgtctgttactttatcagagagataatctcaggaaagggcacctgtatcagtgagtgttctcaggttgcaagcactaaaattggaccccagttaatttaaagcagaaaaagagtttattgtaagggccttggaaagctcacagaatctagtggcagaccagagagctgggctggggataaaggtcaggagagatacagagtagtttcaggggaagatttattacctaatgactgccctgtcttttgggggtaggctgtagggaacaagaccgattttctctctctctctgagcaccacactaatcaagactgaaagccctggagagaccctcctgtggacctttccagagaaccagggacccagagcctgtgaagggggatgcacacctgtggaggtggaggatgcaagcaaggagggagtagatgctcggggaaaccctaaaacaaaaacaccaaccttcactctggagtctttgtgcttaaaatgcttttgtgaaaactattctaataaaacgtattgggtggtcatttcaaaaacacacttttgccttaaacgagattgcatttattgctccgtgaacgctgcctttaatcatagaaacccaaaagcctcatgaaagctataaattagactatttcaggcatgttcccgtatttgcataatatcaatgaaatcctttgactaggtggctaagaaggacccacttagcatatcacaatgaatacctagacttaaaaaaaaaaatctgcaaacaaaaacacgga

SEQ ID NO: 53651 - DNA, 2977 bp, Bovine  19866880642323
ggcttgagtatatttttttctaactgagagtgacaaaatgaagaggtgctgggtggtgagccctcagaagccagcactacgcggtcaggaggcaggaaagaggagagacaggccatggccgactctcaggaccaagacacaggtcctgcgaaccaggcaaggcacgaaatgcaacctgacaaggaggcagagactgaagcaacgttccatcaaatatttttaaattcagttccacacaagtcaactcggttttgcccagagattttaccagacatttagctggtgtgtatataattacttgtctgtctgaattgggtttggggagtggaagacagcacaaggggggctaagcgtccacagaagggaatgaactgaaagttgctgagactcggggattcattccaatattaatttttttttactgtttgcatcctttagtgacggttttttaaagtatagcaactattacccgttgttttgctcggaatgttaagaacaaaactataatgccatttattcctgatgtgaagatctaccttctgcgtcttattcatatcacaggcatccacgaccaccctaagatccttagcatgtgttacaccttccaatcatctttcaaagtccctcaagttattttcagtactgcacgcatccttagaatattattttcagaattcatatggagtatttagtagttaaaattccttggaagaggaccaaaatgtcactgctttatataagcctcagctcagttttgaaagatgataatcttgcagtaaacaaaagagcactggtacacaacttctgaagccagacccatataaattcacatgtactaaaacagaaagtcatatcagacctacgtgaacgtgcacgtagatcccctcttagctgctctgttcctattgtctacatctttgctacctgattcaccaacgattaagacgaaatagaatcatcaccactaacaaccatgttcatgtgcttgtgggctcagtcgtgtccaactctgcaaccccatggactgtagcccaccaggttcctctgtccatggcattctccaggcaagaatactggagtgggttgccatttccttctccaggggatcctcccaacccagggatcgaacccgagtctcctgcattgcaggtggattctttaccatctccaccatcagggaccatgttcatgatcatatgtaaataaatgtttttttctgtcttccacagtctgattcataacattgagcatgctacaacacaattaatagactgaaaatatactctggatcaaaacaaactttaagaaaaaaaaaaacattttaaaggagtgacagaatccactttaaaagagaatccatacataggaagcttcctgtcttacagccaactcttcacagctgccaatatggtccaatagagaagaaaccagcctcatacagctattgagcacctgaggagcggctagtccaaattgagatgcaagtataaaatacacaccaaattttgaaaacttagtctaagaaaatgtaagagatctcattaataaattttatactgatgacatgttgaaatgacaatatttaaatattttggttaaataaaatatattaaaatatataatgaaaggatattaaatcttttttacttttttaaatgcagctaccagaaaatgttacattgtaacctgtggttcacaaaaatatttctattggacagagttgaaatagtctaagatgcaagtcaaccatccactaattccagcgaaagtataagataacatgtattctgtccctaactttcttgtgtgcacatgtgtgtgtgtgcacatcctgcagggggctggaattgcaaagctgcccatcaggaaggtctctgaaacacaagattcagctcgttgcctttagcctcatctcttgacatttaaatcttccaaaaatttcctctgcttcactgcttcctgctgtgaaagctttcaagcaaagcctggtgacccagtctcccagggggtatgcactcaagctatggcagccacccctgctctagaaactggtattcaaacaggtctgggaagggacagacacctgtgcataaaattatgtcgggttaaacataagcaggatgtctacataggtcaggccactcactcaagccacctgtgctgttctcatcctgcaatcatgaccaccaaacagaggtggggaggggactgggttatggtcaagggctaagtcccagccctaagcctatgaaaactctccactgcttcaactgcctcctaccctcctgtccttgcctccccacttttctactctaactggacattcctggtggccatggggcatccacagcagggcactggatgctctctaataaacactggggacagcattcttagcctttccacagaggagtttcaggatatatatatacattcattcatttgagcaatattgctgaatgctgaacaggaaaatcttagcacaggacaaagataagggggcctgggaccaaggatgcccagaacagtagttatagggagagagtggtcagcatgagcctcattgggaaggcagcgtctacactggcctcccggggtccagggtgaggaagtgagctgaacaggcaccctggtgtgggctcgggcccccagggcctctgtggggagcagcacggccagcctggtccatgcgcaggacggcagccacagctgtggccacaggggccgagtgacagaaggatgcagaggaaaaatcccagaccaggcaggactcagggccatgggttgctctgagatgagaacctgctggaaagcttcaagtggaggaaagatctgctctgacatctgctttgtagaaaccacccagcctgtggttctggatactccaggttcaagggtgcaagcacagactattgaactaaaatgtgttaagcactgtggcaatgaatagcgaaacaacagttgagacaaaaaggga

SEQ ID NO: 53652 - DNA, 1848 bp, Bovine  19866880650812
ccaactctttgcgaccccatgaatcgcagcacgccaggcctccctgtccatcaccaactcccggagttcactcagactcacatccatggagtcagtaatgccatccagccatctcatcctctgtcgtccccttctcctcctgcccccaatccctagtatcaataatgtgtatatgtcaatcccaaactcccaattcatcccacctcactttctccctttggtatccatacatttattctctatatctatgactctatgtacagtggaatattactctgataaaaaggaatggaatagcaccatttgcagagacatagatagagattatcataaagagctaagtaagtcatgaaaagggaagtaaatcataaaaagataagtgtcatataatactgcttatatgtggaatctagaaaaatggtacaggtgaacttatttgcaaagcagaaaaacatatgcaaatggactctacactctaagtactatggctgcaccaaaggaagaagacatgctgctttgggaagctcccacctctctgatctgagtcctgggatctctcttctcatctcactctgtgctgggcattatgtcagaccctgtgtggaggagaaatgaaggctacagggaagacgtggatgatgataaagatgccccgatcctccaggaaggtcactaggggaacagaaagcagttacaaaggagaaagatgaacactgctacaggagccaagagaaagaaccaaaaattcatcctgaagacatcctgtcctcaaacatgccgagaaaaagaaaactggagtcctcgacaaaaggcaagaagctgagctatccagggcctgttattctaagaatctgcataataaggctgttatttggcagacctcagcgtaagtcaacaaaaaagccaagggattttctgggtattgtactggaattctggtttaatgcttcagtcgctcgtgtttgattttatgttccaaacataaaaagaatgttaatgattacatgttctgtatctttcaaatttatgaaacataaaagcggtgaatacttactcaacatcaaacttcaattctcaggccataaagaaagtacactttgaagaaaactaattcatcatataatgttttaaattgggaaactgcggaaactccctgcaaagttctctaagaatgagacatacagagcacagaaagcaccgtgattctcccccgtcattctacgtgaccagttatttgctaaaacacagggaactaagcacattaacccttctcaaggtcaacacaactggagtatctttctttttaaactgtttcctcaatatacgatgtattctttccacgggtacggactaaagtgaaaaggcggtttaaagggggagccctggactaggaggcagggggtctgggagggctcagttctgtgtgtgcctgtgtggcttcaggaaaactgccagctggcagtgtggagacatgaggcaaagaatgtacatttgccaccagaaagacctaaggtgagctcccactctgtcaacttaggagcttttctcatctattctgctgtactcaactaccctctagtacattataaggattaaacagctttgtatataagtgcatgtttatatacatacacatacatattgtgctatctacctatctatccagttacctaccttcctatcaggtaaacaagtcaatgtcggctccctttctctagtgtcctgatctatataatgtagcttggaggaattagactgctggtttttcacactgtgatcctcagaacccttaggttgtgaaggttcttccagacccactccaggtctttctaaaacccgactcagcct

SEQ ID NO: 53653 - DNA, 1930 bp, Bovine  19866880732822
attcatttccttgccttctccagcttctatttttattattattttttttaaagtttagttttgcctgcaccacttggcacgtgggatcttagttccccgaacaggtctcaaacacactcacccaacaatagaaatgcagagtcttaaccactgggcaaccagggacagtgcttctacagacaggtctccagcttctaaagaccacccacaacccttgattcagcataccttacttcatcgtcaagtcatcaaggttgcatctccctgaccccatcccccccatagtcatatctctgtccgaccagaacttccaggaatgtttctctgcttttaaggattcatatggactgcaaggagatccaaccagtccatcctaaaggagatcagtcctgggtgttcattggaaggactgatattgaagctgaaactccaatacactggccacctgatgcaaagagctgactcattggaaagaccctgatgctgggaaagattgagggcaggtggagaaggggatgacagaggatgagatggttggatggcatcactgactcaatgggcatgagtttgggtggactctgggagttggtgatggatagggaggcctggtgtgctgcagtccatggggtcgcaaagagtcggacgtgactgagcgactgaactgaactgaactgaggggttcctggatcttcacggctggatggacacacacacacaccatgcacagtgatgcccaaacagcaggtgtaaaccctggatcccaggaggcagagtcacagtttgtttttttccatccaaatgcagttgcagaatctgaagtgcttgtgtctggaaagcagagctttgactggggtctttcacatggtaactaagcacccctagagcatggattcctaatttgaagggtcttttaaagttaactgcacctagggtgttgattaaaattaaattgtacacacataggtatcctactgaatgtgctgaagtatttcaaagtaaatgagaggctatataatcaacagtcttctcacatggtgatgctcagcccccgctaagtgccagcagttctgagacctgcccacaagccccatttcaccccagttcccgccacccctgaaatctccctgcaggagtgtcaactgctgtttgtcatcacgtttgctctgtcgtttctttcacagttgtgttcaaaggaaagtggagtcttgatttactaagtctctgtccaatgaaggaaaatgaacatcagacctgggagggttgtatgtttctcactatagaactaggagagagtacagtgattatttatttgtgacagatgtctatgcaatcaatgtgtaaagcaaagcaaagccacttagaaaagggacaatttaagacactgcaggggatggtttttccaaagatggctgtggctgttctctaccccatagaccccccagtgatgtgactggtcacccttcagtgacaggtggggcttacagatgaggagacagtcgtgaaaggtcttgctatggagccacccacgtgacctgcagtaccatcgggccctctgaccccagcatattgctcatggtaaagtaaacgggaggtgagcgcaaggaagcacaatggggctggggggtgagaggcaagctcgggagatagaaggagagggagagagagggagaaattgagacggagagagaaaaatactaagaaactaaatcactggtcagattcaaaagggacgctggagataaaggcaagcctttcagaggcaagaatgtagaaagtgggacttccctggtggttctctggggttaagactccatgcttccagtgcaagggccacaggtttgattcctggttgggaaactaagatcccacatgtcgataagcgaggccgaaaaagaagaatgtagaaagtatcaaacaaagatactaaaat

SEQ ID NO: 53654 - DNA, 1047 bp, Bovine  19866880737908
ctctggatgattccttggtctttcctggagaggtttagtggagctgacgggccgatataagtgacacacttcagggaattaattttagggctttctaaaatgggatggatgcttcacgctgcagtctcatgcctcagtgggtgaaccagctataaagatcgttatcccattggcagctattttggtggctaactggaactttgtaagaagacacataaggagttattacattttatttttggatacatacttgcattcatttgtatcctgcccataatctgggactgagcacagaaaaattcataaagaatttcttggcaagctctgtgaaatgattgtgcagatcattattttaaataagtggcctttaatgcatagttgactgagattttatccgaggagatgatgataaattatatcttaaagtgaaatttaaaagcttaagtggctgaaagggaaataaatacggctatttagttaattgtcggctggacatcctagctcccctcggtggtgggtgacacatccagataattcattactctgccaactctatgccagatgtacggggtcacacgtgaatacagcggccccctcctagaggatgccctgaaaagttggtttttccaatatcctgttcttatttgagtgcttcaggttttctaatacagagctgcttcttaatttgattttttccctggcgccttctagagagcatcttttcttctgtgacccagagaaaatgtacagaatattgaaatctttggcataaggcttggaggcatagactgggtttggtccaggcaattttgaagcaaataggaggaatcaatgaggtcttggcagatgcaggcgggccgggagggcgggggggtcgtcatcttgggaagggatgagcccgctcccacagtcagccctttcacgctgcttcctcttcccatctctgctgaccatgacacctgtcctgttaaacacacaccttgcggaaattgtgtcccatccccgattgtactgtgtaagcacaacgtgcctgagctcccgcgttgg

SEQ ID NO: 53655 - DNA, 1815 bp, Bovine  19866880781418
acactgcatggaagtcattgcacccttctgtatggagtcgtttatgttgtctttgaagtttatctcttttctttttttcgcttgagtcatgtggcttgtgggatcttgggtccagggattgaacccaggccctcaacagtgaaagtgctgagtcttaaccactggacacccagggaattcccacttatgtctttcttaattcggtatgaccttctttccccataagacaggcagataatggaccgatttttcacttgtgagaatacttcgtgtagagtttgatatgtaagcaagactcattgataaagagaaagaggatctgtgtgttctcagtgacatcaagaaatgaatgtcagtgatgtgctgggtaatttggatttggctgagatgctctggggcttccctggtggctcagttggtaaagaatctgcctgctattacagaagatgcgggttcgacccctgggtcaggaaggtcctctggagaagcaaatggcaacccactccagtattcatgcctaggaaatcccaagaacagaggagcctggcagggtcatgtgtccatgaggtcacaaaagagtcaggacacgacttaatgactaaacaacaacaagacaccctgacccctctgctgaggtttgcatcctgggtcgagggctgtatcacatgaacttgattcccatacttgtctcctttttccgagctgcccatgatctacaatagacggctatcaatttacaaccagcacatcatgtattctgagcggttcacagggactgcaacacaaaccatatacttattagtgacataaatcaaggctttgtgcgcctgaatcaagatgcagccatgatctagacctgcaaaagcagagctgggcagcagagccagcttccccatggtaaacactaataacgccctcccccgaaccctggctatacaacttggattctgtttccatgggaagaaagagcaaataggaaagtcggcccagggcttaaatcagttatggcctcagaggaccccagatgcgggaactttcttaactatgatgcatcttcacgatggagaatgaagcctggaaaataagagttgtaacctgcataaaagataacaaaggggccttctgcacaaataaaaaaccttctgcctgccagatcttttctgatgatacagctaacaaggatttttctctgagagagacagaaacggcccaggccagaaactttggcttgacaatggctgtctcccaggcagcaaatggaataaatcaagattagatgactttgggggcttcccaggtggctcagtggtaaagaatctgcctgccaatgcaggagatgcaggttccatccctgggtcaggaagatcccctgaaggaggaaatggcaaacctctctgctattcttccctggagaatcccatggacagaggagcctggcgggttatagtccgtggggtcacgaagagtaagacatgacttttggatgccaaatgttctcccagtggaggtgaataaatgctcactaggcatctgacaggcttgtaggttctggaaggtcgtgaggaatttgttaaaggaggcaagaacatgaaactcctggtagacccttggctgggggtgggttgctgcccagacctggtgagccccagcccctgggcagatccctgggagaatcagcgaggggcagcgtggcccagggcacccaggggtactgccagctcccctgcggcctgtactggggactctgagatgctctccaactgaggcagaggcagacttttcatcaggctcagaatctctataagcccgcaatct

SEQ ID NO: 53656 - DNA, 2883 bp, Bovine  19866880840278
tttttttttctaaaagagtttgcagtattttcaaatggccctgtggcaagtctactaaacacacttcaatagaaatgtaaagagtgtgtgtgtccacatatgtgttcgaagagtcactattaggtctctgtcggccagactggagttttttcaagtgtctgaagcatttactgtttttcactttaatatcgaaacattaaaatcagtcagaaacaaaaaatgttaagtcatttaatgatcctacttaaaattaatgcagccgatttaatgtatttctgttcgtccctggtgccctattgttgcgcagtagttattatctttgaaatgagagttgaaaaagataccatcgttttctgtgtctttcataacattgcagatatggtgcaaaatcttgattctaagtcagacatgttttattccattttatttaaaagaataacatatttaaatcactgtgtggtatgccagaaccattagttggcattttaagtgtcatttaaagaaagtactttaatttacatcagaaggaaaactaaattagaattcaattgcatcttacttctgccttttttcttttactgtattcaaaatgaaaatttttcttgttttaaattttagttttgtccatgactattcatgccggtcgttcaacaaatcattgggtgccccgatgctagcagtgctaaataaacaaagccaagttgacccacaacttggtcttcagggagtccccattctatttacgtacagctctgtgtgccaggcaccaggctgtgtgcgttccctgcaggagctattttaacccttccatcagtgcaaagagagcagtattattatttcagtttaaggaattaggacacagagccttgatgcagttggcagtcttgacctcatgggtgacagactggttttcaggctgtctctctgtgtcctcatgctgcttttgtgatgtgggttagagtcagggaaaacctggaaccacttagattcggtgttaggaactaagcttaaaaagagtttgggaaggtcatgttcacactgctatattcaaaatggatcaccaacaaggacctactgcacagcactgtagagcacagggaattctgcagaatgtcatgtggcagcctggatgggacaggagtttgggggagaatggatacatgtatatgtatggctgagtccctttgctgctcatctgaaactaccacaaccttgttaatcggctataccccaatacagaataaaatgtttcagttcagttgctcagtcgtgtccgactctttgtgaccccatgaatcgcagcacgccaggcctctctgaccatcaccaactccaggagtttactcaaactcatgtgcatcgagttggtgatgccatccagccatctcatcctctgtcgtccccttctcctgccttcaatctttcccagcttcaagatcttttccaatgagtcagttctttgcatcaggtggccaaaacgtttaagtttgaataaaaagaggggtagactgtgcactgcaggtgtcaggatgtgtccgtgcaggtcatcagggagggatattgatcatgggctgtcacatgtggaggcaggagacctctgtaccttttcctcaattttgctatgaacctaaaactgctctaaaaatggaaattcttaaaaaaagaaaagaaaagaaagtctggaagcaggctcagaggaagattattaagatgcagagggagccaaccgcatcctatgaggggattttaagggattatggaactaggatctgtgggtagaaggctctgggagtctggatccaggtcaataaggaagagccattttacctgcccacagatggatggctcatgaatggagaccctgaaccagtgggtggggtcagggctcaagtatcagttggatgaccttttatgtcaggtctccaagctgctcctcggagtcatccagccacttgttggaaggctgcattctgacctcctggtatcagttttaatgcttttaggattaggtcggcctgatcctctgaatttccagtcgacccaagagatgacccatttgtgggttgggagtggtggggggtgtggcagaggttacagaggtccaaagaccgttttttaaagagggtgaaagtgaaagttgctcagtcgtgtctgactttgcgaccccacggactatacggtccatgggattctccaggccagaatactggagtgggtagcctttcccttctccaggagatctttccaacccagggattgaactcagatctttaccagctttaccagatgagccacaagggaagcctttgaagagggtacatggattttattagaaactgaaaggccaacgtggggagcattgagttacaaaaaaagcagaggagtaggtggcagaaatgggagggtttcttgaaccctgggaggagtcttccatgcaattggaagtcttttagcctcaaacagctcaggataacaagattaaatatatatgtgtagatgtgcaaacatacacagagtatttttaaagttcatttggactgtgaagaggacggatttaaaagtgcctgtgggaacttcccaggtggtccagtggttaagactttgcctttgaatgcagggagtgtgggtttgatccttggtcaaggaactaagatcccacatgcctcgggggcaaaaaacataaaatggaagccatattgtaataaagtcaattaggaaaaaaaaaagtatggacacagaggggctggatggatggctacaggtgattctgtagactggggaagcaccccaggtgaatgaggatggagactgaggagggtttgggaaccacagtcagcaggacttgaggacagatgttgagtgagggagaggggagaatgaaag

SEQ ID NO: 53657 - DNA, 833 bp, Bovine  19866880954619
caggctacagtccataggatttcaaagagttggacatgactaaagcgactcagcagacatgcacagtctgtaatatcaactctatatcacggacccctagactcctgttataaagactactgttgtattaataagatgttgttatagaaacaacattccaagttcctccatggaaaatggactcttgatgctaaattgccaggggttcacttcttgtgatgctgggttgtgtctgcaatgcccggctccctatttaattgaggcggtgacactgagcaccccagttacacccaggtgtctacaaaactccaagtttgcctcggctgagtgtttgtttccatagctgtgagggtctttcctcatttttgcttgttgaaggcctaactcaaattaccacacacagatagatgtcttagttcctccaataaaatttctctctcctcggaagtctgctgtcccttatacagcatctgtcccactgtatagcatctatcccactggtcctctgggaagtggtgggtgagcagctgtctccttggtatatttgaaagctccctgatgatggacttagtttcatttcatgtttgaatcttttatctttagctgtcaccttgtgggctgtgttgacctaacttactgatgagaaacagctcttagttcatatttcagatgatctcaatgagtatgaaaagtgcttgaattatttacttgaacaagaaataacatgcatgtaataaattagaatgtattattttcttattaagtatcttaggataataagcaatgaattattaatgtaccacatcagcatgtattttattccatttttgtgt

SEQ ID NO: 53658 - DNA, 2073 bp, Bovine  19866880964084
gaacacctgatctgctggggggcggtctctgccctctttcctcccctccaggaccccatagccgacatcaggccatttaattaacaacaccctctactgatccgagccccactgggactggccagaccccactccaaactttccgagggtcagcaacacaggcctctcagcaagctccccacaggggctggaaacaaaagggaggggctctctaaaaagccacccgaacaggatgaaatggtcactgacaagcagagacaacacggcaaggatccccataacatacacacgggacatgtgccaacgagtgacggttggggagacatcacaccacgttcagatgcctggatgcgaaaagtcaaggcagtggagaacacaggtcacgggactgttgtcaaagcagcctctttttattaagtttcctcacttgagaatacgccacagtgaatgaagaagcaaggagagcctgcctgctgtaccgcagacgagcaatgggaatgcgcgggctgagctctgagcaggtgtaatcaatttcactctatatcagaaataaagcaggagatgatatctattactccctgtcatggcagcttcttcctggtgatacacggttcttttaatacaccagaaactaaaatcaaatcatgcttatctaccacatagtgaatttcttttttctttcttagagatcagtataataccaaaattctactttatggcactaactgatttataaatttttattacatatgataaaaattataggctcatttttacacatttaattaacaaaaggtaacctttttcctttaaatttagcaactgaatctctatgtgcctattaatttctaagggtatcaagcaccaaacccaccacctgagcatactgttaagattactataaatgcttttaaaaaatcaaacttcataggaaaaaaaatcagcagtaagcagaagtaatttgtgttttctcttccctaagagaactttattcaatcattcactcattccaaaatatttgttgagtttattaatttactatgtgattgttgttgtacagtcgcccacttacgtccgactctgtgaccccatagactgcagcatgccaggcctccctgtctctcaccatctcccagagtttgcccaagttcatgttcattgcattggttttgtcatccagccatctcatcgtctggtcgccctactctccttctgccttcagtctttcccagcatcaggatcttttccaatgagtccactcttggcatcaagtaacccctttgtcatggcaaagggggctgtgtaactcaataatgctttgagccatgctgtgtagggccacccaagaagcatgggtcttagtggaaagttctgacaaaacgtgatccattagaggatccaaagagatggcaaaccacccccagtatacttgccatgacaaccccaagaactgtataaaaagattatgtgattactaaatgcaaaacactgtaacttgattctatacattatgagtatttattttaaaagaaatgctttagacaactttatatttgtatctagggagaatatcacaatgaggcaacttcaaacttgtggttttaacattatttaaaacatctcagactacaccagagaagacagatcaaacagaaaccctcagaatggactgcaggaagggtgtgatccagtgcctccccatcccatccacagtcagaagcccatgttagaccctgttgtgattccaccactagaatcagggagaagtaccaggcctctgccttccatggtaactcaaactaaaacatattctcactgtctgcaataaatctgctttctgcatattgaataggaaagagatgaaagggaatactcaaccatctgaaaacaaacggatgctctctaagtgtttctgttctgaggcccatacaaaccacatgctttgcttctgcctagctgttgtatttttaaataaatcattctgttaaatgctagctccctccttcaagggagagtctaaaaactctgttttcacaagcctctgacaatttgaccctcattctctctcagctg

SEQ ID NO: 53659 - DNA, 1766 bp, Bovine  19866881031738
acaacactaagcttatggtacatccatctttctttttccttcttacattagtaaatttcttatcctttaatgtcctacttcaaattaatgaattgattttaacatttcttttatacatctgatttttttcccctttggacaatgaaaaatgtctagtgcttccctaatatccaagaactagacttgggaagaggtgagagggctatcagaaacagacatggtgaagataattctatcctcgaaggcgctctctaaccctcttaggaacaaaagcattccatctgattcgagacattacatgttcaaatcccaggtccaccacttacttaccaggaaaccttagataagccccatgctgtgctgtgctgtgcttagtcgctcagtcatgtcctactctttgcaaccccgtgggctgcagcctgccaagctcctcggtccttggggattctccaggcaagaacactggagtaggttgccatgccctccgccaggggatcttccccaacccagggatcgaactgaggtctccagtgttccaggcagattctttaccgactgagccaccagggaagtcccgataagcccataggttttctgaatcttggttcccacatttgtgaactatggatgtagggccgttctcaccaaactgctgtgattcacagctggaagaaaatgtatgagcaagttatcatctataatgcattatatctgagtaagctctttatgccgtgaacatagaggttcaaggttaaaggcctccaaaataagattcctgccatgcttttcctccagcagggagcgagcgggtagcaagtgggcggaagtgactgctaatgcattaaggactgacgtgtgacagtaacaatgagacatacagatgcagtctgacattaatggagaaatttgcctgtggtcatggacatggcgggaggagggagaccactccacctcctggcttgaacttggatatgaaatcaaacgtcagctgagattaattagaagcctgaagtttcattctccactgttgatgggaagagaacatttccataatgtgaggaaacgtttccgggggacgcaaatctgcctgacattgagggaagatcggcctcattgtgaatgctgccgctgccctgcttgtcagggccattactttccgctcaagaggctttgctttttaacattttataatcctaacaacaaaaaaaattctggaagcaataattatttattatgttaattctgtagctttctttctgaaatttctgcatgaccattaaaaaccggctgtgcccttgaaaccaaccaggagtttattaattctcagccaattaagaggcaaaaggcaaagtaacagaatgctccataccagcaattattaaccaagcggtcggtcagcactctttccttgccaccgcttttattccaggaagcatcctgtatatttgactgaacaacaacatgaaatgtgttcatatctttataaggacctagaagatctgcaaggaccagacggaacctgctgtacatgtctgggaaacgttcagatccaggtgcttagggaagccacacccctgctgacctctcacaaacatggaaagttctgccagcatctctctgcctctgcatccttccagagaagggctcctaagcaaatggcccttttatctgcagttaaaaccctttctccagaacacgtgctctctctcatgagtgcacggcgcgcacgcgcgcacacacacacacacacacacacacacacacac

SEQ ID NO: 53660 - DNA, 1688 bp, Bovine  19866881151888
cagtggagttaaataatgcctctaccgagaccttaatctattgttccgaacaattcaacagccttcctatcagagaaggccatctatttcctgcccggggccagcgggcccagctctgggagagtcacaggcagacaggaagccactcctcttcctcttcctccatctggcttcgttgccagggcctggctccggaaaaggcctcggtggtcccagctgccctggcccctccactcagcgggaccttggggcaccccggagcagccatgtcccccgaggtctcatccctgcatagactctgtccctgaaagcattcccgccccgccaactgccgggtttatctcctgctctttcctgagtccagccaggcggtcacagctcacccgtgctatcagctctctgcttcttcccctgcagatacgcctgggaacaacttcagaatacaaagcctttaaacaatgagcagcgtttgagctagaattagggctgagtcctgcacaaacagctggaccaaatacgcctttatcggtgactgtctccaatttaaacaacccgtaagatgtttgttcaaaaccccgctcagatttggccatgctgcgttgaagaattccacgccgccctgcctacccccgtcagctgcaggagaaaatgacgtcttttcctgaaaggagattacagtttcccctcctctagggttgtactcccaccagattcagcgccagctccgtgtggctcaaggttgacctggcctcttttcctgggggggctggtgttcacagctggcgtttctagggtggcaggggttggaggtgcaggagcatctggcatgtagctgcctgtctgctctggcctttctgatctccaattcggttttaattgaatactttgcagaagacatgcgtgcctgctaagtgtccgactctttgtgaccccatggactgtagcctgccaggctcttctctccctggggattctccaggcaagaatactggagtgggttgcaatgccctcctcaggggatcttcccaatccagggatcaaacccacttttatttcttgcgttgccaagctggttctttaccattagcgccccctgggaagcccttgcagaagatgccggggaacaaattacaaggagaaagtcatcagtgacatttccatgtcacgaatgaggccagggagggatccaagcagaaaactctagaaggagaggcagggtgagagtaggccaggagtgaccttgactgcaggtcttctgtctggagtaagctgggcccctcacagaggaggatggttcttggatggttgagttcctgctggccccgcccctttctgtctcgtgccttcaggatccagattctcagagctctcatcccagcttgagtctccaggaaagagagaagatgtgtccacattagtgtgtgttcctcacatcctccccttagatgccaggtccatgtgccactagaaaggggttctcacagccacctcactgcccgactggaacccacgcccgacgactgtgaaaactccatcacagggactgcccgagacacagcaggcgagccagccgagccagggatacggccggcagaggagggacagccctgtgggcatcttttcttgctgactctggtaatcttgtctgcaaatcctgtctgcttgcgtgcatgaggagtcctgacaca

SEQ ID NO: 53661 - DNA, 879 bp, Bovine  19866881282709
gatggaagacattctttgtaagagaaggggtctgatcctagggttgagagttacatttgttgctgagggggatgagggcaggagccttaggtgagagctcactgttgctatttttggcgaatcaacataagcagcctgaggcagaggcagctgcctggggccctgctccagtgggcgcccatcatgcaatagcctctgggtacattgacaaatattatttttagatgtcatttctggctctcagaacttttggctatcagagttcctcccctctccacccttaaattaggtttcttccctgtggaaagtcagagattctgtgatgaaaccagatcaactctgctcggaattgctattaaatcttcttttgagaatcttgtttttctttttcctgttaggggtggccccttggtagaaggacgtttacacagaataaaggagaaaaaaaaattgtttgctgaaggcatcagctctgagaaatatttaacagtttgcaaataggcaggcagctcccagaccaaaagagtagggaggaaggctgttctgctcttatgaaaaggagatgtattaaaatgcagtcattaactggtggaatgttctagaattgctgacgacctactgggaatttgggctaagtttctcgaggctataacacaactgtacatcctcctgggaagccggaaaggaggaggacttggagcagcagggcgtggatcttagcagagtggagcggagatgggagaggaaatgtcttcccatcattgttctgatggaagatggggaaggttgcccgtggctcagcaggtagacgtcattaacagggagagaagtccccaccagagctcgccaacggccaagtgttactcattcacccggcaa

SEQ ID NO: 53662 - DNA, 765 bp, Bovine  19866881323626
tctattgggaagctctgcttttcccgactcagccttcatccacgtttctctgaaaatgactcttagaaaaacagctctgaatctgacacctttctctcgttccacgttcccagctttttgtgtgtgtgtgtgtgatatgtatttatttatttggctgggctgggtcttagttgcggtatatgagatctttagttgcggcatgtaggaacttagctccccaaccagggatggaacctgggccccctgctttgggagctcagagtcttagccactggaccaccagggaagtccccacagccttggtttttaacgtttaactctggctaaggcttcttctgtaaacgtagcatctctgaaactgacctcatcatcttagcttctccgctgtgctcagtccccctgttctgaagtcaccagggttcctcatttacccatttctttccagaatgattgctaccaacctgtttgactttttagattttgtgaacctcttcaataacctgctgtgcttttgtctaaatctctttcacatcaatctcactacaacggaaagaaaaactttctgaaacattattaaagtccaaatagttttgagaattgagcttgtaccccactcttcctcttggggacacgtttaaacacaatttttctgaacttcttagcccttgtgcgttatttgatgacacttattcgttccgtgtctttttaattttttcaatttttattttctttatctgcaatattgtgtttcaggtgtacagcaga

SEQ ID NO: 53663 - DNA, 1797 bp, Bovine  19866881358613
aaatgagagagtataatgttgcagggcaaatggaaagaaagatctctacggaatggagttagcttcaaaaggggctgtctcaccaggcagctcggcaggtctttaagaatcattattttggtttctctgaaaaggaaaactttgttatgagaacatgtgatgttcgtattctcaactctttgggtgaattaaattcagcttaatcatacccattggcacatgcgtgtgattagtctatcttccatcattgttggtgacggaggcaataatgacatataattagttactcccttctaccccatcattaaaatctgcactggtgttccaggctctagatttttaaagactgaggaaactgcagggattcttctgcaaaattcgagaaactcggtgcacaggacaaatgtgttaggaagagtgtgctattcaaaaccttggctgacagagaagcagcatctgataacttgagagatggagtatttcctgccgtatcagtacacaaggatgtcacaggcatcagagattgcagccttccagtgtgagcctcagggcatccaggaaagagaacaatacctgcgatctagcagtcttcaggcttcagccactccctacggtaagccccaaaggagctcaggatgtgaaaacacaggatactgacgcagaatagctaaaatgcctataaaaggaatgacttcagccagcccagactcttgcatcttcccatacatagaaaagtgctaaattccttaacttgggatgtctagttttccttaattcataatactcttttgatgttcagacgacctgccctttgttgcaaaccttctatataaccttgctcctcccctcgcctcctcctcagagttctctctacattacttgagatgctgtctctcacgcttgaagtcttaacaattcccaccaagtaaaatacaactctcaacttttgggttgtgaccattttttttaagttgatatgatgccctttttcatgagagttttgtgttgactatatgtgcgtctgaatgtgtgtgtgtgtgtgcgcgctcacagcatcacgcatgtatgctgccctatagcatgtgtctggtcattatactcaaatttcctcttctacccgatttcattttgcaacatgaataagtcatggccataacccacatggatttcagagcccatgactgcttttaaggccttacggaaatagccccctgagacaatctaaaactgagctctgcctgctcagttaagaaagccttttcttgtcaatttgtaattctaaatttgatctcatcctttaaacaacaaaatactacatccctcccctgtctccctcagccggtactaaaatggtcctaaagaatatgtcttttctgatgggaaaccttgtgaaatagggaaagtgaagcctgcagagaaataaatgaactcaggagcaaatctcaaagagaacaaaaccgctgcggggaggtgccaccagcactgtagaaacacttattagcacccatttcagcctgatgaaactgctctcgccacaaccactctcctgtcctgcagaccagctgtcaagcctccttcctggggcacaggctcttttgtgctcctctcaaaaatgtcacctgagcacacgtatgaaatatgtgttttgcaaccactagagaagaaaacttctaacaaaaaaattctcccttcatccaaatgtcctctctccctttctatttttgccctctctcttcttgcctttctgatggattctcaataattactgagcaggaagaacatctgtgacttgcactg

SEQ ID NO: 53664 - DNA, 752 bp, Bovine  19866881484120
atccttctttccaagcgcgtactagaagaacatgtttagaccccgcgttctaagacaatgcaccatatcaagtagcccataatactgctataactgaatgaaaaggcagtgttctcttggtgagacacggctttggcaattcattctatctgcaggagtctcaggtgccaaatttgctgttaatcgggttttctgactcggttgacagtcctggtggagtgtcacacttctatttccttgtgctatttaatgtcacaattcaactttagggacagtgggattacctctacctgatgcaccatgtaaaaagacaaccagatttttgatgcccaggccccccagttttctggggaaaacacttattgagacaaatggtaaaaatcgctcccagaagattctcacgatcagacaaactttagtctcaccactgcaaggctcacccttcctgcacaaccttttcagaacccgcaaacatccacctcatgccatttaccgtgcaagtctcaattaccttgctgcctggactaaaacgcagtaccctgggagttggagagcaggggggggtgttccggaattccaagattgatgtaaaggcatttcaacctcattaatgtttcttgtgaatttccattaatcatgttccatttcaaggactattacaaaagctttctgagacgcagcccaattaatggatgaacaaaaccgaagcttgagctcttgatcaatgaaagcaggtgatgtaggacaaggga

SEQ ID NO: 53665 - DNA, 757 bp, Bovine  19866882033694
ctctgtagcgctctatgacttcccctgttgtatccacatttcatttaaaagtaaaacaatgtactagagagagaatagtttagctcttgtagaatgttataaaatcagatatattataaaattttaatgatcacacaacttctttcccttgaccatagagaactcactttagagccaaaacttagtgaaattaaaaaaaaaaaaacaaaaaactataccagtaaataataatgcaataaatacttttaaatgtacttaaatgtaatgattcttttttagcaaatgtagtcacactcaagcatgacattagctggaaataaaacaatagtcaaacaagtaaaagtgtggacatttctggcactgattcttttcaatataattttaacgttttctaaatttttcaaattatacaggaaaaatttacaaataaaaatccatcagatttagtttagagtctatttgtattacacagtaaaacagttaatatccattttatcaaacatttcttcataaagcaatgtttccaataaaagtcaatcccaacaaaatatttaatattttctcttaacaaaaacatgtattgttttagtttgctgctgcatcaatttcaagtagcatatacttctctcttttacatccacaggaaaatctgaaattttcagaaattgatgtagttatttttgaaagtacgtccacagttctttattccgaggtaaaacaccagagttcaatacacagattcacacacatttaccag

SEQ ID NO: 53666 - DNA, 1693 bp, Bovine  19866880455766
aatgagtcaccagacttccctggtggtccagtggttaagaatccacctgtagatgcaaaggacacagttccatccctggtccaggaagattccacatgcccaggatcaactgagcgcatataccacaacgactgagcccacggggtgctactactgactcctgtacactctagggcctgtgccccacaagacaggccgccacagcgtaaagcccacatgccacagttagagagtaaccctcgaaccactagagaaagcccacacacagcaacaaaggctcggcacagccaaaataaaaacagttgttacaatactttaaaaaatgcaccaccaaatctcatggcagaacccgatataagtttatttctcactcccatgaagtccaatgggcacttataggaatctggaggggtaaatggtgaggactctgctccacatggtcattcaggtcaccaggatgagaaaagctctgcagactagactgggtagcttccacgatcacaacagccgtcagcattcagatggcaacagggcaaagagagaaagagacgggtcaggagagagccacaggtcaggcccagagatggcacgtttcacttctaccgatttcacactgatcagaactcagtcacaccatcacgctgtctgcaacggacatgggagttgtagcccagctgtgagaaagaggagagggaagtggtttgatgctcacagccagtctcccccacaatggacattagtgtgaaaatatttgaaacattcaaaaggcctaagtgagagataataacagctattattttttgcaagtgatcctttattttctgtccttttattaaataacctgtctttttaaaatatttttgtaatacaatgtgatgagtattacaatggtgttgtgcagtgagaacacccagcctggatctttttaggaagtgaagacagacctaggtcttaaacagtggatattaggcaggcaaaggtgtataaagggtggcgtaaaggaggcgggcaacagaggacattcaaaaaaggagtggacaccaaaaaaattacaggaacgtgtcagcgtgagagaaggtttggaagggcataaaaatcagggtatcaggatgtgaaatgaaagcagcccacatgtttgtgacaagatgatacgagttagactagacataggagtttgataaagcatttgtaaacatttatatctatagcagactgtgattacaatactcatttcttaaaatgcaatgcaactttaagatattaagtacccttccagctaaggtagaactatgcactctcatctctcttgcttcattccacttccataagctttggagctgtatcatttctactacttcagccgaatcgaactggcattccagagtattttagaagagaaataaatggcaactttgaagtcaaaaagattctcaaatgtcttagaataaaaatagaggattctaccgaggagagcgctgctttgagttttagctgccactgtgagtgaaagtttattatacacacacaacacaacatacggcgtacacactcagtaaggaaggtatacttatcagtcagaaccgggcactcattagccaaccagaatggatgctcaggagaaataactgagatgaatatattgtgaatactaggtgaacaccagtgccactcacctccaccagcctctcactta

SEQ ID NO: 53667 - DNA, 1658 bp, Bovine  19866880591049
cttgcctggaaaatcccatggacggaggaacctgataggctggggtccatggggtcgctaagggtcggacacgactgagcgacttcactttcacttttcactttcatgcattggagaaggaaatggcaacccactccagtgttcttgcctggagaatcccagggatggtggagcctgacggggctgccatctatggggtcacacagagtcggacacgactgaagtgacttagcatagcatagcatgatactataaggaagtatcagggggtgggatacttatgatactataaggaagaaaaaatcaatctacctggatatttaattttaaagcaatatcaggcaaagttctctagcttaaattccaggctattacagtttaagaaccaatttagatattgttgcatgtagatgcctttatctgttgaaacaaattttgtatacactgtgtatttttagttttctatatctttgggaatatcacatactttatatttttagaagtcttaaagacaactttaactagaatcttccctgattttaaactgactcttctccaacttaggctaaaattcagcaggtgtagtgatttcatttttccttactgatattctaaacaatgatatatctatactgatattctggagtttagtgtagctccaaagaaacaaatgtaaaatgggttaaagaaaaaaaaaatctggatgtttccttaaagacaactgtcaggtttattaatgtgttcatttatcagggggaactgtgacgttataggaggtaaaaatagaaccagtatttgtctgctctccattgtgccttctcctcctgtccctctccctccgtcactttccattccttccctgtatgtggtcttttctggacctctcccacctcccatagacaatttagaatgctaatgagttaagtgagagaaagacaaatatcatcttgtgtgtgtcttgtgtgtatcacttgtgtgtgtctaaaaaatggacacaaatgaatttatttacaaaacagactcacagacaaacttatggttaccaaagaggaaaggttgagggaggaataaattaggaatttgggattaacagatacatactgttatatatacaatagataaccaataaggtcctattgtataatacagattacttggctcaatatcttataataacctgtaatgggaaataatctgaaaaagagtagatttgtgtacatatatatgtatagctgaagcactttgcagtacatctgaaactaacacagcattgtaaatcagtaaaaatgaataagtaaatgaagcgtggctccttatttatttattatttttaaattaaattgtattggagtatgactgctttgttgtggtgggaggaagcttcaggatggggaacacatgtacacctggggcagattcatgtcaatgtatggcaaaaccagtacaatattgtaaaataatcggcctccaattaaaatgaataaatttatattttaaaaaaataaaaagaaagaaagaaaaaaaaaaaacaagctttagatggcaccaccagacatctgcctcggggctaacacatttctacacaataacattcctcctgtgccttgcgtgctgtgtgctcatttgtgttcgactgtttgcgaccccatggactatag

SEQ ID NO: 53668 - DNA, 4598 bp, Bovine  19866880667188
gagcctaatgaatcataaaatatcaggtccctcctttgctcaagccttccaatagtttctcatcctgtcacaaaagcttgaatcttactcattcctgtatgctcctcctccagctcctacatggaaggaatcccttggtcaggaaagtgtgagagcttcaggatacaaggaattaaatagggattatagggcttatctaaacctagagtattctatgtatcattatgaagcttccaagaagatatcgtaggtagcatttttcaaacttggccaagaaaacctttttggaaaagaataacactgtacctattttccattgacaataatatttaccagctctgcctgcttgtgggaaaggaaattgggcaaacttgaccaactccattaccttggcaaaagtgaaaaaagccttgaaaaaagtggccaaattccttaccttcatagccagatcagggatatgggctgaacagctgggttgtgtttttcttttttctagtttctgaatttggtaataaaaaacacagccagtggattaattgatgtttattaatttaaaaagagagtatcagcatgtttttaagtatggtggttaatatggagggttgagtagtcaagatgaaacaatgacaccctatgtatctaaattggtatacacagttgttgttgttgtttttaatctgaaaggacatatgtatttttaaacagttaataaatgcatttcactttttagctggactcaagaaatagtatttgaacacagtaaaagcctttaaagaggtagcacttaagtaaattgatatcaatcaaaagtgttaaccatgctgagctgacatacacttcattcagggggcagaaatcaggtgattaaaggcccacatagcttttgtgcctgcttgtaactggtgcacagcaaggactcactgtttggtgaggtgagtgttgagagaatattttctgtccctgtatgtcttgaagcactctgacagtggtggcatttggaaccccagaaatagattaaaaaacctgccttctgaacttgtggaaagtaacaggtttcagcgaagcatgggcatgctatgaatttaacaaccgacacaatcagagccagccccacactgccccatctcacaggcccttcctctttatttctaggcctccatgtgaggccagaaaagctcagagtctgaggcataacctggtccagctgtcctcttcagagattcatgcctgcagctgtccaaatggtgctgttgttctttcttcaaaatctgatttctcttcctattcccctgctgagcttcaacagatgacatatttctacaaacagagcatgtttgtgttgtcggtgtctacagagatcaagaaagataagccaaactttgcaaagccagaggttttacccaaagaaagccactacagacacctgacggaaaaacgagatgatgtttgccaaagacaataaagagagagctcacatttgcccccttgacataatgcaatacagtgatggattctaagtgtcctaggaagatgaggcatcccattagatgcctattgaggcaattagggttgccttatgggtcattataaatcaattgaaacaaccattatatttattatttttaaagctcaacattcagaaaactaagattatggcacctggtcccatcacttcatggcaaatagatggggaaacaatggaaacagtgacagactttatttttggggggctccaaaatcactgcagatggtgactgcagccatgaaattaaaagacacttactgcttgggagaaaagttatgactaacttagacagcataataaaaagcagagacattactttgccaacaaaggtctgtctaatcaaagctatggttttttcagtagtcatatatggatgtgagagttggactataaagaaatctgagcactgaagaattgatgcttttgaactgtggtgttgggagaagactcttcagagtcccttggactgctaggagatccaaccagtccattctaaaggaaatcagtcctgaatattcattggaaggactgatgctgaagtggaaactccaatactttggccacctgatgtgaagaactgactcatttgaaaagaccctgatactgggaaagattgaaggcaggagaaggggacaacagaggatgagatggttggatggcatcactgactcaatggtcatgggtttgagtggactctgggagttggtgatggacagggaggcctggcatgttgcagttcatggggttccaaagagtcggacatgactgagcaacgctgacctgaactattgaattatttggctatgtcaggtcttacttgtagcacccaggctcagcagctgtgttgtgcaggcttagatgctctgtgacacgtgcgatcttagttccccaaattgggatcaaaccaagtctcctgcattaggaggtggattcttaacgactgaaccaccagggaaaacccttttgtatttactagggactgggattactttgccattttgaaaccatcctcaagtaccattttgtttatatttcccattgtctttggagagtttcactctcagaaatagatgcatgtacctggtgttaaaaatggaaaagtttccattttcactgtttattgatataatatttatatagtagaagtctcatccaattaatcatgctatatgagtgtttgacctagagatcccctttgggaaatagaggagaaaaatataagagtgaggtcaatgggtatatgtggcagataggaaagatgtatttgacagagcagaagaaagcatattcaggcacaactggaacaccagaggaaaagagaacttttgcttaatggaggaaaatgactcagagagataagtggtatattctttatatcaaaaaggtctatgactatagtatagaatttgaatgcttgctatgtagcagataacactctaggtcctggggaaacaaaaagtacatatttatgtgtgtgtgtgtgtgtgtgtatatatatatatatatacatatttatgtgtataattacatatttatgtcactacagatggtgattgcagtcatgaaattaaaatatgcttactccttggaaggaaagttatgaccaacctagatagcatattgaaaagcagagacattactttgccaacaaaggtctgtctagtcaaggctatggtttttccagtagtcatgtatggagtgagaattggactgtgaagaaagctgagcaccgaagaattgatggttttgaactgtggtgttggagaagactcttgagagtcccttggactgaaaggagatccaaccagtccatcctaaaggaaatcagtcctgaatattcattggaaggactgatgttgaagctgaaactccagtacttgggccacctcatgtgaagagttgacttattggaaaagactctgatgctgggagggattgggggcaggaggagacggggacgacagaggatggcatcactgactcgatggacatgagtttgagtggtgatggacagggaggcctggtgtgctgtgattcatggggtcgcaaagagttggacatgactgagcaactgaatggaactgaaatgatatatacacataaattacatatttatgtacatatatatatacacatatataaatatatatatacttctgtcttcatggggaatatctttagtaaaaactatagtcaaattggaagaaatggagtagcccacatagtcaacgatagagtccaaaatgcactacttggttgcaatctcaaaaatggcagaatgatctcagttcgtttccaaggcaaaccattcaatatcacagcaatccaagtctatgcccgaaccactaatgctgaagaagctgaagttgaatggttctatgaagatctacaagaccttctagaactaacacctaaaaaagatgtccttttcaccataggggactggaaggcaaaaataggaagtcaagagatacttggaattacaggcaaatttaaccttggagtacaaaatgaagcagggcaaggctaacagagttctgccaagagaatgcacagattatagcaaacaccctcttcaacaacacaacaggtgactacatgtgaacatcgccagatggtcaatacctaaatcagactgattatattctttgcagtcaaagatggagaagctccatacagtcagcaaaaacaagactgggagctgactgtggctcagattatgaactctttattgcaaaatccagacttaaattgaagaaagtagggaaaaccactaggtatgagcaaaatcaaatgctttacaattatacagtggaagtgacgaatagattcaagggattagatctcatagacagagtgcctgaagaactacagatggaggttcatgatgctgtacacaagcagtgatcaaaacatgcccaagaaaaagaagtgcaaaaatgcaaaatggttctctgaagaggcgttacaaatagctgagaaaagaaaagaagtgaaaggcaaaggagaaaaggaaagacatacctatcttaatacagggttccaaagaagagcagggagagataaaaccttc

SEQ ID NO: 53669 - DNA, 851 bp, Bovine  19866880672997
cagcatatgtgcacataaagagataggcactaggaaacatacgtgggtgtgtaggtgggggtggaggagtggagcagctgctgctgctgctaagtcgcttcagtcgtgtccgactctgtgcgaccccatagacggcagcccactaggcttccccgtccctgggattctccaggcaaggacactggagtgggtggaggggagcagaggctgtgctgaatagtgcaggatccagagaaaaggttacctgccagactggggtccatttttactctggtccggtactctaaccctctcctcactgcaggtcttcctagacttcatttgagaaatgcattttcattgcttatattgattttatacccaactttctcttgtgtagaaaaggacaagactattgtaagctttaacaattggctgggatttatatggtcaaatggattaagcctgtagagaaatcattaggctttctttaaaaataaagcaacaacaaaaaaatcctactgttcgcttaatggaacaaaatagtctctacccagaagatctctcagggcctaaataatgcatataatagtatgggggattctattgatccccctgaacccatctataagtgctaaacctgccttattctttttctttttttatgatgagctgtttaaggaaactgaaccatttaaagtttcaaattgcactaagttggagcaagttacttaacctttccaaatacttgacagggataaattactggagagcaagcggctactgtcgtagggttattgtgataattaaatgacatgcacaggaacagtttgagacttgctctgtgctcagttaacatccattttcctact

SEQ ID NO: 53670 - DNA, 3543 bp, Bovine  19866880696661
aagaaaaattgaaagaattttatagtgaaccctcttacattatacctactatctaccattaatacgctatggtatttgatttatcatatatctaccatccgttcatccatcatccattctgcatccatccatcaacccatcttattttctatgcatttcaaagagaattgcagacgtttgcacatttctccctaaatactgcagtagcatatcactaaccagagttccatatttattcatggttattttaggtaaaatttgcatacaatgggctgcacacatccaaagtagataatatgatgagtttaacaaatgcatacacctgtgtaaccccaaaaccttccaaaatagtaagtatgcccttatgcccttaaccagtcactcctgcacccggaggacaccactgctctcatttttttttttttttttttgtgaccatgtattggttgtgactatcctagaacaccacattaatggacttacataaaagattgttgagtcagtcttcttttgctcataaagatgttttgtcaaatggcttttgacaagttacatgagttcttgccttgtttctcccattgaatgaccaactctatgaggctggggctctgccataacatctctgaatgtactacatcgtgaagcactctgtcttactcataatagggattcaatttgcatttgatgaaatggaaggcagagttcctaagagaatctgaaatattagaagaaaatatattttacatgttgtgctatgctgggttgaaattagaggcagagtaaacatttctaaagttctacatttggtgaggagtatataataagtatctgcttttcacagttgcttcttttctttcttttcttttctttctttctttcttttttttttttttttacaaaagagggagctgagtgaactcctaaagacatcctcagagtggctatactcttggggcaaagaacagccaaccccttatatccttcagaatctccagtaacagatgggtagaaaacattcacagacaggctcaggatcttgaatagaaatcttgaatgaagactatgagtgttggagttttggattgacatttccacactgctatatttaaaatagatgagcaacaagcacagcacaggaaactctgctcagtattctgtaataatctaaatggaaaaagaacttgaaaaataggtacatgtgtatatataactgaatcaccatgctctacacctgaaactaatatcttattaaatcaactatgctccaatataaaataaattaaaaaaaaaagaaactatgagtgtaagtgaaaaccagagtttttaatcaatgttcagccattaaaagtctgatctatgtttcttacaattcctataatggaaatttcatgataacagtagttctgttagacttatttgaggggattaactctggacattgcaatgtgctggaaggtttgaaggatatgaaaacatggtagatagttcttaccctcatcttgcagaagcttagggtctcacgaggcatgaaggtcatcgaggaatgcacagcccagctgagggagtcagctggtgacctgtaagaatcgaccttccaaaaggtgccaattcaagtacactagttctttccagtgtgacggatggttatttgacattattaagaaaagactgaactattttttcccaagaagagtcatatatttattgaccataaaattactactgtagcagctgcctctaattccttggtagaattcagtggctagaattaaacattagtctcatcatttgataatcataaagcaaggactgtagcctgctaggcttctctgtccatataattttccaggcaaaaatactggaatggatagccattcccctctccaggggctcttcgaacccagggccctaacccaggtctcctgcactgcaggcagattctttactgtctggggcaccagggaaggccaatcatagagcgcactgggagtcggaaaaccaagtgtgatcagttttcatctctggtacttaaaaagggttctgtatttctgttcaaagagttaaaatgcattaaaaaaaaaattgacctctgtgaactccttttcactttgctcaggccgtcttctgaattattatttatccacagtttggttttctttttgtagctgtttgcatttaaatggagagttttccaaagacagcctatactgtagctactattggtatgcattccggagaatgggccagattttacattctttggaagtatacataaaatcatcattcactgtgttccaagaaaataattcctgagggcctccaagagggatcgtacttggaagcacgttttttctctctagctctaatgatttttggattcttcatgtttgggtattcatattcattaggggccataacgatgtgccaccctggttaatttctccatgcagaaagcaatagagatttctatgacattgcctgtggtgggcagtgaggaatccctaactcaactcagtattttctcccactgggtaaacgtttctcagaaaagttaataaggcattgaaatctgcacagacagaaatgctaatgcctccgccacatacctacgattatcagctcagtctttagcagttggaatctgacataaatcctccagatgtattaacgtcggctgtggtagctggcagagtcttgttatgttgaccttgggcaaagccttacctgacagcaattcaatagaaagatgggtgccaaggcactgcatttgtataaagaagagaataaagaggctgttaagttaagcatctgctgtcatacaccataaaagcaggattcaggctgccgcgtatgagctgtgttccaatgagaccctgagagagtggaaccccaagagaggggcattatgccaagatcagagaccgagggacatctaactatccattattgcctgcttcactgtgggggctaaaagtgcttaatgcctttgtgctccccccgacagagttttatgactgctaactgcattattttggtacaatatgggcaggagatcgtaactctgaagtatttcactgaatctggaggtgcgaatatattgaataaaatcaatagaggttttccaaagaggattaactggtagaatggacactgcctgcatagaattgaaattctctgcatgaaggaaagagggtatcatttataaggtagctgaagatctatttctctttcaaaaaccagttaatatttgtcaagacccaactttataataatgctgaaataagaatattttgggaacactgggttaagtataattaaaataattttacctctttgtctttgctttttttaaacatattgtcaccctgtttatttaacttatatgcagagtacatcatgtgaaatgctgggctggatgaagcacaagctggaaccaagattgctgggagaaatatcaataacctcagatagacgacaccaccattaggcagaaagcaaagaagatctaaagagcctttgagaaaggaaagaggagaggaaaaa

SEQ ID NO: 53671 - DNA, 1749 bp, Bovine  19866880732265
ttaagaacctgccttccagtgcagggcacatgggttcaagctctggccagtgaactaatattccacacaccccgaggagcaaccaaggcctcatgcatcagaggaactaaaccttctcattgcaaccgatgagtccacacaccaaagtagagaagtccacgcaccataatgaagattctgtgtgccacatctaagacctgatggaatcaaataaataaataaatactgagaaaaaaagaattgggtagatgtcgagttacaagtcccaaccttgctgttccccagctgtgtggacttgagaaactcacttcatctttctgaatttttgcattttcatttctgcgagaaagttctaaactgagtcattggtttcctgtctccctctcgaatgacctaacaaaaagacaggtagcctgaaacctgaaaccttcacttttgagcctagaaaaccttggctcaaaaccaaggcaatgtctgtgataagatatttggtgaggttttctaaataaggttgtggaatcaaattcttttgaagaatttttaatccatcttgggttcaattcacaagaaaatgcacgatggattggaaggggagagtaactctttatcttcccaaagatcacctttagactcaaagatctgaaagacctcttgaagtgtattctagttgagcccattttcgttttacagggaagaggagcagaggcctctggatctggattttttgtgaacgttttgtagaatcttacacaaaaatgtaccattgccagctataaaggaaaaagtcatgcccctcaacagtgaggaaaatactgcctctgtggtttgcaactttttacatatattttgaaaagatggccaggataaaagaataaggaccccaggaaggccgtggaaggtttcctcagttgtccatctagaaaacaacataggtatttcatcaaagaaaatgtattcatttagtaaaatgtggacctctctaaagaagtatagattttcttaccaaaaaaccttagagaagaagcgactctagggaacagaatgtagaatgcaatgaagtcaagtcatgggggcatgcagtctcgtcgttttccgaggggggatttttgaatgtaatcagagggatgagttgcaatcttgccctggcaatccaaccaataaccccagctcagttccagccccttcagacacgtgtctgtggtgagggtgttagtatttacattctatattaccacaaatattgcttctttgctttagggcagattggcagcagaccttacacactggaggaaatgtttaatgaactcagttcttattttctgtaactctctaatcctgaaacactgaggcttctcacccagagatgtttgcgggttttatatctatgtatatagtcagaacacagaacagtggggagtgggactcctctgaaattgctggtaagaaagggaagcaatggcccacttttcagtaaatcttgtacttatcaatccaggaacatagtggttagtgtgctggaggtttgatcctaaaataaccagtgcctctgtgaactgtcagtctttgcaataaaattctgctacaccgtgacagagtagcatctgacttatggacaagttgctctagaaagacagtttaatgcagttccaagtgtgtaaaatgaagtcagtgtagggcatggaaagattatttatagacgagttcctgtagaaatatagaataaatacaaattacacgtcacaataagga

SEQ ID NO: 53672 - DNA, 1765 bp, Bovine  19866880823541
ttcctagaggctgtacatttcacttgggctcacgttgctgctgtccctgccttgcccttcaggctgtaaagccccttaacatgcgcctgataataagcccaactcaaggatgatttcctgtgttctgagaagttgactgacatgcggacaaacgtttgccccaactgttccctggtgcttctatcaagaggatggagggaacattatgcacaaatgtccccaggagcaaagtccaatgactacaattcataaggtaagaatgacagagagaaaagatccctgcagacagaatttctagggggatcagaggaggtggtagagataggaagtgatgcagatggagagggaaggacccttcagagaaacttcctctaacagctaatgcaagctgaccatcagctggcctcagggtactgactagctctcccctctgctttactgcccagaatcctgccctgggagacactgacttagccatttccttactcagatcctattctcttagcagcattcctggcaccaagtccactttcggagtggaaaggtcttgagaaaaaaaatgggaaagaagttgagctgtcagtcaatcttcttgacaccatttctcttgtttgttgaaaaggaatgaattttctttctcttttccttttgggcataaggttctctcactccaaatgaagtattttgaagctcagcccagcctgttctgacctgcaaaagattgagttaattaacctttcatgggctgattactttcaacctttttgttagcacatcggggaaatatattagtggttactaattaaaggtattgatatgcctttacatttcttcaaattcttagattcctagaactaagttgattaaggaaaaaaaagggggggaagggggggagtatctgttgaatttatgaaaaagcgaagctctgaccttattctgtaacctatatttgtaattgagttttgggagttgagaccattttgtcagtataatgacagctcagatttactgtgtgtttttcatgtgtaagaaatatgataatttttcatgtgccatgttatttagctctcacgattctatgggataaatgtgagtatcaatcccatattaaaggtgagaaagttaaagtttaaaagtcaagaaaattgcccaagatcacaaagttagtgcacaccagaggagggacttaacgtgagaatctgtctccgaagacaatgcatttaatctcatcaatgctgacttaaccctatgacaatgcagtcattatttctggagtaagaaggaggtaaaaataaaatccacttgcaattccagggtgcatcatttttttctcacgattatcccagacacttcttatctccacccaggagcagctaggctggatggtctggctctggtgtcttcacaaggtggcagtcaagctggcggatgtgtcttgagacaaaccgggacctggggcctgggatcctttgttgcagggcttgcatccagaccagacagatgcctcttccagcaaaaaatacccacaaattatatgggactaaaaacagctgtgtgcatgtgtagttggggcaaattatggacaagagtatacaaaaagaccaaaatcccaattgccacttctgaaaagccaggagcaaaaaacggggtactgctcatgctccttgcacacaacaccacccaaaagggtgggcaaatcatctaaagcctgatccctggacacacccctaccctcactctttggtaaggaaacagtttgccccta

SEQ ID NO: 53673 - DNA, 1605 bp, Bovine  19866881012999
atcagctgctatattcatctgacatttccatcaagtctccccaaactcccaccaatgtctccttattgtttattatagtcaacccagatttcttagcttccttgtaagaagagccatgtattcacttgtcactccttccctttagcctggattcttgtttcttctcaagtaagattttccactgtctcttctcttgcctttacttccactagaatgccccaccaggttccttcttgtacaatttcctgttctttgtcactttcaaaccagattcaaagctatgaccccccccccaaggaaatactttcattcattcatacatcaattggcactaatatgtatacacacgcatgcacatagacacacacacactactaacaaagtctttttagaagatacttttaaatgcttgaaatgttgcaccagactgggattatgttgcctgtatatactcatcttgatcaacctgactccagggtgtttacttcctaatgtgtctttggtattttcatgacacaagcacatcagattgcatcctatattgcacatacattaaatgtgtattcactgcccagtggatcctactggctgacagagcttgggttatgaagggacagtgttataaaacccttcaaatcatctgatataaatattttaccagaagaggaaaccagaggttggtctaattataaaccaccagaagaaaaatgggtaatgactatcaatgtcacttaaaaaaaaaaatgaactgctgtcatgtctcagagaacttgaacatattttgtgtcccttctcattctttctattggcctactctgtacatgtctgaaaatggctaaaggtgtgtattttatcccttggtttcggagagaaaattgaggaaacattcatgggaagaggagggatgatgaaccttgagaacagttgtgtagagtctattgcctggtgagacgctcatggtttttaggtgtctctttgaatttggccgtgccactggaatcactccctctcattctgtagctcagctttatatcaagagtatccactggggtaagggtcagagtgtttccaggaaggtggtatgatgtcgttgtagtgtaaccacttggctgaactgaattacacctccccaaagcctcttcttctatgttcctggctagaatgtgtcatcagagataatttcacacaagatttggaggttggaggtcatgcatagctgtatgctttcactttggggaggttggagaagatgcttttgtctctcacgccttctcaccaatggaccagttcactttactgttgctggacagcacctgtgcttgcaactggcccgccttccccgggtcttccttcaatgtctccaactcttgggccagatgtgtttagcccatgacaaagctccagcttcttcaagacacccatgccactaagatgagaagccaaaagaatgccatgggctctgcaggcccttgatctcttcctctttacctccaccttcctttcccaactgcctgccctgggaagttgagcaagtcttatggagacagtttaatgagctgccacatgagttggtacaggtcaaatccctgtaacaaatccacatat

SEQ ID NO: 53674 - DNA, 1302 bp, Bovine  19866881021083
gactcattggaaaagactctgatgctgggagggattgggggcaggaggagaaggggacgacagaggatgagatggctggatggcgtcactgactggatggatgtgagtctgagtgaactccgggagttggtgatggacagggaggcctggcgtactgcgattcatgggatcgcagagtcggacacgactgagtgactgatctgatctgatctgatctgaaggttgctctggtggaagcaggtgcagttgcttctggtacttgctctgtgcctcatagatgccaagtagatgcaagccttcagagggaggcccagggcaaagaagggcaggtgcaggaggtggactggaccatgtgccctgaagctggaccagcaagactgatgggtaggacccaggagggcatggatgtggcttacccagctccatgcaggcctgaaccaagaagggaatcatttgacctttggtttcctaccatgactttgaaacaaagtgaatctcagtgaagtgttaacagagcgctacacgtcctagatttttttttaaatcttttttatttgttttatttttagagagtataaatgccttgtgttgtgttagtgtctgctgtacaatgaagtgaatcagccacatgtatacatatattccttccctcttggacctccttcctcctcccattcccccattctaggtcatcacagagctctgagctgcactctctgtgctctatgaagccctagattattaaactcactttaaatgtgtggagactgagtctttgagaaattaattgtctcatcctaaatctttataactccaaagaggtggagatgaaaactgcagcttaactcttctgctttcgcagccaggattcttatttatattatatcgtactgtctctgcatcagagttaaatggaagccgaccagaaagtttctgtccttccctaaaatctaagtatggaaaaggagagagagagagccaaagcagactcttacacgttcgctgggatgactccaggcactcacagggtatggaaatgctgctctggattgtttcatctcggtggtgattgatttaccacctcttagtataacatccttgtacagctctgagctctttgggggaaagatttaatttcagtttacattttagatagaaaggaaagtaaaaaagctgtgaaattgagacatgagccacattatgtcggctgtgatttatccctgtatttctggaggacatcgggcagagtagctaacgtaaaatgaggggagtcaggcatcagggtcatggaggcaaagctta

SEQ ID NO: 53675 - DNA, 1203 bp, Bovine  19866881108159
ggaagatttgggagtatggcattgaaacatgtaaaatatcatgtatgaaacaagtcgccagttcaggttcgatgcacgatgctggatgcttggggctggtgcacggggacgacccagagggatggtatggggagggaggagggaggagggttcaggatggggaacacatgtatacctgtggcggattcatttcgatatttggcgaaactaatacaatattgtaaagtttaaaaataaaataaaaaaaaaagaacaacaacaacaaaaaaaattgaaatagcctttttttttttttcagttatcacattggcaatctcatatggtaagagtttatggggaggcaaaagaggagactctgatacatttctggcgggagagtaaattgctaccacatttggggaaactggaaatactgacgaaaattaaaaaacggaagtattgataccctttgcccaagaaatcccacttcagggactcttccctacagaaataaaagcacaagaaaatgatgatattatgcagcagcagcagcaaattgtttactgcagctttgcagaggaagagaatgaaaagtaagctgaaaaaaggcatcaacaatgtaaagactgaatacattatgatacatacattctattgaacattatgcaacttttaaagaaaggagttagggatgtttatttattttcccatgtcccaaatagctttttttgtttgttacaattctctcttgctttctctgcggactgttctcagcctcaaaaggaagacttcactgtagctttgtttacgttttcttccacatcagtagtaagagaactgtccccaggatggaaattcacctgttagattcgtattctgtgtggcatgaaattgctgcctgagacatagttgaggaagcaggaggtgaaatctcagggaaagtgtccagaaaagtgtatcagctctagcacggagaagaatgtaggctgcatataaatttaggctggttgtttcctaatgattttaaggggtgattctttctaatggcaggggcccgggggggagggtcacggctgcctctttacctgacagtggaagatttagctatacaacatagggttgttcttgtgacgtcaaggttaatgtggctgtctgtaccctggggacctgctggctaaggtcatgtctactttctgcaccgttatagtaaattagtcacttttt

SEQ ID NO: 53676 - DNA, 2405 bp, Bovine  19866881165087
tgctgggagggattgggggcaggaggagaaggggacgacagaggatgagatggctggatggcagcaccaactcaatagacgtgagtttgagtgaactccgggagttgttgatggacagggaggtctggtgtgctgcaattcatggggttgcaaagagtcagatgcgactgagcaactgaactgaactgagctgaaatgagttactacagttacagagaggaccacatgggattgtcccttctcttattttctgatcaaccattccctctccattgattgattcccgtcagtgtacgcattttactgtaatatctcccttgaaaaagaatccttgatcttacatccttctccagtataaactttatttcttttctctactattccaatgaaatttttcatcagaatcacgagtgaactccatcttgcctagtctgaaggtctgttctaaaggtcttcgagtgggacacatttcagcagcatttgactcatcctggattcccttgttctgaaacacagctctttcttgtttcttttctttcaccactggccactcttccttcgtcccctttacagacacttcctcactggactgtcccaggggttagtctctggaacttttctgtccttttttctgtgctcccttgatgatttcattcagtttcatgaaagctacagatataaatagatgacaatggctctcaagtcagtacctcctgccctaatgtttcccctggaatcccccagaatctgactcttttttcatatcttcacttggatgaataataggcctcttaatcttaatgcagtcagtcttcattatttgaggatttgtctatttgctgacatttatctgtgaccccccaaatcaatactcatggtgccttctcaatcatttgcacacatgtgcaaagctgcaaaaatttgagttattcaacatgcacattccaactaaggtcaaacatggcaacactttgccttcttatatcaactcccataatgtaaataagcatcctctagtaatctctttaatacaacattaaaataattgtgtactttccttgtgatttcactgtttaaaatgattcctaagcattgtgctaagcactatctagcattcctcagtgcaaaaaggctgtgatgcgccttatggagaaaatgcatgtgttacataagcttcactcaggaatgagttatcatgctgttggcaatgagtttaatgacagtgagtaaacaacaatattaagtaataggtctttaaacagaagcgtacataaaagaaggtcatgtattgatcagctgacaaaaacattgttatcaggggacctctggaagttatccctatatttcccctaggtgcaaaggttcagtattagctaattcagggttcatggtgactttgtagaatataactattgtgaataagcagaattgactgtatatccaaaccttaactgtgaattcctcccaccccattcttaatctcagaaaataactttattgctctattagcttggcccaatctttgttcatcttttcctctcacctcccacctgcaatcaaccagcccttttatagattcctttgaaattgctccactttttacaccttcattctttcaagcctggttcaaatcgtgatcaccatgatgacggtaatgacatcctaattggttaccctgcttttatccatgaccatgcccacccttcacattcaggtaagtgacagtgtgacactcctcccctgggaaccttctccagtgacttatagtattcagagcaaaggccagagtcttaccatggctttcagctacgctgtcctccctgctgatcctctaacacatcatgaactgctcaccccttgacctttcactttcttttcttcaaacattaatcctgcaagggttcatgtgtctctcgcctttgtgtctctcctcaaatgtcagcttatcagagacagccccccttggtagtgctctatgtagaattgcagctcccccaatctctctccctttccctgccctatttttcttttttaaaaacattttctttatttatttatgtctgcgctagggctttattgctgggcacagactttctccagttgtggtggcttctcttgttgaagagcacaggctccagggtgcacagacctcagtagttgtggctcttgggctttagagcacaggcttagtagttatggtacactggcttagttctccctgcgacatgcagaatcttcccagaccagggatggaatctgtgtcccctgcattggcaggcacagtcttaaccattggaccaccagggaaggcccctgctttattttcctttgtatcagttttcattcaatgtattatccatctgtttaatgtttaatgaaatctcaatagattgtaagtgtttgag

SEQ ID NO: 53677 - DNA, 910 bp, Bovine  19866881282880
cccttagattacagtgaaatgtgcacagtggtttcaggtatctgcccttcatctaagtggaacaacacccccaaatgtggggaaattaccccataagcacacttagcctttattggatttttctgatcttgttattcatttcctctggcagccagttcagaacaagcaagggaacactatattccaaactgcatttttaaaatgtgaatattctgcctgttactttatgttttatgcattgtttgcaaataggaaacacgggtcacttcatattttatgaattttctttgaaaaatgatttgaaagaaagttcaatatcaggagcatagaccttggctctgactttgccgaatgtctgatttttcccatgctatctattttcttaaaaaaaggataatttaaagcaataccttgccctttggcctcattactataatctgatgagaaccagccttaaaatgtatatatttaataaatatgtacttacccaataagctgtaaaaagcactgcatgggccttgaagtcaagagtacaacatgtttttcaaaatatatcaaggtcaaatttgcttacctgataacatgtaaaaggaattcttggtataagttatatactgtcatatacttgcagatttaggaccaagttgaccaaaaattctaccagaaatgtcattaaggtaaaagggaatcttttggctatgggatatattttatttccaaatgcagttttcctttttgcctgtgttactgaaatcttagtaaatcttttcaattgtagcttatctcccatgataggttctttctattgctgtacatttcaactcaaagtatgtctttccctctccacatttcttatattgttcctatggttcctgtcacagttatattccccattttctttcccttccag

SEQ ID NO: 53678 - DNA, 1322 bp, Bovine  19866880111805
tcatggcatctggtcccatcacttcacaggaaatagatggggaaacagtggaaacagtgtcacactttatttttttgggctccaaaatcactgcagatggtgactgcagccatgaaattaaaagatgcttaatccttggaaggaaagttatgaccaacctagatagcatattcaaaagtagagacattactttgccaacaaaggtctggctagtcaaggctatggtttttcctgtggtcatgtatggatgtgagagttggactgggaagaaggctgagcgccgaagaattgatgcttttgaactgtggtgttggagaagactcttgagagtctcttggactgcaaggagatccaaccagtctattctgaaggagatcagccctgggatttctttggaaggaatgatgctaaagctgaaactccagtactttggccacctcatgcgaagagttgactcattggaaaagactctgatgctgggaaggattgggagcagaaggagaaggggacgacagaggatgagatggctaaatggcatcactgactcaatggccgtgagtctgagtgaactccgggagttggtgatggacagggaggcctggcatgctgcgattcatggggtcgcaaagagtcagacacgactgagcgactgaactgaactgatgaattataaattcccacatttaactaactgggaaatgttcatttcattttatttctaacggctatattaatcttctacatctcaatgtagcaagacagccaaattaaacatttttaaagccatagtcatatattcaggttttaaaccaaaagtatttccattgtagaaaagcaatagtctaattaattataatcttagggatgacattttccttactgtgtcttaatacctttcttaagcacctgaaagaatattttaaactatctcacctatttctgaatattcattggaaggactgattgctgcatgtgaaactccaatactttggccacctgatgtgaagaactaactcatttgaaaagaccctgatgctgggaaagattgaaggtgggaggagaaagagatgacagaggatggcatcaccgactcaatggacatgaattttagtaagctcagggagttgtgatggacagggagagggaagcctggagtgctacagtccgtagggtcgcaaagagtaggatacgactgagtgactgaactgaactgaacacctgtttctgaggtggaattgaatcaattcaattgggttaggccaaatgtattttagagaacttagtgatgtgtaaatctaataccctccaaaagtaaaatacat

SEQ ID NO: 53679 - DNA, 2408 bp, Bovine  19866880507075
atgaaagacaataaaaagcagtatatccagaacatggttcaagtgaaaaaatttccaaattcaaatgtgtttagaagcagcttcaaacatgttcttttttccttgtatctgtttctttaacccagctttgatgaacacatacatgatttccatttgaaagtttaatacattatggttcacataattgacaatgaaagatagatcaaagaatatatagacctagattattcttttccatgctttggaaagactggacagaggggttaagaacaattatctcttacatttgtgtgatttccagagagtattacttgattatgttcgtaatgttcaagaatcatcccaaaggtcatgaatattagtctcataaacaaaatttacttaattttaaatacaagtaaagattttgtgatttgtgattaagattaaatcacaaaaaaagatgtgtcattaagattttacatcccccccatgtagccatatttaaaagtcaagaaactgaatatattataaaaatattctcctaatatttttgctcattgaattttcgactttataaaatgagaaacatttctttgttatttgtcaagtcatggagtgcttagtcaagaaaataagaaagtttgcagacaccatgatttaaaaattaattgagcaactaaaacatatatattttaaatatataatcttagcatgtaatacaaattattttacttgtataattgtaacatctaaagataagtaggtgtcccaaggctgagtaaatcaatactcaccttgtgttttcactgggtctgatatctggcttggatcactaattccatatgcattggctgccctcacaaggaaaaggtaaattgcattaggtttgagtcctttaatggcaaatgtttctgttttcacattctccgctacagtctgccagctgctaccagatgcatggctatggatagatacataagttagaacatgcatatttaatggtaaatcaaaaaagagaactaggaaacaccatcttcactctacctgaaggcttctataatataagacgtcggagttgcacctgaattcaaatttggttgccatgacaacgttactgtatttcggctgacatctgtaacttcaggttttgagggggcactagggattaaatttgggtcggtgggtcttggaggctgaactggaactccaaattctaacaaagaagaaagaaacgaaagatgcttacgcagagaagcacataaatgtagataaaatatccatcccctacttagacttccaagacatccacttcatctttttaccagtaaggaaacaactacatttcaagcttcacttttaggtaaaatagtatcaaatttaccttggacttcaatgtaagcactccacgttgcttcaccactgggggttgatgcaatgcacgtgtatcgaccagtatcacccagctgagaagacagacggaaaataaatatttggaatactcaagagctcactgggctggaaaaacgattagttttgtatatggcccatgaatatggagagctgccttaaaatgcactaaccagaagcttcctcttaatttaacatgttttcattggaatgtgacttaaaatgctgcatgaagacaaaagacaaattgttattctaattgtatgataaagatatagtatttaagtgcattaacatcatcaatttctgtgtcaggcacagtacacgaggtatataccttaaattcaaagggttaatctttaatactagtttatatttcatatttactaagtcacatggtaaggctaataaagtatatccaatgactcttcttgctgtttcatattttacttgagttacatccacatggataaaggagataaacagatatttaaagaaaatggatagacacaaaatgatttcttcttaaagcattccctctttttcctcattttatttttctaacctgtaacttcaggcagtttagcaagtataaagttaaaccccagctagaatgatgctctctcctccttcagaagtctgactgccagaaaacaaacacaggtcacatgttcaatggtaaaatcctcagtaacataatgaacccatatacctctgcttaaggcaataactctatcatcaaataatattggataatgcaagaatgctgtcattttgttctggcaaatgtaataacaaagttacaatcattgtcacaaaaaagtacaacatattaactttcatggcacatgaaatgaactgctatgctgatccaaaactccaaagaagccgctcacaataggcaataaagcaattgaaatttatgtttattgctgtcaaagctactctttcatatgcctcatgagcttgtctcatcttgacctaaaatgaaaaagaaaaaccgaaacaaacaatatagt

SEQ ID NO: 53680 - DNA, 4229 bp, Bovine  19866880508574
ctccttgacctgcatacaggtttctcaggaggcaggtcaggtggtctggtattcccatctcttccagaattttccacagtttgttgtgatccacagagtcaaaggctttggcatagtcaagagagcagaagtacatgtttttctggaactctcttgctttttctatgacccaacggaatgttgtcaatatggtctctggttactctactttttctaaatccagcttgaactggattctcagttcacatactgttgaagcctagcttagagaatttggagcattattttgctagctagatgagtgcaattgtgaggtagtttgaacattctttggcattgcctttctttggaattggaatgaaagctgaccttttccaatcctgtggccactgctgagttgtccaaatttgctggcatattgagtgcagcactttcacagcatcatgttttaagattagatatagctctactggcattccatcacctccgctagctttgttcatagtgatgcttcctaaggcccatttgacttcacattccaggttgtctggatctaggtgaatgagcacaccatcgtgattatctcggttgtgaagatcttttttgtatagttctgtgtattcttgcctcttcttaatatcctctacttctgttaggtccataccctttttgtcttttattgtgcccttccttgcatgaaatgtacccttaatatttcctttctggatcatggtgataacataatgtgtctccctgcttccacttattctctcccagaatctattctctaaacaacaaagaaaggctttttaaaaatggtgcaatagattctgtctttagacagaataaataaggacactgacaatttttttttaaccatcttaatcatttttaagtgtaatgctcagtactcttaaatgaattcacatggtggtgaaacagatctccaaaatgactttaaattatgaggcatatcttatttctttaatatcgttttacttttatttacaacttttttgcaggttgtactgcctttactttttctgctcttagaataaaacccaaacatatgatcatagcctctaaggtcactattccagtctgttcaggctgctgcaataaaagaccacagcctgggtaacttataaacaacaaaatattatttctcactgttttggagatggaagcctaagattagggtgccaacccggtccagtgaaggtcctcttctgggtcacagacttttctttgtatccttacatggaagaatagacaagggagctctctcttgaggctcttttataagcgtcctgagtcctaatcccagagccctcatgatatgatcacctcacgaaagcctcattttttaataccattgcccttgggggttagttttcaccacgtgaattttgaaggcacacactcaggccttaatagcctggtgttatctggctgaagcctctctattccatttcctctcatcacaactccttactatatgcattcaaaccagtctcctttcagctttataattttgccaagttttccctacctcagagcctttgtaattgctgttccgtctacctaaaatatttttcaacttttcaccacatacttggaactttttcattcttcatgaatcagcttcagtgttaacctcctcagaaaagaatttctttcacaatcttgtctaatttagtatggtctattccccagccaattactttctgatatatcatgtagatcattatatttattataattggtaatcatagtgtctattcaattaatttgggcttcccttgtggcttagctggtaaagaatcctcctacaatgcaggagagttgggttagatccctgggttgggaagatcccctggaggagggattaatttgattatttatttttcttcctctaatcaatgctctccatgaggaaaaaaaatctgtcattcttatgcaccaccaaatctctaattctgtgaatagtgtctgtcatagagtaagagtccttatcccattcttccattaagaaattaagtgaaagagaaaaaatattactctcctcaaattgaattgttcagaaacattatataaggagaacaaaaaatacttatgctaaaatgaacaacttgaattagtataataatttctcagcattttttcttgtgttttccaacagcatgtatttttgttaatagtttcagatgttcattttgtacaaataaggtattaaaacataatggtttaataaaaagaatttcaaaataaaacagaagcatgtctcttatttaaacaagtttataaatatgttcaaattatccacttaaaaatggagataatataggcattgtaacctggggacattatttgaaactcaagagacttagaaaatgaatgctatttctaaaaataaaatacacctttttttcacatattatgtactcacatattgtgtatttcacacattaaaaaggacgatttaatgttgtttgccatctggaaaactaaagcataatagctatatctctctatgtctgcgttcatggtgattctgcccttttcttctaaaggaaatttaggatattaatcagtttatctcttgtctcttgaaagactttccactgaggcatttttaaaatcttggtttccaaggagaaaaaatatgaaaccgcaacttagtgactactaattcatttaatctataaatcagaaggaacagaaaaataatacatatcatttctagagcttacaacttccataaataaaaatttcattttctggtactgacaacctgagtttctactatgctagtgagtcctcatcatgtcacttgctctttatgactaaagtaaatattaaagcccacatacttgatagatctgcagtgatcctctcttccactctgcttctgaaatgaaataagagttcaataaaatgctgcactacaagacttttgttcagatgcatacagtatatctttcgatatgtacagcatattcatttcttccaaatgttttatcgaccttggtgcttgagggtgatgaaaaacaaagagtagaagctgaagtgctgatatatttacagaaggattcagaaagtataaagtttattggttaccattatcaagaatagcgtttaatctgattgaaatttttgttttgtattgtcagcgctagggtagaactgattagggtatgaaaacattcaggtgcttttcgctaagagacataattaaagtccaagagacttaggcttggggatttaattccaagcagtctctttactgaagcttgaacttggatctcatccaggtttttccctgtctcattttaaatcatcatcatatacttcagtagcagccatgcaaatgaacgtattcctcatgttctgggcattcaagaaagtctatgaagttaaaataaaatggcatagaattttctttttcttacatttatttttgctaaaacttcctgtgcgttgcacaagaaaggaaagtgctgaatttatttctaaacaacatgtgttcatattgtgctgctaagtcactttagtcgcatagatggcagcccaccaggctcccccgtccctgggattctccaggcaagaacactggagtgggttgccatttccttctccaatgcatgaaagtgaaaagtgaaagtgaagtcgttcagtcatgtccaaccctcagcgaccccatggactgcagccctccaggctcctccatccatgggattttccaggcaagagtaccggagtgggttgccattgccttctccgtttcgtattgtagtgaatatgtatttgtaatgtagtggaatagaaaacagggactaatttcaagtgaaagaaacttgttatggcaatggtggctgtattgccaggactccttttgttacagaagacaagctcaacaaactcaggcatgaaagagaacttactagtacatttaatttggtaattgagaatgtggctgaccagatgagcttagatccagggacccaaaacagattgtctctctctcccttcatctctttatttagtttctcttggccattggtctctttctttaatactgcagacaagaattcatgatatggtgaggaaactggctacctggagacatccagtcatagtctgcttattcaaggatcaaaaaagaaaagctttgttttcttcaagtcattcattccaaaactctctatcacatacttaagtgccagatt

SEQ ID NO: 53681 - DNA, 1827 bp, Bovine  19866880522134
accattaagatcaatccattactgaattagaaatatgactgaatttagcaacaaatttgtgccaacattacttctagcagcagtaggttttcagcagcagattggcactgtgacagggtccataattttcacagtatgtgtttcataatttgtcatgcacactctgattgcttggcatattggcagggtccacagtgctctctaaatgtcaccaaacgcatttgaggatttgtcatgcacggtctgagtaagtgacacaacacagcagagtggccaggttcagagctgatttttgcactccctgtaagtgttcttgagctcagccaccagtgacgagggcctgatgggaactgcagagcccttctcttggagctgctgatttttaattttgcgtcaagtgatcatatggatgcttccaggagaaaatactactacactgcaggtgtgatttgcacagcctagaatttctgcctgataatattcttttcaaatcatttcttgtagtgtacttaacatttttttcatacaagcacaaagagcatatcacaaattcggagtaggaaaaggagagtaatacatatgaatagagagtggagaaagctatattcaagaaattatccagttaagagatcaaaaaatgagacgtctgctgtttataacagaaaggtagaatcgtgtcaggatcagagaatactgggctaggtgttaatctggtttctgtaggaataacttgtgagtttaggcaaaccatccatcctatttttggcttataaatgagggggttggatgagagcatctctaagggtgctttcatgtctaaacattccattgttctaagagaggaacatgagtttgttaatgtctttcagtcatctttcccctttgcctgcaatgactgcataatgctcttgcagggtttagtaaaagcttcaagagctacctctgctggaagctgttagttgtctaggattctggctattatcttatcacttttagtcactgtcttttaggaggatgaaggaaattagtcttttttatacatttgggtccccctggatgcacctgttactatgaaatctgtttgatgataaataactcacatatgctcaagagtgttgtcttgacatgtgcagtgagagactttcagagacatatgttgtaaaaagcaatagctgcgactttgtattggctcacagatagtgaaagtagaggagtgagtggaggctgacaaagactgtgcaggcagggagagaagctaaggaaattttgaaaagttcaaacctgcacactgcacttaaaaaaaaaataacagacataagaagcccacattaatcacaaatatgtatctattggcctaaactgccatatataaatccatgttaggcacagaatttttactttaaagaaatccagaagactagaatcacttcagattaataacttttcaaaaaaattattttctcttccaaaaagtctgccatgattttgcctttattgaaaatgtttaattttctgtgctaacttgatggagacaagaagaaacattaccattcttcctttatttctatgaaaaagtattttttaaatgaatctttatttatgggaaattttccaccattcactcacactgccaacccctgggtaaaaatcgggtgactactgaacccttatactcaactctcaccacagtacccatgaacaagtgaagattcaattggtcttaggtttcttgctccaacacctgatgaaaattaggcatcttacttttcaaactctaaatattattgagagattgattcatataactgcttctgtaccttttattaa

SEQ ID NO: 53682 - DNA, 1493 bp, Bovine  19866880573988
gacagtgaaatttgcctcaatgttaactcccattcctggtcttttttaggtgcctgaagttagaataagcatatcttgctcacacaaaagtctcttaaaatattaaggaaaaaaaaaatcagacctagtctaactttattgttttgggggataaatttttgtgccaagttctggattttttttttccagtgatatgaattttagctttcaatgcagcctcccaaaccatcctcatcttcttcttaaatatcttaaaattctacctgaaaatgtagtgctcaaaaaagaacacattactctaattcatgatctgaccagttcagattttgctctgcatataattctgctaagactacatttgtttttctgacaactactcactcaggtggctctgggaggtgttctaattgacttcaaacactgaagtcagctcccccaccgatcctgcccccaacacacccaatgcacacactccttttaagcccagtatcctcagcctatccttctacagctaaattttaaaacctaagttcaaaacctaagttcaacctaccagtcttttaaatttgctccattaattttaatcttgttagtgctggcccatcattccagtctgtcgagttacttaattctggttctctcactcggcatgtgagctgtgtttctcaaattttatgaacttcccttatttttagtccagtgaaagaaacacaaatccaatgacaaatgacaaagtcttatggtataacacagaaaagaagtctgagtcctgcatattcataaaattggctaatttaatccttgtccaatcctgtggagtagggatttttagccccattatatagttaagggaatcaatgctcaggactcaatagcttgctaatagattgaggagctgagataacaaattttttgatttcaaaacggtatgcctgttttactgtttctagttttccagctgacatgggtttatttcatttaggttattctgcttgctatcatgtataaaggttaagtagattaaaatttttaaaaacaagttaacggataaagcattaactactcctcatttacagttgaggatgtattttacaaaatcattcatatgtgtatatgacagatcacagttaatcagaaactttcactaagttctactgggtagagaccactggactggggaccaaagtttcagttcactttacagctgtcctactttctgcattctttacaaatgcgtatataacactgaaaacctcaaactgccttaaggcaggctccgagactactaaagctactggtgaagtgactcataatagcaaatatatgcatttgggtgtgttgatttcacacagcaaaaaacagacgtgggcatgttccacagctccgtttgctttctctgggaattctgaaacaaaaggtcctcctcacaaggttgtttatacactctctagagaagacgaaatgcccaacaggcagctagactctctctcaaa

SEQ ID NO: 53683 - DNA, 1604 bp, Bovine  19866880582404
gttttagtaccaaataataaagtgaaagccctggtataaaagagttttggcaaaattaataactcctggatctggggctaccaccatatggatatggcccattgtgaataataggaaagaaaacaacaaaaaagagagaaggatgaagtctttccaggacttcccttgcctgatgcatgcgtgaggctctgctttttagcttctgtcaatagcagacgtcttagaaaggaagccaagatatgccctctgacgaagtgttcctttcctctgatgaaaaaagaagtcgacaaggcaactaccagctaggttctcccagacttcaagaagtctgtctgaactgtcagctagcagctctactttcatataaatgaggattccccaaaattgaagaaagctgaagcgaagttttaaaaataaaagcacaagtcttatagctaggaaatagcaatgaaaattagtgacacggttgtgtttagcaatcggaacattaattttcctaaatatgagaggtcttctgttttgccaaatagagtgtccaggagcctgattggtgccaaatgaaaaaatggcagcactccctccatctatgtctctgattataaaacagcaggagagatcattagagtagcatacacgttctgctttggggcatatgtcaggttcaatactgagagcagatttaagctttgccaaggatgccaagtacttcttcctgtgacttctccaacagtgaggtgctgagcttgtgctgctggcagttttgcagaaaactgtggtggtgagtgacacagatggtgtggagagtctgacattgcatatcatttaccaatcagaaaatgactcagttcttttatgcatgcaattacaaaggaccacctgtaccagtgtgtgtcgcctgcaacagtaggaaaagggcacgggcccatttgaaagataaactctttcactctttgttatatatttctgtggtttcagcactgcctttatttgtgttcagtctgtgagaattcaataacatttctcattacgattctgcctattagtgtatcggtgtgaagctatacttcttaaatctcatcttatcgatatatctcctgaaacagcaaaatgctatattgtaaagtgatttccttgtctaacctctaaagcctggtatcctaagcaatgtcaagcgcactttttagatattttttgggtgtacttcagatacttgggaaataccttgattatataaaaacctaatgatgagattaaatgatatcctcttgacattaaaagtcaggaaagtagcatttcttcaccacctgtggtagatactttatagatattaacttatataatcatctcaataactccctgaggtagacagtggtattcctctgtaccgatcaagaatttgagacagaaaatttaaataaatttccagattcacagagctaatcaatggtagagaaagattacaacacattgtgtgattctaaattctgctctattttcacaatggtaaataacttgcattctcccaaaagggtggtcttattctgtcttcattagactgctagattgattttttcccctaaaatgaaaatatatatttattatat

SEQ ID NO: 53684 - DNA, 1837 bp, Bovine  19866880586307
attggggtattattttttgtgttttcctttttccttcttactggtacaactcccaacttaaaagtcaaatttataaagacaattaatgtatgcattgtttaacataagcatgttaagtgttaatttatttttagttgttttgggcttcataagaaattctttttgttttctgattcttcatttccatgagataagtaagtcttcgggggaaaagaaaagaattccagtataaataatttatctttcatttttgtttgatgcacattttgcttaaaagtggagtaattcatatagttagaaaggcatcttggtacgatacattaaaagaaaaatcatttacatatttttatgaagtatatagaatgataactttgaaattttccctaaagaaaactgaacataaagctaatgaaagaaatattcttgagtgaagatgctcttattagtagaataaaaagtaaaataaaaaatctatgccaatacaactaaagttctgtatgtgtgtgtgtatatacatatatataaatatctttttaacatagcattcacataaaaagcagctggatgattgttactaaaattgatggcttatttggtatggctgcctcaatatatcaattatgtgttataacaggaacttgcattaagagtctctagttgacttcataaggtgttttttttttttttcttaaacataataaagtagtataatacatcatttaaaagataccagcaaactaaagtttgaaatgtacacttattttcaatttttctctaattttatgtttatggttcaaaatatgtattaactatttcaaagtaatctacttttacaatgcctattatagcttgatgacaaatatacagaaccaaaattttaaaaataataatttcagtagcccaaagacattctaacagataataataagagagcaataaatgctaaagaccccaagtaagggcaaatgaaattgatgtttaacatgaggacaatttggcagccaagggggaaaagtatgccttcttaatagataaccaagactgactgtgaaatgccaaaaatgattgagtaccaggagaaatcatcagtcatctttcagagtcaccaggaaaaaaaaaaaaaaacttcaagatgtccaacagggcacttaaaggaaattaaaaccctagtacacatgaagtctgctaggcggctgatcgtgcaaaacatgccatggtgttaagataccagggacagagaaaaaagagttttaactatgggcccagattcaatttgatatggaatttactatcagcttactatctgagatttaccattttcattttgtcttgaaataggagtatatgtttaaaccaagaatcgataaattttttctgtaaaggatcatacagtaaacacttcaggatttgcaggatatatttattgttgtttttcagtcactcagttgtgtccaactcttcatgaccccatggactgcagcataccagacttccctgtccttcaccatctcctggagcttgctcaaactcatgtccactcagtcagtgataccatccaatcatcttgtcctctgtcatccccttctcctcctgccttcaatctttcccagcatcagggtcttttttaataagtcagctcttcacaacagatggccaaagtattggagtttatgaatcagtcctttcaatgaatattcaggactgatttcctataggattgactggtttgatatccttgctgtccaagggactctcaagagtcttctccaacaccacagttcaaaagtatcactctctggcactctgctttctttatggtccaagtctcacatccaca

SEQ ID NO: 53685 - DNA, 1302 bp, Bovine  19866880756388
aaattttggaaaataaaaacctaccagaccattgccccagaaatatgagtaccagtaagacggacataaacgtgaaaaataaacctttctttccacacaccacaaagatgtatgccaagttgtgactattaattaatgtgaatcattttttattgtgatttgagaaaatacttctccattatatttccatcagacatgtatacatagtgaaaatatattttaatgcccctgaaagcattctcagcttaataagtcatgggtataaagtttagccatgacaaaaaaaaagatttgcacatagttgtcaaggggttaaggatattagcttttctgtaaatacagacacattttctaagaacaagtatgtttctaaaagctgccaaattctgctacttagaagaactccaaactgggagtctgttaaggagagataactgcatccagtgattataataactggattaaaaccgagaaggcaggaccacaggtacctttttactaaaggtgatgcgaaagaagaggaccctctttgaaagaaacagaatagaacagaatattaggacttggacttagggaaaatgaaaagttttatctttcaaatgtgctgtatattttggttacctttaagaatgttgattctatggatagagaattgctcgggagagaaaattttgttggaaatccagaaagcttaagttaaggggaaaaaaatgcactgccaagtctaaaatcatcaattgatcattagcatgttaaatcatgctgaggctagaaacagtgtgcctatctaatgaaacacatgcaaacaaggctcggatgcactgtggaatcatggataaacaactgcactgaagggatgacaagcaacaccaaccatttctacttcaagtgcatgcctgctaggagtaaatgaagtactgtttccattgtaagtcctttccccccagcttactgcagaaaatgaaataaaaacagcaacacaatagtacaacacatgccgaactaacgaaggaaaggaggagggtaagcgcaaatatatacctgttggtgtgaaggtaaaagacgggactgaaaaatcaaaacaaaatataaaccagttattaagctgaagagagaaagggaacacatcacattagtataaatcaagcagacagctgaacataaaacaaatgtaaataaccaagccagtcgttctgacactctgatatgtggataaaaccaaatctaagggtctctgcaggtaccatttcgaagtgtctgacattctaggacaggaggggcgtggggagtgtgctgggttag

SEQ ID NO: 53686 - DNA, 1034 bp, Bovine  19866880760269
tatggatgtgagagttggactgtgaagaaggctgagcgctgaagaattgatgcttttgaacttggtgttggagaagactcttgagagtcccttggactgcaaggatgtccaaccagtccattctaaaggagatcagccctgggatttctttggaaggaatgatgctaaagctgaaactccagtactttggccaccacatgcgacgagttgactcattggaaaagactctgatgctgggaggcattgggggcaggaggagaaggggatgacagaggatgagatggctggatggcatcaccgactcgatggacatgagtctgagtgaactcctggagtttgtgatggacagggaggcctggcgtgctgcgattcatggggtcgcaaagagtcggacagggctgagagactgaactgaattgaactgaactgaaaactatagcctgggatatacctgagtttttgctaaaataccaaaaaagaaaaaaatatatatagttgaacatcaaaaaattactgctaaccacagcaaaggaagtgaagtgaagttgctcagtcgtgtccgactctttgcgacctcatggactatagcccaccaggctcctgtgtcagtccatgggattttccaggcaagagtactggagtgggttgccatttccttctccagggggatcttcccgacccagggattgaacccaggtctcccgcattgtaggcagacgctttttaccgtctgggccaccaaggaagtcaatgcacatctaatacacaaataatgaaaatctagagcaatgatcaaataaatagccattgggattacctttataattatattgcgtctaaactgatttgtgtgctggaactgagaaagctttctgttaaaatgctttcaaaagagtgcttgagcttcacaggtagttctaagattttagctttagttttctagtttcagcatccaaacatgaggagtgtatgtgtaaatatttaaatagaattacaagtttctggaaagtctcaagatgtttcttgggatgata

SEQ ID NO: 53687 - DNA, 2187 bp, Bovine  19866880800961
gctgcagtcccatctgcagtgattttggagcccaaaaaaataaagtgtgacactgtttccactgtttccccatctatttcctgtgaagtgatgggaccagatgccatgatcttcattttctgaatgttgagctttaagccaactttttcactctccactttcactttcatcaagaggcttttctcagcccagggatcgaacccaggtctcccgcattacaggcagacgctttaacctctgagccaccagggaagctcttttataattcataagttgatataatttcttagacatattgtctttgtaactatggatacatcatttcttggtaggatttttacttagagcttacagttttgtagtcagagaaggcaatggcaacccacctccagtactcttgcctggaaaatcccatgggcggaggagcctggtaggctgcagtccatggggtcactaagagtcggacatgactgaatgagttcactttcacttttcactttcatgccttggagaaggaaatggcaacccactccagtgttcttgcctggagaatcccagggatgggggagcctgatgggctgccgtctatggggtcgcacagagtcggacacgactgaagtgacttagcagcagcagcagcagtgcaatcttaagtgttccctatagaaaatttagcagataatatcgtaatgtgaagaatataggccactgtgtcgtagcagtttcttagatttttttcatttgaaggcattaataatgttgcttataaacccatggcactgaatcactgtcttttaaaaatgtcatgttcaggtgtattgactaccaagttgtaaatctcatctctaagtgtttttcttttcttcactacccatcttgttacattttgggcgaggggttctattttttcctattgatggccatttatttcatctagaaaagccaaataaagcaacatttggaaaatattattaaatacataatttgtgatgacatttctcagaggaaaaaaaaattcagtttcttgatatgtgggacttaaggggatgattccagtggaggcttctgttctatgagtaatgaaaatgcttgatgacaaaaacatctgttctataaatacagaataggcattgattcttcttttggatttactctgttacaatagtctgtctgaatgtgataaatcccactagtaaaacaagttgaatgtattgtttttaaagctttactggggacagaagctttattctagacttaagtgtcatggcattatatataaaaatatttatattttaggaaaaactacttctttccataattaatatgggagagagaaaacttactttgtactaacagatcattataaagtgctataatgttctggaagtataattctttaaaatattctcagggcagatttttaaaaattaagtccaacattgacttgaaagaattcagctatttcagttgaccaccaggccagttccttagctcagctccatgtgacagttcagacataattaattattcaaggccagataaggaagaatgcgaatgcatttagtatattttaccttttaacatttgatttgtgtttcttaaagaaattagcttgtctccatgttaataattgcttgtttcatcattaagtagtgtaagcaccttagtatgtctgtggacatactggagatgtatttcaaataaccaaatagaaaaactcactttgtgtcctttggtaccttcatttgcctcttctaccaatttcatcttctacttcctctggcccccctccatcaagtttttccttcctctgccttttcaaactctcatttcctattaaattccgtctgtaaacacacccaagccttccccatccaaaatcactaactcaacagcaatctggtctctctctccttccccactctgctctctctctcctcttttattaggaattttttaaaagcttggtgtaccctcattaagtctagttatttaccttccatttagtgaaaactgctataatctggtttcaatcatcatcactccattgtaattcttgttaattggctcatgaatgtccttctatttgtaataaggaagcagtcgtgttttggtcatcttcctggacctctctactctatttttgcactttcataacatatttccttcgattcggaaatgcatcct

SEQ ID NO: 53688 - DNA, 1198 bp, Bovine  19866880844102
agaaagctgatgtctatggcctgaatatatacatgcagagaggtggtagtaccatcaggcattccagatttatccatgagagaatgttcttatgccaaaggctgtttcatgaatgtctgggctatgatttagagaggattccctggttgcaaaaatatgccctggtttaattcctgaatcaagtggatttattcctatgaagacctcccttgctgtggtctttcagcgtctggctttgtttcacaggtatgaaaacaggaaaccatcagcaatacccagaaaagaaaagattagtgctgactgtcagacttgtacagcgttttactaaagatggttagcagttttgtttctctttcttctttcttttatcacattttgtcatacactaaattcagtaattttatcatcagatggtatgttcctcagattcaggaataatgttttgtttttatctttcccattatctaactatacaaagcagggcactcaataagttaactgaatttgaattacaaaatggttttggtcgaaaaaaaatttttttcttacctcctaagctagaagttgctgtttttgaaaagaaagaattatcttagaaaattctgatgtttggctcgtgtaacttatagcttctttcagcccctttcaggcgactgtcagatcaatttgtgatttctctgtgaatgtattaaatgtcactgaataataattaccaaaaaatcataaatgtaggattgaggttcattttaattagaggggaaaaagaaatctccgtgttaacaagctacctagattctcctattatttcaacatatttccccgtgagtggagactgaactacgttgaatttatcacaagagcaaacaaacagatataacctacagcttatgagccattgctgtgttcagcaggtttccaaatgaacactttttctttgatagtatctgttaactagctatatttcttaatcttcataaatgccatcacttaattacttgaactccttttaatgatttgctaaatcagcaagtctgtctttcctggttcaagtgctccctctggtgttcatttcccaagatgcaccagctccagttgtgtgttaacaggcttggttctaaagcagagcagcatgggagtagttcttggagtaattctaaaagatttaaacacatttcacctttaagttaaaccttttaag

SEQ ID NO: 53689 - DNA, 919 bp, Bovine  19866880887095
ttttggcaccctatatacaggataagaaatcaagtttattcaaaatgattgcttaattatgcacacttgaaacatgtggggcttaattaatggtggttgatagtaaatcatccaggtaaaatatattaacttccgaatacatgctaatcctatgcataggtgtattattagtcaaagtaatttattatttttcttgatttatttttccgcaaagtatttgagcattcaaaatggtaaaatattttacttacaaaaaagacattaaaaaaagacagattgaaggaagagttaaaactctccaaaatatttctcattcccacagagaggctgaagtcggagcaaagggattactgggttaggcaaagcaattaaaaaatctgacttaaaaagcaatgttgtatgaccttgagcaatgtcccaagttgttttgaaaaaacaaaagtatgtgttcttagaaagttcagttggttttcagtcagattaatttggggaatgttaatatgggattcatagcctgtatatatctacataaacctatatctatctatttatctctgtatgtatccacacacacacacacttgctgttgtttcagaaattaacatttataatttcttatttttaaaaatggcctttgggacttccctggtagtccagtgattaagactcctagtatccactgcaggggccatgggttttatccctgattggggaagttccacatgccacataacatggccaaaaaaaggcctttggactctaagcaatactttgagatttatatattaattaaagataatggatttccctggtggctcagtggtaaggaatcccccttcaatgcaggagatgtgggctcaagtcccaggtcaggaagatcccctggagcagggaatggcagcccactccagtattcttg

SEQ ID NO: 53690 - DNA, 1697 bp, Bovine  19866881170030
ttttcttattgcacttggaaatgcctatttgagaaaatatatatttatgttgttaattaagtaatatgaaaaagatgttttgtaccaggactgcaatcagccccattcaagactttaaagttcagagcctgaatggagttgattgcaggcaagactcaacattcatcagacagtcaaatcattccattttccttagatattttcttgtttagctgaaccataagtgacatcttcagggaagatatttcaaatgattttttttttaccttttagttatgcctggttgaagcattgttgtaggccagaaaatgagtctctacaaccttgaaaaagtaaatgaccttattgtaagctttgaccttgctcgtagcatcttttctgttgctttgttagctctgagtgtggtgtattgtttcagttgagcaaggtctttgaagctccactttttgccacccctccctccctaatgatttcaagctgttcaaagaaatgctttgaaacacaggcaggagccaaatgttttatagtaaggctgatttaaaacaagcttcaaataatgcttgcttttagggaactaggggggatgtgaataaatggacagtgcatgttccttcaaaatgttaggtttgcttgatcactcagagataggtttgtctttcattacatgcagtatgcaaaaaaaacacagacttctggaatttataaccaagtaataatgttatacttgcttttctagactttgaaagcagtgcacatgagatttttataatatgcaaacaatttcagggtaactgtgatgccagcaaaagaatgaaaccctttatttgtattgatttttctatttaaggaagcctagaaggcaatatatttggttctttaaaaaatgcaacaaaatcagaattgaatttgtgtagacacttcttaccaaattagagcaacaggaaaatcactgacatattacttttatttagtacatactaaataacaactatgtctaacagatgccttcaaaacagatataccaaggcctagtttgtttatttttgcttgatgtttagttgccaagtcgtgtccgactcttgcgaccccacagactgcagcccaccaggctcccctgttcacctgcatctcctgcattggcaggattctccaccattaatcctccagggagtccctctgtttattagaacctgtcaattaggttgataaatagcagaaacttgctcttcaactgttctataatctagaaattatttcttatacatctatgtgtagcaatatataatattataccctacacatagtgggtgcttaaaaatgatttcctgaatgaataatattagcaaaatcaagaacaggctttttttaggccataagaaaacagaaggctctcacaccagagaagtataaaagtgaaagcaggaaaagaaaataaacctttttaaaagaactagtgttcagcatcaatctctagatgacatgcctagggttggtaagaattactttccattatgatcatgcaaattcagtgtaggaaagggcagggtagaattatagtgcctaattcaccatgatgaggaaacaattccatgagagagagaaataaatagtggaaggaaggcatgagaaggaaggagaaggcatgaaataatggagataacagacatcccacaatggtagcaaagagggggtatatt

SEQ ID NO: 53691 - DNA, 1403 bp, Bovine  19866881239333
tcattagtgaagttcggagaaaaattcagttatacataaaagatgatttaacacctcccattccccatgctaagaggtacaattgttagaatgcaatatgtcatcagttctttttccagtccttctctgcttcctgtgtgtctttgtaggcttctttgatttcccttgttggtgtgatattttggtaaaaagcagctgactcacatcccatccagatccccagggtcctccagatccttcataaatttggcattcagccctctccttgccaattgcttcctttccccccaattcccacatgtctccctcctaagccatctgctcctcctcccttccttcgatcagtgctttcctctggtcttccaacttctttcattgttcagtgtctgttgcttccttttcccctttgttccccgacaggaaatcaacatgctttatgcagttgatgtcatagagccccttttccctgagaagttaaaatttgtgttcctgcaagtaaataggtcattctgttgtgtgaaggtcaaaggaaactggcgtattgaaccagaattttttttcctgtcttacatagttatgcacattatatatttcatctttttttaagaataaatttttattcatgatttaaatatgttaatcagtatgaatctattatatgaatcatgggaccaaagaaatgagttaaaaagtaaacttatgtcctatcctacttaattttcaaatttaatcactgaaatccagtgtattagtaaaagtcaatatagttttatataagacatgtaataaattcaggttttaaaacttatatgcatgactttatagacatttgatctctgtaaatttcattgtttccatctgtgacatgaattgtctaataatacctgtattagtttacagtgtccttgtgggaaatcagtgaaaaaatacatatgttattttaaatggtgacacagtctttatggattagtaatcagtattctggttttcattattgttggtatatctgcctgacctctggatatattcagcaatcaaaaactgggtggaaaaaaccaggaactttatgccatagcaatttcaacttttccgaataaacaagaagaccttgtatatatgtatatatgaaacagatttggcatttgtctcatctaattttctgtttatattgatttacaactgtgagaaaacaaatttctacagaatcagcatgagtacttagtacaggtgaatattatgagtaagtaatttttcaggctaatactggtattaagaaactaatttgaatctttgttcatccttattgtgaaatgcaataaccaatgggggactccacaagagaattaagccctaatgccctcaagcatccactcagtgtaataaatagacttttctcttgtgca

SEQ ID NO: 53692 - DNA, 747 bp, Bovine  19866881532785
ccctatttttaagggtttcattcattttttttttttctttcccctgtcaacagcttactcctatttgctgtgaggcttcatttcactgacaaagtagtctttttaaatagaaagacaaattcccaggactgcatattatcttcctctgcttttcccaagacactcacttctaattaaaatgtccatatttaattaaaatgcatattatcatgcagcttttgcaatcattttgttgttgaaatagaagaataaaagcataacatatgtagtaaaagtgcgacacatgtcttctgaatgatttctaattctcagtgtgctacagaaaatatgcagtggcctcttccaaacgtggagaagtctgagaaaatacaaaaatgcagaatatgttcagaggtagccgtttgtttaagtgtcaagcaggatatttctcatgcaacttcggttctaaagggaaaaggcctaagtattcattatagctatgtatttggaattgtgcacatgctattaagactagatataatcaagttgattgaaaagtgtccttgatagactctgctcctgtctttacaaattccttattcataaaacaaaactaataaggtcactttttgatagctttgggtatgaggattaaataagtggatacctggcatggttccttatatagtaagtgtccaataaatgtcactcattgctaacattattattatactgctaacattatcattattatttatgtgagagctt

SEQ ID NO: 53693 - DNA, 840 bp, Bovine  19866881697492
atttttaaggaaaagtttagaaataatggaacagtctttaaaaagtggattatgctgtataaactgtaaatgtttctgatttgaaacattcacttcaatttgaactgaaacaagaaatgagaataattaagcatttcagacaactgataagaaatgaatttgaaaagtgtaaacagtaggtagaaaagacttagattcagtgcacattttttccaagcataaagcacagcccaaaacaaacttttttttttttaagccagtgactccatcagcacacctaatgttttcagctgccactgctctcagtgtaactgacacaattttctgacactctatttactgctggatgaagtggccatttaaggctgtataaatcaaacagtttggacaaagctggcagtatttataatgtcaggatgagcagatgtttccaatttgccctcatttccatatatattctgtttgaacatgcccttgcctatgtaaatgaaagaggcatttgactccaccagtactttaaattcatttccattcaagtaattggactgaagattttaaatggttatactttccatagtagcctttcaggagcttttcagttaaagtaattttaggacctgcctacatcaggaggttcttgtgtgtaagattaatgtccatacacctttaagcagctctaaatgaggagaaatgtttgttcgttcaaatgtcgagtgtatgttgaatgtaaaggctcaagaagtctttttaacattgaagtccatcttagaagatcaagtaattaaaaaaaaaatgtctttacaaaactacccagattctactctataaatatgcagttaa

SEQ ID NO: 53694 - DNA, 794 bp, Bovine  19866881768864
cagacttaacaggtgttccaatttattataatagctgttaacacacacctgcattttacacagactgaagattttggctagtcttcaaaagtcttcttacagagaacactgtcatgatttaccaattccagatttatttggcattgattacattgcaagagtgtagaagacataccaaagctagaaagaggaataccaactttttggaggtctgggaaaaaaaaagatccttgcaaagaatatcataaactgattatgaaagacagtggttttgttcagtaaaacaccctttctttctcttctcataatcctttgaaagtcaattaaaattggaaaatgacttctgatgagcattgactggaaagggatgataaaatggataaaataaaaaattagttcagctgctcttgtgggtaataatgaagatctgaaaagggagcaaggtaaggaagctttaaaaagaaatatgttcaattttaagctgttttaagttgtttgaatgttctaccaccttcagcttttcagtacaatctgtttcaaacccaaacacatttttgtttgtacattaatttgtgtgtgtctgtaaatcacaaaaatgaacactgagttttttgagttagacattacagtaggctcaggagatgacccatataccaaaccaattaagtctaaatgcggaaaaggaatatgcaagaaaaaatataatttcctctcacagtatctccatcctttaagatatcttgggagatatccagagactttcacgaacttagacggagttcaaagaaactgta

SEQ ID NO: 53695 - DNA, 1814 bp, Bovine  19866880552867
tggacctcacatcttgagaaagagagagaggttgggggaagagagagagaaaagcttttccaagaagaaactatttctgtggcctccgaggccgttccaaggctggaggcacatcttgtgctccagcggcccatccattgatccccactgtgcccttggcagccaggatgcatgaggaatacgggcccagagggaatgtctggccaagggcagctcttgtccagtgagaagctgttcagagaacgcaaagcctctggatgtaaaggctaaggccagagcttcccacacatctttggtggtgtgcctgcaggacagagttcctcttccacagcccggtagctttgggccctgaaggaagtggatggtggcccccagaccctcgtcctgagagggttagagagagaaagaaaatggatgcgagcccctccgctggcccctgatcttcctgagatctgggtgtgaacggggagggctttgggcaacgggaggcgtaccctctggaggttaaacaacccacatgtgcataagaaaggtccagacatagaaatctggcaccaaagcagagggtgagttttctgagcttcctgtgggcccgtgaccccttaagatgttagaacagccttcctcacaggggacccacaagccagtcaggcctgcagaagacaatttgcctgaatattgtcttaattatacccaggaaggtgcagggccagtggcagtctagatggagagaggtaaactagtcctgcttcagctgtagcggacccttgggaagtctggctgagagggcaggaacccatgcagccacatggggctgcagagaacaagacggctctcctccgctgccttgttgcgggctcatccaccccaggaagtgcaggctgcaactacaggtaaaacagtgcccaggaagccttgtgctggtgttcataatgccaactccggaggcaagtccatccacgtccacgcaccctcctaagtctgagacctgctggcacataaaacagtgctttacggtgtatcaggacacccgtgaagacttcttttatcccaattagcagagtttatcctgaaatatttatgaatttggcagactcagggataaaattctgctattaattataatgatcgtctcagagaaagtaaatcattggataccaatgtttaattattattgtcaaaggtgtggctgtttaaccatagccgttctctcatatacagttgagtgattatgtgtacttgaagtctggaatttttaattctacaagacaactatagagcagcctgaatgcctgacttgtcagaacctttggaataacaagggcttatgagcaagactagctttgaatcactccacgtgttatttctgcactccccttggcggatctctgaattcagccagagctcccaagcctgccagcagcactcttgaggggcagccaagccccagggtgaccctgcctgactttgcataccccacttcaagtcagtgtttttgttttttttttttccttcatctgtttccactgtcacctacctcctcccttcatcttgcctaggactctgtctaaagtcttttcttcccctggtggaacaatggctcactgtccagtgtccaggcccccttcctgctccttagcttgtgtctccaggaccactcacccgggcacctgcccacccctgggcacacctgctcaacctgagcatggctctccaccctcacctgacccaacagctctcccatctgagcccccacctcttccagaggggaggaggaggtggctcagggtttgggggatccccctgtgctctgt

SEQ ID NO: 53696 - DNA, 1191 bp, Bovine  19866881344393
ttgtttcaggtgggcccatgcattcctgtggcgttcccatgtgtgcaaacaggagatactaggaggcaaggtgggctccagatgtaaattaccaaagagggattctgtggtcttaattagtgggcctcactgcagggaaacgggacttatctgcttttctcagccctgcaggctttattggttatgaaaagacatttggcacataattaactttctcttattggaaaaatagagcgtggggacaaagctctttcacgcacctgagagtcagtgtaatagaggtgctggcggttgcaggatggggttaatctatttgggcaggtgtgactgcaaacaaatggttttcggaggggaaaatggtccctgcacgctgcggagtgatttgaaagtaaaacaaataactcaaacaaccccagtgacccccaaagctggcagagcactgagtaccattctgggaagatgccaacaaatgaagtcagcagctactgggatgcatatgggttttcctccaggctgactgtttttggaagctggtgaaaatagactaaagttacagattatccactagtcaggccgttagtcagcgtgcacatgtgacacaccagccagtggtccttactgcactgggtaccatgggagatacacgcaggggctcccagggcttgaatctgatggcaggaaagtcaggtgcaaccatctgaggtccctgagaaactgctactgaggaatgatgtggtctaggctccaagcgctgcaggagggccagggtctgggaggaagtcatagaaaaggaaaaagctgtggtgggagctcaagaatagtgtcaaatagcacattcagctgccccttgcatccgataacttgagaaataaaacctgacatcacggacaggctgccttccactccgcactcaggataaacctcctctgagagcggggtgatgttcagagtaagacagaggggctggaccaggctggaggggtccttcctctggcctggcacttcctcgggcaggctgctcatctgcattgtgtcctggcttcctcaactgtatctggagagtattagtatctgccacacagggttgtcaccaggttaagtgagaaaatccatatgaaattcttcaagcaggtccagatggagatatcacagagacagaagggttcttgaggaacctaacacagcagcaag

SEQ ID NO: 53697 - DNA, 9549 bp, Bovine  19866880067095
ctcaacattcagaaaacaaagatcatggcatctggtcccatcacttcatgggaaatagacggggaaacagcggaaacagtgtcagacataatttttctgggctccaaaatcacggcagatggtgactgcagccatgaaattaaaagacgcttactccttggaaggaaagttatgaccaacctagatagcatattcaaaagcagagacattactttgccaacaaaggtccgtctggtcaaggctatggtttttcctgtggtcatgtatggatgtgagagttggactgtgaagaaggctgagtgacgaagaattgatgcttttcaaccgtggtgttggagaagacgcttgagagtcccttggactgcaaggagatccaaccagtccattctgaagatcagccctgggatttctttggaaggaatgatgctaaagctgaaactccagtactttggccacctcatgcgaacagttgactcattggaaaagactctgatgctgggagggattgagggcaagaggagaaggggacgacagaggatgagatggctggatggcatcactgactcgatggacgtgagtctgagtgtactcagggagttggtgatggacagggaggcctggcacgctgcgattcatggggtcgcaaagagtcggacacgactgagcgactgatctgatctgatctgatctgaagtgaggtcaagagtctcccaatgtaacatgtgaaatgcgcaggatattgttcaattcaagattactcagcatatgaagatccaggaagtcctccatccactaagaaaagaccagcaacagacagcgacctcaagatgacaggggttatgacctgcagtgtgtggcccccaaattcaggcactgaagccccaaccaccagtacctctggtgtgactacatttggagacagagtccttaaaaggagattaagtcaagataagccattggggttggctctaattcaatctactcagtgtccttataagaagaaaaaaatcacacacacagagacaccagggctgcccacgtaccatgtgaaagcccacatgagacacagcaggaaagcagctgtctgtaaggcagggagacaccaaacctgctggtagtgccttaaccttggacgcccagcaccagaacttcgagaaaactaatttctgttgtttaaagcacccagtctacggcgctctgtcagggcaaactgagcaaagtaacacactgatctcatcattttctgcaaaaactttttaaaatgccacagcaagcagtagggaatattctcacaatgactggaaatacaggaaatctcagcagagaaataaagactggaatggaaattttagaaaggtaaggtgtaacaaccatatctacatatgtgtacatatagacatatacacactagatggacactgagatgacagagaaaacagtgaacctgaaaatagatcaagagaactcatccactctaaacaacaaagagaaaggagactgaataaaaattaaccaagtcacagggacctgtgaggcaaaaataaaaggcaaaaatcctaaaattaaggtcccttgtgtcccaaaattagaggaggaggaggatggtgctaaaaatactgggggaaacaatggctttaaaaacccccaagtctttagtaaaatacttaaacctacagattcaagaaatcaagcaaaactctgacaggagaaactcaaagaaatccacacataggccagtgggtagtggagaccacaggactaacgaatacaggcagaagggaacatgaattttgaactgggtatatgtgaagccagactgttttcatattcaaagtcacagcccagagacttctcagcagtcctgctgataaacagaccctaagtgccagcaaagaatccaaaggagaactgaacacccccttgaaggcgaaccagagcgtgttaactaccagtggtgacaccacaattacaggcaaaggtttgctgggcagaagggggcgcctgtgaaacgccgcagggcatcgacacagtgagcagcaagttccaccaattaatgaagtgcttctgagcagttctgtctacaaggtttctgaaagaagccacggctgcaccagctaaggcccctgggaactgggaacaaactcattctctggcagcggggatgcgagaaacccagcatcgccatggctaccagcagagcctctctcaaagcctttcaggaatctctactatttgtggaaactggggagcattccccaaaggccagcatccctctgctctccaacacttccagtggttgcctctcttaaccgtccctcaatccagttgaaaagcaagagggcgcccgtacactccactcatgcttgggacccttccttggtgacactcatcaggaatgcctccatcagacaccctgctggagaggtgatcccagcattttcactttgccagaagtcctgtatattcacagatcccgatctggaacctcggtagcatgctcttaaactccttacatgattggaggggaaaaatagatcctcattgatgtgaccaatgtaccagttaaaggacccaagcctttcttttgctttctgtgttgttttcccaacataattgcaaagagaggtgagtgacaactaatgtaatctctgttgtatatttgccaggaaagcttcctacgggggccagcggtggatgttcatctgcattttttcaaagaaaataaggaaaacatgtagattggtttaataagttaatgttttggagaataatagaaattgatttttcaattagcttaagttcttattataaatccagactctcccaatcaactaacaaaacaaatattaaaagaaactatccaaaaaagagagtctgtgaggtcttctgttcggtggttcctcccaacactgcacatctatttgtcttttctggtcagtatatctccattattccaggagggatctcaattcacttttagaatgatgtctctgaaaattgccccttctgcagcctctggccaaatatgaggctccgttgggaaccaccagtgatcatatctcaattgcttaaccctggggtttgcatctgacccacagcaggccaaagttcttcccagtgattttcagaatacagttaaagaggaaacatctgttccctttgggtgggaagctgaagaagggatccctgggttccagatatggacaagtgctttgtgtaaaggaatgaaggtgacctgcagagaaaggcaaagacatggtaagaagacattctggtccttggtctcgggtgtatttggtggattgatacataatgggccccaataagccacgcctcctgggacacacagccttgcacagtccccgtccacattaacttggttgggtcttggccaagtgacttgctttggccataggacatcagcaaacgcaatgcaagcacaggcttggaaagcacttgcacaatgggacctacactttctcttgctgctttcagaacttggtcttccagcctgctggagatagatgacccagccaatagtcagcaacagttgccagacatgaaaaagatcatcataaaccatttggtcccagtcacgccatgatggaaggtaaaagaaaagcccaggtgtcccagacaccccagccatctagctaaggtcacagcagtaaaactacgcccaggtgacaccacatggagcagagatgagtttcccagatgaacccagcccaagtcaccaatccacagattcatcatcaagtaaagatttgtctgaatttaaactaaaagtcactcgattttcaagtgacttgttatgaagacaaagctgactcatacagccttcttgaaggtactctattcttgcttttctcataaaggcaatatattctccagtttgtccaatttgctgtgtaggattaagtgccttcctaatggccaatcactccttttcctttgactacaaaatcttcattttgtgtagggaggcaatgtacctaagtaaactactcactctgtccacttctctttctgtagatatcatcatatgacacagttaaagccttagagaaggatatgaacaatcaatgagacagaccataccttttccactttctaccttctttcatactagaacacagatgtgatgactggggtctcagcagccactttgattaaatgagggagaaaaaaaaaaaaaaaaaagagtaaatgagccatgagtgaaaaataaaagacatcagatctgatattgttgagcttctaaagcaatgccatgagcatctaactccaaaaatgttactgtaacagaagggaaagtggcagggcacaacttctcaagatacaccccaagaacgacataccccaagggcacaacatcaacaaacgagaattaaattggaccaagatggcaagaccaagaccttgatcctcaatcagcaagtgaaatgacacacccaaggtgccctgacagttccaaggcagttaaaagaccaaggagtgggtgctggcccaaatctccgccccttcccaaaaacagttggaataatcctcccactcattagcatgtgaaattacccagcctataaaaaccattctgtctgtggagtgtccttctctctgaatctgaataaattcacttcttacctatcactttgtctctcactgaattctttctgtgatgagacatcaagaacctgagtttcattaggtccggaaaacaagtatcatgggttttggctggatttgagttccagccacgtgggttcgtatcccaaactgggttttggctggcttcaagtcccaggacatgggttcaagtcccaatctgtggtaaatggtttcattactgtacaacataatcagaaacttggttctgagacaactgtgtagagtgagtgtcaggtatacaaagccaaatacaattttaaatgatttaagttacagttttgtcacttgtggccagaagagtcctgcctagtgattggggctttcctctggggagtcctctggctatttctgaatgccacaccttgaggtgcctgacccctcttgactctctgatttgcctgcagacacaaagtcatttccattttccttcttaaaatacatgagatagtggatgcttccaaaatatatttcattaaagtccaaaataataaaacacacatataagaaatacaaagggcacgtaaatgtcatgttcccatatttgatcctaaaaatgccaaaaaagcttaagagcccctattctaatctctttactttatggtactagttctcaaagtggaggccctgacaggagcatcagtatctctggagaacttgttagaaatgcgaattcccaggccagcccaaacctactgaatccaaaccatggtggtagggtgttttgccaaaagttttcactttcgtttctggttcaaaggatttgttaacaaaataaaccactcattttatacaaataaatattccaaatatttactagagaattatagagcttactttcaatatactaatattaaaagagaaatagaaatagcagaagatacatcaccaaattggagtcaacgtgccgaattaaatagcgctgggaagtcccaagtcacagcacatctggagtcccatttgggaaaaggtcccaggcagcatgtctggtctgtgtgtgagacctcaaagattgcagttcagagttccactattaatcccaggatacaaatagataccatcaccaatgtgtgagcaaactgcaagcctgggttcatggtaatgctgtttgttttgtcttgtacaactcggaatgttgtcaagcctgggacttggttggccaggcccctccaggggctcaaccatctccacattcatctcccatcttatctatggtgctgcaagttttgcactcacggcaggcagtcattcctggtcactcacagtcagggcagtgtccaggcaggttagaagcaaggtcagaggcctgctttctttgtctctgaagcctaagcaagaccatttatttaatttccctcacagttagccccaggattgtttaggccaaagagcataggaataaggcaaaataacatgagcagtctttttaatttctataaacaccaatgtagaacatattgtaggttttagggaaaacagtccattcatagtaattgatggagtgctccaataagtggggttctcaaactcgagaagttggtcctttcacaggcttgtcacagtctgtcagtaaatgggcacagttatcaaagcctagataatttaaccaccgctgcaagagtctatgactttgtgtttctactggccaatggtagggcaggtgaagctgtcttgggtgttggccaggtgatattcttgtatgaccacgtggagatccatttgcttcattctcaaagaacaaacttaacaagagggttaaagcggcatacaagtagaagagctgtcaaggtgcctagaataaaagctagccaggaaaccaggaccagactttggcccatgatgttactgtttctctaggtatgagaagatgcaagagtttgggttcagaaaaaaggaaaaacaaaaaaaatctttacctgaaaacatctatctgaaggcctgttttgcccatttttcccagagcacagagggagtgcctaatttctgatatgaccctgaattcctttaagggggtgctgaagttcagcagcgtagtagccattatttaatctttgcagtggcagtctgcaagtgccaggctccagggagcagggccccttcatagccgtagatttgatcatgttttgggggcatttcatggccattgggtcccatgatgctggaaaggctcattcccaggtctagcgaagattccatcgacaggccactcagtgtgctattaaaggaccaggccctatgaataaaaaacgtctctggaccattcctgtcttactagcctcttgggccaggaaacgattccctcttgttgcttcttcccatacctggtgttacattattataatcattgatctcatattttatcagtggctcagtcacatacttggtaatgtaagagataacaattttctgcaacaggtgacatagacaatgatatagatcgcaattatcagtaaggtcacaagcaagaatttaagtcaagaactttcattaggtatagcccagtataccccagatcatctgacttagttaaatgattacagccaggtattaatctcctggttgtacatcacggaacatctgatctttatccagagattgactattgatataaactttagaaacaaaattagcgtgtcttttaataactgaactaaaattttaacaataacacttaacaaggaaccatttcagaagtgagtaacaaaactagaatttaatgtttagtgaaacataaacatttttccttgtgagagcattaaccttgcagccagggaaggctttatcccatcaaataaaactgaggtttgtcagggagctgggaaaagccaagcggccatcttggatttcccatagccctgactgattcatagctacctcttacccattttaaattccccagtttaggaacagactattgccatgttttaaggacatcaggatagcaacaatctggcagtgaggggttaattttgtagaagcagaatgacctttagctacatgtaccaaaatcttcatagatcattgtgcagtactgcacatttactttactaaagtaacaaaagattttaacaaacataaatcacttcaaggaggagaaattcacaacctattgctcaaaagctgcattctaagaaaagtttgttctcttaacagagagagcaaaccaaattccagtctggtaccagctcactgtgagtaacaaaatttgtttatctggttaatctttgaaagatttcttcataaatctgaaaaaagtaatagtgttctttcaaaggtatgagagtaaaaccacagaaggcattttaaaaatctcattatattgcaattgacaaagcaacctggtcattactctgacatgcaacactttactatgataactggaattataattgacaacattttatcaggatacatcaggtgtttatgaattccacatattttttagcatatccatagtaacatcaaccacagggtttaacctgagaagatttatcactccttaaacaatacttcccatgtaatttaacatgtcaaatgaacccatgtagtttaatatctctctttgagaagtctcaaggatcctctgaagtaccccaaagtgagctagaggtcaaaagaacttcattagaatttaattttaggaagttttgccaaaacatcaaaaggttttataatacttagtgagataggatcatttaggtcactatgcaacaacagttattcacttagccaaagttaacaaaagatttcaaagtaaacatagaacagagcactttaggcataaagaaacttaaaatccattatcaaaggcagttcaacatctcaagaaaatttgtattatgcactaacctcttttcttggggtctacttgccataaaacctgtctctctctagttttgtttttttaatcactttgctcatttagaaacagccacctgtaagtcagacctactttcttttttcttaataaaacgtaattatatttctcatactttttttttaaactaaaaacacagtctcttttccttaagcaatcatgaactgtcctttatattagcattctatagattagtgaacataaataccagtgataatttctaaaaacatttgctttcttagagagaacatctcaggatggcaccatacatattcattaattgtccaaaatctctttagtttctctgtaagaggaagttatatcatcatgcacgctaagttgcttcagtcatgtctgactcttggagacctcatggactgtagcccaccagggtcctctgtccatgggatttcccaggcaagaatattggagtaggttgccatttcctcctccaggggatcttcctgaccctaaaattcctgctcctcctgcactgtcaggcaggttctttaccgctagtgccacctgggaatccccaaggggaggttagtgttcagtaattaatgtttcaaaatcttatttatttggaaatgacctagctattcaataaactttcatcacttagtttagcacaaccctagaaatccaaattaccccaatctggagagactatttagacagacattcctaaacttgaattattcttaatagagtttatctaaaagctcttgtctcatttatatttttcgtttttaaagtttcttcactcgagttactttccttgttgacaaagttagtttacattaagcctaggcacaatgaaagtattacacaatatcgatgactcaagacatgtcttaattagattcgcaaacagatatctctagttcacctgaacctgaaatgcatttaggttaatttctcttctaattgtttaatttgtaagcacttgcttttgtttagtcaattgaattagagctcatttacaaaccaacttcagcaatgtg

SEQ ID NO: 53698 - DNA, 4070 bp, Bovine  19866880163576
cagctttcctcacagtccaacactcacatccatacatgactactggaaaaccatagccttgactagaaagacctttgttggcaaagtaatgtctctgcttctgaatatgctatctaggttgctcataactttccttccaaggagtaagcgtcttttaatttcatggctgcagtcaccatctgcagtgatcttggagcccaaaaagataaagtctgacactgtttccccatctatttcccatgaagtgatgggaccagatgccatgatcttcgttttctgaatgttgagcttttagccaactttttcactctcctcttgtcctttattattgagtgaaacttccctcagcactgtgtgccaggctttttgctaggtgctggggatgtgagtgaacaaggcaagtccaagtctctgtcctcataacagtagttttctggaggagacttattgggtaagaaagtacacaagtgtttgtcagattacagtggtgttaggtgctatcagagaaaagctgcagaaagaattattggctcctattgatgtggcgtgctaaagaagattacagggtgattgtccatcctgtagttgtacttaccccaagtccttacacacacccaggtgacaaagtttcaatgttgcttcttggttctggacattttgcaaagaggaaagttcagatcatgggtctagacgaaatggggtttgaggtttcaataaggaaagaacctaggagcaagagatagaatcttctaccatgagctgatgcctctaggtgattggcttagctccggggactggagaaacacagagcatggatggtgactgacatctgaactcatcagattcacacaaggatcctgagaaaatctctgaagtttgtgcaggggatcccagtaaacagtatactcttgactgaggaactgacataaaactggatgggtatcctctcatacctggcttgcagctttcagatgcacatctaagaggcggcctaatgaagtcagatgcctatttccagggaaccataccaggcatgtcaatatctgtggggtgacaagatgttacagcttactcacctggctgactcattgactcttaggaacagaaaggtctttgagttgattcaagtgagtggttctcatacctggaactgaaatcagcctgaagcttctaaaactagagaaacccagggcatagacttactgggacagaattaggatgatctcaagggataaggattgggaatctatgtatttttatacatttagactaaaccccatgtaaagggagcccatgggcaagcatgagccaatcaagcttatttggtgaatgccatcattctattcattattttaaatatagttatcatttctggaatattccttagaaaatcatgatttaaatactctccataagtgtatgattcctggaaccagatcagaatattttttatactgtgcctctttgggaaactgaatgtctgttcctaatcctaggatgaatatttagtgaaggtgctccctacttctgtgtgaaatgtgtgagcatgtgtgtgtgtgtgtgtgtgtgtgtgtgtgtatgtgtgtgtgagtgtgagtgtgtgtgtgagtgtgagcgtgtgtgtgagtgtgtgtctgtgtaagcatgctcacacagtgttttcagacttgtttccaaagagtgagtggggtgaaccctgtcatttcagatatcatttgacatggcccagtctgggggtgtctcagttccatctggattgcacagagaggcagagcagcatgtagtgagaaagcagtaatgagctgctttcttcaatgtttaaggctattatcgttgaccttaaaaggacactatttgccagcatgactattgtaaaagatattcattgattgcatgaacagttaaaaaatatttagttagctcaggctaccggccaggtactaattttattccagggattcagaaattattaacgcctggaccttagtcgtatgaggccaccaaggttttgagtttagttggggaaatatatttaggtttagaggatgttgctccatcgcagtgtggttaggtgtttgtacttaattctctagccccatggcttacaaaatgttcattgacagcaaagaacaccttgagtaaagtggacctagcactagaaggccggacaccgcttacaaatcctctgttccccatgggcactttggggaattagttcactctccactagtaacccagtctctatggctcctgttgagcttctaattcagccacacatacgctgttccatagttatatgatcagagtgattaattcatcaaaagtaagattctaaagcctaatggaatagtatctatgaagtgacacacccttcttttaaaattgatatgttttttctattttttaaaaagattaacaaaaataatctaggtttttaaaagtcattcagtttattcccatttattgcattgctgtgcatgtggaatatgctatgttttacataggtgattttaatttacaataattctgtgaaatctttattatctccattttacagatggggaattggaagcatagacaggtaaactaatttgccaaaaagacaaagagaaaataacagaatcaggattcaaatgtaagtttatctgattctaaagctcacagtttaaagaagaaaacttctctacgctggtttgattatatttacacacgtatggacttccctggtagctcagctgataaagaatccacgtgtaaggcaggagaccccggttcagttcctgggtcaggaagaccccctggagaagggatgggctacccacttcagtattcttgggcttctctggtggctcaggcagtgaaatatccacctgcaatgcgggagacctgggtttgatccctgggttggaaagaacccctggagaagggaaaggctactctctccagtattcttgcctggagaaacccatggacagaggagactggcagactacagtccatggggttgcaaagagtcggacacaactgactgactttcccttcctacacacgtatgtatgtagtattggaagctgtcattcatcatctgaattttaggacctcttagagaatatctaatcctgagtctaaaatagaaattctgtctataaagatttttatttgacttcagacacataacaagcatctactgagcatgtgtttgacattgtgacaaacactgggaagctaacactgagaattcacatgcaatctaataacagacaattacaaaaatcgaatcaaatatttgcaattctgtgattattgcaaaagataaatcctaacttctcttagtcctgggagaacctgaagagcagtactaactattaaaagcccatgtcagtacttatgggaaaaaaaaccctggattgggggcacagataaaatcacacataagggaaaatttaaaacatggtacagcaactacctccctctatttcatcttaagcacatgtttcatgttgagtgaataagtcacatgaacttgaaaacgaagcatgggttttagaaagaaaaatgagtttgtgtgcaaaggcctctattgtttcctgggatcaatgctattgattttgctctatggcacacaggagtcgaggctttgaaatgtggatgttgactagcagcaaaaagccaaggataacagcttgataatgagagagaatgacttaaagtttctctgtctaatctctttaacaagtggtgctgggaaaactggtcaaccacttgtaaaagaatgaaactagaccactttctaacaccacacacaaaaataaactcaaaatggattaaagatctaaacgtaagaccagaaactataaaactcctagaggagaacataggcaaaacactctccgacatacatcacagcaggatcctctatgacccacctcccagaatattggaaataaaagcaagaataaacaaatgggacctaattaaccttaaaagcttctgcacatcaaaggaaactattagcaaggtgaaaaggcagccttcagaatgggagaaaataatagcaaatgaagcaacgg

SEQ ID NO: 53699 - DNA, 959 bp, Bovine  19866880166483
cctagagcaattgtcctaagcatgtgacaaagggaacttacttaatgaaaggtctaagagatataatcagttaacaaggcaattaaacacattacccaggactgtgccacctgggttcctgtggcctacaccagcaaagactagcaacatcatttcaattacacacccacagttagccccagacgcgggttagtaaacaaatgctaatacaagaaagatgatatgtacaggagagaattataatggcagattaacaaatgcaagctaacaaattgtacattctgcaaattaataaaactaacaacagtagcttattcttagaactatcctgacagcattgacttatttgaagaatccataaggtagggaaacaaacaagaaaataaaaatggaccaaaaaacagggggaggggtgtgagctggattctaactttaactctgctgctaatagtgaatctaaataaaaatattctcacgataagaaacaaaatgtaaaaattatcttcttctcgtcagactagctctttcactagactctggacaaatcaacctcttttctgagtttctatctcattttaaagattggaaaaaaggacaaaagagagagtcttgggaagtaggaggagtgttaatttctaaaagccagttgtaaacatcaccgtttattgaagcaaatgtagaaacaaacataaaatcaaaacaaagccaagtgagcagttggcaagtggagcaggtttcacataaactgtgaatcaacaaatgtgaagaaggatttattatttgggcccagaacaatactatctactaaggggacacaaaagagtccttgctaaattaattgagcacttattctcaaatagtcctcacaaaaggcctgtgaggtgaatgcttagaaatgagtgaacttagtttccaggacacttaaccatacactaaaatgctttggccacaagtatcag

SEQ ID NO: 53700 - DNA, 4105 bp, Bovine  19866880208830
aaacaaagccaagtgagcagttggcaagtggagcaggtttcacataaactgtgaatcaacaaatgtgaagaaggatttattatttgggtccagaacaatactatctactaaggggacacaaaagagtccttgctaaattaattgagcacttattctcaaatagtcctcacaaaaggcctgtgacgtgaatgcttagaaatgagtgaacttagtttccaggacacttaaccatacactaaaatgctttggccacaagtatcagaaacccccgatcaacaaggaaatgcatcgctgctgcaactgagaatacagtggccggaagtcctccgggtgtcatacaaggacctgttttctctgtcctcagtggcagctctgtcctgtacctgtaccatcggatgtccacctcatgcatcagtgacaattggagcaacatgtttccttgtttctcaacatgagagacaacccttctcttttctgtttttcccctcaagctgacggggacaacttaggtcatataactcctgagtcaataactgttcctaaggaatgtcatgtgctagaatgctaaaagtaataaggaccattcctagagctggggatggctccagtttcttctgaatgtgattacgagaggtgtatatgtgaacaaaagttaggtgcttataagagggaagaagagagaagggatgaaatagacagacagccagtgggtccactccattagctctaagttcaatgcttggcaagtggcgaagccagaactgaactagttaaaacatttggagaacctcggaccgatttctgcaacttagaaaaccaccttaccaggcaattcttcatattacaacccaacaaatcagttttgacaactataccccagagatgcacgataactctatctacccgacaaaaaggtcaggtcactttaccgaaagaacttgtcaagacaactgaaaacagcatttgaaatccagaaattcatggaatagccaagcatatgaattccatgccaatagaagccattgctttgaatgagaatcaactgtgttataaataataataacactatctgcacataataaatatccacgtgccatttaacccatcttagtactattaatatttgtttatggcaaagcagcactggtgtatctaaaaactgcaaaaggcatagaaagtttttaagcaattataatttgtttaatgactagtcataaacaaaacacctcagcctgctaagcctcctctaatttcttctggctgctactgataatggtctgtaaataatgctgcccggtgtctggtgtctctgaaatatttaacactgagacacagatgagctggcaaggtgctggcctctttttagctgagacctagatcccaaaatattccctcttcatccagggttccatcgaaataaatatttgcttttcacaaaggatttttgtcctaggaggaagaaagacagatagtggcagcccaggacagcaaatctgcttagagaactagctccaggttgctatgcagagggaaataagccaggtaatccaacttttggaccatttcccaatctttccccttgcttagggtcattactatatacctgtactccaagctcgaccaacaaacacattcagatcctctccattgctgggtaaacagaattccttgccaccaaggtactcctgaaaaactgagcaacattttgttccctgaatgggccaagtgtccttccaccccagcttttttgatgatgtaattctttctatccagcttctaagactcagataaaatgtttcctaatggtctcagcatgaaataacctctttatcttttataataccaatctctgcctagttctgtgtaagcaatttacatacattatgcacttgaaccctgagttaaacctcaactcattgttgaggcaagtgttgctagaccattttattaaatacaaataggggattcagatgcagcatgattacattgaaggagatcaaacccgtcaatcctaaaggaaatcaaccctgaatattcactggaaggactgaagctgaagctgaagctccagtactttggccacctgatgggaagagacgactcattggaaaaagactctgatgctgggaaagattgagggcaggaggagaagggggcagcagaggatgagatggttggatagcatcactgactcaatggacatgagttttagcaaactccaggagatggtgaaggacagggaagcctggcatgctgcagtccacagggtcgtaaagagtcagacaggacttaacaactgaacaacagtatacccaatgtcacaataaatgaccaaggcaagagactaacacaggtgttttagatcccaaagcccacacactgctttttaaattccaagtacaccacaaacactagcattttatttgtgcttcctttataatgcagatatcatttctacccactgttagagctattgacgtgaatttctttatcttcttttctaaagtctggaattcttgaaggcacactctatgtcttattcatatttgtatcttctgagggatttgcatagaatagatgcttaagacatctttgttgaaagaatggacaccattcaatacatacttatagcaatgaattgctattattaactttcagatttgatttcctataatcactacccttgatgacagagaatgaaccttttttttttcttttctaggaagcaaacccagagacaaacagaaaatcaaaactggtttccattagcatatgtggaaagacttcgtttatgctcaagtaaaaactagactgatacaaatataaaatgcacttggcaatttgttttgaattttagcactttctttcatgaaaaaaaaaaaaaagcccagaaccattggtgcgttaatgagttccccatgtgagcaccagggttggcatgacatcccctggtttcatagagcttttgacatcaaccatgactggaactatccgttgctcattcggcaggcacagaacttcctcccagccttgcctatgacaaggtcatcctctgtttcaattggacacgtgggtcctttagaatggagcttcagtctggccgtgggatttggcaacaatgacaaagagagcaatcaacaactgccaccccactcactgttcacttgccaaagctaaaaagtgactgattgtcaggccttctgaggttaagtgtgatagatcctttcttcctttggatgtaatgcctgtctggtgatgaagttaagaacttaatgcagtgaagaacagcatgtctttatggcacagactctgggtgctagattcaagaacttccattcacccgtatgtgttgctttctacgttccatatctgatttttgtttttatattggagaaaaaaataatatcctcattgctgttgttgttcagtcatccagtcatgtccgactctttgcgaccccatggactgcagcatgccaggcctctctgtccctcatcatctcctggagtttgcccaagttcatattcattgcatcagtgatgctgtccagccatctcatcctctgacaccctcctttccttgttagagaatttaaaatgaaggaatcggcatttacatcatcccttggactgcgtctgttacagtacttaattgtacctaattgctctaaatgctgtcagttccttatttctgtcttcagatattatttttggaaacaaggactaacatcagtttataaattagctgtacgtcaatagttttgttgtttttgatttgctttgcattgcttagtggctgtctcagaaatattactgaaatttgactgtatttaattgcaaattaggtcacaagtagaacctattttaaatgagtattaagcctaaaagttaggacccccaggtttaaactggatattttgaaagcagagaataagttttgctctaggaatactaagtctctgacttacaaacccaagcaatggaaaggagataggaccactgcaagcactgccatgccacagctcaacgactcagtcgtcactgctataaagtgaacatttgcttccggctaaccgtgccccagtgatgagtgtggaaacctattc

SEQ ID NO: 53701 - DNA, 2620 bp, Bovine  19866880210174
ccaaggccaaatttgcctgttaccccaggtgtttcttgacttcctacttttgcattccagtcccctataatgaaaaggacatcttttttgggtttaagttctaaaaggtcttgtaggtcttcacaggtcttcacaatttcagcttcttcagcattactggttggggcatagagttagattgctgtgatattgaatggtttgccttggaaatgaacagagaacattctgtcgtttttgagattgcatccaagtactgcatttcggactcttttgttgaccatgatggctactccatttcttctaagggattcctgcccacggtagtagacataatggcataagaacctggaatgtgaggtccatgaatcaaggcaaattggaagtggtcaaacaggagatggcaagagtgaatgaaaacattctaggaatcagcgaaccaagaagcactggaatgggtgaataatcctgcctacagaacttttatgtggactcattcatgtaatgtgtttaggatcaagcacataagaaaaactcaacaaatggtcggtattattagtaaatagaaagtgcttaacatattgtgtattcagtaaatagcaactattggttgtcatacacaccgcacataagtcatgattatataattaagaagtatcctggtctcttacttctggttttacatgcatagaatattgccttctgagtaatacaggcaaaaatgtgttcctggggagagagcacttagtcttgagctcatcaagaaaggcagcattgggatctgaatgggatttagagagttagaaaacatggagaagataatgatataaaagccaagagataggaaaaaaaatcatgtttgtggaagaaaagatatagtgttttggatgaagcatagctgcattaagggattaacaggattgcaggcttaactggtagtccagtggttaagagtctgagcttcctattgaaagggtgtgtgtatgatcactggtcagggaactaagatcccacatgctgtgtggcactgccaaaaaacaaaatcaaagcacccacataaacaacaagagcaacacaaaaggttaacagggatgaatttgggtagaattagaacaggaaaaaatagaaggagtgaggaggcaaaagagaagtttgttgtgctcacctaggcccgagtggtaagggtcagaatgagagaaacgagggaaggacaaagggagttcagatgcaagatagccttcaaaagagaagtcagcagggcttggacacattaaatgacacatgagcaaatggaagaagacagaatgacaccagtattttcatttaagttagtgtggcatgtatgataactttgagaaatgggaaagtaatatttagaagggcaatgataggtttgacatttttatgttgaatttgaattaatagagaaacatttttaagtaaaaatgtccaggggcatttggaaatctttgattgctctggcccaaacatagagttgaaagtcatctgcatggaggacggaactgaaggaggtctttattatccagagatatatagtaaaaagatcatttaaatagtttcatacagagaaccactgtatatcaggaaatagtggaaaaattttaaaggaaaaaagtgattacagttacttgtatcttacatttaaaacaatttgtattccaattccaactggccactaatccttagaatgaacaaagaattaatttcttcttgtcactgtttccatatatccagtgaatctgtgcactagtctctgaaaatctacactccatcttactttctaaaaaactgtataaatgcagacttattttctagtctttttgtcatcacctggtgtttttatttaaagaaatcattggtatgttgatttgagatttgttggtcttttatgcacaatctcacacatagtgaaaaagtcagtcttggactcttcagcatggataaaacttcgaagacttttggtaacttatctgaatgcaagatccttttagatttttatcattgtttcccttgagctgtcttgatattttttaaaattgtggtgaaagacacataatataaatgtcttaataccatctcagtcattttcaagggtgcagttcagtggtgttaagtgcattcacatcgttgtgcaaaccatacccaggaagtttcagtcttgcaaaactcaaactccataacccttaaacaacagctctccatgtctccttgcccttagcacctagaaactaccattgtgacgttttcttttctttctttttttcccctcacttttgaccatactacaagacatgtggggtcttagttccctgagcagggttggagcctgggctctctgtggtgtgcgtgcagagtcgtaaccactgaactgctagggacgtccccactgtgtgatattttctgttctcggagtctgagtacctagatacttgctgtaagtgtaatcagtcacacagtatttgtctttttgttactggattattttagtataatgtcttttaggtttatgcaggttatagcacatgtcagaattttcttttctatggctgaatactattcttttgtatgcatgcatcacattttgtttatccattcatataat

SEQ ID NO: 53702 - DNA, 1359 bp, Bovine  19866880295986
cttaaaaaaaaagaagaaagcaaagaagggatttgacagtttggcaggagccagcagctcaacctgcctgtctctcttagtttactcactttcctggtccctcagtccccgatatctgtttatatcaggtgttggcaaacttttttccacaaaggccaggtggtgactgtttcaggctttgcaggttatacggtctctgtcacaactgctctctgccgttttaacaagaaagtaacaaaaaaaaaatttttttttttaatgaagaaatatagtagctgtagataatttgtaaacaaataaacatggttgtgttccaataaaactttatatgtaagaacagttgttgagtcagatttgacccaagaatcatacttgctgttccttggtctatttccagtggtagactttatgttttttagatgaatttatacttgaataatcattgatactttggaataagactggtaaacatttagaacagtattcgtcaaactggcagttcactgaaagacttgagaactgtgttaagaatgtagattcctgagtcctgctcctaaagattcgaatacagaatgtctgggaaagagcctcagtgtgtgtacttctggcccctggctctatatatatacaacagagtttgaatactgtaagtgtatggcttcaatagataattttgcaaagacatcacatgaaataaatctctgtgtaatttatttcacccacagtcataactccacgccagaacctctggtttaacgaacagactatccattccgtctccaaacctcgtgtcattgtaccctttcctgttttatttagaggcagacacatttaagtgaaaataatcaccatcagaatactaatatgccataagctgatgtcaggatatttattcaacagaatgcaattaccagtaaaatgttatgttctaaatggcatggctataatccagtgtaggctttttaacccctggtgatttttgtttcatttgatttgtgatgagtggcaaccaggcatggttgctgtgggctggcaaagcaagaataaaggggaaatagccccatggccactacaggcagctttcaacctgcagtatgccactaaatctccatcaccaccgggtggctctacatgattcccgttgttaattgaatttttccccaagtagaatgagggcttgttttgcatcaacacagttccattgtctgatgattgttgttggtaatgtcaactgaacttaagatatttcagcatccacatgcacaggcatcattgctgtgactttggagtaagagtgggggaagtgcacaggaggacagcacacaggagacgtggtactacgctcactacgctgtgtgg

SEQ ID NO: 53703 - DNA, 819 bp, Bovine  19866880358832
aggcataagagaagacatgggttcatccctggatcaggaatatcccctggaggagggcatgcaacccactgcagtattcttgcctggagaatcccatggacagaggagcttgacaggttacattccatagggttgcaaagagtcagacatggaatggcaccccactccagtactcttgcttggaaaatcccaaggatggaggagcctggtgggctgcagtccatggggtctcgaagagtcggacacaactgagcaacttcactttcactttcatgcattggagaaggaaatggcaacccactccagtgttcttgcctggagaatcccagggacaggggagcctggtgggcttccgtctatggtgttgcagagtcggacacagcaacaagtccatggggttgcaaagagtcagacatgactgagtgactaacatacacacacatataatgttaccctttagagtagttatgctgcctcttgtgaggcaatgcatatgggaagcttgtatgagggcccagtgtatagagggagctcagaagcaaagataatggtaaccgtgacaatgatgatgattttaatgatggtggatctcttgttacttcttctcacccttagataaaaggacacaagtccattttctgtaatctaagattacaaaataattaaataactaaaaaatgaaccctgaattaaaacaattagctagaaagagatggttcttaatctggaatagaaagatattgactgcatttaaacttgttaaaagttaacgtgcttgctaacagcctccaatctaacagagctgctgtctagctcatg

SEQ ID NO: 53704 - DNA, 1550 bp, Bovine  19866880358836
tggactgtagcccaccaggctcctccatccatgggattttccaggcaagagtactggagtggggtgccattccatgtctgactttttgcaaccctatggaatgtaacctgtcaagctcctctgtccataggattctccaggcaagaatactggagtgggttgcatgccctcctccaggggatattcctgatccagggattgaacccatgccttctcttatgcctcctgcactggcctgcaggttctttgttacaggagatgaaaattctgcctggtttcattaaaatacaccacttaggttaacaatcaaagccgtgtttaaacttatctcaggtctagcaagaactgctacccccacacccccacaaccacaagcaggcacagtcaccccaccccaaggctctgcagactctaaaagcctggagacgcaaaaggataagcaatgcttacttttataatcacattcttcacttcatgaaaagatctactaaatggaccctttaaatagcaatctcttttagaacacttaaacataattcaatttactccttgagaaacacatttactataccaagtgaagcccacctcgacctccatccaaagttttgaatagttactggtctaatggaagcacagatattttgtgcttctaagggaaaggatatgcatccactgattgaaagtatgctcgttgccagcctagtgactgagcactgaatgttgggctaagttcttgtaaaacaagtgtgagtcagatttgtgtggaaactttccacacagaattttcaagtccagtgtgttggcagataatctttaaagtaccagcttaaaacagaataagtgctatcataggagaagtacaggtttcatggatacttcaaacataagcatgtcatgagagatttcctagaaaaagtgaaccttgcactaagacctgaggaagcgaaaagcaatgacttccctggtggcgcagaggataagaattggcctgccagtgcaggggacacaggttcagtccctggtttgggaagactccacatgcggcagagcgactaagcccctgtaccccaggtactgagcccctgctcaagagcccgagagccgtgactgctgagcccatgtgctgcaactactgaagccttcacacctaacgcttgtgctttgcaacaagctaagccaccacaaggagaagcctgtgcaccgcaacgaggaatagcccccactcaccacaactggagaaagcctgcacgaagcaacgaagacacagtgtggccaaaattaattaatcaacaaactgaatacctaactgccacaatgttatctgtcagttatgtcaacgttatatgttaacacctaaatatgaagaaataaaatttacgtatacaaaaatatgtaacaattgtaaatgtatgtatacaaaagtttataagtatgacctagcctctgatactgcacaccatcatttcttttcatgccatggaatgaacaggacacaaaatgcataaactacaaaagattttacagttgcctactccagtacttcttgtctg

SEQ ID NO: 53705 - DNA, 3448 bp, Bovine  19866880358842
taataaacacttactatctcaacactttgtgagtgtcagaaatccaggaatgacttaactgagtggtctgccttagaattgtttatgagactgtagtcaaaaattatcagttcaggcaccatcatctgaaagctcgagtggaactggaagaattgcttccaatgtggccccctcgcatcagtggaaaattagtctgatggttggtaggagcccacagtttctgttttggcctctctgtagcctgcttgagtgtcctcatgacatagtcactgctttctccctgagggagagactcaaaagacagcaagcaataagccacagtgtcttctggtacctggtctctgatactgcacaccatcacttcagctttattctgtttaatagaagcaagtggcaaagtacagcccatatgcaagggtaagggtatcaggcatcacctcttgaaatgaggcgggtcaaagaattttaaccatttaaaagcatcagaatgtgttacaagctctttgctctataaggcatagaaatataacatttctgctgtccagaatacaatcctctaaagcaattaagtcacatgcaaggcagttcacatccaaaacagatcagagatagtttcagtgaatgcagatggaaacagtcttacccaagtggtcagaaggctttgtggagggaacgggggcagatgaggatcctggcatacaagtaggatgattaagatgtttcaggcaggaaacagcatcagtgaaggcctgtgatcatagaaagtatgcatttgaagcatatttgatatgcctttattacagaagacaccagaagaacagttgtttatggagattttccccagatagattgaaattcatatactatctgcagagcctctgtgttccctgcgggacaagactgtgtattttcatttccgtgtcctcaggagctaatgctatgcctggcacagaataagttgtccaaaatagtttattgagtaaaatatgtgctgaaagatagaatgaacatgtacgtaaatgaatgatcaagagaataaatgaaccccctactattgaacttgtaacccagagtacttatctgggtggaaggaaacaagatggaaacatgtgacatgcagggcattgtgatttttcatctatgcaaagaccaaagcatagctattaatagaataaatgccagcctctactacctcaggggctgaagccagtgcattcagtcttccaaacttcccaacacagagggtccaaaagccaaccaacttttaaccttctgtctctggataaacagacaagcagacctatgagctgccactcttcccctgcacccctgctcatctttaatgttcatcttctagtcatcttcccaagtttccctggctctcaacaaatactccatgaaaggctgtatctcatccaactctgactatgcagctgacaatccaaccatgagcaaagtcatatgaacacgtgtgtatctcacccattcaatacttgtagaggtgttgctattaaagactatttcctatttccttataaaatatttaaaaggctcatgctgagcttcctgacccgcttcactgtcttcttcaatgttccacattccagaagagccccaggaaatcctgtttaactgattaatcttcactcaaagtataattaaaaataagacagcccccaccggagcagctctcaattgatcaggaattcacacacacgtgcgtgcgcacgcacgcgcacacacacacacacacacacacacacacacacactgatctcccaatgttaggtggaccttcagaaaaatatcaaaacccttctccttcatttcacaaaaagcaactgaacatcagatgaatctgggttgacaggcagttctgaaatggcaggtggtaatgagcttgctaattattatgtaccatcccttgctagtcatctcatctggctacctggaggatatcttctatctcaccttgggagtccccagtgtctcatctccagataaagactgccaaggctggtaacctgaaaaactctccccatgaccttcagatgtctaagctaataaagaaagtgaatgtgaaatattaatttccctcactgaatataaacttttgactgtgttaaagcccttaccagccttttccacatggtccctgctttctctattctattgttattgttattgatggtattcagccagaatttagattgccctctgaaagcactgttactccccccagaaagtcatttatgtgcatctatggccttaaagatgattaaaagatgatttctattcccctttagtcatttgtcattttgcttaggggcatacaagtctagggtaggtttccagggagatttaatcaagtgactggagtggaattttataagagatctctccaaaggtaaggaggtggaaaaagatgagactgagttctagtgactggagttcccacagttccctgggtatgtgatcctaatcaagtgcctttacctcggcactttggtcacctcatctgttgaatgttatgaataacgagctgatgttcataaacacacagcatgtgctccacaaacgagattttcctttcctcctcgcttctgagcagggctcagagcactgtcattgcaagagtggttgtgttccaggaggggagggtctggtacctgcagaaacagagctatccacactaggaagatcgtggcatgcctgcatgcatgctcagcagtgtccgactctttgcaaccccatggacaatagcctgccaggctcctttgcccatgggatttcccaggtaagaatactggagtggattgccatttccttctccagagggttttcccgacccagggattgaacccaggtcttctgcattgcaggcagattctttaccaactgagctatgagggaagccctttgattcactactttctgccttttttcaggctacttcataatcccatcttcccaaagtttttttttttttttttgagcaaagaactgtttcaggtgccttttacagtcttccagggaattgaaatttttgtcactaaaatcattttggaaagactgtagtaaatggacataagaaggcataatgtctggtgaatacaggagatgtagcagaacttcccagcaagcagtgacagtttttgcctggtggtcaaagaagcatgcagtcttgcattattctgaccgaatgttatgtgttttcagttgactaatcccagacgctttctttgctgccttcagttggtcttattgggagcagtgcttgctggaattaattgttggattttcctgaaggagctcatagtagaagactcccttccagtcccaccatatatacattacctcctctgattgaagactggcctttggtgttattggtagtgctttctttcacttgccctatgatctcgtctttcccctgttattgtacagt

SEQ ID NO: 53706 - DNA, 5482 bp, Bovine  19866880367567
catcatcatttgtttacactggttacggctatataatatatatatgtatgtatagattttatatatatatatatatatatatatatatatatataatctttatgtgtatatttagtcacttcagttgtgtccggctctttgcaactctatggactgtaatctgccaggctcctctgtccgtgagattctccaggcaagaatactggagtgggttgccatgcccttctccaggggatcttcctgacccagagatcgaacctgcatctcttatgtctcctgcattggcagcgggttctttaccactagcaccacctggtaggccccaatcttctaaagagacaaatttctatatagagagagacaattttctaactcgtttattttgaatctttttgtgattaaacaagttagaactaacgtagcaatccgtaagtagatggttcagaactgatgcagaggccttgctccataagattgtctaagaagcctgtcctgtgcttcatcatttcccagggtaccacctccaattgtactgtctaggatgactctccagtatctctgtgttccagtcagttgaggaaggttagggactttaagaacgtaactcagaagttacagcatcacttccaggtacactcttctggtggaattaatcatatggtcatacctaggagcacaggtggctgtgaaatatgctttttactctggttggctctgtattcagctacagattgagtgttactttcctttctaaaggaagaaagagagactggatgttaggaagcaggtagatgtgatttccatgctgcttttacagatactaattggcaacataaaactgaggtcctattaattttctttattttaaattttgtatcctttttttaaatttttattttatttttaaactttacataattgtattagttttgccaaatatctaaggcctgaaaacttatcatgacttttaaatgtatttttgctctaccctccatgtttagacatggtttgtggcattaaaaaaaaaaatcaatgcctttacagcattgttttctacttttgtcgttgaacatgtatttcagttaaattatgaaataaatgggttttggtgagctagcctggaaaacttacaaacacaatattgtttctatgggaaaaagacttcaaattcttaagaaaatctgacaaagaaatgtgcttttgaaattgaacacatttgaaaggtgggaactgctaaatgcactcaggtttacacatatgaaataacagatgaggtttactggaacattttctcagtaatgacttacccaacactccaacagcctcagtacttggccagagctagccaagtccagatccagtttcctcctttctccatatgttcatcaggcacagaactgttggtttctctttttcacttcaaacatttagcctgttactggaaagttgtttagttgggaagttgtaacaagagtataaatagaagattagataaggatagtttaagacctttgagttataaatttaaccaagactttagagaccattcattcagctccaatactttggccacctgatgtgaagagctgcctcatttgaaaagaccctgatgctgggaaatacaaaaggagaagagggcagccaaggatgagatggttggatggcatcacctatttaatgaacatgaacttggatgaactcaaggagatggtgagggacagggaggcccggtgtgctatagtccatggggtcgcaaagaatcagatatgacttagcaactgaagaagaacaatatttaattttaataaatgtaatgatggggcttccctggtggctcaaaggtaaagggtctgcctgccaatgcaggacacacgggttccatccccggatgggaaagatcccctggaggagaaaatggcagcccactcagtgttcttgctgggaaatcccatagacagaggagctcggtgggccacagtctatggggttacaaaagagtcaggcatgacttcatgactaaacaacaacaaatgtaatgatggccttcttactctagaaagaaaatggttatggattttacttttttagaagtaacaaaatgcttatggatgctaatgttaaaatagctacttatcgaatagtttgatttcaaatctctgaataagtttgtcaaaggagttctatgcttttaactgtcttctctccccaacccccactattttgcctgctgctgctactgctaaggcacttcagtcgtgtccgactctgtgcgaccccatagacggcagcgcaccaggctcccccgtccctgggattctccaggcaagaacactggagtgggttgccatttccttctccaatgcatgaaagtgaaaagtgaaagggaagtcgctcagtcgtgtccgactcttcgcgaccccatggaccacagcctaccaggctcctccgtccatgggattttccaggcaagagtactggagtggggtgccattgccttctccaactattttgcctaagcacgcgcttagcctgagaattgaataatccagtgttgactgtggaatttaactcccagttcagtctcaaccagaccagaaagttttctttcatatactgaacaaattatttattacatgcctgttaacaaagcatttgaataattttcccagtactgggaagcagaggttaggtaagagtcacaaaccttgctcccagtgaagcctattctctgttgggaaagataaacaataagcaggtagttacgacaggtgtgaggagggttatactggatgatgtggggacagattgcaggggtggatggtttagtttaagggtcacaggaaacttcccccaagaaagaatgaatcaaagtataaaacaaattccctaagcagagagcaggttacatcccgttttattcagagattacatcactggcaagcaagtggcctgtgagaggaagagaagaggttccttagcgcccatggacctgcctctgggaaaacatctggcatagcacttggcacattcctgtcataaaactgaatcagtgaatggtggaatttcagccagtcttgatgatgacaagaaaagttttcttcacatccaaggagggagtaatgacctaacatatcaccttcttccagacaagattaatcctccttaagattgcttagaaacagttaagctggtcagaggttccggaatttaagggagggaaaaaaagcactgtcgaagagatggtaatgaagcagctataggattgtgaaatcagagtgtcagaagcagtaggctctctagaagcagtcatggccgcatcttgcattttaaatgtagaaaataaagtccttaaatatgtatgcacatgtatgtatgtgtgtcggggggggtggtatgggcatgtaaggaatgtataggctttagagtggagagctctgaaaatgtcttctactcaacaaggggagctttaacaacttagaaataaaatgaaaaatgataaattcaaattttggccagagagaaggatatttgaagatgaattgggtgatgactctgaattaaacacgaggatgaataaaggacatagattccttcctctcttgtaaggcacctaaggcattgaaacactggagtaaaccatctcaaaacaatatagaagaagttgagatttcatctactcatttttaaagtcattagttgattcattccttcaatggtatttctttgagcagatgatagcaaggaagtactgtggttatttgttattggataagacaggatttgtatcctcatggaatgttcaatctagtgggagatgataggagattgaactcaagtgttaaattctaggatggagggctccgtgacaaaggtacttaaggacaatatggtgatgtgtgtatagggatttccaatgagggcttcctggaggaggtcacctataattgcatgtctgaaagatgaatcaggcataatcaggtgaaaacaggcagagaataatgagagctcaatgtctaaggaatagcttatacaaaagcacagaagtcagagcataataggtcagggggaagcagaacatgcagacagttagttggctctaggtacagtgctgggtttaggttcttaagacagatgagatatgattcttgtttgtttgtaacaggccaccttctccaccccatccttccaccaggattttttatagagacttgtatataaaaggcttccctggtggctcagtggcaaagaaaccgcctgccaatacaggagatgcaggttcgattccttggctgggaagatcccctggagaaggaaatggcaacctactccagtagtgttgcctgggaaatcccgtggacagaagagcctggcaggctacagtccacggggttgcaaagagttggattcaacttagccactaaaccaccaccactatagccgattaaccatgttgtgatgagggactcagccatacatacacatgtatccattctctccctaacttccctcccatccaggctgccacataacacagaacagagctctatgtgctatacagtaggtcctcattggttatccattttaaatatagcagcgtgtgcatgtccctaactagcttttccccctgtctaccttccccctagcagccataagctcattctctaagtctgtgagtctctttctgttttgtaagtaagttcatttgtatcatatttttcttaagattccacatataaggaatgtcatacagtagttcccctctgtctgacttatttcactcactttggcaatctctagcattctctaagccaagaaattttgcaacacagagcacaaagtacaagtttcagagtccccgaatttcccaggtggctcagtggtaaagaacctgcctgccaatgctggagacggaggttcaatccctgggaagatcccctgaaggaggaaatgacaacccactccagtattctcgcctgggaaatcccatggacagaggagcctggtgggctacagcccatggggtcacaaacagtcagacaagactcagcaactaaataacaacagcagctatggatggcatgtttgtatccctgcttaatgcatatgttgaaaccttatccatagtatgatgatttttggagatggaggtagggccctcatgagtagggatagtgcctttattagaggaaacccagagacatctctcatcccttctgccatgtgaggttgtggtaagaaggctcccaccagatctgctggccacttgatcttggacttctcaacctctggaactgtgacaaatttctgttgtttctaacccacccagtctgtggaattctgttatagctgtctgaatggactaaaataactgtcttggtggattttctgtaaaagtcaaatcagggctcaaacaaacaaaccaaaaaagataaacatgcaacagaaacacctagggaccagccaagccaggctggtagcagga

SEQ ID NO: 53707 - DNA, 2296 bp, Bovine  19866880367570
gctgctttcacctcagaggaaataattatatccaggtttgactctgttcatggggcgtgactacagcagaatgggtctcttcctgaacagaaaaagaaaattgaaaagaaaaaaaaataataataggaaatctgacacaccaaactccaaattatctaaatccattttcaatgaaaagcttggtggcttggtaaagatgatgacttttgaaggaaaaaagatccattgaaaaattccatttcccgtgctgtaaggttaggagaataaattgcacccggggaagaggggagacgctcctttcgacatgtaataaagcaggtggcctcatttgaattttcccattaggtctcctggagtgatctcagaaatatgttggtgttgcaaactgtacctcagccttggttctctgactccaggactcaaacaggttttcaaacagaagaattagtgtctggattacttgaaatgtccagcagaaagttgtttgttattgtgctgggtttcctatttgccatagaatattaaacaggtttcttcttttccacagaatattaataactggattgcaaagtggacaagtgtcttccctcccaaccagctctttccttctgtcctctcatcctgttttcccaccacaaggattggtggggatggttccaccccatgtcagggaggggctttctagatggagcatctgatactgacaggtttgtgtctacagccagagactatcagtccaaatggaggctttcccatgaaaggtgtgataaataagtccatggagtgtccacttcatccctttgttcattcggcagatggattttttttttttttggctgtgctgagtcttttttactgtttgggcttgtctctagttgtggctggtgagggctactcttagttgcggtgcgcgtacttctcactgagatgacttctcttgtgcagagcgtggggtctagggcgcgcaggttcagtagtcgtggaacacggtttcagcagttgccgcacgtgggctctagagcacaggctcgatagttgtggcacacgagcttagttgctccacagcatgtggggtctttctggaccaggggtcgcacccatatctcctgcactgaacaggtggattctttaccactgagtcatcaggaaaaccccttagcagatgaatgttgaaggaagctaaacaatacaaccaacgggttccctgtcctcatgtggtacacagtcaggagagagccaataaagaaaagagttagcaaaacattaactaattgaaattttgaaaagttctatgaaaaagaagtataagataagcactgagaaaatgtatcagagggactcaaaagtatagttgccccacacaagctaatcatttggtatgcttacaaacgtatttattggaggtaggaagaaactgacttaggaaaaaatcattccattttagtagttcaattcagttcggttgctcagtcatgtcccactctttgcaaccccatgaactgcagcactgcaggcctccctgtgcatcaccaactcccagagcttgctcaaactcacatccatcgcatcagagatgccatccaaccacttcatcctctgtcatccccttctcctcctgccttcaatctttccaatcatcagggtcttttctagtgaatcagctcctcgtatcaggcagtcaaagtattagagcttcagcttcatcatcagtccttccaatgaatattcaggattgatttcctttaggattgactggttggatctccatgcagtccaagggactctcaagagtcttgtccaacaccacagttcaaaagcatcaattctttggcactcagctttctttatggtccaactctcacatccatacaagactactggaaaaatcatagcttgactaggcggacttttgctggtaaagtaatgtctctgctttttaatttgctctctaggttggtcatagcttttcttccaaggagcaagcatcttttaatttaatggctgcagttaacatctgcagtgattttggagcccaagaaaatgaaatctgccactgtttccattgtttccccatctatttgccatgaagtgatgggaccagatgccatgatctgagtttttctgaatgttgtgtttttagccagctttttaactctcctctttcactttcatcaagaggctcttttaggtcctcttcactttctgccataagggtggtgtcatcttcatgtctgaggttattgatatttctcccagcaatcttgattccagcgtgtgcttcatccagcccagcatt

SEQ ID NO: 53708 - DNA, 4473 bp, Bovine  19866880455948
cacacgtgtacttaatctgtatcccagttatcccacttctaggaatgtatttcaaagatacattgacaaaactttacccaagactgcagtagactatggagaaggcaatggcaccccactccagtactcttgcctggagaatcccagggatgggggagcctgacgggctgctgtctctggggtcgcacagagtcggacacgactgaagcgacttagcagcagcagcagtagattatatttctctccagccttcctagtacccacattctgccatggcctcatcgcaggtgcagcgattcttcatctttgatattgggcttgacctggaggcttgttttgaaatgatgccatgtcagtggaaacaacagtgtgctagccccaaagctaagctttaagagacaaaaacaataaatgattatttttatattcagctaagtcttggtggttgtttactacatggcattttgtagcaaaagctgatacaaaggaaacattgtttgttataaacagcatgtcattggaaacaacccaaatgtccatcgatagatgactgaatgaataaaccagggacagactacacaaaggattattatgctttatgcttaaactttttaacagcaagagtaactgccatttaactagatcaatttaaaatattcatatgcaattatttctgctgagaatcttcaaattttatgtatcagttcagagcatttaatttttcacagtaacatttgtgttaatcaaggcaccagccccaaagcactgctctcagccttagtaaatcagatgtgtaaagtatcaaatctggattgctcttcccaggaaactcctgagttactgtgggccaggagtctcagactttgctcatcaaaaatgatctcaagctcctaatggccaccacgcatgaatgaatagggaaagattgttggaggtataagttgctgactgtgcatggcagctgactaggtttttccttgattgctgtggggagctgtatatcatgacacataagatgacaggttcgaggtcagacacctgagctctaatccctgacattctgaagtatgaccagcttagttatcgtaaaactcaagtctcttctccatcaatcaaggttaatagtacctaccattgagctttgatgaggatgaaaagagggagcaaatatacagattgtgcacagtgtctgaaagatcatagacacccaaatatatttgtacatcccttctcatcaaaagtatggaattgtgaatgtaaatgtgggctctgaaatctttttttattttattttatttttaaactttacagtattgtattagttttgccaaatatcgaaatgaatccgccacaggtatacatttgttccccatcctgaaccctcctccctcctccctccccataccatccctctggggtgtcccagtgcaccagccccaagcatccagtatcgtgcatcgaacctggactggcaactcgtttcatacatgatattatacatgtttcaatgccattctcccaaatcttcccaccctctccctctccaacaaagtccataagactgttctatatcccttaatattttcaaagaaatttatataaagattacaacactcataaggcaaaattcactacgtctggcatcctataaaaaatgaccaggtgtgcaaaagcagcataatatctacaatgaggatataaatcaacaaaccaaaactgactcagaaatgacagaaaatggaatttgttttcataacctgagagactttgatttgaacttgaggctaacggctttggctttaagatatcttggttgggatgtttggaaattttatctctctggaattcaagatcaataacatctccaatcaattttttgttaatcaacccaagattttccctatgtttggaacagtaaaacagatcttaaggcatctccatccacaatagtgcctgaaagtcttgattcatttgtttatgtatgactacatctcagtccttgagaatcttgaaggccacattttatcttaaacctgcagaaaactagtctccattgtatatagtaatgttagtgacaaccaaccaagaaagcagcgtcatagagatgtgtgttcaataagaccactagatggcgcaatatcttcacatttcattaacaacacttaaagcccagaaaggaatttagtcctttacgagggactcttaccggaaagctatcctaatttgtcattccagctgcctgccttacttgctgatgatcttgtgagaaggaactgagtctaatacatctttgctttgctttaacttgaaagagagagctttctaatttttttttttctttctgttgatgctgtggtgagagtttgagtattttcaaacacagatcatgagatgaattttaattctcccattccccagctctgaacacgggctgcctgccttcccatcaaccttgacccagattccagcattctgcaaggtctagggtggcttcctctcctgtcacaagccatcactgatctttctagtctacgagcatctattttttcctaaattcttgtaatacttttgttagttccttactaaacaagacagtataacattgggcaagttacctaatttgaggctcagtttgttcctctatataatggaaaccgctatagtacatcactcatgtctaacacacaacaaattctcataggcatatttatttatgagtctttagtataatattaggtatggtcagtatttcctgaacatggacaactttccaagcaactgcttactgatatagatggaacagtgaacacagtgtatgcaagccatggtctcacaagccttacagtagaggaaggaagagggggataaatcatcccagcaagatctacatggactatgggaacatgcagcaaagataacttctcttgtcagctagaattaggagagtccctttcaagaaagtattatctgaacttaagctgataaaaatagcagtgattagccaagtaaagagaagaagggggtggggctttaatgtagtctgtgcaagtccaaaggcaccaagaccagggccaaatggcttcactagtgaactgcaccaatatttattttttaaaaaatgcaaaaaatagataaataaattaaaaatttaaaaataatgcccaaaatttacactctttcaaaaaataaaactttttttattaaaaaaaaatttccaaatcattctagtatcactctaatatcagtaagactctaataataaaaccaaacaaaaacattacaagaacattgcagaccattgtatcttatgaatacacaaacgaaaattctcaacaaaataccagtaaaccaaatccagaatttatatagagagttgtaatgaccaaatggaatttataccaggaatacaagatatgcttaaaaatctcaaaatcaattaataaaatatatcattaactgaattaaaagaaaaaaaaactacatgatcatctcaataggtgcatttgacaaaaatccagtacctgttcacgataaaaacactaaacaaataaaaataaaaggaaacttcctcaacctgataaaggacatctattaaatacccacagttaatatgaaacttattggttaaaaaaaaaaaaaaaaacaactgaatatttttacgataagatcagcatgcatcacttctattcagtactgtacttgatggaagttctagtcaggacaattaggtgagaaaatgaaacaaaagtcatacaactggaaaaaaagaaataaagctatctccttttacagatgattatcttgcatataaaaatcttaaggaatccattagacacctattagaactaacaagcaagatcagaaaaggtgcaagagagaaggtcaaaacataagaaacaattgtatttcctaaacacttgcaataaaaatccaaaaactaggaaaataatttgcttactagagtcaaaaataataaaatgtatagtaatatatttaacaaaatacaaaatatcatgctgtgaagactataaaatggtgtttaaatcaattaaaaataaagaagttctaaataaacagaaaagcatcttagctctatagattggaagatgtaatattgttaaaatgacaacactccctgatctacagactatgtataatctctgtcagaattctggttggtttctttgtagaaattgacaaactgatcctaaaattaatatggaatctcaagagacacaagatagcttgaacaatcttgaaaataaagagtatagttgaaactcacactttctgattgcaaaacttactacacagcaacagtaattaagacacagtattgttggcacaagatacacagaatggaagtgagagctaacttattttatatatatataataggtacatattttttcaattaatttttgacagaggcatcaaaatcattgattaagaatattcttttcaataaatgat

SEQ ID NO: 53709 - DNA, 8219 bp, Bovine  19866880459558
atattaatgttccaggaaaaggagaagagagaaaggacacgagcgcccagaaagaatgactccatctggctttgatgtgttcctttccacaggatggcagcagcccggagaatactgaatagtgaggaggagggaagagaggaggtggaggtggcctggcagcatctgagggattatgtgagctgtggagagtcggttctgtctagacaaaaagtcagccagccatgccgccatctgcaactatcagagaacaagccagcaagggaaaggggagtccctgggagccctgtttgttccaatgagcgggtgtaggatattctttgtaaaggactattgttgtgctaaacctggggagagggggcacctggtattattgagactcttcccaaaggtctgcttttttgtggatctcttcaggcaaaggtattctttctttgcctctccattgaggtcctgtgatacctgttcatttctcacatggatatcttgtgtgatacttaagaggtcaatctgcagtttgacctagatttagttcctacctgtatgtctctctggccttgcatggtgggcaaatcactctgagggcctctgttttctcttctgtaagtagtgtaagaagtagtgaggtagtagtttgtgtataggctctaacagcagtggctggtcttacaactgctagagcctattttttctcttccccaaaccagagacagcagagggcaaggcagtgaaggagtgacagcaaatggaaacatcttgggataatcacctactagctgcacagatgtttcatattctgctgaaggaagcaagtttccttggaatacttgaggtaaggcctctgtatgttgagtgaactttgacccttttgcacagtagaaactgagactcaacctgccaactccacagaagtaatagagatctcaacacatgaagaagcatttcagactagatcagctgggaggtgtgacatttaatttaaagaatttaagaattgataatttgtgacatgttggaggtattagctaatatgattagtgtgataatcacattgcataagtaaatgtttcagatcaacatgttgtgtatcttaaacttacacaatgttgtttgtcaattatatctcaacttaaaaaataacagaaaaggcaaaaggaagaggaattagatgagagcttagactatgtctggctaactattttcatttcctttgtgatgaggaatgatggttgggtagcagaaacccaccaaacagtatctgtagtctgttgtacaatataaaaatttagtccatggttcagtaaaccctatttaccatattatatagtggcaatagtcgtgttcagttatatcttttgatcgtctttgtagaaggtcagattaaagaaccctttaggtatgaaattcatctggttaggaccatacctgaatattgttgacaacattcagttgcccagagacaggaaaatcttattaggcaaatccccttaagaatgcagcattagagaaaatatgtccttaagcaatcttggaatggagagtttcctcccaaacaagttgtaaaaccccccggtggctgagaggttaaagtgtctgcctgcagtgcaggagacctaagtttgatccctgagtctagaagatccactggagaaggaaatggcaacccactctagtattcttgcctggagaatcccatggtgggattctgggagcctggtgggctacagtccacagggttgcaaagagtcggacacgactgagctacttcactttcacttttctttctaagagaaaagactgaaaaaattggctacataaaattataacatttccgtccaggagaaaaagtgtaatgaatgacacttaaaggactgtttttctcaacagataaagtgagagtgaaagttgctcaatcatgtccaactctttgaaaccccatggactatacagtccatagaattttctaggccagaatactggagtgggtagcttttcccttctccaggggatcttcccgacctaaggatcgaacccaggtctcctgcataatgagctattacaaattagtaagagatcatttggtcaaaagaaacatgagtaagctgattgattaaaaaaaaataaaattggcttattagcatatggaaaaatgctcagcatcatgtataagtaaagaaatgaacattacaacaccaatgaggagtttgtccaggttggattggtttgtcagtttgattatcatcatattggtgaggtgtgaagaaataagaatttttatcaagaacagatacagatttttggagggcaatttgacagtaactatcaaatttaatacaaatgcttggtcaaggactaatattttatttttattttttgaactgcaagaattccctcatcatttattcttcagaaatcgagacacagtgtggaagagaggatgcatgcctttgctttctggcctccctgggatcacaagaggaaagagaacacagaccgctatcagtacagaaagtatttttatagaagggaggaggagctttccaccccgtttgtaagacctggtctgaaggagaggggccagaccccagggtcctcttgaaggactaatattttaaataaggtattttacccacgcatatgcacatatgaacgtgtacttggattgttttgtagtatgtaaagttagcaccaaagactagcagcgaattcaatcaggaagatactgtgaagtaaactactgttaatctataaaatggaatactacacagctttgacaaagatgacaatgaacagtatgtgtgtgtatctgaaatatgtatattttgaaatgtgtgtgtgaaatatgtatggtcttgagattcagttaaattaattatgtccttttatacccatctttaacctttctttgttgcaagtgtgctacatatgtaaaattgcacaaagcagaatacacagctcaatgaatgagaacaaaatgaatatcatgtaactgctaatctgatgaagaaagagaactctgtctataccttttctttttgtctacaagctcatggataatttccgtcattcaaagcttctgtttccttacctatgattgggaacactgaaaatcgttaacaccactgttctctcctttctgaaaatgtctttgtgagaatcacatgacttaatgttaatgttgttcttctaagtgacagagagctctgcaaatgaggatgaagatggccattcagtctgatagatgtgtgaagcctgcaaggacatcatgcttgcagttgtccttaagccttcccttccttgggaagacagaatgtaaggaaaagagtggtattctgaacgagacaatctgttggtcatcatccttccagtaaatttgacttgaagccatatagtccaacctgtgaatgagaatgcacaaacttcctaattgttctgaatctctgacttttggcaggacactgccgaactggagccatgcaagcttttgggagactttcccagagccgtgaccttgtaggaatggtcttcagtgactaggtgaggggatcccttaccagtaattgctagggatgtgaaataatacatgtgccctgccaggttccattctagctatgtgacctctgacgagtcatttaacctcactgagcctgaattacctaccttcttgaggatatacataaccccaacctacctaaccctaacctcacaaggtgctgtgagtgtccccgtgagatggttcatataaacttctccctgaggttcctcacttgaccagtactcagaactgtttgctgtgtaaactgtcttggaatatctaactgggtcatcacggtgagtgagactgcagcatgtgggcctatatgtttcttacacatgaacacaggcagccaggtatggacgtggagagtggggtgatggttttctgactcagaaaaccacaatttagccctcagctctccattgctcctaagtaggtctttcatgtatgaagtcacagggtctttgtacactcaagatagtgacacatggggcttgcagtgcaaagaccaggatctgtcaggcttatatagaagaaataagagtatgaagtgaatgccaaggctttatgtttgtgtgggtaggatgtggagagcagaggggagagagagaaaggcacagaagtagaaatgtataaagcttgacttttggcaccagaaagattggaatggaatgttctttaagaggaacactagagagcccagcaagatgtatatttgggggacctctctggaagtctttgatgccagtctaggcacttagcattgatctcctagatagtagaaaagagccactgaaggttcttaaacagggatgtgacaggtctcaagcccaggaggtaaaactgaattagcaaattagttaggaaacaagatagttattatccacaactaaggcattattatgttccgctcaagaacaatcccctggcacagagcctcatgttctcaacagatgcctgctgaatttttattttgaatataaaattgctgtagcccagatgtcatttggcctccccagctttttcatataaagtgatgtgacattttaaatctgaagcaagtgactttaaatctttctcttgcacagacccagtccaaggggtgagatgagtttagacgtgacggcagccctccatcctccttactccccctcaaatgggccacggggcctgggttaagccccacttcctattcctctggttctttctctgatactgcctatcatcatgtgccaacccctccaggctttccagacttccacagcgagtgtggtgcaaggctctgatgtgaagtaaatgaaacaaaactaaaggccatgaagtcagcagcatgcagaggcaccacttgaagcgggtgtctgcctttgaaaatatccacgaggtttcctctgccatgggcacagccctgtcataggaactgatgtacaagagagcagaatgcataaaatacaacccagtctatccatctcaagccattgacattttcctcatggtgtcctaattaactctggatgctttttatgtcctttatgcgtttttatatcatagaaagtgaactgtgttggttgccccacgtcatttgtgagagaattgtggaagctaattaaaaacaaaaccaaaagccacagatgtaattattacataatgaggtaaggataacattatcagatgctattacatataccaagagcgaattttaattagaaccccaggtagttactgagaaatcaggtataaagaaattctaccaggaccacctatttgcaaaataatcatgcatcacaattattgcttgggtataaatcaaattccatggatgtacttcttaaaaggaagacagttctctggtcttggcctgtgcaaaacaaataaataaaacacatgcattatcaagaccagtttcctcaatctgatactgcaggcacaaaagatttaggaccttctgaaacatgtaatcctctagtatcaaagattagattcattctttctagtttctataaagtataaatatgagctgcgtctgtaatggcaatgaaataaatattttaaggcatatactcctgttcttacacataatttataatcctattttatgactctgtgtgtgtatgtgtataaaatacacaattcattccagcacaatatgtcacaatgacagtaatatacttgtacatattgtgaaatagtgccaagcaactggtaaacttttcagtaagtcatccctaaagaccctttctagaacttaagccatgtgtcgtctccatcttgtggccaggtggccaggagaaaacaaaagaggctgtatgatagaaggcggggaggcaggttaatctctctgaacatctattgcctgacggaggctgactggaaggcccgccctggtccagcggaaggagaaccactggtggatgatcactgtcttctgtgatcacgagggtgttgtggcagctggtggtgatgtgcagggaatcagtttcctattttgcgcctaatgaaaacattcgctagattcaaatccagatttttgtgttctaacctcagccacctgtctccccaacaactaaatggctgcatgaccttgggcaagccctttaacttctctgaaccagagcttctctatcttttgaatgggaaccgtggtgctcactcagtcctagtgtagcatgaggtcaccataggatgagcagtttaaaattagtggattcaaacttcgatgggttcccaggtggtgctagtggtgaagaacccgcctgccagtgcaggagatgtaagacacacaggttccgtccctgggttgggaagatcccctggaggaggggagcccagtgggctacagtctgagggtcagaagagttgattgtgacagtgacttaacagcaacagtaaaggaattcagtgacatttgaagtgtcatgtagtgctaaatgccacaaaggacagatgcagcaggactggggagagagcttgccggtcgggaggacgttgttttggataaggtgctggaagggcctcaggatccacatttgatcacagaaatggatgtagtcagggagtgggtcacatggctccctgggggaaagctgttccaggtggagggacagcaaatgccagaactgtgttgcatgggttcaagggccaggaacaaagccagtatggcttttccatttctgcatgcttgtccattggagttcattttgaggtgtagccctcacaaataaccatggatttcaggggccaggaaaagtcagatggtggtgctcactcactcgcacagcacagtgcacagggtctgtcacttctgttaccctgctcattgattttctgcctttacttataaatgtatatttagaccatgatgaagttactcttggggcttctcaggtatcttagttcagttcagttgctcagttgtgtccaactctttgcgaccccatggaccgcagctcgccaggcttccctgtctatcaccaactcctggagcctgcccaaactcatgtccattgagttggtgatgccatccagccatctcatcctctgtcgtccccttctcctcctgcccccaatcgctcccagcatcagggtcttttccagtgagtcaactcttcacatgaggtggccaaagtattggagcttcagcttcagcatcagtccttccaatgaatattcaggactgctttcctttaggattgacaggtttgatctccttgcagtccaagggactcccaagagtcttcaacacaacagttcaaaagcatcaattccaggtgcctcagtaaagaatccacttactgatgcagaagacacaagagacacagtttcgatccctgagtcaggaagatcccctggagtagggaatggcaacccactgcagtttgcctggaaaattccatggacagaggagcgtggtgagctacagtccttggggttgtgaagagttggacacgactgaacacacacgcacattactcttgccctgtaagtaaataggtaaatcaaatctttttctttcaggaaataagtattgtactgttagacagcctgatttatgggagtagtagaaacaaaccaaaaacgttgtttaaaaggtgcagtctgtcaagcagttgactctgcagggcagcttcttctgcagcggtgtggaaagaggagtgtcacattcaccccacccccaacctctttgtcttcctcctcctgggcagtgcttcttcctcagcctctggatttataagaccattgtgctaacagtgctgtatgcagtttacaagcctttgctcaattctcgtggtccttatggaagtgtaatattaaactagtcacataagactgagacaatgaaatgcagtcacatacattaagtgtttagcacaatgccaggtatagggtagattcccccaaatggtagctgttattatcacaacattactttatttagtcctcctacatacccaaggaaaggggcattataatcctcaaattataggcacagacaggttaaataacttctccagagtcactctgctagtttcagtccaagatagggtttaaatctcaatctgtctagtgctaaagactgtgttctttttcttcacatactacctcactactcttcaatttccttatatctataaaatggatataatatatatatgtgggcatgtatatgtatattatgtatgcatat

SEQ ID NO: 53710 - DNA, 3689 bp, Bovine  19866880459559
tggagaggcaagaaagaatacctttgcctgaagagatccacaaaaaagcagacctttgggaagagtctcagtaataccaggtgccccctctccccaggtttagcacaacaatagtcctttacaaagaatatcctacacccactcattggaacaaacagggctcccagggactcccctttcccttgctggcttgttctctgatagttgcagatggcggcatggctggctgactttttgtctagacagaaccgactccccacagctcacataatccctcagatgctgccaggccacctccacctcctctcttccctcctcctcactattcagtattctccgggctgctgccatcctgtggaaaggaacacatcaaagccagatggagtcattctttctgggcgctcgtgtcctttctctcttctccttttcctggaacattaatattaatagcttgtttctttgcagctgctttcttctccaacctcaagggaccagaaccttttcttggactttgtgacagacggaggaggcctcattcgaaggcggggagagacgcactgggggagcacaggcgcggatgctgtctctgatgtaatcccgggccgcccagtgcaagcatgtgacgttgctccactgccagcccagtccagccaaatattctgtgtaatatgtgtcccttcagaggaggagaaagagatctgcaaacaatctagccaaaggcccgtgaaatcatccctgatcaataatcagtggttctgccgccagactgcactagtatctcatctcatataatcaccataattctaccagcttaatattggtatcctcctttaatagacagggaaactcaggctcagagagaggcagccaattgcctacatgtcacacagcttgggaggttgaaagttaaaactcaaatctccttctaactaatttcccatacatttctttttgtctgttttctgagagttcagcctgctgcttttgtgctcggtggaccccataacatcagcacttgagagctgacacggtaagaccagactttgtgggtctgacttctcccctctcatgcccactccagtcaaatctgacatggtctctgaggttcatggaagctctggaatggagactcgtgaagccagaaggtattggccagatctgtgctcaccggccctcagagaatggtcgattccctcactgtgctttcccatggtgggctggagggcagccgcacatccagaataacaaaaaggagatgttccaggctgactggggtgaatcccaaaacatcagcggccgtcttggcaaggggaaagctgacagcgctccaacttcaagctcatggacacaagatacgaaagtgacaaaagacaccacacctctgtagttttaactttcaatgcattctcaggacattcaaagtctaaaatggtcaaaatatctggaaatttcatgatttacaaggctttgtgtgatatggctttggcgggcttttacagtctcaccgtgaacaactctttctgactctcagctctgatcaaggcagcctccttttgattcctcaaatacaacagattcctccctgactgatggctttccaggctcagggctgctccccctgccatttatttgagtgagtgaaagtcactcagtcgtgttcgactctttgcaaccccatggcctatatagtccatggagttctccaggtcagaacactggagtgggttgccattccccttctccaggagatcttcccaacccagagattgaacccaggtctcctgcattgcaggtgattctttaccagctgagccacaagggaagcccaagaatactggacttatctctactagtcttttgggttggggacagcaacccactccagtattctggcctggagaattccatggactgtatggggtctcagagagttagatacaactgagcaactttcactttcactacttatcttttgagcttctttgttctgccatgtcagattaggtgagttcatcagactgggcagccacggggcactgatttacataggccgttcaaacatcaacggtgcattttcctatgaagagccagatagtaaatattttcagctctatgggtcgtatagtttctggtgcatctactcaatcctgctgctgtagtgtgaaagccagtacagataatacataaacgaacaggtgtagctgtgggttccaaaacaacctttttcaccaaaacaggtggcaggctggatttgacctgtgggccatagtttgctgacctttcctctaggacatcactgaaatatagaactttggaagcagttaactcaggtttacacagtaaactaacaaaacacacaaaccaatcttaatttcagaaatgttaatcatacgttgagtataaactgaagcaaatatttcttgctgggctgagcccacctgtgatgcatattttttaagagatgcaagctaagacagggcacagccaaataaattaatcaatttttttagaaagggggggaccttccaagtagtgtagtggctaagaccccttgctctcaatacaggagacctggatttagaccctggtcagggaattgaaccccacatgccacaactaagagttgaaatgtcacaacaaagatcatacaagacccagctaagacagggtgctgcccaataaataaatacatgttaaaaaaagatgcatattatcagcagtcagctgagatctggactcctaattcatggagtgaaatgggagcaaattattttcatatacacatattggatcatttaacatgtttcacaagatgctgtctcgggaaattgcaaaagaaaacttaagcgagaataagaactatggaaatgtagaaaacattttgcttaaagtatgcaagactatcaattctgcttgtcagtggaagtgaattaatggatggaactattttggtatacaattttaattaatctagcataagtttctcggaagtctggctacaggcaagccacaggttccatggctgtgccctctgtttgttccacccacctctctcaggcaagccaaattacaggctctgctgctatcagttttatttttggatacacagacctcccaccagcttccagtgtctgctggagcctagcaagaggcagacagaggaagttttcttcatgcttcagccattactgggacacttactatgggtcaggggacacaggtgaatgaaacactgagtctaccgatcaggatctccctgatcaggtaagtaggcaggtaacactcacacatggaatgcaattcaaaggaatcaaaatgacgcgcagcactgaagaatgcagccacatacgaggaccacctacgccgtgtagcgctgaaccgtgtgcatccttgtagtcagcttgcagccggagcctcgggctgtctggacacaggcagaggttacataggggcattgttgttgttgttactgttgagtcactaagccgtgtctgattcttttgctatcctgtggactgtagtcccgccaggctcctctgtccaagggacttcccaggcaaaatactggagtgggttgctattttcttctccaggggatcttccgcacccagagaccaaactcaaacctgcatcgccttcttggcaggcagattctttaccactgagcaatgggggaagccaatactggg

SEQ ID NO: 53711 - DNA, 683 bp, Bovine  19866880506679
caaagaaagcacggaataggagaacactttaggttccttgtaaacattaaaggtacttattccaaatggattttcttctaggaaagagatacactacctcttttttacttttccttttcccctttcacatttctactctattcacatccttcaaaggacaaatcagcaaaaccccaaaagagtcactgctatgagaataattgtgaacttgctgagtccttgcaatgttcgttatttaagttcttaagtgcagatagtcaaatgtccaggagcgtcgaatctcatgatcataaaaacctggtccatggaagccacatggcgcttagacctctgcgtctacttcggcataccctcttgataaatcgctgccctgttgtactccctgaacatttcacgacaaggtgaaatccagtcttgtttcaaatttacatttttcctgagcttgcatatttccatcacatttcctttgttgccagtgtaccaagtccttataccttcccactgcatttactgctgtttgaaatggtttctcagaaatgggacattaaaaatcctttgaaagctgttcaggcatgcttagtatcaatctaatctttttttttttttttttctcaaggtcttcaggtagaaaccctatataggggttgataattaagtataagtatccattaaaaagaaaccat

SEQ ID NO: 53712 - DNA, 4364 bp, Bovine  19866880519509
tcctgagtgttcttggaaggactgatgttgaagctgaaactccctactttggcccctgatgtgaagagctgactcattggaaaagaccctgatgctgggaaagattgaaggcagaaggagaagaggatgacagaggatgagatggttggatgtcttcaccgactcaatggacatgtgtttgggtaaactctgggagttggtaatggacagggaggcctggcgtgctgcagtccatggggccacaaagagtcggacacgactgagcgactgaactgaactgaactgaactttattaaatccaatcaacaatagaggtcatttttcattatttacaaattatgaaaatgacggctagaaaagttgtcacttatttaagatcaaacagctcactgattaataccaaaattacagctcagagcttctacctccctgtccattttcttttaaaaaatattaaccccaatgtgcttgtgtttgactttcccttcttcatcttcattgcacagatgcccaaagggaaattcagacaataagtctacatccttacaatgcaagcttaatgaactaaccagaagagtaatcccaccactgaaaagctaaattaacatcctaaaaccataactaaaaacattgcttcaatctgacaactgcacttgtcatttctatagagtgtgggctttttgcatatggaatatttcccttcaaagaaaattgagaacttctattgaattgtgccagacagagccatagctgtgttgaacattctaccgacattccttgaaaagcatgtgtcatcttggcatcttatttagatatatcttttaaagaagcagttgctgctatgctgtaagctaatggaaaggaactgcagtttctttttaaagtcatctgggcccccagagcagaacaacgattcaaatcatgactattcagcagccacttaagtgtatgacttccctctggcaaagttctgagttaagcccatggatcatattattctgagtcagttgatatctctccgaatgctactgcctgtgtttccacaactaaatttatagaggagtctttgcaatagtactataccaactcttgtatatcttcttgattatttctgttctctctttttgcccacattgtcaggtccagactatgagcagaaagccccaaagctaacaaatgcagaatgcattccattgactcaaaatgtgataacacagcagtatttctctagagaggattttccctcattaatccagctggatctttcactaaaaacccactaagagagtagttgaatgagggacacactgaattttctttcagtactttctaaagtcaactgatcacttctaaaatcagaacaccacccactctttgctgacaaaaaagtattatctttattagcacttaaccaaacaacctaaaaagcacgtgccctttgtaacaattgaaaagaagataagatgaagatttgaagtgatgataatgaagacacttcagttttgtgaactcagaagagaagtaataaatgagagagagagagaaaaaaaaagaaatggtgaagaaagttttggtgactatcagggaacaggaagtataatacaaaaacagtgtaatgcttccctggtggctcagaggttaaagcgtctgcctgcaatgcgggagacctgggatcgatccctgggttgggacgatccccaggagaaggaaatggcaacccactccagtattcttgcctggcgaatcccatggacagaggagcctggtgggctatagtccacggggtcgcagagagtcggacacgactgagcgacttcactttcatggccctgatacagccttgggcttccctgatatctctgttggtaaagaatctgcctgcaatgcaggagatcctggttcgattcctggcttggaaagctccactggagaagggatagactacccactccattattcttgggcttcccttatggctcagctggtaaagaatcctcctgcaacgcgggagacctgggtttgatccctaagttggaaagattcccctggagaagggaaaggatacccactccagtaattctggcctggggaattccatggactgtatagtccatggggtcgcaaagagtcagacatgactaagtgacgttcacttcacagtcttgagtcagatgtaccaaagttcactagttcattcgtttcttaattcacttgacaatggtagcatggcatactggttcaaagtgtagacactgtagccagagaactagaatcgaattccattccaccagagccaagctgtgaagcctttggcaagttccttaagctctctggcttcaggttactcatgtcaggcaggcatgataatgtgtctatttcattaagttgcaaagaggatttaatgagctgtagataagatgactaacactgtgcctggcacactgtgaacactaggtcagtgttacttttactgtcatttccccccatgcatctgcatattccaaccccacaagaagtgctgagtactggagagggaataagatagacgctgtgcctcattagatcatgataaatattatgatagaatggattagggggatgtgagagaaaagaatgaggctgtggagtgattttattcattgaatggtgaggaaacacctctctggaagaagtgtcattgaatctgaaagccaaagtttgaggggatgagggttagttaggggacttaagggagataaaacgcccagtcagagaaatgtcaggtgcccggcacaggttgaagatcttggctgcttctgaggaacagagctaaggctcctatggtcagagacaccgtcagggtggtgaagagtgagaaatgagcctggaggtgtgggcaagggctggaccaccaggacaggacctcttccagacaggctttattctcagaacagtgggagactactgaagaatgttatgcagagaaggaatataatcagatttttttttaagtgaacagactagttttttagagcagttttgcgctaagccacttcagtcgtggccgactctttgcgaccccatggactgtagcccatcaggctcctctctccatgggattgcccaggcaagagtactggagtgggttgccatggccttctccagggcgtcttccccacccagggatcaaacccgcatctcatgcatctgtattggcaagtgggttctttaccactagcaccacctgggagcccaatcaaaccaaagtaatcaaatcgaaccaaaacctcaccaaccagaaagtcaccttcaaagtcaatggcaaacggccccaaatgtgacctccaagtcctactagacctgtgacccttgtccgaagtgccttatatacagagtttcccttcacagaaagaacactccaaattggagccaaagccccacaaatggagctgaagctccccaagttggagccatagcccccaaaaggacaaggtcaaaaagcctctggtaggaccctgatgtcaagctgttctgggggaaggttacttgagtgtttaatttgcaaaggggagtggtatctgttagagcagtttctaggcttacagaaaaatcccacagaaagtacagcagattcctttaaatccctggttccctccttccccacactttcccctgctagtaacttcgtgcactatgcggtgcattttttataatctataaactactattgatcactatcatcactaaggtccaaagttcacatttcaattccctcattgtgtggaacagttctatgggttttaccaaggcctactgtcaggtttcataaatgacaatgtcacataggatcatgccaaatactttcaccactctgtacttgatttttaattggagggtaattgatttacagtgttgtattggtttctgccatacaacaacatgaattagccttaaggatacatatatcaccactctataatgtttttatttttaactgtacaagcttaaagtaggtggaaaatgtggttgaaacaagagtcttgataagaaacttattaagtggctgttgccacagtcttgacaaactcagaaaactctaactctagagtcaactgcagatggtgactgcagccatgaaattaaaagacgcttactccttggaagaaaagttatgagcaacctagatagcatattcaaaagcagagacattactttgccaacaaaggtccgtctagtcaaggctatggtttttcctgtggtcatgtatggatgttgagagttggactgtgaagaaagctgagtgccgaagaattgatgcttttgaactgtggtgtggagaagactctgagagtccctggactgcaaggagatccaaccagtccatt

SEQ ID NO: 53713 - DNA, 1274 bp, Bovine  19866880527494
tgactctttgtgaccccatggaccatagctcaccaggctcctctgtccatgggattctccaggcaagaataccggagtgggttgccatttcctcctccaggggatcttcctgatccagggatcaaacttctgtctcttctgtctcctgtattggcaggtcggttctttaccactagcaccacctgggaagcccagtggttggtttaagggtgataaataaggacaagaaggcgactcttgagctctctttcttcattctatctttaaagggagtcatctgaaacaaacaaggaaaagttaaatctgctaaatttgaacagtaggtgcattaacaacttttgtatttttctaactctaagcaacatgacctgaacgcaagcatttcctcaagtcgctgaccatcccctagatgaccatgttgctacaagtcctctctttgataaggaagattaatatcaccttctttagataacattttccaaagcacttatccttgcaatcctaatacatgcactttgttgatgtctaaattggtctttaatataaaactatattcctgtgtatggtgaaggggtaggcttcctctaatgcagttccgattatctcacttctaacgagtgagttcgcttggctaagaggaagagagcgggctgcgctggtgaactctaaagacttctgacccctttttacattcctccaggctctagtctgacaaattctcaaatttactgtaggataaggcactaggagaagaaaataaaagagaaccactggtgtaagacacatggattggtgttcggctgactacccgaaaaaaaaccaagactaacaagattaaaataacttcaacacttcatgtgaaagaggcacggatgagcactcattaaggcagcacagaaaagaacatagcagtttttggtacaagcagcctggtcttgggagccttgaccttgcataggaggaaagaaagaaaacaggtgggagcaagtcaagcctgtcccatcagtgtggagaacggacttctgcttttgataacagagtctctcttccctgaccccaaggcccatagcaaacacactcaggagcatgcatcaatccatccatccatcactctgcaccatgtcctgtgtgtggcctaacagatcgtaagatgattaaaccatcactgttgctctcaagtgcctggaagtctggctcaaaagactgatagaaaacaagaaagattaaggcaatataacctggtaaataaacaaagataatcgaaacctagattt

SEQ ID NO: 53714 - DNA, 1191 bp, Bovine  19866880562683
caaacccaatgagacagctatgcgtactgtccttatccctgcaggtgagaaacctggcgccaagatgttaaatgacattccctggtcactcagctattaggtggttgaactgaaattcatactcagacctgagtctaaagctgactctaaagtctgagtctaaagctccttctctgttcacaaacttcattgcttttcttgtacattctgtcttattaatatttaaaaatctaaatatacagggagctttaaggaattacactttttttcaataagcagaaaaaaataaatctccccacaaattcctgggataaaaatcatagacataaacatgcctttgtgaatgttacatggtcatacaaccactgtatttatcttatgattttaacctccacagagtctaatcagatatgtaactatcataaatatattcttaataattaagctattagtgctacttttgcaatctctcatttatagaatcgaatcattattaatgaatagttgagtattccatgtgattgtctaaaacaattgcaaaacaaacccattcattataatgattcagttggtgcatattaaagaaacatctacaacagtattttaactttcttgaaattaaccacgttgtcacagtatactgcaggaaatatccatcaagagacgaaagatagttttgtgagctacccatgtagcaaatcatgattgatttgctctctttctcacccatataagttttcaaagaatggggcaaaagtgtttcacataactcttagggtaaggaagtccctggtggtccagtggttaggactccacactttcactgccatgggccttggttcaatccctggttgggaaaccaggatccctcaagccttgcagcacaggcaaataaaggtcttagggtgagggtttctttgcaaagtgtctcatgaaatgaggataccttaaaggaggtgcgcttccatgatactcaaagaaacaacctcttgcatacatgctccttcaagagcatgaattagctgctgttacttcagactctttcaatccagactttgaggtctcagttccatcattagcagacatttttccaacagaataaactgcaaattctaagacacatgaagatcaacagaagtacaaagtatttgggctcagataggctccattgatagatgaggaaattgaagc

SEQ ID NO: 53715 - DNA, 3964 bp, Bovine  19866880569344
tgcaatacaggagaccctggttcatccctgggtggggaagatcccctgcagaagaaaatggcaacccactccagttttcttgcctggagaatcccatggacagaggagccttgtgggctacagttcatgggatcgtgagagtcggacacaacttagctacttaagactatttatatgacttggtgccagttacttaacttttctgtgtcttggattcagcatcagtcaggatttctcccagaggaaccagcgtgaacccttaaaagctgtgattgaggaagttcaaagagaagactgtttgcaaagatgcaggcagagctaaaggaccctcataaggaatggtgaagcatctcagagctagtgacagtacaagcattatcactctgagcctgggatggaggacaagcagaagagtcatttcacagagcttggagagctgttattgctgtagggaagagctgcctggagggagctgtaactttcaatggaagattgcagccaatccaagttctggcaggaaaagagttggagcaataaaaagccagatgtcatcctcctatcttccaatctccctgctggctcccatggactaaaagcctactggaatccagaaggcaaggagctcattgatgtagtccataaaagtcagtttcctagggtaagggtcagatggagatgggtggagaaaagatctgaaggggcaaatgaagactttgaagataagtttccttatctacaaattgggaattctaaccacctatcttatagagattgtcttggaggttagggggtataggtaataagttatgaataagatacaagtcttatttctccttgtcatctgctgctgaaccttaatccactgatgtctctttttaaagtaagttttttcattgattttcttttggatgtcattgttattcggtttgtcttaatctcccagaaatgtcgacatgacatgtttccctaatgccagatttttcaacacgagtttaactctggtgtttccttgaggttggcagtctttcctgctttatgatttatttttgatcataggtgaggcttgagaaaatatccaatttcaggatccttggaagattcttccttcttagtttcagccgcttgttgttattttcagggttatgttgccaggacttccctgctcctgactccaggcaagagccatgcttgctgccacctgggtttcatcatttcatgcttcatatctgcttctgggtttgttagataaagttaccttttcatgaatgggagaggagcggacctttccaaataaagcaatgggagatccgcgtccatgtgaggcaggcttggtgtaatgaagagaaactgtcagccttaggttctaatccctttccagcctcttacttgcagtataaccttgaaaaatcccttttcttgctctgagccctattttcttcatttgaaaaatgaaatttcattgcacttctctcactggttagatgtggagagataaaatgaaatatgtatgtatagaagactagacacattgcttggtacatagcaggcattcagcaattcctgtagacaaatcaaaatctctgaagtccagtggggatcctcaacttctgattatactggagcttaaaaggagctgacaggtactctgggcgtacaaatattgagtccccccaggtgaaaagtgtgctctttattctaattgacagtctttttgtctttgttgtaagcattactaaaatttttctcgtgggtgaattgagtccacagatatcaaatctacttcctaagattctatgatggtaagatgggagctggaaaaaacgacattaaaaattacgtaaaaatcctaataaatcatgcaaaaatccctattaaaatatttttggctgaattatttttcatttttatatccttcttgtgtgatataggacatgacgcttgccctgagtatttctggaatatcttgtcattcggtaagtctgagctccagaatcacttaggttaaaacagcagggaccctgtgtccaaactacagtcctgcccctgactttgaggaggtcgttcacacaaccttttgtgcctaaaaaatgaacatcactatgccctttatctcaagatttgtttacagattaggataacaatgtaaataaagttcaaagcagtgggtaaggaagagtgctcagcagtggtagcagttattgttgaaatacgtgcaacgtatttctgtgcaacgctacggactgtagcccgccaggctcctctgtccatgggactctccaggcaagaatactggggtgggttgccatttcctcctccaggggatctttcagatccagggattgaacctgcgtctcttacatctcctaccttggcagttgggttctttaccactagcgccatctgagaagcttattgttgacaagggactattatcaaatcaatgtagatctgggaaaaaggcttatggagtccgctacctttactttatgtctggggaaactggtgctgagaaaggagaaatgtaacacaccgaagaccaacccattatttcatagaaccgggtttcctgaggtccactgtaatttctcggcactaccatttcatacagaagtgccaccagtggacagacagcagtaagccacgtcatcaggagatgcaggacagtcttcagacttagatgccatctgttaagcactgcaaatttgtacaagtgccctgactgccaccaatgctcctgctcactactccccatcaagttccaaatagcctgaggattttgttgccatccgttgaaaaatgtcagcttttcatgatgcagtttcagaccaaattctgcaagaaatgttttcaccctcccttccatggcctctgagacgtaggtctggcacacagttgaaagataaattctatgttcccataaaaataaaggatttgcatcatggggaatggttaatgctcagttttttgtagaatatgctagaaattggagggacactgtgactatgctttcagtggtcaaataagatgtcttgaagaaaaaacaccaccaccaagaaggactctgctgctgctgctaagtcacgtcagttgtgtctgactctgtgcgaccccatagacggcagcccaccaagctcccccgtccctgggattctccaggccagaacactggagtgggttgccatttccttctccaagaaggactctaggagaaggtaaaagggagggtaaatcaagaatttcgtgaggacctacaagtggatcacacattttaccatgcttttaaaaaaaattattacttcattatgtttattttccactgaaagttctatgaggatatggctctatcttatattctcatccataattaacacagtgcctaaaactttggtcacctaatgtgaagagtcgactcattggaaaagatcctgatgctgggaaagattgaaggcaaaaggagaaaagagattcagaggatgggatggttaggcagcatcaccaactcaatggacgtgaatttgagcaaactctgggagacagtggaggacagaggagcctggcatgctgcagtccatggggtcgcaaacagttggacacaacttagccactgaacgataacaacaaagcatgattaaatgtttgttggggagtaaatgtgctagaagctctttacaagtgatctttccaaatcatttgtcacttcgtgaattagaaattatccccacattgtgaatgaaaacaccaagatttagagaagctaacggatgtgtgcattgcgtcagcgacagatctggaatcccaatccaggggccatgattcctgagtctgttctgtttccacggtgacctgctgcctgactctttatgggagacatctctacttgtggtgcacattactggcaggtgttcttttctgtagtgatttcctgtagatgaagggaaaggctctacctcagagaaccacaagg

SEQ ID NO: 53716 - DNA, 758 bp, Bovine  19866880620580
ggttatagttctggtttctgtttgcaatggggatttcatgggggaaaatatttcagcccagagctggacattttgagatggcagaggtgcagacacccacatagctcttcactgtcatcacagtttcccagcccggttcaggcaccatgccgtgtatgcagagaatctttcctacaagtcatatggcaccccacatgatgtaggacaaaagccacacattttcacttacaggaagaagaagttctgaagagcaagggaacagtatggtgattgcagctaacatggtattgtatacttgaaagttgattagatcttaagcattctcaccacaaaaaagagagcactatctatgtcaacgacgtgaagtggtggatttgtatttatcttgattttggtaattactctacaaagcatatgtatatcaaatcatcatatcatacactttatctcatgtgaagtgtcatatgcagattattcctttgtaagtacagaaagtaccaataagaaagctgatgactgcataaccttcatggagaaaaggataaagaaagatacgaatatccctcctgttggatcgtttaagtcttcctccaaaagtatggtctaatgggcactttttggttcaaagctctgtatgcctggaatgtgacttctgatatccctgggaagttggaataggaaaaccatatctccaaccccatttcacaggtcatgacaagctggtgaaggcaatcacatttctagataaatgtagatag

SEQ ID NO: 53717 - DNA, 1815 bp, Bovine  19866880622468
catcctaactttacaaataacatgctcgtgctcaatgtgtctgtcttgatcacccccatcttctcaattgagctggtaccaaaacataggggaaatgcaatatactttagtttaaaacactataatcaggtgaattaatgaaccgaagttgtggctctgagatcactgtgttttcttgtcaaaattcactaatggattctattggtcaaaattcttcacttcagcttatagaaatttaaattgaataaaaacttaaagatcatataattcaattccaaataagcaagctgaaatttcttcaaagataatttcctgggaggtatttctgtggtatttctaaactggctgcttcaaagagaattataaaataataagtattttgcccctaacctctggatttactaaatagagcatttattcttgaacctgccttttaactgagtaatacaagtcaggggcccatccatagaaaaggaaatttatgggcttatgaatcttcatttgcagttcttgagagtataatgatgacttctgatttagacattccccagagatgcagctgagctggtgctaaaaaacctcagctatttactaggatatcaatccctctcatcaggacattaattcctaggaatgttttagtctctcaattggtaatttccatcactcattccatgactagcaattaatattcattaagggtccatgctgctgctgctgctgctcctgctaagtcgcttcagtcgtgtccgactctgtacgacccaatggacggcagcccatcaggctcccccgtccttgggattctccaggcaagaacaatggagtgggttgccattatcttctccaatgcttgaaagtgaaaagtgaaagtgaagtcactcagtcgtgtccgactcttcgagaccccatggactgcagccgaccaggctcctctgtccatgggattttccaggcaagggcccataagacacctaattctcccgtgtactgggcatgtatctaccgggggtaagagaatttgatcaaagcaccaaatcttcctaggtcatcttattaaatagtctttttttttttttttcaatttaagcaagttgttttacactgcgacttgatacacacacacatttccacttcaagggtctaattgattcatcattgtgttacattattattcactaagtaatatattatttaattataatacatacaaatgagattattaaatattactcactaaataatataataacttatgagaaagtaatttataaattctgaagaataacatacatatttcataaaagttcttctaagagcataaacttgttcatcaaattcagaaatatgaggaaaagtgggccttcacttttctgatctgactgcgtcactctctgcttgagaattcttcaagggtaaccttggcattgtaggtgatacccaaatcatctttctgggcctgctcctgccccacccctcaccttgtacctttgagttcctgctcatcctctctcctcaacctaggcagcttttccacctaatgaacccttgtactttcctcaaggcctaacctgaagtcacactgttcacaggccttccctaccctgtactccaggtagaaggtattcctctctgtacacgttcatagcataacacatgcagtcttgggacagcccctctccatagtaacagacgtgtctcattcatcttgccatttcccagcccctcaaagaacggctactcacaatgcttgtcgcctcccatcttgcagcattataaccaacgagggcgtccttttccttccagaaatggtcc

SEQ ID NO: 53718 - DNA, 2845 bp, Bovine  19866880636851
tacctactgcgtgctgggtattgggcatagaatagatgaacgagacaaaatgtctgccctcagtttctatgcagaagataaacactgaacaaatattttcaagtgtggtaaagactatgcaggaagcttgcaggtaggagagaatcctacatgatccaatgcctcttcaaagaagtggcacttatgttaagacgtaaagaatgatggatggcggatggtgtgttccctgtaccaagtccttagggattcaggagcccaagtaaaccactgaggcggaaggcaaatagtgaaatgcagaatagtgaaaagtaagataaagacttttccaaattcaactttccactgcctagtcctaaacggggcctggcacataataaccctccctcaatactttggtgaatgatgtccttgaacatgatgtgctcttcacaagagttcataatctcacaaactgctacctgtttgtccatctggcaaacccccactcatctttgaaggtccattatctcttcagtggagaaggaaatggcaacccactccagtactcttgcctggaaaattccatggactgaggagcctggtagcctacagtccaggggtcagaaagagtcggacacgactgagcgacttcactcactcactatctcttcagtgagtcctgcacccaatatccactcccttccagggagttattcactcaccccactattctgccagaacatctattatttctttttcatatgtatattatatataaaatattatctaggcttccctggtggctcagacagtaaagaatctgcccacaatgcaggagacccgggttcgatccctgggttgggaagatcccctggagaatatattactgggttttaaaactttttatttttggctgtgctgggtctttgttgctgcacgggccactctctagttgcaatgtgcaggtttctcatttcagtggcttctcgctatggagcacaggctgtagtcgcacaggctccagtagttgcggctccccagctctagagcacaggctcaatagttgtggcacacaggcttagctggtccataggctgaggaatcctccccagatgatggatcaaaactgcatctcctgacttggcaggaagcttcttcaccactgagccaccagagaagcctgatctctgtcctctctgaggtcaagaccaagagttcacagacttgcctgaaaagcaagaatccttgtggagtttattgaagaaacaaatgcccagggccactgaatcataatggatagggtgaagaccaacatctttactggcctgacatcagttggtggactggtgtggatcagcttttggaaaccatttttctggaccgcagatctgagtacaagattactcactgccttgtaatacccactgccctgcaatgaatctttaaatgtgtgaagagtagaattctgcccctttgtgtgtttacttaatgaagatttattgggcatctgctgtttctgggcatcacactaggtgatggcagtacagagatgagtaagcacaggatctatctcaaagagatctcaggtacttcctccagggcagaagacagggccatgactcagggaggcaagcagctggacgtgggatgaagcagcatgttcagctggtactaaaacaccctgaagcttttacgagcacagtcagccaggcaaacaggtaggaccaggatgagcaggctgccatgcttctaaccattcttgttcatgcacagaacttttccccacttcaaggcttccttgagggtcaacataatccaagtttgcctgtagaaaactctcttcagagatgaccaaacattgtgttctctgacgtctttacccaccgatggattgtctcgcccagagaagagtcaatattctaaccaactatatattaagcacttacattcgaggttactgtcctaagcagttccccccattctccaagagcatctatttgagagaagcattagtattttacccctgttgtctcccttactgctacatctgccactgtgcctacctaactcagttcctccagccctatgcccaccatcacctatgtctaacctggcaccagctaatgcagacatctgatacctgagaacaagtttgccaacattacacttaaacccactgtattcctttcctattgctcctgtaaaaaatgttaccgcaagctcagcagttcaaagcaacataaatttccaagtatacctgtttttattgtgctttgctttattacaacaacaattggttcctcaactctgcttcctgacctggtgctgtctctccaattgcctgtattcccttaccatcttaatattttcatgctttttatcatacttcaaggcccagccaattgccttgtcattgaagtatggatggaaatcgccagccgtaaccagtgcttccctcctgcctcttcttgggacatctgcacattcttcctaggaacatattgtacagagttcttaatcttcacagctttgtaagctgctaagagaaatggataaagaagatgtaaaacatttatacactggactattacttagctataaaaagaatggaataatgccattagcactggcatggatggacctagagattgttgttctaagtgaagtaactcagacagagaaagacaaatgccatatgacatcatgtatatgtggactctaaaaaggaatctatttacaaaagagaaatagagtcactgatatagaaaacaaacttatgggtgccaaggggggagaaggaggaaaggtaaatcgggagatagggattgacatatgctcactaaaatatatagccaataagaaccta

SEQ ID NO: 53719 - DNA, 1920 bp, Bovine  19866880680945
attttccttaggtttctcatctaattggcctttcacagtgtgattatatatgtagtcctgtttatctccttgccttggccagctttctttactttcacacccattgcagaaaactttgcttttccttaaggattttattttttaccctgattgcctgcatttaatttacatcttctcctccagtttcaaaggtttgctgaggctgtgacttcacctccttagcagtgatcactttcttctttgaagctgagttttcattggaacagagatgctgtgtcttttggctctctctcctcatccgcactgtcaggagatgagggcaaaccacagtcaccctaaggatttcatgggataaagctgatactttctggatataagaagatagtccacttccctgctgtgacttggaacaggagagaatgttgcttctcagtctgtgcaaaagctttagaaagctttaaaggctctggtccttaagaagtgctctgttgtgggaatgtttggggcataagagggtacatgtacattcccacaagtcacctgtgagaggcaggcagctggctgtcttttattgttgatcccctcaatctcgaaacataacttccctcctcagctgggcctgccctgatcacatttggagtttacagtacaggatttgttttgcatcctgttcctcgtccttggagagaactccctttgatgacagtgccagcaactaattgtgagtggaaccaattgtatgggaggataaagtccatggaggccagaggtccacagcgtcctgaagagaagggaggtgccacgagaggatgtgattccagggaacattcccaacttcctttccttgagaattcttcatgtaggatgtccaactctcccactggaactactgaaccttacgtttggaaggaccataaaaacctccaagctctttcagaatgtaaattccttgggcaattgctgcagaaaagaagcagcttagaatcagatcatcaggaggcagaatctgagctctgcctctgactgccttgcttcagctaatataagcccatgctggaaaacatttattgaacacatactatgggaaaggcactgggatgagtgctgtgtcctcaacagcttattttatcttggtaacaattttatgagtgggtattactcttattatgggcttcccaggtggcgcagtataaaggatctgcctgcaatgtgggtgacccaggttcaatcctgggttgggaagatcccctggagaaaggaatggcaactcactccagtatttttgcctggagaattccatggacagaggagcctggtggactacggtccacggggctgcaaagagtcaaacatgacacatgttattcttattacgggcttcccaggtagagcagtggtaaagaatctgcctgccaatgcaggagataaaagatactggggttctaatccctgggtcaggaagatcccctggaggaggatagcaacccactccaatattcttgcctggaaaattccatgaatagaggaacttggtgggctacagtccatggggttgcaaagagtcggatgtgactgaacacacacatacatacgtatatcacaacatacatcactcttatgttttaaaaaatagaatgaaaatacaccaggtcgggcatgtctcctaaggttacagaattactaaagaaaagaatcatgtcttagggaaaggtgttgtaagttcatgtgctgaacaaatacaaaatactctaaataactacacctcgccaacccttatttcttcatttggaaaatgaagctgataatcctgcttatggattaataggattaaataaaattgtggcccggatgatgaaagtgaccagctagttacctagaacataggttttcaacttgattgctaatgctcttctctctctt

SEQ ID NO: 53720 - DNA, 1864 bp, Bovine  19866880696033
ccttttgttggaagaagatgccatctaggactttcatagctaaagaggagaaatcagtgcttgactacagactttcaaaggacaggatgactgtcccgttaggggctagcacagctggtgatttatgttaagccagtgctcatttgtgtgtgttctcggctgctcagttctgtctgactctttgtgaccccacgaattgtagcccaccaggctcctctgttcatgggatctccaggcaagagtaacggagtgggttgcattcccttctccaggggatcctcccaacccaggaatcaacctgagtctccttcattgcaggcagattttttaccatctgagctaccatggaagccttgcatatttgcatatgtaggatatgtaattatgcataattaaatagaaaagatacagtattttatatgtttaatttgctctctttcaataaaacttttgttagtaatgtgtatttatttgtgatatgggcttcccaggtaactcagtggtaaagaatccacctaccaatgcagcagatgcaggagacatgggttcgacccttgggttggaaagagtgacaacccactccagtgttcttgcctggaaaaccgcatggacagaagagcctggcgagccacagtccatggggtcacaaaagagttggacatggctacgcacgcacaacccaatccaatccgtttgtggtaatgatttgcttttgtattcacaattttgcatgaattttagcgccttccttttccctagtgtcttccttttctcaggtgttatccatcgattttattattgagtttgtcctgtgacgctgtttaacttagctgatgccctcttcttttccccggcatctggattgaaataatacttttaccccaaatactgtaaaagactatcagcaagcttaacctacattctgtacatgctcccgtctcctctcattttctggtagttgtactgtatctatcttgccagaacatgaagtccatacatgttctactgtctcatttaattacgtagtcttacatctacaagcatgtgtgtgtatattgtgtatgtgtgtgcagatacacacatgtatgtgaagtgaagttgctcagtcgtgtccaactctttgcgaccccatggactgtagcctactaggctcctccgtccgtgggattttccaggcaagagtgctggagtggattgccatttccttctccaggggatcttcccgacccaggaatcgaacccgggtctcccgcattgcaggcagacactttaccatctgagccaccagggaagcccacacacatgtatacatgtacacaaatgtactatatgtgcatatatacacacatacatacccatatactatctcttgaatccatgcattaaggacccatctctcatttcctgagctctgtctttagctgcatagaagtgtactgatattaatttggagagtaaaactgaaattttttttctgttttcagaattttcttctctctgtcatattgcccagatagcacattccattcctgtccactaaatctcagggaattccttctaaccaactggggtatgaccccctttcttatattcttccttcatttagctgaaatcccctattgccttatttaaaaaacccaaagaaagtcctttgttttctcacatttgttgttcaaggtatcctatttcttgcatttttgtctgtaaagctagataacttttggattgcacaaggatatccgacttttgcacaattactggttaaatttagtcacggccgttgtaattgctaaccgttaaacaaaatcatgattgtggcatcggaaactataaaggttgtgagagggaaagagaattaagtaat

SEQ ID NO: 53721 - DNA, 1515 bp, Bovine  19866880740676
acaatgggggaactattgtaagtggaaatactgccttgataaaaaatgttcagaataggtctagaatcatgaaagaatcaagccaatgtaggtatttactatctgctgctgctaagtcacttcagccgtgtccaactctgtgcaaccccatagatggcagcccaccagggctcccctgtccctgggattctccaggcaagaacactggagtgggttgccatttccttctccaatgcatggaagtgaagtcgctcagtcgtgtccgactcttagcgaccccatgaactgcagcctaccagtctcctccatccgtgggattttccaggcaagagtactggagtggggtgcattgccttctccgatttatctatcacaacccataacttgtaagcaggttttacccatccaaggatcatgtccttgataaataatgaagtcaatacatggaagcttgagcatcacagttaccctgggcccctgatgctctcctcctggctttacacctgtactgtcctgtcctacttatgtgttcacccttggcattcgcttgtgatttctgaaactcttttgctctttgggtttgcacattgattttgatttttacaaattgacccttgctgttttctgtgcctaaaactgcaattttctctgcaactctcttcactgcccagtcactttgtctagggtcctgtcctttatttttagcctaccacatctaaaactcgaaagagattcagatagtcattgtgctgagcatatatggggcattcaatacgtagatattgattggcatattggctgcagattggaatcatggtaatcagtggaagcctaataataaattaatgcaacaaggtcattggagtgaccctcagaaaactatttgcttgctgcatcattgattacagaggggaattataaccgccccagggtagctgtgaagggctaattcacgtaatactgtcacagttctctgactttcctgctcatcgacaatattcaatcaaaattcttgctgcactacatgctgatgccaacaagacctctgagttgtcacagagctctcctgtgaatacagagaactcggttacctggcgtccatcactacttaagtgacctacaaacagatggaacttaacatgtccagggtacaacttattaccatatcctaaccatttctcctgtgtttcctaactcctgtcagaaacctgggtatcatctttgatacttcccaacactcacctaccacattcaatcgatctccaagacctgcctgtcttatcaactagtctctttagaatttgcctacttctctccctatccactcagttttcttagaatgcatagtttctagtctataattaacacacaagacttccaactgacatgcttgttttttaacttgattgcttcatccccacccatgcattctccatcctatatgcattccaggaggtctttctaaattttatacttgatcatgtcactttcctgctaaaaattctcacatcgttc

SEQ ID NO: 53722 - DNA, 3157 bp, Bovine  19866880813062
ttcttttccttataggatattgcaaaatattgagagtatagtttcctatacttattggttatctgttttatatatagtagtatatatatgttaataccaacctcttaacttatccctcccccctttccccattaataaccacaagtttgttttctatgtctatgaatctctttctgttttataaataagttcatttgcatcataacaaagtatctgagaccaaaacttaagagctttatacaagcagttcctcaaagagcttgtcttggtctgttctggctgctgtaagacaataccagagactagatggcttatacccaacagaagtttattccttacatttctggaggctggggagtctaagatcaagatctggtgtttgatgagggtcaacttcctgcttcatggacagctgtcttgtcactgagctctcacatggccaaaggggtaagggagatctctggggtctcctctataagggcactaatccattcatgggggctctacatcattacctagtcacctctgaaaggcccccacctcctaacaccactgagaagcaaatactgtgctccttgctttatgactgttcttgtttcatcttcatagacctcctggaggacaaaaaaatttctctgattctcagaaaggtaaagcaatcttccctgagtcacacagctgggattaagaactcattaaagttgcaatgggaagctgttaaaatgcacagggagctcagcttggtgctctgtgatgacatagaggatgggatgagggtggtgggagggaaattcaagagggaagggaagatatgtagacacatagtggatttactttgttgtacagcagaaactaacatgacacagtaaagcaattatagtccaatgaaacaataataactaaaaaataaagctgcatttgtctgattgaaaagctctttggctcttttggcccaaccttgccagaggacctgggactatagccatcctcctggacactgtgtactgaaggctaaggtaggatttgccagcctgggaggggtgatggacattccaggcagagcagtttcagactatggaagtcaaagaagccaggaagtatgggatctttaaggggaatgactttctggtctttctctgtggctggagactagagtctgttggtgaggggtatagggaggggaggggatacctggaaagaagcgagaggaagaaaaccatgcaggcagtctatttgcaaagggctttgcatctgccatggtatccttcttgtgctaagaaggctccagtctcaggatttttgtttgttttgttttgatagttaatttactatacatttctcctaacacttaacataccagtgaatatcatgaacaccaagaggtcaatgaggcaagaattcagtgcaatagaaggaaaggtaccccggatttgatttcataggatgtagccttgtgtcttgacccatggtttagacctgagtgaactttggactgcaatttaaccccgtggtggtttcatttcatcatttgtgaagtggaaacaagcttaagtcctattaatagagtcagggtttcaaatagcatcatagataggaatctgccttgcaaactaaaaagtgttggagcaacaagcattcccagcctttggcatagcggtagctgatggtgtcaaaggcaatgaacttctccttggctggatttctaccagaagaagaatacaaatggctttgtgtttcatcatatttttttgttgcaactgttttgtaaaagttctcttttgcttctcgggccagcattagattgccttgtgcattctttgaaggaagcccagcccaggagtcactctggtccttgtgcagcggagtcactgagatggagagataatgtgagcttgtgtgtgcctcaccctgtcctgtgagggaggtgtgagaacgctcactgtgacacatgggctcatgggtccggagactgaggctcagacatgaagtgatgtacccacacatggcgagcatgtcccagagccagacgccagcccaagatttgtatgcctcttcttttcactggtttatgttgccttcaataaaagctcctctgagcaaataggtaggactgtcagttaagttcaagccagagttgaggcggaagtatgcccaagggtgatgaacgccttgtcggacactttgctgtggcttttaccagtcagcagccagaagaaaacccacccagagccagctgaaatcagcctgggccgtaatgagccaacacctattagggtgagaaagcctctgttgttggctccagttgacatcaagagaacaagtcaggaatgaggaaccaggaaaccactgggagaagattttgccacctggaccgtttcctggaatataatagttaaataaggcaagccctgataactcttacagatctgtgtgtgtgtgcgtgtgtgtatcgttttaaaggaagcctattcaagcatatcagactcaagacttaagtgaagggtgccttcagttttggggagaccatccttgtggacagcagccatctcctctcttggaggcgtctgcaggtagcccacctgtccagcaggaatactctgtcaagatgcattagtgtcatctggaagaacgctgcctgtggctccctccccagattagaaagagggaagctgaacacctccagggtatcttgggaatgacatttaaaaatccacagctgtcctgggtgatcctggtgcctgagcgcatttggagcacacattatttatgtcagcaatctctgtcagtgctacatctggggatgaagaatcaaaccccgacaaatttaattaaggctcatcacatagatgaaattgagatgctagacgaggcaatttgtaatggttagaaaatgcctttctaagtcccacctaatgcattggcttctcagcatctcccagaaaatgctctcaccagatacgccccagagagagggcaccttttagaggttcagggaccacataaagcttggtgatggatgttttcctcggggcgattatggttctttagtctaatagctcccctattcataccatattaagggcttaataagaactgaaaaggtgctggtagctctaaaagctgacgcaaatgcaagggctctgtagaaaacataata

SEQ ID NO: 53723 - DNA, 2986 bp, Bovine  19866880826967
ctttatggcaaacagatggggaaacaatgggaacagtgacagactttatgttttggggctccaaaatcactgcagatggtgatagcagccatgaaattaaaagacacttgctccttgaaagaaaagttatgaccaacctagacagcatattaaaaagcagagacgtgtctttgccaacaaaggtccgtctagtcaaagctatggtttttccagtagccatatatggatatgagagttggaccataaagaaagttgagtgctaaagaattgatgcttttgaattgtggtgttggagaagactcttgagagtcccttggactgcaaggagatccaagcagtccatcctaaaggaaatcagtcctgaatattcattggaagaactgatgctgaagctgaagctccagtactttggccacctgatgtgaggaattgactcattggaaaagaccctgatgctgggaaaaattaaagataggagacagaggatgagatggttggatggcaccaccaactcgatggacatgagtttgagtaggcttcatgagttggtgatggacaggaggcctggcttgctgcagtccatggggtcacaaaccgttgggcacgactgagcgactgaactgaactgattgatatttatggacacccatacatatcatctttattaaaactaaaattaattccacgagttcagttgtgctgttaaatttacattttgaattttaaaaactaataaggggaaaagtatatcaatttttgcaaacagccatgaagaaatgaatgcatgaatgaacaactgctgcccaaaaatggcgatcacaaatgagacccctgttgccacctggtggcagcataccctaattgaagaattagtttttgagtgaaatcgagaagcctaaatgtcagagacagaattctatcacatcacatgagataacataagtgaaatattagaggatcagaaacctatgtgatttaagttaaaacttatttttcattttctatctcaagtgaggaggagaaatgcaactctctggtctagggtacaaggctagttttccttaagctatattaagagtgttcacctaatgagccacagagccattttacctataaggtggccccaggcctattcagctgccctactaactaaaaagttttattatgtcctttctatgggcctcatgtagagaaaataactgttacaccagcagtcctttctagggataactcctcttgaccctttgaaaatttctgtcgttctatggattcctgcacatacttatttttaaaaggtcattttattaaactaagcccattatccatgccacaattcaaaccaatcacatcgttatctcttgagaaaaaaacaggcatcactatttttattaaagcttcccagtggttccaatgtgcagccaatgttgagaatcactgaactgtagtaagggaagattgaaacatgggccatggaaaaatgatgctactgttcaaaattaagcaaatctgcagcaaagctaaatataaaattcaagtgtgtatgaaaaaatatgcaacaaaaatccacaatgtcattggtaactgccctccaaaatgcttccaaacctctgaatagtaaactatcattgatagacaactttctgtacaggtgttttctatatacatttaatcttcacccaaatgagaggtacactttattatccctgtgttccttgccaggtggcacaatggtaaaaaatctgcctgccaatgcagtaaacacagattttatccctgggtcaagaagatcccctggagaaggaaatggcaacccatttctctattcttgcctggaaaattccatggacagaggagcctggtggctatagtccatgaggttgcaaagaatctgacacaactgagcacacacaaacacacacgtgctacttacagtttcaaaaactaaagcagaagtagatttattaacacaagatcatgcatgttgtaaatagcatagcatggattttgaacttaagactgactccaaatcccatgggtgattccatgctatcttgttgattttgaattaagaaacagaatagccagcagacttccaagggtctcctttgattcattaagcttcttcctgagcctcagaccactagagccaaagctttaacaggtttagagacagagacttggctcagtaattcatctgagctcccctggatcactctccctccttaccaaataactgagttaagggaactctagttcaaatgcaaagaaggcagtggtaccagctgattaggagatgaatcaaagacagacttttttcagtgggaaactctggtgggcttcccaggtggcactactggtaaagaacccacctgccagtgcaggagacataacagccacaggttcgattcctgggtcagtaagatcccctggagaagggaatggcaccccgctccagtattcctgcctggagaaccccatggatagaggaaccaggtaggccatggttcatagggtcacggttagacacgactgaagcgacttagcacccacacaggcatagatgagctggcatgtgctctaataaaatgatggaaggtagggctccagaacagcaagcatttatctcattttataagcaaatatttgtgtggattctctcaactgtgccctccatgaaggcagagacaggatctgggtcttcagtgttgcccaccacaccaggcccaagggtaccactcggcaagtgcttgttgactgaacacaagcctgtggaaagtaaattgagagtcaagtggttagaaggaagattaccacttcctagctgtgagaacatcatcaagttacataaccacgttccactcagttttcacatcagcaagctgagcttacgcctaactggggccaataaatgcccttgaaagcaataggagatatttgagttaatttttagtgaaaaacaggttaaagtattttcatcctcagatac

SEQ ID NO: 53724 - DNA, 1741 bp, Bovine  19866880829322
acgcctttgctgggtatcagttcccccttaactaccctatccagtacccacttaagaaggattagtggataatcagttgagtggaggcagatgatgtcagaaggaggatcatggacctgctaatggtatacttcatgatatttccttggtgcatttgatatttctcaaaaaaattcatttgtggcagtatcacatggaagagagggcacttaggttagaatcctaagtccatggtgtgccgcactcaccctagaacctagggcacgagtgaaacccagcttcagctacaggaaactgaggcctgcgagagatgtgtcatgacaggggccctgtcggtctgttgttcatcggggtatcctcaatactgagtacatgctggacacagtgagtctttaattaatagttgctgaataaactgaggcttgtgaaaagtactcagaattgaaagggtactaggagttgcagtgggactatttagaagctattttcaaaataagaataaagaaggaagaggcttattgctcagggcagaaaacaatgttaacggagaagagaaaggagacattgctgagtaagttttgtaaaatatatcatctctgtcagggataatgatcttccagctggaaaggacagacatggagaggaggatacatgaggaaatgctatggaagcacagaggtcgagatgcagaaacaaaataagtaggtccccccagggcagaagcagacctttattaaaggcacatcaggcactgtgttaggggttttagatatgcagttgaattcctttctcacagcagctctggaagacatatattatatccattttacaggtaaagaaactataggaagaaaataaatcatttgctcaaggtcaccaccttgaataaacgacttttaatacagagaagatttgaatacacagttgtaactctaagtaatcttccaggaactacagaggacaattccagagaactgaagatgggcaaattattcaaagttaaataggaagaaaatataagtggtagaatttccatctaaactttatgtctgtccccaagaaaaccctacagctgaaaatgtgtacatataaaaaaattacatatatatgtgtgtgtgtgtatgttagtcgttcagttgtgtctgactgtttgtgactccatggactgtagcctgccaggatcctctgtccgtagaattctccaggcaagaatcctggagtgggtagcctttcccttttccaggggatcttcctgacccctggaaggaaggggtcaggatcaaacttgtgactcctgcattgaaggcagattctttaccatctgagccaccagggaagcccatgtttatatatacaaatgtgtatgtgtatatatgtataatattttttttccagaacttggaagcagtgatcaccagaaactggcatggtttacctaaggatatgagaggtgatgatatattaccttgttttcctttctggcaggattgctaggccagcaaagcatcaagtgctctgacaccatgtgtgtcaggctcagcatgggacttggaagtttccttcctcatattttggaagaaaaacctgagaaatgagagctggacgatagtaattttcttctttaggccataccacgaggcttgtgggatcttggttctctgaccaaggatcaaacccacccacaccctcggcagtgaagacatggagtcctaaccacggacagccaaggaattccgacaga

SEQ ID NO: 53725 - DNA, 4159 bp, Bovine  19866880833009
tacttttgatgaattagtcctctgatctttaactatggaaacagcatatgtgtggctgaattagaagctctcagacctgctctacaggagccatagagactgggttactagtggagaatgaataattccccaaagtgttcatggggagcagaggacttgaaagaggtattggacctcctagtgctaggtcccgtttactctcagtgtgatctttgcagtcaatgaacactgtgtaagcgatggggctagagaattaagtataaacctaaccacactgcagtgcaacagccttttcgcctaaatacacttccccaactaaactcaaaaccttggtggtcccatatgactaatgtccaggccctaattctctctgaatccctagaacagaaatagttatctggcacgtggcctgggctaactatttgttacttgctgatggaatcaatgaacgccttttacaatagttatggtggcaaacagtgtcctttttaggtcaacaataatcgcctttaaggggcttcccaggtggagccagtggtagagaatacacctaccaatgccagggacacagacacatgggtttgagctctgggtagggaagatccctgcagaaggaaatggaaagctgctccagtattcttcctgaaaatgtccatggacaaaggagcctggtggactaccatgggctataggccacggggctgcaaagagtcggacacgactgagcaaatacagacaagagcctttaacattgaagaaagcagctcacctacatgctgctctgcctctcatccgtgcaatccacatgcaactgagagaacccacacggggccatgtcaaaggacatctgaaacgccaggctcacctcacctactctttggaaacaactgccgaaaacattctgtgagcatgctttcacaaacacacactcacacacacttttcccacagaaatagtgagcaccttaactacaaattcatcctcaggattaggaggaggcatttagtttcccaaagaggaatagtcttagaagtattctgatctggttctgggaatcatacattaatgcaaagatttaaatcgtgattttctaagtaatattccagtaatgataactatttaaaattaatgaaaagaataatgtgttagtcactcagccatgcccaactctttgcaacccaatggactgtagcccaacaggctcctctgtccattgaattccccaggtaagaatactggagtgggtttctattcccttctccaggggatcttcacacccatggatcaaatcaaggtctcctgcattgcaggcaaactccttaccatctgagccaccaggggccctttctgactggctcatgcttgctcacagactccccttacttggcatttactctgaacatataaaaatatacagattcccaatccttatctcttgacatcatcctaaatctgtcccagtaagtctacgccctgggtttctctatttttataaacttcagagtgattccagttccagggatgagaaccattcacttgaatcacctcacccctttccattcctaacagtcaatgagtgagaagctgtgacaggtgagaaggctgtaacaatctatcagcccacagatcttgaggggcctggtgtgactcctggaaagttgcaccacccgccaaccccttaaatgtccatgtgaaagctgcaagccaggtatgagaggatacccatcccagctatatgtcagctcctcagtcaagagtatactttactgggatcccctgaacagacttcacagattttctcaggctccttgcatgagtctgatgagaccacatgtcagtcacaatccatgctccgtgtttctccagtccctggagctaagccaatcatctagaggcatcagctcatcgtagaagattctaccccttgttcccaggttctttccttattgaaacctcaaacgccatttcatctagacctatgatctgaaccttcccctttgcaaaaagtccagagccacgaaatgacattgaaactttgtcacctgggtgtgtgtaaggacctggggtaagtaccactacaagatgaaccaatcaccctgtaatcttctttagcaccccacatcaataggagtcaatcattatttgtgcaacttttctctgatagcacctaacaccactgtaatctgacaaacacttgtatgtgtggcctggtgcgctgcagtcaatggggtcacagagttggacacgactgagcgactgaactgaaccgtgtaatttcttacccaataagcctcctccagaaaactagcgttattatcatagagacttggacttgttttgctcactcacatccccagcacctagcacagagcctagcacacagtgctcagggaagtcgcactcattaatacaggagaatgggtcttcttatggttgcacaggatgctactttcctgcccactaagaaatttctctttcagaatcagtttgtgactatattgctcataccaaccatggggattctgaattccctcacgaggttcagaggattaagtaaccataagatgcacaaggaagctcaggaagttgtaggtatcctgccatgttgaagtctcaagtcaacaaccaacagacacaggctgtctatactagttgaggagaagggtgatggacaactctacaagacccctgttctgctcctctgatacctaccaccctagataccgcaggcaagtacgcactgcagattaaatgccctgcttctgacagagaagaggcatcagaagcctgtattctgaagggtattgactgggacttgaggaaatagcagaggaagggacatacagcggaatgggtaaaaggagagaaaaatcttaagggagaaagacaagtgagtccaaatgtgtttaaccagtcagtcaaggtatatttttatcctgacttacgaagtactccttctaccaataagctgaagcatctttcttaaaccctcacctaatatttgagcaacataatggggattaaatcaatttttcatattttatagagccaaagaagctacaatgagtttgtaagaatccagaatgattcaaattatcagaggttttggagatgggatggatcttccagaaatcttcccattcaaatgcttgactttggataacgcttaatttcccccattttatagataacacaagctagttctaggactgagattcggtgagaaaggtgtgaagggcctcaaaagagcataacctggtccattatacacagcatttggcaaaactatgcttatgactcagataagctaggaccttatccaagtaacccagagattcccagactcatcaaaatttatttcaaaaactttttaataactgatttctataagccagtttctgttcaaaaacctttaatcctcacaacaagctggtgaagtaaatacaatcagtattttgattttactagcaaaaaaaaaaaaagtacagagaggtcaagtatgtttcttgaaattgcacaactaaaaagcagccaaccaattcttaaaattggcaataaaaaagataatccaggagatctccctcatatggaaggaggctttaccaacagccctcctccaaactcacattgctccgagagaacaggttggttttagcccctatgagatattgtatcagagaccatttgtttatttcaatgacctctttttagatccagagacccaaacccttagaacttacactatggtcattgggtaattccaataagaaatgtgattgtggggtgtcaaccacgacccaaaggaatctgacggacctccactgtatacccctacctactaattaaggtttggaaagatgctttcccaaaagttcaactccagcccacacggaagggcccttaccccgtaatactctcgccctccacagcacccaagttaccaaggcatggctcctggattcaccactctcaagttaagttgtggaataaaataggagaagatacctgatatatctgcgagcctctggaagacttctggtatctattcaggactacagataagtgtcattctgatgaatatccaaaaagttaagctcctggggataagctttcttgggacggtgcctgtgttcagtctgagctacttcattgtctctct

SEQ ID NO: 53726 - DNA, 1890 bp, Bovine  19866880833588
tactatactaatatttggaaaaatatatttttcagtcactcatccattcatttaaatttgcctaccaagtgccaagtagctacaaactgttagaaaaaaagaatcaaataagtctaagccactgtcccaaagaagactacatagcttgatgtgaaagaacatggaagccaaatgaaataatttgattattaataagattaatagagaaggtctgccatcttcaaccttatgtccacctacgcatcaagagctgtaatcagtaatggacatctgccttccccatcacagatgaacagtgcatgccttgggctaaggccaatccttcaccttgtgtagcggatcatctctctcacctacccaagggcaacactctctcttttatcatcaaattttcctctctgttggattactctgtccaatgcacaatcatgttattcttccttccaaattaaaacacacacatgaaaaccacagaaaaactctcttaacctacccttgctctcctgttaactcatattcctctgatccctttcacagcaaactccaaaaagatatttatttaatctttctctcattttctcttacactcactcctaataggcttttggtccattttgaaaccaccttgtcaaagtgatcagtgggtttcgtgttgccaaattcaaggatcaattctcagtctccatctaacttgatctgttgacacgcgcctcacaagatccaaagataaatgatgctatagttgttctgctccagctgtcagactatttcctttcaagaactgaaatctgcctacttgaagtctgcaaaaactggtccctgctccgacttttggaacaccactgaaaaagcttatcctctctttcaggcaggtttttccactgtttgagagagtcccgtgtcctgcacaagcacaccttttccctaaacgtcacatgtattcagtgggtttctgacaattagtagagtcaatcatgacctgaaggcaaaaaggaactatttatcacttcagttgttcaaacaacagatgtttcttgagtgtcctgttttaggcacaattttatacaatgggggtatggcagagagcaaaacagacatatcacctgccctcagggaacccacatagtaaattctattgaaaaatgattgtgatactctaggccagtgatccccaacctttttggcaccagggactggtttcatggaagacaatgcttccacagaccagggtgggagtggtttggggatgattcaagagcatggcaattattgtgcactttatttctattattattaattatgtcagctccacctctgatcatcaggcattagaatccagaggtttgaggactccttcatttttctcatgttttatacatattaatgcctacatttagtgggataatgctctgaattatgatctagcacattttttcatctccaaaattcccttttgccttccattctgcatttcccagccagagactgtagcaagatgacagaaaataatccagaaggaacaaccagtcaagttgatgactttgagttccaaagaagattatttttagcctgtagcaaaaacaatggtcatgaaaaatgagctgcaactaagcatctggtaaagtttcccaaattctaggttttaaatcataagagaaacatctgtaggacttagaacatggagtctatataataaacttaaaataggaagtggtagagtgagcaattacagaaattctaagccccatcccactgatgttgggcaagactgaaggagaaggggacaacagaggataagatggttggatggcatcaccgactcgatggacatgagtttgaggaagctccaggagttggtgatggacaaggaagccctggcgtgcctgcagt

SEQ ID NO: 53727 - DNA, 2041 bp, Bovine  19866880863946
cctgtttccttttttttttttcctttttgtaaactgcaggagtttcttggatcacttgattactttatggggtaatgaaaaaaaaaatcaatcctaccttgaggcaatcagctgcctcttcaagcaattagctttatgcataactttcaaggaactcctcattgtcccttctgaactgctgtgggaaaagattggaaagagatagccaaaagccaacaattcagggtgaggcacctggacaccctcctcagctcacagaaaggttaatgagttgcattgtggggacaaagagaactttgacaagagagagtctggcagttgtcataaggcaggaaatgtgaccattatcaatccagagctggttgtgcaaacacaatctatatgtttatataccttctcccagcttgtggacattgtttaaatgggaggggaagaaagtgtggggaggaaatcctcttccttttggcaagacacagacagaaattctcatgcttgacctgcatcttttgtctcaaggagaaaatgccacctcctctgtgtggggtgtcacagagagcatttgaaagacagcatcaccaccatcaacactgaatgaatgttcaacagccatttattgagcactgattgtgggacaggcattatgggcatgtttgtatgctaagttgattcagttgtgtccgaccctttgtgaccccatggactatagcccaccaggctcctctgcccatgggattctccaggtaagaatactggagtgggttgctgtgccctcctgaggggatcttcctgactcagggattgaatcctggtatcctgcattgcaagcagattctttatcccctgagtcaccagggaagctcaacagtctctacacaaggtgccagacttacaataatgagcaaaaagtcaatctcctttctttcttccatacaattcctggtctagtcattcttgtcattcaatagtcatcatcatcattgctatcatcactaccatctctttttcatctgttagtacggtgtttaaaatttaaatgtgcttgaaacaagtaggtgaaaaatgaaatatttcctgccatatcattaaacaaggatatcgcagtcatcagtgattacagccctccaatgtgagctagtgaggcctaagggcactcaaggaggagaagaatacctgcagtttagcagccatcagactgcagccactccccacagtgagtcccaagggagctcaggatgtgaaaaacacagaatactggtcctggatagctgagatgcataaggaagaaatgatttcagtgagccccgtctcttgcatcttcccatatatagaaaagtgctaaattccttaacttaggatatcatattttctttaatcaataataatcttttgatgttcagactacctgccctttgttacaaagtttctatataacctggcttctcccctcactttctcagagcagttctctcagagttacttgagatggtatctccaggtcttgaagccctaaagcttcccaaaaaataaaacacaactctcaactttcaggttgtgaatatgttttaagtcaatatagcaatgaaaaaatgaacataaaaacaaagtcttaaaaaataagactaaaaataatcacctgggaatttaattaaagtatacatttccaggtatatttgccatgctgtgcctgccctagcaaatttgagatgggtcccaggactcaacattttcaaaacaatcaggaagattttgatgcagacatttcatggctctcattgtgcaaatataggcttatgttatatcacttcaaacatttttgtcacattcattgtgtttcaaatgtcacaactgcccaagaaggtaaatagaatgagaattattatctccaatttatggatgagggaaacaaatgcataagaatgtctattcaatctaatttaatataattggcacctgatttgttcaagctttgtactaaaagttgcagagaatgagatgctcagtgactttgtgttagaagaacaaagaaaaggacacaaatatg

SEQ ID NO: 53728 - DNA, 1311 bp, Bovine  19866880978394
tgaaagtgaaagaggagagtgaaatagttggcttaaagctcaacattcaggaaacgaagatcatggcatctggtcccatcacttcatgggaaatggatggagaaacagtggaaacagtgtcagactttattttggggggctccaaaattattgcaggtggtgattgcagctatgaaattaaaagatgcttagtccttggaaggaaagttatgaccaacctagataggatattgaaaagcagagatattactttgccaacaaaggtccatctagtcaaggctatggtttttccagtagtacggatgtgagagttggactgtgatgaaatccgcgtgccgaagaattgatgcttttgaactgtggtgttggagaagacttttgagagtcccttggactgcagggagattcaaccagtccatcctaaaggagatcagtcctggtgttcattagaagctgttcattggaaggactaatgctgaagtgttcattggaaggactgatgttctttggaaggactgggtgttcttccaaagaagaactgttcattggaaggactgatgatgaagctgaaactccaatactttggccacctcatgtgaagtgttgactcattggaaaagaccctgatgctgggagggattgggggcaggaggagaaggggatgacagaggatgagatggctggatggcatcactgactcgatggatgtgagtctgggtgaactctgggagttggtgatggacagggaggcctggcgtgctgcgattcatggggtcgcaaagagtcggacacgactcagcgactgaactgaactgaactgattactagcaaggatatgatgataattcaaattatttttacccatagaaatgcaaatgagttgcgtctagcagaggtgcacctgattcctgccccatagaaaactggtttgctgcctcgttgttgttttttactcctaagtcatgtctgactctttttcgaccccatggactgtagcccaccaggctcctctgtccctgggatttcccgggcaagaatacttgagtggattgccattttcttctccagagggtcttcccaacccagagattgaacctgagtctcttacattggcaggcagattctttactgctaagccaccagcaaaactctacagtttgctgccttacaggctatcaaccagttttgtaagtattagcaaattcattttagcattcttgagtgactgtaaatatgtctgctcttcagattttcctttgaattgtattaatcatcttaggattttgttttaattaataaagtagataaaat

SEQ ID NO: 53729 - DNA, 4142 bp, Bovine  19866881012020
attaatcagttacttacagtcagtactttatagatgaggacactgtggcttccagcggcagtccgaagtaggggctaagactcaggtgtgtctcgtgtcaacgccctgttcttccttgtctcttcacctcttgggtcccaagatcggtccttgacttgccaggagcatagtacataacacataggctccatgtggctcaagttatttttagctaaaatcaccttcaagatttgagttatatatcaagcaaaagtttataatctacaaagatatctgtagagatgacagggcagtgaagcaagcaagaagaaaaagaagtaaaataagtagatgaatattgatcatctcagttggagccctaacagtggcttgtcagccctctcaattccataacacctctgcttttaaagcttagtgatgttcttctgtaagatgaatccttttatgaacagcatgtagctacagatattgaggatggtgttggtgacaaaacaataaaagcaaaattaatctattaaatataagggcaagaaactgaattcttgaaataaagtaatacctttcatgagcaggcttacacttcattggcaatctgacagcagctttctcctaaggcttcatgaaaattaaccctcctccattcccaggtgtagaatatttcagtggctttaattattactcaaaagccataatagaaataaattactgggtttgaagaacaaatatgggagcttatggaggaaatggatcctacttgataatccagttagttaggagataaaacatcactctcatcccattgcactcctcaccatttgtcattttctggtaaaacacacacatacatacatacacacacacacacacacacacacacacacacgtgggctgtgtgtcagtgctaaagaatccacctgcaatgcaagagatgcaggtttgatccctgggtcgggaagatcccctggaggagaaatggcaattcacttcagtattcttgcctggaaaataccatggacagagaagcctggcaggctacagtccatggggtggcaaaagaattggacgtgattgagcaactaaacaataacaacacacataaataatacatacataaatcacaaaactactttttagttgctctgaaactgattttctggtgctgaatgcaatgtagtattaaataacatttagaaaatagacacataaataattcaataaaatcaacaagaatgcaatgattcagagataaccactgttagaatgttgttagactcaacagaaacttgggcaacaaatataggtaagcaattcacagaagagaaaaattcagtaagtattaaacacataataaaatgtactcagccccactggttgttcaggaaattgaaaataaaacaatgcaacaaatataaaagctaacatgagagacatagctgaagaaagtgtcaaagaagagaaacataaaatcaaggacattacccagaaggtagcatacacacatgttgtgaagaaatagaacgcatgtaaaacatctgctctccagaaaatacggaaaacatgccctctctttctcatgctttccttccctttcatgtgccttctctgaatgatgtagctgtgaagccgtcagtgtagacagagcaactagacaatagtgagcaggactgctgcatggagcgtcagaacaagagcaaggagagctgggggtccatgcaggacgagaggggaggcgacattgacagtgagatcccaagcagggtgagggaggcacgcctgttgaggagtggcttggtatggagtgccagaacctgagcaaagtaagttcttctttgtaagagggacttgatgaagagaagacttgtcaaagagagtcagaccaaagcagggtcaggaggaacggcctatgtttgagaatggcctatacttgagaatacatgtacatatacatatctcatatatctccagatgggagatagctgtatttaggtgaaaattttaaatggcagaataacgtgaatatgatattacttctgtaaaagactgatatctaacagaatatcattagccctaagcatttgtgcatgtgagcatatacacttgttcttaatgcacatcaatttgttaatgtgttatcttgggagacagaaatgaaaatgttatgggataagatcattaatttttaaatacgattttacattgttttattggttcggaagagggtatgttactttcttaatacaaaaaagagaaaagaagaaaatctgtaaatactttatgtccactggggacattttagaatgcttagtttccaaagtgtgttccagggaattgtatttgatggtaaatttaaagaattctccttccaaataagtttgtgaatctggggtaaaaaaaaacaacaaacagcattttttccactaaattatttatcatatgacttaataattttacttgtgaatttctgagacgacgccttcacttgtagaatttcttgaatattttgacaagctggaatatctcagggaaccactgcttcataaagtcaattttctgaaataacttgctattccaactcccaagacattaccattctcaagaccaattctttttaatctttttgctaccatttgtacatagtgtagatcatatggtaacaaaatttttacttccttttcctttgtaatgctatgttgttttaccattgaagagattttcgtggaattccagtgtaaatgtttatgcaaaatgtaaccaacagaatcctaaaatcacaatcctaaacataattaacctgtaaatcatgtacttgtgtaattcacactaaaagatttaaagggactgaccagagatggtggtgtctggagacaggtggaaagccttcatgcagaaaaggaatttgaaaacacaaaatcaaggcagctctggtcagaatgaaaggatgtaagaaatgagctcaggatacagactctagcttctattaagagaataacccgactgattaatcacaaagacttgaggatgaaatgcagttctacagagttgaaccacaattctgttgtttagtcactaagtcgtgtccaactctctgcaactccatggactatagcccagaagctcctctgtccatgggatttcccaggcaagaatactggagtgggttgccatttccttctccagggaatcttcccaactcagggatcgaacccttgtctcctgcattggcaggcagattctttaccactgagccaccagggaagcccacagaattttgtagaaggaagcaacacctatcattatgtagcttataataaaaagatttatgtttccacatacagtgagctgtcttcactgtgtcacaacccaatcccttattcatagaaatggttatcccctgaaaagaaaactgaaagcctgtcatagtccgttcaggcggctatggaggaataccatagattgggtggtttaaacaactgacattcttttctcacagttctgaaggctgggaagtccaagatcaagaagcctgcagatctgatgactagtgaaagcctgcttcaggattcttgccgtatccacacatggcagagagagagagcaaggccaagctctcctgtctgttcatatgaggaaaccaataccacgcatataggctccaccctcgtgacctaattacctcccaaagtaattacctcccagctcctaatgccatcacatcgggaggtagcatatggatgttgggggggacacatataataaagctgctctgatcatttatctggaagccgaataaacccttaagtgagtaataattagtactagcatttttagagttgtttactaatctctgctgctgttgctaagtcgcttcagtcgtgtccgactctgtgcgaccccatagactgcagcccatcaggctcccccgtccctgggattctccaggcaagaacactggagtgggttgccatttccttctcaaatgcatgaaagtgaaaagtgaaagtgaagtcgctcagtcgtgtccgactcttagcaaccccatggactgcagcccaccaggctcctccgtccatgggattttccattactaatctcacttacatccattatcagtttcatccagcttaccctacctggacagttag

SEQ ID NO: 53730 - DNA, 1134 bp, Bovine  19866881029367
atgaatcagatgccactttctgtctatataagtaagggcagaggtagatggttaaaagaagacagaaaccttaagtcaaccactgaaagagcgcttgtccctctcaggtgtctttttttcttcttcttctttaagcaggtagaaagaatttcccaggactaatagaaagtctcgtcaaaaatacccatgatttgtcagttaagcccctgatatttttagtgctggaaaatctgtcaaaaatgaccaaaaaggctcacgctttacggagcataagaaacaaaaccacgggggttgactgaaatgaaacacagtcatgagtagtaagtttgaggttgcctgctctttaaaaaacaagaaacaaacccgtctcttctgttttcccggcgctgtcagtcttaaggggcccctgctaactttgttctctctgagagcaggagtgtgcctaccagtttctggtttcctgccgtcgtgtttagcatacggactttacatatttgggttatcaccccagtcacctcttcgatgaaactgaccttcctaagttaaaaatactctgatgtcagacattcagtgctccatgggttactagtgactgaccgacgtgctgtttccaccagggcagatgacgtttcttgtgaatcctgaaacatgatgtggtttttcctctctcccatgctctcatttcaatttcccctaacccaggatgagtacagaagaacttcctcaaaagcactgtaacagaaagaggtttcaacaagcatgagaattataccaaagagaaattgctcacactaatggtttaaaatatcactgggcaataagctaccataatttcagcattatgggggtatgatgtgtattaatagtttaggctacactttgatagcaaggagctacaaatttgtaatggttcaacaaaaattgttattgtatcattatgtaacagtccaaggaggtggcagataatgtgtgtgttggggtggagggttctactccaccccctcattgaggaatccaagctgacagagattctgccatcttgaatatgtagcttccaaagccattcttgaggttgccatcacaaccagccagaagaggaaaaggagcaaagaagaagaatgggggtgcccaaat

SEQ ID NO: 53731 - DNA, 1280 bp, Bovine  19866881285260
tcatccacaaatcaatagactgtgatgaaatgatttctatgtagtcttcgatccctagtgtttaatggttttctcatattgttagaaaagtttctaatcatcaagtctttggtttgggttttatattaaacgagtaaatacactggggctcatatggcagattttctttctggaggattctaggaatctttttgggccctaaactctatttggtcttcaaatccactggcactgaaaaagagaaaatgctggaactctgaagggcagatgttagataactgactcctacaggcatgctagaaagcagttattttagagtaccacacaccaacagcctacaaaaagtggcagtagtaatcccatcatttaattattccaaactagattccagagaaagctacaggcttgaagtacagctgcaggacagaggacagagttcagaatccagaattcaagttctagaatcttcatgtcctggtttgagacccagttctatacatccagctgcataatacacggcaatttactgaatctctctcagccctagttttctgctctataaaacagacttaacaatgatcaggatcatgatgtaataagagcaaatgactcctagggttgtggtgacgattgtacaaaaagaggtacatgaacagtcattatagcaatcagacattggagagttttgtggcaacatccccgccagttctagcacctaataaatggtcatcacaagcttactgatggatggcctggtaaacaaacatgacaaaagttgctcttctcacttccttaaacccagcagaagattagggacaagagacaaatataattcatgaacggaaggaaacaaaagggtttggagggacatggagtgacaaatttctaacttccctccaacatgtttaaacgatgtgtccctaacggagtgacattgcccctgattctgctgtttctattttcagcagccatcacctagctatcaggagaagagataactaaggaagcataaagacaggaaacaggacttcgatggctttagataaagggtcattgtgtctgtcaggaccccatctccacagcacagacatcaaaatgggtgtttttggtcagcccagacatgaagtcattcgagtgggatgctgagccagtgtcctctcttcacagagttcacacagagttaattctgcttgttactaagggttccagggccaagattccatcaaatacagattaaagtgtccccagaacacgacaacattgtttggccagtaccatat

SEQ ID NO: 53732 - DNA, 1778 bp, Bovine  19866881418049
gtggggaagatctcctggatgaaatggctacccactccagtattcttgcctgggaaaacccatggacagaggagcctggtgggctacagtccatggggtcacaaaaagtcagatacaactaagagactgaacaacagcaatgcacagaatgccttccacgagggattacaattaatagacaccatcataaagagttcagtggagagcagggtgaggaaaaggcactgtgaggactctaatcttggagataaattcttgttagcatcatagacttgcttccttcctgccatttgaatggcatatcttggcctgcccaggatcagcaggaacacacaatgcctgtgctccattattgcaacataaaaacaacaaggctcaggtgacttctcgggcaaagccattccaaatgtctctgccccttacttaatcacagtgataaatatcatataaagagctgaggctaaatgccaaacacataaaccagctggatggcagcaaaaacaggagctattaggccctgtcactgatgcccaggggagcttacctgttcctctttttcaacaggcactgcagtggtaggactgtttgatgtgtttcgtaagtcagtatagcaacagcagggagatatatatttgaagtattctgcagccaaacttctctttgagtgcttttaataccagcttataacacagagaccagcaggagttggtattcaataacagagctaataagaggtgcggtgtcgcagaaaatccacttgtttccagtgatgcgcaagtgcaaagcatttttatgagattttgtccaagacctcctgagcacctgtgaaaagtgggtattacagtcccatcccagacactgaggaaacggagactaaggtggaggagccaacagtggcaatgtgggtagctcacataatttctctaaagagatggacagcctctaacattctgtgcctccagacccattttttaagccaggtctccaaagtaggaaatcaaaagatacctggagtaacaggcaagtttagccttagaatacaaaatgaagcagagaaaaggctaacagagttttcccaagagaatgcattggtcatagcaataatcttcttccaacaacacaagagacaactctacatatggacatcaccagatggtcaataccgaaatcagattgattacagtctttgcagttgaagatggagaaactctatacagtcagcagaaacaagattgggagatgacgtggctcagatcatgaactccttgttgccaaattcagatttaaattgaagaaagtagggaaaaccactagaccacccaggtatgacctaaatcaatctcttatgactatatagtagaagtgacaaatagattcaagtgattagatctgatagacagagtgcctaaagaacaacagacagaggttagtgactctataccggaggcagtactcaaaaccatccccaagaaaaagaaacccacaaaggcaaaatggctgtttcaggaggccttacaaatagctggcaaaagaagagaagctaaaggcaaaggagaaaaggaaagatagacccatctgaatgtagaattccaaagaatagcaaggagagaaaagaaggccttcctcagtgaacagtgcaaagaaatagaggaaaacaatagaatgggaaagactagagacctcttcaagaaaattagggatactaagggaacatttcatgcaaagatgggcacaataaaggacagaactggtatggacctaacagaagcagagaatat

SEQ ID NO: 53733 - DNA, 1298 bp, Bovine  19866881695316
ccctggtgactcagatggtaaggaatctgcctgcaatgtgggagacccagggtcaatccctgggtcgggaagatcccctggagaaaggaatggctacccaccgtagtatccttgcgtggaaaattccacggacagaggccgcagtccatagggtcacagacagtcagacatgactgagcgactgacactttgaaggctgctcttgatgttgggaagaaaagaggtgatatactctactgaaaggctatctccatttagtcgcatactgatatgatggggaaaccttcctagaaaagttctctttagatacatctgtgcaaaaagaatgagctgtgtgaacttggccaagtcatgtcacctctctggtctctgctccctcaggggttaaccccgcgttgcgttggatggctgccgagatcctgtccctccatcccattccctcctgtttccaagaacaataattaccacagaaaatatcatcttgccctagattgtgatcttcatgacttcatcccgtgtgaacagacgaacatcaaaaaacagctgaggcataacacaggatctacggcagtgtcaagggggcttccttaaaacctccagttgagataaactttcagacaaatagcacttgtgtgtcagaagggaggcgggagaaggtggtgcagcatgaagcagagtctttattcagggcataagctcccgcatcctgggacagggagaactttgttttctctaaatgtgtgtctcaggcgcttgcctgtgttgtcactcgaggacagggaagaaggggatgtatacgagctgcttccatcctaaacccttcaacccaagtctgcagcttctgtggcttctggctaggttcctgggcaggggaccaggccagcctgcacacacgtgtgcatgcacacacgcatacactcacaagaatcatcacacactgagactccatgggggagagaacagggtgctgtgtgaccctcgctgtgtgacttctgtattatttatttattatttatgtatttattttataataaatgatatttattttattttccaataattttattgttttatttatgttataatatttatttatttataataaatataaattatttatttggggtcttcactgctgcatgggctcttctccagttgcagtgagcgagggctgctactctccagtcacggcgcacgggcttcttactgtggtagcttctcttgtggggcgtggactctagggcactcgggcttcggtagttgcagctcccggactctaaagcacaggctcaatagtt

SEQ ID NO: 53734 - DNA, 1534 bp, Bovine  19866880392643
tttaattcctgtattacaggtaatatcactgttattttagtcaaagcctggctttagttgaaactgaaagctgtgtgaccagtaatggcaaaactgaaggggtaagggtaacatctttgattcaagaagaacagtaattctgtgatgagaagctccagataagttcctccctagtgatatttgctaatttttcactctttggtatgcattcatttttaatcatggcagaatacttagctgtaccatatgaatatttcccttgacttagggaattccaaagggaaaatcacttttgctttttatttttgtaaatataaccttaaagaccacattatggaaatttttcaatagtaaatctgtccagcctataaatacattggtgcatttcatgtccccctccccagaccaggataccaagccaaagtgaacttgggattggctgaatgtcttggcataagtgccttggcattcgtagttgaatttccagacccaaagctaaatgggtattttcctctacagtttgctgtggtggtttggggaaagtgtatgtcaagaaataaactgccaacttcaatgtgcctaattgtgcaattaggtgaaccattgtaaactttatagcatttctggaagaaagcaattacttgttgccatagaagcactctggagtggaatcaaacagtgtccccacagccaaatatgaggaacctgtcttgccatgaggtgcacggaaatgcagcacccattagaagtttctgaataccaggcaagtgagctgatggagggaaggcttttctgagtgtgatatcaaaatgaaagctacaactttgcctttatcccaggacaactatgtgatcattactggtggctgagatggtaaagaatctgcctcctatgtcagagacctgggttcgattccagttgaatatgtttttctgcctcagtaaatggttgaagtagcatgcatggtgtatgctcatgtgtgctcagtcactttcagttgtgtccaactctttgcgatcctatggactgtagcctgccaggctcttctgtccatgaaattctccaggcaagaatactggggtgagtagtcattcccttctccagggaaccttcttgacccagggatcaaacccaagtctgcattgcaggcagattctttactgtctgagccaccagggaagcagatttttctgttcttttgtaactgaagtatagttaattcacaatgttgccttagtttcaagtatataccaaagtaattcagttatatatatatatatatatatatatatatatatatatatatatatgtacacacacagaaatatgctttttcagattcttttctgttacaagttattgtgatattggtataatgctctgtgctaaagagtagctccttgttatttacctattttatatagagtaatatgtatatgttaatcccaaactcctaatttatctctctccccaactccaaaattttaaatcatttaaaaacagatataatttagggaaaaaaatacaagatatg

SEQ ID NO: 53735 - DNA, 1220 bp, Bovine  19866880589762
ttcccaggtcagggtatttttttttttttttctaaaacagaaaatgtcaagcaagtagtgatggtataccctatgagcagtatactcagatcagtccaccaaaccgtatatcaccaaagcactaatgatatctgtctttatcatgggcccttggcctaaaacttggatccctctgtagcaaagagctcctattcccttccaattacatcaggctatttcgggcattaaggtctatcactgtatggaactagccaggaaatgaagaactcatagacttgatcagggagaagagagaacagcagaaagagggagatgtatatggccaatgtttggctaattagcaccatcaactgatatgttcgttggttttcactactgttgtcccttgagaacattttttagaatctgagaactgaccacaagatataaaactcagagtccatattatcacacgcttctaacatttttaaaagcacatcttcatggctaacagaattttaaaagtgaccaaggatcaaaacctgaatcaaagtcaggccagtgagctgatgtattgcatggtataaatgtgggtctgtgactccactgggataggagcatgcccaggcacttcatctcaaatgagtagctgtgtaaactcttgaatggcaataaatagcaagttgagaatctgtttcttcttcacggtagatgattctgttaccaccatggagttcaacaaatccataccaatgatttgctagtatttactgctgatatcagttatgttaggatgcgtgctaagtcacttcagtcatgtccagctcttcatgaccctatggcccatagcctttccaagctcccctgtccacaggattctccaggaaagaatattggagtaggtgtccatgctctactccaggagatcttcccagcccagggatcaaacccacatctcttacgtctcctgcatggatagctgggttctttaccactagtgccacctgggaggcccctatattaggataaaatattaggataatatgaaggctaatatccatactatgacagcttcaacttagatttcctaaagaactagaaaccactgcgaataagagatgggtccattccccccaatagccgttgctcattggtgagaccacagtaaactacttcatatttttaaaagtcaatgcttacccctcaaagaaactgggagagttaaatatccccacagctta

SEQ ID NO: 53736 - DNA, 3042 bp, Bovine  19866880625274
cctcggaagaggggataattttaaatgaggtctaaagttcagttcagttcagtcactcagtcatgtccaactctttgcgacaccatggactacagcacgccaggcctccctgtccatcaccaactcccggagtccacccaaactcatgtcctttgagtcggtgatgacatccaaccagctcatcctctgttgtccccttctcctcctgccctcaaactttcccagcatcagggtcttttcaaatgagtcagctcttttcatgaggtggccaaagtattggagtttcagcttaaacatcagtccttccaatgaacacccaagactgatctcctttaggatgaactggttggatctccttgcagtccaagggattctcaagagtcttctccaacatcacagttcagaagcatcaattctttggtgttcagctatctttatagtccaattctcacatccatacatgaccactggaaaaaccatagccttgatgaggcggacctttattggcaaagtaatgtctctgctttttaatatactgtctagtttgatcataactttccttccaaggagtaagcgccttttaatttcatggctgcagccaccatctgcagtgattttggaacccaaaaaatggtcataaaggtggggccctaatctgatggggtagtgtccctttaagaagagaaagagatgctacacctctctcccccacctctgcctcttgagctcacagtgagaaggtggacatctgcaagcctggaagaaataactcaccaggaaccaaatcgactagcatcttgaacttggatattccattcctcagagctgtgtgaaaataaaattttgttgtttcaattacccgatctatggtgttttctatggtagcctgagtatactaaaacaggcagcattaagagctaattggtatttttttctttttttaagcttaaacatatatgctgctgctgctgctgctaagtcgcttcagtcatgtccaactctgtgcaaccccataaatggcagcccaccaggctcccccgtccctgggattctccaggcaagaacactggagtgggttgccatttccttctccaatgcatgaaggtgaaaagagaaagtgaagtcgctcagttgtgtctgactcttagaggcaaatatacaaataaatcacattaactaaaaacagtaataaaaatcactgtgatctacatcaagagtctacttaaaacagagatgaccaccattggcatatgaattagaaactgtatttcaatgagcccaggattgctatctcagaagtcatggaagattatgaaagtttaatgtacaccatacagctatttttttttcagttttatttattttactttacaatattgtattggtttttgccatacattgacatgaatctgccatgggtgtacatgtgttccccatcctgaacccccttcccacctcccttgccatcccatccctctgggtcatcccagtgcaccagccccgagcgccctgtatcatgcatcgaacctggactggcgattcgtttcacatgtaataatttacatgtttcggtgccattctcccatatcattctgccctcgccctctcccacagagtccaaaagacacaatgccatagaggtttgttctgatcaagattattttatatgcaaaaataatgccaccaaagaagcatgagagtggtagtaattacaccatgttatttatgtaaagtaacatggtgagaacaaatgtctatacttgttgtatatctgaaagcagttggctgtcagagccatattaaagaattaatttactcagtattcttatgctgcattaggcttttgatttagtcttttttttttttttttttttttttagtctttaacatttccaggaggcaggatggttttatccaggctttttcttttttttttttaaattatgcacaaaagtttactagccctaaaagagtactttcacccttgatatttattacagccctacatacaagtatactcatttgtttatgtatgtatatgtatatacatatatacatatttgaatgattatgtgtatgtgtgtgcatttatttgtatcttggcaaaaatcaatgttactacgatagaaaatattcctaaattttgcttcttatatatgaaaatatggattaaaagtaaatttaaaagctcacaattccattttttttttcaatctaatttaactggaattaagctaaggggtggttttcagtccctagacttaacataacttgcatggctttactatgataattagatcaaaggaataattccaccctctcactacctcaaataaaaattccagcctaaattggtcatggaaaatcctttcattttcccttcctgtaatgtgcttgcattgttatcattgctacacatttgaaattaagctgcccattttttgaataccaattgttatatgaagtatgctctttgtatgtagaaaacacacattatggtctcacaatcactttgagcatatgccagctatggaatctgtaagatttgtggtttaggtgcttgctttcccagcaggactttggaacatctagtgtttgtggtctggtcatttttgaattccaagaatatagcagactacacaaaaggaaaatttgagaaaatatgttgaattaaataaaaagaatctattactttgaaaaagtgtctattcttttttctgagaagttgcattgacaaacatctgtaaggcaattggtatacagatattttgagaactatagttaaacccactgaataattgagacactcatgaataagatatgctaagaatgtttctcaacagggtgtccccatgcgacctctatgacaaattttaagtgactgttgatggttttaatcatataaagatataatattccaaatcatcaaagattttagtgtctgagtgaatgatacagcctctgtgcgtggcttcagtatcccttgctctcatctcttattccagccaccgctgctgggacagtttcactgtctttgagctg

SEQ ID NO: 53737 - DNA, 2038 bp, Bovine  19866880666652
catctgctgtctatctgcatcagagtcttttccaataagtcaatttttcccattaggtggtcaaacatttcatacatagcagtgtacatatgtcaatcttaatttaccaattcatcccacccctctatttcccccttggcatctgtatgtttgttctctatgtctatgaaaaaaaaaaatgaaaaaaaaaaaagtacataatcttcttgtgtggtggtctcaaataaccaaacatttagcaaatttctgttgaatgatccctatgtgccaggcagtaagatatgctttctggatatactagtgatcaattcatgaatttcatccctttctaggatttattatctggtcaagaagatacatgtcaaatacaaatctaatgaatacaatgttgaagaagtccaggaactaaggtattgataccagagtaccaacatagccgagtacaaggctaaggtagggaggtggactcttctgaaggagaatcatttattttgaaatgtgagtgagtaatacctcactagagaaggtaagaaagtaatataagtattagaagtggaaagagggctccatgcagaaaatacttgtcccaggctcacaggtgggattgaacaaaacaatctgcagcttcatgattttcttctcccaccaatttgagcctagagggatgttgcaatgaagcaagaaacagaagggtgttcttctccagttggacatcctacagggacccttgatgtatgaaatgccaaagaattgaacacagagaacaatgcaaaagactgaagagttctcaatctggaaggcaagggtgtatgaaagccagaagtgaaggttaagtgtaaatgaagtgttttcacattcattacataagtttaatttggaatcacttcaaatgttgttgcatatactgcactcagcagatgaaccagagtatgtctttcaccaattcactgatgtttttattaaatcttactcaaaagtgcatgttcaataaaacaagaacatttaaaaatgagtgtaaagctatatttaaagcttcagatgagagcaagagagagcatacacaactagattaacttgagatattaaaatggagaaaattactccattcaaagaagatatgctaaatcattgctttccaacataaaaaacaaaaacaaaaactaattctaagtcatttagccaatttgtccttcgcatgagagttgtaactttgctaggcaatctttctttattgtttattatttattgaacaccaagtaggcagcactgtataagtcatcctagacacagtgcctaccctaaaggcacacagactaagtcagacagagaaagcaattcagacataaaatatgtcaaatgtgttgattacactctgaagattgagatccttaattataaatatgtcttcatagcttaggaagtgaaaactataaatacaacaaaaggcaaaatgcttgggaaatcatatgctaggtgtgttttatatctattatttaagaattaatgattataattttacctcgaagtgcacctttactaggagaaaaagtaaaaagcaaaataatacaaagtttttgcgaaagtgattccataataaccttctatattctattaaaacctttgaactttgctttcaacttgcttggaagtttttggttctatgctctatgttatcacaggcttgaagacaatatttaaagactgcccttgtcacaatgctgatctcctgtaatatattgggaaggtcattacatttacccaatatacaatgccaaatggacgaatataggtggatggacaggaaaatgctgctgctaaggtgcttcagttgtgtctgactctgtgagaccccatagacggcagcccaccaggctccaccctccctgggattctccaggcaagaacactggagtgggttgccatttccttgttcaaagcatgaaaaaatgaaaagtgaaagtgaagtcactcagtcgtgtccgactctatgcgaccccatagacagcagcctaccaggctcctccgtccatgggatttt

SEQ ID NO: 53738 - DNA, 768 bp, Bovine  19866880845496
tttaggtaaaggacataaacaacaattcaagggggaataaaatccccgtatttgcaaaactagtttttgtttgtccttctgtgatacagttcaaaataaaatagcacctaagatagatactactaaacatgttctacacggtgacagaaatatgttcttttaatgtccaaaatgtcatccacatggatgagttaacagacttgttccataagtttcttgacttcctgcagtaacacttcctgttacatactagtgatgcacagagacacagtgaagcttttctaatctctttgctataagtgtgggtatgaatgtgaacatatctggctttttggctgagtttgctccaggtttttacagagtgaggtctttctggctgttaattcaaagcaaggaaaatctagactattttggttttgggtgtggaaggcaaagaggaaacaatgtctttcaagcgtttgtaatgcgtcttagcaggcaagacatttaagaagattcataagcagttcttggttgtatgacatagaactgaatcacaaaacatatgctgaaagcccaagatgtaccagccaatgtgtcttacactattggaaccatatggtacatatacttcttccaatttaaaaaatacactaaactcccattgtaggaaaaacaatgatggcaattataatcattatgaccggggtgccagtgtacctacagcagtactctgattgttctttgagtgtctctacaggtttcttcttcctagaccagcagagacag

SEQ ID NO: 53739 - DNA, 675 bp, Bovine  19866880864365
gaaggaacatgaaaattttgtaaatttattgggacaggcataaagtgaatatcatcttaaatactttggaaatgaccaagttttattactaaaggggaaggagagaacaagaatgagccttgggtaagcagagagcgccataaatcatataagatagctctgcgcttttatccgtgggtccatatgttattctcaaagaaaaacaatgtataacaatttagcattattttgcacagctctgaggaggtccttggaattccctgtaacaccacttgtaaatttaatgtcaatatatttgtagcttttctcttagtttaattcagctctatttaaaacataaattaattttaaactttttaaagaaatattctaatttcaaggatcgtgaataaggaaaattaaaagtgctttatttatcagagattaatatttcagtggcttttttgaagcatcttatttcaataaactacaaaggctttgtgaacaaaaataataaaatctgtattcctctgattatgatttgtgtaatcgatatttatcattggcaattgttacatatgtatacatattgttcatatgtgcactttgggagtattaattacacttcttttataatgtttaccacatgttaatcaacacaagttatcagatacaatgggtagttattcatgctta

SEQ ID NO: 53740 - DNA, 1693 bp, Bovine  19866880864593
agaaacttccaagatttttagacttacacactgatgtttcatgcatcggatgcccttctaaagccctcctgttcccttctttctgcctgttcttggtgtctccactatcggtgcgtgtgctcaggtttagagaaagaacttggataactagaaaagaaaatctttaaggaccattagcacagcaatgaggctttctcacagaccttcagaaaaattgacaaaggacaaagtttaaacaggagatctttggagaaacaaatgagcagttacgtgaaacattttatatttggataaacttctgaaatattcacatttattttcctttaataggtaagctatatttattataaaacctaaaagcattaggttaagtgctattttattggttattaacccagggttagctactttatcaaattttatatagctaagtataaatgaatttgtaaaacagtagctttcatttttataattttaatgagtgtctatttttttttgacaaatccatagacctaatcgtagatacagttaagtaccagaaaacacaatatatccactgacaggaatgtggtttctaatcacagctttgtcactcacttgtatcgtcataggtcccacaatgaactatcctgggctgtttttcccatctacaaaactgggagtgtgagtcagcagaggtcttctctcctggttctgcatgggaaatatctatggagttttagaaaaatgcaaatttccagaaacctccttcactgattcaggtgagtctggacatctgttttttaaataattgccccatattacttaaccagtaaccaaatttaaaggatgcttgattcagaagaattgtcacacttttcaaaattctactgtgtgcctgtatgctcagtcatgcctgactctttgtgactcaacggactgtagcccaccaggttcctctgtccatggcattttccaggcaagaatatgggagtgaactgccatttcctcctccaagggaagactgtggtggggccagtctgttttaattgctctggcctaaagaagatatacagacgttgtgctggtgccaagaaaccaaataactacaaaacaagctagataaacaaagctatcacggtagtttaattaaactggtggagaaataaatgagacccaaagtgggctgaagattgggaccaacatcatgtcagctttgtaaggggcaaatgtcattacaaataggtcatatcacattaaattaaagttaattagaattttatggacttgaagatttaaaattattttaatgtgtttagttttgtagttatatatgaaaaacacacataaagggcttataccaatattatgtctgcaaatatttaagcaattctgtctaaatcttttattgaaatagtttacaatgttgtgcttgtttcaggtgtacatacagcaaggtgatatatatatagatatatacattcattttttacattctcttccattgtagaagagaatccagaagaagtatccactattagaagatactgagtatagttccatgtgctatacagtaggacctttttggttatctattttatacatagtagtgtgtatattttaactccaaattcctaatcagtccatcctcccctttcccctttggttaccataagtttgttttctgtttctctgagtctatttctattttgta

SEQ ID NO: 53741 - DNA, 478 bp, Bovine  19866880867173
cttttgtaagttttgttatttctaaaatgagatacatgctaaatgttggaaattagaacatatgtttaacatgcagatatcttcaatcttggaattgttgactaatttttattctgcagttatgtgaagaacagtgttaaaaattttcaagaccgaatgccctccttttaaaatgcaatcctctctctagctctcaggttgtcatctattctctgacacaaacagcctgattcccacatggcatattcagagcctgccctgtatagactcatttacagtgacaccatttaagtcacactttttaaatagttcccaagagacaaagctcaaatagagcagagccaaccacattagccaccacacacagctgggttgagtaacaggcatgtttaatctgttcattttgaatctctttggcttttgtgtctaaggatagaaagtgaagtcactcagttgtctccaactctttgcgacctca

SEQ ID NO: 53742 - DNA, 722 bp, Bovine  19866880929729
tagagctgagaacctagtacatctgggctcaagtcattttccacctctagaaaaaaatgcacctttgcaatcctacacagatggtctctcctcgattatgatttctgtccatctgtgttgtttactggataacatgaaacacattatctcaagcctatggcaaaacacacgcttataaaactatttcacagtgaatcagtgaaaaggaacaccatccaagaaatttgaaaacttaattttttcccattttttaactcatgtcacttatttcctctccttcacttctccttacaccttctagcttcccctacacagttactgaaaaaaggtagaaaatatcttttctagatactgtgcttttgagtgactatcctctgcaatctgcacccccccacacccccgtctgtaaattgtattttctaggctacgaaacattcaacatacacaattttgatgccctcccatctagagacctctgtttttcaaaacagattttttataactgtgctccccttctgcctaatgtgtaccccaggggaatgttgttggctttgtgattgaaccacatattttcaacaaataacagtgttgaagccaatgaaatctgatagtagcaagcattattcagtgatctctgaatagaagaggttcatatttctctcccctttggggtatgaaggaaaatgacacagtgggatgtgtgaactgcagctacatataag

SEQ ID NO: 53743 - DNA, 1488 bp, Bovine  19866880969317
taaaaaaaaagaaaatctcctgatgtacatcacacacacacacacacacatacacacacacacacacacacacacacacaaagttgctcagtcgtgtctgacactttgcaatcccctggattgtatatggccagtctcctcggtccagggggattctccaggcaagaatactggtgtaggttactatgccctcctccaggggatcttcccaacccagggatcaaacccaggtctcctgctttgcaggcggattctttactgtctgagccaatagggaagcccaatgtaaatggcaattgattaaaaagcatgataaactcatcattctcttttagtcataaatcaatttgaactttcaactctacttttttatatcttcacaggatttcttacctaccccaactctccaacagttttccccacttcataaatgtatctagtaaatgacatgaaattagattacctgaatgatcgtatttgttatgtgctcagttgtgtcctactctttacaggcccatgggctgtagctcactaggctcatctgcctatgtaactaccaggcaagaacactggagtgtgaggccgtttcctacctcaggggatctccctgacccagggatggaacttgcgtcttttgcatttcctgtattggcaggaagactcttcaccattaagcacagcaccatcacctgggaagacctcatacttgctatatttgtaacacacatctagaaatgtttaaataactgattttaagaaattgaaacaattcatttaaaccttttttttaaacaaatcacaattctcttagtataaattcaattatagatttgtgtctgtgtatgggaggtgtgtctgatgcttaaaaaaaaaaaaagtttgtaaaagctatgttagccagtatacatcaatctcaaatttttgtaatatcatggtaaatgaatggagaagtctagaaaacaatttataaatttcttcagtaatcatcagagacaggttttttgctattaaaggcaatgcaatttaaactgggtggccataaaatataggaggtttttcccattgcaatacagaggaaataaatgtatgttacattccttccccacccagaacatggaaatagaaatggaaaaacaatttaaacactaaactttcaacagtaaaccaaacataatgctgtcccttaatttatctgcaagcctccaaaactctgatcacagccaaattcaatggtgtgtttaactgctgaagtctgtcaagagatacaaaacaaattcctgaaagtattcattctcttcccagagcatttcctctgacacatgggagattttcgttttcagtctctgtaggctgtcttccctatcagtactggcctacacttatacacatgtacacacacctacaaataacgctatttatggaagctaactcacatctttaactgaaatctctcttcccttgctattaaacatagcaggccacccacaa

SEQ ID NO: 53744 - DNA, 976 bp, Bovine  19866881004135
tgcaagcaccactcactccttgaaaaacagacagactctccctttgctctgaatcattgcaataaagacaaagccctttcaacattagcatggcaggcagcaggtcccttggcattgtgagctgtttagaaatgtagaaatgatcatcggagttgccaaaatgtgaaccagtgccagaaatgcttgtacctcagtgaaatttcatctttttgacccaaagctacccagaaaaaatttgagtagagagaggagaggagacgaaggggagtaggtgtttgtttttaggtgaaaagcacaactcaaagagtattctaaagtcaggactagaagaaagataatttgtatatttgtatatgtgcatatgtctttccttggtggcccctaatcttggaaaaaaattatttttgcaaaccaagataacctgaaacagattatagggaaatccgtcagaaaaaataaacacagagtgtctagtatgacgtgaggatgtcccttagtggagctgccctggaaatatggtgacagaattgtttgttttcttgtaattttacacagttgtgtttctgtctggcttgatcaatgctggtcttgtatcctaaatctccctttctttgccttcctagtgagtcactgaccatgtggctccagctcccagtctggctgctaaggaagaaggaaaaaaataactagtcttgataaacatgtaggccattttgggtatgagtttgacattgctgatttttttcttttagctcaatctctagagaactgatacatttaatctcattcattaaaagccagatataccttctcattatctaatacactgagtttctctgaagggtctttcagaactcaaatcagattggtaacacttttatttacattgcatctgcaaacactgctatgaattgctatctgagggaaagaaggctgtgggtctagggtatctatgccctttaagtttacccagtaa

SEQ ID NO: 53745 - DNA, 1107 bp, Bovine  19866881030294
ttttatcctagagaagctaacctttgtaatgctttgaatttttaaaaatttcttttattttcacattcccctattgctatatttttttcctttcgttctatctcacgcataatataaagttggaaagtttaagtgaattggttagaatttatccacccaaactctatcaccaataataaaacctggttcttatcctggcattattaagtttgcggtttcacactaacaatttaaactcttcagctggaaagctgctagttcaatacaatttatcttcatatttggctgatgaagtatatataacaaatcatcacatcataaattctcacatatcttggtgctgtcagcttaatcaagccagctgcatccttgtttctgcaacaggcactagtccacagaaggggtggatctacaacatgtcatatttcagagtacactgagtgcagttttacacatcaggagaatttatctctaaaacaaattactgtcttcctgaagttaagaatcattggtggaaacctccttcctcactgacctggtaagtaggttctctaggagtgatttgcatagtatattacaaaattagaagagaaacctaaaatcagcacccaacctcaaagctttctcacccagagtatgtaaatccagcattacaagggcaagtcactgtagggtaacattgaaaggtgaacagtattttggaagcttttcaaattaaacatttatcctttagtaacatcttagcttgactgtgatgcacaaattagctttgataaaatgcatggatcagatggtggttactgccaataattcactgaaaagaaaaaagatgacaaacaactgtgttggttttaaatacactttctcagattctttcctatcatttggatttagcagatccaggggagtggtttgagattttaaattttacaatcaccccagataaatctgacacatttggtccagggagcactctgagatactctggaagaagaagaaggcatcgcatgacattttcatggtgaaagcctggaagcagcatgtggctaccaaggaataaaggggaaactttatggttttactcaggattcatcaggaagattatag

SEQ ID NO: 53746 - DNA, 3578 bp, Bovine  19866881109079
tacataatttccactgatgattctgctaaacccagtagcttgtatctgttattcttacatcccaaccaaatattttaaagaaataaggcatcggctgcacttctcttatattcctaatgttacaattttgtttatggaaaataaaaatgtgtaattatctaacagttctttggcaggttatttgaattgcaccctgggctgatttttcaagtctccttcaaaccattcccacccttatctcctttcatccgggttagtattgcaggtccggtatgaaaatctaagggattctcaaacttttcaagaaataaaatgaaggcagcaatagagactagagaaatagattatggccaaaaaactgagagtcagctttgagcatattcgcttgctacagtgtagaggggaagtgttctgacttgagtctggctcttactggggatgtactgggaataatatttgtccaacatatgtcctttaaagaaacaaagagcaaatgaggatggtggtttttattttagcttttgctaaattatttgtattgggtatagtcgttttacaacaaagagacttagctacatatatcccctcttttttggattcccttcccatttaggtcaccctagaggattgagtagatttccattaacacaaatatgtggaatctggaaaactggtatagacgatcttatatgcaaagcagaaatagagacacagacagagaacaaacacacaggcaccaagagggggaagaggtgtaggatggattgtgtggttgagattgacatatatacactattgatactcgtgtaaaattgataactagttaagaagatggccattgaagaagaagcagcaaaataagaatcaattaatatggtagcatgggctatagcagtattatgggttaaagtagtgcagggactttaaaatgtcctcttataaatatgttatgaggtaaggaaagcactttatcattattattattactaagttaaaagacaaaaagaaaagggtaggaagggcaaatggtgccagtccgttgccctaaaagacatgttcctcgcgctctgaggagggtgctgctgtggatatggatttcgtgacacagtcatcagcaggagttggctttgctgggtctcatctttctctgggtttgtcttctggaagggctcttagagtgcaactgatcacaaagcatcgtggcagctccatctcttgtctgcagactcactgctgctgctgctgctgccaagtcgcttcagtcgtgtccgactctgtgcgaccccatagacggcagctcaccaggctcccccgtccctgggattctccaggcaagaacactggagtgggttaccacttccttctccaacgcataaaagtgaaagtgaagtcgatcagtcatgttcgattcttagcaaccccatggactgcagcctaccaggctcctctgtccatgggattttccaggctagagtactggagtggggtgccattgccttctctggcagacttactaatctccttcatttataacttgccacacccttccacactcagcaacttgtccttagaacaaaatctcatctcatttatgtgtaatttcatgcagagtttcatatagagggtaggctttgtatgaaaacttgatacagttatgcaaatattgagggactgatacagagatttaggaatctgcaaaccacatttcccatgttcgtttgccatttggcttattaaatgctatcagcaagaggtgctgggggcacattagaaggtggaatttctttcatttactctttgtcttttcctttctttcatagaatctttgaagggagggggtgcatgcctcttcaatcccaacattggagacggtggttcttgctcccagatcttggtgctggaggcagtggcagtgtttgaagttgggagctttttccactcccaaatcctggctcagaaatcttccttcttttaattccatttcctcctagagttaataatctttgactcagctccctttctcttattcttctcttcaagttttgcccacctacataatcaatcattgtgcaacattactcttatctgagaaatctggtaatcaatcatcggaccacatcacttctatttgagatgctcagtttccttttttcctagctagattctcactactacagaaagaacatatgggagagagaaaaacttgagactctgggttgattaacgcatgagaatggcaggcaaaatagaaaagcatgctattaatgtgtataaaatagaaaactttccttaatttattctttaacaatattaataacatttttcctttgttgccaatgattttgttgaaaaatgattttgttaaaattatgaaataattaatacctataaatatatatgtatatgtaacataaaaatacatatggttgtttttgttgagtcattcaatcatgtctgactcattgcaaccccatggactgtagcccaccaggctcattctgtccacaggatttcccaggcaagaacactggaataggttgtcatttcctcctctgggggatcttcctgattcagggattgagccacctgggaagtccacaaatatatataaatatatacatttggtggccatacaataataattaagaaatataaatttgtctgctcgcctgattaggacatagagtagcctgtgtgctaaatccatcacatttctccctcttactgtaatagaaaatcactattcaaaattgtttttatcattctcttggattaataggtttcttgcatatgtatttatgcatgcactacataatacttagatatttatgctttaggttcttgaacatagaactattatgcaactaataaaattctgtaagtatccttttgagagtttctcaactttattaaaattgtttgttgggatcaaccacaataatatgtttagcaatagctctctcctctataggattgccttgtgttaatatattataattaatttattcttttccacactgacgctcccaaattttcattttcaccaggagacgtgttaaaaatcttctctagcatgtttcccagtgcacagacacagcagtttccctgaaaagtgctattgctgggtcacaggatatatgtatattctattttattagataatataacattatatcctattgtaatggtagcaatttatttctgtaattacctggcttctatcttcctgtcaatccatattatttccatgactttatattgtcattttttttaatttgcatttaattgcttgtgaataataaagtgaaagactttacatggtttttgatcattagtcttccttattttgtcaaatacttgtttttatttttctatttgtttccttatgtcttataacggttactttatgtgtgttacatagcaatctttcttttttttaattaatttattttttaaattttattttatttttaaactttacaatattgtattaattttgcccaacatcaaaatgaatctgccacaggtatacccgtgctccccatcctgaaccctcctccctcctccctccccatacc

SEQ ID NO: 53747 - DNA, 1101 bp, Bovine  19866881121231
aattagctgcttctattcctatgttataaatatagatctcttctattcctatgttataatatcataataaggcacattcttttcacctttttgattttgtaagactagtaagggttcccttaagggtacccttgctgagctctctgtcctccctgtattttatgatcactgctatgcattggttccattagcagtagataatttgtccttaaaatagcattaagagcactgtgcatttcatcattttatttcccccaataaagctttcatacttgaactttgcttttcttgtattgacaaataaataaaaaaagaataagaattagctggctttccatgacaatctaatgagatggaagatgattttaaaaataagtaaaaatcttaaaagcaaatagcttacaacaattgttggtgcattgtactattaaaacagagctttttggagttgcctgttgctgacctcttctactagccatgggtgggatgggaggtgcttgggtctttgtcaatgagccccagaaagtaggtgtttaatcctgagctctgcgcagtgacctcctggtagttacagcgtagtatctggctgctagcgatgatgaaagagttgccagtgactctccagtcctgccaattcggcagtgatgatgactgaggtcagtgagaggggagagagtctggactcccagaagcagctgtcgtcaacccagagaagccaaaagcaatctcttccaaccaaatcccttatcagaaatttccttcaaatccaatgatatgttctatctcacaatttacagtgacatggcagttttatactgataatgcgccattgcttttcttagaaaccaaaagctctctgcagctgccaagatgtccttagagaaaatcatagcttttcaatgtcttcttgctgccttcctaaacatttatagcataagcattcatgtttaatagtcatgagtagtgataaattatcatgaaatgaccctgtccccagtatttctttatgtgactatcaacttccattgataagagtaaatcattcatttaataccttaccccagtcttttctgccaagtttataatccgctttttttttaa

SEQ ID NO: 53748 - DNA, 1297 bp, Bovine  19866881159902
tgtctatgtttaatgtgctgatatgatttctcctaaaaggatggtaaatttaaatatggtggcataacgtggggcctgataaatttgaagatggctgactgactaaataaatgtccattggcataggactaaaatgtactatgtctccacttgatcaatttagaactcaactaacaaaaattgttcattcttcatgaactgttgcacttgcaagtgtgatcgttctgacttcaacttaaagaaagcaagtcagttattaccatttccagccttcaaaatgaatagcgaaatgcaggcaacaggaaatgaattatttccttaaaatacacagtcacattatatgaacaatcagatgattcacattgacttaaaaaagaaaacacttaaacacattctagcatgctctgctatttatgttcttgtttaattgattgttcaaagtactccagggtgatgaaaaagtccctgcctgtcactgtgattgatcatctaagagtaaagtacaaaatgcaagaagtcagcaaacaattattttaaaaatgaaaacttgagacaagtaatttaattttaagctagtgagctgatgctcatataaacacaccaaaactgatcagagaaaaggaaagttaacattaaagatttggaattattttgacaaacactagtacatttcggaaaagattctgtatattctgcctaagagttaaggatcttaactgcagaacaaacaagattacaggaaataatcagatcccagagattctccagttggataaataaggctaagcattcataacaaataagctgtatcttttgtgtgggctctcaagcgtgtgctggaaagattttgaggttatctagactctaaaaaaattccttatacaactatcactgtttcttggaggaaatgctagtaggatgtttgaatgtacaactttgaaatttcctactttttcttttgttgtgattcattagagaggatcaggttgtgctgctacttctctgtagaaatattgacttgtgttcattcaaaaaattaactttgccaacacactgaattacttttcactggaagactagcaaacatcttatcaaaatttcatgttaaaggtagtttttccttatttttcttttttgtttccagaaaaacaaatattgatctatatctgatatttattataatgtatttaataggtgacaacacgatgctaaaaagacaaatagtaatatttaacttaatgacagatgatgacaacacagtgttaaaaaggcaaggaataatattaacttactgatg

SEQ ID NO: 53749 - DNA, 1221 bp, Bovine  19866881259903
ttattataagtatggggactattagtatttacaagtgactgaaaaggtctctgaaagtttacttatgttgaaatataagaaacaaatatcctaccacaagagcttagatcctcagggataatcttaacatggccagatgaaacctagattttaatcatattctcttaaagattattggctgttaataagtcaagaagtttctgcaagcatgcactacctccttctgtggagttgtgtttcacatttgtgtgtgtatgtgttcttgctttcacaataattcaaaaataatgctaataaaaataaatgacacaggaaaattgtgatctgacaatcaaacataacattaagaaaatatcaattcaatgatgacacattttacaaaacttttctatgttgagaggtttgactgattctttatatattacctctttagtgatgagagagttagggtagacagctaaatgacttttgccccattggattataaaatcacttccattactcagaaactcattccttgctgtaggagacccacatcattttaataataccaattataataattatcatagtactaacacttgcaattatacaaggatgtctattccagtgattcttccaactctttagaaaggaaatacacaccacagatgggaatcattttgccactgaaatgcagatatcactggagaaaaagatggtgtctcctttagctgttgttcctggttctttctgacagttgctattcagaaggaagaatttaattgaaggtcaattaaagaacaatcatgaaaattgaggggaagctgaaaagcctcagatactccaagaaatagttgttaaaaacacagatgatgcccaagaaaatctagagatttttaacctttattccaaatgcaatacttccctttatttgcggcaaacaatctcagtgaccaaagaacatctactgaggggccatcaagtgcctatcagctactgcgtccttgattgcaggtatgtacattcccccatgatcttttgggtgataccctaggcatcagaactgcattattttgaataacaaaggtaaacaattccatcatgctctcatagcccttttgctctagcaatttctaaaccacgccatattttcagacttattttggctaccttgtgaatatacatggattgcatatggacagctctgcagcagtaactgcaggttggcaatctctcaaa

SEQ ID NO: 53750 - DNA, 993 bp, Bovine  19866881285506
tttggtagaactggaaaaggggaaagtcacctgtttcaattgatggatttttaaatgtgaaaaaaaaaagaaataattttctcagtaggatatatgaaatcattccatgttctttttgaattatgtaaatcatgctgaaagtggatagtaatttcaaagagcatttttatgccctacaaattagtttattactcagaagcacacgaatgatgacttttaaaaatagagttatgtattcaagaagcagaaaatgctggtgtgtggagaatgcgtggaccaacagtgagtggctagtcataaagccgattgctagaattatcctcaggtggatccaattagctgcatctgacaggacgtcagacactgctgggatgcccatgttcgtgtgtcttatgtcccctttggaagccagaagatgtctcagtgaggctccacccacagcagccatgacagtgtgccctacccctctcccaattcacaccagcatgaactaactgaactgtgattgaactttcctgctcaggcaagtacatttttaacacaatctaccctgtttaagcctaatttgcatttcattttacaatcttgccattcaacacaagcccttaaagatagattttagggcagcagctaatctgaaacgtacatgactctcattctgctaaccaaagatatgctttctgtttctgaaatatccttaggagaattaaacagctggacatctttatttgactgtatgtttctgaattgtcttctcttacagtaaaaaaaaaaagctactagtgtatttcttgaaaatgtttaaacttttaattttataaagagaattagttatcctttcaacaacatataaccgagagatacgaccaatattgcccatctccaagaaacagtgttttcactgaaagactcaacaatagtgcatttttgcagacttggttatgacagattatatgtgaaggcaagtttcttgtcaagtagagcataacatgc

SEQ ID NO: 53751 - DNA, 2456 bp, Bovine  19866881641062
acagcatattaaaaagcgagacattactttgccacaaaggtccgtctagtcaggctatggtttttccagtggtcatgtatggatgtgaaagatggactgtgaagaaagctgagtggtgaagaattgatccttttgaattgtggtgttggagaagactcttgagagctccttggactacaaggagatccaaccagtccatcctaaaggacatcagtcctgggtgttcattggaaggactgatgttgaagctgaaagtccaatactttggccacctgatgcgaagagctgactcatttgaaaaaaacccagatgctgggtaagattgaggggtaggaggagaaggggatgacagaggatgagatggttggatggcatcaccaactcaatggacatggatctgggtggactccaggagttggtgatggagagggaggcctggcatgctgcggttcatggggtcgcaaagagttggacacaactgggtgactgaactgaactgtattagtcataattgttcctaaatccctcccttcctccttcacatttctcctcactaaaatctcagttttacactttctttgacagagcaacttagctcgtgatttgtctactctttatcattacagttttccattgatagccaaccctccacaacgaaaataacccatcataaggtttctgttatgtatgtatacacataaacatgggcttccctggtagcttagctggtaaagaatccgcttgcaatatgggagacctgggtttgatccctgtgttgggcagatccctggaggagggcatgacaacccactcttgtattcttgcctggagaatccccatggacagaggagccttgggggctatagtccatggggtcacagagaatccctgtgtccctcacttgaagggtcccttagtctttaatgactgacagactaagtacagcacagcacagacacacacagaaagacatagacacacacacacatataaaattctctttttcctcccatgtctactgtgtgtgtgtgtgcggaggtggggggggggttgtaacctttagtagagatgctctatagaacaaagtagactaagttaggttttcaataacaccagctgttcagaaaggttccctactttctcagtaccaatttgttgtttgatttgcatattttagtatttttaattggacatataatataggcatttagtaaatatgttaaaatattcaaagtattgagattagattcagcttgctgatttgcttaagtaatctaagtctgtagagcagttttcctctggaaatcatttgtcctccatggtttttttatttcattgtgatatatatttatcacatataacatatatcattttttaacttttaattaatatccataagtgtaagtatcatttcctggccagccattgttatattggaaaactgttggatcttggtggggcgcagacccatgcatactctgagatagctacctttcagatattaatttcactcatttgtaaaatgaaatatcactgtaggacctgtctacgtcattgtcctgaagatcagatgcagtagtaattcaaaggattttgaaaagtgataatttaagatatcgttgtcaaaataatttcttatatttaaatgtaattaaaccagttagataataccattggcaaaacattaaatattttcttgatatatgttcaataaaaaataaatataagcttcatttgagatgctctagtcaatccctatgactttaaacgtgattttgtgaggaaactctagtactatctcaactgtacttccgagaagtataatcatagttttataaaatttattctgttaccaatatcataattgtctgattgtatattgctaatgggataccacttaaacacaaatgctagtctacatctactaatattattactaatggtgatctcatatcagtaaaatatacaccaattacacagaaaacatttttaaacacaggagtggttttctaattcagttttatggttcttgtaaagttaaatgggcaaagtaagcaaacacataaatgtcaggaaagtaaattatctttatgtcatttcatttccactaaaataaaatttattttactagaagcagaggtagagacatcattttaaaaatgagttggaaaatttctaagttctcctttaactttagaaatgaacattttcttcacatggatctgcatttctttttaatgattgcagattctgaagcagtcctatttaagaagctcttctttgaaagtaattgtaaatggcagcactattacagtcttttttgaaatagaagtacctgttgactctgataactctagctggccttttcctggggctacccactgtccatacacagtccttgccaaaccatttttatgagatagtcggcttcatacaaggagacttcttttatctaa

SEQ ID NO: 53752 - DNA, 936 bp, Bovine  19866881885791
acagagtcggacacgactgaaggcacttagcagcagcagcagcagccaatgcagtagacacaagagatgcaagttcaatcctgggtcagcaagatatcttggagaaggaaatggcagcccactccaggtatgcttgcctgaagaattccatggacagaggaagcctggtgggctacagtccatggggtcacaaagagtcggacacagctgagcatgcatgcacctaaggtttaaattcaggatgcattgccatcagaaaagaatgttgatatttttgcatctgtatatcttactccttgtctatttttattcagttcagaaattgagtaggatatgttgatttaatttagaaggcaaaccccagggctattattgtcattaatatttgacaatatgtctttcatctcgcaaataagtgacttttgactccaagatacttttgcttttttcttgaagtatgttgtaaactgttattagattagaaagagccactatactttttcagatctactattccttgaaacatctcaaaataaactacttcttgcaaatacctgtttcaagctctgtttcctagggagattctaagcttacaaatattgtgactgatacagtaatctatactatttgtgtataatatgcatatatacacatgcaattgttaatagaaataaaaagggcaaacctcaagtgatttgaggtttttaatctcttgattattatctcttcctaataatataattataaagaaactctgagaattcttcaacatgctgctgttcatttactgaagcagtttctaatgtgtttcccatcctcacccacaccccctcaacccccttccccgccatcttcacatgaatgggaataaatctacctcagtgcacattgggtaatccatcagtaagattttccagtatgcttcctgacaggtct

SEQ ID NO: 53753 - DNA, 841 bp, Bovine  19866881900506
catttattgttgaacaagcaaggactgtgtatcatctgcacctacatcttcccttttcccttcttatgaaagactgtgctattttattttatagtcatatatgtgggaaaatagtaagtgacagggttccaggaattgcatctcttgatacattatctgcattgatggaatgttagtagctcctatactcagaatagaatctatgatggctgggttggactttcctgctgcttttcacttctgtgcataacaaagaagactgcttgaataactttaaattacttagcatgagctaatctcattccttgcaggcaatattaatggcataacatagaatacagtgacacaaaggggagtatactcttgaaatagagaataagatagagaatgatgtaggagggaaaaaaaaatccctgctatattgctgagaaagttaccattttttcctattaaaagagttatttgtgtgattgctaaaaatgatcacaaaagagaataacattttatttcagtgcaaatatgttcacttgtgaacacagataaatatcctgacctcagatgtgtatttctgataggaattcagtgaatgccatttttatcacccttgatcatgctgaaagatttttaaagatttggtagttataaataaatacctaactaatacttgttgagaaactatttgtcaaataccatacaagactccatgtacaacaacacatctctccttttaaggagtttaaagtcaagttcagcaggaggaaagttaattgatcattaaaacatgttcatttaaatggtcttacagaagaaagcactgtgggctcagatagtaaagaatctg

SEQ ID NO: 53754 - DNA, 1188 bp, Bovine  19866881906276
cctttgcaacagtcacctagaagtggaattgaagagaaattgtcagaccagagtataagttcaaaaatgagggtgaaaaaattgccgacagctaattaccttaaaacatctctctttcattactggacagcaattatgctctgatctttgaaagatgagtttttttaaaaaatggcagaaaataagacaattgaatctcatcattagtctctttacccttcctgaaacggtctgtgtaactgtaggttgacatgtgtgtgtatgtgtgactcatcttacaacatgcctgtgatcatgtaccgtatgccttttggcttctactgggtgggttttacaagaaagaagaggcagggtttcatttttcccagctgtgaagatgcaaaatttttaaattaaaaataacctttcagctgatttcttgcataattgctatcttgttttgctaatactgtggctgaattataacttgctgaggccttggggatttgcatgctggtttatcctctgaatttgcattgacatggttttcagtgaagtgagcaactaaatcctgtggccatgagcctggctggcagtatttgcattggaaatcagtaggagattatgggaacaagggctctgtgcagcctccctaaatagacccaatggtgaaaattttgggtctctcaaaatgctcttctctcctattaagtgtcgacagttgctgagactttaactgcacttcatcaaaggaccgaaatgacaagagaatccatgggggaaatgtacagaccaactaccactctatgacacatattgaatgatatgatcatttgccagaatcttttaaaatatatttttgggaagaaaaatttggggagattctttctgaatgaatacaaactttctaatacaaaacactccctcaaaaccccattgtgtttcctggggccaggagttaatgtataaggccaatgaggaacttagcatctttaactatgttgtcaaacttcaccagcttacaaaatattttaaaggcagtcagtgagacattctgtaaattaaaagtgagtgaacttttttatagactggccttttttttctttctaggcattggttgtatagtgagatttgtacctgctataactaggcattgggggttatgcctgatgctgaagaagcacaaagagctttaactgcaaacaagtt

SEQ ID NO: 53755 - DNA, 1111 bp, Bovine  19866881944958
cttaaaccctggacccctaaggatgtccctaacagaaattctcgaaactctgtaagtggagagcaatttggtcagatttgcttttaaaggtaagtggctgaacagagtgaacaagccccaacaagataagatgctctgtgctctgtaagtattagttaatggcaatattcaagtgtttttggaagacacatattgtgatgtggtaattaagatccataagtctcagtcactgttgtaataccaatactttttgtatcaagggttggcagttttgagattcttccttcttttctattttcctgttttggaggtttggtccctctgggtctctccattcattgcaattttgtgtggctgagctattactcttgatatggtaactcaggaatcagcagtcctaggtgggcaggtcaagactcagtggagcctgagaacagtacttaaaggaggaaaaccaagggaaagtaatgactataatataacatgtccagcgagggggcttgacctgtcagaatcctatgagctgctgcagacgctccactagctgtgccgaatagtgaagagatcagtcgcccctaccaggctaaatacccttttccaagagatctctattgggaaagaaagtgagtgatttgtctgctgagttaatgcagggcgttcagttgtttggaagtccaggactggatgccaaggaggagaaagagaacgtttaaccctaacgggatctaatgtacattcagaagcacaaaactggttagcacataagatctgaagatcaaaatgctctgggaaagaaggaatgacaggggatctctgtgaacagagttaaactttaagaatcaacacatagctactgtgacaccactgctgaagtaaatttcttacggtcataaggctgccttcaatgcctgtagatcacttatctcaatctgcagttaggcttttcatttaggagattctgtctttcctactacaggagtaaaagccaatgtttgtttctggcttctcttatagccactgaacccaccataggatcaggggcacagtcggtactaagtaaattaataacgttatcatttatgggaggcttgctgtatggtattgaagtgaa

SEQ ID NO: 53756 - DNA, 1283 bp, Bovine  19866882069147
tttggggggagggtaactttgttggatttgccttgtagatatgaattgctaggctaaaagtgtaaggtctttatagtcaaatgaagttgtataagtaggttgaaaagaggagagagaggaagatggtgagataaagatacaatatgagtagaatcattgctttgggagcacatagatattttttaaaaaatgtatggagaaagcaggatttatctgaaatttcaattctcttttcctttaaagagaatggtcctcttaatgagaaaggtaaatcaaatacttcagaggaaattaatcccaaggattagagagatatttataagagagcaacaggtacctttaatgagttgaaatttcaagagtcagttacatactaaaataatttgtggctaggattactgatacactgtcagcaattcaaggtattatcaaatgccagagataagcaaatatacaaaatcttaataaagtaggaagagattaattctgaacctcataaaccagtaatcttgttgtcagcatctcaaggattcttgaaagactcattaagtaggtgtttggggagtagttgacaaagataatagagatatggataggacaacagaaatcctctcttcagttcaaacaacaataaaacattcatctaaagacattcttttaggtacagtgtgagtaaaaaagagaaaataacaagatttttcccttagtgattttcccttagtgattttctagttgggatgatcataatgactttgtcagggctctccagataaacagaagcaataggaaattatatatataagattcattataagggattggatcattcaattacagagactgaaaagtcccacaatctgctatcgtcaagtgggacttggcagtataattcagtccaagtcaaaaatctgagagccaggggagtctgaagtcctgaatgcagatgggagaaggcaggagaagataattgttggagatcaagccatcatgcaggagtatctaagctcttcctcttttagcccctttgtttaattcagactcagcacactggatgatgcccctccaaatcagggagaacaaactgcttactgagtctatggattcaaaccatggtccaatggctaggactctgtgcttccaatgcagggggcccaggttccattgctggtcagagaactggatcccacatgtcacaactaaagatttcccaagtagcaatgacgatcaaagatcccacacactgcaactaagacccagtgcagccaaacaaataaattttgatg

SEQ ID NO: 53757 - DNA, 843 bp, Bovine  19866880658625
ctaatgtctgcatctcaatatagctgtgttgttcttatttattatctcacttaatattctgtaagtaagcaatatagcttactttaccaacaaagcaattttattctagagtgatattcatataatagggaatcaggaaagttttagaacatatccttcaggaaagtcaaaggtctacaatatattaagtaagcaatataattagtctgttatttatttttattttttattcaatccaaaatcaacaggcttgaacctccaaaactatattataatctatactaccggaaccaataaggtcaatgaattttgctctaaaaatagtctttttaaagatattatactgctaaagtgctatttatgtaagtttaatttcaaaatgttgtttaacactccagtgttattaatacttaattttattagaacatctaaattagcccaagaaattttaaacccacttgtattacgtctagtagtggtgctgtgatcactgtccctaatctgattttcataagcaacaatatgcaaggtctctaaggaaattattttaaatgaactcaaaaccatgaatttaatttgctttacaattggaagaaattggctcaatattatcttagatgtaaattagcactgttaacttactatctgaaattttgtagatgcccagtatcttgaatttttgaactatagagctctacttttataaatgagtaaatcaagtcatgagggaaacttagctgattttcccaataccatatctaataagtagcaaagctggctcttgaatcaaaatctcttaatttaaaatccaggattttcacataaaaagagggggaaagagaa

SEQ ID NO: 53758 - DNA, 943 bp, Bovine  19866880973871
atataacctgaactattgccacatttatatttatagtgttgatgaagtgcttatactgtaaggctttctataaatttaagtaaacatttgtctggaggaattcacaagctaaagtaacgtctagaattggaattataatatatctaagaatatttatgagacaagaggctgatgaacagtttattaagtaaagcagtatgccagtcatagtttgccatttatacacttagagtttctgagatttatatatatatatatatatgtatgtatctatgaatgtacagcttatcaactttgaaactagcatcaaggggatagaagcttctgattactgaacagtaatgatatatttcataatgaacatatatataagaataataataagcactttgaaaatagctttctttagaattatgacattcacaaaaatcagaattgactgaagagaataaatatattgctttcaaaccagaagaaaaagaaaaataacatttacaaaatttattacgtgagtcagaactgtctgattacacttacaataaatagaatacttgaaacatataatttttaagtaattgtattcacaacagggcttccctggcggctcagaggttaaagcgtctgcccgcaatgcgggagacctgggttagatccctgggtcggaaagattccccggagaaggaaatggcaacctactccagtattcttgcctggagaatcccatggacggaggagcctggtgggctacagtccacggggttgcagagtcggacacgactgagcgacttaaaaaaaaatcacaacattgggaaagaaaactccacagtgcattgaaaatcttctacagtcttaaagtgtagattaatagttatctggataataatttccacacgacttttcccctgaaatattcagattgttaagtaccagtcctgccttctct

SEQ ID NO: 53759 - DNA, 971 bp, Bovine  19866880250713
tcccttctgctcctagatccctgtgagtttgggttaataatctgagtttaatttttgctaacaagctggtgtggagaaggcaatggcaccccactccagtactcttgcttggaaaatcccatggacggaggagcctggtaggctgcagtccatggggtcgctaagagttggacacgactgagcgacttcactttcacttttcactttcatgcattggagaaggaaatggcaacccactccagtgttcttgcctggagaatcccagggacaggggagcctggtgggctgccgtctatggggtcgcacagagtcggacacgactgaagcaacttagcagcagcagcagcaacaagctggtgatcctttgggttgaatcagctgagttatctcgaggctgtgatcagtgacagaacctccggaaagccttggttccttctgtcttagggcacaagatggccacgcagggcttctggatatgaacggcaagatggtccatgacttgcccttaaccagatatttgcatcatccctttctcctttcaaaggtacatgaccgatggtggacttggcctctacacccgccgcctgaaccggctccctgatgggatggctgtggtgcgagagaccctgcaaagaaatacctccctgggcctcggagacgctgacaggtaagcctgctccacttggggtggcccagatgtggaggtgactccagtggggcctgagaaatgagggcagtcatagtgagagccaacgtgtgctgctttaacctaccagaggctgggaggccttgaagccaggcctgaggttaggagctggcccagcaggtggaagagggctcctgaccggctctcgcatcctgcctctaggtggtggatgatggttctgacagcaagaacccagggagttcaggctgggaaagtttttgttgttgttttactgttgctactgcatctttatcagttcagcagg

SEQ ID NO: 53760 - DNA, 779 bp, Bovine  19866880355323
tatctcctatgtactaggaattactatccctaaaatacataaggatgttgagaagcagtggggtaagtaacttgcccaagggcacactgctgctaagaccctattaagcagaggccatggttgaaaccacctcatcacctctgagttttggccttgagcctggtacttggcacactggggagaattttcttcatcaccaatagccacttcgcccatcgagtattaagtacactgacaatagcctatacgatgggccctgtattttctccccctcctccttccctttttataggagtagttggctccaagggtagaaagcatcataggagatcccagttctgtactcttcttgaagtttagagagaaagacaaaaacactcattcaattcagagcatagtacaggctgacactaaatttgcaggttcagctgcaggcagctagctgcacccagacagaaactccattcttcagccaacctttccccaaacatggtaccaggaacaatgggatgcggggacgaaaagtgtgtgaatggttcagggcagccccatcaccagtagccagaacatacttaagactatgttcttctaacaatgcccaagagtgtcatgtgcatgcacaaatgtcagaattataaggaaaatatagaatacagtctttatttgcagctcacagtagaatgcaaacatttagctccaagaatggcctctgcattgttctttgtgatgacaaaaggagtgggacaccctgaaaaaccctcagtggggaaagagttcat

SEQ ID NO: 53761 - DNA, 1590 bp, Bovine  19866880356269
gtggtggggtgctccttaagcagctgagtcgacgtggcaaacaccctcctaccacagggctgctgggcagagtgataggaaattacacacccagagtcttccccagagcttcgaatctcactgtagcagtgataacatatctgccttctccacatggggaagaaagccagtatcagccctgggaatgaggaaaatgttctggtcattgtgtgtgacgccctgcccccttccttccgatctaatgctgcttctcttgttttccacctgcctggccttctagccctctctcttcccctgccgctagccctaagttctgcagaagtactctgccccggaaacaggacaggtaatgacatcgtaggccggggaccccaccgagcctctagcatcctctgccccaccctgtgtcgagcccggatgttttgtgtgaggctgttggcctgtggcttccgcttgtgttcgtggccccgctgtactctgtgacccaacccccaacctgagacatgcccgtgagggtgagttctgctgtccacagagctcgggaagaggtgcactggggccggcccctcttctcccagcttgggaaggaacctcaaacctgccacctggaaaggggcggcaaaagctctcactggcatgtcagcctaccccgtggcatgctccttgctccctggcttcctgcccttttgcctccctcccttccccttccaggcccagacatgatctaccacccaccacgcggcttggccctcacctttgtctcccctctgccccttctccccacgcagctggctctttgccctctccaaggcctttgctgcagtttggctcggtgtctcgcgggctgttgtgttctgggtgcccattttctgtaaagataagaagaacatggggagtactgttggcccccagctgccctgtgggtgggcctcagagatggattattgactttgaatttgtgggggagccatggcttggccaaacataataagcagatgttgtttcatgctaggggaaaaaaaaattagcgaaaaccctcttcaccatgtcaatagcaaaaacgttgctttggtcggactcagagaccaagccttttaaacctcggtctttggaaatccgaacgttgctctgttcggactcagagaccaagcctttaaacctctgtctttggaaatccgaatgctgtgactttgtcagccagcaagttgtaacatgccccaactctgcccaaggctcagcttctagctccacccaatgagggcctcgaaaactgagagggatccggaatccacttgttacagatgaattccaaatatgcagactgctggcctcttgaaaccatccaagtcccttctttcacttgaagtcatcaccggaggcatctgggggtgggccagagtggtgacgggtgcagggagccctaagcgctggcggtaccgatgggcgacgggccgaggaaggcgtgggcactgcttcaaggtgggggcagcccctgggttcggctctgaacctgtggaaaaggaaggagcagtcggggccgagggctcgggcccccaggtgccggggtggaggcgcccaggttagcacggg

SEQ ID NO: 53762 - DNA, 2416 bp, Bovine  19866880359219
ccctgtccgtcacaaactcctggagcttgctcaaactcatgtccatcgattcagtgaggccatgcaaccatctcatcgtctgtcatccccttctcctcctgccttcaatctttcccagcatcagggtcttcgccagtgactcagttctttgcatcaggtggccaaagtattggagtttcagcttcagcatcagtccttccaatgaatattcaggactgatttcctttaggatggactggttggatctccgtgcagtccaagggactttcaagagtcttcttcaatgccacagttctttggtgctcagctttcttcatagtcctactctcacatccatacatgactactggaaaaatcatagctttgactagatggacctctgttggcaaagtaatgtctctgctttttaatatgctgtctagattggttatagcttttcttccaaggagcaagcgtcttttaatttcatggctgcagtcaccaaccacagtgattttggagcccaagaaaataaagtctgtcactgtttccgttgtttccccatctatttgccatgaagtgatgggaccagatgccatgatcttagttttttgaatgttgagttttaagccaagtttttcactctcctctttcacttacatcaagaggctctttagttcttttttgctttctgccataagggtggtgtcatctgcgtatctcctctagaaaatagcaaatttatctgcccattatggaaagaggtatctttcatcctcctggggacaatcctacaataagttggacttgtcaatttttttaactgttacttattttccaaggaatatcgtaacatactaaaaagccaagagagagggagagagaaacagatgaaatgacctctaatccccgttccacactgtttttattattttttcatggtgtctcttaaagtcagccaacaagcatacacaattataacacacttgttatcatagcttaaaaataattttatattctatcctttcttttcattaaggcaaggagaaaaggggatataaccgagttctatttgcaattccttctgtgcattgaataatagccactaatgcttccagcaaccctctccccacaaatggcacctttcttccaggtccatacagttaaattttgtagtttatggggtttggaattagtttcttgtatagtcactttggttttacaaattttctggcctatcattgtaaaatcaagctgaactcctacctgattggtgccatgttcgtatgaatttgccatgtgatcctttgcattccatcactgctaacatcttcagaattcagaaaggtgatatgaacattctggctctggataaatttgaccagaggccttttcagagtatgttgtacaaacatctaaagaaatactgttttctcccttcaaaatgtcattttccaggttcctgatctcattcctacagaactgcttttgaataacaatgtggccaaagccaatgcttaaggacttcgatgcatgactgaagacaatttttctggccttggaatgtgtagggttagagggtgggggaagggcaggcgtccaatgagtttctttcctcgtactctgaaattgttcgcttcttacctgcccttgcctcaaacctagtttttactgaaaaattcattgctcttaaaagtaaaagagctattaaaagtattcagatgtcagggtatcaggcaaccacttgtattcttggtggttctgtttgctctcaggaaaagtaattccaaataaaagttattgaacagggagtcttgcagcatgatgttggttctcagaacacaaatgagctgctgtgtgtgtgtttatctgtaataatgtcctcaaaatacagggaaactttttaatctttttggttcccttggagaagagaggacctaactaaatttcccgaattcttccacacaaaagtctttttttgttccctaaatacttttgctgttggaaataaagaactcggcagtctaagtccttcagcaaatgtttcaaacacctcgtttgggccaacaccttgtcctgggattggcctgttaacctttcaccctttacccagcctgccatggggcagtgatcctcttagagtcctccccagagaaggctgcaacataggatgatacttaagtctatttaacctggggatttggggaggcggcttttccacaatgcattgttcatcatctccatttgttttctatagttcttccaattaattggccagggctttgaaaacacatgtgatttttaaggccttgtaggctgttcctctattttaagtgggagaaaccagagtaggctcatgatttataaatgtccttatgtttacatactcagaaatagtccataaagaaataggggtcacatgtattacaacagcaca

SEQ ID NO: 53763 - DNA, 2497 bp, Bovine  19866880362006
tggctgattcatgttgatatatggcagaaaccaacacaatactgtaaagcaattatccttcaattaaaagtaaatacatttaaaacattttttaaaataagtttggaaaaataaataagggggaaaaggcattgtaatgaacacttttaatattccagaaggtaaaatcatggaaatagactctataaatcttgtctctatggaaaaaataaaagaatattctgggcaagggaacagccaagacaaaggcctagaggtgggaaagagctggaaattatgagaacaggaaattatccctagtgcctgctctcaaatagaaaagggtaacatggggtgatttcaggaagcaggcaggagcgaatggcacaagaccccacaagccacaatagtagggggaggggattttattcgacactcaaccggcagtcataggacactttaaacagggagcaaaaggatctaagttttcaaaaggtcactctggccctcgtgagaggaatggacagagagctggggtcaggactggaagcagggagtctagttacctggctgctggaatagtccaggtgcaagaagcttaggccaggggacaggagcggagactgaagggagtgcagaaaaataactgaaaaagcttcggcagactttggcaccaaatcaaaacttcctggatggataaatgatgacttggctgaagttttacctgatttgattggcttttctaaaattgtccatcataaaagtgaagttaaccatatacccaggtaccagttctaagtcagagatgggcagcaaacctcttcaaattgaacaacaatcaattgctgttctataaaggaggcatcaacacaagctcagggcagcgtttccatccggagtaaagaaaaaacagctcaatggaaactgggctgtcaggagctccctgtctgtcttccactgtctcctacctgcccccatgatctgagccaattctcactctgcagtttcaaagttaagagcccgaaacctccccagaacgaactgtaacttccaaggaagaatgtggtttagcattatgcttcagtaaatgcagaaggcaggcagagataagagaattaagggtacctattaaaggagccggaagtcctgaagaaagaagagcctgcacccggccagaggctgagttccatcactgctggcaagtttgcagagaagacctctgcctccaggcttcctcaaagagcagcagaggggtggcagtagggaggaagagttttttccttcatccctctggaagcctaatgtgcatgccagttagaacgtgggtcaccagtagtcctagagaacggtgcttgttcccaaggagtgctcgccctgggagcagaccacagagctgggctagacaccaagaaggggccatgctttctaccacttagaatcaagttcccctggtagtaagggctttgacttccagcaaaccttataaaggaaagtgcagaggctaagggacccatgaagatcactggcacaggagttcctaaagtcagtgacctggacttagatatgtatttggtatggaaacaagcaaaagtaaggttctcctttcaggttttgaattcaatcacctcccactatctggtggctcagatggtaacgaatctacctgcaatgcaggagacctgggttcgaccccaggttgggaagatcccctggaggagggcacggcagcccactccagtgttcttgcctggagaacccccatggacagaggagcctggaaggctacagtccatggggttgcacagagttggacacaactgagcaactaagcagacagccctaccacttaggggtataaatgagtggtgtgtgagaagaacaagtactccggcaggcccagagtggtcgctccctccttgggggcccagcagtggggctgcacagagttggcagaaggggaacatctgcaaggcaaatcctgggtgcctggcacctctactcaagtcagcacaccacaaagccccactggaaatcctcttcgatggggaggcacgactgcctccgtaagagaggggagtcaacgaggccggcagtcatgtaaccagtgggcagcaggactgaagtcagaatgagtcaaccccaagtcccatgtgctttccatccctaccagcccgcaccctcagcccagccacactctcccctgggggactgagtgcctgcccttcagaggtctacagcctgggcttccatcccaagcatgcagcttgcccctggctcttacctagcttagggaaggcgaccagtcccagacgttctcacctgtgaacttctcgaggcaagcgctcaaagcgccctaactctcctactggcagtattcacccacagccatgggacagggtcgctctcctcggcagattaagatgtgtcttagaacagctctcaggctcagtttcttcctgcccagccccaggcctgcagatcactccccacgggctccgcacctgggcaggaagggtaa

SEQ ID NO: 53764 - DNA, 975 bp, Bovine  19866880367467
tgaacgaccctagtgggaccgcattgtcggggtgaggggcaaacagtggtgcctctctgacatcaccgagcacaaggagctctgtctccagctgtacaaacagcacaggaaatggattttttttccttcatgttattttttgtctattaaaattatgcaaacccagcaaatacaacaattgcttttgttaagtctctgaaatgtctaaccattcatttcccaaataaggaggctgcggtgcctttgatgctgaggatggttaatcccaaatgtggagaactaataaaataatcaaaaaaggcctcagaagtgttgataaatttcaattatctctccgctctctcccaggattgggtgaggcgggatggggctgccttcaagtagtacttgagtccgggctgcattttctcttccccaagcctctaggcaccgacctctctcctttgtggctgaatcgccttagcagggctggggtttggaggtgctgggggccagaggagacaaagcaggcccgcttcacaaagccaagggagccaaagaaagcaaaattgaatctccagcaccctgctcctgagtaaacagacagaactaatgggtctgccatttctcctcccatccaattactgggctccggtacagagaatatggcaacatcagctcacacacattctaatactcttaatcccttccatacatataaacctcacatccactcacatgacttcattaccaaaaccacccaggcaggcggtgtgaaggaatgggcccaccagctgcagaaacctgccttcttcaagatttcatcagctaatgaggggtatgcaaatgaaaagcttatgggattacagcttgtctgacagcggttcgccccgagtgctgcaggactaatacaggtgttagtaaacgggttattaggcccggcctaatttaggcctattcatgctggcttgcactcttagcctcaacgtttgtcct

SEQ ID NO: 53765 - DNA, 995 bp, Bovine  19866880475629
atagagcatgttctatgaaaatttattttcaaattgtgaactcttatattgcttctatgagtcttctgggccctaccccagacaaacatagctattcctgctggaaactatgaaaatgtaatattttccccaccttattaatacctctgctaataaaggtcctgccaaccaagcatgttcttctgaacagttcccctcactgtatttgcaatcccacacttaccccaaggaactggatctgctataaaggaagatgtcagaaaggacccccaagaaagtggcttacctttctcgtggctgcttgatggtgggggtggggaagtgaccggtttagacttgtcatagttgttaaagctctggctccgtcggttgttagcagtggctgaccctccgcgtgtcttggcctcgctgcctgcagcggataccctcgcggtaggacctggaagtctaaaatgcaaaagcaacggagtcatcgcttcagtctcaggaaaacagcagcatctcagaagaaggaactgcagccatgcaagaggtgagagaaaccattcaagacatcggatctgtggtggcttgctagtccaaggactcagtgagaccaccacaaacatctaggctataatgacctcagtccaaaggtaaagtatgggctgttttcctttgagcacagaaagagaaatatacgactatgtttgctgattagaaatacaaagctcaggagttccctggtggcccagtggttaggattctgggctttcaatgccatgctccctagttcaatccctagtcagggaactaagatgccacaagccacacaggatgaccaataataataataaagcaaagctcatcttcgtttttctcctggatgagtaattttaattttcaataggaccaaaccatgtcatctcaaattctatcaagagtggaacataaagcccgggtaagacactaaactggttactttatgtgtgcatttcttctgaaagatattgaaa

SEQ ID NO: 53766 - DNA, 1420 bp, Bovine  19866880480727
tgttccaatttaaagctaagtagttgtctatttaggaaaatcttccatgtgcaaatacatggaatttgcattttcagtaaaatttcaaaacatctcctaaaatcctgtgttcaaaatatcagaataacaagaactttgcaattctggcaaccacctggaaactcttaccagacagatttatgcagagtgtttttcaacatgtatagatttgtttgattttatgcaaacgagtcattctataaaacgtagcaaggcaagaaattctcctaagctggtcggatgcagctaagaatcgagttaccaagtaacacaaaacaaaaagagatgaaatagagaaattagtccaaagcaaaacaagagaagtgcaggagaaatttggagctggcaatctcctaatgtgaaaggttaatcacaagatttaaaacctgatctcattctctaaggcagctcatgtaattgcatacattgtaaagagatatgagaacagtgggaacaggaaaaaaaaaagaacaacaatcgagcttgatataaactgtaaatttaatgtggaaaaaaagcaaaaacaggcagagaactcagcaaggggtcagctggggaactaagacagtagaaatgactataaataactacttttaaagaaaagacaacctttaatttttggattgatccatagtctaatgggatactccctaaaggctctttagattaattccattcatctgtgttgcctagcggatatttatagggaatctatcatgtgctgatactgtgggtatacagagataaatctaacacagggagaagaaagccatagctccctagagcagatagtaccaactgagagttgagaagaagaaatcactccacaaaagagctggtatttaaactctgcctggaagaatgggcaggacttggccatatgcaggtaggaatggaaagacaggagcagaggcaggagagtctggagtatgtgcttaagtcagaggcaactgcaagtggactggagtgcagctgacagacacagaagcagtgtgggctgcaaacggagatgggtagacatcatgggctctggaggaaattgaccgctttctaatgggaagtgggaaaacactggagtttggggattccaggaatggtctgactctaaaggtgttgaagaagattaatctatgtggggcagtctagaagaggaagaggaaaacatcatctcagcagaatatatttcaggacagcgaaagcacagagatttgtgttttggggctagaaagcactgaaagcatatttataagttacgtatttctaaattttaagacgcacttcttgctaaattggaaatgaagtaagaggtgccatggaggaacatgtaatttatcaagaactcaggcagacccagtgggtggactcaaaccaacttccccag

SEQ ID NO: 53767 - DNA, 1013 bp, Bovine  19866880605552
atctgggcctctttagagcagaagctgtcagttgtgacaaattgagcccaattgaagggggcttttgtgaggtagacaaatgtccatcaggatctcaaatgaccaccaaactcagttcacttctgccttctctctaatttacagcccaggaccctgagcggagggaccccgctatctggtcgcctgaccacagtaaataatagcaactggagaacttttaactgaagatgttttagtaaaagaccaacttgcagaatgggatggcagacagacatttccagtgtccactcacattgttttattaccgaggtgtaaagagatactggaaacatgatcacccttgatgagattatattcagaagtaaacctgaactccagattttggttataggttaaaatttttgatgctgtctttaagaaaacatgttgcttattatccatgttgttcaaatatcttgtatattgttttgtttgtttgctcttaaggaataatttcaaatttttatagtagtattttcttggggagtgctattactgactgcctggatttagttgcttgcaaatttttaaattttttgtttacaaaattatcttcttcagaaacctactcagttatttctgattttttaaagaaagaataagtaatatctaattttaccttaattagtatttctacctgattgtagaaatactaattaaattaaattgtagaaatactaattaaaatccatctattgaagatggatttcactaaaagaaataaatctaggcacttgaaacacctcaaaatctgattattatacaactagtagtgaatggagaggaaggaattaatagaatccattcttaaactgccattattaatttaatgtttacttttgagtgctgtatacctgctaacttccacagaagttttgaggcagattaaagttgtaagacaggttaaaagagaagtgaaaaaatcacatagaggaacagttgagtaattgagatctagagacatagttatttag

SEQ ID NO: 53768 - DNA, 1709 bp, Bovine  19866880617774
cttggattttccagtcctgagcctgtgtgtttccttttggctaaagctagtttttgagtgggtttctgtcacctgcagcccaaggccacaattgtggaatgaatgctaacaaataaggctgtgtatgtggctcaaacaggaacctgctgcttgtcaccagagaagcaagaccttccttcctactgatgaagaatgctgggtgctttcagaaaacctcccaaccaggagacaaagtttgcatcaaacagcccccaaactacagtcaaaatcagtgccttctggggaagatataagatgctgtgaaggttgagcttagaacagtatttagcaatctcttctttaggtggttcataaaatataggaaaaaggggttttgcagtcatatgcatttgtataagattggatcattcagcctttttaacagttaagaatcaggacattaaagtggtaagtgttagtcagtcatgtccaactccttgtagccccatggactgtagcctatcaggctcttctgtccatggaattttccaggcaagaatactggagtggatagccatttccttctccaggggatcttcccaacccacggatagaacctgggtctcctccactgcaggcggattctttactgtctcagccaccagggaagccccaggacattaaaggacagaggttttagagaacccatatgcctgttcaccacccccaaactcagatgggaataatgattatttggccatgaaatttttccccccacatactctgtgagtctaaagttccagagaatacagtttggcctgaggtgtagcctctctgggtgatgaggcaatcagagggttgagtagcatcttgcgtgggcaggagcgtcagcgcttcttggggtttttctgagtgactcctccctggccacagtgccctgtggcctctcccatctgtagagcaggaccgtgtccaaggcttgccagcaagagtaactcacaggtatcagcagagccccatttcaacattaagattccattatgtcagagtcctaaggctaatgggacctcttgttatgtaatttcagcaataaactaaaattgtttgtttccaatggcggttgaaaatgctgaagactgttgcttaggtaagtgtaactgtggtggcagggggaaaaaaaatacaacccacattcacacacacaaatgaaatcctggccactggtttctatgccaagtcacagaacaaacaatgcaattctggaatctcccctcctgcacgtggccggattacctttgaccgccacggagatggtcgtgttctcccccaccaggtagccgcagggaagcagttcgggggtctcagaggtgttgctgcgcttgacgtccccgatgctgtagccaaggacgctgtcagagttcagccccagctgactcactgggtcaatgtgaatgatgtactcctggaaaaaatcaaataaagaccccgttaaagatgtggggaaaaaatctgtggaagactcacggtttcattgggtgatttatgatcatcttctcctcttccccagctgatgcctgagttgaaactgacctatggaatggggggcagaagagctgactttcaatggagggggcggtgtcctcatatcacaggccctctaaagcacagatttatgtggttagtgatgggagggtggcaaactctcacaagatggtgaacgtgtagtctgg

SEQ ID NO: 53769 - DNA, 2152 bp, Bovine  19866880630391
tgatttttatacataatatttctcatgtctgctcataatacacgtacacggtaattacaattgctggtatatccatttcacagaagggatacctggaggtcactctgtatatttgacttgatcagagaactaattggtggcagtaccaggatttggactaggtgtctacactggtagttcgccagcctgccttccccagccacctggattcaggcaacaaaatgcatgtgcacttttgacccttgaactgcatgggtctacttacatgcagatgtttttcaatagcattgataaatactacagtacttcatgatccacgggtggttgaattcccagatacagaggaactgcatgtgcagagggcggactacaagttgtactaggatttcccactctgtggagggtcagtgcccctaactctgccttgtttaagggtcaactatcatttgggaagatttggggaccttttcagaaactcacgaagctcctatccaaattgcttacactcaggagaaagaggaagggaacttgccccgggtcgctcagccggcaaactggcagagccagatccagacacacctgccacctccaaagcccagattcaatgacgtcctctcccccaactctgctgatctgggtgttgatcgcagctacccttggtgttcacttgagtcaggtttcatcaataaaaacactggtggagccttcctttagagatagcttaggcaacgcctcccctaggctttaaagggcccgacaaatactttttgagggggtcttgtctaatacataaagaaaatttctttccagaagccaacgtgccagcaccatttggacaggccagcctcatataattccatgaaagaactttgaccccagctaggaggatccacattcttgcttccctggaattggggcccagctatggagcccaggccatcactggggtaactgctggagctccttgggacatctggtcatcaccacgagtgggtagaagttcagagggttccctgaaaggagaactgggaacagggagccccccgcttccaggtgttaggtggggtacactgcctggtgtcaggctctagacggagtctttgataatttctaggaagatactcaaaagcctactttaaaggacaatagtgagcacagagataagaaattatgggggaaagaaaggaagaagggagtatgtttattaaacatcttctatgaggtatagtgttcggtagggtggggaaggggagaccagagtaaggtgaataagaaggacagaatccatgctttcctggatcttagagcctggtgaggaaaacaggcatgactcacaccattacacggaggagggcagggaacgaggaaggaggcaaggggccatctgtctactagagaattccaaagcacagtgacacggtgggaggtagaatatcgtgatcttagactttggggtcaaaaaggctggactcaagaacctcccttgctccttcctatctctgtgccgctatacgagacgcttcacctcccagcttagtttgctcttctgaaaaatggggataagagttcctgcttcccagagtgcttaggaaggttcaatgaaatcatgcacagagggaaagcccgtagcaggaaatctgacccacatatggtgctcactgaatggtggctcttactagttattatctgacgtcttagacttaagtagatccaaagcaagtggggaggaggtctggggtaagtggacgctctgaccgtccattcagcagctggcagtaaaattgcacaggaagaggggactgaaaaatccactgtttcctcagcccttagagaaattaatgatggttgtgatgctccttgagccacgagggaaggttaacttctctctgatgttttctgacttttgagaaggtgaggatatatagcacagaacttctgagggggataaaagggactaaaatatgagtttagatgctggttatgttttccctgtcatgtggccgggccaggcaaagcacgggccctagatgtgtgtgtgctgaggctctgtctggagcctgtcagccttgtccgggctggatttccagtttgggagttgtagatcttaaatatgggtgacagatgtgggagaggcgtatgcaggagatgaaaa

SEQ ID NO: 53770 - DNA, 905 bp, Bovine  19866880693972
tgttatatagtacagcagttaaaattaagaactatagagttacaatccccagccacttctagctccctgactttggacatattgcttaagcaacataactcctactcctagagttactgtaaaaattaagcaattcaatataagtaaagagtatagaacggcacctagctcatagcaagtgctcaagaaaattctttttttccccaaaaataagatgaataagggcttccctggtggctcagatggtaaagaacctgcatgcaatgagggtgacctgggttgggaagatcccctggaggccggcatggcaacccactccagtattcttgcctggagaattccatggatagaggagcctggtgggctacagtccatggggtcaaaacgaatcagacacgacagtgactaagcccagcacagcacaagatgagtaagctgcttacacgcacagaaaaatagtctagacatcatcaaggtgctgaggctgcctctcactgggtcatatgttatgatgacatttcgcttccccctctactgtttgcttgtctgtattttctatttttccataataaaacatgttaattttttttaataaggaaaagaaaaaatttttaattaaaaaaaaaaaaaatctgatctttattgagaaacagaaaccctcacccaaatgtattttttaaaaaagctgtagaccaggccaagtaattacaaaacctggagtctggagaaaccgcatggtattccctggtcttttctagttcagtgccctaataacaagaaagaatttgcaccccagcacctctgcagagctggggagaggaagagaccagagagacaggaaagcctggtttcattcttagcaatccacttagtttaaaacatcaggaagtttagaggattaaagg

SEQ ID NO: 53771 - DNA, 1390 bp, Bovine  19866880739159
ttcttgagtgtgaggctagttaacttgcagtgagaggacataaaatttattttgaatattattttaaaaattatgatttaatacatttttacaaacctatagaggatgaggtaaattccctcttttccttaaccacttctcctgactcctccctccccccgcctctctctttctctcatacacatgcatacatccataaaatgaatggaatagatttgtaaggaaactggattgtatcacgctggtagcattcaactctggcttccagtctttggtccatttgagaaggcagaggatcctgatttatccctgactcctccactggggaggagtcatctctctgcctaaacaagatcagaattcccagtagcagctgccaagctaaattagcctattcggtcacacagtcacatctctctaaggccccccacctttatcagtggtcagtttttgacaccttgcacctggcaataccaggctggaggctgcagcacatctcagcattccagctctggaagcgcaccaacctctgctcttggccttcacagaaagccagggctatatatgtgcaggcctccatctacatgtccaggtacgtgtgattgcccgaccgtgtgtgttgtttcaccagcagtaaaaaaaaaaatgcagcagggaaatgcaggctttaattagtttgtttgtcctttgacaagatctccccagttgaaaaatttttgtttatctctatggctgagcaggctttgctaaaatcgaaattaactgccttgcttaatggtgcagtagattgtgttttgaacagcttctaccgaaatctccttgaaaggacatttgatctagaaagtctagcctctggcagagttactgcattttggtgtaggtccttttgttcctcctcatgctagttgtaggatgcacacatggagctcaccactgtatctactgggtagtgggtggatggatggacagatgggttgactgacaggtgctcagttgtgtctgaacctttgtggcaccatggactttagcccatcaagctcttctgtccatggaattttccagggaagaaaactggagtggttgccacttcctcctccaggggatcttcctgacccggggatcttcccgacccggggatcttcccgacccagggatcttcctgacccagggatcgagcccacatctcctatattggcaggcagaatctttaccactagtgctgcgtgggaagcccctgactggcaggtagacagttcaattgccatatgacttagatgtcaaattttctgacgtttaagaggaaggaaaacctgtaattggtttcctcccaacacgtttttgctaaacttcgccttatgacagtgtctttggatttcattcaacaaaagca

SEQ ID NO: 53772 - DNA, 2779 bp, Bovine  19866880760083
cagagggaccaattataaatctcaacaacccaatacaacacaaaaatgaaggaaaacatgttaccttaaaaagttaccttaaggaaaaaaaaaagataccctaaggaagtcacttactaatttcaagtgttttctttcctcctctcctgatattcatttctttattttcccagtagagtcaaaaccctccttacatgcattggtttcaattccaaaaagcatatcaaggttatgatggctcattactcacagcagaaatacacatgaaaatgttcctggtttctccaggaaaggatagaatttcttgttctagagacttttgaaattagcaagacaatggacatgacgatttcagtacctggaaaatggtaaaaatctatgccaagttacaattagtggaaagcaggagaaagttctaaaagtttctgagagctgaaattgctggtattttccagcagaagaggggaataccttcagattagtggtcaacgagctctatccagggaagaagccaaagttgtcactacaagagtaagtccatgcacagaaaactgaataagagctgaaggatgattgcatttgaaacacagaatctggctgctcacaggctctgcagcatccgtggcatccttgcctttgggagggagccgtataactgcagaaaagcagacggggccctttaacccactgacctcttttaatctgcttgttagcctggctgcgggcaggaccagggggcctgtgatcaatgcctctctggggaaaggtcagaggtcagaggcacagtccctcatcatcattattctcaattattcttcattcagagccactttctccccacttttgagggaaggccctgtaagcattttccaggacactgaagggtgatgacccggccctgcacactgtgcttcttttcctccctacctcgctcactgcatctccctgatcaaagaggataacagtgggtagaaactcacagagaggcccctgtaggaagaaatcatggcagtgagcacaggtctgtacacagcacactcacacatacccagctcagcagaaggtcttgctgctccccaggaccgactcacagttttatgacagagcaattcaaggcaaggcctttgccatcagacaagacagaggttctatgagttactaaccttggaatctttttttttttaattaatttattttaattggaggctaattactttacaatattgtggtgggttttgccatacattgacatgaatcagccatgggtgtaattaaccttggaatcttaggcaagtcacttacctaactgaactttaatttcctcatctcaacaacaggtataacagtttctctcgcatagtgctatggcaaggatgaaatggaataaagctcaaagtaaatgatcaatgcatgttagctattaatatgctgaatgtcaattctataattgttttggcagtacaattttctgtatttccttgatgataaatgtaaataatggtcattgcacaaaaactgaaatataaggaaaagtataaaccaaaaaaaaaaaaaaaaaaattcttgataatctacccccagaactgagcactgataacagtgtgactatttctgtcagtgtttcctctgtgcagagacacacacacacactacgggatcatcttgtaattgcagaaacaactgcttgtcaactcaccgggccctgagttcaaagtctgacacacacttctttctaattctcattgtaactctgtgaggcactgtgatacccagttcagtttcagttcagttgctcagtcgtgtccaactctttgcgatcccatggactgcagcatgccaggcctccctgtccatcaccaactcctggagtttacccacactcatgtccattgagtcagtgatgccatctaaccatctcatcctctgtcatccccttctcctcccgccttcaatcttgcccagcatcagggtcttttcaaatgagtcagttcttcgcatcagatggccaaagtattggcgtttcagcttcagcatcagcccttccaatgaatattcaggactgatctcctttagcatggactggttggatctccttgcagtccaagggactctcaagagtcttctccaacaccacagttcaaaagcatcaattcttcggcgctcagctttcttcacagtccaactctcacatccatacgtgaccactggaaaaaccatagcttttactagacggacctctgttgacaaatgtgatacccatttacagatgagcagagcaaggctacagaggctatgcaaccaggtcccaaggccagcagttcctgaacagagctgtggctgcgggcctctctagctggagtgcctacctctctgcctgaggacaggcagcaagggcgctccccgacctccttgcacttttcctctcctcattctttgactctgccgcttctcagaagacacaagctgctccagaagtggcatcattttcttctccctgccctgcccacgttgaaagaatctcaaagaaaggaagcagggtggggagggcagtgatcaggatgtcagaaccacccacatcatgctctaggcctgtgcctacccctcccaggggatgcttcaggcctgagcagtcacctcctctcactttcatcaaaggctccatgaccctgtcagatgggatttggacagagaagactctaccagctactggcttctacccgaggtgggcaggtgcctttctgacatccccctgcggagataatacataaagatgcaagtt

SEQ ID NO: 53773 - DNA, 1861 bp, Bovine  19866880762803
ccttcctcactgggtctatccctgccacatcatctcttttctgcttcagtcccttagcttccaacagtccttttaactgtaggtcccatacccttcactggggacttttaagaaacctctgaacacaacctacctgaagatgaaaaagaaaaaggctagttggaaatagattgggtattttatcttcttagatagctttggagacattcagacaactgcttggtgtcacctcgggtcacttgcctggaaggttgcccacagcctctatagattccatctcatgttgtgctccagtcatgtctgactctttgcaaccccatgacctgtagtgtgccaggatcctctgtccataggattctccaggcaagaattctggaatgagtagtcatttcctcctccagggaatcttcctgatctgaggattgaaactgcatctcttgcaagtctcatgcattacaggctgattctttaccactgagccacgaggcaaagagtcttaaaaagccttctcaacaaatgtcaataaaaaagcattagccctgatattaagcagttaattttaacttgtcccattaaccaggaaaagaattcaggtaacagtgtaaagtgtttttaaatcagtgagtttgtattactatgttgttaaaaataaatgatcttatttatttattatttggctctgctgggtgttcactgctctgcaggcttttctctagttccagcgagcaggtgctactctctagttatggtgtacaggcttcttagaggagccttctcttgttgtggagcacaggctcttgagctttcaggctttagcagttgaggcacgtgggctcagtagtcacggctcccaggctcctgagcacaggcttagcgattgtggcacatgggctttggttcagacatgtgagatcttcctggacaagtgattgaaccagtgtctctggtgctggcaggcagactttttatcacggagtcctattttattgactcatagttgcattttaaaaatgaaaaccttaggatgtctgtatctgtatgtttctgtatgtctctttatgtgtatgttgtagatgtgtagtgttatcctatctgcaggtggtatcaccaaattaatcataaaacccattaggggagtttcatttaattggctaaaagataaacgagcacttatataaattaaatacttctaggacagttggaaatatagaaacaacctccatttttttaagttcacatggtctgagataatctgtgataaataaagctagttttaaaatcgtcaggaaaataagaaaacaggtatgtctccaaacttgttagcattaagtgtaatgaagacatatatattttttctacccaggtaagctaagcttatgatgcctctgtgagatgtggaaaattgtaaagctataaatccaacctaaaagcaaagtgcacagtaaaaataaattgctcaatgcatgccaaaagcagcagttaaaaaaataaaaaaaaaaggaagaactatatgtttaacttttaggttcctggcttctatgatatttttgataacttgccttatttgttaacaggaaaagtaactgaggatgataacttgctttgtttaatgtctcatgaaattttcatgggtttttcaagcataattgttaagaacaagttaattaaatagatataagtgggataacagtttataaatgagcttttcaaccataattatgttttacatctattgaaagtcatctgaaaaatcttttgatgacttgaaaccttaaagctctaccaaattaagttaaataatgaatattcattggatatctagatcatttctaaataagatgaaatactgcaacattaattt

SEQ ID NO: 53774 - DNA, 717 bp, Bovine  19866880779727
gtaaagagtcccctgcaatgcaggagacacaagagatgtgggtttgatccctgggctgggaagatcccctggagaaggaaaatggcaacccactccagtattctttttttaccccagtattcttgcccagggaaatcccatggatagaggagcctggtgggctacagtccatggggttttaaaaagagttggacacaacttagagacaaaacaaaaaacaaatcaccctgatgaaggatccccaatgacatctgggtacaggtctaaaaccttcctaaaactggtctcaatagcgcctacactggctcaaagcttgatgcaaagtatgggggaaaggggtggggtctcctgtctaaacttaacaacaacacagggcagggattaaaacacactgaaacccctctctctgctcttcagtgctgtttcagcctcttgccataaactccaagggaaggagtactttgcagacgaactcacttcagagcacataaagccacagcccctgccccagtaccactgaggtgaatcatctgcagctcatggatctctttcagctcaaatcctttggtggtttttagtgccttgaaggcctaagtgtcaggcactacagggaaacacagaagactcaggtatcacttaaaaacaagcccgagctcacccctgggagatgctgaaacaacctcatgtgctgagagcagcaccacctgcaactccacg

SEQ ID NO: 53775 - DNA, 3846 bp, Bovine  19866880854080
ttatacaatacatagcaatttctatgtgaaactttgcttttaatggggaagaaacaatagtctaggaagtggaagcacaggtagagaaggttcattacattctactgtaataaacattctcgatccacttagtaccctggcttgatttaattattacatggggaatttcctgcaaaaggtaatttcaaactttgaagactattatatggtagagacaaaaaattattttttgctgaaatactagcctagatatttaaagttatctgcttatgatattgcacatttctgaaaaccactttttcctttttatttatatagggctattttcttctctttgagtctatgttagattctgtcctttatgcaaagaacaaatacttggcaaaaggaggatcgggtgagtataaaattctagttttagtaatctaattttagtctggcagaaccaaatgaacctttggatttcaaataaactatgcatgactgagaaagttcccaatagagatgaaagatgtttccattagaggaagctttaagacatttgtttagtgtactgttggtagtagaacattgtattaatataagatatgcaggactcccaagttaatgctattctcatgaacacttgagtcttttgatttgtttgtttttatgacatttagttgttgtttttccccaaaagaatgtttcatactaggttggaaatcattcactttggtagcaaattttccatgacttcactaaatgtataaacctgtcttctctgtgatttaacagtaacatttaaatattggtttctgttaaatttataaagcaccgcataccagtcagtatttttaaatagatcccaataaatgtggaaggcttccttttcatgtctgtagtgaactttcactcacattatctgcatacttggtgagattgtgttttataggctttctgctgtaaacagctgtatacaaatagagtgtcctcaggattatgttttgctcatctttggctctctactgagctctacagctcctggactatagatagatcataatacatgtttattgcattgaatcattaaaactgagttgaatagcatctgtctcccttcactcacctttccctggaccttccctttctcaaagctttagaattagtaagtcatttctgtggtcagagtatagttgataaaactgctatataaaagtagatgaaaaggaggatacattttgaactgatatcataaaagcacttgagcatacgtatgcctcctgcgcattcgtgttctatgaaattactttggcagtaaaaatcagtaaggccaaaacagaaagtgcacagaaaattctccaggacaattgaggtctttttataatagcatttaagtggattgcctttcttttgcagaatgctctcattttatcgctgtattttctgtaaccattgcaagatatgtttctgatctgtgacatgaatatggctagaatgttttagatatattttaccctgtaataattggctatatcttgtaataattggcagtggtttttttatgacaactatatttaatgactagaaactaatattatctacttttgtctgctgctgctaagtcacttcagtcgtgtccgactctctgcgaccccatagacagcaacccaccaggcttcccgatccctgggattctccaggcaagaacactggagtgggttgccatttccttctccaatgcatgaaagtgaaaagtgaaagtgaagtcactcagtcgtgtccgactctgtatgaccccatggactgctgcctaccaggctcctccgtccatgggattttccaggcaagagtactggagtggggtgccgttgccttctccgctacttttgtctactagcagccaaataatacagtctacctttatttattgtattacatataatcgtcacaacagccctttgagattttagaaacatagatgtcctggatggtacatttaaatatccaagccttgaacttgtttttctaaacacagatctgccagactctagtattcatgttctattgactgttccttgttgtttctttactaaagtgcattttattgaatctcattcttgccttgaagttgtttcaggggaagattcagaaaactgtttccatacctccctgagtggtattcattgatcttactgagggactgacagcagtttaatacatttaaattgaattcttgatgaaattcattaagaacttacagccatgtgaataaagaggttgtagctgaaacagtggcagagctattttccatcatcggagggataaagtagagacacataaatctatctctttccatatttttatatagctgcttttagcactcagatattctaggggtgtattaaagagaggtcagcattcaactgcatcagtggtgctattgaatgttacttgtcaacagaattaaaaaagtaggaaaagacagaaatgagtaacatgaagtggtttagcctattttgtgtatttgagcatgctttgatgaatatcattggtcatctagatgctcattcttttattgcaaataagagttttacgtttttcttaatgaaagatttagtaagctattagtagtgtaaagatttaagaaagaataactgaattatgagaaatagactattgaagactatataagcatgaagggaccacaatttatttttacaggaatcttagttcaatttgtgtctcactttatatataatggcaaggccttcataaaacatagtcagccaatagcttaagtagtcactctcctaatcaccaagtaatccacagtactttagaggtgttcattttctgctgttatcactaataaaacttcgtggggattccctggcagtccggtggttaggctgacgcggtgcattcactgccttgttcccttgttcagtcctcggttggggaactaagattccacatgccatgtggtgaggccaaataaaataattaaaaataaaataattttttttaagttttgtaaagttactgaaagtgggtttactactttctgcttattatcagtttaccaattgtatatcagaaacgtagtgtttttacattcaaccaaccaaaaactcaggaggaacaccaggcaaatgttagatcatgaccagtgcatatttttacaagaaattaagcaaagaatcggacatgactgagcaactgaactgaactgaatttgaaaaccaatgtatattttaggattgaagcatagatataaatgttttatacactaaaagtgtcaaaatacctacacagatttatctttaataggaatttatgtaattcattatttcattgttcaagggttggctgttttatgtcatttaaaaatgacaactcacatcatagcattataagtacatttagtactacaaaggtaatgttaaaatgatactgttgattaaaattgaatggtgaggcttatggtcatcagtcctgtctgtgtcttgattgtggtggtgattgtataactggagtatttatcaaatcacataggattatacaccgaaaagggcaaagagagtgagttttactgcatataaattttacctcagtagaattgacttaaaaaaaaatgaagcagtattacctccgtcaggtcaaatgaatcatgatataatatgatttctagctgttttgaaaaataaagctatgtactaactttatgcccacttctgtaatttttgttagtattatcaatgtatctctctataactaaaaaataattgggtgattaagaagtggaaaggaaagggaagaaccaagtaaatacactgtttatcattactcgtgataggagattag

SEQ ID NO: 53776 - DNA, 827 bp, Bovine  19866880883472
attgaatcctgctctaccactgctgaaactctgtgacactgaagcccgttatttagcttcccgaagccttgaagcactacaatgaatttcgtttctaaccttctgcagttagatttctctttgaggttttatctaattaatggcaaacgtctgatgaagacacacagtttcagacaacgttcagatgtcatatcagcctcaaagatcccagcacttgggaaccgtgaaatgactacagttttcacccagatgtttgcttgacttagtggaagcagccttgatgcatgagtattctataaatcagtgtgaaggctctttgaggaaagttcttgtaaaagtttacagcaagtttatttagtaagactgatgtggaagtaaattctagtttcggaaaacccacggcctttgtttttaaaatgacgctggacctcagcttggtcgaagagctgttttttgatgtctccagctccttgtcactcctggatatgaacgcatgcgcacctgtataccattagggtttccctaaggcggggctgacgttacgtgatttccatggagtttactaaggaactaagggcacacgcctttggcctctgtgtgcgtgtactcactaaaccctcctatttcacttagcatgtgccaggcatgtccaagtactttataagaaaccgcctgacctcaccacttcattttattagactgataaattggaattcagctgtggttagtggaaaaggaattaaaagtaacagacgtagatgtctcttactaagatttggtctgtgaagccgatccatctactcatcttcccaaacttcagcgcgcca

SEQ ID NO: 53777 - DNA, 897 bp, Bovine  19866880898456
cgccttgcgctgcacgtcggagaacacggctcgacgcagcatgcccctgcgaggcttgccgcgggcggccagtggccaggagaaggtccccgggatgggcacgacgctggaggacgctgcggaggccaggagtgctaggtgagtgagtgggcggtgtcctgccccgtccgcccctcctttgcggcttcctttggttttcctttctgatccttcgtctctttaaagctctcctttttctccccctggagaataggctacgaacctacaaacctgcgagagtgaaaggcgctttccgcccaaataactttccctttcaaccgtgcaaacccggattaggtaaaaccacggaaacacagaaaacaacccccacaatagcctgtttcgtttttccattcaacggtctcagggaaaccaaacctgcgtgcatcagctaatatagcaggagaaaaaaaaaataagttacaaaagtaaaaatagccagccgaggccccttgggtttcccccctaagcttttagcacattggtggcttttgcattctttggatgaaaatgaggtgctttactgatttgttaggagaaaatccgctttggatttttttatttttggaaaaatccaatcagtattcatcttttttatattaatctttcctcccctcatccgcaaaacgtaaagaattcggcccgaatacatgaaaagtggcagctaattagcacattgactgcttcccaatgggtattggcatgataaaaggagggggtaggggggtggggcagagtttcgctttaagggaggaaaaaaaaaaaaaaaaaccccaaaagaaacagagactctaatgaagcgtgaatggtaattgtgtagtaatgaactaacagaaaaagactgaggacaagcagcga

SEQ ID NO: 53778 - DNA, 1004 bp, Bovine  19866880906904
caaggggcatgcttatagcctggtgtgggagcgtaatctgctttgagggccttctccagcccagagttccaaaagtctgcttacaattagcttccagcttcagttcctccatcagaaaggctaggaatgtgttgagttctagcctctgatcagaaaaagctctaggagaaggtggagacagggtcagcagagattaagtgccaaaaaggtcagctggtctgttgccacttccctgacaccagccccacactacctcccccgctagctttccgcctctcctgactgggacagtcacatccgtcaggtcggcctgtccccaaaagtccctgctgactaactgccaagaaaatacagcgtgcccctgctccctcctaccaggagagggaggggggaaaaaaggagcagggaaggcaggaagccaggagaatcggattggcccttgctgatttccttaaaagagactgcatggctagggcctgtcacccagccgaattgggtgatgcgagctcggtctggaaaggtagaagtcatcaattctgttcaagccacccccacacccgcaccccccagtcacccgggctaccggcaccggggatctactacccaggaaggaggggcttagctttgggcagccattccaaggcagccacccccgccccatcgctacagccagccgagacgctaggagtctccggttgcctgcctccgccggtgcacccggcagtcctactgcagtcccagcaccgtgcctggaatgctgtcagcccaaaggatggggcaggcccgagtatctccaagccgaggggggccggtgcactgccacccctagacctcttttcctggatcttgcatccaagccagggggggagtggagcccagcgaggtctcggaccattcctcggcagggacagaatctctgcagaaccgacagacacacagccgctgcagcagacactgtcttcttggggccaagccccttgacatgcagaacctgacatctccag

SEQ ID NO: 53779 - DNA, 2236 bp, Bovine  19866880923337
tgaaattctaagagcatcttacagcagatgcctgtaacaatctgtcggtgaaacttaaaagagtaaaagacgacctcggaagagtccaggcatgacagttggagagttagaatctcggggttccaatcctgtcttttgccaggtaccagccttgtagtatggtcagtccttcccccatctctgcctgtcagtatcctcgatcgtgttgacctacatctttgtcttttcagcatcgtgatctgccttgggagcccagctgagatgccctgttctcctctgaggctgcttctccttggtctgcagttctctacagcagtggtgctcagcccgccagggagttttaaagcccccatccacaagtgcttcccatgatccccaacgcatttcgcccacatcgttacactgaatacgcacaatgttcgctcgttgcacaggtgtttatccagcacttactctgcaccaggcaccttccaggtgcttgggataagatggacaacagggcaggcacagctcctgtcttcaaggagctcatggtacaagtgatatcacacccagtttacaggtgaggagactgagactcagaaaaggctaaatagtgggaagcggcagaggtgggattcagccccagcctatgctgtttcactcccattgtcacagacctttcttttccccctctcccagactccttggaggtgggctctgggtttccagtgcccggctccctgtctttctctgagttgctcaataaccaaggctggcttagctgaactccacaacccctggtgacctactctgtaaaatgcacagaaacaggtctgcattgccctctctcggggcggatgtgaagaccccaggccacacgtgggcatctggaagggcctctgagcaagctggagccaaatgtaacttggaggccataccctctgcaggaaattcaatctccctggctccaccactgcgttggtcagccctgccccaggcctcagtgcacatcggcgccttcccacaaagcctccagaaggtctcattacatgcccagcacatcccgcaaacgctgcgctcaggagcccatgcgctcgggtttcctgggctgtgtgcgagctccctgccaccaggtcaggggggccccggggacagcgggcaggggccctggcaggccggccgagtcttccaggccctcccaggtctccacctgggcagagagttctcggtttccagatgggatcactgtcaggagggaaagcgacaccggctatttcctggaagggaaataactgctgaggcgatgcattaagtgaatagcctaccccaacgctacttgagttttagtttaaaataaaaaaccaaacaacttgaaaccagatcaataccactgcctggagagagtcagggagaagcaaaggaagccgggaaggggacaagcattgatttgcttcctccccggggcagctcaaacactggatgatctgagcatgcagttagcccgtgtcccaggtcctgtccgctcccagctttctagtgagctggcctgactcagccctttcctgaccggcatcctgcgtgagaagggcacagagtgaaggaaggtggtaaatctgagcccttcatcggtgctgcgtgacttcaaattactgaccccacctctgttgagtgtcaagtttcacatctataagctgggtataattatccctaccccaaagcaccactgacaggtaaaataataggagtgaggacataataagtattcaataaaaggtagacgataatgataatcatcatcaccgcttttttaagagggacataatgaaagtctagcttcacaaagcttagtcctgtggctcttctcagagctagggaatgttctagaaggtagatatgactgacggacgctgtgcacagggcaacaagaggggagtaagagcaggattcctaaaagagaaatggaggggacgtgtggcaaagaggttcgatgaatgaaaagactgtggaaatcagacaaaatttaaattaaaaaattctaattttgccatctgcagctcctattaaatctgccttctcttgaacagtcctccttccacgctttcccagcattctcctacttaacgacagtaaacacactccataaattaaaaaaatatagtagagaggtaattaatgctgagccatctaattccgaatttctaatcatgctctgcttacattaaaatgagatttcaggcatgtacaacaatcaatt

SEQ ID NO: 53780 - DNA, 1945 bp, Bovine  19866880934334
ttggagagactgtatacgttggattaggtggggttttttgcgagtataaatgtaaaggatcatatggaggtctttgcaagtaaacgtgataaacacaatgacatttcaatgaaggcagcagtgaatgctgacatgctggtcagcaacacatcatcaatagctcaagtcatggtcccggaatatcagagacacatttagaaagtgcttctgggaggaagctcctgctttcaaaagagacaggccaacaaacatataaggtagtcattcacatctctggtcacagacagagaaactgagcccctaggagtgtattcaatctgcttaaaatcacacaaatagaaaatggcagagcagggatttgaacccatgtctttctgactttcaagtttgcattgctttccatgaccttattcttgaggtgaccaaggatagatgaaggaactcttagaacctcagaatttggaagagaacataagctttctctaattgtgggttctcaaacttatgtgattagactcatgcttgaccagctacatggaaagtttattaaagctactgaggaagataaagagacagattcacccatcatcagaggggctggtcctttgggagcagaggcaggattagaggtgagcaggagaccaacgtagagctccaggtctgagtcaggctgatctcttaactcctccactcctagctgggataaactcccaaattttctgaatctcagtttttccacctgtagaatggcagcattctggctttggatggagtgtgcactttgagtcaaaaaggccttgattagagtcacatctttgctagtgatcttggctaaatcccttgggtcctcatctctaaaacaggcatcctaagaaccccttctcatcttgctacaatgaaatgagatggaaccctcagcagagagcctggctcctaataaacgtttcataaacaacaactgctcttactcaaggctaagtgctcagggcttaagagcttgggcgctggagtgacccttccagaactcatcaactccaccacttactgcctgtgggatgctgaataagttccttaaccctctgtggcttgtttcactcattctgcaaaatgggggtaataagattatcgaccttagggggttatggtgaagattaaataacacatgcttatcaattgcctagcctagtctggcgggtggtgatcattccttaaaggctacccactgttacttccctatcgggtgaaacttactaagagttggccaacagaagataggtctacacctacctgagtgagggagggagctccctgtctgtggcagtgctcaggctaaaggaccatctgtccagggtgggtggaagggattcccacatgaggtcagtggcaggccctgctgacccgtaagaccgatgtgtcctgtgactctgatgttccaactctgtttgagttaatagagaagacactgacccatcagaccaacaaatcagaagtggaaaaattacttcctggcttagtttttaaaaatcaaagcccctttccagccaaaggtaatcacagactgatccacagtaaggcagaagcatatttcaattgaaaaatggcatcttcctagccgttgccatatggagccagaacaccaggtggcccagggctgagaccaatcacagggtccaattggaactaaataaaatgaccccctggaggaagtggctccagtgaggcccacaaatccccatgacatgtcattttggcttgtcccacgtcagcctgggcctcatgctctgcctgacgcctgaggctctctcctttcgctccggtgggacaaagagatgaggggcctcagctgtgagtacaccccgagtgtgaagggggagcccctgacacagcagaggagtcctggcctcagccggctgctgtagagaacctcggggacagccagtcccca

SEQ ID NO: 53781 - DNA, 1644 bp, Bovine  19866880957880
ctcaatcagaacggtgagtttgcaagctaagggttaactgacttcatgtttattgaactgcaccagagataaaagttcaggcacccacctctggccccaggccccattctgggatggttattcacacacaattgacttcttagagttccttcctgcagaggaccactaatgactcaaaggtttaaaaaaaaaaaaggtttgttttcttcaagctcattagaagataaaaaccattcatccaactacacaatggagagcagaacatttacctttgaagaaaataacaataacaaccaccattgttcccatttttagacacccaaatatcagacttggggcttccctggtagctcaggtggtaaagaatccacaggcaatgcaggagaccctcctttgattcttgggttgagaaagatcccctggatcccctggagaagggacaggctacccactccagtattcttgggcttcctcggagactcagatggtaaagaatctgcctgcagtgtgggagacctgggttcaacccctgggttgggacgatccccctggaggagggcatggcaatccactccagtattcttgcctggagaatccccgtggacagagcagccttgtggactatagtccatggggtcgcaaagagtcagacgcaactcagcgacaatgcacacagcacatatcagaccttggtgccagatcctgtttctgaattctcatttcatctgttcacacctggggaaaggggctataaaactcttttacagaagaagaaaattgattcggagattagtaagtgacaaggctagaattcgaaccaagactcacctgagagccaactctttcccaaagagcacagcctcccaccatgaaaggactctctgcacagtgtcaacgtacaacaaacgggtaaatcagcaaatgatgaaacacaaaacaaactaacgaggtgtcagctaatgacgcggccgtggtttcgaggattctgcagaaaagctgagggcccatccttgagggtagcagaggctctctgaatgtccaggtgcactccgtggctcctcctgcctgggacagtagctgttgcctcatccagtgctcccaggaggtttcagctcttccagcccctccagcccctcccccacctggcacaggggtacttgggttgaaccacagctagcttgggtggtcctcacagttcatttgaaaagtgagcctcagatctgaagacccaagacagacccaataaaggctgacctttgacccatgtgggggaatgctccctccacaagctaaaaaggggcagctgttttggagccacgaggacatgccggcccttaccatagccacctgccaccaaagctgtagaaagcatcccctgtgatgcgccacattttccctgcctgggatataacttctttttttcttgagaacttttcggtctggttgtctatcactagccagcccagaccaggacccaaacttcctgtgctggatcttagagcagcatctcaggtgtaacttggagggaaaactctgggctcgcccacagcagtctggttggagaaagattccaggcaaggattagggagctggagtcctgacagtgcagtgaaggtgcataatgtccgctcacgttacagcaca

SEQ ID NO: 53782 - DNA, 986 bp, Bovine  19866881022195
cctcccacactcctctccctccaaggccacgttcgtttgcttgcttacttaatcccacaccctctgcaccttcccagggcccctttgtgtctgggatggagtggagcatctctgcctcctaaacccaattttccaaatgaacaccaaacacagacgagcccagatgattgacagtgtgacagcatcgtgtttggggccgacggatgaaatgaacaggaggtaagagggaaaacatgagaaaggatgaattttcagtggcttcctccagccaaatagtttgcaatttcattggaaaggatcctcatggggaaagagaccaaagaacttgggaggaaaaagcaaattacagtctcagcagtgtggctttgtcctttgacaagttggtcatgaaggaaggataggatgcttgggacagggctgagagctgggagagtggacttggtcacctcgaaatgcgggtggcccgagtcacagcccttgggccaggccccaaagattccccacccacttcctttatccctgaagctgcagaagcagtgagaggagagggcgtctggccagagccccccgtgagggtccacagcgggagaagctttaagagaacacacttggaatggagaagaatttttaacaagaatttttgttaaaaacaaaaaaagaaaagaaagctgaccatgaaagaacatattattcagagctgattaaagaaaaatcagccagcatatttgccttgtgaggcacccagtttgctaagggttcaagttcttccaataagaggcaggattacctagttgtcaaaagcttggccatggagccaaattgcccgggagggaatccccagctacaccactgatgggcttgggtgacctcagcaaatcacataaactttccgagcctcagtttccccacctgcaaatcagggctgatgataagaactgcgcttacttgagggagttgtctgtgaggatgaccatgagtaaatatgt

SEQ ID NO: 53783 - DNA, 2389 bp, Bovine  19866881134050
gagaagagagagcacttagaattcccctggaaaagcccgtttctttggaaatgggccacagatgacgtaaccccgccatatcccattacccggtacttggcgaatctctgtatgaaacttgttttggtgaaacttgagcctggagaagccaactaaagtatattactttctcactgttgaatgcctcctagacttgggctaacatttaatctaaagagtaaggtgatatttcctgagataacaatgagttcatgttttgaaatgaagtgaactgggtttattacattgattggctgttttttcaagttctaactgcagtagtaaatggtctctccacaaagtaatgtctggctgccgtatggggaaaagtgaggagctatagacatgggagagttcagtcttcagaagttgtcccactgcctctctagttaggggactattccagattgaactaggttttggtttaaagaggcccatatttgaacacacagatttctgacccaggacaacgtggggacagctattgagttactttgtatttcctgaatccatgctgcatgccctctgctctctcaccttcttaagttgcttctcactcagtgaaggttggctgcacatcttctttatacaaggtaaagaagagaagagttctcagatagcaaattagtcaaaaaagagaaagcatgtatataatcagataatgctaggaatctggaggttggtgtgtgtgtatgtgtgttcagctgcgtccaactcttcgtgaccccaatgactatagccctccaggtgcctctgtccatgggattctccgggaaagaatactggagcaagctgccatttcctactccagaggatcctactgacccagggaccgaacctgagtctcttgcgtatcctgcattggcaggagggttctttaccatggtatcacctgggaagtttggtgcattatcctttaacttagttcctggaagtgttctatattataagaatgtacagattgatacacagctatagactttttcaaggagaaaatagaggtttcaaggctgtgtatggtgcagttccgagatgtttcagatgctgagcactgttgattatatctccagagtagccactgtggatgaagacactgtggataaagaatccccttttcatgcccccaccttgcttttggcttgcctggactctgcagatgcttgcagggtgcctgctgttgaggcttcaacatctttgccttccccacaaccagcatagcacccggcacacaaacctgttcaatgaatggagcaactatgaagtcaccagttttctttctttctttctttctttctttttttaatgataaggcaatggctattttttagtttaaaaattctgttttatagtggatttacaatgttgtattaattttttctgtacagcagagtgattcagttatacatatgtacattgtttttcctatcctttttcattatggtttattataagatgttgaatgtatttcccttgctatacagtaggaccttgttgtttatctgttctatatgtaatagtttacatcttctaattcaaaactcccagtccttccctacccccgtaaagcggtgtggaatcacgtgaaatgtggtgttgcgtactataaggttagtgaaataactggagggaatctgagctgcagaggttcctgggttctctctggtggttcccagcgagtctgggtcctggctgcagttccttttcctgccacttgaggtcccctccaggttcagtgtgggttgacttttttggggtgccgtagctgcaagagagtggccgttattccaggaggtttctgatgtcatggctcccagtggctccccaggcgtattgggcctgggaagcatgagcggtgtggatacggggctctgccttggcctccccagagggtagtctttccccatctccttccttcccctccatcctcctccttatacacgtgcacaaaagatgagacctttacctacccttgttggagaatagagttctggactgaagcctggagcaaatcaccaggccctttaaatgggaattcaagtcatcctgaggttcagttatcttcatggttttactgtgtgtccctgctgggagttggtggttttggggctcagctctttggagttcattcaccttgtactgtgtgtgaggtatagtttcgctctgggagtagagggggtgtaggtttggaagaggcccttttgattctgctccttggtgtcacctgcacaagaagacaagctgcaggtcgtgctgcctggccctctgaatttccctggcccaagactgtcagctggaaccgtggtcttacacctgctccaggtcgtgaacatgctgtctgtcccaggggcca

SEQ ID NO: 53784 - DNA, 2781 bp, Bovine  19866881139936
ctgttaatagagttctctttcctgtagtctcaatatctataacttatgaatattgtatgactaccctgttatataaatgtaacttaatatgtcaataattctctttaataaaagtgctagcaagtaatatttttataagtagaatatccagttaaaattcacaattttcttcaatcactgtggggattgggaatattgtttcagaaatacacatatatctttctccaaagaagacatacaagtggccagcaggcacatgaaaaaatgctcagtatcattaattattagagaaatgaaaatcataaccacaatgaagtacacctcacacagatcagaatggccattatcaaaaagtttacaaataaaaatactggagaaggtatggagaaaaaggaactctactacactgttggtgggaatgaaattggtgcagctcctatggagaatagtatgaaaattccttaggaaactaaaaatagggttaccatacgatccagctattccactcttgggctaataaatctggagaaaattctaatttgaaaagatacgtgtaccccagtgtttatagcagcactatttataatagccaagtcatggaagcaacctaaatgtccattgacagataaatggaaaaagaaaaaactgtgtgtgtgtgtgtatacacacaatgggatattagccataaaaaagaaagaaagaataatgctatttgcagcagtatggatgaacctagagattatcatagtaactgaagtaagtcagataaagacagctaatcatgatattatgtgtgcagtctaaaagaaatggggcaagtgaacttacttataaacagcagtgactcatagaaaacaaacttatggttaccagagaggaaagggggaatgtgataaatagggagttttggactgacatatacacactactgtatatacgatagatacaccacaggggcctcctgtataatgcaaggtatgtgcatgcacacgcccagtcacgtcagactcttggcagccctatagactgtagcctgccaggctcctctgccatgggattttccaggcaagaatcctggaatgggttcattttctcctccagtggtctttctgacccagagattgaacctgcatctccagcgttgacaggagtattctttaccactgagctacctcggaagcccataacacaaggaactatattcagtatcttgtaataatctgtaatggaaaagaatatgaaaaagaatttgggattagattttataggcttgtttagtttttggaataatcttttatttttatctttaaatccatattattgcctgtttgtcactagactttctacagactagctttttatttttgctttcccctagtctcacttttttaactagttagttctgcctaagagtgtatcagtaattgagttatttgaactgaaaaaaaaaatgagtcaggagaagcaccttattctgaaggtatcacatgaacaggcattttaaaataatgttcctatttcagtgaataatgttaatggctcttttagttccagatttgatccagtgtgttcctttagtagtaattaatttttgaagtgtaaatgcaaattttaattttaaaaaatgaatgtcaatttgggaagaagagtgctccatgagcatcatgggagaaagtatggagtataattctcttccagatggcacccctacaggtgaggcagcagcctgtgaaattacagtctgaatcacactgcagacaagcagggcatttggagcaaagccttctgatatcagtaataaatgacttggttcagaaccaaggacaattcccaggaaattaaagcccattctgtcacgtagggagcctatagtaaaatgaagtttagcaaagtggaaagttgcgagaaaggacaataattgcaagcagtccatatatgaatcttttcatctgctaatatacttaactagacattttaatttatctcacagttaagttttgtttctacatatatttatggattttctaaagtaatatttttcacagtgaatgctggctaacagccacttgccaactaagctttcactctgaaatattatcaatcaggtacctgttgtaaatctaatcttgtttaatatgtgctgggtattttttatttcagaacacttgagtccttaattacaaatgtagtataatataatacaaatgtgtgtgataagtcatgtctgactctttgcaattccatggactgtagccactgagcttctatgtccatgggattttccaggcaagaatactggacactgctgccatttcctcctccaggggatcttcctgacccagggatcaaacctgcatcttctgtattggcagggggattctttaccactgagccacctgggaagtcccataatataatatgaataccaagtcttacttttactcaggttaaatcagcaagaagcaacagagaatagttactcagaacttggcctctatagtcagatagacaagtattcaaattctgactcattcaactgtttctttaactgtgagctgtttttttttaagtcttatgattttaggttatttaacatttctaagccttagtttccttgtcagctgaatgaaaataataacatgtgctttagggatgaattaaataagatattccataaaggacacttaatattactgtgatgatatttaccactattaacatttgaaaattaattttagaaagcaaaacagcatttaaaaataactagttttcgttcaagtg

SEQ ID NO: 53785 - DNA, 1360 bp, Bovine  19866881143738
ccccaggaacaacggacaactcctcctggataaacaagcatccacgctaccacctcgtacccccgctcttaacccatcatcctcgttcaatgggctctattcgacaaggtattctattttgtttgtaggaatcaaggactgaaaaacagttcaaaatcaggcctggctggggctgttcattcaaagctgccctttcacacaatcagtcgctgagagcccctgcgagcaacacccctgaagtagccaccctttaaaggacgtccttcccttgggacgctacccgcccccccacctccgcttcatctccctccctggcttcttctgaactctttttaaaacacacaagaagcaaatagcagcacaggtttccctaggctttcgtgacctgaagctcagtcaaaatgaacctaacactttataccatacctttgtactaaactcgtgttgacaaccactaaattcttcccattgctctgcatggaaacttgcaaaaaaaacccaaaaaaacattcatttctctccctgccccccaaccccaaactctgcccgtttaaaaagcttggctaaacaatccaccaggtggggggaaagcttttctatgtgggcagctaagtttctggagcccataccttggaaattagattaacaggcgaaatgtgaatagcaaggaccaaaacgcctcccctcccttcatgctttctaccatttagagcacttaacccagagcaaaatatcttgaatggtgacagtaaaaaaaatatatggatttgtgaattgttctatgctgaaaatggaaatgagagaggatgaaaacaagccagctttattttttagaaagcaacaccaagcgattgtcgcacttggttttttgagagaggggcagaagttatacatgatcataaatttgcactgttggtatgttgatcagctttgcagttaattggcttcaatactctctaattcctttcaaactttgtaagctagaggacagtgaccccacagtaattcttatcttcctgaattgaggaagttagggctaacttctgtaaccacgatccctctacaggctctgattttgagaaatcctttaagacatattctaactaaacacatgtatcaagaagctactcactttgagaaataagcagtaagaattgaagcaaatgaacattccctcagaacacttacctacaaggaaaattatttggttttgccaaataccatttatacttttttccaaagcaactttctttctgtttataccaaaggagaacatctctgttttcacataaaatagacttccatttctttttttccagttttttttttttttaatatttatgtatttatttggatgctc

SEQ ID NO: 53786 - DNA, 1787 bp, Bovine  19866881286093
tcctgattctgagccccgtcctgctcgtcttccgaccagtggaccgaccgaggagcgcggatgactttgggattttgcccagtgtggctgacctgctggtgacggtggccccgctggctgtgatcatggccagaccagcggcagagccactctgcttcttgaacccaaagctgttggcgttggcggtgggcgtcctggagctgctggggaggggtttcttggattcatcaccactgctgcggccggcatctgatggggagcgcttcacctgggcggctttgggtgacagccttcctttctcagacacttttgcatcgtctgtttttcctgcgacagaaatcagcaaagttagcctccatattaagaagccagctcagtcaactcagactatttaaaattctcccctactccaaagaactactttgctttctcctgggggaaagcagtccccttgggagacagaggagagagctttttataaagataatctcatctacgactgtcaccatgagcctttaggagatgtcagtgattttcctcatttgcaaagcagtctacatttacccagaataaagcaaagccagccaatcactgacacatctgggaaggagaccttgtcttttactgaccattctccctctatccattaaaaagctatccctaacattttcagtgggtatcctgccttcctgcaaaaactctgcccttgtttatacacatccttaaatcacgggcaatactgactcagcatatcaacagctcataaccacgtgcccttgaatagtcttcactgggtaccttaactcagagcctgaccatgcttcaaccaattgaacacgtctcagcagctgaaccgtcctcagactttaagaggctctcatgctcacaaatttccacttggaaaaaggcaaagatatgaatctttctgaaagctggatatgagcagagtccaaaccctaagaagtaatacctgaacatttacagggacttgaaaacatcaagccctgctagcgtgactgctttcccggttttgaaactgacaagtgcgcaagcgagaaagcgcgagcctctgactcaccggttccgggggtcttgagcgtgcctgtcggggcagccggcttcgtccttggcatggtgatgccgacctgagccgtcatgcctcgccgccacgagcctgtctgtgagatgacggggttcttcttgcctgacgtgcttttgtcggactcatcagacacgtcagacgggttccgcctccacttcgacccgggctccatctttatgccgctgtctgagcccccgtctgacttcttgacatcctcgctggaccacagggaactcctctccacctgtgagtgtttctcggcgtcagtctgtgaaggagaccctctgaatcagtctttctcaaaccccaggctagggagcccctcactccagagcaaaaaggcccatgccctggacaagttagggggaaaataacacatgcccactttaaaatgtttaagcctttgtactggttatcttgttaggaagcctgatctcttgggtccaaggaaagtgaagaatatgaatatgtctgagaagggaggggggaggagagtaaaaggagccagaggaaaaagagagggagagttccacgcaggagaaccagaggacggggctgtggcaagaactgaggcccccagctctgcccttggcgacgtgcctcctctaactccagcagcccgagctctctgcagctcccagtccccagcccaggtcccctttgttctgtcagctcctgagcacca

SEQ ID NO: 53787 - DNA, 1346 bp, Bovine  19866881306665
tgaaaaactagataccatagattctaggtgggatactttttgaagcatgtcatcaatatgttcttattcaagtagagataaaagaaactcagctaagaaaattgctaccaggctgactgacagaacagctgtgggtgaagtgtgggatctcttaaaaaggcctgtctcgaggataagttttgactcacgttttgggagagctaaggtgactttgatgggcactggaatgaattacagcatgtgaaattccttaactaaaaaggtattggctttaaaaaatgagaaggtggtaccaggttttctgtgggtctttgcaatcaggatttttgctcaaataaatttctcacctctctgtgtccactttggttggcctttcccagactgtccctgagtcctggttcagctgatgcttttgcaaatggttttgtgctgtaaaggatagctattccagatgtatattcgggtttcagaaggattaaaaagattaaaaagagaagccaaaaagagcagccaagagacctcagcaatcttctgagacgatcgctttcaacctgagtttttggagcctgagagttctgtagatgtatcttgggtgggatgggagacagccctgtggatggagggatgctgagggtctgggctcagggtctctaccggcatcaaccagaagagctcaatgtaatctttcttatacattcaagttccaactctgctggaaaaaaatactgtttcgtgtttaaagcccacaaagctagtccatcatcatcatcatcatctcatcgtgttttacaatagttgatgttgagtgttttgcatttgtcagacactgttaaaagcactttatgtgcattatctcatttaatactcacagcacctttgaaaggtaggcaccattatcatgcccttaacataggagaaaacttaggcccagcacttaagtaatttgccaaagcatacacaccacaagagatggagcccggctttgaacgcacacagctgccccttgagcctgaacaattttccaccacgaggtacagacgatgtgaggcccagggagaggcagggactggccctagatcccacggtgggctcagggcagaccattccctctcagggccttcttcctcctgatggatctccttccctcctccctctccagcctgcagtatactttctagaagaaactcacaagcagctttaaatagaccatcccttggttaccaagcatctgtgctctcatgaagggagcctctgaaggagatggagctgtgatgagagatccgctttggagcccctcttttgaatgtgcctggggtgcccacctggcctgagtctcacttcccacc

SEQ ID NO: 53788 - DNA, 1127 bp, Bovine  19866881342658
cgggcctggagcacagagccgttgcctcaccagcttgtaatgaggtgcgtctccatcctgattaggggaacaatcctcactcagaaagactcaagggaaggaagtgacagcgtcgtggggacagggcataacctcatctcccaaggaggggctggcttctggggagctggtgacttggaggtcacagcccaagagggtacccatccccctggaggaggctaagcagaccccactggggcaagtctgggtcagagcaggagacaggctgggccagcccctgcctctgtctgtaagcctgtgaggcagctgctcacaggctctggtttgccaagaggggcaagcaaggaaaccaacattctctggacaccttctgggcaccaggctaggtgccagtcctatgacatcatcactatcatcaacattgtcctattaaatcaaatgttagggcaccatttttttttttccaaaactgtggattgcagtccgttcctgggtaatgaaaacagcttagtgggcgacaaatagcatttttaaaataacgtgataaaaaatacagaaaatttcagtgtgcattgcacagagcaaggattggtattgtggaagtttcatttcttaatgtgtctgtgagtgtttggaagctggatcgtaatggggaaggaaacagagctcatttcttaaagtagttgtagggatagaatgggttaatgttttaagtgcttaacgcactgtaacagaggctgccagcacccacccaagtccccttggagagagttcaggctctccatacgtgccttcctgaatctctctctttctttttctggttgtaggaatatgcttagctcaagtgcaaagcaggtaaaaaagcagagcagaattactgccccaggagtgaccctcagcctaggaggactgggagatggtgggtaagcactgcagcctcctcattgctcagcgcaatgattctggggtgtgtccgccaccatctctctgagccccagatgcccacagagcaactcccttcctgtctcccttcctctctctctctgcttcctggaatctgctcccaaggaaacttcttgcacctatatcctggtcttggtgtctcatttgcaaacaactaactcatg

SEQ ID NO: 53789 - DNA, 1543 bp, Bovine  19866881348851
tcagtgtgatcagatgcaacagacgagaatcctggtcctagaggagtcagcagtcgtgtagggagcgattattgatgacacagcagaagtctaggggaggcgggaaccagggagaacatctggcgtgggcagttggcacagggactgactcttagttggggctcattttcagcatcatctctgagctgtagggcacccctcctgggcagccttgccatgctgtgtttctgaaaagtgacctatttgggggtggtggagggaggttcatggggcggccttgaattcttggtagggttactcgtaacagactttcttcctttgtaaagttattgtttggccaagcttcacagagtaatgcatgtgataaattccacaaagcgggtgccaaggaaatgttgtctctctttgctgagaaagctttctggggaaaagcacagaccatgtgaaggagactggagcaaaatgccttgccatgtgacagacagacagtgtgaaccaaagccgattgttctttgcaatgacctggaatcttcaagtttggatgagacagggtttggctaagaccagagtgtcacagtggaattttgttcagactttacactccatttaaaccaggaaaccatagtcctctctcaagaatgaagcagtttttccaagatccccttgaaaaccttccaaaccaaaaaaatatatgtatattatatatatatgtgactatatagttaaaccccacagaccacagtcacagagagctgggagaggatggcagtgggcagagggggaggatatgatttctaaagacattaccgtctctctagcccaaatctgtcttagtcctaaatctgtgggccccaaatctgtttctcacaggtatgaaatgggaataattaggagattttcaagggtctgttggaggtctccgaagatttttgaagtgaagttttattggctgctgacaactttttaaaaagaggtggttttgtatctctcaaaacagttcagggtgcaggtcaagaaaacaaccacaaaaagatttgcctgttcaggtgttaaatttttcttctagtcctttcggtcccccaaatacaactgcgtctcttttaacagtgatcacgggcctcctgtttggcagttaatatgtccagtctctctcctggtttcacaggtcaggtttgctttgacctcacatctagtgcttgggtcctggagagagggctcgcatgattatttctgcagaccacatgctcaccatgtcattcagagataatcagcttcagctttgtgactttctgaacttgggcttttttttttttttctttctttcttttttctgttttcggtccaagaaatgtccaagcttgctcttctggatcaccctgcacctcagctcctatcattgaaatcaacagaaccttttctaaattgaactgtcttttctaacattgcagttcatcactactcttatgatctcccagtttgtgctgatttgccaggtagcagaaggacagacctcagtaatcaaataaggaacccagtctggaag

SEQ ID NO: 53790 - DNA, 1235 bp, Bovine  19866881362218
ttatgttacagaaaacagggcagagtgattcaaaccctgctgtcaatccagagtaaaggagagaaaaatgccagctattccacagctgtccaggagaatcctggaggagctgctttcatgacaactctgatgagcagaaacaagccaacttccagagcaggagttaaaccaaataaacctgaaggatatcagtttaggaggagagtcttaaaatagcagccaggaatgcatggtttcccttggacaactcaaattacatgacttgtccctgtcttaaataaaactatgcactcaaagtgtctgcttcatctaagtttccctctgagatgccaataaattttcagctcatggaagccagtctggaggcaaatatgctgggtgagcaaatgcacaacgtgatggtccttgcaaaggcaggcagggtacagggagaaggaagaaacagcctggatccccagaaaaccatcctagggttaggaagagacacagccacagggtcatgttccccaggggaggatttccagttaaactaatgggatggtgttcatgaggatgggcatttaaagtggactctccagaaagggaaccctcctacactgttggtgggaatgtcaactgatgcagtcactacagaaaatagtatagaggttccttagaaaactaaaaatacagctaccatatgatccagcaattccacttctggccaaatatctggaaaagtttatctggaaaactctaatttcaaaagatacatgcgcccccaatgttcacaggggcactagtcactataaccaagacacggaagcaacctaagtatctatcaatcgctgaagggataaagaagatgtggcatatacatataatgggtcataaaaaagaatgaaatattgtcactggtagcaacatactcgaaccttgagaattatcacactaagtgaagtaagtcatacagagagagacaagtattacatgatatcacttatatgtagaatctaaaaaataatacaaataagctaattcacaaaacagaaacagactcacagaaaacaaacttatggttaccaaaggggaaatgtcgggggagggctaaatcaagaggacgggattaacagatacacgttactatacataaaataaacaccaaggttctactggagagcatagggaactatattaaatatcttaatgcaggcaatgcaggttcgatccctgggttgagaagatcccctggagaa

SEQ ID NO: 53791 - DNA, 1073 bp, Bovine  19866881408258
ttcatcccagaaagtgcccttgtaaggagaaagcaaaaccagttctttctctctgggtttagggctcgttttccttttgtttctggagtcaccacccacctttcacctccccactaagactagggtgttcatatcacaccccccccaccttacctctacttcctcagacagcaaatgaggaccttcccagcactaaactctcagggttttaacaagacactggtattcaacaagtggtgaatgcaaagccccagcataggaggtggtatctgaacagtgacctctgagcagtggctttggtgacggccagcatcccaggagatggctgtgtccctgggcatcctgcctggctcgtggctggcgatggcaagctcggggtgcagactgctccgtgctgaggaatcagtgtgctgtgaggcatctaattagccatcatcttcccaggagacagctcagttgtgtaattgttatttctatattttacacaccctccatcagcaagagagactcgggccaacccttcaccagctccattgtttgcttgccttccagctgtgccaattgccctcttctcatctttccacggctcccacccaccagggaacatgcctgctggcgggcagggtaggggtgcagggaatggctttcacatgtgtctttaaagacccatctccaagaccagcacactgagagcaactgtgttggctggatttcctgtctggcttcggaggttgggggtcgtccgtgacggcataccctccatgtgccatctgttcataggcagagacgtgatgtggtgtgaaagatactgggtttgccatcaaacaggagccatcattttctagcaatttaatttacctctctaagctttggcttccttatcagttaaatcaagaccccgataccttgtatcatgaggctattgcaggcttctatcattcaacacatatttattgggttcccctggatgaaagaatgtttgtgatagggctttgcaaactgaaaattttgctgtctagataggagttattttcatcattgcagtctggcgttgattatcggaggagctttta

SEQ ID NO: 53792 - DNA, 981 bp, Bovine  19866881451610
tgctgctaagttgcttcagtcatgtctgactctgtgcaacaccgtagatagcagcccaccaggctccaccatccctgggattctccaggcaagaacagtgcagtgggttgccatttccttctccaatgcatgaaagtgaaaagtgagagtgaagttgctcagtcgtgtccaactctttgcaacaccatggactacaagcccaccacgctcctctgtccttgggattttctaggcaagagtactggagtgggtcttctttgctgctgctgctgctaagtctcttcagtcgtgtccgattctgtgcgaccccatagacggcagcctactaggctcccccatccctgggattctccaggcaagaatactggagtgggttgccattgccttctccaggggatcttcccgacacagggatcaaacccaggtctcccacattgcaggcaggcgctttaacctctgagccaccagggaagcccaaaatattactttgagccccttttttggtggggttgggggtgcggcaagaatactggagtgggttgccattcccttctccaggagaccttcctgacccagggattgaacccgggtctcccgcattataggcagatgctttaccatctgagccaccagggaagtcaaaggtatataaatgatccttaaaatgacttctcaggattacagttatccatccttcactttaatgagcatcaacgagctgggtattgattggaacccaatgacttataacttcggccatcacgagtgtccaactggaagatacctggagtggccttgattctcaaaagccatatatttattcttccagtgttgtatatcaaaatccaaggtcagagtgctagcctaccataatttccagtgtatgaaggagtgccaggtgtcaaggagctttcttttttttccaccttcaggacatacatttatatacacacaaggaaggggcagctgcctcagaatagg

SEQ ID NO: 53793 - DNA, 2073 bp, Bovine  19866881490532
tttcttctttttcatttatctcctcaccagctcagcacaggattccgaagtccaggcttttggagtctgtcaaatgaacggtgccattaatgtgattaacacagctactgtcacgtttattaggcatcattgaatctctgggcttctgattctaataatacactcttctaaaccaggcgcttgcacactgctgtgggccgaatacagcctgcctgtttttgaatagcccttgagctacgaatgtttttatatttttaagtggttaaaaattttcaaagaggaagaatgtgtcatgacacatgaggatgtaagaaattcaaatttctgtatccataagtaaaattttattgaaatattctcattactttatctattattaatggctacatttgcacaatgatggcagagctgtgtaattacagttgtaaatctgcaaatatttactgtcttatcctatagagggaaagtttgccagcccctgttgtcacctctactgttttctttgatgtctagaaggggacttgtgaagtgatgaggtcccagatggttcagggaacccagagtataggctctgtttggataccgagtggctatggggccttgggtatgccagttagctcctgtggaccacggcctccttgtctgtgctgagagggagatgaccactgcagctcctttggcctgcaaaattctttgacttttaaaacacagagaaaagagtgctccgaatggaaaaaaaaatgtgtgagaacatggagattgactcaggaatctctgtaagattttgtttttctctccagagctcctttgctcaccaagaccttgcttcctactctgtacatgaagtacagatgtgctctccaggacaggaacaaatggggtctcaggtcataccgtccattgttggtcagcatctctttgttttctagtctgatttgtagggttggattgaaaagggagtggaggagaaagaatctgaagcagaaatatggccaagtgggaccctttgcgggatgatagatcctcctttcttggaaaagattcttcttgaccttgcgtcattcccgctgcttgcttgtcctatcagtcagaattgaagtactgtgtcaggatgaattattcctaaggcacagtgttcccagtgtgcaggcgttggcagattagaaagaatacttagtagctttggattgtcataagacttaaagagtaattagagaatttatctccttagatgtttgtggagctcacaaagctctctctgctgtgtcatataagtatattgtgcttattcttttgagctggtactggaaaaggaaatttatagtggcaatttatttaatcaattcctttttctagaaggactctgattcctttcttagggtaaaacacactgactgtggatcgtaaagacacaataatataatggacttaatgctctcagaagagacgtcttttttttcctgctatatggttagggaaactaaatatgatttttctgaaaattgtgtttctgggatatggagtagcgtgttttggtttctttttctattgcgtttttatttgagttgctagagaacaagaaagggtgttaataattagattttaaagatagctcccttcggtctataaacagcatcttcctcactccagagaaaaccagttgtgtgtcggtgtctctgactccgtcgctgggatccacgtttagtttggtttccaagtccttgaaagccgttgacccctttgcttttgagtttcattcaccagctaaaaggccacgcatcagggtgggggaagtgaaattcaaagtttgtgggcttggaaaaatgcgtatttataatcagcttgagggctcagaggatttgtgaaatcgttttggattaacagccattgattgctaataaaacagtatttcgctttgtccagagaacagcggtggagaaaggtatgggcaccttgtcaacagggcccattgagcagggctgatgggccaagcgtgggggtcgcagcagcagcagcgtgggtgctcgtcccgcaaggagcccttgtcagccctttgccaggcgggtgacagga

SEQ ID NO: 53794 - DNA, 909 bp, Bovine  19866881606248
tggtagctgctgctgctgctaagtcgtgtcagctgtgtccgattctgtgcgaccccacagacggcagcccaccaggatcccccatccctgggattctccaggcaaaaatgctggagtgcgttgccatttccttctccatcaagtagtagcgtaagaggttttccttccttttcccacgtacatactttccaaaattataacttcagcttaaaaactggaaactagaaacaaattagttgtcttcacttaagtgatgtcactttttttctttccaggacaatgtctgtcatagatattccttccaagtaaaaatgttacattaaaaagtggccagatcagcttgcaactgtgtcacacaaatgcttttgtggagacagatatttttattgccatatgcaataaaagtgctttattagtatatcatatagaatgttaacaagatgagtactcaagggtcaagatttaatgaaatgttttttttttttaatcaaggacattttaaatcgagtatgtggcagtgaagaatacaatgactattagtatagtttggtgccttgatctgtgccagagccagcaattttacgcgactgcttttgtaccatcggtgtaaatatgaatacagtgaaaaaggcaaacaccttagtactattgcaaaaacagtttcatttcctggacttcctctaagaggttttcaggggtcatgaggggtccgctgaccacactttgagaaccagtgatggaggtaaaacatgatggcagcttggactagcatggcgtagtgagatctgttttggttctggacatattttgaaggtagattatgtaagacttgctgcctaacttggatgcagagggaaagaaacgggtcaaggatgtctctcagttttctgtcctatagatggaggaaaa

SEQ ID NO: 53795 - DNA, 1223 bp, Bovine  19866881890405
cgagacagccttgggcagtgtttggcgtatgtcatttcttctttatgatagccttatgaatgggaaagttagggctcagagagatgacaagactcataagtcacactgtttatgggtgtgacagggcctaaggactggaccctcccttcccggacagccagtgaagcctctgctctccctgcaccccagcctgtgcagggggcctcgttgggtggtttctgagctggctgctttgcaaggccagaaggcccatccctcctcacctgcccgcccgtgtaggcggctcttggcatgtgtgctgagtcaggcggcccaagcagctttccacgctcagaggtggcgagctaattaagggctccagagctgccagcggatgtgctagtagacgttgtctgagaagtttgccgagagccacggcctggtgcggggctccctccacgttggtccccaggaggctggggtgtgggaccagccaagaccacccatcatgcatatgaagggtgttatatcagacaggagttagaacccggttagacctgggttcttaaagcctggctctgccactggttcgggtgagttccccaaacaccctgaatctccctgctgataaaattgccgcagtaatcaatgcctgcctccaaaatttgtggggatgatacataaggctatatgtgacatgctgtccgcaggtacaaaataaatgttcttttatatttactcattatgaactaagcccacttatctataaaatgagaggtttctttcagtagacatggtctggcacataaaagcgggtgaatagaggttcgtcccttcccctccttcagccccaagagctaggcctaagacccctggccctgccctcgaggttttccataggctggtgattcatgaaccagcttcccagagcagttgggctgggggctgggtttcattttggaactattgtgtcaaaagttccattccccatctccctttccttggactattactaagccattaaaaagaacaaatttgagtcagttctagcatggtggatgaacctagaaccttttatacagaatgaagtcagaaagagagaaacaaatatcatatattaacacatatatattgaatctagaaaaatggtactgaggaacttagttggagggaaggaatggagacacagatacagagaacagacttgtagacacagctggggaaggaaagagtgggatgaacag

SEQ ID NO: 53796 - DNA, 2888 bp, Bovine  19866880672526
tatggcttgaattcgtgctcctgaactcgtactgatatacacatgcatctgagcaaactcagcgatagtggaggacacaggagcctggcaggccgcagtccgtggggtcacaaagagtcagacacgactccgcaactgaacaacaacacggctgatttattttgctgtacagtagaaattaacacaacaattgtaaagcaactgtactccagtaaaaatcaattacaaagaatcgtcaatggccaattgtttaaccaattggttaaccactttttcgaaacctccaaaaaaaaaaaaaacctcagaaggacaaggttcagaaagcttccatttttgtgaagcacatggagacttgggagcattcagagagtgcagggaagcctcacagactttatttacccctttccctgcacatctcttcatctgggggttcctgagttatatccttctataataaaccagtcatctactaaataaaatgtttctctgagttctgtgagccactctagccaatggtccaacccaaggagggggcctggaaacttccaatttacagtcagggcacaggtaagcccctgggcccatgactagcatctgagttggaggagggggcatggagatgcaatcttgtaggacagaacccttagcctgtggaatctgatgtgatctctgggtacatagtgttggaattgagttaattttttagacacactgccagtgtcttaaaactgctggcattgtgtagggaaacacacacacataacacattgggcttggtctcaagacaccggaagggtatcccctccattctttaggagttcggctacttcttccctacgcttctatcttccttagcacttctatcacgaccagccatcctggacttttttgtcctatcacttcactggttgagaaaaccagcaagattactagtctaaggcaatgcacccttttaatcactaaggctctgaatagggaggcatttgtggctaagagagtctcagatcaacatagactctaccaacctctgatacattattcctgctgggatccgttttctgataagtagctggagtcagtacctccctcccttaaagttttgaaagagggggaaacccttgcgtttaatatttcagatggaaatcaaagtcaagggaattttcagaaagtgtaagtagtcctgagttggccttcattctaaagtaagaaacccaccgaaatgaaaagcaaaattaacgagccccatggcagtgtttgcagcattaaagagggtgtcaagaggaccagatgtctcactagatgtagctcacatttccactgcaaacttctaaaagagaactcttcaaacaggaggccaggtaatgcccagtggaaggcactttaattgcacagtgattagataaaagctttaagtgtaaaggacaaaatgtgaatttaagtgagaaaataaatgatacatttcaactataaaagaagagttttcccatgtattttttttaagtcggtgacaatgagtaacaaattgaccagatacatggattctatgggatacatttaaaagaataatacagcaatttattttagtcttaagattgtcaatttcagaccccacatattccgtatattgctcctaaactgatcttctcaagagcaagccacagccgggcaccataccttctcttctttcccaccttccttgcacaattgcccttgcccgcctgccccttcaaatcttatttcagggcattgtccccaaggtgtgaacactttgaggcaccaaagagacaacatgaaatgtgtgtgtgctaagcctctgttaatcaagacttgggtctgcttctcagtggcatgttttgcatgatttcaaggtagtgaaagtttcacatggacctttgatatttgatagctcagcatgacagcttgaaaggagagggtgggatgcactgagagagtagcgtgggcatatacacactactatgtgtgaaacagatcgctcgcggagctgctgtagagagcagagggctcaactcagcgctctgcgaggacctggatgggtgcggtggaggggaaggaaggaggctcaagagggagggggtacatgtatgcatacagctgattcacttccctgtgcagcagagactaacacagcagtatacagcaattacagcccaagttaaaaaataaaaatttctaaaacacacattgtatcttggaattccagaaaaacatctacttctgcttcactgactatgctaaagcctttgactgcagacgacaacttactgtggaaaattcttaaagagatgggaataccagaccacctgcttcctgggaaacctgtatgcaggtcaagaggcaacagttagaaccagacacagaacaatgaactggttcaaaattgggaaaggagcacgtcaaggctgtgtattgtcaccctgcttatttaacttacatgcagagtacatcatgtgaaatgccaggctggataaagcacaagctggaatcaagattgccaggagaaatatcaataacctcagatatgcacatgacatcatcctaatggcaaaaagctaaaaactcaagagcctcttgatgaaggtcaaagagaagagtgaaaacctggcttaaaactcagcattcaaaacactaagatcatggtatctggtcctgtcacttcacggtaaataaatggaaacagtaacaggctttattttcttgggctccaaaatcactgcagatggcgactacagccatgaaattaaaagatgcttgctccttggaagaaaagctatgaccaacctagacaacgcattaaaaagcagagacatcactttgccaacaaaggtctgtctggtcaaaactatgattttcccaatagttatgtatgg

SEQ ID NO: 53797 - DNA, 1424 bp, Bovine  19866881286706
tgggagacacactattttcccgtgtccagtattaaagctatctattattttggtaagaaatgcctaaattgaaattccaaagggcattatgaacttgaattaaaaaggtaatggattttttaataagttctgggtcaagatgtattatccaactattttccatagggcatagaatatactatctatccttttaataataccagccctggtcttccttccagcgccagctgcggctgcccggctgttacagcctctcccaccatccccaacaatgaacgaataactagacggcccacggagcattctaaatagaactgtctccaggacagcctgtgaccggcagagacaggttcgatccagatctggactccctgctttgggagaagcgcagatcgatattgttggggagtaagtcgtagagggaaatactgggatgaattaagtaaatcgtgaaacaaatgggtcacatgcttccatgcaactttattctacctgagggctctgactcagaactcggcggaggctaattctgtgtattctctgattcaaagggctttcggaaaaacaacctgaattatacaaaccacttactagcaatgaaatactatgtctgcaaatcctcaaaggctgcaaggaacttaaccaagcactggaaaagcggtctgcatatttgaaattgtagtcgagatttcttctttttttcctcatttatggtttggctccagagccaaagttacgtcttgaaaccttccttgctgtcactgctgactgcctgactctgctgtgctctataaacctgcctcttctctgcgcctgccgggtaactccctactgcacaccccagacactgtcttacatctctgctgggtcctggggtgacgtggaagcaatgtctacatggcgcagtggagggaaagagggcagtgcgcttactgactgccagacagcggacagcagcccagagcagtgcttcttactctccgtgaaaaagtaaactatgaggagctgatgaagaggcaggaaaactgctgcattttaagtctgtataccctatggtcagggacagattaatacatgctgatgccgttactatcttcatggctgcattcatttagataatattttagtgcaggagtttatagtgcattttgatattggatgggcttcgctggtggctcagagggtaaagcatctgcctgcaatgcgggagacccgggttcgatccctgggtcaggaagagcccctggagaaggaaatggcaacccattccagtattcttgcctggagaatcccatggacggaggagcctggtaggctacagtccacggggtcgcaaagaatcggacacaactgagcaacttcacttttgatattggaagccttaaattcattggtataatcatcttctggttttctggtatctt

SEQ ID NO: 53798 - DNA, 913 bp, Bovine  19866881460380
cggaaaaggacagcccacagcacagcccagatgtcagcacccagccctgcagtggccgctgcgtggagagttcagggagcttacatttaacacgtgtgcatttcactgtatttaatgtttaagccctcgaatcctttgtgtctatgaaaagtcacagaaaacccaatggacaatattaatcagagcacatcattttagtggtagctgtgcccactcccagggctcggctgcatcccgagagccttagccgtgccccgtggtctcgaggtaagaaatacagttggctcagcagcatttgttaatttatgtaagaaggaaaatgaatcacatagaaacatatggaaatgtccaaatgccaatttttttttttttaggttagcttgttgtgtcctcattttccttctaacctggggtttatgctatcaactattaacactaaacagattctaccttatactcagttttcaaatacatataaatttaaaagatatatatgcatgcatgtacatatataatttcagactaagtaaaatgagtgttttctttggatagaaaaccaacaaaggacgggaaatcctgacttcaggatattgcagttaagggttgggaacattcaggcaggagttactgccatccagaggtgggaagccacgagctgccatagcctattccaattttactataaaagaagccaagaaaaacgagtgcattgttgcagtctggctcattaaatcatcagagaatgggaaactgagacccagaatcaggcgtcacgggaccctgaggtcccactgtcgtcgtgaacgggaaaacgtaacctggattcctcaaagctactcacagggaaaggggacacagctctctgtgatataaggccaaccatttcggcagactcctcgatgtgcaaaagcat

SEQ ID NO: 53799 - DNA, 4633 bp, Bovine  19866880359862
catgactactggaaaaacctagctttgactagatggacctttgttggcaaagtaacgtctctgctttttaatatgctgtctaggttggtcaaagcttttcttccaaggagcatgcatcttataatttcatggttgcagtcaccatctgcagtgattttggagcccaagaaaatacaaagtctctcactgtttccattgtttaacagcctcatcttttcggatttgaaatagctcaactggaattccatcacctccacttgctttgttcatagtgatgcttcctaaggcctacttgactaaacccagaaaatactgtgttgataaagatgtggaaaaactggaattccttactaatgatagcaatataaaatagagtagccactatggaaaacagtacagtgtttcctcaaaaaaactaaaaatagaattcttatatgattcaacaattccaatttatgggtatttatacagaggaacagagaaggcaatggcacccccctgcagtactcttgccaggaaaatcccaaggatggaggagcctggcgggctacagtccatggggttgctaagagtcagacacgactgagactgagtgacttcactttcacttttcacttttctgcattggagaaggaaatggcaacccactccagtgttcttgcctggagaatcccagggacgggggagcctgatgggctgccatctatggggtcgcacagagtcggacacgactgaagtgacttagcagcagcagcagcatacagaggaactgaaatcaggatcttgaagagatatttgccctctcatgtacattgcagcattatacaaaataggcaggacatgaatgcaacttaatgtccactgacagatgaatggatttttagaaagtgcacaccctggaatattattcagtcataaaaaaattgtaatatactacaaaacgagtgaactttaaagacattatgttaagtgaaataaggacagagagaacaaatattgcatgatttcactaatataaagtatctaaagtagctaaactcatagaagcagaaaataaaacactggttgccatgtactgagtgggaaaagtggagagaagctctgcaatgtgcatcaagtttcagtcatgggggatgtaaatgttctagagagccactgtacactgtgctcccactgatcaatactgtattttcacttaaaattttgttaagagggtggtttcatatagtgtgtgtttttttaccacaataaaaaagcattaacactaagattttagaaagacatttgacctgtacagcattaactttccccccaaaattaggaagtactgaattttcaagtttgtaaaagagagctgtcatgtcactttatcaacacaaaatatgatctttcacatatttggaaaattatcagggccacacaatcgggctgtgtcagtggaaatcatgaaaggggaaaaaagtgaacactggcagcactgtgttccctccagaaaatggaaagaatccttctcttcatctatcacattattctctttgactttctagttgcatctgggatgaaagagaactatttataatacaaggattatttgtgccaattatctagttaatatacagcaaaggccatggttttttgttcttgcctaaccaatcatttggaagaatgtacttagcagatagttatagtctgtaagaaaaaaagggtttctgctggtaaattagaactaattgagggaaaataagcctatctgtcataaaccacaaataatggttggagcaataatgtttattatcataatttttacatggtaatatattaactgatgaattatactgaagcagagtatatcatttatcctcaatagctcccttgtgccaaaagagctacatatagaacttcctttattccatagttaagagatgttgaatagaaccagcaaacaaggcagaggatgcatagaaatcgagtatctttaatctctgattaacacttcagtctgtatttggaacatgccacttctatactttccaaaggatttacagaagtataaataaattgagaacaaagaaaggaataatttttttttgccactctgtgcagtatgtgggatcctagttccctgaccaagatcaaacccacaccccttgcactggaagcaggaatgatatttagaattcttgcttgtgtttgtcctttctatgtttcctttctgtctgtaaccaacttccctataatagaagcagtgttgagcatgggaaaatggcagccgtgactcatgattatgtaaattggtatcaatgtggtcctgggctgcccatcaggcagagaccaaggttgaccctgagcaagggcctgagcttatattgctggagttcagcatcactacttgaactcctgtttgtccgatcccatttgttctataggaaggctgcaagggtgaacagttagtatagatacttgaatgattaaggtaaatttatgatcacccaataaagttattggaaaggtaaagaatagtctctggccctgctatgtatttactccagatataaaagcctgagaagaatgagtaaagacatgagtaaagacaccattctagaaagtcattcttaacttaaaaagagtaggatgaattgattcagtttctcctaagtgtgacaaggcagcatccttccttaagcattggactgttcttcaaacacttcctacccatgggggttaggataccaagaaagttaaaaactgagtttttaatgttcagtgctatcttaggcttaagatagaatgtcaaatttgtgatctacagcagagacatatctttcaagaaggttgggttgtaagtacatcacataaggtaaaaatgcagcaggtcaaaattgcatttgggaaagttctatactggatctaaacatgtttcaaaacatccaacacaaccaaatttttctctcttgaaacatagttcttttatttttctgattgaacactagattatgtaagtggcttgcatttgggacattgcaatttttaaataaagtattttaaacactagcgtgtctctgtatggtgaatattcctgactgagagaacaagactttgctacccatcttctcaaacaaagaggaacatactcactgagtggaagtcaatcagaagagcttgtggtatttcagttgatcatttatttgttctcatcttcatcctcaagctaccattcattcacacaatcttgacttctatctttttggctcaccttttctcctccctcttctttagcagagcacaaacaggagaattttgcatacattaaatatccctctgatgtgattctactgtaatagtcaaggcagacataatcaatcattcacaacacgatttttctctcatttgaccaagactggacctcaaagttcttcccaacacagcacttcagacggccactacaggtaaccagtacaaattctctgacattccatataatgtttttaaacaacttagatttcattactgtttttagtttcattttatatatgattttaagaaagaaagcactagatgagaggcttactagacctcacagtgaattctgatattatgacccattagattgtgtgttggagaagactcttgagagtcccttggactgcaaggagatcaaaccagtccatcctaaaggaaatcaaccctgaatattcattggaaggactgatgctgaaactccacttctgacttgaagagccaactcgttggaaaagaccctgatactggaaaagattgaaggcaaaagaagagggtagtaaaggatgagatggttagatagcatcaccaactcgatggacatgaatttgagtaaactccaggagatagcagaggacagaggagcctagtccacagggtcactaagagtccgatatgacgtagtgactgaacaacagcaacagattacagcaggggtcggacaattaaggcctattgatcaaatccacctcatcacctgtttttgtatagcctgagatataaaaatggattttacacatttaaatcaccaaaaaatcaaataataataatattttgtgaaaggtaaaattgtatgtaactaatatttgtactcataaataaagtttcattggaaaatagtcactgttatttgtttacatttttgtctatgactgttttacactacagagttgcagttgtatcagagagtatacgtcccacaaaatctaaaataattactaattgatcctttgtaaaaaaaaatatgtaaactaaagtatgatgagaacattgtgggttgaatgtcaagtcaaagaattggtattaacagcagaggtgataaaataagagcaagcaacataacatgactgcatgtatttgtcaaaaagtcatcttatgacatactttaaaagggtgaattttattataaattttttgttacatttattattttgcaataaaaatttgccatgagaaaagaataccaaacataaaaataaaaaatacctggaatttattggggtatttgacatgaatacagagaatttgacatgaaattaggtgctctaaaagaggccactgaaatgtagatttaacatgagatttatattttataatccagctaagaaataagttc

SEQ ID NO: 53800 - DNA, 1460 bp, Bovine  19866880507756
aaacttagcatgaccagaaggaagaccagaatgatgggagtggggggtaggggaaggacgaggtcatgaaggaagcagcagcaggttcaggcgaggccttgaaatccatggcgactactttgtgtccttttctggatattacagccattggaggcttttaagtatgggagtaccctgatgttttcagaactagtaataacatggagaattggtcatttgaccttccaacaaagcctaggccatttcaccccaatggagaacttcaagtaatgtaactttccctaaagttgtattgagaaagttaaatctcgtctctaaacgcagacttttttgtcacatgcttgttctgttttgcattcaacccagaggtcttcatactcacctctcagacttcaacattacctgtgatctggagctcactgtggtctccttgccgaggaccacagtaggaactagtaaaatttaattttagtcagtgcctagaatttgactttcaaggccttgttgagatcactttaattggggagtccacagaactaaggcgtcctttgtttatatatagctcagggaatggagggatctatttttttttcaattttactctttaccatgctgggcatttccgaacttttgtcagctctttctttaagaatcatgattacttgtttttcaggagtgattcttctgatcacgatttaaaacaacctttccccacattatggcagaagtcagttcttgatgtgagcctactctacaccattcatcaaatatatcaggcaatttcagtgatgacagttctatgcaaacagtattcaagcagtaatgatttccaaatattgataccaagtgcccattttctaaggaaaatggatgataattttctactacttaccattcacacatgcgtgagaatttacattcttcctttttattagtctatgattgatgtaaagtgcagcttctcatggtatgtacctgagagagaatgtatttcaataagtaatttacaacttgctaaagataagctgtctttacaaaatatttttatttaatagcaccttaaaccaattcatgaagctaaaactgaaaaagtaattcacaaactctatcttccccatgcaaataaagaaaaaacaaatagcaacagcaaaataccaatcagttttaactttttaaacattcagttcagttcagttgctcagtcgtgtccgactctttgtgactccatggactgactgcaactcaccagctcagactcatgtccatcgagtcggtgatgccatccaaccatctcatcctctgtcatcccttttcctagggccttcaatctttcccagcatcagggtcttttcaaatgagtcagctctttacatcaggtggccaaagtattggagtttcagctttagcatcagtctttctgatgaatatccaggactgatttcctttaggattgactgatt

SEQ ID NO: 53801 - DNA, 2363 bp, Bovine  19866881366506
tttaagccactgtaccaacacagcaatggcctacctctggcttttcagggcagaaaaaatgtccaacttaatatgttgaagccactctttattcagttacagctgaatccagttcccagtacacaaatggagaaagaggatgttatctttgcataattatacaatcatttttaattcttccacaagaaaaaccagccatttttagattttaagaggcacatcatttcagaacaatacattttacccatcttctggctcactgcattcaacctttagccaaaatgtcaagtatcaaagtacagatagtattacattataattctttatttacatctgtttatagactctaaattatttaagggcaggacctatgtcttatttatcctttcacctttagaacctaaaacatctcttggcacttattaaaaggtcaggaaataagtgtttaatttatttagactagcaggagaataagctctttaaacctagggtggaagctgttgccacaggataaaaatcagtgctcagatacatgataagacaggcaagcagaaaggagtcaggatatagggccagctctctgtcactaaaccagtgtctcagtcttttcatacagagaacactgtgcatctctacaaggatgaaaatgccttcagcatccgggggcggtgggggtgcttggaggagaaacgtgcaaaaaatgaagccctgatagatgctttagcaaatactcctctatgttcagcattttctgcctgtaattacttttcaccaaagacagcaatcatattaaaaaaaaaaaatagctctcctagttgcttcacttaaaatggatggtgactttataaagcacaagtggcaaaaagccaaacaacaacctgctttattgaatcttattttctcctgtgcagattactcacgcattagtttgcctggaactgagaaatgtggttttctctgacccatggggtctgagaccaacaggaaccagcaccagctcaaaatcagtttcttctcaggcctgcccatgaaggttagataagttattaatgcatgaaacacccaactcctgagtcattcacaaccgaagttgcctaagtgtgaggaggttgtacttctgcctaaagccttgaaagatcatttttggaatgggtattgttgtgatagatagaactcagtgggaatgggcaattttgacattgtaaattaccttgtaattttatatactggaggccattctttcaaatccacaggcctataatcccgagaaaggtcattcttagtgtggagtctggagtattttgaaaaaaaataggaaaggcagggttgaaaagcccatttgtcctgcaagttgggggaataaatttataacaaggattttttaaatgaaggttgaatttgcaaccattcatttgaacaggcatgcctagaccacctgataaataatacatttgcattgtgcttatgaaatatgcaaatgtagtccaatttgcaaataaatgccttgaagaattcttttaaaacttcagaggttacctaatcctagtagttgccctattcgtatttgtgaggtttttgttttattttgtgacagctgccataaattcaattaaactgtatggcaaatgaagttttggtggtagctgttttttttttctcctgaaggaagaaaatgatcaagaggttggaaagatgggaagcaatgagcacatttgcaaacagggaaatcaaacaatgccgcatcaaaataggaaggaaggaaatccagccagctaagcaggtacagccggatttggtacccttgtccttcactccctttatccacaggctttttttgcttgggaaaaaaaaaaaaagtataagcaattaggatctgcaaagttagaagctaaaataattcactgacagcaaacagaaacagaaagcaaatctcagaatgtgcaggcatgaaaaatactgcaagggatggtcattcaaaatgtgtttcaggccatttggagaggcgtgactgagaacactgccctaagtcaagttcattaacgcctcctccacgaggttttaactttctatcatataaaaaaaatatctaaatgtttaattttctgagtttccacaggactcaaattctgaattctcttattctaagactcatagctcagtcagtaaagaatctgcctgcaatgcaggagacccaggttcaattcctgagtcaggaagatcccctgaagaaggaaatggcaacccactccagtattcttgcctggagaatcccatggaccagaggagcctgaacaggctgcagtccatggggtcacaagagccagacacaacttagtgactaaaccaccaccaccaccatgaaa

SEQ ID NO: 53802 - DNA, 617 bp, Bovine  19866881730817
tgaaacaaagacagcatagtgttccgccctggagagagatgactgttaaaaggagccacccgtaaagccatgggtctcaggaatattaaagtacagtgcaatgaaatgggtctctgtccttgcttaatctagattgagttctagttttttaatacgaaacccagacaataggaccatttatcatttaggtgaagccaaaagctgggttgagtagccggtgacagagggctaacacagacagattctgtgctccactacggctgttttttcctgccagcactcacgccgaggcagtaacttggttctgagttatttgctgtacaaatttaaagccacaacacaagaatagaggctaaacccaagggaaatggcctttcaccagcccgtgtgctctgatggcatacgaaaatctggaacgaggaagttgatgcaaggattacacaactttaccaaaactttcactgagattgcagagacagagagatagagaatattaaaggaaaggaccaattgccaaaacaaatgatttagatttgggagttggtttggttacaacccaggaaatagtaataattttggaaatcttactgctggaaggtaagcacaagacatcatca

SEQ ID NO: 53803 - DNA, 704 bp, Bovine  19866882013420
tgaagctgaggagccctgctggaaagcaagcttctaagcagaaacagagaagaacagaaaagtgtaaatctccacagatgcagacagacttgtgggtgaacagcccatttaaaggcatgaagtttgcattaaaatataaaatactctgcaggccaaacagagctcctcgcaggctgcatgtgcagtgaggactctctggggaagtcttggctgaatgaacaagtcttggtccgtgcctcaagagcaacaagtggaacattttctcccctgttacctcctgaaagatttactattatggcctctcagagtcaagggaaaacttgaattaaaagtgtttcccagagaaagcattaagcctgatcactcaaatgccttttcttgcaaagggtggcctaaaggtcagaaaactgtctcaccaccaggttcatgttgccttaaaatcctctaatgttctcatctgaccaaagggaaatagggctactgagtactggggcgtgcggccagaatggacactgttgtcagagaaatccttatgaaatatggttgttgttatcttagcatattattgcttttcctactgttcatggtttaattaaagcccagaactgcacaggagaaaagcagacaaggcaaatttccttttgaggaactggaaacacatcctggatttacattggaatgctttctttttacaaaggctttaa

SEQ ID NO: 53804 - DNA, 1483 bp, Bovine  19866880429808
ccacatgttacatgcatctcgtgccctgggactaacaacgatgcatgtgcattctcgatgtgcctcacagtccaactgagcagagtctttccagttcattaacgaaaggggaactggggatacttgcccatttttttccaatatgaggactcagtgccatcacagaagggcaacattcatctactatattcatctaccattcaaaaacgtatgaatctgcacaatttgcatgttctgagataaataaccattggcggtccttgtgcattacatatgcttgcacatgagaaaaatacacacgccagagtaacctgcagtgggctacaggtgagaaaagacagacgtgagggagaaaccagacactgcaaacagcggcccgccaactgcagctaaggtttactgtttactatgggccgagcactgggctaagggtgtggctagcactatcatttgttcctcgcagtgaagtaggtactttcattatacttcttttaaaaaattgaggctcagaaatgacttgcacaatcttcaactggtaggcaacgggaaagcctcaccttgaaagcccagtccgcctgactctaaagcaaggcccatccgtgaagctcaacactgtactgcccccaccccaagcagggaggatctgtgccctgggatccaaggtgaccgtttcctcaggaggacggagggaagggggagaaggcacttctttctctctatctctctctctggagaaaggaaacaggagaaggaggaaaggacttcctctacacgcacccccacccccacatacacaaatacacgtacagcccttgagaaattttcggaagcaggcttctaatcaattatttagaaaggatatgatcctaatgagtgaatgaatcataacctaccatagcctatggcactgagctcctgggaggagaggtcctaaaataatcaggaccatagcaaagataacagtctacagaggaatactgccaatcgcttcggataatttccttacatttttactttaaaggagaatgaagtcacgaaacatcaggaagcccagacaaagacatctttggcacagtaagttacacggtctttaatgaaacatactgactgagtgccagttatgcaccacaggcaccacggaccaaagagtaagcagatctcaacacacaccaccagcagaaagcattgccaggaagaataaccctcagggggaatgcaaacgcttgttattttgataacaacctacgaaaaaatattctaattctaaaaatcttctaggtcatttatcaatccttcttagtattctatctcatgatgaacagacacacaggtaagtggagtttatacactgaactgtctcctttcttcagactcatataatagcaaaattttggtttttaaaaactaaactcattttatacttagaaattagcaaataaactggtatattcaatcaataaaattccaaatttcaccatgtaga

SEQ ID NO: 53805 - DNA, 1462 bp, Bovine  19866880588363
tctactttggacagcagagaaagaggccaaaaaccaaggaaaggaaatgaggaaaggtagaggggcaggaggagaattaggataacacagtgccatgaaccagaaaagcaatgtctcccagttgggtggagtgctcagtatcagcaggggccagaaacatcgaatggccgagacagagcatttggatctggctcctacgtgatcagtaggacaaggtgtttcaaaaagatgaggagagcagagcagggagccacaaaaagcaagaaagaggcagccactaacaggctgagtacatatgtgtgtgccaggcatcatgataggaattttgtatggatttatcatctttaatcctcacaaacatcccttaaaagtaagtgctatgaataatttgtatccagcgcatttttcgtataacttaatgaaagaagcataccttttaaaaaaaaaaacaaaaaacctctcatacatattttgatgtggctatggagatttgagagcaagcatgtagctggaaactgctatcagggaaaataatacaaactgagaggggctgaatatggaatggtctggctgggtgactaaagcacatgatcaaaatgtttgtaatggcaaacggatttgtgtgtgtgtgtgtgtgtgtgtgtcctgtctgtctgtttctctggctcccacaagaactgcttgggagaaaaacatgcttatgtggtcaattagtcccagtgcaaactcatactattagcaacaatttttgaaggctgatttttttgcatagcagaaggcaatggcaacccactccagtactcttgcctggaaaatgccatggatggaggagcctggtaggccacagtccatggggttgcaaagagtcgggcatgactgagcgacttcactttcacttttcactttcatacattggagaaggaaatggcaacccacgccagtgttcttgcctggagaatcccagggacaggggagcctggtgggctgccatctatggggttgcacaaagtcagacacgactgaggcgacttagcagcagcatcataacagagaatatgaaagaaaacaaatatgaaagggtgaaaatattgctaatccaccaggtcacacatgatagtgatgtaaatacttcctgtcccactgaatttccctcctcaaaaaatagccacagaaggaagagcagctctccagggttccaggaccatgaaatgaatctgtattcctatgagtctttaaatatttatacacagcaagtaaaatctgattgtttattttttaaatttaccttagcatgaggtttaatttaatttaacctcaatgaagaaaatggccgtgacttcatacatatctatcaaataaataaatgcgtcaatttaacctaaaagacacttgtacttttagcaactctcaatcttatttgatcaaaataaacaacaaaaacaggaaacagtataatggctta

SEQ ID NO: 53806 - DNA, 2203 bp, Bovine  19866880590828
ttttcgattagggcctaatggattcattttcactttattaccactgtacagatcctatttttacagaaaatcgcattctgaaatactgggagttcagacttcatatcttttggatatggagaggcaaaattcaacccaaaacagtagctctgttctatgaatggaaacaaatttatcacagagcccagaatgatgcaaccatcactaatttgttctttttttttttttttaatctatgtaatcagctaggaaatgaaaatagatttttcttacaataattctcagaggaaaacaaggatggggaagaagggaagggggagagtggtaaggtctctccttggcgtttcctttgttgtgctgtggctatgtgtctgatgtccagagaggagcctgggtgcacatgccagcttctcttacctaataaccagctgaggccacagcagcacttctctctgtgtgaggagaagcatttctttggagcggacagatcctttcttttctggagtctttctgtgggccttgcccacccctgagcagtggactttcatttcccagggtcatgggttcagagatgcatacagtgtgtgggaggtcggggagggcaggaaagatgctgtgaggggagaaggaagggaagtggtccaaagataacaatatttaaggcatcatttcctgtacaaaaatggacaaccaggcatgataccaaaggaagtgaaaaccaaaataaatattagccgccctctgcctttggagtgcttgtgtgtacatgcaggtgacatcttagtgagctgtttgagataattaccctgagtaagagaggccctgttgattttaagtgaaggatagctcagagttaataggaggaataccctgagcatcagttgcttatcttctgcattattctccagtagagggtgactcagtgccctggaaaagttgatggaccagcagcattcaaggacaacagggagggaagagataaggaaggacagttgtccttgtgaacactggcagtagatttggcacgagagccccttcttctctattactggagctgtttagaagaaaaagtatgggccgtcttcacagaaatgggttttacatagaggacatacagagactatggtcatcttgaggaaaagaattcattgttagtccttggtgactctctgtggcttaccccccgttccttaatttaggttagggatgtataaatggtgcccctagatgtgcttctagctagaggacccagcaatgcctgttgcttacctcctgtgaagatgtaagggagcagatgctccagggacaacggcaacaggaagtcaagggaccatgttgttatgagcggggccttgtctgactttccagtgtaaagctctttgataaagtgggctggacacgtggcgttgcctgaagacaggtcagtgtacaccctggtgtttaccattcctgccacaggcaaaatgtaatggtctcctttactttcatcgttaaggctgcttctcagaaagggagagttaggtgaaacaaagtgagattgtgtttaataagtaaaggtatgttcatttaaggactagaagattaaacacaacagtataaagtgatgcaactgtgtcttgatataacgtgtttgaggcaggtctgagggaacaactcaaacgatgtgagtcagcttcgagcagttcacgttagattgggggtggtctccaaatgtagtagaattgagcttgtgatagagttgaggtcctggttattctaaactgtgttcaggctttaattataattctttcagcttgcgatatgggaccgaggcaggacatgtagagcttgggaaggggccaggaggcgtaacagcaatgaggttccatatgcacgatgagaggaaagacagcaggacggcttggagaagtgaaggctggcaggggctcagttagttgttttaagtatatgaaggtctattgcaagaatcatggtgaacagatattttcactcttcactaaagacaggactaaacaaggaatgccgttaccttttagcccaaggtactttaaatgagaatttagggaaaccatcttaactgaacatgtgggaacatgggattattttaataaagggatccagagcattgactttcagataatttacggcaagtgcagaaacacacttgaactggatctaatcttgatgattttctttgatttga

SEQ ID NO: 53807 - DNA, 722 bp, Bovine  19866880641293
tgagtatgttcagtgctatctgtctccctgccgagagaatagctccaggagccctttgagtcttagctcctcaaaccttagcatgaccatgatcacagagcagatgctctgttgcttcattctttggtgttgagcacccacagctgagactgttttgagactggttgtccaatcctccacggaaactagacctattctgcttgggccagaaagttctcttttgtggttgcatcccacattacttagcttgcttcttcagaccaccccataaatcttgtgcactagagcctttgcagaaaaaatgtgaggccataaccagagaaactggaccctctggccacagttgtgtgaaactcaggaagagcagggttgactttgcctttctctggtgaaaatagtttgaggtttagccacagattgccttcagggcagtcgtttctcttggtgagacaccagcatgtcagaaccttttcctacccttctcctcgctgtggttgcatgattgcaccctgccattctatctcgctaacatatttacagcccccaaaaatgggtctaacattttttttccttagaagagactaaggggtactaagggttggaatgaaaaatgactctaaaatggttaagaggtgtttagaaaatgcagccacagtgtaagatgaaactgtacattgagaaaatcaggtctctttttaattgttgacagctttaaatcctac

SEQ ID NO: 53808 - DNA, 744 bp, Bovine  19866880666630
gctcctctctaaggaaatacagaaaggaaatggactgaagctgcatcctgggaaacttcgttggacatagaattcccttggtgagagtgttagataccaggccacgttcccatgggactgtgtggaatttcctctaacggtcttgaaaaaggaagacttcttattttaggggtgattctgatgtgggtttgcttgaagacaggtctccagtctgatctgaagttcataataccacccataagtagttcagaagactgagaagggtcttggctcttggtcagctggtcatccagatggtttcctgtgttaagcactagcaaggaggctgggagagaatgtggctgcgtgtgtctgaaaggagactgagaagtctctcccacaaaagcctgaatgctggaacactagtgagtggagtagcgtgccaaggaccacaaccctactgtgagttcaaacacccatgtctaatgatccaactactttctttcaaccagaagtgtagagaagacatgaaggagggatcagagtccacagccgtgctctcctgcctcctgctactaggtcagcacccccaagggccatccagcatctgccacatgccaggtgccaggtcctgtcctggtgggggtattaagagggtgacataccatgccaaacatctgatgacaaataatgagttaactaggtaaaaagtactttgaaagggcaaaatggtgtgattaggaggaaaagtagaaaagaaggctg

SEQ ID NO: 53809 - DNA, 1927 bp, Bovine  19866880671338
agacagaggactcatgaggtaggagtgtggaatgagggaaggaaaatatgacacaataaaaggaaaatggagtaaatgatcagaggtcttttcagctctgcaaataactgtggtcctcagatacagagaacaaactagcaggtaccagaggggagatgagtgagaggagggacaaaataggtgaagggaattaagacatacaagtggccaaataagttgtagggatgttatgtacggcacaagaaatatagtcaatattttataataactttgtatggtgtgtagtctataaaaaaatcactgtgttgtacacctgaaacaaaattaatattttaagtcaattatacatcaattaaaaaaataactgtgacccccatcaaacaataataaaactacaataataataacccaactctgtgtgccagatagtgtgttaagcactatatagtaattaattcatttcatcttcacaactacatcatgagggagggatattctcattatcccatttagcagatgagaaaaccaaggcacaaataggttaagtactttgtccccagttacagagccaggaaccaaaccacacagtctaatgctttgccctcaagaacaaagctataggaaacatggaggtactgcagccgccagagagcttctgttggccatcagaagggacgagaccctcctgcaaggccttagtgagctcctgcctagggttaaatgaggtcgaatgattaagagctctgtgaaacctaaagtgctttataaagatgagggctcagaacaccactctaggcaaacagtcagttcaaaaacaggaatccaatgacgaccagtgtgactgtggtttacattctatagcagtgggtgtccacattttttttgcctaaaaatatccaagagatggaaaggcaatgagttttgcattttgcagaggaacacaaaaagcactaatcataaaaaataaggataaatttggactttgccaaaataaaagaacgtccagttgtcaaaagatactaagagagtaaaagatactactgggggagtaagagaaggtgtctgtaatttttatctccaatgagacaaacatccagaatatgcaaagaatgtcaacaaataagaaaaaaaagaactaacaacccaattaataaaatggatgaaagaccttcataaaacaggacacacaaagggccacaaacataagaaacagaagggaacgtgatggcacatcagggaaatgcagttaagaccacagtgaaataaacacctttctgaatggaaagcattcaaaagaccacccaaataacaagtactggcaagaatgcagtacttggaactctcatccactgctgatgggagagcaaagtgataaaaccactttggaaatatctattaaaattaaacctatgccttatgatctagcagttcttcctctagttatatacccaagagaaatgagcacatatctaccaaaaaacacatttgagaatactcaggtttattcacaatagccaggttttgcaacaagaagacaaatattcattcacaagacaataagctgttgtatatttaaaataatggaacaccacaagcaataaaaaagaccaactactgttacatgcaacaacatgaataaatctcatagaaataataatgagggaaagaagctagatgcaaaagactaccgacagtgggatttcatttatacaatgttcaaattcttgaaaagtcctgtgctgggagaaaccagaacagtgatttcgtcttagagaagaagtatgggcagtgattgggaaggtgcccaagaaaacctgccagagtgacagaagtgttctataacttgacctaggtggtcacacaggtatgtgggaggatgtgtctgtgtgtgcacagtcattaagatatagacttaagatttatgcat

SEQ ID NO: 53810 - DNA, 1420 bp, Bovine  19866880697186
taaaatagtcactctatctttagccactccattctcaaattcagatcctttgtaagtagttgtttccataaatcatgtcaaagaaactatttttgcaaggtatggccctcagttaatcatagtgcacccgatcctttagaacacaggtcctttggaaagttgatgctaccacttgctgaaagcatgttcctctagttttgagtccatctgaacacaacatatcggcaacaggaaggctagtttaaagttattctccttatgccccgtgcagtttcaaagtggcgcatgagcctgtttcttttcctggatatggcctatcagggaatttgggctattccttgtggcaacataacctctcaagtaaacacagcacttggccctgtacttctggagatgagggcaggaggtgagttgggggtaggcccagagtgaaaaacgtcctggaagattttctgtgattttccagaacaccaaattcacgtatctgtgctccttatctgccggtggtttctggtggggaattgagctaatgagtgcagagctctctgtgacctgccttgtaatgagccctaagtaaatattaactatttctacttttcactcatctcgctgctattctggaaggacatatgaccctaggctttggggcgaaaccaccaggagtttgccccctaccctgagcaattgcaaaacacaccgacagtctgtcatcttctgaggagcagcttgcagaatgagttggctctaggcaactcatttcttgagctcgtctctgcccacacgtaccacattttacccagaaagcaacagctgtaccccagtggaaattcccccagggcgctcactgcctctgctaatgggcagagcacaccagtgctctgagcttccctctcccgctcccagtgtccagcacaggcacccagataccagtggaagccctgaggctccacagcagtaaccctgcccctcgcagacatcaaaacaagcctttctttgtggtctctataagcaggcagagattctgactggggagatggtagaaggcaattggggaaggactccattttcttagtttcaagagaattttgggtaactcgtagttcctgaagactgtttgttctgtctcttttccccgaggaagcccacatcatttgacgttacctttgctcctggtccagttagcgggtaaggcattcagattctgaaagcttcacggagggaaaggggttaagggaaaacagcatatgtgtgcacactctgatggcctgaatattacattatctgttccaacaaataaacgttagaccagatcagtctatcaaatacagagacaacattgatctttcaggacaatttgccagctccaaaacgccagctgtcccttcttgcccgttgggagtaggagaatgcttctttttca

SEQ ID NO: 53811 - DNA, 1723 bp, Bovine  19866880753921
atggaagagaatgtgaaaaagaatatggataactgaatcactttgctatacagtataaattaacattgtaaatcaactatacttcaatgaaataaattttttaaagttatattgttgtttggaagtagaatgactagtgacctgtattttattcttgccatatattttatattctgattcattgtctctctctcccccaacccccgccactccctccctctccccacctatctctgtctacttctattttacttgtataatgagaaaaaattgataaggttataaagcattgaaggagtagatttgaaggagtgaagcagtggaggtggtgacttggtggggcaggagcttgttatttgtgttgaggtctgacagatgaagacatctttccctaagtactacacaagaggtagattcatcttgactttaggattctttcagcttctctgtccagccataaacccttttggtgacactgcctggtatttgcaaataggaagattctaagtaggtagaatttttagtgaccatgctagctgtgtgagaacagtgtgtgctctgggaacaaacatgttgcataatcaccagcccagagaaggttaactgcacaaaaatacctgcttcggaataaggcttggtgtcaactcagtcactgtgacaacctaccagtgacctgggctacagacacctccttgccccagctgtcaccatgttgtgcagtcaacaattactaaacagctattcttatttcagtgatgttctcttattccaatgtcagtaagcttatttacaaaagtaaaggatgtatgctgtttcatttgcacagaggaaaggatccataattcaacattcctattgttgcaagtattttgccctttaggtcatttaactttcaaagcaatgcatgaagtaaaatatgaccatcccatcttacagatgaagaaactgaacttcataaagcttcataaataagtcattatatagcagttttccaggagatgatctgattaaaaaaaaaaaaaaccttttaaaaaatagatgaacttaagaaaagtattggtatgaaatactgtggatattgaaaatgaagcttgggagaggacaccatttcttttgagaattcactttgttttcatgaagtagacctgaaaccctatatggtcacctggttttagaaaaggaaccagagatcaaattgccaacatccactggatcatggaaaaatgaagagggttccagaaaaacatctatttctgctttattgactatgccaaagcctttgactgtgtgaatcacaataaactgtggaaaattctgaaagagataggaataccggaccacctgacctgcctcttgagaaatttgtatttctcaagcaacagttagaactggacatggaacaacagactggttccaaataggaaaaggagtacgtcaaggctgtatattgtcaccctgcttattgaacttttatgcagagtacagcatgagaaacgctgggctggaagaagcacaaacttggaatcaagatatgcatatctgacaacctcagatatgcagatgacaccacccttttggcagaatgtgaagaggaactaaaaagcctcttgatgaaagtgaaagaggagagtgaaaaagttggcttaaagctcaacattcagaaaacgaagatcatggcatccggtcccaccacttcatgggaaatagatgagggaacagtgga

SEQ ID NO: 53812 - DNA, 1964 bp, Bovine  19866880787229
cattgcctgggctgaaaccttccgattttagccaatagattaagatactgtactctgtattgactagaaatacaatttgtcatttaaagatttgaaccagccttttgaattgtgacttttgaaagggaattttctctttgctttataccatcctatacttagggcatttgcatctgaaccattagtgttccctgggtcatgtatgcaaaccagcatctaaggtcattttgtttgatttggtttcattttcctggtgactttcctagctgccaaaggtgggcctcttggtctgagggcagtagttgatggtccttcaacaccttcttcaggtgactgtcgtgaaacagcattccaaattcccaattccagccagtgctgcctggttcccagggacaacagcctgcagcctgaaaataatgtattgggattatcacccacaatcagcctgaaacaaccatgactgccaccctacactccatgcactgtcttacatttggagctttatacctactttaatctctgcccggaacaatcttccctacacccctcctgtgtcagattagtttctatttatttatcaagtcttagcttgtgtgtcagcttctccaagtaacccttctgtgcctctacaagttgggaatttctattgcgtacccaccgtgacattctctagttacccctgttatgtgtcctcattttacatagctcaggtgcacgaactcaggaccatggtttagttatagaacatcagtcctccaacaatacagttgccatggtatatgaactgtgaatagttatgcgcaggataaacttcccagctgggttttcagtccagagatcacttcgtgaataacagattcacatcagtaacaaattatgttactgttatgatgatcagtaacaaattatgtcacttttgaagtgacatggtgagcggtcattgcacttctgttattcacttaacacacaaacagcaaaagcagtacttgtgttgccccttgtctcctggtgataaacccatatggcaatttatgaatatggataattgaaagaggagattagccagaaaaagataaagtgcagcaaagaaatgaagagtgattatcctagaagtcaaacgtaaatcaaatgtaaatgtagttatagaagaaatagctggccgtggactgtatgacatctttcccattggacatggtctagatttgcagccagaggaacttggtgaaggcaaatttattgacataaataagcaaagtgttcatgacagaagggaagatgatgtcccaggagaagtgattctgcaaaccatttcacgtggaaggaactctcagagatacttcacaatgatataaaaagagcaaagggtaaactgttagaagctgatccgattttaaagggaatatgatcatttgccaagacagagagagtatgtttgttctgtgttgttatatgatgaaaagagaaggcaagctctgttcgaatgactctcgagaagttttttatactaagtctcaaagtttctaatgttttaaattagagtactgactaaataatagtcttactatttttttttttcatttccttgtacgtttataactaatagtaagagaattttaaaggtcatggagcagtcacacttttctcattgattccaatggtcacttttccgatttcagtttgcagggcaatttttatggtcctgcactactgtacagagtgagcactgctgtagtatagttagtttctatacacacactcacagataatattttgaattggatgagtgagggaatgagtgaattctatataaatacgagggatgaaagagaatattcccttcctcccttgccaattccttcccatctgaatgcatggcccatattccaaggagtaggtccactcttgtgctcaaattaattctgcagccctaatcatggccctgaagctaagggtcagcacttcaa

SEQ ID NO: 53813 - DNA, 1593 bp, Bovine  19866880805085
ggttattttacggtctcttctattaagggatgtaaaatttccttttcaatgaatttatttaagtcatacaaggtgaatctaaagaaaagatttttttttagttagaggagaattgctttataatgctgtgttggtttctgccacacaacaactcaaaatcagtcataattatatatatatatatatatatatatatatatatatatatatccccttcctcttgagcctccctgcccccctcccaattccacccctctaggtcatcacagagccccagactgggcaccctgtgttatatagcagctacccactagctatctattactgtatatgtgtcaatgatactaaagaaaatattaaagaaataataatctgggtcagaggtcagcaaactggcctgcatgccaaatctgttgcactgcccgtctttgtatagttcatgaactacaaatgtttttaataaatgtagaagccgctctgtaacatagggagcccagtctgggggaagggagtggagcataaaacatgaagaatattttgtgatacgtgacaaatacacgaaattcaaactgcaggctccagaaaccaacccttgaattgcacacatccgtgtttattgatttacgttttacctacagcagcctcctgccacagtggcggagttaagtagttgcaacagagaccaaatagcccacaatgtttaaagtatttattacttgatcctttacagaaaaagttttctgacccctggttaaggtggttggctgacatggccaagatcttgtgatggtaccagagtgagtcaatccctcgtcagaactctaggaggttctcatcatttgtttccaccagtttacaggtgagaaggaaaccatggctcagagaggtttagtgacttgcacaaggtcacacagccagtcagcagaaagtcagaatttgaaccaaggtcagactccaaaggggcatttggtgggcagggttgaacatcacgtatgctttgctgatctttcttgccacccattcattttcttcatgtgcctcaaatacacctagtactttctttcaaacctctatacctttgttcagacacctcttcttcctgttaactccagcaggatagcccctcctccaggaagtctctgctatggcccatccctcctggacccagggcagacctccctcctctcccctcccaacactggtacctgcgtgtcggtggatttttcatcattattcttttttctttttttcgcctcattgcacagcatatgggatcttagttccccgaccagggattgaatctgtgcctcctgcattggaaggcagagtcttaatcactgggctgccagagaagttcccatcgtcatttcttgatgacatggctcatctgcacagctcaggaaacgccctggagggtggagatggtgtcaagcacagagtcctaataatttagcagaacaagacaggccttcctcgccttgcacctcgtctctggtcacctcacctctcccctgcttctgctttctgctcctgcaggactgaaccacctgtaattccccaaacccttcgagttagctcaggcctctctgccta

SEQ ID NO: 53814 - DNA, 1420 bp, Bovine  19866880819650
ttttgcagcatcatccttgaccctgaactttattcttcccacatcttccttgcctcctcccatcttcccaagtgtcttaactctttggcctaaccctgccttgttcaagagcgttattcacatattaatcacttcctagccttgtttcatacctccttttcatttaaggctttctagaatccccgtgtgtccaaatgaaaatacagagaaaagagacgtggaatgagatggttatgtgtggacaaagccaactggccaaggttccttaatttttcttgccaagacctccatcacctgccacgggctgtgcagctataagctggcctcttggtttcccagcctgtgtcactgtgtatctgcttgccgggtgtcctgacctctcagctttccttcccacaattttccaaagtgaaggaggcagtcgcactttaatgaaatctctgccatctctttgaaacactctggttccctcctctcgtggccactgagtcacgctttccctgcacatctcttctcagagctttcctgacacaggagatgaaggagggtacttggcactttccactttctgaatactactccccacttcattgagaaattaaaatcacaaggtggacacacctcctaactggcagaatcactgtactgaaaaatgcccattttctttctttttttctgattaagcttcttctcactctgcctctatccttcagaatctctcttctttactgcatggctgtctcaactcagtctaacttcccacaaagccccctttaacataatttccacttcccatctatgtaaacttttactgaaggttcattattatttattttcagtgtttgatcaaagcgttaaccctgctcagtacaggtttcctttgctcggagtccctcagagtaaagacctgtctgctttgtacatttactccatccgagggtcatgaggacacagtggatatgtgctgagggaatgaatgacccgtggccaatgctgggcttctgcctccatttaggatatgagcaccgtgaagcatctgttcgtttgacacacctctgtggtaccctaccatgtgccagaccctatgtcaagcatgctgggtatgaataaaacaagagtctctgatctctttttttttaatttttaattggaagataatagctttacaacattgtgttggcttctgccacacaagaacatgaatcaaccataagtatatatttgtcctctccctcttgaccatccccctaccccatcccactcctccaggttgtcagagtattagggtgagctccctgggttacacagtaactccccattagctatctattttatatatggtaatgtatatgtttcgatgctactctctcaatttgtcccaccctgtccttcccctgctgtggtcactgctatcctgaag

SEQ ID NO: 53815 - DNA, 982 bp, Bovine  19866880839213
acacatttgacccctcagaccctctgaacaggggaccagatctgacttttggctccactccaacatctaatgatttggtggggctcagggaatccccagtgacatcacagtagaacccagacacctcatatcaaacatacacaccactgccagaaatactaaagcagaagggagagatttttgttcttagatagtcaaggagagtcttttctccaaagtcataccgccatttatcaacaccatctgagagcagcgctggcaggaaagcccagaagagatagtcagcctttggctcaaatcgctcctactctcctgtttctataaggtctggagaatgactttacccctcgcagttaccgcagccacgtctgcatgatacgcagagcaagagcagcataattaatgatgtgtaagactacgattgtgaactaggatttcacaaatcaagcccagtggaaatacaacctggagaatcggttaacttgaaattgagcccttgtctgttgggagtttattgcccctgccccgtgtggcccttcccgtcatggagtgagaagggccctgactggccctggggaccaggcctctcgctgcttacaggaatctgggaacagttgaacattggcagcctgtctgatctcacagcagatatgttaggtcaacagagaagtcctcttaaactcttgaaatcagactcctttaggcaggctgttgccctcacaactccccccttctccacaccctagaccctctgtaccttgttacctctgcgtctgagtgtgtcatgtctgaagagaaccttggagaagggggtacagcccttagctattctccctattctcccttctcctgtccctgagtaaggaagataccagaaatgtgagatgggtgcttactgtgctggtcgctcctgtccttcgtcccatccactgtgccatctgggaggattctcaggaagtagcccccgttgctgcagtagagg

SEQ ID NO: 53816 - DNA, 2420 bp, Bovine  19866880894716
atgactacaaaggctgacaaacacccttggcatatgtgaggaactgagagaaagccaataaggactttctccgagtttagagaagtggacagggaccaagtcaagcagcatcttaaaagccataagatagactttgttttaggagcatgaagaagccagcgctgggaggagagaggggcggtttcaaacagaggaaaacggattacaggggaacatcaagtaccgcactcctagtatgtgcctgctaccgtactagcagagaacaagacaaacagggttccctaactttactgtttacactctagttggggagacacagataaccatcaaaataattttgagtttttactagacagaggtctttttcagatgagtcactagtggcttcttggaggaggtgtaactgagtgagacgtgaaggagaaaagaccaggcttcatggttagaagaaatatgacaagaggcatatgaaatatgtactgcaatcaaactctttgcattctattaattctgttaattttcagttaataggcactgcatgtgcttgaccaggcccgctctccacacatcctttcaggtgtccacttcaaagacagatggcaccttgaccatccattgccaaaaaaggactgctcaatctgccgtgccatggcttaagaagatttaagttttttgattaaatttaattaaaaatatgtaggttatatgtaagcttaaacacctttgaatctcttaagtacttgctgctcatttcagaatctgaccatgtttactttagaagttaaaaccatgttgacaatgtctatagtcactgtctaaaaagaaagttgaagtcattaattggaataaaagtgtgaatagagttatgaaacaccaacatatcttctttcataaaattaatctgactcagtatttatttgggagggtactcaaatttagatttaaaccatcatagcataacctggtatttcttacataaagtaggagttacagaaattttttctcagtgttcaactttatggatggcttacagaacaatagtttttaagtgggcattctatttcccattcttgtctccttatgccattgggataaccttttatttttttcttaagtccaaggtcactttttgtcaaaaaattaaaaaacagatcttattttaaaccatgaagagacacagtttcaggctctgtgtgtcatttaaaaagttaggaaacttgagagatctacttgaaaattgtagttgtgatcgttaactgttgagaaccctaactgaaaattcattttgtagtacctttagtcggaagaatattcagtcacataacattggtcagaggcagatttttgggtatcagaaagcctagagtcaagttttatttctgaccctctacctaactgtaaacattatcacacacagttgtctttagaatgcagtgctatgaaaaaaaattctttgattttcaactgggtaagatttaaaactgtgttgtctaactgctcatattcaaatactaccataaaagcttgatttaaatgaatgactgataatagattctataggaataaattctaaatacttaaggaaagctttccaaaattcagatcagagggaattcacgttaattgcaataggtagatgagttaatagaacgctttgcaaaatcaaacagaaaagtacttttttgcagaacaagaattacttctgtttaactcaaacacttgatatttgtcttccacaggcagagaatggctttaccctgcatgtatgaccaatgtaaacatatgctatatgtttcctctgagttaaacaggcttcaggtatcttacgaagagtatctctgtatgaaaaccttactgctcctctcttcaggttggtggaacacctattctcttctaaaattgacttctgaaatatgtcaaaaacataaaacatagaagtctagaaataaaggtttgtttgtatacaaagcactaaataattatacctctactatttcctggtactttagattttcttaaatgtaaaattttagaaaggttaagattaataagatagataagtatcatggagaaatggagaggtatatgaaccacatggcaggaaggaggaagtcactgctgatctggaatatctatagccttcttccttcctacaactttttacacttccactacagaagacacagagaaggcatgccagcttgaatgatttttctatacaacactgttcagttcactcactcagtcgtgtctgactctttgtgaccccatggactgcagcacaccaggcttccctgtccatcaccaactcctggagcttgctcaaactcagttacttagtcaaaaattttagttatacaatgactaataatacactaaatccaatgacatatttcttatactatgtataagaaattatg

SEQ ID NO: 53817 - DNA, 782 bp, Bovine  19866880949925
acacacacgcagggggctgacagtctgcgacttggagacttcggccggggctggcgttatctggtggaagtgggcgtgtcggagaaaagaactcaacaggtctggacacatttctctcttaacctcgcacttttttcccctctcgcctccctcggccccgggtttgttctttagcgcttgacatcacttcgcgcctgaaggtttgaagtagccccttttagaaaaaagaccctcccgaaccattgtagttttgtggtgcaatttttgacaagtgctagtttgacgttttgggattgcagacttgacgattgcagccgtgtaatgccgcttaagaccccttggcatggttcgttaacgccgattactgtgacagggttatttgcaacctaaacggggggataaagtcgtttgaggtatcttttcgttttatgaagttttgttttggtttcgagtttgaaggcagctgtcaaagcggcgtggaaattcattaggctccatttgataccttatgtttagagatcgttatcagataaatacagcagaggggcggggacaaaagcagtttacccttgagatttgtagaggcgggtgcctaccactgtctaccatcatcacattccacttttagagaggaccagtgaagtttgagcatcttaaagtctccgtacaggaaaagttttctttctttgaacgggatttgaatataatgtcgcaaataatgcttatcaaagactctgcctgcctcttaaaacatcttgattgtcaataacctatcaacctaa

SEQ ID NO: 53818 - DNA, 1067 bp, Bovine  19866880955151
caactcaatggaaatgagtctgagcgaactccaggggataatgaaggacagagaagcctggtgtgctacagtccatggggtcacaaagagtcggatacgactgagtgactgagcaacaaagatgcatttaaaatgcttgcaacagtgcgttacacacaatgctaacacacagtgcaaattctgtgatagtaataattctgttattattagtagtgctattatcatcatcattgaacgaagagggagtaattccagaggaaaaggattgtcagtcgcttccacccactgccaaaggttctggaggtctcactttttgtccctcctgctggaggtggatgtgaggatgtgaatgtggaatctgagaagagggaaccgaagcctggccccttcccattgcccagacagggacgaacggggcccaggtcaacagcctcttcctggagacagcctggaacagtgtcggcttctttgatttaatctcttccctgtctgcaggccaccaaaagttcaaagagttcttatttttctattgtaattctttagaaggacggttaattccttctgggacattcaggacatttattcgttttttttgaaaagcaaaattggcaacactgaccgaaggataaggtgaaaagtacttaagagccagtattctaagaaggcctttctctgtagcagaggtttgagatcagaaaggaggaaacttttcttgagccagaaagtatcatttataggtgtccttgatggaatcagtgctcagaacacagttttaaaatctgcttatgacagtgttgcttttcctcctgcgtttcatctggcctgggatttgtggaatttgcacaggatgcctgtgggtattcagtttccagtggccgagcagaaatgaagaggaggaggaagcagagtcagaagacctaggttttggacttgctagttagcacactccagtattcttgcctggagaatcccttggacagaggagcctggtgggctacagtccaccggactgcaaagactgaagcacttagcaggcagttagcacagggaaacctacagctgtgccc

SEQ ID NO: 53819 - DNA, 2446 bp, Bovine  19866880987900
tactagagtagggtgccattgccttctcccaggtagtcccattacaaagactgcaaatcaaaaattcccagggaataggaagatgtcagaaaagtcacataatctttttggcctctttaactttcccacttatgatagacaggtagtcataaagaaatcattctcggttttaagaaaaccaacattagaagacttgctagttaatggagtagatggcagatgctacagtctcagtcttggagacaatagtgcctggtaagaagtatggctcactgcaggggagaatgtacctattgaacagtaaaggtgacacagtctccaaatagatttgagattctggctcagatcagtctgaagagaactgacttccagcagtggggtacttataaaggacagaggatggcaggccattgtgagggccatgagctagggacaatatgatccccacaagactgggttttaggagccagatcccctagtctgtgagcccgtatgtctcagccagtacctgacagtgtagtgatgttgcccaactaggaggaaggtctcaactggcctgcctctttataaggatctctcttaatattcacccaaattatagagatgggcaagagggaaagcaaatttcattcatctcgagaagactgtcagaaatgtcctctccaggtgattgtaagcaccttgttcctgcaggaagaagcctgtagtagggtcaaacattcctctgctagattaaatcctaatgctcttagaatggttaatatcagaagaacttgttgaatgcctatggttggtcttagcctcttgggtgcctatgattagaatcttgatagagtcacgtgggatgcctcaatcttgagattaggaccaggctgcactcaactttgcttttcttttttgtaattttggtctttaagctgaagcatcacagaactctggaaaaggaacagaatgaaggtaggattataaagaaagacaaaaggaactaaaggacattgagagaggagatttcaaaaagagtgtgaggtgattgtagttttaaaatagatgtgaagaaaaattccagactgcattatttacttctaaataggacaatagctgggtcatttttaattaagaggtctgaaacattttacatataagaaaatgtacagttttgtggtctgtatcatacaggtttcagacttgtctggttttctcttggcagagttataaaggcaagtataaattgaaagctattttaataatctttatggtgtagtattatatattagatgaaattcattgttttgtaccccatattcatttcccacagcataccactgcttttacattagatgtctaccctgtagggaaaaatgggcctaaaatataaagctagccctttctttttacagacatcctgtaattagcttaagttttcatctcttcacagcaagatcctgctgcacaaaagttctcttttctcaacatgttttttgccagatgtttccacacaaaaaagtgtaaaggcaaaggttttttgtgcattggtgcatatgacttcgtccttaatgactgcctcaaaatgctccccctccttaattaagagaattagttcctcctccccccacctccaacccccccaagccctccccacccaccagttcctgtgtcaagagtatctattgtctcttgtcttcacaacctctcagcatttcagccatgtgtgactgtcctgtgtgtcctcagagggaatcaaacttagctccactcatactcatcctgtctgtttaaaatccaaaataaacacttaagctctttgactgacaaaaattcattcatggcaaattagcatgtgagatgactattctctctccagatagccgtacagttttgtctgattaagggatgagtctacactctgtgataagtttgcatccatattagcagtcaggctctattttatttcagataataaggttttcagctttactagagaaatacttttgtgtgttctaaaatattttccatgcttatgatcttacctatctctgctattatccatgctgaattttgtaaggtcagtagtggagataaccttagaaaatctgatttggcccctttatttggtatctagcaaaacagagggagttgccccaatcatacatctgattagtaaagacatcttgactctcattctctactccacatctgttaataacagatggtactgaattttcatgtggaaacccaaaacaaaataacaaaattccttcatcttttattaatatcagttacattggcactgaggatgatgcctacatacactcccaaccagtggcaagtcaatgttttgctccaactatgtcatgagttgggctaacgtagccacactttcatttaatacacttggaatacaacacaattgtaagctcccaagagcaagagaaaagtcttcacagtt

SEQ ID NO: 53820 - DNA, 1216 bp, Bovine  19866881081167
ttctgtgtacaaccatagcaggacaattcccaaggaatattttttataaatgaaactttcatttatttttgtggtctgtccatcacagagctcctttataaaactgagacacataaatatatatgactaccctgtagatatcaagaaggtacaaaattcccagctggacccataaggctagttaagtacctactttgggtgtttgttgtgcttttagaactggtagaatctcaccttcatggagacaaatgggaaaatcaatagaaattgaatgtgctacaaacggagttagaacaacagctacgagtgtgggcattaagagaccccagaacagtatctttggtgtcagacagcccactgtatgctcattctattattttacttccgaagagtatcgatgattaagatgtgttttattggctgacaccttgccaaagcatttctccagagaagataaccacagcctctcaattgctttcataagaatagcccactaaaacaatttttttaaaaatgaaaaagaattgcccaccatctataggttcacccacccaataaaagttgttgctacagtcaaaggaggaagcctgatgtggtggagtccacgttctgtttatttagtcatcctacctttatgacttgggaatatctactgagatatgcatccatcagtcaccatggcagggctccaacagccccctgtgtcacagaaggacacatcttgaatctagagaatgaaaacctcctgaaacttgtgaataaaccctctgtgagctcatccacagcattcatgtcaaagaaatagaaatagcaactagaacccatcactgggcaagctcagaagggctgtctagccaacaagttctgaacaaggaagttaggggaagaggaaaatctatgcttcatacatatatatgaaaatcatctcctctgctactagctttgaaatcaaaataataaaataacagcaagtcttggaggacagaaagatgagaggaattttatttgtaatttataaacaatagtgtctgccttcagcaactaatttcaagagaatcactttcagagtccatagtggaataacacttaacttggatattgctcactataaatattaatctgatggtccacaaaagtccataagggatgaaagctattttaacccaactaaacaactcaatcaatagttgtaaatatctgtgcacctagttctctg

SEQ ID NO: 53821 - DNA, 1107 bp, Bovine  19866881087662
tcaagattaaagctgtggtgactttttctcaacccaaaggctgccttctgcctttctgggctttcctctttccttccagactctccttcgtattcttcttaagttggtatcttgatctaacctgctattgactgtgtgtgtgtgcacacatgtgggtgaggaagatagacatgtattatcattgaaagtttaccattgaattgaaacatgacattgaattatgtttgagggaaactaaagaattcttatttagtaagaaagaagtggataagtgacagccaactcacatactgttaaactgagtaaaaagaaaagaaagaatatacatgtcacaatgatgaattttcacagaagatgatagatttgcactgaagagcagtaggatgtttacacggaagaaactagtaagctatttgtattcaattaggttttctaaactcaagaacatttaaacctcagacttcacatttttaaatctaaattaaaaattttaaatctatagataattgtaagcccaccgtgactcatgatacttgtctcttacaaaatgtaggcaccgaggtcttatgatgctgtgtcatattatggaactttaggaaatgggtaagcaaaagatggacatctacaggtgctaaaggttcagggagaccaagaaggactaatgcctcctctttcataatacagttctttctgtccacccacctcccatacctcccctttcactcccgactccccccacaactctgatcccaaactaaaatgaaggagtagagttgtgacataagcgtctgtcactgaaattagagcaggggactttttgcaattataccttggagtataatttcctagaggatggaaacatttaagatttggtaataggagtcaaagaggaaggaacaatggtttatgacttttttactttcaactgagagtattgtttgtggtctgcactttggcacacccagccagcaaggatggcaaatggtataatttaaggggcaccaaagggcctaaagtatgacaacaattcagtgtctgaaattcccgccattaacctcaccatctaagggcctagtggagacatgctcatgatgttttagtattagt

SEQ ID NO: 53822 - DNA, 878 bp, Bovine  19866881101646
aatctgaaccaatgttcccatttaaaggtctgttccccccttgaagagttctacaatgttctaccagggtaaatgtactttcacacaccaggccacctcactccggtaattaccaccagacttgacgtttgcatggctctaaccaagccagcaaaagtctatgaatcccaaaaccaatagcagaggtcataagagaggtggcaagaggtagacacagcggacgtgggaaattctgcaacaggacctccctctgaaaatgaaacactctctggatttttgttcctagaagtcatccttcacaggactcacaccctcttcaattggccatctcctttgctccagccagaggaatctgtcacttagcaactactctccaacaaaatactaaggaaaactgggaaaccaaaaccaggaagccaagatgaagtcaggcttctgaaaactcttgctccctagcattcatgggataagcttcaagcagagcaacactttccatcagacctgggctcaaagcaagagaagctctgcagaggcgccctcacccgatgtcactgaagagttaccctgaaccactcagaccagggcaaagaatattaaacatcaaggactcaatcaatacactgcagaaaccacaggatcccccagctctcacccaatctgtcctcaattgcagtgtaagcatggtgccaatgaggtcctggatttggcccagtgtatcttccagcctaggcaactgacttaacactacaaaaactgacaccacttattacatcctcagaacccttccttaaagcctcacctaaagtcagtccctctctatcaactgtgatttgtttctttcctggcttagagttactttgcctcgttgttttcttttt

SEQ ID NO: 53823 - DNA, 1629 bp, Bovine  19866881132226
taattcaccctgagccatctttcacatctcaactgcgttactcaaagatgtcctactcaacccttccctgaccacatgtcccattaaaactctcatggtgctgcctgcctctcctccatggtgctggtcaaagtttaaactctatttttatttgtgccctttaccagtcaatgtctggctctcccccagactgtggctccatgagagcagaagcttgaaagtgctgccttgtatgtaattctatcattgcacttaccatgctgaactgaaatgatttgtttattcatctgtctcatcccttggtctaatgagtttcctaagggcagtatccaggtctttttctaacacagaactcagctcagtaattacttggtgaattgaattgaatgactgggatttaattgaacagaataacttggggaagggcacctgaaagttcagaactttggatggagcaagtccacatatactctatcagaatcaccccctgtggaaatctggagtgatgtttgagagaaggttagtgtttttaaaaagccaggttcacttataatttggatagcaaactaggaggatctatgactttccttaagaagcatcatattatggttataaatccaagagaagtgaagacgacatggtgtctgcctgtccgaggttcatctgaagtttagtaaaaatcagagcataaataacaagtggaatctcatggaagttgtgctgggatttggctcctcaagccctcagccttgcgtcatttccttatctgtcctggatgaccttgcctggctcacttcccagtgcggttattgctgtctttgactccataaatgttgtggtctggttgcaaggaagtattctcatctttggagctgatcctttccatgacctgatgccccctagtctggcagatggtccctagggattacttgaatgagactgagagaggcagaaagggaaaaggggcttcccttttgcccagaggatgagcagggccaggggcaagctgcccattagaggctggtgctgacccagcagggtttatgaagaaagtgccaggtgactgtgggctctcgcatccagacaggacctggcctcagctctgcccaccctggctccaaaggaaacaggcagtttttcagaaaagctgttttcattcatcatgcctcctccttcctatcaaaacagattatgagcgtgtactttggaggattgaacagcaccctttaagaagttagaagccatttctgagttgagaggattaacctagttaaatttaatagtagtggcacatcatagattagcaggtaatttgaaagaacatgattgaggctccagtaacccattatgatgtgcatagtttttcaactattttgcaataacaataccacctgggttatcacctgtgagggattaaagtaacactatccttcttatccccgtgtgaaaacctctggcacatagcaggtgctcagcagtatttgttaaaggaatagaagaaatatgaggctgttctaaagttctgagaactttctaaaatggggacagaaacccacagtttttaatagactttgcccaaatgcattgggtaatggcacatacagctgcttggctgttctccttgggttt

SEQ ID NO: 53824 - DNA, 1428 bp, Bovine  19866881135783
cttacttcgtatgataatctccagttgaatccatattgctacagatcacatcatttcattcctttttatgggtgggtagtattccattctatacatctgccacatcttcttatctgttcttctgtcaatggatatttaggttgtttcgatttcttttgactattgtgaacagggaacattggtatcatctgtcttggtatcacttcgaggcttcccatttctttggcagattttccctgacaaagagacaagagggccactaacagttctcatggtttcaaatccagaaagaaaaaaatctctcatcacaacagtccaatacagaaattggttctcagacttcactgggtcccgggcccattcctggatcaacacatcacttgggcttggtggcttggatgatctcataggtctgtctagggtcacaggttcatcactggacgcagggttggtgtctgtctaccccgaatcctgggacctgagattaggggagggctgggttctaaagaaaaactgaggtcctgttaccagaataaggggtaatggctgccaaacagctatctcccttggggtagaaaagacgaagagcatttgagcctgagtgaacctggcggggtgggggggggggggcacaaatgggagtctgcaccccacacttgaatgtggacagagaaggtgcccaataaatactgacaaagaaatgaatgaatgttggttccaaccgtcatagaatgatgaagacggggaccctctggagcacaggatacataaaggaacattgaagaaaagatgctagagccataactgggaagcaccctttgaagtgccatgctgtttttttcaggccatgagtttttgaaggttttttgatcaggggtgttccatggtcaaaatttgaaagaaaaaaacctggaaaattttaaagtgctatactaagtgagagcattatttttttgtggacctggagtgctctccttgcctgtgaaggttttcgcttgatctgaaagtccttgagaaaagaaaaccatgaacatgtcactgggaagagtagcagcaggctatcctatcagagcctgattagatataccctccccctttcagggcctcgaagtatgtagccccacccatatgaaggtgaaagaactccaagatactggagtttctcagactcacatctgtgggatggttgaacaggtctgggtgtggcctctggggtgtgtgaacatctttcttaaccacggagcacctgatagaatgcaattctgtatcatgattaggcatgatttatgggcattccttattacatctgactggggggtcctcgatgagaatttcagggtgaaatatctcaacactgatgcatccccaggatgagtcaaatcatcaagtgagactgaatcaactggggaggaagagtaggacagaggg

SEQ ID NO: 53825 - DNA, 992 bp, Bovine  19866881201912
gaagattcccacagaactgaagaaagagatgccagcaagcacataaaacaaaaccttctctataccaagtgaccaggaaaatgagctacaaacatggtcactgttggtcacagccaggtgtcccttttcagccccagcacatccccacgcctggagctaacacaggtgaaagcagaattcccagtgactcttctcttttcccatatgtggacaagctgagaacacattctaccaaaaactgtgcttggagagaggcatttccccaagtcacacgtggcattttaaactgagttctattgcttaatttgtaagaaaagcaagtgacgtctgcttgttcaaggccattctacagcctgaactctgtattatgacataggcaaaaggaaacagaccgtgttcaaatacacttgactaatttctgtgatgtgcaatcttgcctatagcttctgggtggcaagtgactatgtcaggggaggtgtgccaagactcacagagaaacaacagggccaatcttcatcctgtcccactgatgaagacaccgcgagaggagggaagtgtccagtggatgctcagtcagcaaatggagagaggggccctatcctccgtgggggaggaactgtcctaatacattccaagaacctctcttggtctcatccattcaagcctaagacatggaggggaagggttggagggctgaagtcaccaccagtgtcctgcattctctcaaacatggctgagaagactcggaaaacctctcacctctccagatgatgatatgcccaccacccacatcagtcacaacacagctcacaatctgcattctgagtacacatctgcatgttttcctaaggccactgtccctaaaactgtatatcttaaatgaggccatagccagcactgactctggagaatttatttttccaaccagagcactaaagctaataaattttcagggtgatttttaaaatgaaatcaaaaagaacaaagaaagg

SEQ ID NO: 53826 - DNA, 1336 bp, Bovine  19866881245596
accccttccccgcccctggccctacctcaacctctgccgctcctggattacgttttagctccatcactgaccggctatgtaactaaccctgggttagtcataacgtctctaacatctcacctaatgtaagtcatcatcctctgggtgaggagacccacctaagctgtagggctgccaggagacccactgagacacacagggtaagcgctctgtaggctgtcagcttctgttctaggcagggctgggctagccttccttaatacattagtcctcccgaaacaggacccaggaagggaagcacaattacctgtactgagagagggagatgtgaagggactgaccaaagcgcacacgacctctaagacgcggatctgcaactctaccaagccctctgaactgaggcccctggggcacagtgcactggtccaccccattaagatcaactcctctctgttacctgggacaatgcagagaacatcaaaaagagaacacccgaaagccactgcttcttggctactgccacccagacagggtgctggcctcttgtataggcgatcacgctggacatgcagctgcacagacacttctttctgctgccttcgttctgatgcgtgcaggaatctcacacacgcatttcagtacaaggagagaaggcagggaggctggtgttggcgctgggtgcatgccaagcttcgtggcaccctgctcatataaccccactgtttcatgttcaggcagcgcgagacacagcaaggagccaagcagaggcaataatatttacttttcagaaacatctgttgctagaaaggcagaacgctggccagagcagagggaaggcgtgactggcagcctctggggaggacaaggatctgctttacagagtaagtaggctctgccgctgagtgaggagaccaggcagcgaagggacgaggaagcagcatggaagtcggggccctgacaggctgctccgaaagctgctgctcactagcgaaccaaaggaaactgcccttctcttcctggagatgccacagcagatactaactccccagagattaagagagcaagccaagtataatcctttctttcactgaaacaggtaggtatatcctaacttcttaagttagtttatataagttttaccagtaatagcacaagacaagccatttccttttgctcctggggtaaaacaacacatatgagcacatgaacacacaggcttacacacgtgtacataatgaagaactcaagtacctcacagtatgtttatttatcggtgcatctgatcttccaaagttagcaagactggatataactatgcttaaaatgctctgctact

SEQ ID NO: 53827 - DNA, 3319 bp, Bovine  19866881261600
aggccaggtagagattagcttaggaagagcaggcgggggtgataaaataattgtgtgtaatgaaggatttttaagtgaaatctttagtctgagcttcataattagacaggcagcactgaaagccagatcttgttcaggcggtcctagactttgagtttggggatgacagatgcagagtgcgccaaagcatttgttcagctagaccaagtgttcatcccttccagttggagttgagagagtgccaaaagttagctgaggagccccagccctgatgtagctggtaaggacaacgtaggaagcagacctcttagccaaaagaatgccctaaaattcaggttcgatggaaactatctttggttgttgagattctctcttattttttaaaatcatattataacctttttaatgtttaaatagttttggctgcactggtcccttttacacaaggaaactttcaacctcttagagttgatagattgttcatcaaggattttcacaaagaagcaagagtcttcattccagtctttgattgtcagagctgactctggggttccaaacagtggcaacgcagcttccactgaccggacatgaggttgttgatctttgttgaaagaatctttttctttccagactatctggaaaaaataattgtacatctgggtacagccattcaaagaactagaaggcttccagccccctctggtattgctaaaatgacataaaccccctatctatcattatttagaattttgactttggaggaaatgaacctaggcctccatttttattttttgtttatcatactgcaatttttgccagtatacctaaatccacacctgtgaccttagtgtagagctccacaatgagaaaattctgcccttgagttgtcttcaccttggacattactttagggtttattagcttggagattgagccaatcttccttgttttaatcaaggtatttcctgcccttcccagcacttcaggctgctgctgagatgcttccagtgtaaattctcttctgtagtctccatccacactgggagtcttcctccttcctgggggtcttcatacgacttgttttagtcagtacagaggggactgctgggcataattggttccttccatgctcagacatccatgaatacctggagccacaaagctgtgggtcatgttctctctctctctttttctctgtctctatctctccatctctcaaatatgtgttgactgcatctctttggtatagctcctgcagtacagcctttagagtttgtcctgctgggtcatgttccattcagtttcccaaggactagatacagtgttcaccaggatcagtgacattgtgacccacgtttgatatcagagggcccaaataaacagagaataaagatttacgcagaattaagagtacagtcactcattcttaagagttcagaccttgctagtaatgaggggcctccgaggcttcaagaagttaatctgctctcttacacacattcaaattaaggctttgcaaagctgccctattgtttcattgtggggaaccagagctgttgccacttgtgctataagagcttggttctttcattggaattaaaggaatttgccttttggcaactgtaaaaggatgagaatctaactgttgggtttgtttgaaaatcagtttagtgccggaaggcctgtctgatggagttcaggaggtagcattctaatccctctgtttactcacgcccaggttcagtgtctgctagcccctgagagctcccgtaccatccttcccaggctctttctgttccagccactatagctttctttgagttcttcaaacacaccctcctctgaccatcgggcctgggactgttacctcttcaagagtattcttccttcatagaatgaatgcctgtacattctttagaacagtgagtgcttctaaagcgggaatgacttaggaagcttattaaaatgcagattctccttcagcagttcttggaagagcctgggatctggcatttctgacaagttccaggtaaagttggtgcaactggtcctctggaactcttctttccatcttcagtttagtaaagtcttctgtttttcatgcttctgaggttgtaacctttccttcatagaggactctcaactactgtaccatttctttaatgtgagccattatctgatgaatgtttatcatctactaaagtacgaaccctgcaagagtgcagagttcagggaccacctgttggtttgctcacgccttcgttcccaggacctatcacagtatggcatatagggtgcattgtgtcatcctggcttttgacagaatggttaaatttattagtctgagatgcataagattataaaacccgggatgcatgattttacccatgcatgattttttaaatgtacgttggtcatttgaaaaaatattgattaaaatcttccagtttgggcatatttcatcgtacaatatatttttttaaaatagtgtttattagtatcactaccgatagcatttttcaggtagtccttaagtattgggaacctatcagactcatggtggcaaatccaaattttctaaaattatacttactgcttgaaagaatgaattttatcattataccaaatactgtcagttgttttccttgcagtgacagactcaacttggttcatttctgagaaaaatgtctgccaaatacccgaagtctgagtaaccacagtctcttcagttgttctttcaagctaaaatggtgtttcatgagaaaagaggttagtttagttgcagctcaaataattgcacaactgctctccctcacgtcagttctggtatgtaatagaagtacttcgtgcctgtttcctattcattacaatctaaaaaatatttgtttgggggagaatggatgtatgtatatgtatggctgagtcccttcactgtccacctgaaaccgtcacaacattgttaatcaactgtaccccaatacaagagagaaagttaaatatatatataaaattttaaaaacgtgtgctaagtaaacagtcagggtttaatcaaattaataatcgttactactttctctagggtattttttgtttgtttttttctttaacatgtgagtctgtggtggtaaaagagtacagtgattactggtacagcttggtgccactgctagattagtgctaaggcatgaacatttttacatacacttgttattgcatctcatggaagccttgaaaaggtcctggagatccttcaggagtccatggaccacacttgaaaacccctgttaacagcttaaaccaaaatcaccttctattaaat

SEQ ID NO: 53828 - DNA, 912 bp, Bovine  19866881303298
atttcatgaagataaatttggggacgctgaatgagagcatgttatttgggttagttgaacagatccagatataattatgtatatttataatgctgattagagacctagaaacctatttaggataggtcaggaaacggggtatgacatctcagtctttactagtataatctctggaaataatatattttgggcataattaaatggcacctggatcagatgggttatatctccctccctccagctgaacaacccacaaagttgttaaatggagtgatactatgaaaatacagtacgcctcttcagccttcttctgaagtgtatctctttcgcctttttcatcacataaactaattcttaaaaaaaaaattaaacaatccaaaaacaaacttgtattttttccgattataccagtaacatgccaattagatataacttagaaattacagatgaataaaaggaaaatgcaaatcacgccaatagtactgattagagatactcattttggttttattgtcttttctactcaggttatgatcatctttccttatgattatacactctctgagattgtttttagtggttatgtagtatttcaggtatgctctgtcaagacttactaatggcctactttttcatgttcgttaaccaatctataatgaatgttcttacagctatgccatcattagctccttaagagtatttacataggttgccccgtttcttttcctgtctttgagattcagttctcatctctctgcttgttcccttcttttcctacaggttgagcagaaccttggagacagaaagtggatgtcttttttgagtggcacagaatgaagagtctcatatattgaatgcatatgatttcattcatttgaacataataactagtaacatgtttaccactactta

SEQ ID NO: 53829 - DNA, 792 bp, Bovine  19866881307392
tgaatgtcctcaatatgtaagcacattacattaaaagatgagttagttggagatagtgcccttaaaacaagagtctgcagaaatataaaaatacattagtatatataaatatatatatatacatatatgtttaaaaatgggtgaaggtggtcaacaggtacaaacttgataagtcccagggatataaagtacagtatggtgacttcaaagaagttaaaagaaaaaataagaaaatatagtccttctatataatcatacatattaatatataaaatatgccataactgtaaaccaagaccaaaaagtctggatgctacaggatgaagtgctgctgaattccccaagaggatgatcaaggaagggtttgtgatcaaattgacacttgaacctgggtcttgcgagatctgtcaggtttaggcagaaaggactgggatgttctgggcaagagggacagtagggaaaggctcagaggcagaaatgtaatccaagcacatgtggggagcagctcataattgactctgtctgaacatatgcttttcatctacagtattatagttgttttgcttcttatgtcaatatgattttttacttctttaggcgctaaagctgggaaagcctagtaaatgttgtcttcccattccagaattctgtgctagctggatcccagtggagcatcatctactgattaatcttgtgtaattgacttgcctgagacgttccctactttcatcacagttttgcttcacagtcaaatagacctcaccatctggaagtctcttttttttttttttt

SEQ ID NO: 53830 - DNA, 1955 bp, Bovine  19866881364915
ctttcaacaacagacaagactgctgaagctttgagagtttacactgttctgcccaaggtcactcagctggtacagggcccagccaaaggcctgaatccaaaggccaaactgaattaatagcagagaatgaatgagactctaccgagggaaccctgtagacttggtgtaaaatttggttgcttatttatgtccctatttgactgttttccacatttgaggaactgaggcacaaaaggatatacaataggtcttatatcaaccaaagattagctttagttctgaaagtaataataaaataacattatgctcccaatcctcaacagaaagcaaaatagctggatttgagggttttgtgagctaaccagcactggaaaaagtatgattgatacttcagcttttagtttatacttcccctatcagatttttgccaactttcctggtggctcagtggtaaagaatctgcctaccaatgcaggagatggtgggttctatccatgggtcgggaagatcttctggagaaggaaatgacaacccgctctagtattcttgcctgggaaatcccatgtatataggagcctggcaggctacagtccctgaggtcacaaaagagtcagatacaacttagcgactaaacaacaacagtcagatttttaaaagcttcaattcctcataagctcaagccaaagcatgaatgtgcataaaagatggaaggaaaagagcttccaaatgtcacaagttcagaatcatctgatgctgtccaaaggcttaaccaaactttcacattggctaaattttctagcaagtgaaagtggaagtgaagtcattcagtcatatccaattctttatgaccccgtgggctgtagcctactaggcttctccatccatgggattttccaggcaagagtactagagtaggttgccatttcctcctccaagggatcttcccaatccagggatcaaacccaggtctccggcactacagacagatgctttaccttctgagccaccagagaattttctaggggtacttgaaatttctgtttcctgagagaggaaaccctctgctggtccctaggtctgaggatcctacaaaatggtttttagtttcccaagcattttttgagcatttccttcatactagacatgtatggtgatggaaattttccaccgtggtggaaaaaacataattcctgttctctagtaatttataatcagggaacagaacatgacatggacaagtgagttcaattgccactctatctgaaatgctgtgacacatttaatattctttccagtgatactttgaactaagcaggcaccttccatttaaggcaatagcgcacagtgggaggaagggttggaaacagatggggacatagtgatagtaaatgattaagtgattctattgcccattagtcccattacttaacctcattaaattctgttttcccctctgtaaaatggggataataatatgactttgaaggaccattataaggattaaatgaggtaatgcatataaagcatccaacattatgcctggtttacacaaagtactcaatgaccgttagaatcataataatggagatgtcagcagaagacaagagacagtagtaattgtaacaatgagatggggtggaaagaaaatagaggctaaagagaggaaagagttcaaccactaaagctctttcctctgcagtagtcacaccttaaaatgcatattagaatgcaatttccaacattcttttaagtagttaaagtataggccttttcttaaatttgtgggtaaaggttgagatacagctgaaggggaaatgatttaaactgaaaccaagatcttcctttttcccttgtcttttccttccctgaggtccagaacaatgaacctcctttagataaaagagtatgtacccaaagcctgtttccatttaggatatttcagcagaacagttaat

SEQ ID NO: 53831 - DNA, 1534 bp, Bovine  19866881763592
ttaaagagctgtctatgcagagaatgagggccagatttagctagaggatggtttccttaagatttcaaagaagaggaaagaagccttcatggaagcctgagcaaagagacagagaagaatcgtggcccatccatggtcacagtcagagaacaaggagggcacagccttggattctgtgtacactgacctgtctcctaccctacaagctacagagctggattcagcagctgggagcaggaagcatggagaggaagtaagctgcaatgatgctgccaagcagaccctaacatgtgccatcttgagaggcagacttactgtgtaagaagacttaaaatcaaaatccagatggcaattttttgatttttttaacttcctatacagaagtcacattttccagtacatcttaattctatttagtgtgtgttcgtgtgtgtgtcatggccaaatgtcattaacaatggccagacacgaaaatgaagagagtcattaggctaggacaggctcggcagctgcaccagctccatgctcttgaggggaaggtagagtgggcaggagccattgctgggctgcatctaagtgctctgcagcctctagggacctgcacacatgtggaagcacaaatctgggctgacagcaacatcacattcaatcaagccctagtctgacccagagagccactgacttggtacagaaaacgcttgaatagttgacctgaaaaccaaatagacgctaatttgcattagaatttgaatttgcatgttgtttatttcacttaggtgcagagaaaggaactgtagcgtatgctcacatagctccacattcttctaatttcaaactaggttcgttagccaagcataaaacaactaaccacgaggcaggaaggagtgagagggttaatcaagagggcactttggcatcagacagcctgagtctgattgctggccctgctacgtactttggcatgaaacctggggaaatgtgcttagttttccagagcttttctttttctgtaaaatggggataatacaaccacttcacaagttgccgtgagaaattaaatgaaataaatttttagcttggtgcctgatgcacgtgtgctatcctatggactgcaacctgccagggcttcattggtgactcagatggtaaaaaatctgcctgcagtgcaggaggctcaggtttgatccttgggtcaggaagatgccttggagaagggcatggcaacccattccagtattcctgcctggagaatcccgtggacagaggagcctgacaggctacggttcatagggtcgcaaagagtaggacatagctgaagtgacttagctcacacgcagcctgacatatagcaagtgcttaagtaatgtatgattacaactaagtaggactgattcttattgtagtaacgatctttattactacctttgaagtcctgcccccctatagaacatcaaagcatactgttaaattaattaaacaaggaagtcattaaaatgagatggttctaatgccatgatgtggcggcatatgaatg

SEQ ID NO: 53832 - DNA, 1341 bp, Bovine  19866881973873
taattattaattttattgacaatcatcattgcctctcttcactccttccccagatagtgcaatgggtggcctgacaattccagcagaggagtggcaattcatgagtgctggagccggatgcacctgcttggggagctgattgctaagttttcaggaattctgtaagtcagttgttcatcatggccaagattcaaaactaaaccatttagaaacttacaattaaacaaaatacttaaaaaaccaaggtaataaatgctcaaaactttacttcttaattgctttaccattatctatgctttaaagttgtttctgtccatcctttataatgcatatcccatataatggtgtgatacaacatctcttcccaactctgcattcagaaatattatctcagtagtttgaaatctatcatgatggagtatgtacactatagaaattggaaaacactgcaaatcagagcttgacttattgtgttattgtataaacctgagaaaatgatagaagaaaatttagcaataaagattgaacgtcaatgtgtgttcattcatgaataacacaaaaaattgatgaaatatttttccagtacttgaaaactatctgatcaacagagaagcactcacatcattgccaaagtgtagtcctcacatcattgccaaagtgtagtccaaacataatctttgttgttttactttcatcttgctcattaatgtaaaaaaaaagtcatcaacattcatgtttgaacttcagtggcatgagtgacttctttgctgaactgaatattaaccaaatatgatctgcttttgccaaacataattgaattgcatctgtaggctgactgtgggtacaagagtttagcaaaaaccattgaaaccaatctgaaaatcaatgggctatatagaatttactctaaaaagtgttgtgtattttattattttttggtaaactgtatgctatgcattctttgtatcagtaaaactgtataacagatacagagatactccctcgcagcagctgttacacatttatcagcacactgattatggatgtaatctaatttactatttgaaagctcattccacctgtcatgtggagcctgcgttgtaggagctaaggcaggaagcagggggaacagtgaggaggcgggctcacaggattcgaggacatacacagatttgctctggggtggtgccagtggaggtgggaagctatggctggacaggggaagcattttggaggcaaaggaaggcaaaccagtcatgtggcagctccatggaagagacagacgtgtgcaggaactacccgtgctaaaggaagattgtcggcaaagactgagaaggctca

SEQ ID NO: 53833 - DNA, 2452 bp, Bovine  19866880595502
tatctggaacaatacaacctcattgaatcttggtagaattgagactttgaaaccctataaatacccatcattattgatgtggcacagatattaggtttatttagtctgctcacgtcattgctttgtttctgtggatggtataagaaccctcaagacttctttctgtaaggcttttcctgacctctatttcctggacactatttctccttaatattttaatcttctttttaaaatatattttattttatttatttaatttatttacttgtctgcgccaggtcttagctgtggcatgaaggatccagtttcttgaccagggatcaaacccaggccgcctgcactgggagtacagagtcctagccactggaccaccagggaagtcccaaggttttaaccttctaaatcacgtattttctaagaagttttcaaaaatctaaacttgggattggcctcctacatttgggagctgaggatgtttcaagttgacaaagggttcatatccacatgagttaattcacactttgacctttccaggagcctggagtctgagcttccatcccagggagcagacacctccatacactttgcagttggcattgacccgaaacacccacagatctgtctgggcctgtaagtaattttcttttatttttaaaattgtactcttggcacagctaatctgaaggtgccacatacaaaaaataatctgaagagcacaaaacaattctagcaaaaaatatttatataaggcaggaattgaaaaactgttacatatcttctgaattcaatattggttcccaggaaacacaaaaactgtgtaataaccttatcattcattatcatagtctttgtattatacaatttgtattatttttgattattccacttttaatgtcagcatcataaacattgcacatgctttgaaaatattttaatgtgtatattttacattatatggaaatttatctgcattttttccattgtctgttctttccaaacttgatgttcatttactattccatttcattagttcataagtgtttggcaaatcaaatcacaccttctaattgattggcttataacaggaaaattttttactgtttagccttttgtcccttgatttttccgaatatattccctcatcacattatttaagtattttgagattaatgatcaattcaaagagataagtcatgccagcagtacatctttttcattacaattttacatatctcactgatttaacaattttctgatcagcctgaaaatctttgttgatcaaattgcttatttgctgactaaattatgcacaagcctcagtctatttatccggctattaactgaaggattgtggtgtgtttgctgtgcaaattaccatgatgttatgaacaatcagcatacatatgcaccactatctgtggattcaaaattatttcatagtaagaatttaaaagattttgttgttgtttcctttttcttgatttgaaaagtttatcaggtgaagggattcagaacatccagccccaaatatgccactttggcatattgattattttgagtgaaagtacttgagaaacagcagatgtatgaagactgttggacctccccctttctatctaaaagcagtttgcaaaatttccaatgagaaaggagccttccctgtatcaggaagagaacatttttatcaccagactgggagttatggctgaattggacctgtataagcttcctaataacctttatcttccactaatttcatttaatttctagtcactgtcccacaacttactgcccctagaccaagccccatcatttattgttttttgtgtaaaaaggcatataagctttggggatagatggctttttcaggtttttattttccatctgaagactcctataaatgtaaaaaaaaattaaataaatatgtatgtttttcttctgttaatctgtctttcctttccttatcacttcagtcgtgtccgactctgtgcgaccccatagatggcagcctactaggctcccccatccctgggattctccaggcaagaatactggagtgggttgccatttctttctccaatgcatgaaagtgaaaagtgaagtcgatcagtagtctctgactcttcacgacccccatggacttcagcctaccaggatcctccacccatgggattttccaggcaagagtactggagtgggttgccattgccttctccggttaatctgtcttgctgctgctgctgctgctgctaagtcgcttcagttgtgtctgactctgtgcgaccccatagacggcagcccaccaggctccccgtccctgggattctccaggcaagaacactggagtgggttgccattttatgtcagtttaattcttaggccagccacagaactaagaaggtcaaagaagttttcctcccacatgaagcgaagtcacacacacacacacaca

SEQ ID NO: 53834 - DNA, 1497 bp, Bovine  19866880624774
actgttatggggttctcaaggcaagtatcctgaagtggtttgccattcccttctccagtggcctacattctgtcagacctttccaccatgacccattcatcttgggtggccccacatggcatggcttagattcattgccttagacaaggctgtggtccatgtgatcagattggctagtttctgtgattgtgctttcagtctgtctgccctctgatgccctctctccacacctaccttcttacttgggtttagtctaccttggacgtggggtatgtcttcatgtctgctccagcaaagcgcagccactgctccttaccttggatgtggggtatctcctctgggctgctcctgcgccgtgcagcagcagtaatgcttttagtaccattactctatttttgatgtatgaaattaaaaatgtgatagtgcttagcaaatagaggaatcaatcagctcatccaatcagcagatgtttgagtgtctacacattgctgttgttcagttgataagtcatgtagtctccaacttttgcaaccccattaattgtagcattccacgcttccctatccttctctgtcttccagagtttgctcaaattcatatccattgagtcagtgatgccatccaaccatctcatcctctgttgtccctttccctttttcctttcatcagggtcttcctatgagtcagctcttcatataaggtggccaaaatattggagcttcagcttcagcaaccattctttcaatgaatatttagggttgatttcctttaggactgactagtttgatcttcttgcagtcaagggactctcaagagtcttcttcagcaccacaatttgaaagcacagtctaaaacataaagatattgaaactcaataataagtttttaagatgcttagaactgttacacagggctggacatagagtaacagctcaaaaataatttgagttgcattttgatgaattaaatggaatggaatatctgtttgttggtttgtttgttgagagcaatgcagtatcatatactggaagagaaagagcttggaagttggttctttgaagaagtcacaggttcaaatccttacccacttacataattataaccttgggaaaaatcataaaacagagataatatactatatttatctaggctgttgtgatgataaataagtaggtaaatcatctaatatgttagaaagcatcaattcttcagcattcaatcttctttatggttcaagtctcacatctatacatgacaactggaaaaaaccacagctttgactataagaatctgttggcaaagtgttttctctgctttttaatatgctatctaggattgtcatagcttttcttccaaggagcaagtgtcttttaatttcatggctgcaatcaccatccacagtgattttggagcacaataaaataaaatctgtcactgtttgcacttttttccccatctagttgccatgaactgatgggatcaaatgccatgatctta

SEQ ID NO: 53835 - DNA, 791 bp, Bovine  19866880683472
aaaaattgcatgtggaaaaaacttttcttcctccctgccctggtcagaaacacatgtgtaatcttccctttaatcatccctttgcttcttgtcatgggttgaattgtatacctctaaaattcagacactcaaattttaactcctagtaccacagactgtggtcaggttaaagtgaggtcagtagggtgggccctaatccgatatggtatgcattcatgtaaagggaaattcagagacagaaaaataaactaggagaatgccatgtgacgccacagggagaagatggccacataccagctaaggagagaagcctggagaatatcattccattaaggccctcagaaggagccaaccttgttaataccttggttttagactcatagcctccagaaccatgagtctgtcggttccaggaaatgaatacactcctccagacatttttctccaaatatccttcatccctgttcttccaacatctcccagtatagaaaaaaatgacttcacatatgtatattatacatcttacattttcatttgccttctttgaacatcagtgtataattttgcctcacaaagttagatgtcatatggggaaaacctctacaattttcaaactcatgataatcaagttctataatcaacaaaaaagaagtgtacaaaagaaaaccaatgctgaggactcccataaagcaagtacaaaggcagaagacaaaattggctgtgcactatcattaactagagctctcacagtccttttgtcatcctaagcagctattccagatcttttcact

SEQ ID NO: 53836 - DNA, 893 bp, Bovine  19866880841667
catttatgtgcaaggagaggaattgtatctctaggctaaaactatttatcaattttcctgccactaaaacttgccagccagtttgtgagcccgagatacagatgagtaactctgtatagagaactcttctctgtggggaaaatgcactcagggaaattactacccattgatgatattttccctgacgtcctcttcacccttatctgcactttgcacagttactctccaaccaaccctctctaactatcatctatgccctacaatagatctaaaccctctctaaaatcgagaagtggtttcatttttaaaaggaagctcttttactttcatttccacagaattacagaagattgttgttgctgttttttttaagaatttaaacatatattagtaatgtatattttgtggccatgaaaataaatacttgtattattttctttttcatatgtcaaattaaaatgttcattactttctcatctcaaagcttcaggaacaaagcatcgagaaggaaatggtaaatagcaaagtcgccctctaaacagtcagaccatcaggacgggatgagatttattgctaccaggttttcactacttgaatcttgctgaggcctttgtatccctaagggaatctgataaattttagggtttctgatcacacagctactgtctcttggaaaaaataaagaagaatatgtaacagaaaatatcagaggtttttcatctcaagataaaggaggtaagaacagggtctcatttagaattttttgaggtctggaactctgaaagattgtgattcttcacgtgttgttcaaataaagtcaacaccagactgcaaaatgcaaaatacaaaatttacatggcatgtaaattaagagtttctctccagttattttt

SEQ ID NO: 53837 - DNA, 2588 bp, Bovine  19866880885655
cttagtccgtctgagtcctggtttctttatctatctatgaaaaaggggaggagaagggaacaacagaagatgagatggttggatggcatcaccaattcaatggtcatgagtttgaacaaactctaggagactgtgaaggacagagaagccaggcgtgctacagcccatggggttgtaaagagtcagacatgactgagcaactgaatagcaacatgaaaaaacagaaatataactatttgactcatggtactattgtaaagattagatgagatgatatatgcaaattatctgctacaatgtttggcacaaggtagcccctaagcaaatgtttattccattttttattcaccactcttattcctcattctctttatttttttctataaaatgattgttcattattttctattgtggttttaaacagtctggaagaagagcaaaaggtttcattatacatttctttgggatatgggacaaagtgttcttgctcctttcttcctttatttcttcgtacatcaaacatccactatataaaaggcaaggtactgcaaactatggaataaaaatatgcatggcagagcccttgctctctaagagctcatagaacagcaatcaaggtgggcaagtgacccacaatatgataagatggcactgcagaagcactatttctgtttgcaaaagagaaagttggcaggttgctggctgacagataaaagcaccatgtctgtatccagtctgtcttcagcttcttttgttgtttacttcttcaatatctgatttatttcaaggctcaggctctgatctagctgaccctgtcactgcagaaaccatttgatttttcctatttagtgtgttcaaaagtcactttgtggtagaacctatccttaatgagctgacaaagctggggccagagttccctgagtcacggcacctcatctaggggactcattgcctctggacaagaagtgattacctaaggcaccaactttaggaaaagatgaaaggcatctctttataagcttcccttgatcttgacactgaaggcctagatggcattctcatcaagcttttactagctcatcaccaaccaatcaataggaatttggcagaaagaaagaaggacaggattcttctccttcaagcagggaattaaatccagcagagttaaagaaggacattctcacagtggaaagagcataggactgggagtgaggagacctagctttcaattcagtccttttatgtaaaatgacattatacaattactttgaagttttaaaattctaggctctaacaactgtggaaacaattaaatactgtttagtgatatgcctatcaggaataccaataaagatttaacatttttataactcaagaaaggtttttcttgcaatgtagcattaaattagtctaagaccaactaagatgcaatcttacttttgattaaaggaggtaaaataaatatgtgtctctttcttttaatattactttgatagaaatagaaggggagatgcctacaaaccagagaagaagtcgcaccttctggagaaacagattgactatctgtagccccatctgcgtgtgggtgacttgggttgtaaggtgtgtctcttttgctctgacatcctgccaggaaattaccccactggctgtagatccagggttcacttaactcttctggggtggatgcaaacggccatttgaccctgaatgtctctgaaatacacttctggttataaactcctggaggcaggaactagtcccttaatatatacctattgaatgagtgccagacaccctaaacccatcttagtatctgagaggcagcttagaaggaaggctcagcatgtggtctttggagctggattcctgctctgccactaattaagtgtgtatgttgatgaacctctcagggtttcagttttctcatctgtaaaatgggaatcacaggtacctcattaggttagcataaatattacacgaaacaaaacaagtcagtacctgacacagggctgaggagacacttcactaatcccagacagtataggtggagccgaggtagagcaaaagatgataacaatcgataacttgatagtataggaagaacaggaattgttattttgtttctcagatgaggagactgaatttcagtgaactaaagcagtagcttgtctcagccacacagctaggatgggctaaaccagtgctacatctcgtgtttttaggttcctgtcaggccagtattgtccccatatgtccccgtaatgagctgctaaaaggtggataaatgttatgacttgttcagtaggtcaaagttaaccttggaatacagggtagtcttcctgctgccttcctctcaggtatttcaggtcaaatggtatgtgccatatttaaacaagggactgagtacacttttctttgatagtaaaatggaatatgtctgccagtttctatagaatacaaggctcaggcaccatcaaggagaacttggtgtttacatgaaagatgacattgtttccaaataagagagaccttttacagagatccctgagagtagcaatgatctcctcttagaaaagggctgagaa

SEQ ID NO: 53838 - DNA, 1536 bp, Bovine  19866881067487
ggctgagaaatgacagatgctgaccttttgatcatcattggacatagcccataaatcagttctttaagactaaaaaggaaaaagtagttaatgtccatggagccaaacatgttaggtgatttacatacttatttgtcatcacaacagcctagagagatatattatattatctctgttttatgattttttaccatggttatatattgtgtaagggggttaggatttgaacctgtgacttcttccaaagaagcatctttcaggcttcttctcttcaagtgtatgatactgctttgctcttaacaaacaaaccaacaaattaacaaacaaacagatatttcattccattttcttcatcaaaatgcaactcagaaattatttgttgatatgctactctatgtccagccctgtgctatagttctaagcatcctaaaaccttgttatggagtttaagtatcattatgttttagattgtgcttttgaactgtggtgctggagaagacttgaagggcttccgtggtggctgcctgcaacacagaagacccaggttcaatccctcggtcacgaagattccctggagaagggaacagctacccactccagtaatcttgcctggacagagggagagtcccctggactgcaaggagatcaaaccaatcaacctaaaggaaatcaaccctgaatattcattaaaaggactgatgctgaagctgaagctccaatactttggccacctgatgcaaagagctgactcactggaaaagaccctgaagctgggaaaggttgagggcaggaagagaaaagggcagcagagtattagatggttggatggcatcactgactcagtggacatgagtttgagcaaacccagggagatgatgaaggacagggaagtctggtgtgctgcaatttatgatgttgcggagagttggacaggccttagcgactgaacaacaacagcatttgagggaaagcagtaatttaggttgttcaaagctgctgcctggcatgtctattaggcttgataattattttgtggaggtggaagatagatagataaaaagccaattcatgccaaagaaagacctccatgtacaagatcattggctctttgtagatggtatgaaaaagaacatgagatggcatgtattttattaggataagacactaagggtataatatcaagttctgcgccaaaaccagatactgtacttttagacatccttgtatcactatgaagtaatttagtgctggagcaggggtggctaaatacagcctgcaggccagattaagcccacaaagatgtttagcccgcactcactcccactcagaaaaagcaacagcattcagctgtgggtggatgctgactcaccgactcagagctctgcctgcgccaaccagctgcaggaagacgagagaggccagtgtgaacctggcctcccaaggccctttgactagtatcctccaggacttaatgattcagtcatgcctaccacagatcctagactggcaagctcacccaggagacaggcacatgag

SEQ ID NO: 53839 - DNA, 751 bp, Bovine  19866881493591
cattcccaaatgaagacacaattaagaactatcctaatgataggaagttctctgtaacaagaaaaaactgttgaaaattaatttgctaattaccatgcactgattattgtaactgaccagtttctaagatgatctatatataaaatttaaaaagggatagtgtttaggtaattgtttagataacttattaatgtagtagattctagggctcaaaggaactaagttgaacatttaatgacttttcacatttgaggaagcaagattaagcaacaacaaaagtggaaaaatatggggggaagtagaataaggaatcaaaagataaaaagtcagcaataaagcttcataaaagagtgactaactacatttcactgtttttcatagtctccctgggagtttgtttgtttaaatgtttggactcttcttgaagttaaaaaaaatacaaaaaacttttaggaaaaatactcaaagtcaactaaccttcctagttaacctggctctggaaattgtacttgacactatgactttatcacatcttaaagggatatgtcaaagctctttaaatcatttccagagggcatggattatttccaagagtgaggtaaagatgtctgtaatcatgtaagcattacttatttagccactgcaaattaagatgatcaaatacctctaaaaagtgggaattatgagtttaagttttatactgacatgcctacacatttccttccttccttcttttctttctttcttcctc

SEQ ID NO: 53840 - DNA, 1294 bp, Bovine  19866881681296
tggtttttgcttggggttaaaaagtgcttctagaaggggtgaatgttttattgattagccaacccaacaattttttactgtgtataaataattgctaggtgtttcagcaaattcaagttgtaaaagtgactggagtcaacattatttggtaaattactaccaatccttactaaacatttttcatatttcaattaacttttttctgccactaagtactaaacaataaagtaactgtgcagttagataccattttatcatgcctgaacattactattttacaaagagtaataatttttggatgcataagctgtcagttaaataatttcatttacctttaaatgatttgtaagcctctttaagaacatcattaacaaacctcctttaatgattagccaggaaatgtcctcatataattagcaattttcttacaccaagcagaacacttttgtcctaaagaagagggtgggagagctttgaggaggacctacaaaagacaaatctaggccagatagtcccaatggtcacagatgataaatatctggaaccatttaacaaagccccaatgggaagtcagtatcatcatcattttgtaaatgatggaggtggatttcaaacattctttcctgtgtgtaaatgtggaacatctgtgggaacaaatgcctgttcaggctgtgcaaacaaaaatagaaagatttccattctgaaatctctttccggagtatggttggatataagaaagagaagaccagattcttgttatggcactttaaaattggtgttcataaaagataatcaggtttgcccattgtttcaggatggttgtcttaataattttattaatgttcccaagcataagattcacccatgtagatagagacaggttgatgtaatgcttttggcaaagaggtagattatgttactctgctcatttcaaagcctccatgatggtcacagatcagaaagtaatttgaaaaggatgaatctatttcccccttgcttcctgctaaagtagttaagattgctattccagattagtttttattgataaaactcatatgttaactttttccaagtaataattaaaatatttcagttagatttggctcataacaatcttttttggctatcacaatcttagacttaacttccctaattataccaagttaatttatactatctgactgaaaacaatggagggaagtagcggctatagcattttaagtcattttggtttttcccacctctcagatgtttatcatatttttcaatggaccagtgaacacatcacactttg

SEQ ID NO: 53841 - DNA, 1014 bp, Bovine  19866880455799
cctgaataatgcaaattactggggcttccctgatggttcagtggctaagaatctgccttgcaatgcagagggaacattggttccatccctggtctgggaagatcttacatgctacagggcaactaagcccgtacaccacatctcctgaagcccctgccgttgcagctcctgaagcctgcgtgcttgcatgcaccacgagataagccactacaatgagaagcctgtgcaccacaaggaagagtagcccgcacttgctgcaactagagaaagaccatgtgcagcaacaaagacccagtgcagccaaaaaataaatcaataaaaatttaaaaaataaatctttttttttttttaagtcatgcaaattactgtctgttgtggccagaagaatgtgcctctcagattttctagggcaggaggtaaaattggcctccagtcgtggctgctgacatgctggcagccaggttaatcttcctacaggctgcaccggccagtgaccaggcacgttaggggtttcactcctgggagaaaggggctgttctgatggaggaccttggctcaaaagccccttccagattggttgaaattttcttagaaccacagagcagcccatggcattcctcagcacttttattcctcctcccactccatctcccttccctctctccttcatgggcgccagacctgcctcagggtctgctggctctcctgcctcctcctgctccttccccatcatccctcactggtgtttccccagtacatctcttatccatctcatccctgcttggcatccgcttctcagaggacctgcacaaaatcactatttaactattctgttttgcatgtgcaatttaggaccaaacgtacttcctgacggagaaggcaatggcaccccactccagtactcttgcctggaaaatcccatggacagaggagcctggtaggctgcagtccatggggtcactaagagtcggacatgactgagctacttcactttcacttttcactttcatgcat

SEQ ID NO: 53842 - DNA, 918 bp, Bovine  19866880582153
tggaagcattttgatattcagaataaatgccatttaactacttaatagtttgttattagggagccatctaaaagactagattgaaatgttggctttttaagtggttttagtaatgttttaaaaaaaaaagttttttgtatattgcccttagcagtgttctccaattttggacgagtttgactttattttaaaattatagttttctgttacctcattactacatttttccaagttattgtttataatcattttcagccataagttatagggttgctaatttctaccaaaagagatgaaagtaaaggaaaaatggaaacatgtaattaaacagtttctttttatttttcctttaattatgcactactctcacaaaagctggattgtaatatgcaagtcattagaaaatcttgaaaaacaattaataagcttacagatgagtgattacagataaatcctagagaaaaacagattacaaaggaaaaaaaattaataatttactagtttcttcattgcctttgtcttattttgtcctcccaacaatggtataagatggtcaatatccccatttcacagaggaggaaataggtaaaaaggatactttgacttatccagaagttctgtaggcaataatcgcacttgatttgaaaccagttttcatgttcttcctcccatatgacactacacaagcctttccagctccagatcttctttactgtagcccaatgagtgtgtgtgcactaagtcacttcagtcgtgtccaactgtgtgccaccctatgaactgtagcccgccaggctcctctgtccatgggattctcctggcaagaacattagaatgggttgccatgccctcctccaggggatctccctgacccagggattgaactcacgtctcttatatctcctgcgttggcaggcg

SEQ ID NO: 53843 - DNA, 1562 bp, Bovine  19866880607732
cgatgagctatttttactgccggcttggagccatctggtttgctctgtgaaggttcacgacggtatttttcagagcagccagtcacatgtactctttccccaagtccaggctggtgacctggagaggaatgtgtgagacactctagcatctccagccttggtcctctgctgttagttgatactcacggtcctcagggctgaatgctgggcgtagtggctaccaaccagcacttaactcccttttgtacagttagtgctgaagtttgtagggagagctggaactggggtttacaaagcgcctgggaaatggcctggtctttaccatcatggtgggataaggaccaccccggccacccgccccccatcacattttctgccttgtttctgggatcagtgcaccagatgaatgttaaggaactgagtgccttgtcacagtaaaaatgtgctgtggacagacattagaaaaacatccagagcagactcatggggaagaagaacttgtctcactctgctccgacagcctcaggcagggcgctctcacgcttctctaggagcgagcattcctgggagctgcggaggctgtcaccccacaccccaggaaagccttgctaatgatctggactcttttgttggtctttttcgtttaaaaaattgcaactgaagtgtggcctgtcaccatttgtagaagtgtaagtttctttacctttcaacacctttcaattcaatgactatttataaggtgcctggaggacctaccctgtctctgcacctctgacctttcacgtttccagacgacagcacagaggaaagtcctcccccttctctgcaagataaacagagttcttttcattctgccagactgctttaggtcctagggtcttttggtgacagtacctactagaaatgcagaaaaaaaaatcccagtaattaatataggattatacaaatgaaaataatagattttcattgaccaagaacatttttatgcatcatcacatcccccaaagtctttggtgtccagctctagaatggatgctcacagccagacagcactgggttaggacaagcctctgagacttagagggtcaaggtcggctgtgtcctatgtggactacatcgctacacagcggatttttccctttaaggattttctacatattggtccaaactattcctcacccccggtcatattttcttactaattgcttctaccacttattcaatgactcctttcaactaccagccaatggtattgaccctgtccatgaggcaaaccttcacctaaaatcactctatgtggttgttaagaacacaggctgtggagccacatgtcagctccatcacttaggagccgtggacaagtcatgtaatctccctgagcttcagctctctcgtctacaagaaggaataaaaatgataatacctacttcagagggttatgatgaagattaaattaatactggggtctataaaccagtgaatgcatgtgaacttgaatggggggaattagttacatctggcccattagtttttcaaaggttttggtatcattaagcacatca

SEQ ID NO: 53844 - DNA, 1947 bp, Bovine  19866880614544
aaaacttgtgttttatatttcatgatttttaaagactcagacttatagattcactggagccctaatttgtttcgttatttatttgacagaagcagtttaacccatttcccattgttccagtgaggtttctatttttaccaatgggggtgaatcacacttgactatttagggacatgtttagaacatggtttttcaagtcaagacccaagtgaaactttgattcccagaccagagcctagaagctcagcacagggcagccattgtgccctggcctggtgttggctgattgtgttgcacagaatagaggtggttggaagagctccatggaccaaaaatagctcagataataactccttataagataagaggaaataaatggcacttggcttggggttccctccgtccccctgacctggtgaacaagaaaatgcctttgtatcttttggttgttgacattgacgtggtctctgttcacattcaatgacagtaaagacgtgcttgtcctcacacacactgttgttctgtcctgggaaccatgaatgcttttcttatttggcttcaacttctagggcctcattaatagaatagactcttgatgcctgcttaataaaaaatgtcatctctgttggatctacttttgaatttttaaataaaagataaaaataagtaaaactgattagaactttcaccttacatgcaataaagaggttcagtgttcaaattcacattttcagaagtatagaataattgttcttgaaggcctattttatagtttttaaaagtataaactccttaaaactgaacattattcctagtgctccttttttccagtcaggcagaattttaatgtgacatggatgaagtctgtaagtttataaagtcttggtaggattctcaggtttttctctttgaatgtcagaagtttactcacagtcattcctgaaaaatataaaaataaaaatgcttccaccttgagatttttccttaactacattttgattaaaagttgatttctattccaaatagagaaactcatagttctgatcctatttttctactgaaaagaaggaaggtttatatgctttctcctccattggaagacttccataattataaacattttgacccattttttttaataactcatagttctatttttaccttttatgttttctatagagctggaatttattttggtacaaagaataaagtataaacccagttctgtataatggctttccatttgtccaaatacaatgtagcactgatttgaaatattttttttatactaaacttttatgtatactggactctgtgttcctttccattactgtatttattttaattaccacagttttaaccagtgtattttttatgttaccacacccattttaaccactgtagtgtatcatattttatatttattataccatatgttaaaatgtattataaagggatactgttcattttttctattcttttccaaaatgaccctggctactccttgaacctattaataatctatagcctaatctaagtcatctggcctgctccatctcctccaattgattgggatatctatcaatttagatagtactcagccttgaattggagaaggcaccctactccagtactcttgcctggaaaatcccatggatggaggagcctggtgggctgcagtccatggggtcgtgaagagtcggacacaacttcactttcactttcatgcattggagaaggaaatggcaacccactccagtgttcttgcctggagaatcccagggacgggggagcctggtgggctgccatctctggggttgcacagagtcagacacgactgaagtgacttagcagcagcagcagcagccttgaacactgccttgagctgaatcataaagtaattcagtattccttgaatacttcctccttaagtttattcctaagtgc

SEQ ID NO: 53845 - DNA, 2467 bp, Bovine  19866880761406
tctgttggaatttagacacacattcctccatactactctgtgaacgagcccacccatagggcaaagtgaaagaaagtgaggtcactcagtcatgtctgactctttgcagccccatggactgtagcctaccaggctcctccgtccgtggaattttccagggaagagtactggagtggcttggcatttccttctccaggggatcttgccaacccagggatcgaacccgggtctccctcattgcaggcagatgctttaccatctgagccaccagggaagtcccccatagggcaaagctaaagggaaataaaagttaaactctcccttactgaggctgactctcttccacagtctacctgctttgtttgttttctaagtgctcaaaacaaaaatagatgttttgggttcagagtttttagttgtaatcaggagggatggactgcagtcagttttatacttgccacctcagcactgcaattcctcagggttttacttttgtttttaaagttaatactgtattttctgctccattataattcagtagcaaataattaggcaaaatcactaaaaagtttagaagttcacttgtatttcaagaagatacttataattttgcaaaggagaagtgaatagaggtctttgattagtaaagcaaacattaatggcataccctatgtaccatgtgtaaaataaaataatttcagagtttacctttcaacctagtgagcagtaaacttgcttcaatgaataaagaatcaataaaagatgataataagcatattatttgcaaaaaaggaaaaatttcctcgagtttaaataccattttatttaattaacatattaatgccccttcagaataattaatggcataaacacaatgcaatatttaatccaccctcaagtcaatataactttagtattagtggaaaaactgaattaatgggattcctatattttattagctaatgtgctttttttaagttttaaatcttatttacgaaaaatcctggtaatcaaatacataatttcttttttagtatttctcttagggtggatgatgtagatactcttttgaactctttttaattaaatcgcagataccaccagaccaagaagaagccaggagagtgatggtgttgaatatattttcatttccaagcatttgtttgagacagatgtacaaaataacaagtatgtggaagtttttttaaagaattttcatgaaactactgtttttaagcatgtggccatatatgtggttataagcaattccatttgaagtgaattttcacttttataatatttgaaactgataaaatataattcaattaatggttattactaacctttgcctttaacttttcaataacctagagctgttgtgtatcaggctaagttgaatgtgtagggattattttgaagagtaagggaatgtagctagtgtattcctgtcacgtcttcccaccccactatgctatgctatgctatgctgtgataagtcacttcagtcgtgtccgactctgtgtgaccccatagacggcagcccaccaggctcccccgtccctgggattctccaggcaagaacactggagtgggttgccatttgcttctccagtgcatgaaagtgaaaagtgaaagtgaagacgctcagtcgtgtctgactcttagcgaccccatggaccacagcctaccaagcttctccatcctaggacctggcaaaacttaactgcaccatctggtataccagttctttataaattccctgaaacacatttgttgtcacattgctcctctcctcaaaaacttttagtaactcactgttttctctataaccctattttctccccaccttggccaggccctcagccctgaccatcagtgatttcacttgtccctactaaatgccctttctcattctccatgttgacaattccacatactctccacagcccttcctccagcctatttgtcacaaagaaaatgggctatcaggccagaacccttcaacttctctctcctcttcctctcaacttatctactcactttcctccttcctgcctggctcagaagaagagctttcagtcctcttgccccaggctgacctccccacctgcctgggcctcagcccaatcttgcctgtctctcccaggccttgctctcttgtctgtacttttataatctgaccctctctaagagctacttcctcttcaccaagaatatatccaggtcttctcccgtctgaaaaaagggttccccaaatttcagcccccttatcatgttctcagcatatcttcacttcctcacttttcagtcactcttccacccaagtactctggcatctgtcactgtcacttacttaaatgccttccattaaggtcagcaacgaccaaataatcaaatgtattttgtactctcttgttcattcatgtctaattctttgcaaccccatggactgcagcatgccaggctt

SEQ ID NO: 53846 - DNA, 679 bp, Bovine  19866880838609
caatttcttgcaatgatctcctgaaaaatcatcagtttttctccacttctgctcctgctggagcacttcatgcattcttttaaaacaagatcagttttgggacttctgtaagttaagactgctctttctatttaacgaaagtgtttaccataaagttcagtaaaaacaaatccattcatttgctgttatttcttttaaaactatttacccatctctaattctgtatttcttcctaaccctgcttcttatttgtcccatgtttaagcaccagtgagcctctagatacattgcctattgtataaatctagcatgagattccatttgtttcaatattcagtcactttattaaagaatgttatgtaggtaagtacagctgtgtcaaaatatactgctttaatatttttccaaaaaataaaatttatacaaagagaacatttagaagtattctttcaaacgcggtacaggttaagaacgaactctgcataatctcaacatgtctggaatactacttggaaatattctctctgacagaaaccattcctgcttggagaattttaggttgcatagactcaacttaaaaaaataacattaaaatttcaaatccaattttccccttttcagaattatatttttatattcatttttatgtgtgcatactgtatttttttataattttgaa

SEQ ID NO: 53847 - DNA, 1577 bp, Bovine  19866880860094
taggtgctgtaacatggccagacccaggatgagatgggctgagtagtgagagatgaaggtggaggaccatggggatcacacacagtcttatccagtaagctatggagactggacttggtgcagttaggaagggtgtaaccaatgggcaggtccttttagaaagttctccctgtgatcaagcccatcttcctgctgtcctgtgcccagaagttacctgaaagccactaaatagtctccacccttgtccttgggtggagaccatgtgttgtttagaccacgtgcttgtgtatgtgtgctcagtcgactttttgccaccccatggactgtagcctgtgaggcttctctgttcatgggattatccccccaagaatactggagtcagttgccatttccttctctaggggatcttcctgagccaggaatcaaatccgagactcctgaccactgaagccacctgagaagtccatgagtgagcactaattaaaggcagtgtcctctctctgtgatcttggaattaggaatcagtggaattaagaattgtctgctgctcccttctaaacggcagtcaagattaagtgggcagtatccatagaatttggtctctggtgagagaggaatggaggagacatacgggggataaagacagctcagggtggctggcttcacaccctgtccttcacgggcagcctgacaccctgctgtgtgcattaccttgcctctcccttgagggcttcagtgattggtaactgcagagaggagagaggggcctgacagctgtgcatttggtctagttggtttcgaaagttcagggtgatggctgtgtcctccagaaaggcctcatggttttaagtgtgtacaggccagagaacttttcagttctctctgtaaagttctcacggctctagggagcctactttctgagataccaggaatcaggatgtggtttgcaaatcttcctcattagacgttagagccatattaagaaaatgctatcttggggggattaaatttcatgtgggaaggaaatataaaagctcccaaatctggaggacattgttttgaaggttctgtttgttcctttgactgctgaaagttaatttcttaaaggattcttatttttgagggaggtgagcttagtagcaaccctgaggtgattgcaggatgggttgtctttttcttttttcaaatagtattttatttttttaacttaatttttattggagtgtagatgctttacaatgttgtattagtttttactgtacagcaaagaaaatcagctatctatatacatatatcccctctttttttggatttccttcacatttaggtcaccatagagccccgagtagagttccctgtgctatacaataggttctcattaattatctattttatgtacatagtatcaatagtgtgtgtgtgtgtgtgtgtgtgtgtgtgtgtatcagtcccagtctcccaattcattccaccaaccccttccccttggtatcgatacatttgttctctacatctgtgtctctatttctgctttgcaagtaagatcatctatgccatttttctaacacatataccca

SEQ ID NO: 53848 - DNA, 666 bp, Bovine  19866880939501
aattcctaaaaaaatgtaccccattttatgtcaggtaacactttgtccctgttctgggtttttaaaaagtagaaactcagagcaaaatacattggaatgcagggaaagttatttgatatagaaaatgtgtagtctagccaagaagtgattactccagaaatcctcatggagaataaaggatttaatgtgagacttgatattttggaaaaacaaactgaggattaataatatccgggtgatgtctcccaaaaacaccaaaggaaacagtgaagacgtcttaaaagaatggcttccagatgcctagtaaatcatgtgtctctaccgaatgagaacatgactagagggggatattacttattttgagaaaagaagcattctttgagtgactagtcgtcttttgcccgtcaactctataatactattaaagatctaaaagccaagagtattacccttttcaaataatgaaatgatggatacattatttgcaatgaaaattagtttaactgcacagtgtgatttatttgtaagaaaataagtaagttagggttttatagtgagatggattgtcttctttagtgactgtaatacatctcggagttttgttaggtggaggaaggatgattgtaaaaagagaggatgggaaaaccaggatggggctcagtgctt

SEQ ID NO: 53849 - DNA, 1376 bp, Bovine  19866880945415
ttatttactgtcaatcagataacctcgggctgtgtttggcagtttacctccacacgtcattgagacgtcatttaaaacaaatgattgcatcgagactagtcaggctttatttactgaagcttatttaaggcagtttctactgaacatgtaccaaaatcagaatattggcatcagatttccttacaaacattgaacatttattttcaagatgtgaatgtatataaaggtacttagaactttcctataagacctggttacctctagaaatgatttttattttaaatgacttctcttctgtttagaaatataattatagaaaacaagcccttatgaaaactatttaatggagcataaatatatatatgttttgaattgtccttttttcttaatagtgtgttgtaaacattttaacacatgccattccttattaggattttttttgaataattgcatatatttttaacatgaaattaatgtaaccagagtttcctcttctgtccagttttttttaacccctagcttctttctatcttcagtttcttccatttttgctctcttattcttcaagggagaaaaacgaagtacacttttattatgtagttgaatctgcaaagggaaatgtttagttaaaataaatgagatttttcagatttggtaatccattgtatttagtaagggatgctatttgtcttattgctaaaggacatcttggattatttatctgtcttttggattccagaatgttacccctcaggggaacttgccaaactatatatcaacgtgaacttttctggggcattacagagtgaataatataaagtgatgccatgttatctaatataaaagccactggtcccataggaatgtttaaatgaaaataaaaaattcagttcctcagatccactagccgtgctcagtccaggaaccccatggccagtgactcagctactgagtcagggcaggtccagcctcagaatgtttctttgtgaaccttggggccacgtctgtacattttacctgtttgtatattagagttttttacatcagtttggttttaaagttttgttcctagtatactgggcttccctcgtggctcagtggtaaagaatccgcctgcaatggaggagatgtcgctttgatccctggctcaggaagatcccctggagaagaaaatggcaacccactccagaattcttatttgggaaatcccatggacagagaagcctggcgggcttcagtccatggagttgcaaagagtgaccacgactgagctactgaataacagccgttttaaatactagtaaaaaaacagaatttcaatatgtttggaaacagtgaacagttcaaaattatttagagtaatttttactttgcta

SEQ ID NO: 53850 - DNA, 762 bp, Bovine  19866881038848
tagtctttttgatggtgaatatttttatactaatatttactttgataattaaaaagctaatttagaaagctctaatagaattttatagtctgggtttcttcacgaagaatttggcaagctcattttctttattctgtaatgtgaatcagcaatttaaacgcttttaagaattgaagtgagccagtttttcaaatgtttacagtatctgtttttcttgttaatatatgttaaaatatgcttttaaatcactgatcttgctttatagagaatggggtgggaggggaaatgcactaaaaagtgagtttaaacccattgtgtggttcttctgatttctgaaaaatgtaaatgcagtgtattttccgttattaggcagctgtggtccaaatttaaaccacatggcctccttctaggtgtcaggccaatgtaaattttaatcttgctacttttatattttcattttataatctcattacctgaatttaaaaaacccggtcatcatattcattgtttgcagggtgctgttttgtatcctctggctcattggaaggtcaagcaactctaaattgccattatcttcatttgcacttaaggaaattaaggcttaatgaggttaaacaactagatcacagggctagcaggattagagactgagccaaactctagagcccttgcttttagttattatacaatagtgcctttactgcttatttggggataaacattactgaaaacagttatttaaagaatcaatattttttcaag

SEQ ID NO: 53851 - DNA, 2867 bp, Bovine  19866881073152
accaactgaaatattactttaagtaatgcagcagagcaactctgtcaagacacagggagcagtcaggggtgactctacttgctttgagtgaagtatcacgtgcaggacagagtccctggtcatcccagtgtggtacatgtcccttcaagggaagttctcccctaacatactggaggaagggtgtgcatccactaatgcagaaatatttgtgctggtcctggatctgtctgtcctgggatctagtcctctgtactgcggcagcaatgagcccagcggaccagttcccaagctgggagtggccaggcagatactagcaggagatagggggaggaaggagggagaagccagggtatttctcctgctccctttctgtccctgggaacatctgatcaacagtgggacacttctggttcctctgttattaccttcaccttttgcatcttcagtctggcccagggatggtctgttaacctctgggttgcctccctgtcttgctattgggcatttccgctctgctttcccatgggtgaccagttttctgcatcaggccctctgttttaaatattcaagtgatttctcttccttgaggaggccctgaatgatagagtataactcaaagccttagatcagagcttcagaaggatgggcccagcacatactgtcctactgctcttctgaaggcttttagtctgttacatatttattaagtgctcatgttatttcccctccttgcatgctcaacatctcttctatttatgattgaaagttacacttcagcttataaatggccttttttgttttctagttattatatcttggcatcgtactttccaaacactgttttattatattccacacttaaaaagccacctggatattctccgtttctagtctttttgttaaactatctttaagctcccttgcatgtttttgtaatgggtaatgcagactctgttacaacagaaaagtttcaaaagacttgtgcagctgggaactttttgatgatttcactttataagtcctttggaatgaacgtgggcattaagaagcacaacgaatacaatatcagtttaacaagattcgagtggccttatttttacggagacgttaacgtttctagacattgcaattccaccagtggctttctctataatgtttttaaaaaatggaatttagcagacatataaaatggaaaaaaacagaagagctgtcataaatcttttttactgaagtgttttgtgattgcttcacaaagaaacaagatgagaccgtccaggtgctatttgttaaagtgcggaggtgatgtttcagcatctcaaagcgatataatgaaagaaactaaggaacacaggtcatgtgtgacggcaactcaccagacaaatcaggtccatctggcttctccccaagaaataggaatacacaaggccaaaacaatgaaaagtgcacagcgaggcagaactcgccagaccttttccccgtggcaagtttcagcctgcccctgtcctggccacggtgctgccccgtgtgggtcacaacagggcaacctgagggcagctgtgcagaaatgatctgctatcttgtgtgactacctgctgtgctggccatgtcagctacttgcactacgaatgcatctccccaaagatcacatggctggctcaggacttgggccggaaaggttagcctcacttccccgcctgcagtctgcagctgataaaggcccagcgacttcatggcaggacccactgtactcctccatagacttgctttttctttctaggatctggtttagtgcagaggtccccaagctttttggcactagggaccggttttgtggaagacaatttttccacggacctaggggtggggtggggggatggtttggggatgattcaagtattttatgtttattgtacactttattttgattattattacatcagctccaccttggattgtcaggcattagatcccagaggttggggacctctgggtttagtatatagcttggatttcaccctctgaaaaatccctaaagattgtttaatatcttgactttaatatatatacatggatatttattaatttatgatatatacattgatatacatatctcaagcgctttctggattagcatgttctcactcactcttcaagcagctgtgtaatagtccttcccatggatacactgtttaaaccactgccatattggtggatgaagcttctcaagtggtgcagtggtaaagaatccacctgccaatacaggagatgcagacttgggtttgatccctgggtcaggaacatcccctggagaagggcatggcaacccactccagtagtcttgcctggagaatcccatggacagaggagcctggtgagctacagtccatggggtcacaaagagcctgacatgactgacatgcactcatactgctggatggttcatgtatttccactttttgctatgacaagtgctgttgcaataaatatccatgtacattttcctttggtgatctttggtgatctaattccatagaatgaatttctaactgtgggattttaggccaaaaggtatctatactttaaactctgagagagactgatgtattttcttctcggaatatcatgccagtttacactcacagaaacataatgaagggggctactggtgactccaaaatccatttgtgtcctgagtgctttgatgggatgggtttgataagcaaatttagagggagaatgcaaggcatagttaaaccttcctaaataatttcaagaggaagaaagttaatgggagacgcatggcatttcggaggctaacgatgagagcagtaaggctgcaagaagaaggcgaggggaaggacgaagcg

SEQ ID NO: 53852 - DNA, 3225 bp, Bovine  19866881075427
atgtataataccaacatcctagaagccatttcagaacacatcatcccatttcagaacactttctaatcactaccaccaaaggtaaccactatcttaatttataacagcatagattagttttaactgtttttgtagttatacataatgtatgcatttgtatgtggtttctttctttcatgtaacattatatttataagattcatctgtattgtttcatatagttagttgtaggttgttatgtctctttataatattcagttgtgtaagcatactacaattcatttatccattctccattgagtatttaggaaatttctatttggggtctggtgagcatatgaacaggtttcccaggtaactaagtggtaaagaatctgtctgtcaatgcaagagacacaggttcaatccctaggttgagaagattcccctggagtagaaaatggcaagacacttcagtattcttgcctgggaaatctcatggacagaggagcctggcaggctacagtttatggggcagcaaaaagtcgacacaacagagtatgcttgagcacgtgagcacagtgttttgcttattaatctaagagaggaattgctatatcatagagcacacatataattttagcataagtagatactatcaaaccattttctgatgtgattatacccatttcactcccattagcaatgaatgacagtttcacttgctctatagtttgtcaacacttttttttttaatttgaagatactttattacactcagagttttcccattacttttaattgtaaactcttactagtcaaaaagaaaataaataataaaaacctatatcttcaggaaacttttaacaacatagttttcctttatatgcttgtcaaatttaaattattacaagttagatacattcagtcattacatgataccaggaagatcaaccttaaagatatcaataatgtctatactggtaagtaaaataatgataaaaaatggtatttcaattttacctaaaaaaaaaaaaagcaaacagattccagtttgttaatgatgggaatacagacttatcttcttaatcttggatattaaatatttggacttaaaaaaaataaatattcctgttctctcaaatagtggctgacattgtcttgggagcagactgcctaaagaaccagtctctcctccctcaagagggagccaggggtgcaccaagtacaggatcaaggagccctttgcaacatttatccccaagcccacggagctactactaagtcacttcagtcgtgtccgactctgtgcaaccccatagacggcagcccaccaggctcccccgtccctgggattctccaggcaagaacactggagtgggttgccatttccttctccaatgcatgaaagtgaaaagtgagtcgctcagtcgtgtccaactcttagcaaccccatggactgcagcctaccaggctcctccatccatgggattttccaggcaagagtactggagtggggtgccattgccttctcctagccttactaaattaaagagaacagaatctctttctaagcatcaaggtggctatgtagatgtcaccaagaccacatatgtgtactactgatgaaagatttttcaaattgctgaattgccccttttccattattttaaaaaatacttttcagctctagtgtaaaaagggagagaaattggaaaatatatttttataacacctccatcaccacccccaccaccaaaagggactccatttttatcacacgctgtctacctccacagtaaagaattgaggcaaaaaacaaaaacaaaccatgtgctatttctgaacaaagaattcagactacctaaattataattcatttcctagaaagtcaatgtattggaaatttcgatcagtgttcaaaaagagtattacccaaaccatccaaggaagacttgtactttcttagaccggccacacaaccatgaagtatggcttcagtattagacctggcaaccccaaacctctttttaaactgaattggttgctgtttacttaattaacttagaatttgctgtttggattaggctgtcaggtaacattggttatctaactatttagctgcgagtgtgtatcaggtatgaaatctcacatgtatgaaggaaacccagtaagtcatgctatcaaatgtgcacagagcacacatgtggatctgagaataaacaaaggtcaaaatatttacatggaatgttgacccagatttaaaaaactattttaaattaatgacatctttacatacaatttgttttatgaatagcctcatttgataattaaaaaaatatgcctttcaaatatttcataaatatataaaatttcactacactatttttctttaaacaggacatctaaactctctttagaaatcaacaaaaatatttttttttttctgtttcaaagtcacagatacgatgattctctgattggcagtgtcttactgcatgcaagaatgggacgcatattctcttatacaactatgcacatttctagtattttgagctgtataatttactcgctgaaggtcagtagtatcaaagaaaaatgagagatcccatctagctatttacaatatgagagtctttcttaaacttctttaaaaacagcaagattaggatggtatctggccaatgtaaagaaatattttgatgacagaaataagttaacattacatgaacagttttctaaagtacaatttgtagtgaaatttaaatatggtgatcaactgtacatatttgggaaaatgatcacattttctttaactgtatcagtaacatataaaacctacatttagaataggattcattcttataatctactgggaaaatgcaaagtcagataactggctccagaatttctggtgagtccagaaagaaatgtctgagaatttataaataaaattgtcctttgtaatcagtccttttgggtatgtaatcaccgttctaacaaggaaaggtttttagtttcgtatgtaataattttcaaagcctaccctcccttattaagcatttattgagtcactagtgtatgtactcacaaagccttctcaaactataacatgaaggccactcgctaggacagattttcagtaattcctttaaagagagattcttgagtgcacacactgtgactatactgtctatgtaagagaaaatgttgcacttttaggatagtaagaggaccgccttactg

SEQ ID NO: 53853 - DNA, 994 bp, Bovine  19866881106384
cctggagaatcccagggacagcagagcctggtgggctgtctatcgggtctcaccgagttggacactaccgaagtgacttagcagcagcagcgtagcactttttctgtagtttgtatgtgtatatgggaaaaggggcttcccaggtggctcattggtaaagaattgcctgccaatgaaggagacacaggagacgcaggttcgatccctgggtcaggaagagcccctggaggaggaaatggcaacctgctccagtattcttgcctggaaaattccatggagagaagagctttggtgggctgcagtccatggggtcacaaaaagtcaaatacgactgagcaactacacgtgtatgtgtacatgtggcaaaagtctctgatcagctttacccaggattaaaaacttgctggttgcaagacaatgcctctgtatgtgtacttaaagcagtttgaatcttgagaatcaaatacttctgagagttataacttctttttctggcacttggaagtttgtggaaatgatgttgtaaaaatttggagtcgagccaaagataaaatcgtttatggagcaatggaccaagacttaggaagtttctacagctgatatagaaaccactttttctcctcttcctaatatggcttgtgatttgacttgagaagattctttttcgacctctgtgctctttccacattttgaatttagttcccagtaaggcccatcagagttgactgttttttagacgatttcatcagggtacagtgttcagggggaggaaatgttgggctgtgggcagtgaggagaggaattaatatcatttttatctgtttagagtatttttaaataggatcaaaatttcttattttggaattttcaaaatgaaatcatttcatttttaacatatacaaagttgagtataaaaactttaagctgaggttctcaaactttaccatgtctcagaatcactgtagggagggaattgttaaaattccagcggctg

SEQ ID NO: 53854 - DNA, 1790 bp, Bovine  19866881223730
cctggtggcatctggcagttcgtgtgagtggaaagaccgtcacaaagcaacagcaaatgttggagagtgcagtgacctggaaatacattccctatcaaaagaaaattcaaatgtaaaaattagataaacagtgtattggccaactacacatcctcagatttcacccaagtgcctccaggtttctgagagttctgagagtcacacaggttaagcgatttgccttaaacctacaatcaatcaataaaaaacatacaaccgaagatattaaactctagaagcaattcactggcttacctgacagcatagcctgatccaaacgctgaggggtccaaatttgttttccattccagcggttctacaaaaacatagtttgcctcttggggatatttatagataaaactctccacaaacataataatttccttcactatagcctcattgagaggagtaacttccagggtcttagccccatgccccacagcagtccactgcgcagacctggtcagtgccacgcccatgggatcccacgatgctcaaacctgagctcagcacacacacactgcatcagagcagagagagagagacaatagcatccatcttcctagaggaacatttctcattttcaagattttaagctagtacttacccaacccacattctgcttgttcaccttagagacagattttttttttttttaattatccaattgctcttcaagtcaataaaatagttaatgttccctgaaccagctctaagtaaaactgacccaaggacataaggatttcccagtatctgcctgccctggaatgaataacttctttctcattttcagcctaagacagagaattccggtcaaaaaacagaaacataaaagtccaagagcggaaaaaaaagaatcggaggaggcatgccttctggtttgcagctctgctggggccagcgattataagagatgctcttttgagctggatcacacattgtttagaattatgctattaaactgaattttgttattctttgctgtaacatacatctatatctgtgcaatgatggctgatgaaagtttcccaaatgccctcagaattcataaaaaatagaataagaacattaagtaaaatagaattttaattttttttctgacaattcataaggcacatactgatggtattaatcaacatatttgagtaattcaaattccatacttcttgcatatatcctgcccagaatatttttatcataattcataacttgcttaagagaaaatgtgagcatgaatgagaacctttttagcctgtttatctaaattatcagaggattctagcattaaaatgtaaaacagaaattgaaataaatttcactttcgataaaattagcctttaaaagaggtatctgaaaagataacattatctgcacacttaaataagagccaagttaataaataagtcctgatatcactatattatggagctttgtctttttttcagataatctatacttgtttattttctcattggcaattaacactgatcattaaaacctttcacctggaataatagaagaacggtttaaaagttaaataaaaaatataattagcttcccgcttcccataattattacaaaagctcagaaccaagattttatagaaatggtttggagattttactttccttcctgtaaatccagtaacagggacatctagatcagaggtcctcgactgggcagtactggctgctgaacagcagtgaagaagtatcgtacagatgttttattatcaaaacgataggggacat

SEQ ID NO: 53855 - DNA, 1307 bp, Bovine  19866881263957
ttttataaaatctttaatttctaaaacataattgcttcaatacttcgagcagtggtcgtaggttatattcctgctaaaaacataaattatgattaaagctaagcaagaaactggcagccacatcctgacagttggggtgtaataacggcccagaacgaagaaccaggcgacatgcagactaagggccacccctccaggaagacatctcacccagcacaatgctccttcactccttttttttttttaccccccacacccattcaaacttctacaaaacaaagagatttctcataactagagacatctctcataactattcagcttcagtttttcattttggaaaaccagtaaaattctcttaatcaggataattttattcttcacttcccatcaccattaccccaggaacacaaaagaatatattttaatgcattataagccaactgagttccttaaaaaaaaaaatctagaatgatagttaataaaaaataaatttaaaaatacaagtagaaagatagttacgaaacgaaaggtgctttgacaaacgtataactctcggcacctaagtgtaatctatttcagctcttacatgggtgcctttatattttatgcttgaaaatatacgttagcctctttgtatttacatttgagatgactgctcccccacttatatatgaaaaccggttgtatctcatgatttcctgtttttaataggtatcaagtaaaatactctcttaattatgcttgaaactaagcaaactctcgtaaaaagtctggaagacagattttattttgattagccagatgctattgctaagagaggattctcttaccttgttggcaactgcaatgcagagcatcagggaaagagttttgacacttatgatattaccagaatgatcaaggtaatgttcttatttaacatcttggaagcttgcaacttttatcatattatgaaaataaattttagagaatacaagctatgaaacaagtaatagttgatttgaagaaactattaaagtatactctaaaataaaaaccaaccatcctaaaagttaaactcattttgcttaaataattatcaataattaggtcacttgaacagatactgtcatagaatactaaacttccttgctcacaaaactcatctaactgtattgtagttacttgtttaagcgtcctgccttcctgcaacaataaaccccaaagcttatccaaatcaggctttcaccatatgcctgtactacctcagactagtcattagtattcttaataatacggcttcaatgagtttagtagattttaat

SEQ ID NO: 53856 - DNA, 1652 bp, Bovine  19866881277916
gatgtgactaagcatggtcacattagaacagttgtagatataaggcacatcaatatatcttaaatacatgaagacatggagggtgaaaagttcagaggttttgactgtttaaaatcagagtaaagtgtataatcagagggtgaaataatgtgaagcaaaacagacattttaactgcctcacaatgaatgagttcagtggcaaaataagaccaaaaatggggaacactctgaggttgcttatcttcttttcacctgtatggtttgggccagatttggagatgtggtggtgagaatcaagaatgtaataccccaaagctgacttgctagctgcctcacaccagactttgctctgaatgaatttcagttatttccaaaaatgaaatctcccaaaagatgaagggttttcatcactgaggatatttaaaattatactgcagccactaaagactaaaggttcagagctgaggctatcaggaaggtctgacacacatcagctggaaaatactgaccccaagtttcagatgtgaggtttttggctttatcaataaactcaaatctaaaactgctattgggaagttatcatttccaatgaatgaactagtataaaatcatgtgcttctacaagtgaagtgtcagatatagttactccccctgtattccatcaagcaaaattctaaagagagagccactttcttcaaaataactcaggattcactactagagacaatctagtaagatttgcctttgtaaattttataatacaccaaactatgttaggctatccatggattcttccaagatcaagttctactatgcatatataatatccaaataatatggtaattaaagaaaaaacagtgttgtttcaacatacaacatcaacttactttgagcgctgaagacttcgaggagagacaggttcatgaccttgctgcttgtcagcagttacaggctgctgtgtggccgactgtgaaactggtccttgcttaactactggagtactaacctggaatgtcagaatctggtgagacaggcttctaccacatagacaaacagcagtggaaactagataagagcaaaagttctgccaatgaaaactccccaattatttctgttcagtgatttttttaaaaggtaagaattgtcttaaatgttcacaataagattagtattagcgatacagccacacttaattatgtaaactattgtcatttagggcccaaatcttcagatccctccaagtctagttagtaatcttgaacaatataaaacatggagatttaaagaagaggaatcaaatgagtttccaaaggtcatgtagatagaaggaagttttgaggcttagatctaatttcttcataaaatggcccagggccaattacttaagccaaccagcttaagaaactagttctcctgattttaaaccccattttctttctaatatactgtaacatcttttctgatttactattacttctgtatcaataaaaataaatatattacaccacatcatacaaataaagatgcttaaaattcaatcacaaatgaagagaatgtatagacttgtctatcagagaatgagctatggcccatatgcaatttaactggagtgggcttcaaagagatggcaccctacagaggcagaccaagag

SEQ ID NO: 53857 - DNA, 832 bp, Bovine  19866881338998
caggggagcccaaggaaaaaaacctttttaacacagggaagagtactcaatatcttctaggagtctataatggaatatatatatttatgaatcactttgctttacacctgaaattaacacaatgtcataaattaactgtattttaatacattttattttttaaaaaaacctttaaaagtaaaaaaggagaaagaaaattctaccttttatgatttcaaatcaaatgtaattacctgaaggactgcatttgaagtggcacagtatttgcaaggacaacattcaaaatttgcaatctgtgattttgttgacttgttagggtaagcatataaaaccatattctagaggcttcttgatagatttccctgtgatcaccctgggcctctcagtcacagaaaggaataggcatgatcttaggctgggggtggtcataggagagggcgtggctggagagaaacccctgcgcctgtaattcctttattaacgtctttaaagtcctgtgcagggtaaaaatcagacggagctcactctcagggcaggatttccacttcttcccaaaggaatagtactaacaaaagttttttaaataagttctctcaagtagtttaatttttcctctgtataatgaggattttattgtttttctctctgatttgttcatctatttctttctgcgttgctttttcctttctgaagaaaggccagactatttccaatttaagctagcacctcgaggctttttgtaatcttgtagctgctctccttcctcttcttttttccttccccagagcttattacagaaggattgcagctatttcttaattttaaacagttg

SEQ ID NO: 53858 - DNA, 1484 bp, Bovine  19866881544850
tggtgagactggcattccaggcaaatgcctccagaatatatacgctgaaccactgtacactattcaggagaaaatgagattgtgcaaggtactaaataagaactttattttattttaaagatgatacatatttatcatataaattgtgtagaaaatataaaaaagaaagtacaaaagatcccaaagactaccatgcagaaataacaatcattaaaattattccagggcttcccttgtggctcagtggtaaagaatctgcccgccaatgcaggagacacaggtttgatccctagtccaggaagatcccacatgccacagggcaactaagccagtgcaccacagctactgaacgtgtccctagagccctagagccacaatttctgagcccacttgctacaactactgaagcccatgcccccttgagactgtgtgatgcaacaagggaagccaacacaaagagaagcctgcacaccacaaccctgctcactgcgactcaaaacaggcccgagcagcaacaaagacccagcacagccataaatacaattattttaaaaaattatttcagctatctctttatgcctacagctagataaaaggatgtaaggataggtgagagagatagagaaatggatggatggatggatacatgcatagatagataaaatttctgttttaaatactatctattgatttagaacttgcacacctactcatccactcttccctttttgtcagctgtattattatattactgttatcaatatctataaaatatagatgattcccctaatgaaaattccactgttttgattgatcactgggtactttagtcagtaccctccagtttattcaagggaacaatctggctctgtaagtctgatttggtcaccttgcggttatttataagcacattttactctctcatcacttatgcacaccaattctaaaagatgacactcttccatgacttctcagcattccttctaacactctcaaacaaaacctttcagccttgaggatcacttacatcatactttcgagctccactgcacaagcaccaactgcttttgtgacattgacaagaagagcttggtttatcccgacaagaaggttcacgaggggctggatgccaccacatctccggatgatgactctgttctcgtgttcttggcagcattctcccaacgcaccaaccacgttcacaagcacttcctcgggctggtcagttaaaagtcccaccagggtttcgatggctttgtattcccgaaatctgagttcatcacaaagcaaaagagggtaggaagggaaggaaagaggtgaacagtgttatttctgatataaagttggctgatagcaatcttagtgataatattaatagctaaaatgtactaaatgctaaccatatgctcattcaatcattataacaattctgtgatatgaatactattattaccccctttttcaaaaggctaatctgaagcttg

SEQ ID NO: 53859 - DNA, 1166 bp, Bovine  19866881563897
gagtggggtgccattgccttctccgatacctgcagtaggtatccacaatgcatgaagacactagtaagacctaacaggaagcagtccagttaaagatgctggctcacgtcttaggcaaggacacctacctgccctgctgtaacaatcaagccaggcctcagcaacactgcatccaaacacaaggacaataaagtatcaagactcaggagagtctcgttcagagtcaaaaacttactaaacagggaaaaaggttttactgtctttaaacacatacatacacacacacacacacatacaagaatttaaaaaagaaaacagaatgagaaatttctaccaacttaaacgtattgtaaacgcccagcatgatccagggctaatcagaaacttgactccctatttgagaaacgttttcaccaaaacttaacagagaatttcgcacactccttccttccctctccaaagcaaacattttaggaattacatctatgccataatacaggtagaaagtatcacaatatatattgtagataatctgaaaattgaagaaaatagataacaaagtatagatcatagatttacctatataaaccagaaagaaatctttgtttaagacagtttattttctattgctttttcaaaactatatttatacaaatataaatgattaatataaatataataataaattaattaaatcaacggaaattaatgacaagatgtgacactcattctcaaaataacatctcaaaaatacagaatacatgaagaagtgaagatatttccccagttccagaaaagtgcctctgtaaaaatataatattctgtacaggacagtagttcctaagagaataaacggctcagagtttgatgacagtcttcccgccgtgaacaattcgctcttctcacagattccagatgctcaagattcctgccatcaggatggaaaaatttactgtgagtctagagaaatttaaaaccaccattcttgtcatttccctcatagcttcattattagaacaagtctggggaagctattaacctacgttaaatgataaaaaagatgttctctgtgtccaatcatattagatgccatacacaaccaaaatatttagaaatcatatagaaaaagacttggggaagagaaagatagagattcaatttttttc

SEQ ID NO: 53860 - DNA, 1242 bp, Bovine  19866880172335
ctagacagcccttgtgttggcaaagtaatgtctctgcttttgaatatgctatctaggttggtcataactttccttccaaggaggaagcgtcttttaatttcatggctgcagtcaccatctgtagtgattttggagcccagaaaaataaagtctgacactgtttccactgtttccccatctatttcccatagagtgatgggaccggatgccatgatcttcgttttctgaatgttgagctttaagccaactttttcactctccactttcactttcatcaagaggcttttgagttcctcttcactttctgccataagggtggtgtcatctgcatatctgaggttattgatattgctcccggcaatcttgattccagcttgtgtttcttccagcccagcgtttctcatgatgtactctgcatagaagttaaataagcagggtgacagtatacagccttgacgttctccttttcctatttggaaccagtctgtttttccatgtccagttctaactgttgctttctgacctgcatacaaatttctcaagaggcaggtcaggtggtctggtatttccatctcttgaagaattttccacagtggatccactgatccacacagtcaaaggctttggcatagtcaataaagcagaaatagatgtttttctggaattctcttgccttttccatgattcagcggatgttggcaatttgatctctggtttctctgccttttctaaaaccagcttgaacatctggaagttcacgattcactctggtatctaggtctacctcattggtcctcttctctcagtctgcagtattaccttctgcagttcatctaagtttcctatctgaacccattaatactaaagacccagatccacctctgtcaccaaaggcagagtaaaaacaaacaaacaaaaaaaaaatcagatttgttgtatctggctggcccttcctctagaatctgacctttttacttatttagaaattcatgtcaattttcttttgtcatcttgaccttatcatttccccccctaatttttttcctgaagcattgccctcaattagaggcacttttccagtctttacagtagctcttataactcagccatacaattttctcttcatctcaattttctctctctgctttgggtccattattcttaaccttttcaaaaatctctgaactataccttacaaacataggtagtttacgtttctctggcattctcagaaaatgtagg

SEQ ID NO: 53861 - DNA, 727 bp, Bovine  19866880804164
acacacacacacacacacacacacacacacacacacacacagtcttctacttattgtctgcttcaggaaattctatctgatagagcattaccattttaactttaagatttggtccctattaaagatgcaggtgtccatgtgagtgccaatacttgaagccagtatcagccatttacagccagcctctggtctatatttgagagcagtttttgataggctagaagaggaagaagagcatgatggtctggggccagggttgagcaaagggtgtctggttgccagcctgaaggcaaacttctttgtcagtaaatctatagagggcactagtttatccagccaagactgagggagctcagctgttcccagtcctttagtgagctaggggagggcctctgtgaaaagggtcaggtgtttggattctgtgtagaggagaagtgccttcctgagagtcacctgcccagctggacctgaggccctttaggagtcctgtgtttgctcacacccctgactgctcccaggtaaacaaatcttgtttctatctcccagaaaggcagagctccagcactgtggcagcctgttgttatagatactgatatgtgacttatcacagcaattgtcagagcaatggaagaaaaatgcaatttagcaccaactgctcgtaggggttgtgtgagaagagaaagctgctcaagagacctggagagggagctaggctttcggatttata

SEQ ID NO: 53862 - DNA, 3165 bp, Bovine  19866880883188
cctgcggatctattgagaggccgtcaagtccatgaaacaagtaatgggacaaaaaggtttatgtttagatgccttcacaagcactacagatggtaaaagtggcaggttcccagatggctggctctcaacagaccagtgaaggttactccccctccaaatccagagaacgttttgccaagtaaggacatgaaaatacaaaaaaacaacaacaacaacaagaaaaacctatgcctttttgatctcccattaccatcattttataaaaataaaggtcagcataaagtctagtcattcaaattggatccaattagtgttaggaaaagctcactactttgtaatgaggcacctagggcatttagagatgggacaaatcagcaggcacttagattcataagggaagactgcagagaataattaaatcatgattaaaatgattaaacctcacctccttttggaagccttccctgattgcctcagccagaggcgatacctccttcctgagctcagaccaccttgcttcttccttgtggtatctcttgaagcccacttcatgttacagttataccacttacatgtagaacccttgactcaccctataaaggggaggaacaactgggtatgtgtatgtaacatttgggtatattgtgtaacatttcacaacaattgggtatgttgtgtaacatttcacatctcaggggctttacaggcatttactcttatttgttaaggtgagaaaatttcctccctgccaccctgctaaacttcagacctaaatgttcgactgcccagtgggcatctcaaatgcataacccaaacagaactctttccccccgaagtactcccaaacatacccacacacacacctgctcacgtatgtttctcttttcatttcatattctgtgtgctttcaaggcatttttctagtagtagtcataacggtcacagattagatgtatacagaccttcctatgttttggatactttttaaaagcattttctatgttttgagtaaatccaggaggttggtatcatatttacacccattttacaggttagaaaactgagactcagagaggttaaatagtaataacagaaattaacatctcagtgcctgctgtgtgtcaaaaaactgtagctagtctttatttaagagtaaagagctagggacagacttccctggttattgattgagtccccattctgcagaggtaatggaaaatgagggaaagtcccttggtaggagcagaggctgtggggtgtgtgttgagggggacagatgggctcttgagaagtaagccaggctatgaggcagagaaaaaaagctagtagcactgagcttttagtggctccattaggaacaggcagtggtcggactacaaaagtctttcttaactcccatcatctagcctgttccctgccatggaggctgtcagtaagaaaaaattagatcaggatcaaacaagtcaataccatgtggagttccctgattggttatttgcagatgattttaaattgttgggtgtgtacaaaaatgcaataggtgagactagaaggaaggtcaccttgacatatgcttcacattcagaggttcagaaggcggtacaggcttattgttctcttaagtaattggcagtgagttatctttgtgtttcctaaaggagatcagctgacttcaagctaggagactgacagctgcaaacacttcttcctttagttcatttggaggaaaggaaatctgaagggtgagaatgagtagctgcccccaccctcaacccaggggagaaggtgaggcttgggaagaaaaatcctggctgtggcaggatctgagatgaaaaggcctttcttggtagtttgaaaaagtctactaacctttgagaatcttcttctgctccctcagtgaatggctgcaattggaataggccaaactttcattgcctcagatgtcagttcttcagaaaatagtctagttgtgtataaaagtatatttaaaaagccagcagaaatgatctgagacagaacaagttttgttggtttgttttgtagttgtcaatcaagatgggctctgttgaggagaaaaatgctcagaaaggaaactggtggcaatgcaagctttcccaaagagggagaaacgctcagaaccccttccttctctcaccatggcaggagcttgctgagtcgtgctttcattaaacagttctgctttttaccactgcagcagaaatttgagacgaagaaataggttttggcaagaagtttaggcccagattatggtgggaaatagcacctatattttacatgtagtctttgtctaacacaatttgctatttgctatttgctcagatcactaatccttggtgaatttttttttctgacaaaagatgtatgtttacccaaggattactgagacatttgggactcagctggctggttcctgttcctgagctgggcaaccaatagtgatggcagcacaggagcagacacaaaataagtcaactggcagtcatacctctaatttcaaactatcgctcagcttcactgatttgaactaaatcaagaaaagtgaactagatgctgaaaactctgttttagaacatgtattttaaaaatgtatcattttccatttgcaagtatacccagtagtcagaaagctaaatgggattccctggcagatgttataattctcctgtgttggagttaatgggctctgaaaactgctgctgctgctgctaagtcaggtcagtcgtgtaggactctgtgcgaccttaagatggaagcccattaggctccaccgtccctgggattttccaggcaagaacactggagtgggttgccatttccttctccagtgaataaaagtgaaaagtgaaagtgaagtcgcttagtcttgtccgactcttcacgaccccatggactgcagcccaccaggctcctccgtccatgggatttcccaggcaagagtactggagtgggttgccattgccttctccaggaaacattctgctactgctaagtcgcttcagtcgtgtccaactctgtgcaaccccatagatggcagcccaccaggctcccccgtccctgggattctctaggcaagaatactggagtgggttgccatttccttctccagtgcatgaaagtaaaagtaaagtaagtcactcagtcgtg

SEQ ID NO: 53863 - DNA, 875 bp, Bovine  19866881056214
tttcacatcagatgagcttttggcataagggcattccacttgattttatatttaaacattaataattcttaatatgtgcatgtctcttaagtaccacaaacactcatggtatatctttagaaaaagaccacaactcagatccaataaactaacaagtataagatacaaatccactctagagtttaaaaatgctagagcaccctggccagctgcctgtatcattccagcaattaactcctttatttcttaataaacattcaatttcttaaagctctcaaaaccacctatcagccccttctctggaccaccatgcagtatatagatgaaaatcctaggccacatatcaacatatgaatagtaatatcgcaagtatacagtaaatctgaattatgcagactttaattcacaaaaaatatatatatatttgtttttttataggtaagttctctcttctgactgacaagctttggttttccttcaaactggaaacaccaagtcctgagcgctgtttgaacagctgtactacagtggatgccgccttggcggttcattttagcaattcctcatcacatctcaggcagtttctttccattgagcctattcctgtccccctcccttcaaaatgatttagtaattaccaaaagggatgaagggccaagccagagcaatcaaatgctattaagtttcattgcatgtgtgtgtgtgtacatgcacacacagataaggttctcacttttacaaacatccccaaaaagtgcaagccacgacccacatctgttggaaaaagcgatgggaagggtctttggaaatagagtagaaatagcatttctctgtactaaagtaatgctcacactaattggggtactcgattccca

SEQ ID NO: 53864 - DNA, 690 bp, Bovine  19866881853171
tacacacacgctttctgaaaaatcaaacaaaggaaatagaaaagacaagactgatggtttttatagtagagtatgagaagaaggaaggtttgcagggagggtgttgtttccttcctccattctttagccctgatgcctgattttcatgattcccaacctagtttcttttaggattagagaaaatacatcgataaaacatgtctactacagcccagaaggaagatatgaagaatatccacattataatatcacaaggataggaaaaagaggttagaatagagtaggctaaggccttgctacttcacgtgtggtcctcataccagtagcggcatcacccccggtggatgtttataaatacagaatctcagacccttcctcagacctaccaaattagaatctgacatttaagaatatcccccagtgattttttggtatgctaaagtttgagaggctagagcttatcccccaaagcattagaaagtcatttgaaaataaacaattacctataatttatatatatatatatataaaatttccccaggtccacttctctttgtattcagtataaaagccttaagtgtgggcaaaagagttgattgaaaggaaatcaggccataggattgtactgtttacctgggtttggagactcacacaaacctgagttcaaattctggccctacccctcggcct

SEQ ID NO: 53865 - DNA, 1505 bp, Bovine  19866880136732
tgaacacccaggactgatttcctttaggatggactggttggatctccttgcagtccaagggactctcaggagtcttctccaacaccacagttcaaaagtatcaattcttcggcgctcagctttctttatagtccaactcccacatccatacatgaccacaggaaaaaccatagccttgactagatggacctttgttggcaaagtaatgtctctgcttttgaatatgctgtctaggttggtcataactttccttccaaggagtagtgtcttttaatttcatggctgcagtcaccatccgcagtgattttggagcccagaaaaataaagtcagccactgtttccactgtttccccatctatttgccatgaagtgatgggactggatgccatgatcttagtctactcaccaccaaaagaggtcacctctccctcttgtaggcaagattgtccctagaaaggaaagctgatggagaaactgaagtgggattatgtggacacctcttagaagctggattcaaactcaatcaacaagttcatgcttggtaagaatccctgtgactcttaattttaagcaaaagaagcataaagtgagcttttatttactgaatgtctagtgaaagctcaaaaaaattattttaagtattcacacttgtgagagtcccagatgtgatcatttaatgttcctcatattgacatctgagaaatagattaacgttcatcttcagaatcagtataaacatatgatactttactgtttaaaaaaaagcaatgctttgaaattatttggacagatgtcacactttattttgaatcacgggtatgatataatgaaagaggttttgaagtgatatttatgtagcttaaaaaattcatccattcattcaataaacacttgctgtgcataaagtcgaaatgagaccatctattctgcacagctgatggccgtcccctccgaggggagagggtgggccaaagtcagatgacaccacctcctgggctgccatgagctttgctctgcactcatccaccagagtaagggaacagcaaatcttgagcttaaccactcacagttaaaatatctgcagcttgactaattttcttgtaaaaataagtttcttttctaattaattccatcattgtctgcctcatttcatgtcatctcataaaggataaatacttggctcaagatcactggcctcttatttcccttcaatacctttggaatggaagttccactccagagggacttggatgccattgcatcttaccatatcatagatgggataaatgaatggtgcttcttgcaggagagacgtgctatgaggaagaaagaaatgttctctatttctctgaggagctctcagtccctctgggagtttctgtgaaaatcctagagaggagtccagtgctcgagggtgtggacagtgacgtcctggagagaagcccaggtggaaacagggacagaaacctgctattattacgtctttatctcctgtgaccttacag

SEQ ID NO: 53866 - DNA, 1691 bp, Bovine  19866880687637
ctgtgccaaagagtgacagcaaatgcaggttggccaactctcagggtaagggtgtggtgggcagtggggaggagggggactctgatctagatgtggcctccttgtggtgatgcccccatcatcccagcccttcagtcggctgttggcaggggttggagaacgtcgaaggagagggaggagacccccagctcccatcagcattggctgccggggctgcccacctccactgtggggaagggaaatgggcagtcccttgcaatattccctctcttctgtgaagagaagtgggccatgggggtccccacccatgcacgcaggcagcccagctcgctgcagggtgggagggcatcactgcatctctgcccacacacgggcagagaaccacggccagtgcttgggggacagcccgaccggggctctctggccagtgggggtcctctgtccctggtggggtccaggagggactccagacggtgcttgtggagtaaccagaagtactgctcagacataggcactgccacctaccctctccatggggggccagatgcagctgaccctgcccaggggatcccgccctgggatctgctgcccgggggcccagacatgccatcagttcacagggggacactctatgccctcacccatcaccacgtcccgccacctccagggtcccttgctgccctcatggggcctgatcacattgcacacagacccggccgcggtcaccggggagacgaggttgcagtggctccgggcagagggctgggctctccgcacagagcctgccttagtaggcgggcagcttgagagcacgtctgcacatgcaggaagatgcgcgtccttcgccaggacccggggccagctctgtcggcataactttttaaatcagtgacataagtatctatcatttcactatatatgaattttttaatatttccaatatagatgatgctgaatgtgggattttcatgagatatgattccacttagcctgggggccttttgattcctctgacgttttttttttatcaggtttcatcagctttattggaaaacgggctggggccttattggaagatgggtagaaatttgtcaaacacttagccatgctcagcatccttggctgctcagacataacatgtgcagcaggctttggacatggagagaacctagaatgttctctgctagggaagaatctgtggataagcataaacacagaacaaaatgcttccttacatatatggcaactcatacaggagaatgggagtttggccaaaaaaggcaggtatgattataatgcttctattagaatcaatgaaaaccacaaatattttcaaactggaattagggagaaccgagacaggctgaaaatctttcttaaatgaacaagcataggagagaatttctttctttaaagggaagaggcaggagagacctgagggtgaatggaaattgtgagaccatatctaggtttagaatgtggggtgaagcggggaccagggggtgtggggcaggacagggcgaggtctcagaaaatgcccctggagtgggtttcaggggaccggtcaccagcctcaggcttagagcgtggggtgaagtgggaactggagtggtgagcaggccacagcaaggtctcagaaaatgcccctggggtgggatttgggggaccgggtcactagccttgagcactga

SEQ ID NO: 53867 - DNA, 880 bp, Bovine  19866880732715
atgtttctcatctctaaaaggcagtcgacccctccccccctcagaggtgtgctatcaacggctctgtgatgcttagtgcacagctggaactcagggaatgctaacaaatggtagctacttgtgttaacgttagtaatattaacttcaagggcaatttatgactaactgcaactcaggatcgtctaatatgaactataagtatgctgctgggactgccaacctttctgtgctgggcagcaagagcaggagtggaaaaatacagccaatggaactgacatggcaccaagagagcgggccttcgaacatcactcgttgcatctggaactgtttctccagtcaggctgggattgtctcagatcctcactggtcccacttggctccccaggaagcgggcagaggggccccagggagggatctctcagcagatgagctcccggccatccgacagtagtggatgttggcaacagtttcagcggctcatggagtggatggtacccatggtacccaggactgctgggcaggggacggtgcccagaagcactgcctggtgctggcatcgaggggagtgcctagtttgaagagctccaaccttattaagccctattggaaagtagttagtgcaatgaagtgttgagaattatctagctgacacaggaggtgttgatggccaattgagataatttcaatctttaagggaaatttcagtccttaattaccctgagtcacttcatgttcaagaccagcagatattttccaactttctttttccactaccggcgcacacagaagcaggatgatgataactacaaaacaggcaaaatttgcaatagacgttttctactctgagggtttttttttttcttgttcttatttttagaaa

SEQ ID NO: 53868 - DNA, 841 bp, Bovine  19866880738080
attcatgcagaatatgatttcttcctgttatgtttgtgaaatggatgcaggatacaatttgtctctagattaactgcacacttctgctctaaagaaaatgaacttgaatgttttgaacataacccatccttgtgtaattatgggcggatggaaagaagggaggatggaaggaaggaaaaagaaaaaagtggagagggagggaggggagaaggaggaaaaaaagagatcgcgtccaccctagggcaatcaagaatttaaacatcagtgtgtatggaaaattacaagggcgcagaggagaaagcagcacagtatgtgtaagttgctgactcctctcctccatttgaagttcaagaatggcatgtctagagactttcagcaaagcatgtaggcacttatgaacaattatgtgccctgtggtttacttgtgtgtctgtaccttcgctgcattatctaatatgagaactaaattgagaaaaccaactaaattaaagctaatcagagcttcatcgaggtacccagctcagcagataatattccagtgctccatgcaattaaattcttcaattattctaagtgttattatgctaatttaaaaggctaggattattagaaaatgtataaagaattatgctcagttatagcgttttatttatgtgatttcacgttaaattatttaaggtatgaaaattataagagttatcagtatgtgacttcagcctgtcccactggggcagtcagccacatcgaaggggaaatttgtcccattttattctcttggggggatagactcacagctgaaggacaatggcttgcacagctcctgtcgagggctcatcacggg

SEQ ID NO: 53869 - DNA, 1830 bp, Bovine  19866880988916
ttgaaaataatgaatgtcagcgctcatgcattgaaaagaccttggcttttgtaattcactaaagcaatttctattcatttagttgagctaaatgcttattgttaaagacaaaagccccagcagtctgacactgagctcattacgtatgttagaaacgcggcaatccaaggccacgccaaatgcaactgagctggggactgggggaggggctgggaagggagggagaaagcgggggtccagggattaaaatgcagaacacaccgttctcctcaatgacttcccatttaggcctgattaaaacttcaaaacaaagctggttggaagcatcagtagaaagatttctgttgttgtcattaagtgatgggggtgatcattaaactccagaaagtttaatggggccccatctcagagacctcccgcagcggggactcaagtcccagctgatcctcaaaactgctggaaatgctagaggccgtgttgacaaacatttgcagaatagccttatgtagccacggtgagttttagaagataaattcacctcttttgtttaaatagcactgacaaagcacaaggataaaattccttgcattgatgtcggccaccgtagctggagaggacacttttgatggccctctgagcccagcatccaaacctcaggtgggccttcgtgcttggtaggaggaagtcctgctcctgcaaggcaacaaaagaaagcctcgtctcctgttatgggcaagacagcctccctgcacttggtggtcttgtcatgatggggaaaaacatgaccatttcttcctggagcagaaagtttcgaagttgggaccaaacatttgcacatgaacttctgcaagacaaaagtggagtagtttctgaggagaaaagctttattttttcagcttattcaaaaacagcacgtgacagctttactctcgagacagaacacgtgaagcccagcaggagaccatccagacgtagtttaagatgccacaaggatcttgacgaggttaccctgcaaaagttttcctttcaacctacaaaatttgaaagctacattttagaaatggcgaaacgtgtcattaaaataggcagagagtacagttccaacccaaagaagtgaaatgagtcggtttgagggatccgatgggtctgtcccagtgagacatctcaaattcagcagcaaacacacccggaagagctctcaccccaaaaccagggagaaaaatagctgcctcctccgcgtgggggagagcggctgtcttatcggtggccgagtgccactgacgggtaccgacagtgacacaggcaatccatcatgtcatcagcgccatcagggacgcggggcctccgctggcccgggatgcgagcccagaggcggacgcttaacccctgtgagcctccagcgcctgcagcctcaacacggccctgccgtgtgtgaggtctctgcagaatgacagcaaatccatgcgggccggcagtctgccgtcatgacgcccgggcacaccaggccgtcgtgacaagcgcgcaggacgcggcctttatcacgcgccttgtagagccatttaaggggtctcagctgagacccggcagcctgccaggcgggagggccggccagcgaccgccgtctccctctccgggaattctccacggggatggctctcagaggcccagagttagcaatcatgtgctgcaaatccacctgatattattgcaatgtgtctccatgttgaccaactctgtagatttatttatttttaatccccagtgcacaaatagtgagacacttgagttaggagatgcttctgtatacgatgtagcattttatcgtgtcat

SEQ ID NO: 53870 - DNA, 1983 bp, Bovine  19866881131865
tacatgtgtgtatatatatatacaccccatatatatgtaaaatgccctccctgaagccttcagaaaacttcatgggtgacccgtggtttttgcccaactctgttagggacaccaggagaaatgtggtcataagtgtctgccagggcggaataaggactcgctctagcctgcttctcttcccacatgcttgctctctgcggcccacatgtgacgccgtgaggtcaccaccattgcgtcccccgtttcacggcaggagcagtggaggctccgacagcagggggttggagaggatgaagacctagctggctgcctgggcagtgcatgctgagtccgaggcctcctccttccgctcctcagtcttctcatccctagtccagtcccctcaccacagagccttcccgggcacagaaatgactttctgttgcagctgttcttcctaagtcaactgacagtttaaaagtttgcattttcaagatgcacttgaaaatctgcaaatggaaatagaggtgtctcatcactgtttaaaatgataacatttaggggcagggcttggtgagccagatgtcagaacagaacccttttgccaacaagagttggaaggtatgagaaggaggctagaaggtatgagaaggtatgagaatgtttgcaataggaaaagtgtagtgatttgtagaatgttgatttacataacttcagttcagtcgctcagttgtgtccgactctgcgacctcatggactacagcatgccaggcttccctgtccatctccaactcccagagcctactcaaactcatgtccgtttacataaacagtgagtcataaagttatatttatggaaaacagctataagattttaaatagcgataaatgctctccttgatattaaaatccaagtcttaaatttttcatttgcatgaaatgttaagataatataagaaacagagagagccatctgcgagcaaacaaataaaatatgaactgacaggtgagtgcaggaataaaagtaagacatttctgaatccccacgggctggtaacttatctggactcaccttctctgttagcacctccattgctgcacgaacggcagctttcaggcctggacacacgcacagccacgttggggaggttcaaaggagcttattaaagcccggatctaaagggcgggtctggagtccagacgggtgtagaccctggagttgccaccgggcaggtcctcccagcgtccccggcgtgcataccggctcccgtgttatccaattgctgactcacgttccaaaaaaacccaaggctaaccctcctgagctctgcaggtttagtctgatcgctgctgctgtttacacaggaagataaaagatggataccagaaattcacagcgcatttgctgccccgcagcagcgggcaggcccccagaaggcccgctgggacgtttcatagctccgtccagagcccgaattttaagccagggacccccaagctcaggccgcgcggcgcgggtccagggcgagggggcggccgccagcccggccgcactgccggccatgtttacctttattttaaagtcagattgaatgtgaagcactgaaaacaccctttaatcatttagctctaaaattcccccgctggctctccactccttttcagcatgacttttggagtcttttgatctcctgactgctccctatattagaagtctaatcctatatttaaacatatttctacatttcatcaaacagtttgatttaaattttccataacctagatatagccacattaatcgactgcctcgctggctctctggcaggcaggccatccattccgtctttaagaaataaggaggaataaagaacgttgaacgaaaatgacaatgcagtggaaaatactcgagcatttagcatcacaaaaagcgaacatttaaggcccctgcttccaaatgccaccctaattaaaggagcgttccttttcaatggcttttttcacatg

SEQ ID NO: 53871 - DNA, 2163 bp, Bovine  19866881265471
agggggtgaataatcctagaacttccagaaaagtgcaaagacagttcagggagttcccatacccccttcacccaggtccgctgaagtcagcgtcttcaataactagggggcatttgccaaaactaagtaattaatgcagcaacactgtcagtcaaaaacaggctttagtggattttgccagcttctccatcaacgtcctttttctgacccgggatccagtccaggagcatttagtcggaggtctccaagggctcctacaacctgggacagcttctcagacttttttcatgacttggacagtttgaagggtttcacgcagatattctgtagaatgtgcctctatctgagttgtttgaggttgtgtcctgattagtctggggttgtaggttctagagaggaagagtctaccgtagcatcacatatcaggggcctgcgacatccacgcgataccagaggggatgcctgcctggacctgtgggctcgggtgcctcctctgtagaggtgctgggcttccccctcaagactcctggtctggaaaggaggcacaaattcctgctcaatctccagggggagccatggcaggggaagggttaggtccacttcctggagggggatatttatgtacatgatttggaattcctctgtaaagacatgcccctcctttttctttcattgtaaaatatattcttagatctagtctccttatttaatagatcagtaaaataaacatcttctacacatgctcttaagaaaaattgtttccttctccaggggatcctgactcagggatcaaaccctcatctcctgctctgataggtggattctttaccactgagccaccagggaagcccttagggaaagtgagagaaacctgactcactagcggagaggagcagcgccttgcacacgggcaggctgccgtctgcgtgctccctcgtcccggttccccgccaagcacgcagacgcgctgggccttcagatgccacgtctctgatgaacgcttcgctcagagtgaagggtcatggtcttctccgtcggaaagttgctttataagcctgggaaatcccttttggttctgaaatgcttgttttcctttgtgaccccccgccctgaaaggcagcaacctgctctcgcttctggtttaccttgaccagagtgagtcggctgcaggaacctcgacttgaaatgaaagtcctgtcactgaggtcctatgtcacagctcgagggtctggctgagcgttcacatcagccagttacgtctgtttggaggtcagcacagctgcacagccccccagccgggaggtggattctggagtgttctttgagaggcgtcaatgaagcagaagtgtgcgaagcgtggatcctggtacgggtgatattttaaacaattacagatggtgcggggccggctgtaactgacggcagcgtcagacccagaaaggccttgacaagctccatcctcctatgattaattactgcgcgctgtctcgggcactccgatttcctcccttgcagctcgcagccccagtgaaatctgtagctcgtattacaccacacaacacaggaaatgtcttttcattgccccatccaaggaccacttgcgcctggggaagttgctaggcaggtctccctctgacagtttggacctagagatgacttgacacggggaaccctgaagggacgcaaaataggggcagcccctcttttatttacttctccgaagtggatgatgacttacaagtcgagtcaggccgacggctgtccaacgacagcactgcctctcaggagaagaggcgcctgaaacagcggtggcttcaaggatgaaaactgcagatacatcctgcctctgctcacccgccctcgtttcaccgaggctgtgagacagacaacatggactcgtaccgtcagcccatggagacactgctttctgtacatcattcattttctcccccacgctgtgagaagcctggcgtctccccagcctgtttccatgagggatatcaggccaagggctccagccactcctccgagagtctggcttggtggtcagctgcacggggagcccagtggtcagcagatttctccacttgagaaaatgaacatggagacttcagacctcagcctttgggtacaactttgtgaacattttaataggtgtggctt

SEQ ID NO: 53872 - DNA, 1378 bp, Bovine  19866881323282
taaagaatgatttcagaaatcttttgagagagataaataactcaaagtgatgaattattgaatctttaggggatatttatttatcaggcagtcaaaatttaccattttaaagcccattccatttttctttcatattagcgtggttgtcttcaaggtgacatataaccacccaaactgaatatgcaatcaacttgtgccttaatatgagaaaacttgataaatctattacatttaaaaacaaaccttcatagtgttaagtctgaaaaaaataaaagcccaaacaatctgtaatgaacagggaaaatctggcttcattctgacccaaagtattctagatagctttatgattgaatcctacaccaggagaggaagcccttaaaccctcggacttcagactcctactgacaggaaggaggcttctttccaacatcctaagagacgttcttacaatcactcactgactcttgcaccgccaaaagcactactgcccagaccgtagttggatttagctcatgccttgttcaccagccctggcggctcagatggtaaagaatctgccggcaatgcaggagacctgggttcaatccctgggtcaggaagatcccctggacaagagagtgggaacccacaccagtattcttgcctggagaatttcatggacagaggagcctcgtgggctacagtctatagggttgcaaagagtcggatattactgagtgactaatacgcttgttaactataacttgacccattggatgatacaagctcaggtctctaagatgactaagactgtcctctaatgtctcttttgaaggaaaagcttacaaatagtttaatttcccagataaacagtctatcgcttggtttaagtgtctccagtgccttcaactatcttcgccctttggcagcccgcttcccccggccccgggattttcccttccatttttcctcctacatgtggctccccaaactggacacgctactccaggtgtgagataaacagcacagagcataaaaggagaacatcgaggagctcacttgtcttcttctggacactatctacttgaagaaaagactagcctggagaggaaggaaaaagatcacggctcaaaaaacaacaacccacaacagcagccttataatatgtgcctgtgacattagtctaggccaggggttaagtttcccagaaataaaaggggagctaacacaaataaagacgtctcttccctggtccagttgagatatcttctctttaactcaaccattaggaaccaaattccatgctaccacatcccacttgcacacacaaatagaatctctgctaatgagcccagggaagccctctatacctccagcgaaaacaaaacaaagcaaaaag

SEQ ID NO: 53873 - DNA, 1335 bp, Bovine  19866881667130
ttctttttttcctccctaaaattattgggtccaagaaaagtgcagcaattaaagtattaataactatcggaaaacttagctaaaaaaaatacagaaactctatgaatgcaatgctaaaattttctggaaaccttttttattttaaatattaaattgtatttcatgatactggacaggagaaattaaattacactgcatttaatgtaatgtcaacctaaatttcatcagtttttttcaacttcacaaaattattcttaagttcacctgcaagtacatacttgagaattactaggagtgtttttgaagagaaacctaatgaagaagaatttgcaataacagacaaaaaatatgaagttaaaataatcaaagcagtgtatatctgcactgagatgggcaaaaatgtcaatagaacagaatgaagaattcaaagctagtatagcgggtttagggtgtgatagatttgaagttatacattggtatggaaggaaaggattgttaaaagattgcatttaaaagactgcctaaaaatgtgaaaaagatgaatattggttgctactacattattgattttaaaataaatgtttaaaataaaaattttaattaaaaaaagacaaaacagtactattctgcaaggcaatataaatatatattttatctttggttgaatatttattattaaacattataccaaaaatagaaacagttaacaagtttaattgattttattatctaaaaattgtcaaaaattcatagaaaaataatattataatcagtgttaacggatagacagtaaattggcaaagcagttggtgtgacaaacaatagcaccttaatgttctaaagtgttaatagaagaagagttctcagctgctaagtcgtgtccgactcttttcgagcccatggactgcagcacaccaggcttcctctgtccgtggacttttcaggcaagagtactggagtgggttgccacctgggaagcctgtcccttctatatacgtacattgtttaattgtgcctttattatgtttaaagcatttatgttatatgttatgcagcatcacacacataatattatatttatatattatatgacacacatgtattatgctataatatataacatgatatattatgttataatatttataacatatttgctttattataattatatttattatgtaccatgtataatagaatgatgttgaatttctttttagtgcagcttctttttttaacattttattttgtatttggggtatactcaagtaacatgtggtgataatttcaagtgaacagcataggaattcagcagtacgcatacatgtatctatt

SEQ ID NO: 53874 - DNA, 1008 bp, Bovine  19866881707326
gtgggagcagagatccagtcctccgtcccaacacaatgcatagcttcacaacacaaacaaggctccagatttgactggatttggtagtaaactattctacgtttcaggctccctaattcaacgaagcatatttgacttcatcttttcactctgactttgtcacttacctcactgaaaacatcggcacctccaacggaatctcgaggcttctttgaaaggactggcctctgttgtcaccggctcctgtattaattgtggcctgaactttattgaatttacccaagtgctttgctggagcgtctccaaacactaacaggcaaatgaaattaaacaaaaagggccagctctagttaagagcatcgtgtaagtgctttggagaccgggcgtaattaaggaggctgtaaactaagaatgccaagcacaaatgtcaccctcacctgagtgtgcccggcgaacgggggacacgggcagaattcatcccggagcgggacagcagcagccaggacacaaggctctttaacggaaggtgggcttcccagcaaggctgagcagacgtctggagaattctgagtgtgcctgtcagggctgtggagcgagactcactcatcccctcgcaaggaagccttccagctggacacagggagcctgggactcaggccacgtgtggatgcgtgtccaatggcttcaccctcagttcctggtccagcctgacatcagttttgccaaaagacttggacacaaaccctatagtatgcccctatttccagttgccaccccccgagaactgcctggaggcagaggtgtcagcctgatccgcccaggtcccagttcctaaccaacatttagaacatcgtcaatgctcagatggccagaggatgagtgaaggaggaaataaatagccagaaagctgcaagaaaaaaacatttttatgaaacagaaaataccttggtgatcaaaaattacacccttttctcatacaagtttccctgatcacttggtggtaaaaga

SEQ ID NO: 53875 - DNA, 2366 bp, Bovine  19866880607647
tacagtcccttctgctctctcatcctgaatggcttcatggcaagttttctcggaagcttgctgttgtctggtatctagcctttcagtttccccaagacccccctcaaggatgaagtttctgccctcaggttgcatttcctgaattggagtgggggtgggggtggggtattgaaactggatccataacctgatcttcttttttttttgaagtatagttgatttacaatgttgtattactagctcgcatggtatcacttatatgtggaatctaaaatacagtaggtaacctgatcttaacaggacagggaatactttccaacatgggctgaaaagtgaaagggtcagtgtttgacatgaaggaggccctgcgtgtgcccatcctccgctgctctgctcaccctctgagaggaaaccaaacatgggggtggggggcagctctggggaccggtgcccactcagccctgctgcctggcatcctggagtcatcttcagttgtccttttccccatgcgccccatcgccacccacctctctagtagcctggctgcctcgccatctaccatgtcactgtactttcatgttttgtgattgtggttggccaccttccttgtttccagcccccttcttctctgcccccatttctcactggtggcttgcaccccctgtcccccactttcctctaggcaccctcatgcatcagagcccttgagatgctgaagctgcgctgtccactctcagtggggagggcatctcccccgcccctccatgtaatgagtccacccagaagggcaagctgtgcagtgcctgtaaaacatgggacccctggtccatgtacccacagtctctgctcctaggagattcggccgtgaccccagaaggaccgggccccagtgaaacatgggacccacgggtccatgtacccacagcccctgctcctgggacactctggctgtgatcccacaaggactggaccccagcaaactgcagacagcaagctgagcttgcaccctccttgctcagcctcccaccttccctttgccttttttgctgagttcaagttctcatgtaggctcccttgggcctcaggatgagttttcccctgggagattcctcaatcactcttaaaaaataagttttagggactttccttggtggtccagtgtaagactttgcaatgccactgcaggggccacgggttcaatccctggtcagggcaataagatcccaatgctgtatagccccccgcccctactcaaaaaagaacattttggaagacctgccttacctggtcatccctggacagatctaaccctcctacatgtgagctcaagtcaggtctacccctctgccctcctgcaacaggtgcatggtgttgatctcccagcccagattgcaggggcgggggggagttgggcacggaggagacatggggaggaggaggagtgtctgtcatccacagacagctgtgctgaggtttggggtcaggactgaagtcaggcatgtacgcccctactgccaagtgggctaggcgtcggccgccttgggccagagcgcccttcatatctgcagccatagtggcttccaagtatcaggtcaccgtggagcctcctgcaggagcagagaacagacggggccaccttggggggcctctggacaacacagactgtcctgagggcctgaggctccggatggggctctgctggtgacaagtttatgttgagcagcatgggaggcagccagtcctccctttgccttttttggagatggagaaataagggctgatgctttggggaaagataaagtggagaatatgcttctcattacacgggcacggagacagatgagaagggtcaggcccgggtctccgcggctgcggcttcagcaccaatttcctgcggcagggcggctccctgaaccacgcactttcccgggaatctgacactgtggactcagggcctgggaatgaggggcccgcggaggccagagtttatctccgcagcttgtttctttccttctctcttaatctctacccaccctcgcggcccctgtgcccctgtttctgttttcctgcgacccaactgtccagacagggctgtccctgccccgctttgtgcactgtctccagagtcctgcggctggacccgccagcccccacctcgttcatctgtccagtctgtgccacggctgcccggcgggcggacgagaatcagaaacctcctggcccggcctcgccccttgggcatcgcggggactcggtgaccatctgctttcaatgaagtgtgggtttcagcatgtagtatggaaacagaaacagaaaaaccattgggggtccctcctgcaaaaaacatcatcacccaccaaaagggg

SEQ ID NO: 53876 - DNA, 1155 bp, Bovine  19866880703202
ctggaaggagactaaccacaccccaatacatcacctgatcttctattgtggcaactaagtgttgtcacaatattttagattatttgcatacttaggataactaaacaaatatatcccttgtcattcatacctcaccaattaaagagagagcatctctggataactacttactgcacacaaactacatttctacaagaattgaatttagccagtactaatactatgatgtttcaagatgtaacaaaagaggggcacaaaaattcagctgtcaaaaatgttaattaaacagaacattctttgatataaattatagcaatattttttggatctgtctcctaaagcaaaggaaataaaagcaagaataaacaaatggggcctaattaaacctaaaaacttttgcacagcaaaggaaaccaaggacaaaacacaaagacaacctactggacaggagaaaatattttcaaatgatactaccaataaggaaagggtgaatattcaaaatataccaacagttcctacagttcttcaacatcaaaaaaataacaacccgattaaaaaatgggcagaagacctcaactgacatttcccccaagaggatatgcaaataggcaacaagcacaggaaaaaatgctcaacatctctaatcactgggaaatgcaaatcaagactacaaggagatatcacctcacacctgtaagaatggttatcatcgaaaagaacacaaataacgaatgctgatgaggatgtgaagataagggaatcctacactgttcgtgggaatgcaaattggtgcagctaccatggaaaacaggatggaggtttctcaaaaaacttaaaagagaaccaccatattcccaagcaactctactcttgggcatatatctgaaaaaaatggaaacaataattcaatgagacacatgcatcccagtgttctcagcagcattatttacaattgccaagaagtggaagcaatctaaccatctgtcaacacatgaatggataaagaagatgtggtacacacacacacacacaaaacggaatactactcagtcataaaaaagaatgaaattttgccatttgcaacaacatggagggtattatgcttttaagtgaaattaagtcagacaaacacaaacactgtagatatcacttata

SEQ ID NO: 53877 - DNA, 1830 bp, Bovine  19866880837356
aaaactccgaaatggctcgtaaagagaagatgagtcattcagagactaaacagactttataaaaagatgtgaaagtgttaggaattggaagacacttggcatcctgaaaattgtcttagaaacaaaccagaactctttcattccctcattcagcactttttgaacatcaaccaggcactggagacacaaaggtgaagggatccagccaaacacaaaccctgctttctttgactttaccaatgaagaaagcagatgctctcactgatgaaaacacacatattcaagtaggcatcggcccaagaagttcatgtggaagagtaaatcacaaatgaatcaggtctacttggggcagagagggatggatgtgaggcaggctttccatgcagggccatctgagctgggatccaaaggggaagaggagtggagctgggtggaagaatccttctagagacaggggacagcacatgccaagtcctttggaggaaggctcatgcaccttccagaaagagacagagaattagtacagctgaagaatagagaaccaggagaagtggggttcaccgaggcagggcaatgggaaaggtccagcaggcaatctggagggtcacggcaattatctgggctttcgtcccgagagcagtaggacatcacagagcatcttttgcttaaagtagggatgggatgtgaccaggagctggactcttcagataaccaacactcaccaacctgtgtgcccaaacatttatatttttactttctttgaaggacgaagacctggatgaggctggctcttatcctttctgtccattcttacacctctgaacccttaacattatttcaatggtccaaggcaccaaaataccatacttttaagatataaaggctgcttgtcctgtgttcagtgatcctagaccgtttttctcttttggaaaaggattttaactcttcttttccatcatgccttcctctcactctaattggatgcttccaatctattgtggaacgaaaaaccagagaaccaaattgagaggcttcagctgagctgaagttcatggtctttgtagctccccggctacctcatgggtttcctcctctgccccagtggttcttcagatggcagggtggctacagggagctctaattggtgcattacagttgcactgtccaacatggtagccactggtcacaggcactattttaaatttcaattcgtcaaaatgaaataaagttaaaaaacttagaccttagtctcaatagccacatgtcaagtgcttaatggtcacatgtggccaatggccaccatatgagaccacacggatgtgaatgcttgtattatcccaggaagttcaattgcacagcaccatctcagagtgttgatggagaccataaaccagatggtgcacactattgtcattcatattttttaaacatctctctgacagtcactccaggcatgtaccagcctttctggttccttcaagtgtacaaaaatacaatgtgtaaattattcctttcagaattgttataattaccgtaatgctattgaaaaaagcactcagggatctgctatttccagcagagaaagactcaaagctaattaaaattcgacagttgctccctggaaaatctgagcttgattcaccttcccacagtgtctccaaatagatccctgtcacacacatgtcacgcagccttaataatctagctgagaaatttcaagacacccgcatgagccttcctccatccatatctcaaccaggtacttcaggaacctgagaccttggcacaaaaaatgctcattttctgggggggaaaaaaaagcagtttgtt

SEQ ID NO: 53878 - DNA, 2462 bp, Bovine  19866881082249
tgctgtattcttttttaaaaagttgttttttgttttttgttttttttcctggaactgatttgtccaaaacagatctggggacctccttagtggtccagtggttaagaatccgcctgccaatgcaggagacacgggttcaatccctggtcctggaagatctctccaagctgcagagcaactaaacctgtgtcccaccacaactcagcctactccctctagagcctgtgctctgcaaaagagaagccactgcaatgagaagtccacataccacaactagagaggagccctcacttgctgcaaccagaaaaagcccatgtgcagcaacaaggacccaacacagctaaaaaaaaaaatcaaaattgagatttgtcctcttcaagccatcatgtgctaatgagataggacattgtcatgtggcatctctttccttaccacccctgtctcttcactgagtgtgtgggctggctctgtggtaaaggatgagctgctttgcctcggaacataatgacctgtgaacatccagtcccacagtatgaaggtgattcccatggctacccgtcccagcaaggtaccagcactaactctcagagctccctccaccttctcctgagggtctcttatgtagaaccccactgggtgagatgctttggatgtcatttgggtgtggtttcatgcccatcagcatctcggggtggggggttccactggtttccaggctgagattgccatgagatcctcgtttctcttacaactcatgtatactttcaaaagaagctcccatcactggaggtgactggagatttcattctagccagcagaaaaattgaacaaggctcttgtctctaaatattctctacttgcacacaaggcaggtagtgggatcttcctttcctctagttgctgactgagcataaattaatgccgtttacatttttaggaatagtcatcagctcatgattcatgatgaagaaaatgttcctatctctcctgctctgtaagggtttattttggtttcctggttgtttatgttgaaagttccaagattcacggccttggctaaatctgcaaagaatccatcatctaaacagcacctttctctaggtctgtagggtacagactatttatttttatctgaaagtgaccagcattcatttcagcattggtcccagatgtcacaccctgaaaagctgacctagccgaggagtagctatgcctctctgctcctaaagtgagaaggatacagcctgttcatgctggaagacagtggaagccttggagctttgtgggtgactaggtgctgctctttgagcatccgtcctgtacaaattctcaaactggccacatgaacctatcagcttggtctagtcgtgtgtctgtattgcactactttgcttgtgagtggttggaggacccctagaattaaggttaataggaaagctcctttaggacttccttggtggtctggtggctaagactccgagttcttaatgcaggggcccggggttcaatccctagtcagggaactaagatcccacatgctttaactaagagttcatatgctgcaactgaagatcttgcatcctgcaacaaagatggaagattccacatgcttcaactaagacctgatgtaggcaaatatatatatatatatatatatttttttttttttaaagaaaggcttcttcaccttgagttgagctaggtggtctaatgaccctcacggactattcacacatggtcccttcccctgccaggcacacctagagtggcactgcccatcaccttgcgctcaggtagagctctagccagtaaaaatgtgagcaaatgcctgtgagtgccggtgtgcaatgtgctacaactgctcctgacacagcaagtgtgatgcttctgattagtggtaacctgagtgaaaggaggctgagcccatctgccctggacggatggtgtgagcaagaaattctctttgttatgttcaaccattgacatttcatggttatttagaaccatacttaagcacaggctctcttgggccatgaaatacacagactcaaaatccaaggttttctaactctgacctgaaacccagaagcataagagagaaaatttacagatgactatatttttaaaagtcaaagggtcttaaatggtaagattcaaaatgcagaaagcaacagagggaaagtacactgaggggaagatgtttggagctcctggactgaaggcttgtttctctgtactcggatcatgctgttcctccacttaaaatgctgttcccacagagagactcatggctcagactctcacctgctcccagaatcagctcaaatgccgtcttctcagagaggctttcctgaacttgaaattctcatgctatggctgtcctttcctttctttattctcctaatgacgtgtccagtgttgtgcccatctatttatttatttaggtctgcccactccatccc

SEQ ID NO: 53879 - DNA, 717 bp, Bovine  19866881222923
gaccgatttataagtgtacgctgagtaatgattttcctgggggcagcagctcttatgataaagtgttactgctccagctgcattattataaacaacatccaatttatgttgttagggagcagatgcatgtctcagtaatgtgtcaccatcatctagaatgagccataaaatctaggttgtcgtgtattttctggctgtacacttcaaacaattaatattcctataaaacagtcttgatcacaagcccaatttagaaattagttgttcaatacgatgattaaattcccgagctggaacttgctgtggccaaaggtgagtcgccaaacgtgacaaatcttgtaccacttcccagacggaaggagctgttggagacgctggggatttttggtgaattttaaatgaggcaccttcaccttcagagaatgccacggtcctgcccgccttccagaggaagatgagtcaccggtgtcttcctgtatccagcaagtcagtctgtggaggcggcagacatgcccagaagggagcttcaccttgacgcatggcagagtctaccctgctctgcccagaaggcctgagatgggtaccttctccagcttggggaagccaggcagagctgcaagactggcggacccagaatgagcactggggaaatgtaaagcttgggtgatatccctctagagtctaggccaccaacaactgggtggacagagtgacaag

SEQ ID NO: 53880 - DNA, 1495 bp, Bovine  19866881266087
ttttaaatgtgatcccttatgttatctgtgtgtatgtgtattcccccatcttttaagtactcagtggagtcaaaactaggctaaagacagtagatgaatacatttaaacctttttattcacagcaaaatttctaatcttttaggatatggtgccaagatatttctaaaagagtattggaaagatgggacttgaaacagtaattgttacaccgtgaagaatacatagtgtaaaatacttaatttggaataggccaactctaaattaatgaaaaatataagttataaattatcttttctgggtgtgttttgaagtatgacacattgaaaacttgctgtaatggatgatgtgaaataaaatggagcaaattaatgaaagattacaaattaagtcagtgttacattctgtgtcaccagaactcattaacgtgtcaggtacagtggaagtcatccattttgaaacgtcctattgcacagttcagttacttggcttaggttaatgtagcttaatgattaggattttaattaatcttcacttaacttacacaaggacttggagagtatatgagataacattaatatcatctctttttatctcaaaaactgagtaaaagatggattatgaagctggctgatgccttacaatgaatttctaaatttaaaaactgatttttttattcattccatgaaaaatgtgtaaagaatccacctgcaatgcggaagacctggtttgatccctgggttgggacgatcccctggggaagggaaaggctaaagggcttccctcatagctcagttggtaaagaatccgcctgcaatgcaggagatcttggttcaattcctgggtcaggaatatctactggagaagggatagactacactccagtgttcttgggcttcccttgtggctcagctggtaaagaatccacctgcaatgcatgagacctgggttcaatccctgggttgggaagagcccctggagaagggaaaggccacccactctggtattctggcctggagaattccatggactgtatagtccatggggtcacaaagggttggacatgactgagtgactttcacacactatattttgctatattagttttcttttttttttttttttaagtgaaaactgaacattgccttagtaataaatgagtaggttaagccttaagttgattgccagtaaaggtactatgttctttgcaaaaggcctgatgagatcctggactctttctgctatcatgccctctctttattaggacagactcccatggccaacattggattgacacctatgtgatccagtggactcatttattttttttaatgctatttttcattgagagcagaagatttgtctagaatatttaaaagttaggtagctgggaaaagcaaaagctaataaaacctatttttaataggtttttatcatattatataatatgttaaacatataataacataacatataataacataatagaggtgagga

SEQ ID NO: 53881 - DNA, 2016 bp, Bovine  19866881367808
tgcaagccttggtccagcctctcttccctctccactgcctcctcgctcctgggattctagccacactgtccttttcaaaagtcccctggctcactggcttccgccgaggaaccagtgtctcttcttggaatttccccccatgccacctctcttttctctgttgatttcccagcatctacctcaaacattgtcttagtagagcctttcctgactcccagatgaggtcaagacttcctgctcattcagttccctagagttttcatccacaagtatgcatttcatccatacattagtgctcattcctgggtcgaatgctttctcctcttagaccagaaacttcatgagggccatgacaacactgtcttattcaagccatggccccggcacccagcagagaacccggtccagagtgggtactcaggaaatacttcattaagacacatggaagcaaatccaggcatgatgtacccgatgtgtgtgtatatatatatttacaggtttatatagatatatgtatttatatatatttacaggttcacacactatatcaatatttaaaatagataaccaacaaggacttactgtatagcataggaaactctgctcaatattctgtaataaccaaaactgaaaaagaatttgacaacaaatagacgtatgtacacgtataactgaatcattttgctgaacacctgaaacggtgaacctgtcaatcccaaactccctaactatccctcacccctcccacacacagaaccactattatgaccttggattcagactgtggggccaccttggcccaaagggactggagagaggtagagaccatggcacgagctgaaatgtctcccctcttttgagtgtgaggtggacatggggaccctggtggggaatgtatcggctggccttcactggttctaggaccatgaccacacaaggctagaggagtgggatttgatgaaaaaaaaagcccaactttctttctgccactgaattgtcagcttccactgtccagaagaaaccagccccccagggtagaattgcaggcttccttttaggttccagggggacacttaacaaagcctagtgggtggagggctgtctctttgatctctgtcccatccattcttcttaaaatcacatacccagaacctcccgccaatttctgatcttttgttccaactcaactagtgaacagtcataaattgctttgaagataaaagcgccacatcagtgcaccatgataccattattattttaacaagtggggtctgcacatgtctccttgacatatgagctgttcaaaatatttgtcttgtttttcaattcagctgcatgggaagaggacttgcatcatcccttgtgtatactcccacatctaccctacgtggagtgagcattgttttcataaaaatgtttgccttttccccaacaaaagaaattgatgcttctcacggggacaccactccgttagtcaaaactccagtaattattttcagaggcacatacttgtaaaatgtctaatttattgcaatgcttacaaatgccaataaaatgtataaagactatgacattcataaggcaaatgaagttcaggtcacactgaaaaaagtttggtgcacagtgagaagaaatacatatgtgaatgtaataatgggctcataaacgaacatcaggatggattccactcagagaggagaaacagaataaagcgttttatgctctagatctctttttttttggctgtgctgagtctttgttgctacacttaggcttcagtagtcgtggtacatggaagtagttgctccacagtacgtggaatctttccagaccaagaactgaacctgtgtcccccgcattggcaggtggattcctatccactgtaccaccaggaaagtccctctagattcactatttttttaaaaaaatgttggctgcactgggtctttgttgcttttgcgtaagttttctcccgctgtggccagcagcgctgctcttctctgcggcgcacaggct

SEQ ID NO: 53882 - DNA, 1338 bp, Bovine  19866881504133
tcacaacttccgttgtcatagagaagagggaataagacatttgaagtaggactttcttcctgctctcgtttactgcttccctctttgttttgctctaggttgagaacagaattagactcttaagtcacctctgtttcctagaaatcccctggccttagaagtacagctctattcgcttccctacagcctgctgctgccgacagtaggaaaatgcagcatttacatgtgagttaacacctgcgcagggaacacccgctgcgaaaccagcagacgagctgccaagcagccgcggctggtccgggtagcagctctctggtccaccctccagagcttggtgttcagtggtgagtagctgtctgctctcggttcatccccttcaggaaacactgtaggagtggaatattcaaaatactgtagcagggaagaactctttactaccagagatgatcagagaaggtttcatcaagtaggacggtaggctttgaagggaccatggtctccgtcgaccagaggagagacatcaggattatcgttctgggaacagaagacagtgtgaataggtgtcagggagatgaagtatgtttggagaaggggcagtccagacaggtggggtggagtttttgctgtgatgctcagagtcaaggtttagagagattgtgaaggacggcctgtggcaagttaggaggttgagtatattttcagtggtaaagcattgaagatttttgtgtatgagggaaataaacattaatcagttgcttttttaggtgactaatctattaataagtgtagttatcaggtgccactccttttttcttagcaaatttgagtactttaggtcccatcgttaagttagataaaatttggttgttaaatttttcacacaggtccagaagctgaccctcatacacctagcaagagtatttcacaagaaagttaagactaagtggtttaaagctattgcaccaggaaatatcatcaggtcatgacatatgattttatgtaaagccttactaatgagaaattctttgcagtatatacttgggaaggaatgaaaacataaccagaaatcacttttcaccttgggatgatgttggaaaatttattttaaatacttgaaaggcttattttagtttccatgctgagctcaattacttgtggatacatactccagcgagtataaacattacagtgttcctctggaattcccgtggagcaactcccagaaaatgtctgttttagatggaatctttaaactgaaatatctatgacacaggatatataaatcaacacaaattatttttaaaatacactatattttaaatggatcccttatgttat

SEQ ID NO: 53883 - DNA, 937 bp, Bovine  19866880392046
aggggaagactgaccttaaaaccacaggtgagggacttccctggtggtccagtggttaggactcctgcttccatggcaatgagcacgggtttgatcccttgttggagaaccaagatcttgcatgctgggtgcagcggaccccccaaaacctagcaggcggagacccccgagggtgagcaggaggaaccctgggagggtgctgatgagggagagggggctggactgggccccagactcctccccttggctactcacgttccccttggggctttctcactgccactgccacccccatcaccacgctgacctgccctgaatgttcaagggaaaacgtccctttaatatttccccgcatgttaaagagaagcagaaggaagtaatttcagaaagtacaaacaaaaagaaaaacttgacatactacaagtatccaaaatgtttctgacctctcattctagaagcaggaaagaacattcttacccagattctttttttttttttctgtttaaatctcagacacatccttgttctctctgcccactctgccccttcgccccaaaggaccctttccacttcccggtcgctctgcctggctctcttccccttcggcatcctgcctgtctctgggccagagggcttccggctgcctttttggtttcttggtccctgggctccagcacatgtgtgcttgtgccagatgaagacaaaagaccttttcttaagtcaagcttgtgctctttcttggtttgagaggctccagtttgaggcactctcctcatcccctgtggcagggatgtggtgactgacacagcagtcagcaaacccttcctgccccaggttatcagtgttccctccctggaatattctgtgactcacagaggtgagcacccccaccctttcctcatccaaaacagggcagggccttaaaaaaaaaatctat

SEQ ID NO: 53884 - DNA, 1707 bp, Bovine  19866880528409
tggatgcatttgctttttcctgtttaaaatgcagcataagagaaggaaagctccagcacctgctagctcgagacctggtacctggagacatcgtgtctctctccatcggagaccgcgtccctgctgacatccgtctcacagaggtgaggggcccagaccccggtccaggggccgtgcagacacttggcttctcggaggcaggcattctctccttcttgcacacacatatacacagacataggcatgtgtgcacacaagcagaaagttagcaagcaagctaattttaagcacaaagctcctccgatggcatttcataaattatgtattctcatgtaagtataagctaacacgttttggttatatgattttctagcttgtagcctactgcagtagagaggaattttatagctgaggaatgggtttatagctgaggaatgagggataagttgcttctagaaacaaccatactgatggcagacagaagcactgtcagactgcttaatctcaaggataacaactagtctagccgtagaaagtagcacaagcctttgttaagagtgcagtttgggacatcgggtgtggggctccatccccaacctttgcgggtctcagggtgtcacaacctcacagaacattccctgaggctgtcgaagatgatcctgaatcctcaagaaaaggaagaaaaaaaaaaaagaaaaggtgaagtcaggttcagagagatccgttgatgggagtaacctattttatgatccctgccaagaaggtttaaggattgttcaaagcttttagtgataaaggattaagccccggttatcagcctgatttatttatttaaggaggacgtgttctctgggtcaatagcaggctgttggaagggtggcctggagagaggtggggagtggacggagacaaaagagactgggagccaacctccggggtgttctctgggtcaatagcaagctgttggaagggtggcctggagagaggtagggagtggagggagacaaaagagactgggagccaacctccgggacctgcgtttacagcaccctgagcctggctttgaaggtgaggcgggggccagagggcacccgggctttccagctcctctgcccctgttttcagatccccaggcagggcacagcaagtgtaccccacaccagggtgaattcctctccgtctgcttctccctacacgagcatccagccttcgagtccagggcatgtggttcccagtagaggagccactatccagtggccaagccccacctgcagagaaagctggggaaaccagtctgacactgtccatgcctccctagggatgggctctgccctgcaacgtggaggagtccccaggtacaggggcgggctgtccacatactgggcagctgatagacaggacgcatgtatactatggacgctacagggaggcagagcggtgaagtgattagtgccctggggctggccattagccaagtcctatccttcagaagctgtgtgaccttgagcaagtagcttaacctctctgtgcctcagcttcctcatctgtcagaggggttaatgttcattcccaactcgaggggttctgatgatgccgaattgagctaagaccatcagcctgcttgcgcagcgccccgaggtggggacagagtcccgaacatcagccattggtttaactggttatcattaccaagcttgacaacagttc

SEQ ID NO: 53885 - DNA, 774 bp, Bovine  19866880547345
attttcaggttccttttgctatctcctgactcagttattcctactgaaaaatggcatatactccctatcagactgacataaaccacttcctgaaacacggaagcctctccaagcctctacaggcctcctgtgcaggtccatgcttcccaccaggttggggaagtgcttttcccttccgtttcctgcttaaatcagagtttacacttaagaaaaacggcgaaaggaacaaaatgttgacaaatgacaccatgaagatggccttgccaccaaagaatgtaaaagcagaatgcaatgcagtaatggataaacagactgtgagtaactgaaatctggctatatttcactccaaaatgctgtgtatgactattattttctgtttacagttgatctgagttccatttcatttgtggttatacaaaactacctggcactcattaagcacagacataatgacagggcagacagatgatccagaaatgcggacacccaaaataaatgaccctggggtcaaaaattggcctgtggatactgatatccttctaagaactcaaaagagaataaacttattcaaactgccgttccctcctgtttctttcccaaatttaataaataaaatgatacacataaaaattactctctcagcagaaccactgagacgttaatgcaagtcaaattctatgacagccaacatcaacagatcttttaatggagctagaatttcacacagttaaatgctgcttaaaggaaaaaaaaaagaaaataaaataagcgggc

SEQ ID NO: 53886 - DNA, 870 bp, Bovine  19866880565830
ggaaatgcaggaggcaggggctatggccccgcccccactgtgtccccccaaccctgggaggccatcgctgggaggtgacgcggtgcaaggaggccaacaactcattgttaaaccttggactcggaagggaccccagaccctcctcagcttgcaaaggagcccccatccatctgggaccccacctccctggggtggttcttttagaagaccccccacggatcccagacaggactctccgcccagctgtgcacccacaggcattcctctggccagcgatggctgctggaaacaagtctgggaaaaaccatctccaggtggggtgtgaaaggtgtgcaagggatcaaaccgagagaggggagaagcgccccagacttaccgactctgcctttggggcctctcccaccgcccacacctccatcttctggaactggaagtcctcctgggccgacagctgagggctgccgtacgtggtgcacgtgggcttggccttgctgtgtcctttcccgaaatcgacgtcgatccacagcccaaagtaaccgtgctgtcctcccatgccctgcggggggaggcgcatcagaccccgaggcccaccccagccctcaggccacaagggcatgcggaagcgaatgcaactttcttcttttttttttaaactgtgaaataataggtattggtacaactgaaggatcccactgcaggtgcctagaacactcatccaggtgtcctgagtcccacccagcagctctttctcacagggctgcactggcaggaaacacaagtcaggacctccctggtcgtccagaggctaaggctctgcactctcagtgcggggctgaggctggttccatcccggtcagggagctagatccc

SEQ ID NO: 53887 - DNA, 1947 bp, Bovine  19866880583133
catgtgtacacacgtgggtctccaagtatagttgaggagcagcatttatacacagagagccaaacgactaaagctacacaatgcaatacaggtttccactaatcacaccagcaaccttacctagaaaataacgcttttcaatagtctttcctgatggacatttgaaaaccaatgctgtaattcatctactgacatagataatttcccttaagaaacatgtgagactgtaagagctaccaagttatatcatatttcagtatcatattactggagctcctagaacaacatatatcacacaacttctgaaaagtttaaaaaacaaaagcacacatcacattctaggtgtcctccatcggttctcgagccacagtcggtattcaccctgtgccctccgtgcggccctgaaggctttcccacagcactcttaaaaggcttatgtttgttttgcaaaggatgagtcaagagtatgctaaataatcagtcgtgaaaaaaaaaatgcagaagataaattccatgtgttcctccaaatgtagaatactgcaggttcccacgaattggtcaaacttcccaaccatcatctggcttcaagctttgcaggataaggcctccttacgcaaagaacggttgagaatatttgctccccacacccagagccattcaggcatatactgtgcgaaaagaaactgaagatgaaagagaaaaggattacaaggttagaatccaaagccattgacaacaaactgcacagatcagcaatgatttaagccaacaaacatcaccaatcaccttaaatacaaaagaggaaaaaaaccttaggtgatgctgcactgagtacccgcttttgcataagaccctatgctagactctctggggaacaaaaagggggatccccacccactcaccccccttcctctaagtaggcaggacacacctacatgcagtgatacgattccatctttactcagtgtgatatgaatagcaggtcatgtaggtaagaattccaaatatcccaggaatgaaaggcaggtcaaagagcaaaatgcatccatgggtcagtactgtgagagagaactggggtttgaggggcagggtggagcttactgtactgacattaaaacagcgaatttcctcttctagatgtcatgcagctggaactttcaaatgttcttaacatataaatccacagaagagaattcagtgactgaactggaaccactaagatctgagaatcagaagttatgatcctcatcttccagcatcaggtttccatcagattcccatgtatctatcgtttggaaaggtttaggatgccttaaccttaattacgagagctgagcgcacacggctggttacctggatggaatgggaccagtatcctgtggtcctttttgaaatgccgagggtagaaacagcatgatgtgcatacacttttggggaaggcaccaaccatgggcacttgtgcagaaagctgccaggggtggccacgttggtagccacgtagaatgggattaaactctgtacaaagattcctttggaagcatattcatactgcaatgctctgctgaagtggtctaaataagcctgttaaataaaacagaagaaaagactaatttcgttgggaactcgaaacaatcaagagggaaaaaaaagactaatggtcattttgggaaaaaaatacagcataagcaaacatcagctgctgacacagaactcaacaaactagaccaaaccactgtgacaaatgttttcctacatgatgacttcactttccacctgggaacgggttaccttagatgctgagaacgctgccactgggggggtggggtttgcagcaggagccagaggagatggtgacgatggcgcccttcttcctctccaccatccctggcaacacgatgtggaccatgaggctggccgcccgcgatgttcacgttgacgatgtcccag

SEQ ID NO: 53888 - DNA, 1016 bp, Bovine  19866880591481
tggtacataataagcaatgtaaaagtaattagttactttccttaacgagcaaacaagtgattcttgaagggtgggtgactgttgtggggaaggcaacttattatatgaagattatatatagcatctgtttaagaaagattcttaaaaaaatgttctaaacacttctgtagtaaacacactgaaacctactatcattatttggtgagagaagcttctttaggttcagcatttcctcatggagtccatttagaatgaagcctaagtactcttcggcatcttcttgtcgaccctgagaaggtcaaataggatcatgttaattttaacagattactctccaaggcctgcacagagtatattatctgcatatacaaactagccttctcctgaatgttcaataagatttaacataaagagtttccccaaaaccatatggattttttcttgacaattaagatggtaaagaagaggagagggagggagattaaacatttatctctaagcaataaaaagggtgttttgtctttttcatttttgcttttctgtatttctgaaatttcctaaaatagatagatactaccttcatgataagttattttaaaagtttcttttttattaaaatgaaataaaaacatgaactcaatgtctaggccaccccactgtacaaccccaggggtcaccatgcacactgtaactataagctgtaaaattaacagcccctgtatgtctccttccatttttgacaatgggcaaccaaggtagaaaagatgttatatgtgaaaaactactcatttaaagactcagctgcctgtttcacacatcagttatatcagtggtagatgaatcacacaagaccgtcatacagagacatgagatgaggtatcatctcacatggtttcatctgattatgttatttatcatgatcgcttcacacttcactctttggagcataaccatgtggcgtgtttcagggatctgcaagctcttctgcttgtggtctctgagcagatctgcttact

SEQ ID NO: 53889 - DNA, 1235 bp, Bovine  19866880621628
cttttagttcagtgtatgtacatagccaaaaagaaatgcaatgagtagagaagaccaacagctgcacaagcatcaggagagccagaaaggttattaagtatctgggggagtgcagtatgtgatgcatggcagccttcacatgagaagagcttgtcagtgagggagcaggagtcagttcaccaaactctgaagctgtctgggtaagaggaggcacacccatgtctgcgttcatcagcacacattggtggaagcacaaatacttctgaaaatgcagaaactagagcactggtagcagaaatggatggtataaatttatctagaggcacaggaatgagattttaagtttctgatgtccagaccctgggacgtggtttctgtgaggcggtcaccgataaggccagaatactcacgtctgcatagatgttgcttccaaacacgggagcccagtaggatggctcgtctttgcagtgcgctggacagcgaactctggaaaacaagaagcgtttagggaatggttatcatcggcagaaaacaaaacttcttgagaaaagcagctggccctctatttgctcatcaagatttagtacttagatgaaaggcaattattaccacagtctactctttaagaaaaaatacatatatacctctctcgccctagcagtgataaaagatatttttccttttcttaaaagcacatgtagaattttattgacatatacacactactatatacaaaagagactttctgtaagatcccactctatactactgtatagcacaagcaactatactcagtactctgtaatgactaaggaaagagaatctcaaagagtagatacagatggaaagatcgagggcaggaggagaagggggtgacaggatgaggtggctggatggcatcaccgactcaatggacaggagttggagccaactccagaagacggtgaaggacagggaagcttggcatgctgcagcccatggagtcacagagcctaacactactgagcaacagcaatagctgattacataactgattcattttgctgtacacctgaaactaagccgacactgtaaatcaactacactgcaataaaattttttttttaaaaagctcttcatattaaaagacatgcacaaacaatgaggtgaaatgaaacaaaaatctagcagaggtgagtatgcaattgtaaggggttgtatctcccattcttgggtgtttgccggttcacactgcg

SEQ ID NO: 53890 - DNA, 1125 bp, Bovine  19866880681299
tatttgcagatgatgtattcagaagctggaccatcactgcccatgctgatggaggagaatcagagatttttgtggtctttactgtatatataatgcagacctcagtgtgtatgctgattctctgtaggctccagaggatcatatcttgcgttcaagtcttgcatctgagtgtactggtcagaaatacagtgatttttcacctcctaactacaatcctgttgatcttcctgtgccttgagggccttctgtttacattttcactgcatttatgtttggcacccagatcttctcaacatgtcatgatgaaatggagatggagaagctgaaaaggaagaagctgacatgggagcagaggctgcgatgggaagggatgaagtctgtcttggtgggcaggggcttgctgctttggatgaaccactttgtcagcttccagtttaggtggttgcagacaagacccaggaaaggggctccgagctctcaatgtgaactcttctcaaaatgctggaacttgttcacagactttatttatttggggtcgaaaagggtatcaacagcttatctgtggccaagaggacagatggaacctacacaaaccaattgcctgctcaggcagagatttcatatttacagtcacagttgccacatctcccaccctagtagctgggtgacactctgctcactgtcactgtccagtaatgaaatctaccctggaagttgtttcatgtgaaataaggggctcatcttcattggcttcattaccaggatctccttgcacttttcaacctggctgagacatggttaagtcctctgcatctcatgtttcttcaggccaaatggctcttcctcaagataccccatgatgcatttcttcatggcttccaatttacttaaattttatgctaccaaagtaacctgatgtctatcataaattagcagtcctgtcactctatgatcttagcagagttacttttcatgatagagcttgttgctatgtcactttgtcctattacatttttgccccgggtcaccccaactggaatgtaaactccctacagaggagatgttgccattctgctccttatttcctcagaggccaaaatgccggcacagagtggcactcaatta

SEQ ID NO: 53891 - DNA, 898 bp, Bovine  19866880689912
tgagaaaggtgcacataatcataccagaggaagttttatttctttatcccatgaaaacatgattaaattcagttaagtccctgaatgaagcatccaacttaaaacacagatcaaatgggaaagatgacttcatttttaaatcaggcatgaactgaaatctcatctcttaccactcacgaccgcccatcttccatactgcttgatcaggtccgctctgctcaccaggcgcgggatgaaatgcagcctgatgaggctgtagaagtcacagacgacggtgatgctttttctggccgtgtaccaggctccaaccaaggcgagggcttcaatgtagcagttgcaggacctggcgatttcccggtacaagaggtagaagctgtcgacggcagccatggcagcctgcaggggcggggagcgagagaggtggtctttgcttagtaactgaaagggacacacacagtttggttgaagaaggacatttgagacatcagggcttaataattttgcatttaaataacagtaactgttcaaatgcacgtagcccgtggatccagtcaatttatgatatcattacttaacatctgcagcttacaaagttctttccatccaagaagattagtcaacatgattatcaagagttaccaaattcctactaaaatccaggcactgagctaaatgttatggatacgacaataaacacaatatgctctgcgccctaaggagttcccggcccagcttagtgacaggcagactttttaatccacgtaacagctgagagtaatgtttatttcttttattgaatttattcatgcaaaaccggcaagcacagaggacctactatccctgtaaagacaaagtataaaaatagaagcactattaagacgtagcctggcctcaaagg

SEQ ID NO: 53892 - DNA, 1405 bp, Bovine  19866880720207
ggggtgtgtaccggtgatgctggggacgtgtaccagtgatgctggggacgtgtaccagtgatgctgggggcgtgtaccagtgatgctggggacgtgtaccagtgatgctggggacgtgtaccagtgatgctgggggcgtgtaccagagatgcagggggcgtgtgccggagatgctgggggtgtgtgtcagtgatttgggtgccatgcctcccttcctacctgccctgctaacctctgtcccagagatctgccacatcctcaccttcaacacttgtcagtgagctactagcaatttataattcctgccccctgcaaagaaaaactaaggcaattgaaaccaatatagcaagccaaagctgctcagtttcccctgagggagtacacatgttccagagtgtttttagacactttctctgataacagacaggctggcacatgacagcagggagtcttacttaatgttcagcccatcagggaaggtgtcggctctgtgcagcaagctggaaatggccaagaaatgaaatgtctgttcatttacaagaaccgtggcttttcctgaaagcaggccttgaggaagatgaccaattaggaaaatcaacgtttctggggcagcctgttcacatgtcttagaaaactcaggacctctcctcgcacacacgaggtacatctgggttaacgggtgtcatctggcagctaggatgtggagggcgtcctatgtttcatctgcccaggagggtccaccctggctttgcccccatcagcgctctacctgacgcccctctgatcatgatcgtgttgaccagggaacatgcgttatgacccttgagaagtcagcatcctgtgcggactcagcgtagggctgggaacacagccactgacctcgcaggcccagggatcccatcttcttctcctcctgctggcagaaggctcgctgctggggcgtcagcggcagggggatgcccccgtggttgtacatggtgcagtaacgaatcacctcctcaaaggcccccttcatgaagtacatatcttcccgctccttggaaaatacagagggaaaaacattggcagtcactgcctgcttcagctcctggtgaccatcacctcgtccacacgggaggtgttcacggtggggtcattgatctgtttcagttaacgatgatggtctgggataaatgaccccaccgggaagagaagttacaggaagtccatgtgatggaaccacacgcagcccagagagggctgatctgtgacccggacacccgccccctgcatcagggcccctggtcagttgttgctcagagcatccacatgtttcatgaactggtcatatcccagcttttacatgtgtgactgactcctaggtgtccagttcagggagacttccaagcgagggaggcaccatgaa

SEQ ID NO: 53893 - DNA, 1388 bp, Bovine  19866880733087
tctgcatgtctgttcctatactgtatgcgtttttttgtgtgtgctttatacataaaaggactagattttttcaccccttaaggacccattttcacgccttgagtgggcagtgggatgcattagggttggtttacatctggggaagtagaggctcaggcctgtccaggaactgacctgaaagcatcagagatcaattgaacgtcactggcagggacccgagggctggccgcccgcacccactcccaggggctccttctgccagctcttcaagtctgaaacattcctcctggcagaaaccccatggcctttctccgtgacctaaacgctttggatttctcatctgcccgaggtggtttgaataatgaataatttaaatggacagagctttgcatagagattggtttaggatgactcactgaaaacatcccatttattatcccagatggacttaggcgatattaaagattcatacatccgaaagaaagagatcccgttcagttcggagcagaagtggatggcagttcagtgcagctccaagaatgaggtgaggttgtcttctctgcccccttccagcccccacccccaccccagcaaagcaaaatgcagaggtcaggagatgagtttcaagttcccagctgcttctatgacatccgaagacgtgaaaatacagttgatggcgatgaaagctctgagtatcttggggccactttcgagattgtcttctgaatctctggtcctcaaagtggggtcccagaccagcagcagcatctccttggaatttgtttgaaatgcagattctcaggctgtaccccagactcagcatcagatgttccaggggtggagtccagtcgtctgtgtttgctgggggttctgatgcaagttcaggtatgagactcagcggcctgccgtacagtgactgagtaattcctaccagagtgactacaggctcctactgatgatgctgagcccgttgctaacttgggctccttttgtcacattgctgcatgctgggttctttacacgtatgagctcatgtaactgttgcaatgggggaacgatccgggacgcacccctcgtgcccaccatagacggatgacctcacgtgtgtgtgcacatgtatgttctaagccaccaaggggaatatgtaccaagctcttaccagctatccctgggtgagacagcccaccctatcttccccctccccttttttttacattttctgtagcttttcagatcttctactgaaaaaaaaacaaaacaaaacattttctttctcttttaaaaagatttttattgccttccatcttttgctccaaactttctgctcttgctggaacctgccatgtcttgtctatgctgagattttccatctcattcacggtggcagg

SEQ ID NO: 53894 - DNA, 819 bp, Bovine  19866880859702
tggaaggtgtttccttgtgatttttgtccttctattgcctcctgttccccatccagccctgcctccctgctgcttgcttttccttcttgctcttggttttgaaactgtccttacaaacaggtaccactttcagaaatgcttcccttcttttaaatttcattttcatttaccattgtttcctaggaaagtacctcctgacactcacagagaccaggtgaggctttgagaacagtctcccactgtgtctcgcagtcaccttggcaaacgtaaagcggcgcttcctctacctgtcagagtgtctgggcgagcatttgattagctcatgtcatttgtattgcagattccaccttgtgcttgactgattactcacagaaccgagcttatgtctagtgtgactccttctctgattaaacccagacccagggtatttaaagtccattttaaggatcacaccgtgaaatgagtttgctccctttgccggcttgtcctgtaggtgccacggacgggattggaagggcctatgcagaggagctggccagccgtgggctcaacattgtcctgatcagccggagccaagagaagctgcagatggtcgctaaagacatagctgacacctacaaagtggagactgacatcatagtcgcggacttcagcagcggccgcgagatttatgacatgatccgggaagccttgcaggacagagacattggcatcctggtgaataacgtggggtgtgttctacccctatccgcagtacttcacgcaggtctctgaggacacgctctgggacatcgtcaacgtgaacatcgcggcggccag

SEQ ID NO: 53895 - DNA, 1493 bp, Bovine  19866880944378
tttttacacgggtagaatttgtggctttgcagggtgttcggtttggtggtctcaagaaattgtattttggttgccttagaagaattaatgaatgtacaaatttgggggaggggggccggaggagaaacctttctgtgtcagttttctttgagaaaaggaactctacttttccaagttacttgagctgtctttacaggtttgcttgtgatagaaggaaaatgtcctttggatcaactgaaatccatcattacctccagctcccttgcagaattagatctttgatgattaagtgttgataattcactgggtatgttctggctgctaatgttactgaaagctggttatcacgtgtgtgctatttttttcatttgttgcttttatattgtaactgtatgacacccaaagcttttctgtttcttatctcttcttaatttcctgcatgttgaagtttttttccccttctgtttttaactccataaagtattcaattctcgaaacacattaaaaatgatttgcctgctagggtatggcttattttataattaaagccctagtcttgtgtggttattatagtaatcttcagtcctattttctctgcccaaatgaaaaagagcccctttgcatgttgagcccaaatataatttggaaattaaccagactgcctttcggtgtcatgggaggcaagggcattcccagtcagctctcactatgctcctaattactgtattttaccagaagtttcattcagtttcttgatgacagccctaagtcctctgacctgaaatgaaactatttccttaaatttgtgtccgttgggataatctgattagaaaagaaaaacaagcaatgggttatctttatcagaaagatacaataacatttctgtaagaacagagttcctttaccacccttagggcccaagaagaggcaaatagatagctctgatgccctgcaggggtttcaaagcctccaccagcaagcagacaagcccagacactgtggttgggcgtcacttccctgagcctttggtaattcagctttgggagaatggtgggaagaacctgcctcagatttgcctctgagccactgagctgccccagatgggataccaactaacagatggtaaattctccttgattcttttacttccagaagaatcttaggttagaaatgagatgcctcccattttccagatgatgcacccaaatctcgggctaattatattacccacattgaactacctcacctccccagaaggtccacgtccttttgggttctcttgaacagagagagaaccttagacaaggacttggaggcaggtggctgacctggggagctggtctcacagcccaggaagccgagcgagaccaggaaggaggaaaagctgctcacagggggctttatctatgactgagtattgagtcaccccaagctgtggcttatagccatagcagttatttttggtgatgaatctgagggttgactgggctgat

SEQ ID NO: 53896 - DNA, 1800 bp, Bovine  19866880963021
gtgagtgtcgcttggttgggaggggtaggcggcagcaggccaggaactgactcctgggactggccagcttgttgcggggcctcggcccgtgtctgcagagcagccaggagtctgtgtctcgacggtccttgtgggcgttgccggggcggcgggggggggtgctgtctggtctcctgccgtcaggggcgggaggggagtcctcggtgccttccgttcccagcctcacagcctctctgaggaagacgctttcagtggggaggaccgcttcgctttcctcctccctgcagcagggatagcacctctggggggtcagcagtgctttctagtgtgagaagcagctcgtgcagatgccaggccacagggaagcacaggccttggagccctgggagcagctggagctgcggcctggtcttgctctgtcagcaggaggggcagggcatccacattgggctgagctgtgagcagttcttgtttttgccaaaagttccactttattctcctcacatctcctgaagtcagattcccatctagacctgttagcaaaaaacacagtaacactccaagagcagccatcctcgaagaaaaatacttagcaactgtggaaagagaattttcgttactgtttactaaaggtctcttctctgcactcaggcagtcagagtttacttgaattaatagcatgtaggcacacaaacgcacatgtgttaaagctggtgttctaaagcaagccagagcgtctgggcgctgctgcctgagtccagctgtgttctgacgatgagcccccaccaggcccgccccaccagggtggcgcaccccacgcaggtctccagacagaacaggcctgctgacagtgggtccctcctggccatgcctctaggccacgcagcatcgagtgcctgctggacccacctccaccctccccttctcccagccaggctgcgtccacctgtcaggaacctgtaactcctacctgcagcctctgaggtcagctgtattgagttagtaggaaaatatgttttcctggtcagttagtgtgagcccagagtccgtgttctcacagccacttggaaggaggtaagtggtcagtcccgagacaggagcagaaatgagcatatttgcctttgtcttacacgagttttactgaagatcccattaggtacagagcaaggttggaggttgtgtgattgcactactatgggttagggatcgtctggttttctttcttttgctaagagcagatgagcaaatacgtggttctcccccccagcacagtccagaaacgtgaactggtgaacccagccagcatgaagcaggccctgatcgcgtccgcccggcggcttcccggtgtcaacatgtttgagcaaggccacggcaagctggatctcctccgagcctatcagatcctcaacagctacaagccccaggccaggttggtgttcccgcctttctcctcttcctgggctttctcagcacaggctgtttgcctcaaaacagaacccaccccaccaacaaggcttgggggccttggggagcttcgtgctgctgcttctgctgggacaccaggactgctccccacttccctacatcctgccgtttgtaatgtcagtgatttagagtaatgaattcctgcttttttttacttagtaaaacttttttttgaagtaaccttaaacttagagaaatttgcaataatcatatggacgttcttatatatcgtacatcaggactccagccctgccctggcttttccgatgttggcatcttacgtaaccatcgcacacgccacgagcctagcagtta

SEQ ID NO: 53897 - DNA, 1685 bp, Bovine  19866880964900
cccaccaccgccgctgccgctgcggtgggtccttcttacaaaggttttcgatggtcttaatgtagttgttgctgatgttgagagcatccagtttctgcagaggttctaggttctcaatcttatggagcaagttcacttgtaagaagaggcagcgcagttccgtctgggcctcgagattctcaattttctggatgccgttgcactccagccagaggcagcgcagccccgtgtactcttctaggttctcaatgcggtcaaagcctggtgggaaggaagtgggtatttgttgggctcccacacacacagaggcacaggtctcaccgtcttttatgcctactcgccttggagaaggaaatggcaacccactccagtattcttgcctggagaatccaatggacagaggagcctggtgggctagggtccatggggtcacaaagagccaaacacgactgatgcgactcagcacgcaggcacacacgcccagcatccacacattcctccttaggcacaccaccgcctctctgagaacaccgcgtcctgatccttgccccgtggctctctgcagggagctggtcgtgctgagccacatggggccaaccttcaggaaccctgcggagctttggctggctctactggaaagaggtaactttcttcgagaattgccagcctggtaggggggagcctaacttcccttctcgcctcggagtaggtgggagtgaggcaggtgccctgcctgaaatgaatgagcacaagggaacgcagggcttcagaagggggagaggcagcctcgtgaagacatgcggtgagaaaatccagtggtacctgaagccactgcaaacttcgggtctggctttctggtatggctcagttttatgagccacgtttaaggagaggaaaaccaacatttttgtttccttgagtaactcgttatagatttgtacttcacggttcgtctgctgttgccaaatgttttgaaagtcatttggttgcctgaaaagttttaaccggaagtttgtgggtttttttttttttttttggctgtgctgggtcctagttgtggcatgtgggatctagttccccgaccagggatcagacccgggcgccctgcgttgagagtgcaggatgttagccaccgggccaccagggaagtcccaaacccaaagtttttatgaagaaagggtgaaagcaacggtgaggcagaatcacccgactaaatcattcccaggtcctgaccctcagaaacagtatcaaataataatttcctaagttggtaggcatggggttaatttgctaggcagcagtagataatataggcacctctctcgtcttcttcttcccacctcttaaatacgggtcccctggggtctgccctcctgtgtcatctcatcactgctacacctagacactgagaggaggatttgggagggggcaatgtggatgtgaggagaccaactaggggtccttccccacctttaaaggatattgcagctgcagccctccgtgaatctccctggcacagtgtgaatctcctcatggtggccgactgtcccccaagacaccaagagcatcctcagcatatccatctttgtatctccagcactgcgccctgtgccggcccacagaaggctctcagtaaacttttactgaataaagggccacgtggatggcccaatgaaacaggttga

SEQ ID NO: 53898 - DNA, 1331 bp, Bovine  19866881050956
taagtttgcagctatcacgctgatcttttgacactttaaagactactttgctagaaaagagcactggtatgccaactgtgtgcatgtaatacacacagataaaaagcagcatttctccataaaacaagtacaagtggggaaacaaaactgtactaccatcagagagagaaaggcaggcagctaggtgtaaaacttggataccaaaggcacaagagtggggcaccagtctttctactaggaggtattttcattttcaatgcactacttgtgagactcttaaattaaaccagagagtgtaggcttatgagatggtgagatggtccttgagctgataatcagaaaaataaagtgagaactgacctgaagaatgacaaccaaaaaaagctgcagacaaagcccaggagggagaggcctgaagagggagagcagaggagcagccctgggctagcacgtggtccgagcacctcgtcatctctcagctctcaaggcagccagagagggcatgtccaggaagactggctgtgtcctgcccaccccaaaccacacttccacctctacacctcagcaagcctactcccgggagagggcaacccgagcacagggtctttccagacagggagcagcatggagctattggtttctcgggtcctctgctgaaaatggggtcacgactgaggagctttcaaatagtcagaaagtggcccactcatgcaaagtctacgctctgaagactccaccttgaggcttacgacagatcctacagtgcctgatccttgaaacaaacagtactataaacctaccccaagggctatctttactttgcctacactcagttcttcctccagcctgcactgacagaaaagatcacagaaagacctattgggagatcacgtcaaaaaacaggaaaactgcagtccaagcacatgcaagtctttggaattgaacatctacactgctgaagtagcactaaagtgacaaatgacagtaatcccatggcccaaggccaggaaattccactgcaaacagatttatctgttttgtgccacagtgattcttgcctgtgtggcagtaaagagaactgtgacagcgtaattacaaattcaaaagcaagcgcttcccactggttttcatacttagtgtattgtcagggaagaagtgtcctcagcaaccaccttcaatgtgccacttgaaaagccagacctcttaacagcaagcacttgcatgtctgacatttgtaaaagcacaaacaaacaaacaaacaatcttgatgtaactacttcaggttgaaatgatacaacttttctcaattacttgatattatagtctgagca

SEQ ID NO: 53899 - DNA, 1608 bp, Bovine  19866881055905
gggggtattggcgatggtgtcgttgtctagactcgtgttcaccgctcttccctgcaagtgggtctaaacattttctttgctgcccatgtcactcacctctgtccactcccccttccagcctgcctgccagtcctgaacacactccagatggcgcacaaccacttagagaccgtggaggacattcagcatctcagggagtgtgccagactctgcgtccttgacctttcccacaacaagctgagcgaccccgagatcctgagggttcttgagagcatgcctgacttggtaaaaaacaaacaaacaaaaatagaaagaaacacgcacaccagagacttctctggtggcccagtggttgtgactccgagctcccagggcagcgggcatgggttcagtccctggtcgggaaagaccctgagtgctgcgtggtggggagtggaggtgggggacaagcccccggacacaacttgtgtccccttgtgttctgtaggcagcaaatctcttttcttctcccctccctcccctcttcctttctccccgccttctgaacacccatcacacttttcctctctatttttagctgctgtgttttaaatgccaaatgctgtgtcatttcacctacaatttcagtgtgtattcctgacagataatgactttttaaaaacatcattacagtactgttattatacctaaaatagtatcagaatggcagttaatacccagtctatgtccaattttctccatttgcctcaagcatgtgttttgaccattggattcagttcagttcagtggctcagtcgtgtctgactctttgtgaccccacagaccacagcatgctatgcttccctgtccatcaccaactcctggagtttacccaaactcatgtccattgagtcagtgatgtcatccaaccatctcaccctctgtcgtccctttctcctcccaccttcaatattaaccagcatcagggtcttttcaaatgagccagctcttcgcatcaggtggccaaagtattagagtttcagcttcaacatcagtccctccaatgaacacccaggactgatttcctttaggatggactggttggatctccttacaatccaagggactctcaagagtcttctccaacaccacagtttgaaagcatcaattcttcggcactcagacttctttatagtccagcacttacatccatacatgaccactggaaaaaccatagccttgactagatggatctttgttagcaaatgaatgtcttgctgtctgggttggtcataactttcctttcaaagagtactgtggtcaccatctgcagtgattttggagcccaaaaaaatagtctctcactgtttcctctgtttctccatctatttgccatgaagtgatgggaccgtttccactatttctccatctatttgccatgaagtgatgggactggatccatgatcttagttttctgaatgtcgagctttaagaccatcagattttaccaatccaaaccagacccacacattgtatttggattatgcatcttattcacagccctccccgcttgtctctttctcttcccgccaccacccccccgccaagaatctgctgaagaaaccgggt

SEQ ID NO: 53900 - DNA, 932 bp, Bovine  19866881077291
tggggggggcctgagcgcccaccgctgacagcagagaacccgtttccaggcagcctgaatacccaccactggagggacccccatccttagggcagcctgagcaaccccccgccagggccactttgaaaggacatcctgagcacccaccttccctggggcaggatctcccgggtgacctcttagcagagctgttttcaatgggtggggtttcctcagcacagaatagtgaaaagctaacttctgcttttcagcatttgcaaaagatgtattcggaaaatggaccatcactgcccgtgggtgaacaactgtgtcggagaaaagaatcagagattttttgtgctcttcactgtgagtaaagatactactcctgtagtgacttgtgttgagtcttaattctttatatactgtcttacctggagcgagggtacgtttattctgacatcagacctgcagtcccttctctggggttcagattacaactgtgttgttgctggtggggaggcacccagcagtgagtgtgggttgcccgttgctccaggtgttcgctgtgacttaactctctcctggataccttgacccaccgttgtcactaaaacgtgtttccctgtggtcgattagtctgcgagattacggtccttggtcccgagtgaccccagggaggcatgtcacctgctcccctcactgctactgcccacctcgcacaccctcactgcgcctgagacgcagcagtggacgcaggggtcctggcaccgtgctgaccagtgtctccctgcagatgtacatcgctctggcatccgtgcacgcgctggtcctctgcgggctgcagttcatcgcctgcgtccgaggacagtggacaggtaggcctgggggggtggcttctcttgctcgtgccgcggtgggggagagggaggaaggggctccggtttcagagg

SEQ ID NO: 53901 - DNA, 1898 bp, Bovine  19866881154527
gttcataccctgggtaattttaaaagcattaggctttgtaaagagcttgtctctctgcacagtctaaatcctggctccctgaaaatccctaagaggaacaagcttgtgaaaaatccaggggtccttctttagcaactaggatccagggcaaccttggagcataggagattgacgctccttactttgtcctaatctttcgactgcaagtgtccacacctaaatatttcagtgaacaagcaaattcttaaatcacataattttgtgctaaagaatgaaaaaacaaaagtccatgattagagctacagttctctctatgggaaaaaagctgtctgaaagtcaaaacattttggttgatttgctttataacaaaacatgtatagattgggcaagatattttattcaacaaatatttattgagagcctgctcagtgtgaagcactgactggttctacatctatgtcctctctatctggaaacttctctgatcgtccctggaatccatgtttaagggaagagaacttaggtcaactgacattggttataagccatccacagcctgcataactttatgtatatgttttaatgatcgggtctctctctctgctgtaatgtaagctccgtgagtcaggtgatggggaaccatggaggattatagagcaacattttcacttaggaaacagtccaattctcagtttgaagctctctaataaccttcccaacaaaatgctaggtttttaactcacatttcagaccatctggccccttggggtatgtggtggcggtggggaggagggttatctcacagcttcctggaaagacagggcctgctaagtcacttcagtcatgtccaactctctgtgaccccatagactgtagcccaccaggctcctctgtccgtgggattctccaggtgagaatactggagtgggttgccatgccctcctccaggggatcttcccaacccagggatcgaacccacatctcttatagctcctgcattggcagacagttctttaccactgagctaccagagagggcgggagtgggtaagcaaatgtttctgctcaggcctcttggggcagggtcacttatagattgactcttcatgtccctggagggagggaccttctgggagggtcaggaatgagggctgaggatcccttctgtcatcagcatcttcgctagattactccgaagaagctaagtgccctgagccttagtttattcctctgacaatggaatgtcagagctgagatgcccatgagaaggttggcttaaggaggtagggaatctgaacctggtctagtgctcagcgcagaatagctgctcagttaacacacgatgggtgcactgagtgtgtgaaccttcacagtgatgtcaggtgtctcatggaggaggaaactgaggctcagagaggttggagcgattctctcggctcacagagctaggagaggcacggctgggccagctctgcccattaagaccacaatgtccagcgtttgctctcaggggcagggcccctcctgactttcacgggtccccttcatgtgcttctttctcaaaaaacaaaaaatatataaaatatcttttacaactgccttgttctgaaattgaacacagtccacactggatcatattcatttcttgccttctgtctgaaaagacatgaaaacggtttttcgtgggccccccagtcccacgggtcccgggcacccacgcctgatggagcgatggactactcaccttgtcctcctccgccctcaggtcgggcatagtgctgacgcacaggctgacggccgaggtggccacgaagaggatggacaaacaagcgaagaccttcccggggagcccagactgcgggttctccaccatctcgcgcagccggctcatgaagagcc

SEQ ID NO: 53902 - DNA, 1205 bp, Bovine  19866881185870
tcatggtcacagttcccatcaacctcaaggaagatgaacggaacacggctctccgccacgcatggtcagaggtgctgcggacacaggtgggaagaagacagagttccgaggagagcacgttgtaggggagaaaaaacgccacattggtcaatgcgcagtccccccaagggtgacggagggtttggagctacgtcaggcaggctgcggggaacgcgggtcgcccgctaagggcatgtagagcagatacctgcaccgtgtcagggccagagctgggcaggcatcttgtgcaaaggcccagaggtgagacctcagaggcgccagggcactagccaggaatgagcgagagggcaggaggacaggagggaggccagagaagtgaaggggcagggccgtgggaccagctggggtctgacctttagctggcagactctggcctttaacctttaaccctctggggactgggaaggtaatctatttctttgattaaagtctgttctttctcttcctaatcctttgtttaggaccctctgtgagcatcaccttgcttgacatgaaatatttttcaaaacatttaatcctttaatctgggcccctccgtgaaatcggttctttatcacccagggccatctgttgttcaggcctcaccataaatcacttgggcgatttgacttctaaggcgcttatctcttttgttctctcccaattccgagaagcgacatctgagttttcctcagagagccctggcacatctaaactggatctctcaatgtgccccccaccccacccctgtcctgttgggggctgcccttaggaagtcacccacctgggaggcatcggaggtgggggaaagcatgtcccgtctgatctccgggttctgttaaatttcataaatgaggctcaatgtgaaaacaggctgggcggaaaagccggcagtcccttgccagtcacactcagcatccctgctcgccctcccagggaggccagggcagctgtcacctctgattaggattccagtggcggggccccaacatgggtccagggtcgctcattctgaagaaaatgaactgggagttgttggcgtgggatgatgtgtatttcgtgtagcttggaaattattcctgaggatacgggaattggcggggtggggcggccgagcaggtggtggcagaaaggctaaccagggctgaagacccaaaaggtataag

SEQ ID NO: 53903 - DNA, 1626 bp, Bovine  19866881267287
ccgtacgtatttattatttattctttagctgctctggtctagctgcagctcacgagatcttaagtcacaacattcgaactcgtagctgtggcatgtgggatctagtttcctgaccagggaacgaacccaggtcccctgaactgggagcgtgtactcttagccactggaccaccagggaagtccctgagcacgttattccttcaggctctttcctgttctctctggacctggactgccactggccatgtgtggccgcagagcgtggaaagcctggcttgtcacactgctgtgtgctgagtgcactggctttttgagattaagtatggagaacaaaatcacttgtttcggtgtggcttctagcgaatttacgattccctatgtgttagcgttgctctgggccgcgctgttttcctttccgcaaggacttgcgccctgccgcttgcagcctccgtgtggcctgcctcttctccgggaggtgttggtggtacctggagggtgccagggactgcggttgagagtccagggtgtgcgcatggcagggccggggcgggggggcctgctttctgtagacgtgttctttgtggttttcagtgtgggcgagtccttgcaggcccctcaggtcgtgggctttgctcctacattgaggtctggctgtccacagaatcattttcgctgtttctgcctgtttttgaaagctgacatttaagcccactccccagagatggtggcgcctcccttgccatgttgaatgcccgctctgtgaggaccctggaaggaacggaggtggagaaatgtacagtcatttggggttgagtttaggttgactcagacctttgggggactttttgtggagtccacaccctgaggggatctcacctttttgaagcctctgccttccacaaactccaccccaacatcctgtggtgggggagcccctccaggcccgccaggaccacctctatgtggccggccacttcctgtctgccctctggagggagggggttgattccgatagtagggacagatgaggctgcttgtctctgtactttggttcgaaagaattggttttggcaaacgtgtcaaaaaattttggttttaagcatgtctcaaattcccaaatgtatagggtttgagttttatttttgcagtttgagacgtagattttttttaacgtaattttgttcatttacatttattgttatactgtatttcactgggtcctgctaccctggcttgctcctttagctatgattcgatttcccatacacttgtggttttaagggggacggtgctgtgtccacttgcactgtggatttcttagaccttatgaaacctcttcttaatctaggttgtctaatggctaacagacacaagcgcgagtgttcttgtttctctagatagccatatatagctatcacggggcagaggaactttggacttccttctgtaggcatcttgagctgtggggcttcctcctccgggtttgctcttcgcccctccccctgctgctggggctcaggttgagaaacaccttatttttttctgggttcccctttctggctctgccgttctgctgtgttcactctgtgctgatgacttacacagacccttagcagcacagcatgg

SEQ ID NO: 53904 - DNA, 719 bp, Bovine  19866881293609
tgtctggagctagtgacgacacctgctacctggacgcccagagtgagcagtgggtcaaggagacgcccctgccggcccggcggagccaccactgcgtcgccgtgctgggggggttcatcttcatcgccggcggcagcttctcacgggacaacggaggggatgcggcctccaatctcctttataggtatgacccccgctgtaaacagtggatcaaggtgagattaaagccagattatttctttactcttgaggactttcgatcttcttaaccttagtcttgactgccccctcactcccttctctcaggcctggacagccgtcctgcttctgaactaggtgtgatgataagatgacgagccccatcacagccccctgcctggttgggggcactgagggctgactggccaccttctgcagggatgggccacgcccagggcaccgctgccccgtagaactctgcacccgcagaacagttctgtgtctgtgccatccagcagtagccaccggccacatgtggcagttgagggcttgaagtgtggcccatgggaccgaagaactgagttttcggttttatttcattgtcacgtgtttaaacgtgagtgtgaatggccgtgcgaggctagtggctaccatacctgatggcactggtctggagacttgacccatacttctgacagcctccccacgtactgggagtctccgccaagctcctctttggg

SEQ ID NO: 53905 - DNA, 1465 bp, Bovine  19866881343074
ccagagcatcactcggagtgcagagcgccttgctggctgcccacaggcctcaggctctgctgggaaatgagggcagatggaaaagtaccccggcggggagagagtcctagacaaacacgaagatgctggtggttttcaaagacacgagctgcagcctcttaaaattccacaggcctccctgccatggataaaatgctttctggggagattgcaaatgtttgccctggtgggactttgttataaatggacttggttttgtttagttggttatgtttttatttggttaaaaaaaaaatcttgcaggatcttaactgaggactccatgttagtccaaacaaaccaagaaagggcagacacgatggacgaagaacctgcctgcccccgcacgtcaggtctgcctgcccctgcacagcaggtctggcttgaggtcctgcttggctgcagagcccttcagtggataggccgtcacagttacccccgtttctggcgtgcctactatgcaccagccctcctggtcagccctctatgttccctcctttctaatcctcccaaaggctgcatgaggcaggaaatgttgttgcatcgttttaaagatgaggaaactgaggccagaaaggtgaaggcactgggtgcaggtcacatagttgggaggtggcagggatgtctttcaaccatgtctcacagccacgcaggctgaagccagatctgcccacaacgtaaccctcacggaggctgcttggtcactgagttttctgggacacagaaccccgtgtgtgccagccagcctgcgaagccacccagtgagcgactctcctctggtaccagatagcagactatcacccaggccgaggccagagaaaggccatgtgcagacccctcccagccacttaaacccccgcccctgcaccacgctgggctagcttcccacagcagaggccaaccctgctcccactgaggccccctaacaatccacccaggatggaaatgtctctgaagaccctgtcttcagagcttcgctcctggactttggggaaggtggttggcccgtgtctaagaaatctgcttaagatgaacctccgctccacccaggggatgacctcggcgtctgcacacgtgttaacccctcagcctcttccctgagcccagcaggctgacacgcgactttcaccggctcttccaccccgagttctctgattttaaccagctgcaattcagagttgagcaccacacctttcccggccccagcccttccccaaatgctcactctccatcacactgacactaacgctccctctccctgctgctctgttttttagcacgaatcacaggatataatgacacattcagtttcttgtgtttgtgtttactgagggcagaggccttgccggcacatagtaggtactcagtaaatacttgtggacggcggcggctgagacaatggtgcagggatttttgggcctcagca

SEQ ID NO: 53906 - DNA, 1748 bp, Bovine  19866881405939
tccccccaatgcatttaatcttaagagctgtttgctgctgctctctgggtgtccctgtagactacctagagattaaacattctgtgtgtgggatcatgtcttacagttccccatttcccactgcgtacaacacccaagctgcaagaggcaccagatgatggtttggggtaataaagaatgtgtgagtgtgaaagtcactcaatcgtttccgactctttgcgaccccatgcactatacagtccatggaattctccaggccagaatactggagtgggtagcctttcccttctccaggggatcttcccaacccagggatcgaacccaggtcttctgcattgcaggtgtattctttaccagttgagctacaagggaagcccaataaagaataggtgctcaatatatataataattgattggttatattaatgccaaaactaccatttattactgacccactgtatgcaagtcactctaattataactatcccggcttgcggaagatgagactgccctagagagcggttaaactctgggcaaactgccataaaactggcaagttgcagaggggtagtgttagcccaaagtaacttgctccaaactgtgtgtccatagcacaacatggcttccctgtagcaactcatacagggcttgcctggacagtcattgcttacaattgttggctgggttcaaaaaatgaaacacaaatcaagcagtttctttatcagtccctaaaaggtttcccttatgattgaagccaagcaacaggagaggctatcttctaagcctattcaggaaaactttggtgaggagtcaccaggtgatcccagaaacaccagctcgtcattcactctgtccaccacagatcaggcactggactggacactgccaattcatttcgggtgtctgccctgacatagcttgccatccagagggagagagagcctttgatcttacatggtgaaggaaatgaagggatacattcaaaagttgggttgtgaggggaatggtgtcttgggtgagggcttgggctcttggcgtcagactgtccaagcataagtctgttctaccattgactggctgagggtaatctgtttggagcaagttctttaacttctttaagttccaggtaaattatctgtgtgacctggcaagaggagtgcctaccgcagagggctggcctatggttggaatgtggtgagtgcatggtacataaccttcagtgagtgtgggccgccgctgttattattttttggccgcgtcttgtgacatgcaggatcttagttcccctatcagggatggaaacccatggaaccagcagtggaagcttggagtcttaaccactggaccgccagggaagaccctgttattattattacggttactgctggcagtgaagaccaggtatgtggtgctgggcgcagcccgtcgtccccctcgcctccctggggcggtagtctgcaccttccttgcggccaccttcgcctgcgttcccgtggtcaccagccgactcctccacaccaggctcctgcgcgcactcttgctccgctaccccgtccaccacaggctctgaggcctcggggtgcatgtttatttcggaaacaccgaacaccccgtagcagtgggagcccggttctgcgggatcgctatggcccctaacccaccaggccactggagcccgggtcgttggcggcccaacgcttctctggtctccacggcaaccgctgcacacgcgcactcgggcgggcctg

SEQ ID NO: 53907 - DNA, 904 bp, Bovine  19866881468762
aaatggcccctgaggaagaaagccagtggggaaacgtccctggtgagaagtcccacacctcacctgactgcctgggctgctggtgaccctcggtcactctccaggagcctttgtgccctgcctgtaaaaaaccacctcaccagtgattcccaagcgtggctgacactcagtcattccgaggacagtagttttcagcccccctcagcccccttcagaatcgctaattctgaggtggggcccaggaacctggtgtttgaaaagctcagccaggtctggggaggcggggactacggggcctgcactgtcgcaccggagcccttcattccactacagaaacttctgcgtcactcttgccctggctgctctcagcgggatggtcggggggtgggggggcacccacagggggttggtgacttgggaagtagccccgcacagacgcagtgaccactcttgcctgggccctgggttaattactcaagcaagatggtatgtcaaatcacatagaacatttaatcggttactgtgataccatagaaataccaagaatcataaaagtaaaaattaaaaaaaaaaaaaaaagctgctaggtcgtacataatggtgccagggttctcccggtggctgctggtctgtcggcacgccaggggtcactggccgtggtcctggggcctcttgcctttgcccttcttcttcttgtcctccagccgcggcttcagggcgcacacgcaggccgacacgccagcgatggccttgggcagctcggtgccctcactccacttgtccttgtcgcggtcgtagacctgcacggtcttggagaaggccgtgttctcccagctgtagccgcccaggatgtagatgcggccctcccacacggccacgcccgactcgctgtggcgtcagcagg

SEQ ID NO: 53908 - DNA, 1001 bp, Bovine  19866881558272
ctgatgaattttgacggaaatggttctttttattggtgttgcactttccccttcccatcccttccctttccttcctagattagcaccaaggtgatcgaaatgaaaacaggtggaattttgaacttttttctactaggggtatcccagataacaagtaccaaattgactgcctaatttatcagctcttttccatgtgataagtctatatagcaagttattgtagaatgagggctgtttagtaacagtttagagcaaagcaagttaaaatttaactgacattgtgtaatgtacaataggcctggaaagttggtaaaagtggatttgtgttaactgaatcatgttttctgatttggagagtgcagtctgtggaaacaagtttcagcttagactccccatgaaagcacttaaataaatccagtctattaaaaatcttggaaaagtgaaaagataactttttaaaagttactatttttttgccatgccatgtgggatcttagtttttggccacaccgtgcagcacttgagatctagttccctgactcgggatcaaccccatgcctcctgcattgggagtgaggagtcctgaccactggactaccagggaaattgttgagagggtagcttttgataggacttcaatagtcagaataaaatacacaaaccacatgaaaccaacacttgacatttgaatcttcaggagggcgtggctttggcacactttttggtccatttttccccttctcggggctcctcagccacaagaaagtgaggaggatcctgctgcagccctgggtagtcagtcgaggcataagccttcctctgccccctcttcctctgtctgcttctgccgtttgtagtgctgtaagcaatgcgcagttcacgcacacggtgacaaatttataaatatcgtggtgtcccaaacttcgtcttgttcagaatttgttctcataatcacagttcagcgtggatagttgatgctcaatacatgctgttaaatcaat

SEQ ID NO: 53909 - DNA, 992 bp, Bovine  19866880172098
gctctttagttctttttcactttctgccataagggtagtgtcatctgcatatctgaggtattattgatatttctcccggcaattttgattccagcttgtgcttcttccagcccagtgtttctcatgatgtactctgcatataagttgaataagcagggtgacaatatatagccttgacatacttcttttcctatttggaaccagcttcagtatgtccaattctttgcgaccctaaggacagtagcctgccaggctcctttctccacgggcttctccaggcaagattaccggagttgcttaccatgccctcctccaggggatcttcccaacctaaggattgaacctgagtctcttaggtcacctgcattggtgtgcaggttctttaccactagcaccacccagggcaggccatctggaatagaaggaagccctgtagtccctgatctgaaatcctgacttgggcatgtttgttggtatccaaaagtgaaagtgaagtcattcagtcatgtccgaccctcagcgaccccatggactgcagccttccaggctcctccgtccatgggattttccaggcaagagtactggagtgggggtatccaaagcgatccccaaaaatgtcatcaaatgatcatagttagactcagttgaattaactttattattgttaataaatacatattataaagcaaagaacagagatgtctgatagaggcaaccatcataggatgatggtcaaagcctggaagtcagggacattgatggaattcaatcccagtaaaacagaaattcacagctggacaattccccgggtctgatgggagccacaaactctaagagtgcagaggaacagatggcagcactagtaggtccgattctgatttcttctgcctggaagtcttctgctttatctcagctggggatttcagttcttcctaatgccagtgatttccatctgggcctgtggtgaaaaataaacctctgaaccattaaga

SEQ ID NO: 53910 - DNA, 1902 bp, Bovine  19866880388073
tacacagtattgagtagagttccctgtgctgtacagtaggtccttattagttatctctttatgtatagtagtgtgtgtgtctcaatcccagtctcccaacttatccttctcctctcccctccgaccccgtaaccataagtttgtttactacatctgtaactctatttctgttttgcaaataagttcatttgtacacccgccccccaccacctttttaagattccacatataacttccctcctttcattgacactcatatctatttataactgaaattcattggttttgctttggatctctgtagcagcaaagagcaaatattactttctctgacaatcccttactctcctcagtcttccattattatttttctgcttctcataatctctcaaagatgactgttagtgattctgaaattccttgaggccctgtaatccaattcatactggcctggattcttgaggccacttgaagtgactaggctgtctctcactagctcaataggcaagagcctatctgaaactgaaattccctctttgcgttgtttgttttaccttctttagggttgaacactgggctgccttgttgaatagcacagaaggaaaaagccactgggcacttctgctttctctcttccctcctttatcactacaccaaattcccaaatgaagttctttgcttttgtcctcgcttcagacatatcttgaaaaagcaattaatggctcctttaaaaaaagaaaaacaagtcttagacagataatgctcatctttagcttttgtgacattacttgaacaagttcatgctaaacaacaaaaatggtactaggaatactataggtagcttaaatactcttgtctttctgttagtagaatttgacaccctaagtgtttcactcagtgttatatcacgagagtctccccaagtcatcggaattaatttatatatactgtgttcactcattccattaatacttattgagcagttactatgtgccagaaactattacaaatgttgggatgcattgaagaaaacaatagagacagagcttagtgttagaagttactaattacatagatgcttaatcataatagtgccacaaagaaaataaatacatgtggatcatgagagagactgtatgggggacactgacctagtctggcatgtagaagaagctcattggaaaagaccctgatgctgggtaagattgaaggcagaaggagaaggggacagcagaagatgagatgcttagatagcaccaccaagccaatgtgcataaatgtgagcaaactcctagagatagtggagggcagaagagcctggcctgctgcagtccatggtgtcacagagctggacacaacttagagactaaacaacaacattcaaagttcagtctttcaactgatgtagattctggagatgttgattagtggtctgtggtaagtacagtaattgaggattaaatatttaaaaacctcaatgaacatgagtttgagcaaactctgggagatggtgagggacagggaggcctggcctgctgcagtccatggagtcacagagtcagacctaactgagtggttgaacaacaacaatggcaatacgataatgtgattttatgttaaaaaactggaatatgtatgttgtctgttactttttcatttttctctagtaattcattatttttttaaatttaagcagcaaaagtgtttgttcatgatacattgggagggaaaaacaagtcctctctcaaacatagttggcatgaaagctagtagaacccccttgctcaaattttctttaatggatccaaagttccctaatgctatataatgattttttttcccctttctcatgggaaaccaatggaattagcaaattttaagaacatacatgtatatttaagc

SEQ ID NO: 53911 - DNA, 1247 bp, Bovine  19866880397853
acattattcagtgaattaaaggtccactgttatacataattctatttcatgaaatggccttagaaaacatattttccctgtacttatcatcatgaaagcagcagtactaataatttattgaacactctgtgccatgtgtcatgattagcaagtccataatcttccaaggctgtttcttcaattataaaatagagccaataccatgttgtattagaatgtaaagggcccagcaaagaacttggcattcagaaagcacttgagaaatgcaatagaccttgggaaacagtaaataggaactgagcctcctagaattatcacttgaagattggttgaacttcagggtagtttttatatactgcttgtatttgaaaagttgaaatttggctataaaatgtgtacagttcctcatgcttccaactaaacattcatttctatccttctcattccaatagtcctgcccagttttaggaagacagagaaccttaagatttgctaaatacctaccacggacgaggagttttacattatctcatttgatcatttgattctcatgacattgttaaagtaagcattattatcctcatccaagagtagagaaagcaaagctcctgaaaaactaagaattaagaatttaccaatggataaagtgccagagatggagtttcaacctagatctgcttgaatcccaaacctgaattccttccaggaccctgggtagtctcctgagaacacattaccattagcaactactcagtgttacactagaagaatcctctgtaaacaaaacatggtggtgtggagccagagggttgacccttctggcctggtctctgaatctcactggattctgtgaataattagtgtctcagaaatgaggccaggtttgctgttgatgattgagtataaatctgttcttgggcaacactggagaaagatacttctggcctgtttttaaaaaatcaattccccttcctggcaatctggtccagaaccctgcagtccttacagatgtcctcattttgtgcctcaatccccttcaggagggagccaccaccgctccttaacagcccaacccagacatgaagacgatcttcagtcccgctgtagacatctcttgtatagaataaatagctctagttcttttaaatttctcataagacctattttcttagcctttcaaaaattttcataactcatgttttttggacacttttcaaactttcctgcttaaattacgatttcaaaat

SEQ ID NO: 53912 - DNA, 2503 bp, Bovine  19866880400723
tgatggacagacatggaaagcagtgatatgactggctactgatcatgaaatgtatctgtcatttacacaatgatttgtggactaaagcgctagcagtgaatttttaaagaatcactcacagttaatatgctcgattaactgaaatttgaactgagttgttgaaagatcactgctatttacctagcccatggtaactgaaatttatgtatattaagctgtgtaaagcatggactgtctgtgtatatatatttttttcagtttttttttttttttaacaaaattgaggtcatgaaaatacaattttataccttgctttttcaaatttagtattataagttatttactactctctagtaatattgaagaataatgtatatgattgggaaaataccaagggaatgataaaagagagctatggactggcagagtgacttgcttcccattaagaagcagcacagggaagagtgcaaactgtctggtgtatgttgttatatcaagaagaagtagaagatttggctagaatgtaggatctatgttggaataaaaatgtcccaaagtccattttcctaagctttaagaaataataatagtaataactggcatttattaagtgcttactatatattctgggtacttttcaagcatgatctccatcttcaactcttagatgctgtcattcccattcctacacaccaggatgctggagctcaaagaagtccctgagtttgcctaagtcacacagctgttgtggcatagccagcggtcctgccactgactactctataaaactgcctgatgaaagcatttttcagtttatataattcttctacatccattgataatagatatgcaattaggtgggtggtacaaaatttccaaggtatgtggcactgaaatctagtctatgccactagctgagcctgagccagaaggctgcctacttccagaaagggcacttttttcctaattagcacaaaggttcagtataggctagtgttggtcccaatcaacatgactgattctcaacacaacctcagaattgatagttggcagagcagttaggattattccaattttatacttaaaaaaaaaaaaaaaagccttgaggcttgcattaggtaagtgatttatctaaggtaaaaaatgaattgctgagataaagatgtggctgaggaagagattagatgccaggctgagcaggtttcatctgaagcaaaaggcaataggggactgtagacattgataaatcaggctacacatttgacttcaacagggtcaaatgataactcatggatgtaatagattgccctgggcagttcaatgccttccacctggctaaataatttcttttctagaattttggtcctttcttgcctttcaattagacctttacagacacctccacgtcctttgaaggataatcaccaggatttaaaaagagtgaatctgaaagcaaatttcccttcacctcactgggtttcataactgcactttacagacttctttaattagcaagttgtaatattgttgttactatcctaagagtatccaggcctaagattttctgagtgtttccgagctactctctatacccttaccttatagagaaatgctcctacctaaaccaggtccttcagacatatgctatgctatgctaagtcacttcagtcatgtccaactctgtgtgaccccatagacggtagcctaccaggctcccccgtccctgggattctccaggcaagagcactggagtgggttgccatttccttctccaatgcatgaaagtgaaaagtgaaagtgaagtcgctcagtcatgtccgacttttagccacccccatggactgcagcctaccaggatcctcccatccatgggattttccaggcaagagtactgacataagggcgcaataaataaattcactttcctgagtgaatttagcaattcctctgggatttacaagttttataagaattcttgtaagaaaaatggctgcataagaaccaactcatcctgcttctaaaaatagccaaatggttagtaagcattaaaaagtacaattaaaccaaaaaattccagaggctggctctaagaaatgcaataggtttctgatcaaatgtgtggaaaattctagacacttatacctcttatttggagtgtcacaacactgaaagtccttcctcataggtaagaaacttttttaatttttacaaaactattgtttttcataaacttggccaaggtgagagacccaatgaaacatttttattcttctcagttattttttattaatatcctgatgaacaagcattctatggaacatgttttgagaaatgctggaccacagccatggacaaatttgggtacgaacagttacttctctatttaaactcagagctatttcctgtccctgagtccagggctggaggggcagtgacagaaaatggactagggatggccgacctttcttactgagtgaagcaacagcagttttcatacctctat

SEQ ID NO: 53913 - DNA, 2657 bp, Bovine  19866880518414
catgactttgcagcatgggcgctggagttggaaagtccttcctaaactgcaggccttgggcaagtgacctttctgttttctctggaaaatgggatgataacaggactcatttcactgggttatatgagaaaaagcgaagataaatataaaatagacttagagaaatattacttaacatgtactgttaataattattaacagtaataattagttctgtgaggtagattagtgttgtgaggtaagaactttatgtacactcaagaaattcaatgaagatcttaaattctttcatgaaatgagaatgaaagcaagagtggagaaaggctttctcttcactttgcccaaggtagaggccaagatgcatctcattggatgtctccctcagccaatctgagcattactggtgggcagtggtcacagggacagctgtgcccaagcacactgctgcctgtgtccctgtgtcaggagactgccagcctctgaagcatggccccttttaacatcttcagaagacacttatcatgaagactaaatcctgcatccatattcgttagagtcaaagatcagtattgtacaacagacacaatgagctcattgtagctcagacagcaaagaatctgcctgcaatgcaggagactagggtttgatccctgggccagggaagatcccctggataagggaatggcaatccactatggtattcttgcctagagaattccatgggacagatcatggggttacaaaaagtcaaacatgactgaataactaaccccacaccccataaaaatatttaaaagacattttttatgaatgtttttatgtaggttagctcatttaatagtcacagcagtcccttaaagttattcctgttttaggacttccttggcagtcaggtggttatgactctgtgcttctaatgcaggggcatgggtttgtcccctggtcagggactaagggggcttctctgctggctcagcaggtaaagaacccacctgcaatgcaggagacacaggaaacatgggtttgattcctgggttggagaagatcccctggagcaggacatggcaaatcactccagtgtttttgtgggaaaatcctatggacagaggagcctggagggctacagtccatggggttgcaaagagatggacatgactgaagcgaccgagtatgtagcacagggaactcagataccacatgctgcattgtgcagccaaaaaaaaaaaaaagttatttctattgttatcccaacattccagacaaggaaacttaagcacaaggcagtcaggtaaactgcccaaagtgagatggttcaaggtagtggagacaggatttgctcttaggctgccccactgtggcccctgtgctcttctctactgtccgcaggccctgctgcccctccactcatgatgtttgcatcccaagaggtaggtacctctggatggtgcccaatccactgatacccaagtgggtgctcttcaccccagttgattgactcagtctctgacccgctattgaatggtgatcaaagttactgcatctttagactttaaggccacagctatcattttgaagggagaaccataatttaaaagaggcttagtgaagtttaatgaaaggtaactcttctcatgcttgaggtgagttgaaagagaattcaatataagccaatcagttgcatgaaatgactttgcttaaggcctgcatgggtctagtgaaggcaactgaatagggccaagtgcaggaatgggcagggacccatttgtttcccttcctccaacacatgggacatccttactctcagtcttcccagacactcttcccactctacgacctgcccacacacccccagctcagaaaccctgcacacctgcaggaaagcaaaaaccagttttttcagtaaacacattgcacgtgtttatgcaaaccccagagtggaatcaagctttggaggaagagagaacagttgtttaccctacaaagttctcagatgccaacagactaagtgctaataatcctacaaaagttgttgtggaaaactgcttggcctcaggcctctgtatacaacatgctaagacacgcagaagcgttactcaaccaggtgccagcaggatctaggggagctgagatgccctacttagctctgccctgctcagaaggtttctctgttcccttgcttttgaccatggggctgtaaatttgagagcttactgagatgtcaattttgagaggccagattctgtataatgctgcatatgtgatattccagacttaaaacctttaaaataaatggaagtataagtactggaagggccaaataaggaaaactatgagctaaagaaagtctgaaacaagatgtgacaagcctgttacaagctattcataaatccattctgattcatagcaggagctaaaacaacctgtgagcccaggactgctgctggttgagtgagagtgctggcatgatgatttgatttcttcagcaaggacagggcaaatggaggcctttgggagcgagattgctgcagcagataaaagtgatcctccaaggccaaacggtcttttggctgaagagctcagagatttggtaaccagagttggactgaaaccacagagttgactgaaggaagttctcagccagaggccaccctggatag

SEQ ID NO: 53914 - DNA, 1440 bp, Bovine  19866880543235
gggacgacagaggatgagatggttggatggcatcaccgacttgatggatatgagtttgagcaagctccaggagttggtgatggacagggcagtctggcatgctgcagtccatggggttgcagagttgaatacaactgagcaactgagctgagctctttgagatgaaggactacatatatttcatcttagttgagtttctgtgacattgccagtgatccaataagtgtttgctgaaatgaatccatgtatctgaggagtaattgttggcttgatcttcttattcaatccaagatataaacacgtgctaaaatgcaaggtggttgtctgttgacaaagaaagggggaggatgggggctctctgcttatgataatgacatatagaactagtcggactgtactgttccatctgcagtcgaaagggctggttcggccaggcaggagcacgtggcaaacttgcctacccgctgcgtctaaaccaggctcttttttacaaacaaaactgccaaatatcctgattatgcaataagattggggcaggaaacaagccctaatgccaagttacagatttagggaaaagctgcttttgaattgggttacctcagccagtttgatgtaggtttgatcttgacattctctctcacttaaaaatacatgaaggaaggttactgtcaagaaaaaggagtacagtaagtctgagaaggcttgttcaaactagtagcttatcccgggcaccaggtaagtggggcaaggtaggcaaacagtgggtgtagtccacccttagaaacaccagttgccggtattaatcagagcagtccaccttttaagtctcattaaaatgaagatttatgcctgcagtctttatgtagcagatgtctacccctcaattgctgtccccagctgtggccatgatcacgcacaggcagggttacagtccagagagatatgcatgacttcagagggagtttcccggagtgtttttggcaagagggccagggctggtgggaagggtgagtctctctctgtggcattcagcatctggcagttggccatcgttcactgggaggttcctggagagaaataggaaaatcagtcttcagggcagttctacaaaaggacatgtggtgaagctgctgattttgagattccacccaatgagaaaggaatctctgaatacaattaatttttccctcatggcatatgtggttatcagactagaccatggcatcagtgctgctatagaacagtttcaaaatcacacacaaaaaaacaactggcccattgtaccagggtatgctaagtggcttcagttcagttcagttgctcagtcgtgtctgactctttgcgaccccatgaattgcagcacgccaagcctccctgtccatcaccaactcccagagttcactcagactcacagccatcgagtcactgatgccatccagc

SEQ ID NO: 53915 - DNA, 1474 bp, Bovine  19866880573108
gatgtactgtagagcacagcgaactctactcaatactctgtaatgatatctatgggaagagaatctaaaaaggagtggatatatgtatctgtataatgatttactttgctatacagcagaaactaacaccacattgtaaatcaactgtatttcaataaaaatttttaaattaagttaaaataaatttaaaaaaacaaaggacagataaatcagtaattacgctaatagcaccataatggctcatgctttaggcagagagacagtgaaagctacaagatgcaaagcgatcataacctttccagacctaggggtaagaacattctctgaagttgagagtgttaacaatttagaatgggtgaaatcagtcccctgcaaaagttactcctgagattacagtgtttcccaattctacagaaaggagaacagcttgttcattcaactgaaacaagaaaattgaagtgtttctcaatacccaaaaaagagccagtttgatccatatacattcttaggatttcaatgttgctaatgtcactcaatgtataaccaaggaaagtgcatattctcttgatggaagaaataatgaaaaatagttagtctgtttggactctagaaaagggggaagcagagaataggaatctgtcggtgagtttttagccgtgcataaaagacagagcatgttccggatctgaaccaggcagaattgttctggctagcttaacaagcattgccattcttctggcaagtacatccccgtactggaaaaggagatgatcagaactgatgactctattactaaaatcatcgaaatcctttattctgagccagtaagcaagttctcactttccatatgaggctttctcccagttgagggaaaaaatctgggcaggaagaatgtggctttaatgctgaatagaaaacagaccctaattctggagttcagtgttaacatcttgactccagccacagtcatttgatatggagaaatgacccaagctgtgagaaaaatattccacatgaattttttgggcctgtttttcctatgttcaaatgccttctgtgatcccccattgccttcaaactcaattccaaattttgagtattactctcaagatgcttctcaaacttatcctccatactttattattctggcccatcccgatgccttcccatgcatctacattcattccctcttccctacctttgatcatactttctcttccttggaatgccctctctctcttcttctccactaaccaaaacctcattggttccagggtaagtttaagtccacctttttccataaaaacttctcctgctacactagacccactagtttctgcatttcagatatactgcctagcattctgaggcttaactcttcctttctagtcttaaattatcattgtagattcctactgacttcattattactgcattctcttctctattatctaagctgaataaaactgtatta

SEQ ID NO: 53916 - DNA, 3457 bp, Bovine  19866880603444
agaggattgatttcttttttggggaggggttggcttgggttgaccgatataatagttgaagtctgtaccaggaagaaattcatgccttgatgaattagacagtctctgcattctctggattttcccttgtagtgtgcgtgtttgcatacataagtgtcccatactccagacaaacactcacaaaagcatagatgatgatctggccagaagacaggccccctctgatgcattgttttgttctaaatttttcaagagcccgtcaatggacttcttgtaaaacaccaccatacattttttaaaaaggaagttatttgagacaccaatgttaaataagtgtcagttacgtttatatcagttacaccctcactctttgggttgcaaaaaaagacttttatatattttggggtcatgtacttctgtataagggatataacttagtaaaactagacaaaagaccatagagggaatatgatgagctgttacagagtttgtcataaccagatcccgaatgttgtaaagatgaaatatgaggtgtgcatgatagaatgaaggaataaagggaatatggaaaagaacaaaatggagttctatgagaattttcaggtctatatttttcaaagaaacaaagtttgagagtcagcaaccagagaatcgattctcagagaaaatatctgtgaattgtgttatgttctttttttaaatgaccatatattgaggttgccttgttgtttgccattttatgtgtatgtttgtatgtgtgtgtgagagagagaaggcactttcctgatatatggagttacagatcagtgctgggattttttttttttttttttagtattaatttattttatttgtctgtactggatcttaagttatagcacttaggatcgtccagctttgttgcagcatgtgaattcttagttacagcgcatgggttctagttccctgaccaggaattgaacccggcctgctgcactgggagtgtggagtattaggcagtgggtcacgaggcaagttcagacgcagggctatttttcaatgaacttcagtaaacacttattatgtaaacattaattagtacctctgtattctgggcattgtcctaggccctggactatatatatatatatatacacacacacacacacacacatatatatatatatatatcatgctgcatttcctcttcagtaatcttttgtgtgtgtgtgtgtgtgtgtgtactcagtcattcagtcatgtccaattctttgagaccccatggactgtagcccaccaggctcctctgtccatgggattatcctggcaagatcactggagtgagttgccatttcctgctccagaggatcttcctgatccaagcatcgaacccatatctcctgcattgcaggcagagtctaccatgagacaggaagccctcagtaatctttatggagttgtctttttgttgttaacacctaagacaaaagtctttcagccctgggatttctttggaaggaatgatgctaaagctgaaactccagtactttggccacctcacgtgaagagttgactcattggaaaagactctgatgctgggagggattgggggcaagaggagaaggggacgacagaggatgagatggctggatggcatcactgactcgatggacatgagtctgagtgaactctgggagttggtgatggacagggaggaccggtgtgctgtgattcatggggtcacaagagtcgggcacgactgagcgactgaactgaactgaagacaaaagtcagaaacctttactttactttcctcttatttgtgttatcaaaagaaagagaactccagagatttagtgcaattactggaacacagcttctaaagtggcctggttatcaaaactacttgtgtactgatctgctagaaaagcatatcttgtcttccagttggaaatgacaacttgaaaccaaacagtgcctcccagcttcagtaaaatccagggctctgatgccgaggactagcagaactctgctgtctgatttgggtcctgttgtgggtctcgagttccctggctgagagtgaggcactggtccttgacaggatgtttggccccaaggtgggggcgatgctgtctctgcactgttttttcccccaaaccctgtgggagtgagagaggtggggaggggggtggacagaactcctggcccagtggaggggtcttctccagatgtctcccaggggacctccttcttcattgtatatcatgtgtgaatggcccgtgtgtgtgtgtgtgtgtgtgtgttagtcattcagttgtgtctgactctttgcgaccccatggactgtagcccaccagggtcccctgtccatggaattctccaggcaagaatactggagtgggttgccattcccttctccagggattgaacctaggtctcccacattgtgggcagactctttaccatctgagccactagggaagcccatgaatggcccctgagccctcagccagcatgactgaatctccttgaagaccagccctgatgcctcttctgccctgagaagctaacttctaagctggccgagacagacttgggaactaggctgatagatgtggatgctgcacatctgcacgatgtgcagatcattacagcacataatgatctgcacaatcattacaggcatactcccttcctcttcacttctcccctacagctgccactttttgtggttgacatcaataatacctaattcctcactctggaaaatgtctgagtcggtcatgacaaagccaagggcagaatcagcaacaacaacagaacaaaaataataatagcacctaccgtgtgtgagcactggctgtgtgccagccactgtgctaaacactttacatacatgatctcatttattctttacaaccatctatgaagtagggaatgctgggatccccatgatatagacaaggaaactgaggcttagccatttacctgttgttgggagatttacatctgagtgccagattctaaaacattcaaccacagctgtgatgtgaatgatgatcaagtttataaacacttaagcattaactaagaaaagacagaaaaacagacctgtgaagagggtgctggggcaggtggccctctggctcccttggcttccctgctcttccgtgatgcctctggaaaggtcttcgagagaccaccagggagaccaaagggctcgttctgctgcctgtggcttctctctgcaagtggcctctcatcccttcctttgaggtctggcagccaacatttatcttggtctttgtttacaaacaggggtcatgcatcctgttctttctttgctatttggggctgactttaattccaaagaagcatatgttttacttccactgtgctggtgtttttggagacagactccagccctaagaggagtctgagagagtctgtaacctcttctttccctttctgagggagt

SEQ ID NO: 53917 - DNA, 1865 bp, Bovine  19866880622002
tctgactctttggaccccatggaatagtccacggagttctccaggccagaatactaccaggagtgggtagttgctcccttctccagaggctcttcccaacccagggatcaaacccaggtcttatgcatttcaggtggatattttaccagctgagtcaccagggaagcccagaacagtgaggaatgaatttccattaagtcaaaataagcaaataaataaaagtgagagtatcatatcatagaacatgattgcttaaggctgaaccccagcaggggctgtggaaggtccaggagacatcaggaggggctcaaggatgtgactgtccctgtggtttccttgttgagtacacttgtgctgagctttgcagatagagctaagagagcctctaagggagggttggtggatgtggacactagatcagaattaagatgagatcttttgtgtggctgttgcaaactagctgtttttaatcaagacatgaacataaacaggattagcagaaaattgttcaaagtaatgagagtggggctgtgtattgtaacctagaatagaaacctgaatattagttgaattaaatggaatcaaattgtggaaagcagacataattcaaagaaattgggagggtatgcatttaaaggaaaatgagtagtaaaactgtaatatagtgttgtattataaacaaagacgtcagagacagacagatctggcttctgggtcttgtgtatctcaagctgaatttgtgactttgagcaagctacttaggttccttgagccttggtttctttgttggaaaatgaactagtaacatttaatttgggggttattatgaagattaaatatgaaatgcctgtaacatatttgtcacagagcttagaacatagatgttaaataatattcatggatgtttgctattatagtattattatcacattaattttagtgagttccctggtggtacagtgataagaatctgcctgccagtgccagggacacgggttcgatccctgttctgggaagactccacatgccatggagcaactaaagcccacatgccacaactattggagcccacgtgttctagggcccaggagccacaattactgagccagaacacctacagcctgtgctctgcaacaagagaagtcactgaaataataaacccatgcactgcaactagggagaagcccccgcttgttgtaattagagaaagcccatgagcatcagtgaggactcagtgcaaccaacaaataaataaaaattttaaagatacattcatggtctcaaaggatcttggtttactgtgcctgagaagtctagaaaaggtcagcccggtgggctaagagagaaggtcaacctggtatccactaagaagtcccatttgggtacaagagctgaagaagttttagaaactctagtctttgaattcacactaggatttccccccagacacaacatacctcaagccacgtatgtgcataatagcaggagctcaattagtggttatgaaatcagaaagtcacaaagatctgaaacttttatgaaaaaggggtgtgtgatagctcctcttcatcacatgaaacagtccctttgagctgtgattgtatctcagctccatcttatgactgtactttcagaaaagtctcttccaatagattgggagcagttgaaagtttaagggaggaaatatgcctaaaatatggccctctacataatttgccaatgccctccaagggctcaaagctagaatttcttatgttcacagtcatatttatttagccattttaggctgtaagatatttggtgcaactactcagccctaccatcatagcacaaaaacagccataggcaatacataaatgaatgag

SEQ ID NO: 53918 - DNA, 908 bp, Bovine  19866880625105
cctgtcctcatgccatgacaaaaagccccaatcaacatttcaggtggatagtaaacagctttagggaacatgtggatctgagcccaaagtaggcaaaaccatataattctattggaggcagcatctcttttatgtcaaagaaagcactaaccaaattcagatggccagccctggctagacatgtttttcctttctatactgaaatgatccccattctacagtctctgaaacttccaactcctttgacaaatggcaagagttgacattcccatcaccatactgcttgccttctggtatacccagggaaaagcacaattataagcttgatttgaacaaacaaattaaaacataatacaaattggggccagttcctgggaaaataaaagggcctgttctgcatatgccctaatctctgttactgatttactggctgaatggcccactccagaaagcatttggagaagcccacatgccagaaagcactctaatgcttttcagttttcaatcaagtgacttggaatcttcctttgacaaaacacacttattgtaagctggccacttatcccaacctaggacacaacttatctgcagcataagggctataataaaatccagcttgagtgacagagaaaacatgagctaagggagctcaacttggaatccagatgttgttaactcatgtaaagtatctgagtcttttatattttatacttttgcaaacagtagggtacctagtatttccccccttacctttcaagtgctgtgcctataggaatgcaatctgcagagtactgctttaattaaatggtctttgcatgaacccaggtgacactccctgaaacgtgagatttgggctttaatggataaaccccaatcccaaatattcactctgtacttctagtcttaaa

SEQ ID NO: 53919 - DNA, 1100 bp, Bovine  19866880636795
gaagcattaattttatgctttggcttgataatttttaaacttactataaaatatttatgtgatttgccaactaataccaatatttactagcatgtttttacctacataacaggaccttatatcaagtcaaacctttctacaaactttctatatgcagtgaccagagcaatcattctttgttcaggtggagaggtaccatgtttgaacggtaaggggatggtagttatgctctgtacacttgcttatcacgtttgttaaagctagcttggaaatttagtattcatacaagtatatatattctatattttttgttccttaaattataatgtagagaaaattttattaaattctgaatagtgttttagttccatcaatggcagatttgcttccataatggcacaaggtggccagataacaggagttgaatgtaaacatgcagcttcttcatactgcattgactgtgtgctaaaagctgtttatcatatttgcttgctgtcttggccagatgattgatagtcaataaaatcaataacaactgcttgttaaaagcactatggatttatctgtgccatgtaagatttattagattgaatggaaatccaattctacatttgagtttttgtgaataatgcgcttggataacatttcatggatgtggagggggtggcatagcataagtgataccattttatcaagttcatgaactggtgcatctgggtgatggcataaatatcagtagcataatgcaatggactacacacctttatagtaaagtcagctgttgattgtttgcatcaaaaatagtatgttataaagtcatttcccttcagctttgagtgagttataattacaactgaatctgtgtatatttgaccttctgagcatttgctccctaccaagtcaaaaagcctgttatgaagaccttcctggggtagaaaaactgtttaatcccccatattcacatttacttctctctgcaactggttttgttcagagactagataatgtcttagactgatgaacagcacaggtcagagcagcatggccctctcacagctcttcctggagtgggcagagagtataagtattggtgtcaaaca

SEQ ID NO: 53920 - DNA, 1646 bp, Bovine  19866880677455
aaaaacactagacaggagtcgggagacctcgggtccagccccagctctgccctctgccccagctctacccagctctgcggctgcaggtcacacactccccatctatgggcttcagtcttctcacatatgagtcaggaggtcaggagctgccacaattcactccctctccctttgcccatggcaaacatccctgatcaatcagtacactctttcctgtggaacccagactccacgcagccaccatcaaaccagtgcagttggtaaaggagacaaaagcatctttgcaatccccgtgcttcagtctaaaatctcccttattatttgagtagtctctgcctctatgacatggatggcctcaaaggataggtttgctcactggctagcatcgccaggaagttgagcgtcatgactttcctagaaagcagtcatgcacacctatagtccaatgccctttaccactgcagctctgggcagactagtgatgggtcctgctagggtgccatgtggaggaaaaccagtcgtaactataacccacagctgggtggagctttgccccaaccatgtccatgcagggggcagggctggccctttaagacctgacattgacttttggttggaatttccaaagaacatatcccatgagcctcgtttcaccatggataatcagactaattccacagattctgctgtgccaagtctttccttacttgctagcttcaatgtctgctttggcctcctgccctgcctgggaagctctggccacttccaccgtagattccacagcccatgaccttgactcaactctgtatctggctccggtcatcttgggctgatctggtgcctctctccccagtcagccagggcctagaagccctagaattgctctgcactgccccatcttccctgagcatccaactcaaatgcagattctgaactgactcttcccaaatgtatctgacttcatatcatttttcccatgagcatgcaagtgacacccagcttagggaggctcctagccctgctggatccatgaaatggtattgtctctgctactcaacagccttcaatagcttctgtaattctcttttctcatccacattcgtctacctgcttctaaggaccttggtgacccagcccatcctaggtaccacccagcacaccttcccaccccccaactcaagtcacccaggtcttcttactgtaccatcaacccccaagcccacttctacttctgcccaccagatattatattctccttgccaggcatgtcctgttctctttcttcaagtccaaaactaccaatttttcacaatccagcttacatttacctcaggaaatctaatacccaattatattttatgtcacaggatccataaatgttttgtcagtgttggcctttacttatcaaggatagtgaaaatttttggaggacaagaatctgccacaggacctgggtatctctcagtggtgacataacaaatcaataaacacattactggtcacctgttctatgttcagaatttctcagcaaaatacgtttgcgaattcattgttctaaccaagtaaatctactcagatgcatcaaattcttacccttttatgtccaacctggaccattacagatccttccctctctgaattaaaaa

SEQ ID NO: 53921 - DNA, 902 bp, Bovine  19866880714081
taatccctttattcacataagaggactctgcgtgcttccttcctttcccacaactcctgctcctcaagcccatgcttctccggggaccttgaggagacaagagcaaagaaaggaacaggtagtaaatgagcatctgaaatacgagggcaaaagcaaaataaacgttctcctaaaatgttcagttttttgaaaggttgaggtactgtactaaagcacattttcccagagcagaagaaaaaaatgattggggctggactgggaagtttattgcagcccattataagccctctccccccttccacaaaacaaacagcagtatgagttacgtctttaaaagcaaactataattaaggtctgttgtctacaaggtagatttctctgtgatgtttctaagctggcttgattttctctgcctcaacttgcccttttacttttgctgtttctctctcttcccatcctttcctttctgcctttggcctttccctcttcctttccttcccagtactcactattccaaaaagtgaatagaggcccacagtgcaagtatgactatgagagaatgagatttttatgtttaaaaaaatattttaaaagtcaaacttagatgagggacatcctccaggtaatgagttcaggaagtcatgtacttaacatcattgtccacattattcaagatgtttatacaaatccttatttagaattgcctttgggcaatttgcgcaaagctgtctcctcttatcccctcttgattatgcttcttcattaggtttagctctaaatgacagatttctgaagggaaaaaataattttaaaggaaattgtttttggtggccaagattggctaccaataaaaacacacacgtatgtatagcttaagtaatccttaagggcccttcacaatg

SEQ ID NO: 53922 - DNA, 1340 bp, Bovine  19866880754331
tatgacacccccataggcatgtaatagacttgaaaggatgggtgagagaacttgtagaacctgatttagaaagaactgttcaagttgtttttcttttccccacgaagagtctgaagtggtccatgctttatttctctttcattttatcacactctaacattttctaatttacttactatgtttacttttttattgtctctcatccccagaatgttagctccaagagggtaggaatttttatctgctttttttatcttttccactgatgcatcccaataccccagagctattgtgtgtgtgtgtgcgtgtgtgtgtgtattcatgcatgtgcttagttgctcagttgtggccgactctttgcaactgcatggactggaacccaccaggctcctctgtccatgcgattctccaggcaagaatactggagtgggttgccatttcctcctccggggaatcttcccaacccagggatcgaacccatgtctcttgtttctccagcattgcagagattctttacccactgagccatctgggaagcccccctagagccatgctcaataaatatttgctgtatgaaatcatatctccagggtccttagctcagtgtcacatgccctgcttccccatttcagtgttcatggctctgtgtgagtcaattagtctaaatgtttctcttggcaaaatgtgtatattgcacttgttctttcttcagaaagccacatgttgactccagccctacatctgccaactgtcttgctgctgcccctcggagtgccttcctgcccagaagatccattcattctgtcccctctccctctatgttcttcctgtcattgttcccatacctggcaccttcccgtctatgggaacagtgtagctgagttcattacagcaaagcctttctggaccagcctcttatgggtaaatgtctctgtctcctgcttgtccaatctttctgttttccttcaaagcacttaccatgtgttctgttgttgaatacgtggagaaagaaatggccattacagtacaagatccagatataataatggaagtttgtggatggggtgcttccctggtggctcagtggtaaagagtccacctgccaatgcaggaggcacaggttggatccctgatctgaaaagatcccacgtgccatggagaaactaggcccatgcaccacaactactgagcctgtgttatagagcccaggagccacaactgctgagttcatatgccacaaccactgaagcgtctttgccctaaagtctgtgctccaaaacatgagaagccactgcaatgggaagcctgtgtaccacaactagagagcaacccttgtgtgg

SEQ ID NO: 53923 - DNA, 1697 bp, Bovine  19866880821347
tctgacacccggccttcgctcccctgtatctctgcctcccgagctcagtcgggctggccgggggcggcagtttggcctgagcttcgttttggtaattcggaacaacgcaggggaggccactgggcgaggaggcggtcccagccgaggcgatttagcgattccttactccctccagtcctcctgtcccgcacccacctgcccatccaccactcgggacgccggtcttgcgccggttttatgctggatggaggaggccccgccgaggaagtcaagccttccccgctaactgtctctccaggtcttcaggtagacacagcctctgtccgctgtggttttagcgccagtgacctctcggaaattatttttacccgctctgctctcgatggtagccgagggagtgatgcaaaaggccaggggaaggtatttttagggcactaagactcaagataggagatggagactttttttggtcaccttttatttgttgggtctagggaaggagtaggttacacctttccagccagcctgcgccacttggaccagcttctggggattggagacaagagagaagaaccagcctccagctggctcccaggcccgaaagccacagaactacccgctcccggccggggcttctaccctcctaggtcttctgttgcctgctaatccggtgagccctcgccaggggccggcagtaacgcccactgggcccctcactaagggagtgatgaggtgcttctggaagtgacaaggagacaaggaaacaggacctgacaaaggacactaccccaaatcagatttatgctaacagaagccagctttaaaattgccctgctcttttgacccaaaaataaagttacctgttgaaggtatgcctctgtgccttgtttacatggcaaaagaaattccgttttgtgttcacagccgaagcttactagaaatagttgtttcattcacagcttttacattttgggaacaatgacattggaactgaatattgggggtggtgatcttttttgtctttccgcaatctatatatccattcggagcttatttcggataaaacaaaacagtttctaaggctattgcactcatgatttaaagtcatgactccattgtgggaaggaagacaagaagtatgttccaaggactgccgtttgaattagttgtgtttaattaatagactaaatttaaaaatttgtttagtagttgattacaacgttgacatttaaaagtggaggtttatactttttcctctcatttttgactttaatatgcattcagaatcagtgcatattgaacaatagttgacaaggtcttaatttgatatctaatgagataacccaagttttcatatgtgaagataaatgagacaagtgaggaatgtaacactatcatggaaaacagttcctaaatctgattattttttcaggcttcatgcataaaaatctagcagataaagaataacgttggattgtgaagcattgctgaaatttgaagtaattaggtaacccagggagtaaaatattttaaactacttttaaaaaacatgtgtttaagattgggtttattgtctaggattttattatagcaaaatttactatatgaatttttaaaatcataaagatcatgttattagtatgaataccatgataaacatagactcttcacatcttacactttgtaaactaagtact

SEQ ID NO: 53924 - DNA, 2263 bp, Bovine  19866880860848
attctttaccgtttgagccaccagggaagcccatccttcctcttcagccaacttatcaataagtgtgtagtttagaaatgcgatgtggatcagcaaaagtttctgcaggcaaaagctttgagacttcttagaataaccatatttgaaacaaaaacgtcaaactgtagtcaatcaatgtctggctgatatctgagaggggaacccaggaggacggagctcccggccaactcccctgaccttgagtgagggtttcctttgagagttgctgcaggaaggacccttacaggtcagaggataatcactcaaggatccctagagactttgtgcaagtcagagccttcaaggtgtcatcctggcctcagtgcctagggggctctgatgagtatattcagtcagttcagttcagttgctcggtcatgtctgactctttgcgaccccatggactgcagcacaccaggcctccctgtccatcatcagctcctggagcttgccaaactcatgtccactgagtcagtgaagacatccaaccatctcatcctctattgtccccttctcctccttcagtctttagtctttcccagcatcagggtctttttcaatgagtcagttctttgcatcaggtcgccaaagtattggagcttcagtttcagcatcagtccttccaatgaatattcaggactgatttcctttaggattgactggcttgatgtgcttccagtccaagagactctcaagagttttctccaacagcacagatcaaaggcatcaattctttggtgctcagctttatggttatcagtgctcagttgcttcagtcgtgtccgactctttgcaaccccatggactatatagcccaccaggcttctctgtctgtgggattctccaggctagaatactggagtgggctgcctttcccttctccaggggatcttcccaacccagggattgaacccatgtctcctgtggctcctgcattgtaggcgaatcctttaacactgaggtactggggaaattattgttataaatcatgtgaaatgcattgcttcagaatagaaggaagtgggagaaggggagttggaggtcaggaagtagaatccaactgaaattagcaaaaggcccaaagaaaagcacgcttgcacttcctgggcacaatccactgggccagacacaaattcaggcaggaagactaagaactaaggtgaggttaagcgagtgcaccagacacaggggcctaataaatcctgtgaatgaatgaacagtgtccacaagccagcacacagctggccatctcagagagcacagctccagacatgctgccattcctgtgttgcagtcttaacctccaggacctcaaaatgtgaccttatttggaaatggagtctttacagaaatgaacagttttaaaggatgtcattagggaaggctctgatccaacatgactgatattctcatgaaaaggggagattttggaacctccccggtggtccactggttagaacaccgtgtttccactacaggggtccagtttcgacacttggtgggggatctaagatcccacaagctatgcagtgtggatcctcccccccccccaaaaaaaaaatcagaagaggaagctgaaagcaaagaaggaaccaaagactttgcacagaatgccataagacaacattctgtgggtccttcactgggcacatagaaatcctagttaattgttcatagatattttcatatgattttgacaaaaacagaagatcgatcatttcttttggcttgacgtgtgctgtgacttgcttgtgcattgcagggttcagtctagattgtcattagactgacgtctaccttcataaaataaaggtagcactacgtgaaaaagtttgaaataggatttgagaatagaatggtggttcaaatagctcttaacttttcgaaaaatctgatgccaagcaataagacttttcaagtctgagttgaaaatttacatttcccaagtcctgcctttctgaggtattgaaagagattagagaaaaagatttccctttgatataatttttctcattttcactgtgtgggaaaaaaaagaatgtatttcccataaatgggaactctgcccagtgtctcaagaaatgtgtattccagtgacaactgtgaggccctattggagataaagtccaaaatttactcatacttttagattatacaactaataaaaactaccttactttaattcagtgttctacacatgataatacaggacatgtttaggaag

SEQ ID NO: 53925 - DNA, 883 bp, Bovine  19866880921294
attgcttgttttcactcaaaacttaatgataaattcagcccttacagctggagagtccctctggacccagagcatagcgggtaggcattagcagatctcccaaatgctagagaactaattaaatatttctcaaatcatcagagtttagatggaaaatgcttccagcctttgaaatgtgaagtggtgggatgggggtgtaggggaagaaaggacagagataagcatccaatctctgaaggcaatatttataacaccaaactagtgattcaacacaaacgcaggcaaggtttccaggacaggagcactacttcatgttgtatatagaccttatagtgcacctcagttctaatcctttttctcacagcggagaagatcttattctttaatttccacttttaaatataaagttttccctacttcagtctttacctcaatactcatccttctaagtttagattttccttgcaattcaatgcccaattttctacttcttccttcctctcaaattatccctttaacttgttcctacttatttttataggcccccaaagcctcttcctcaggataatgtgcaattcaacaggccctctcaattactccctataccaaagtttaactatagaggccaacgataccatttttcctgtttgggtttcaggaaagatactttttaactaaaattttaccactcataaatttctccactaaatctttcctttccctcatcctacactagattgtttcacacacaattacaatgtaatcaaacactcaaaatgtataattctataatcatacaaagatatcctaaaaatatatcattgctaatgtatgacacacaccctttataactctgttattgggagtacaagataaaaaaaca

SEQ ID NO: 53926 - DNA, 632 bp, Bovine  19866881060502
tgggaatagtccgacgcccggtgctgcggaccttctccgaggtaagagcaggagccgcgtacccggggactcccttagccaacctccaagactggccaccgcgccccggccgctcattctgccccctgccggccgggcggcggcggcggcggctggacgggacctcgggagggcttctggaagtcgctagccccagcccaggcgatgtccccttctccgcgtctttcttctccttctcctcgctctctcagctctgggcgtcgggcaccggactggaaggaaggtcgcttctcggcgagtcggagctcgcccacgccaggaagggaggacggggcctcggggcagccgagccgggcagcgaggaaggcgcagagcctcgggcagcctctgcggcgaggggggaggccggccgggactgcgggctgcgaccccgggatcggtgctcgcgctcggctcccgggtggtcgggctggggacgcctgcccgtcacgccccgttgctgtgcccgggcggcggggccagctcttgagtcccgaattcctgggtgccgcctgttgtgcgcgcgccggcccgggcagcccggctgcgggaggggacttgagcgcggcgtctgtcccacagtccccgtaagt

SEQ ID NO: 53927 - DNA, 1256 bp, Bovine  19866881068011
ctaaagaacctatccccaccccatacccactccctgcccacccctgtaaatcaaaccaaagggactccgcaggaagaatatttctctcatctttttctctggacagaaagcagcagtacaaaacacgaactgcacagtgtttgcttgccttgggtggcagctgctagaatgcaacattgccatttgtattcaagggaccttttattcccaactgcttgagccaagccacagggcttgcaagaatgcttgggatgcttcctgtgaacttagaacacaaaggctcagtggtgtggctgtgaaataggaaccactaaagagagaagagattaaaagaacttttattatgcttgtaaggccattgccgttcatgtacagagtatgttgtgtatgcagaagatagctcgtgtgtttaagaggagatatatatatatatacacacacataaatatgtacatatatataaaatgtcttttttgggggacaattgaagttattgttttcaatgtctaaccgaagagtgttggaatgactcagtgggcactgagccattatacctatgattgaccaagttcaacaagggaatcatagaattaaaggagccctgtgtttttcttattaatggttaaaccatggcccctgataagagctcttcaaagtttacaaataggaaaatggtcactccagctagaaattattccaaaacagactccctgtttcacataatactgagcgattttggtatgccaggggctctgatagaagttgtttcctatgaaacattcaaattgataagtttccaactcattctgtctcttttcaaagggctgtgaaaaggtcaccagtagtaccacgtggtacaaaaagtgaaaggtgtggaatatttctatttacatcaaagtcagagaaaccatcacaccgttaccaaaccatggtaaaggtctttgagatgactaatgcctgcagttatagcttctctttcattaaccaaggttgtagtgaaaagtgaacttgagtttatagttcatggtccttagctgaaacatcatagatttaggtgtttagaaatatagctataatacaaacaagaccttgaatttcacctgaagtcagtgatagactctgttagctacttttccccttacgtatttttcccaaattatagctagatttaagagcagtttggggtaacggggaccctaaggatagattaattttcttcagtgtcatctaactgaaaaatagtggtcatatgcaag

SEQ ID NO: 53928 - DNA, 1303 bp, Bovine  19866881168291
tggccctgaagggaaatctctggccagggatatggctacaggattttctggtctttgtgagttggctggtgtttggggattttccagtcatttattaccctggaaaagcaaccagactgttcattttaagtcaggatgttgaagtgtcactgaatcgctggggaccaacatctgggatcagagccttgccttgattgaagccagagcctcaatatcacttaaggacacagacgctccagcttcttcctcacattaatttgtgagtataaatatgaaacctctgttatgttccccacaccctctcaggaaaggggacagagttcctatcttggcttttcattctgaccttcaggcctagagccatgaagtgtctgtcgaaactgagactgcagtcatgttctagtgtttgtcatcattcttccctgcatgctggtgcttcaagggacactgcagaagcctcttttgaactattacccctgctagtactagtaataatacacagcgtttggggagcttcccaggtgacgctagtggcaaagaacctgcctgccaatgcaggagacctcagagacacaggtttgatccctgggtggagaagatcccctggaggagggcatggcaacccactccagtattcttgcctagagaatcccatggacagaggagcctggagggctatagttcatagggttgcagagtctgacacaattgaagcaacttagcacacatagtactttttactttaaaaagtgctttcacctttactgttattttaacaactgttatctaaccatgaaaatatatcagccaggatcccaggaggaatcagcggactcatttaaggagtctgtgcatgtgtgcacagtcatatacgactctttgcagccccatacactgtagcccaccaggctcccctatccatggagttttccaggcaagaatactgcagtggattgccatttccttctcctggggatattcccaacccagggatagaatctgcgttttctgcattggcaatggattctttaccactgcgccatctgggaaacccttaacaagtttaattgaaaattatttaaagaaggaaccatttacagagatatatctgagtccaatcaggaaaacagaagcaaggccaaatattttaataaagagaatatttaaagagtcagaaatctttacatgaagtatctatagtagtcaaattcatccagacagaaagtagaggggtggttgcagggttgggggagtagggtaggggagttattggttaatggacgcagagtttcagtttttaaag

SEQ ID NO: 53929 - DNA, 1583 bp, Bovine  19866881267313
cattttctgccatcttgccaccttaagaccatttgggcatgctgatttatgttgtcacagcagttcaacatctagtcaattaaatctgaagaaacccagtttgtcattaggtgatttggaattccaacaataaacaactggttttgttgattgctttggctgaattgattaaatgcctctgagatatagtagaaacacttcagtttgtatgacagcattgcatttctgctttccagtaattatagtctccgttgagccaatatttccaaaggaaatgctgtgaaatgttctgaattggtgtttcatttacaatgtattattatctttattatatttacctgaaatagggaattagcaaaaacaaagccacaggtaaagcagaatagatgagctgcttgtacccaaccaaagttcatctagagaagttgaatataaacacagtatttctatatctgtgaggcacttagaaagtgatagtcattaaaagcccacaaatgcctcttggcacatctgtttatagtgatgaacttaaagaaaacatcaaggtcactcattctgtgtttaaagacttagggaactattccttcttaatgactgtgcatcttctaagtgcatcttaatgactggtggtggccagtggccaccgaacttgtgctgctcagatatctgctgtgatgagcatagttgactattgccctactagctgcccctctgaatgtaccactgcatttgtgccaaggtcacaattcccactggagaaggaaatggcaacctactccagtattctttgcctgggaaatcccatgggcagaggagcctattgggctacagtccatggagttgcaagagttggacatgacttagtggctaaaccaccaccaccacaattcccacaggctgcttctagtgactgaaatgaacatgatgaagatcaaatgtgttctgttcctaagaaacacgttgttgttcagtcgctcagtcatatccaactctttgtaaccccacggactacagcacaccaggcttctctgtccatcaccatctcccaaagcttgtccaaattcatgtccattgagtaagtaatgcctttcaaccatcttgtcctctgttgcccacttcttattctgctttctatctttcccagtatcagggacttttccaatgagtcggctctttgcatcagttggccaaagtatcggagctttagcttcaggatcagtccttccaatgaatattcagggttgatttcctttaggattgactggtttgatctccttgcagtccaagggactctcaagactcttctttaatgccatagttcaaaagcatcaattattcaacagtcagccttatttttggtccaactctcacatccatacatgactactggcaaaaccaaagctttgactttatggacctttgtcagcaaagtaatgtctctgctttttaatatgctgtctatgtttgtcatagcttttcttccaaggagcaagaatcttttaattttatggctgtaatcactgtccacagtgattttggagcccaagaaaataatgtctttcactgtttccattttttcctca

SEQ ID NO: 53930 - DNA, 2965 bp, Bovine  19866881300782
cttcagcatcagtccttccaatgaatattcaggactgatttcctttaggattgagtggtttgatctccttgctgtcctaaaattgtctttatgttatacttgtccaggaggaattccttattttagacacatctattaaggaattttattgccttggcttgttagctgtagacaggagcttgggagtaaggatctttgagctactcaccacgccagttcaatcctccaaggagcaaagtgaggcagcactatgtgtgagctatcacatcaggatatactagagaactgctcgcatttggaaaacagtcttcagttgcaagcacagccatcagtgaaataactgtagcttgacattaatcttgtagcaggattacatttcaggccattgctttgcagaagatgaagtgtgtttgcctctgcttcagtgacaatggtgtaactgtatgctttgtaattgggtcctaaggaaggaaaactcaactttgttcaggatcaggactgggtaattgagcaacatttgagtttctgttattcccaccaatagctgagagctgtgactgagaaaaattcaattaatccctctttctcaaacagctatatttctgcattcttattggcctctataatagctcatgaagggtaaatagctctctttattaacgcttcattaagaatttttatatctatgtgacaagtggtgcattctttgcacagaatgaagtacttggagccttgattccagctggtctggattggaaaactcattattgttcttagcctgactgccaggaaactcctcaggggagaaatatagccttgtatatatggaaacactcaaactggattggtcaacttttataaataaaccgttggaaaatgtaatttagagggagaagtatatcaattgcagattgttttcttaattgtccctgttatttcccagtttcaaattttaggtatttttcataacaaaataattaaaagtagggaacaaagctcatcattcagtcttttaaaacaacatctttctgtaatgacaaagggaattataaatgactttataatttggaggtaaaactacaagatcctttatagttaggcaattgatagtcatcttgatcaagttctagactcaagtcaccatctcttgactcaaaaattggcaaaaccaggttagaatagacaagcaattgtttccagtggagaggattaaaacacaattatgagtacattcatcttccttggcccagggactctatcccataataccatttgcataatgggttactttgttcccttttaaatgttaaatttggaacattttattccaagagccatcaaaaaataaacacacggagttctaagcccacagattttcatatgtatctgagactaaaaagcagtccactttgcctgtatttaaggaaggataagcactttctcatttgtttatacacccaagatgatgtggctctaaagagttgtaaatatagacaaatggaagttagcatctcacttcatctaccacacgctcaacaagatacacaccccatcccccccacacacaccgcctctgttcctttctgaaggaaactggagatgccactttgttcattcgttggcttctgactgtccagctccctccctgtctctgatgtcttctactcctgagctgtactcctcagtcaatgcatgcctgcactctttcctcccctgggtccccagtgcaaatgaacctggcctatgtctaattgcctggatggcaaagtggtaacttaaaaaccagtcactgcacagagaggatctattattcaactcaagtggaacacatttaggtttttaagagggtgtcttgggatacacaggctccccaggtgacgggtcgcaaagagtcggatatgactaagcaactgagcatgcatcctgaggatatataacagctgagtttagtctttagtggagggaattcaaggtacaaggttgaccagcagatagatctttggcagggggagaaaattccatgttctcccatacaccatgtagagctactttctcctgtccccagttcagccctgcacagcactcagttcagagaggaagttaaaaagcactgcagccaacctgtcctgatgtttgggagtagttatcagtacaacaattgcccagaggattagaaagtgccccctttcagcctgccatccctctgaattactatagaaactaccctgcagcgtctcagcctcctagaacttaaagttctgcttttctaaagcttctgacattctatttgtattagtactggctttttttggggggtgggagattcaaactttgttggcaaggctctaggtaaggagattctatgctttttaatggtaaaaattcagcctccctgatgggttttccccaacacagctattcacgtagccagtggatgggtctccttggaaacagcagcagctcagtttctgcatctcctaatgacacactctctgtaccctcggctgctgattcccagcagttgatgccttgactagagcaggacactgaggaccacgagtaataagcatcaaatctgtgcttaagctggtgggaggtaggcttaggtgacagtggaggttctgcgaaaccaagatactgtccagggagcatgggtagctccgtacaaggttgcaacaaaggggggcaccagctgttctcaaagtaagggcccaacagtaggctgagcccaacagtgagaaatttgacaataaatgttgacgttcaggaggttaggcagggctgtatcaccatatagaggacatgggctctgccactgggcaaagagacttgttagcaatgggcaggcctgagtgatagaaagaggactaagggatgttccagaaacagctctcagatacagggagtacagctatatctgagtaatctgtactgggatactcagtactcagctgtacagatccag

SEQ ID NO: 53931 - DNA, 1087 bp, Bovine  19866880422218
ctgggtcaggaagattccctgggaggagggcatggcaacccactccagtattcttgcctggagaatcccaaggacagaggagcctggtgggctgcagtcgatagggtcgcacagagtcggacacgactgagcgactatcacctttccaaccaagcttgacaggtaagcaacctcaacccacattcttaattaatttctaacttaaagatgcccctgagcgccagggctggcgaagcagagcggagacagcctttgggcctcctcctggaaaggctgctccctgcgcctctttgagagaaaaactaacccagcaaaggcgtgcctggctccccgtcttaaagcttggaaactgagccaaagtgaagctgaggctgccctccttccttggggtaaatgcccagcactcggagggcgcccgtgagcgttcgcaggacccgcccagcgtgtgggacccagtcacccacctgctcggcagctgccctgtccggctccccagctccgtccgcagtcccctcgtcaggctccagagtccctgggtctccacccgcatctcgagggccctcggaaccaggcggggggctttcccgcgcagggctgacgccgcccaccctcttgtcccctcggcgacggagctcgagctctcgctccagccacagtctggatccaggctgtgcctggaagctggacaggccatgtttcccctccggaaaggccttcttggggtctggagggaagaattccgatgtgggcagcggggttttcacgctggtcagcgacaggcagagggcgccggactcggggccgtcgggcgggagccgggggagcgtccgcacctttctcaggcggctcttgtccaggaagcctctgtcctggtcagccggagcccgctgggcgtccaggaggaggcaggccagcctctcgggggccagcccctcctgacctgggctctctccattcttcacaggggaagacagcagagccttggaaggtggggtcccggggtgctctgggccttctctggtggggctcgggggccagccctccggggcaggcagggctcggggtcagcagaatggtcccccagctg

SEQ ID NO: 53932 - DNA, 1594 bp, Bovine  19866880760807
tcctgtcctgtgcagggacgtgacatcagttaaccagactgtgattcgtgaagggtgtgcactgcgatcactagagcaagtactacaaacacaagaaaagaaaagcttataatggaaaacccagtggagaagataaagtcggatactaacaaatattcgattaacccaaaagggggtggaaagacacagaacatacaagacaaaaggaaagcagtgaagtgggaggttgaacctgagcacgtcaaagaaggtattaaagtcaacagaccaacactcaggtacaaggcagaggttaccccactggacgcaaaaagcaagacccaactggaagccgttttcaagagagacgctccaaatacagagacagagaggaacagtttaagggggcagaagatggactctgccagcctcgggtgtaaggaggactggtggggctgtagaagtgtgatcagagacaaggttcaatcagcaagaaaatgtaaaatcctaagtgtgtatataacggcagagcttcagaaatcaaataattagacacatgacaattacagctgtagatgtcaacagtcttctccagtggcagacagaagaaaagaacactcagcagatcacacagctgtccttgacagactctccccaaggaccctgtcctggtcttcaggtctccaggatgccaaggcccactcgggtgggctctcccccacctcccaggggatggagccagcttgccattcatccctagagtggacttgaccgggccctgcagaccctgatccttgcaggccaaggagcagcctccttctcccctggactcctgatggacagggtggccgagtagctggcggctcctgcattcaggtccctggcttcagggtgtcccggccatggggaggtgggtctccccaggaaccagtgcttttctcctggagtgagtctggtgcccccaggccaagctgcaggaatgcatgtcttgtgagtgcacgagccgctgagaggagagggctcgtggcacctgatgttgcagggtctgaactgtaggctctcagttctcagcgcagagccaaggccgctgaacaaggcctgctctgcggcctggggacagggcccccttgctcccgcagggccggacctcgcctggggcggggcctccttccactcacattgccgggcaagacaccctacaaagtagccattcagacatcagtttatgattctgtctcatgactctgcgggttggctggactcagcggttagttctggttccgggacgttcacgggcttactctggatgcccccagcaccctcccccaccaggcggctcctggggctctccccttctgcagcaccttcccgggagcctcctgtgagcgaggtgcttgtctgtctccagggtggaagttcagctgctggcggagatgctgagctcggtggcctgcatccagggcaggagcatcatggagaacctcaaggggcggaagcagctgcgcctggcagccgccaaggccttcattgaaagcgccaggtgcgcctcggctctcgagggccactcgccgtgggtggagatgctggggaccacggcgcgtggtgttccgtggga

SEQ ID NO: 53933 - DNA, 586 bp, Bovine  19866881015642
cccctggctgcttccccgagcgaggtatggcccgcacgtctgtgcaggatacacatctgggcggagctggccaaggtggcccggaagcagaacgtgtgggacgtgtgccggacggccagccgcttctgcctcctgtacgacagtgtcaaggtgaagaagctggccaagttcaagcgaggtgggtccctccagacacacatgggcatctgcgccggcgggctcttcccaggcactggggggtcactgtggggttcaccagagctcaggaaggggtcatggggccggagcccgcaggcagaggctgggcgggggcgcccctccactgtgagccctgggtccggctgagtccagcctgcaggtctctggaagcggtggtcttggggatggtgaggacacgggggcatgccaggagccccagggggcggagacgtgggtgttgcgggagtgatgggggcttcttgaggggcagaacagcacacgcaaaaccaagagctgacctgtctgtcggggaaccagctggaggttcgctgcggccaagctggcttggggagccctcgctgcccccagggccctgcacttgggaggc

SEQ ID NO: 53934 - DNA, 837 bp, Bovine  19866881425542
gcccacagagcaggacagaggtgcggggtcctgagcacccacgtcccagatggcctgcctctcacctgattgggtgtgtgtacgtgtgcctgtgtgagctgtgggcgtgcgcagcgtgtgtgcctgctggctgagtagtctaaataggtgtgtccgagtttgcacatacatgtatgtttctgtgtgtgctgggggggccacatgtgatctgtttggatacgggtgcacgtaagtgtgggtgcttccacggtgtgtgaggacgctggtgctaacgtgcacacccacacgtgcacggctgcacgcgcggtagtgcctgcgcacgcgtgctggcccgctggcgggtgtgcttaccttggaacgccccaaaagactcgatggagagcactctccttccggcggccgacaggctccggcacaggcggcaggacgacgtgagctgcatcttctcctcgcacagcgcgatgatgctctgcggcgggccggtggtcagcccgcgcccccgccccagggcggcccccaccctcgcccgttaagccttccaagctctggggtcacgggccggggctgggggtgcttacggaaacccgcagattctgtcccgcccgtgaccattacaaggcgcacccttcatcgccgaagtgcacagtataaaagtcaggagcccggatgaccaggtggtgggggccccgcgtgcttactgggtgtgcgagcgcgggccggggttgcgcagggttcagggtatctcctggggtgaagcgaggcaggcctgtgagtttacctggaggtcgggccggtccccggggtcctccgcctgcatcggcccagcagcgcctccag

SEQ ID NO: 53935 - DNA, 1643 bp, Bovine  19866880265901
aggcttttgagttcctcttcactttctgccataagggtggtgccatctgcttatctgaggttattgatatttctcccggcaatcttgattccagcttgtgcttcttctggcccagcgtttctcatgatgtactctgcatataagttaaataaacagggtgacaatatacagccttgacgaactccttttcctatttggaaccagtctgttgttccatgtccagttctaactgttgtttcctgacctgcatacaaatttctcaagaggcagatcaggtggtctggtattcccatctctttcagaattttccatagtttattgtgatccacagagtcaaaggctttagcatagtcaataaagcagaaatagatgtttttctggaactctcttgctttttctatgatccagcggatgttggcaatttgatctctggttcctctgccttttcgaaaacgagcttgaacatcaggaagttcatggttcacatattgctgaaacctggcttggagaattttgaacattactttactagcgtgtgagatgagtgcaaaattaggtatatttttatcttgtttttctaacattttagattgtttagaagcatttgttatatatctgatagtgtgcagcatttattttctcatttttattaaacagattacctgcttaaatattttattaggctatatagttccctatagcagatgttatttcactaaatttatgcctttgtttactttttgcttatctttcatgtaaaatcacttactaatttattgtatttcttccttctttccattacattcattagtagataatctgatcaagttcatatcctcagtggaataactgactgaaaaaattctgtaaaatgctggcaaatcaaatagaaatcttataaagtataatcccaggtattggaagtgtagtgctagatattttatatgtagaaatctaagaaaccaataatgttatactttagctaagcaaacattttcatatgttctcatacttggctttcttagaaaataaaatagcacccaggtcaaaatttagggcattaaatctgaaaatttaccttaaatcttaatatacatttccattttaatcaaggattacagttttatacttttatagcagagactttggttcatatttatactttatgattttgttcatatttattttaggcctcttttaatttttggttcacaaaaaaaggcactggattaaccattgatgaaatataaaaaaagagaagactatcaaatagtagtttatatgcaatttttcatggagaaggggtcattattatttaggactttctccagtacattttaggaaacaaaagcaatacctaaatttatttttccacatctcataacggaaagtcaattgtagaaattctatagtataataaattgatttagcaaatatttactaaactttctatatgcaaataagtacagatggatatagaaaagatactttctctaccttctaggaatttatacactgatgggaaagatttcccatcagtgtataagacataaaaataccataaatatgtatcatatgtatatatatgtgtacatatatatgtatatacaaagtgagtaatgctaaaaggacaaagaacacaa

SEQ ID NO: 53936 - DNA, 1503 bp, Bovine  19866880445306
ctgggtcgtcctagtgcactagccccaagcgggaaatttttaatgttatattttatctagtaaaaatagctattaaaagctgctgtaccaccttttacttggtacttcattcatttttagatttaacttatgtttggttaatatgttaagaaaattattttaaaagagtgaagagcttttttttttttgaggagctctatttttatgtaaaaacatttctttttttttcatttctttgaacatatatattatattcccactcattttatttagtgggcagagttaattttttatttttctcaagattcaatgtcacaatatatgatgcatttgaatctttttagacataaaaatgaaatgggaatctgagttcttgttcgcagagctgaagaatgaatttcacaaacacacaagcaagcgaataggatttattaaagaaggaaagtacaaacctctcagcatagactctgagaggggttaaacagtcccccaaaggtggggcagcagttttaatagcctgaatatctacatttttggttgtctcctgtccttaaaatgcatcatttttaatcattttaaagatcaagatgcttaacttaacatctttatggtttctcttgatcctcggattaagtcatcagcctttttcatgctccctggccagtttacagtggaccagatgtatgagctaaagattaatgatcaccagttgtttttcccacaggcatatggaacagaagttaattactgcccttccctaaatctgagtgtgataatttatcagaccacggaattaactttaggccaatggatgtgtattgaaaataagatctaggtctcagagtcttatactgattgcctagcaatttctaccttaaaaatagcaatatggctgttgacatttttatatttatgactcagcattttatgaattgttttattattaactcaaaatgttacaatttgctctcggtttgaaaggttagatttaattataatgaagcattaaggattgataattagaatttgaaatcaaaaggtcagtctatttattgtgaagctacttgaatgaggtgagaatttcacgagtctgtcagtttcatcttgtcggttagtgatcatgaaaactccagcaggattctgtagacagcgctgtcttcaagttctccttcagttttttttctccctgtgatcttgtaattagaaaagtacaatttggaatggtgttaacagtttatggtgtgcttgtaattggaaatgagtcacaagaattacctgtttttctcatttgagttaataggcataggctagcatttaaatacatgttcaaatactattttcaactcatggtaaacacaaagacattcataaataaacaaaaggagtaacagattgaaagtctttatacttttttctaacattttatagtagagaaaatgggctaataaaaggagtagaaggaacactctgttcagtgagtgtacagatttatgtgaactgggg

SEQ ID NO: 53937 - DNA, 1573 bp, Bovine  19866880466550
tcactcataggtttgaaaatagaaagttttggttaaccctgaattactcacaacattcaggtgatctctttttatttgacaatgtttgaaaatgcagttataaagaggttattaagttgaagataattttacttcgatatgaggggattcactaatgttttatactgacgtccgtcttagaaaatcaatttctgcttgaagtgaggctttgttcacgttacatttcttctggtactgatgctaggtgtgcactcgtgtggcacctgctgcttgctgttttcaacacctgagcgatcttaagattcaagccctaactatgaagaacagctgcagccagaaggtaaatggggaccgtattcttcaaactgcagcgcagaacaagctggtaacatggaagcagaaggtattcaagaatgaaagaaccctaacattaaaagatgttgcagcatgagcctcttactcatccttttttttaaaaaaaggtgctaattactacagttttctttttatccttaatacatattagttagtacgctgatatacacttttgagaataatactgcttagctacacccataactttgagactgtatgcaattatgtttttctcttccttttgtcatttattcttcttttaaaaacactcctttttgttcctggcttcctttaaggagcagatggtttaatggctggtatttgacattcttgattaaataattgcattatctaaaccatcttctagttttcaggaacctccttttgtgaaactacaataatgtctagtaaattttctctaatactctcagtctgtgaccaacttagactgtcatatcagtacctgatactgtgaaacttggaggaaatttcaaatggtttcaatcatcatttctgttattgtgctattctgatctcctcattttggttaacagatgatttatatttcaatatcttccatatatacatcagttatagaaaaaagtattgatattttgattattcttaacatcttcatttttctcttaaattttgtgggtttttttgcaatttcagtagcaatatctataaaacattgagttcatatgacttcgttttatgtatattgattagaaaagctcactcttttataaatgtttccatctagggttacgaaggtgacttttttcaaaaagcacagtggaaatgaatccagattttggttaacagtggacggtcactttaagggacagtttaaagccacgtcacgcactttggggcaggtctgccccttctaagtgttcctcctgagcatctctagcacatgagtctcatgccagatctgactacctaggctcttgtgcccccctcagcctctgagttctaatgcagataaacaatcagagtcttccccagcagggatgtgtgagtctcggaatgactgtcttactatcacctcttcctgcccataatctggcttttgccatttctttggaggagcttgtgataactttaggttttgctggtcttgagttccatcggtagtggcaatggtgactgggatgaggacaaaatacgttttagcacaattcctcaggtg

SEQ ID NO: 53938 - DNA, 1625 bp, Bovine  19866880509077
ccccttgggagagcatcctcttgagggagccaggcttagtgtcctcgtccacctgggagtggagggtgctggcctcaggtgcctccagaaccccagctgatgttgtgactctcctaggctggggtcctggagaacacgcttgcttcctctctacctgtcccttcacttaactcacctgccctgttacctgcccctcaggattgagactggagacacagagccggccttgaaagccctttggtagtagtaatggctgcactcatatccggtccttcgtgaagtgctgaactcggtgccaggcactggattctgggccttaatcctcccacagccctgctgtcaagtgcttgtatttcacactcagggagctgcagggacaaaacgcagcaggggctcttgggattggaaccatggtctgacttcaggactcacgcacacccttttacactatacccaacacccaccagtgccagggagggcccacatgtgtgtctgctctgctgggcgaggcacccaaagaagtggtcccggccagatcagtccctgtctcctgtctccagactcaggagtggcctctgtagccagaaaagggtgtttagggagctgctctcttctccctgtggatctggggagccccacgtattgcacccctcccttgatgaggatgaccgtctttacagcctggggaggtgagatgctcagggagggcccacctgggccaggatgacttctccacatggctgtgtcctcggagtgcatttggaccttactgagcagtaacaacagatattattttttattttatgtttttaaactgcaagcactattaaaccaaaagaatgcccactaattctgtcattacattttattgggcctagtaaagatcacttatatccctttaaatcagattttggcttcttatgtgcacagttcacagcaaaatggcagcaaatgtccaagagctagaatgaaaagatggaacattaattcttctttcattgctacaggagtaagtgtaagctggaggatccctcatcttctttgcaaaatctggctctatcccttaccagcctggatgttagcctttctggaccccagggtcctccattgtaaaataagactaagctggctggtcaggttatggggtgttatggggcatggtgacaggctgtgaataaacctagctgtttgtgcagcgcctggagcagctggacgtggactgctgtatcccctcatctgaacccaactcttaacaccaagatgtccatgaagaatattgaccagcaggtgactggagccgtacgtagcgtgtggcacttggattcatttgttcgctcactcattcagtgaatgttttctgaacattgccttattgttgttcagtcgctcagtcctgtccgactctttgaaattccatggactgcagcacgccaggcctccctgtccttcactatctcccagagttctctcaaactcatgtccattgagtcggtgatgccatccaaccgtctcatcctctgtcacctccttctcctcctaccctcaatctttcccagcatcagggtcttttccaatgagtcagctcttcacatcaggtggccaaagtattggagcttcagcatcag

SEQ ID NO: 53939 - DNA, 1043 bp, Bovine  19866880539736
tattcaaaggtgtgcaaccaatactgcaatctaatttgaacacatttttatcacctcagccccaaatcttacaccctttagcagtcattcttcatttccgtccttattaattttattttaaaaacatttaattttctactgtttcaggatgtggtagcatacaggaggtagtcaataaatatttgatgaatgaatgaatgaattgccaactgactgatattacagctatttatgactggcatctttaggggtaattcctatctgctagtttctatattttcatttttaaaaaatgtggttggtcttcaagcatcttatattaaaataaatgaaattttcagtctcttgaaagttattttataaaatccatggtggtagtattatctttattgtgtctaataaaatgtggatgatgagctactattataccaatatgttttggaaagtgttgaggtcactttaacatagatgataataatcagtatatttgaacttataacctttgccacattggcaacctatcatcaatttctatgatgacagactaaacaaaattcttcaaatgcaggttaactttattacattgttgagctggagacatataaaataaaatacttcttccaatatgaccttatgctaaaaagtggaatgagcacagactatgcataaccacaaattaccttttttataaaccatattttatttttatttaagattgtcagcaaaatcttcttttcaagagcaattcaatgcacaaccctcaaaagcgatcaaattattatttgtggtaatggtaaaaaaaatgtttaggcctccactttaaaatatatccctaaaattttagttcttatatggatacaatcacttatataattgcattcttccagataccagttatttttaaatgtttggaataataaatctctcaaagaactggtttaatttgccacagaaaataggtactatctctagaaagaatgactgttataaaataaatttctcaaactaaaatagatacttcaattatattttttaagtacagt

SEQ ID NO: 53940 - DNA, 3969 bp, Bovine  19866880583072
cccctttagtggaggcacagagtcttaaccacaggcccaccagggaagtcccccagggacattttcttatttccaacttctaactcagtgctggggcaaggagaaatcactttataccacataaggctggatttttatcatgatcatggttgctcaaaatatgacttcctcacttccctgggaaagttatttctggtaccaaatcaccacctggcttttttaagataaattattaaaacccaaatcacagcaattaataccaccattgttatttgcttcagtcaaaaagctgcagcccactcaacaccaagaagaccttgctgtttgttaggacggagaaggctgcattttgcttgagattctgtagaacgtatttttattctttgtgaattttcattcaattgcgttttcctactccctttctgagctaatttcaaatgatcaagtttagggtgatttctgccagactcagtagtttggattaaaagtttgggagcctttggagctgagcctgatattttaaagatacaagaaagccctagaccccaacatatcaggcttggggcagcctgatcaaaactccaagctcagtctgagaccagcagcagcaggccggccccccaggaacgacagaactctgccgtcccctgaatcaccaaacagaaaaggggagggagacctcgagcttcctccagcagttcttagtattctaatcatctcctgaatacaaccaaatccccagcatgcaggtgatggaaattttaggagctggaacaagcaatgactaataaaaccctgagagaaataccaagaaagtgaataaaagcggtgacagaaacaagatacaagactgcttgtgtttggtgaaataaataaagcataaacgaaaacacaatgatgtgaaggatacgagaggggtatccataaaagtcacataaactggcggtgctgctgccctgatgggctttatcctcgagaaggtttctcccttcccagctagtagacaaagacttcaccatgtttcaaagataaagtgagcgcctggcctaagaaaaccttgggtgggtacataaaaaggggccatctttttctagaaaaccgtttgccaatacacgtcataatttaaaatccacgtcctcttcgagccaacaattccactgcagggagtttccctgcattcttacacggagtgccaagatacatgcaaaaggattttcatggcaggataatttgcaatagcaaagcacttgaaaccatttgatgtctgtcaacagtgaactggtaaaagaactcatggtgcatttggataaggggatattagggcacctgatgcaaagagccgactcattggaaaagactctgatgctgggaaagattgagggcaggaggagaaggggacgacagaggatgagatagctggatggtatcaccgactcgatggacatgagtttgaacaaactctgggagatagtgagggacagggaagcctggtgtgctgctgctgttcatggggtcacaaagagtcggacatgactgagtgactgaacaacaacacaactatttttaaaattagatgtacatccactgaaaaggaaagtggtctatggtatatgttaaataaaaagcaaaggtacagaacaatgaaaatacagtcctatttgtgtacatttaaaaacatgatagatacatagataagacagaaggtgtaaataggcggatagataaatagatgatgaatagatggatggatggatagatattacctagattcagcatttttacgtctggatattatttttaccaatagtgttaaagaagaaaagaataaagtaaactgaggtgtgcagtggctggaaaccagctcagggttcccgtccttcggaagaaagaggcaggtgcagccttgtctcagcccacactcaggactgcagtttttctatttgtccagcaaagccccacagagcccaagaggcagtgagcatccgccccgcagaacctctttagagatgaattgccacagtttggagaagaagcacctcagaggtgctgtgtacactctgtgcataggagggttttttaaataattcctcactctggttggtgacatgggatgaagtcctctctgtgcagggcccatccagacaaggggaggctgggtcggctcttctggtgacaagagcgtcaagggtttgcctaccctgcactgtggatagtgccctcagaatgctcaggacaataatggcctggtaataacagctggtgggaccagatgctcaccacgtgccccccagaccaggatggatgggctctgtgcatgggatctcattcagtcctcacagtaactcctagatagaattaatctcatgttgctgcaaaagccactgaggctcagagagggtgaatgactgatgcaaagtcacacagccacgggaaagctggacaggaattcagattttcgagggctgtgcccattcaaactcttctgtgccctccagcctgttgggggaaagtctcctgacttctgagtaggaaagctcacagatccacccgcattcccacttcatttccctccacccacactggaggccatgttgtgagagcagcccaagctgacatattgcagcatgcgttcgtcttcaaaagataattacattccctccctcgccttaaggaaaagaacagcagattaaaaaagaaatgtaacaagccatctgagtgccaggaccgctcccccaagagtcccacttccatctcggtccctcactctagacataaaaccaattaaagtcgctgcaacatacacagttaacaagtgacaaaagcctgcctaactgctttcaggatctcatttacccgcagactgtgcccagaaaagcatggctggcctgttactgtgagatgttggaggtacttgacccagtaccaacttcgaggggcgcccagtcacatcctcagaacacaccacccccaactcccccagctgtcactgtcagagtggctggctcaggaaaaccgcttcatccctcataccctaaatttgacctctcccacttctgcccccatgactggaagatgtgtggggagagagagcctgtggctttagcagctgcttttatcttatctcaggcctagggtatctactttcgaagtggacagaccaagagtagtaatggaaagtgggtcttattcccttgacttgccaggattccattcctactccaggacaggattttcagaaaatggtacccaaattgagaagaaaatggacaacaggcagaaagaaaaggtgatttctgcaatgcacgagcctcatctaggcttgcttcccttgaagtcaatcgagaatgaatccccaagcctctcccactaaccgtgggaaccagtatcggaagaggaaagaagccactgcgctctgatgcgaagctccttggtttccattcttccagaacatttctgtctctgggggacccttagggtattcagataatatctcctttacctgcaagtgcttacagcttaccaagctcctttacacacattctccttccgttcttctgctgccaggtggggagttgttgagcacctccattttatggatgtgaaaatagaagcccagaaaggtctttatcctgcaagtgatagagaagccccccttccccgccctagttgtcactcagccccgcctccgacaacatgaccttctccttagcttcccttctcctttgctggcatcttctcactcactggggaatagcaaactgttttgactatcagcttttgccgagcacctctagagtttattttttaattccactgagtttttcaaggcaatttttaaagggtattaagtgttcttctgtaatctgtgctgtgtgcttagttgctcagtattgtctgattctttgcgaccccatggactgtagcctgtcaggctcttctgtccatggaattccccaggcattaatactg

SEQ ID NO: 53941 - DNA, 1846 bp, Bovine  19866880642512
ctggaagactaatgcattaaaaattaaatggagtcagtagaacttgagattttcaagtgatgggcaggatgcaggcagccagtatagaaggaaaaggtcaatccaagccaagggactcatgagcaaagaagagtcagaaatcatagtgacttgtaagtggggagttgctaaggcagttggaagatggcaggaaggcccttactcccaagattcatttgaatttgatttggtgggaattaggaaaccatgatgggttgttgaacagagaatgatctaaaaacacagggtttaagaaaattagctttgctgcagtacacaaactcagttgtacaagattaggcagaagtaaaagactacttaggaaaaaatttgcagtaatccaggcaggttggagtccagatggtgataggaaaggagagtatctgatggatttgaaaattattgcaaagtaggaatcaatagaatttggtgtccctgatggctcagcagtaaagagcccacctgcaatgcagaagccgtaggagatgcaggttcaattcctaggttgggaagatcccctggaggagggcatggtatcccactccagtgttgttgcctagagaatcccatggacagaggagcctggcgggctacagtccatggggtcgcgaagagtcagacatgactgaagtgactgagcctgccagtaacaaaattgaattaaattcactaatatatcatttattcttttgtgcatcttgcctttatatgttaaagataatttcatgttaacagcaaagttcttaatataagttgatttgagagctcttttccagttgaatgaagttgttacagtgttggaattaccctaaagattttagtaagcaagacatcattaaaaatcaggtaatctatataaatacaacattgagaccattaaaacttaatgtcattacccagttttgaagggacagtaactagccagtcagaaggtactttagggttagatatcctggaggacaaataaaagaaaaatttcaggattgattttcctaagaatagccaggaaagggaccccaaaacatatccctctaaaccagggtatcagtccctgaaacaaaatggaacatggaatgaggttaaagatgcaaggatccaactagagcttattcattcatgaaataatattcctgtacagcaaagtgaatcagctatatatatacacgtatgtgcatgctcattcagtcatgtctgactcgttgaggccccatggacttgggcctgccatgctcctttgtccatgggattttccaggcaagaatactggagtggcttgccatttccttctccaggggatcttcctgacccagggaatgaacccaagtcttttgactctcctgcatttgcaggcggattctttaccactgagccacctgggaagccaacatatacatgtaccccctttcttggatttccttccatttggatcattgcagagcgtgaagtagagttccctgtgctatacagcagcttctcattcacggtacagcagaaactgacacaacattgtggggactttcctggtggtccggtggctaagaccatgttcccaacacagggggcctaggtttgatccctggttgggaaactggatcccacgtgctgcaaaagactcagtgcagccaaataaataaatatttttctccaaagaagacatacagatggctaacaaacacatgaaaagatgctcaacatcactcattatcagagaaatgcaaatcaaaaccactatgaggtaccatttcacgccagtcagaatggctgcaatccaaaagtctacaagcaatacatgctggagagggtgtga

SEQ ID NO: 53942 - DNA, 1545 bp, Bovine  19866880645832
agttcactgagactcacgtccatccagtcagtgatgccatccagacatctcatcctctgtcgtcccccttctcctcttgcccccaatccctcccagcatcagagtcttttccaatgagtcaactcttcgcatgagatggccaaagtactggagtttcagctttagcatcattccttccaaagaaatcccagggctgatctccttcagaatggactggttggatctccttgcagtccaagggactctcaagagtcttctccagcaccacagttcaaaagcatcaattcttcagcgctcacccttcttcacagtccaactcttgtttatcaacccacaaaaaagtttttagcaatttatgttgtgaacatattgcttctccagtttcaccccctaggctttgctgggttttcatctttgcaaatatgatgatggaaacaagtaattttttttaatatgcagatgtattacattctaagttgataatttactttgtgaacattttaattggttaagacaaaaatatccttcaagggttaggaaggtgtttttaaaagctttaaaatatattttctgcaatagtagtaattaagaagtaaatgagtttttataatattatgtttctgtatttcaaaacaattccctagtttgtatatttttttcagagaaataaaagcatcttttaaaaaatgtatttaagataaattttatgatcacttaacctaaatttctataaaatcttgacaatattatctctttttgcatttggctgactagattaccactagagagtatttctctgtcgctaaaaccgtgctttacaatataaccttacacgacactgtgttacttttcttgaattctttttaattttccctaaatgagagtacctaatgacttccttatattttcacattaagaatcttttccataatgaccattttatgaaggttcagatcaaattattgaaatatctctccctgagttcctatgtttcctttttttttttttttaatccctgtagcttatacacttgcttttaagagtttcttttcttttctgtttctcctgtttccattggggaggattttttgaagggtgtttaatagttcccatcttctagactgttatacagcagacttaaaaaaaaaaaagacagctcagttacttcctgtacccttgcttccctccacaatacctataccaaggaacaatccaagctattgtaaaatacaatagaaaacaagatatgaaagacagcagcaaaactaatttttatctgacaaacttgctgcaatattagattaaaggatgtttgatgttgcccattaggacctttgacctaagaaatatattagggaaaagataattggagcagataaacccagaattttggtcactttagataataataatacaaagttcatttatcattcacttaaagttcagtgtgcaaaagggaacatgtggaaggggcagagtggtatgtagggcactgtgccaccagtgaaattagacgagaaaatgtcattcttcaggctttcagga

SEQ ID NO: 53943 - DNA, 1567 bp, Bovine  19866880696878
aaatgaaaaaggttgtgtctagaaaaaaaaaagggagggggaaaaactcatgcttgtccttagctaatcaaatgagtttgagtttgtatgtgctagggaataaagaatcaagctgtcattgtctgcccttgatcaaggtactggttatattgtaacagtgttttcggactcaaattaattaatatactaaaatagctaactccttcaatattagattcattcaagttctacaaataccatgttcattaaatatactattctaatagtgttttacctaaatatcacaattaaagtatatgaatatttcagtgaatggcaagccaaattagaccataattacacagatattaaaataattttaaaataaataaatgtaacatactacatagcaagaataccaggtaatttcttgataaagacagtatatgtcattaaatgccaatttagcattacttccagtacaactatgactctaggggatgagaaaggagaattgcctctctaaaggggacatcaaaatcatccagagtagacattttcaaattacactattttgaaatgttctctttgactgagaatccctaatacagtaaactttatatacgcacatgatactaccctaatggcacaaagtgaagaggaaccaaagagcctcttgatgagggtgaaagaacagagtgaaaaagcgggcttgaaacttaaccattccaaaaaactaagatcatgttatctggtcccatcacttcagggcaaaaagatggagaaaaggtggaagtagtgatagatcttattttcgtgagctctgaaatcactgccgatggtgatgacagcaattaaacttccttacagcttaatccttggaaggaaagttatgacaaacttagtgtattcaaaagcaaagacatcacgttgccaatacagatccatatagtcaaagctttggtttttccagcagccaagtacggatataagagttggtccaaaaggaaggctgagtgtcgaagaatcgatgcttttgaattgtggtgctgaagaagactcttaagagtcctgtagacagcaagatcaaatggatcaatcccaaaggaaatcaaccctgaatattcactggaagggctgatgctgaagctgaaactccaatattttggccacctgatgtgaagagccaactcactggaaaagatcctaatgatgggaaagactgaaggcaaaaggagaagtggacggcagaaaatgagatagttagatagcattagtaactcaagacatgagtttgagcaaactctgggagatagtgaaggacagaaagcctggcatgctacaatatacggaggtgcaaagagtcaaatacaacttagtgactgaacagcaacaacaatttaccataaaccattacccgtgatggaggtgcccagtatcaattgtttcaatttattactgttttcatgttccttttaatatggttgaattaataggaaaaaaacccacaatttttcagggtgctgatattattaataaaagcacttttattttgaaataataaatactaagcacatgacagagataa

SEQ ID NO: 53944 - DNA, 1127 bp, Bovine  19866880711710
ctcactcctgtcctctcccaactcaccagtgccttgcctaattgcactgctctcctgaatgccaagaacctcaggttttaaaagacagaacaagactacttctgctatgtttgttctcagggaaaaaatattagggaaacctcccccccgccaccaggagctgaattacccagattattaatggcaagcagaacaccaagtctttagggattttccttccagagggccatttcagggaaacagcctttctgacttccccagactgcatgacttccaagctccccctctccaaagttacgtacttcacttggtttgacttgctctcctcctccataaccatgctttccctgcttacttctgttctgtgcagtcagttcttcaactgagatgcgtccccggtcttcacacttgctgcctccctgctctttaataatccctgcctttgtgcattcattattcttctaccccacttttttagagacaagtcctaaagaactgaacatcaaaacgccagcacagagggttccagggagatttttacaaccacagaggctacaggctacaatggaaggactctgggtatttgtgaaccagcattttctcccatcccatgtctccccatcttaccaataagccccgagtaggcgaggaggcagtcagcgtaattttcctttagacagctgctgacagaccttgactctggctggcagttggtgaaaaaatcggccaggcgagatctgcaacagaagaaagttgggggaggggggaggatgtgtttcaaaatagcccaagcttctgcacagacataatttttccttattcctttctcgataggcctttttcaacatccccaaatacagagagtgtagactcttaaaaggttagcatcttctcttatatacaagcccccggccatcctctcgcccaccttctttgcagagaagtcttcagggcctgcaactggagaaatcttgacgctttgaagtttcccttcaatatttatttctgactagacttatttgcatctttaggaaatatgcttctgcacacactcaccggagatccacagtgggaaaatatttactttatacagaaacatgtcccggcgtccaaataggatcctacag

SEQ ID NO: 53945 - DNA, 2267 bp, Bovine  19866880757053
gaagcctggcatgctgtggtccatggggttgcaaagagtttgacatgactgagcaactgaactgaactggctcttcacataaggtggccaaaatattggcacttcaccttgagcatcagtccttgaatgaatattcaggactgatttcctttaggattgactggtttgatctccttgcagtccaagggactctcatgagtcctccccagcactacagtttcaaagtatcaattcttcagcactcagccttctttatggcccaactctcacatccatacatgactacaggaaaaaccatacagacctttgtctgcaaagtgattttgtggctacagcccccatccatggtgattttggagcccaagaagattaaatctgtcactgctgtttctgctttttctccatctatttgccatgaagtggtgggaccagataccatgatgttactttttgaacgttgagttttaagccagctttttcactctcttctttcaccctcatcaagaggctctttagttcctctttgctttctgccgctagagtagtatcatctgcatatctgaagttgttgatatttctccctgcagtctttaattccagcttgtgattcatctagcctggccttttatgtaatatacaacccactccagtatgtttgcctggagaattccatgaacagtagggcctggggggccacagtccatgggggcacaaagagttgggtgtgactaagcacacatccacgccaccatttaattatcaattttgcccttcactgtgtgagaattccctaagagaaattttaaatattatgttttcatgaaatcatgttcctaggttctctattttaaatagttaccttgtgacaatttcagtgcctgagtttacatctgtattcacaccctactggagccctggtgattcactttcattgtcatggactaatgagaaagggtggaggttgacttatgcaattatttgtgtacttgataccaccaaacaaaaccaaaaaacttcatagggtgcatgacaaatggaagttagaataaagaaaagcggttgtagggttgtgtcatcagcagtagcacagatacaaaaaccaaagaagttgacaccatattcacatagcagatagtaatcaaggttcaaataaatatcagtcactctaaattaatgctgttgatttgaatggtatttgttttttaaatattttatttaatgtataagatttgttttaaaattgtttggttgtataagaactgtagtcataaatagttactatgtaatttcatatttttacacatttaagtaacacagtgaaaataatttagtctaacactgagggagctgtaagaagttttcttttaaaatggatctatacattttctcaatttgggttgcactgttctcacagctacatccttatgcatattcttagaataaattgtttccttggggaaatttcttagacataaaattactgtcaaatgttgtaaacattctacggtttttgatgttttgaactcaaatttgagttcagagtcttcaagttacttttccttcctttagttttgtcttcattttaatgttttcctcagtaattcacttacttcaatttgcaaatatttactgagagtttaccctgcatacgcatcatgcttcttactgggccttcaaaggcagaagaactcagtctgtgctccggagcccccactcacagggaggcgatggcataaggcagtgattctcaaacatttgttttcacatttagaaatgattgtgggccccaaatagcttttggggagatgagttatgtcaattgatatgtattctgttagaaaatggacaaattttttaaatgccatgattcttattttcactttaaggcctatgttttatcattggccagatgtactgttactcatttttcctgaaatgacaagcttattttgttcattttagagaaaatttttccatatacccaagtccgaataaccacaatttgtcagtcattcatttaagaaagaaatggtgtcctgtaaaagaagaaagaacacagctagttcatctggcaattcaaaccatcacgtaagtgctttccttgagacagccatcttactttcgtatgcagcagaagtgctgtgtgcataattgctattgtttttttttttgccacgagtgtggagaagatgagtaatacctcagtgctcttaagcttggtaccaccatcttgattcacactatacagctctagcaattgtacccaa

SEQ ID NO: 53946 - DNA, 3232 bp, Bovine  19866880767750
atatcagttactgctcacatacaccattggggtagaaggaaatctgagaggcatgtccgcagaggcacatacctgcctgcataatgcatgtatgaataggtggcagccattcagcagatgagcacacaaacattaaaaattcagaccctcgctcattcctgttgtagttcctaaaagccagtccatttcaagacttctctcacactcatcttattcacactttaacttgagtataatatgataaagactaagaatgggtgctgagaatgtgtactaaattgtgagaacctgcactgtagaaaaataagagttttattatttgaaagtaataaaattagtctgttcatgaatttgaattttatttcaagtacctaaaaatgaagttgctgttgagtttcaccaccaacatgtccagttgtttttttaaattatgttttcttcagtgcttctcttaaatcacagattaagtgaagcttgacaaatgtccaaaaagactaacttcactgtaaattagcctcccttctttagatcagtgttagtggcctgtctttaagtggaggttgatttaagaatggaaaattttttccctttaactttgtctccttatcaagcaggatttaacaaaacaaaacaatagaaataagtacaaatgtgtgcacagaatccagtggaagtagcgagaggagcctctagactcaaatttataaaggctagaacataagaatgtggggggactctgaatagatgtatattttatcttctcaatgatttcctgccttgtaattctttaaaaaaattatatttcaatctcagattgctgggtaagagagagaataaataggaagccaagctgattgtatgaactttcagtactgttccacgtaagcatgtggtatgtggctaattatgttctccgggaacactctctagaaatgggttcagtgaattacagtcttggggctaaacaagataattttaagtaaaacgaaatccctcttcaatgtgacagtagaaaataagaaacattcacattaccacgaaactccactgagcacaaaactttaatcacttcacatctagctctgtctacctgccaaattgctggaattctttgtgtctgctgtcacagggtatgatctgccaactgcagcttctcacaatctgccagtttgttctataagggacccctggctactatgcatcaccaagttctttgggctcttgcccagcatgagtgacactgaacagtgggaaacccagttgaccatggtgaaaggttaaggatgagatgtacctacttataatgttccatgtcttttcattcctgagtgcaattcccctgtatgaatatactacagatttgtttatctattcgcttgggttacatccagtttggggatgttacaacagatactttgaaaatttatatacaagtttgtgtgaatataaattttcattctcgaggataaatcccaagagaggaattgctgaatcctaaattaagtttgtgtgtgtatgctcagtttctcagtcgtgtctgactctttgcaatcctgtctatccatggggttcttcaggcaagaatactggactgtgttgccatttcctcctccaggggaccttcccaacccagggatcgaacccatgtctcttgtgtttctgacattagcaggcagattctttaccattgtgccacaagggttgggaaaataccctggaggaggaaatggtaacctggcaggttacagtccatgaggtcgcagagtcggatacagctgagcaactgagcacatgcgtgtgaacacacatacacgttaggtatatgttaaactttaaaaaaaattttttttaattttatttaattttcaaactttacataattgtatcagtattgccaaatatcaaaatgaatccaccacaggtatacatgtgctccccaccctgaaccctaaaaaatttgacaaagtatcttccatagtggctgtgccattttatacagtcaccagccatataggagagttcaatttgcttcacatctttgtcagcacactgcattgttaatattttttttcgaatttctcataataaacatgtagtggtgaacaacagcaaaataagagtgagatgtattataattcattcattcgtgcaacacatacttagtgaacagctactgtgtgccagacacttgggcacacactgtaaggatttgtacttgaaatctaaaaaggtaaaatacttagaagcagagagttggatgctgttaccaggaatggtgagatagggacagttaggggtggatggtgatcagaggcacaaagttgcagttatgtagcatcaataagctgagagacctaatatacaacctgatgaatacagttccagggtcaggaagatcccctggagaaggaaatggcaacccactcctgtattcttgcctggagaatcccatggacagaagggagtggcaggctatgtccgtggggtcccaggagtcgggcatgacttagcgactaaaccaccagcaccagtagtaatcatttcattgtattgagcagtttgctaagagagcagatttcaggtgctatcaccacacacaaaaagtgataactgtgtggagatgatgataaacttgaccccagtaatcatttcccttccctaatggctcagtcagtaaataatcctgaaatgcaggagaccacctgcaatgtaggagacccaggttctatccccgggtcaggaagatcccctggagaaggaaatggcaacccactcctgtattcttgcctggagaatcccatggagagaagggggtggcaggctatgtccatggggtcccaggagtcgggcatgacttagcgactaaaccaccagcaccagtagtaatcatttcattgtgttaaagttcctcaaaacaccatgctgtacaccttaaatatatatagttttatttaaaataaacaagcaaataaatgaatatttcaagtccagatatttctggtgtaatgccttaatgcctgttccctttcatctgtgtaatataccctcaccgtgggggaagaaaatccataactctgatacataacatacctctcaagtctctctcaacagttggaataaaatcatgtctagatttgcccgtgggttatagcaggtattctccaaatcatatttgtctgtttatttcaaatagaaactgttttcctttacataacttttccttttcttactg

SEQ ID NO: 53947 - DNA, 1036 bp, Bovine  19866880771096
agcaggcttttctggaagctcacatggacagtctggtcttctgctgtccacgtggatcagatggcaaatctgatcgtacaggctgtgacccttgtaatcgatcctacaagagcttggccttttccagctggggtgctaaaaattacatttaaaaggcaatgttggctctttggagcccattttgtccttcatacaccgtctgagacatattgtattacacaatgatgaatctcctccttgccctgttttttcacaccttccacaactacattaagcctcaagtcatatccaagatttctctctagggttcacagtgactgaattattctgaatatctgtgaatttggatataattcttctgcctggtgaagacagtgccctgtattaaccacgagtcaggcactcgccccatgcttgctcactccaagttcacccattagagcttctgtttccataaagaacacactgtggcccacaccctccacaccatccatatcttaaaaaattagatgcctcctataagtggtgtgtaagtaagtcacatgcttgctgctgcaaaatgattaatagtgctgtctcagcaaatgggatcattacatttttaattaacctttccaacctcctccaccttttccttttgttacacattggatctctgaagttttctacttgtttatgttcaactagctttgaaataaaggcatgaaaaacgatagcaggtgatgcaggagctggtgcccaggtgaggtggctggtgaggggcagtgcctcattgtacacgggacctggggacaggcactcggaacttgatggctgggttcccatctaatttttgttctggcagcttagcgttatttaatggccttggctaccaggaaactggctttttaaaatctctttcaacctaattataattactgtgtataaatcatacaatgatcaattataaaaatctcgggttcataaatatttaacttagcatttaaatccacactgcaggagtgcataaaattccaagcccatctcttgcaaacaa

SEQ ID NO: 53948 - DNA, 952 bp, Bovine  19866880773875
ttatcggtgccttcctgcagggggacacgtgttttctcccttcagtgtgtagtaggcagtttgtgtgcacacagcttaataccccttcagctatgcattttctttgatcctgagcttattaaaaaatgcaaatctaaattgtatcttattaatgtgatcctttgtgttaaagctgtgggggttaaaaatcccagtttctctggcatatttggatttttaatgtgcaaagtgagacaagagcctgactatctgcaggccatattttctaatcagctgttatatgaaagatcttttattgtgctgctatttcttgctttcttggaattcagggagataaagagtaatgacttcattgttataccccaagtattctcaggcatattgagacccttattaatttgctataacttctccaacatgacagtggctcttgtcttccaggtgcacactggaagcatattttaaagatgcgtgtaacatgggagatggttaatccatataatttgctagtgactcccctaggcctgggcttcccaggtggtggtcgtggtaaagaacccacctgccactgcaagagatgcaagagacatgggtttgagccctggaggacagcatggcaacctattccagtattctggcctggaaaatcctatggacagaggagcctggtggactgcagtccatggggtcacaaagaatcagacacaactaaagcgacttagcatgcacacatgctcctaggcttctggggcacgcgcgtggtgactgtgcccagatagacctttgtccaggtatgtgcagtcacccttagacccagtgggttcttattgttagagcgatttctttcctttaaaaaataccgtgttggagattttatttgaatcgagtcaaaaattgattccatgagaatagagatgcatttttctcacttgtcttatttctagtttaccag

SEQ ID NO: 53949 - DNA, 2231 bp, Bovine  19866880821331
ttttattgttccttgtccgtgtgatacattttccagggtaaagtaccatctcggtggtgcctcatgttcctgtggagattgggagtgaatgcttgctccctctttttttccccccgctttcctgcatagtctcatctgccctcctggttgcaatcacccacctgtattctgatacctgccaactggcccaggccttcctcccaagctccagatcctcatttctgatgcttatccctcagccttctctgcctcatccgtgccccaagcccaggcctgtgcgcttcctgtgtttcctatcagaaacactgtgtcagccctgagcctggactcagcctatttcctcctgtttctcccctctccattcaccacgtggatattccttaggatccgggattcttccttctgggtcaattttgagtcctcctcgttggtcccattcctgtatctcctctcttagcccaggccctagttatgttgcctggactatcacacatgcctcttgatggccatgctctctctgtcctccgcactgccgctgtggtcaccgtcatcacacacagatatgcccctataattgtctagttcaagaaacctgggtgactccttattgctggaggaggagggttacgtttcttataagcctttgatattcttcacagtcagggctccatgttcctttacaccttagcttatctagcatcctctatttttagtgactttttgcctttcccaaacaagccagatttggtacaacctctgtgcttttgatcatgctgtctgttcgtctctgtctatcttgtttccttcaagaatgactgctcagccttcaagcctcagctcagaagtctcttctctgtaaagctctgtacacagaccccagctctacatcatcacctgccatactgcctggcagtctcctgcatgtctgttggtgcattagtagaaggtaacttcttgaatcttatctttgtatctccagggtcagtccatggtaggcttgatatcactggtgcagggatggtttgaaagatagaaggagggatagctggatagatggaaggatggaaggaaggagagttagggaagacaggaaggaaggggaaaggtggaagaaaggaatgaatgaattccgttcggtattctgttctccaagcagacgcttctgtctcgtctccctgatgcctgaggatgtcatggactttttgtttgctgctccatgtctaaccaggagcactggcacattgtaggctcttagtatttatcgatggatgtgtttatgaaaaatgtgctttaaaactcttgggctatggaaaagaaaagaagaaaagctggttggtagtttttttctgcttataaattgaagattttgtttgtcatctttttaaaaaatagtgcatttgctggcttacttgtggtggaaacagtctgcctgcatcagacattagtagcccctatattttttaaagcctccacttaggaaaaagctaaaggaagggcatttggtaaccagctgggaactccatctcccatgcaggcctgctttttaacttaatgcttaggccctgcaaagttgaaatggccaggtccctttggaaaataaggcaatgaacttaacaaaaagagaaaatcaagatttccattttctcctgaacatggaaagcagcataactaaattctttgtttccttttattaccatattgatggttacattttgtaactatggttaaatggagcagtcccgtggtgagggatgcagggtaagcagtgccccgtaaacatagggaccctgaggatgggaaatgtctgtgcagttacctttactcatttttctgaagctcataatttagcccacaaagtcaagctaagcaagggaatcctaagatgaggttccccggcaaggattgtaatgagcgtaaaatcaacccgcattcatctcgccctttaatgatctatgcatggtaatctaactttgcattttttcccttctctgtccttggtggaaggcagcctgctgggctctcacttgcccacgctttctgataaatgtcaagcctatcttgtggagctggcacgtagttagaagtcatatgtttcctccaagtcatcctttctcccaaggataaggctccatgttgaggataaaacccagtgcacattctgcactcagctcagaacaaacgctattaacctggaggaaagctgacatttctgcaggctgctgcagcgtttg

SEQ ID NO: 53950 - DNA, 927 bp, Bovine  19866880843366
cacacacacagacgaggcggacataggaaacacaaaagtacagtttgaacttaggggaaaacgtttgtgtggctgttgtctattttttcaaactcactaagacatgtgttgtccttgaagaaattcagaaatttcaagcattcctccaggtcgtttccgctgttgttgcagtcacaccagggggccacgctgaggctactggagtctatgtagttgggggtcatgactgtacctaaaagagtaaaaacaaggcgttttattcttgtgtgatgatataaactttcctatagcctgaaaagaaacaaatgttcctctgactacggatgcgccgtggataacaccgtggataattacaaacactgtgtttgctgagtgggaaattatgttaagcagtgcattttctcggcaatttatcttgagcacataaaataatttacacatttacttaaaaaattctaacagaactccttgagctgcgcttagggtatttttctctgcacaaatggtatggatgtcatggagcaggagagaattaacttagaatgcatgaattgccaaatcccttgcattttcttgaaaacgtcattaatcttcacaaatagatagagctggttttacatatcttaaaaggccttttaggactttgccatctacttccttcggaagcaaatggctccttcagagtaacccagggaagtttagaagctttccttatgggttaccccatgttctagatgtattcaaggacgcctctgctcgctagactctcaacagatttaaacaaggtcttccaagttgtgatggaattggaaacaaacagtggaaatttcctaagccagtggctcctccagtattgtcttaatagtcctcaaaaatcctcaaagaaatgctgggggtgggtctcttgcccacatctttcctgtgtat

SEQ ID NO: 53951 - DNA, 1789 bp, Bovine  19866880851409
aaatgcagctcataattgcttcttgtctgaatattttactaatcaagcaagttaagcatgaatgaaaacacacggttctctgatgtagttggcaacctgtctttgccctaacttgggggaaagcgaaatagatgtaagatgatccggtgaagttagggaaagaagaaaggccaggccgaatgccacgttgagctccctgctgtagacagtgtctgcacacagtgctacttgccatcctgccattagtgttaaattacaagcgccaggctgcagacatccttttatggtgtgcaggagactgacaggccagcccgagggactgcttagctaatggaggactgttgatatatcttacaggactgtatctctttcatcacattcatttttaaatccgaggaaacacagaagatcacgagccagttctattcagtgtcacgttcacaaggcaaattagctgaagcttttgcatttttcccacccctgcctgaatctgagaacactcaacgtagggaccacagaagagctcagagatcatcaacagcaacttggattttaaaagcacttccaacacgagtatcacgtttgattctcacaactctgtgaagtgggcagcagggtgcggttattataattatagatgacggttgaaaagccaggacacgatcttcctaacctgtgttctttatagcataccatatcaatcaagctggtaccaggagtgatttctaaatcattaaatttagagttctcagtcaggtctagaagttctaactgacccacatttaaccaattcaccacataagccaacctctccaccattcccctgtaaatatctgatgcccaaggcaggctgaatgcctcacactaggggcctctctcctgctcacctgggccccttgctttctccaatggagatgcaagcttgaaagattcaggatcacttgttctcaaacctttaggtgccgttgtacttggtattttgcttacctattttagttaaataagctggctacaacataaattccccttccattgaaaaatggctttggattaggtgtaggacaaccaacagtaaaagactgaaaaaaaaaatttaagtatatggaaattgtgcactgagattccctggtgggtatcaaacaaaagtcattcctgttttaaagaaatgaaaactggatgttgcagattgtaaatgatagtaggtgtagcttaggcagaacataagccagggaattccagtcagcaaattctttctttaaaaaacttttcaaagtggctttgattacgtatccaaaaatcagtcaatgcatgacattcaattttttaattaaaatgtttgataccatacaggcaatggaatattcagttcagttcagttcagtcgctcagtcatgtccaactctttacaaccctatgaatcacagcacgccagaccttcctgtccatcaccatctcctggagttcactcaaactcacgtccatcgagtcagtgatgccatccagccatctcatcctctgttgtccccttttcctcctgcccctaatccctcccaacatcagagtcttttccaatgagtcaactcttcgcatgaggtggccaaagtactggagtgtcagctttagcatcattgcttccaaagaaatcccaggtctggtcccatcacttcatgggaaatagatggggaaacagtggaaacagtgtcagactttattttggggggttccaaaatcactgcagatggtgactgaagccatgaaattaaaagacgcttactccttggaagaaaag

SEQ ID NO: 53952 - DNA, 3244 bp, Bovine  19866880852440
gtccgactcttagcgaccccatggactgcagcctaccagggctcctccgtccatgggattttccaggcaagagtactggagtggggtgccatcgccgtctctgagtatctcctgaactgtgctcaaattcatgtccattgagtcgatgatgccattcaaccatctcatcctctgtcgccctcttctcctcctggcttcagtgtttcccagcatcagggtcttttccaacgagtcagctcttcgcatcaggtgattgaagtattagagcttcagcatcagttcttccaacgatattcaaggttgatttcctttaggattgactggtttgacccccttgcagtccaaggggcctcccaagagtcagtctttttctagcatcgcagttcaaaagcttcaattcttcggtgctcggctttctctatggtccaactctcacatccatacatgattactggaaaaaccatagctttgactgtagggaccttagtcggccaagagatgtctctgctttttaatagttgagagaaagcgatctgtgagaagtacaaaattatccaaatgcctggtgttgttaatttccatgacttgagtgaatggggatttttccctttggatctgtgtggtggcctggttttcagttgccacagaaaagtgtcttcaggtctggtgtgtctggtagcagtagtacagccctccttcctcatccatcactgtgcgtcacatttcctaaagaagatctctgtagatcatgtgccaatttgttgggggcagttatccatcaaggtggaacctgggtcattcatctttacacctggcagctgccatcgacacatagcagatgctgccctgaagggctaggaagtgacaggaacagctcatctgagagggagccacagcaccccgtgacttctgatgtgtgctttgggggaagaaattccaaagagaggaggtgtgtttgaaattattgctcccccaaaccccaatcctgtttcacgtgttttttgccccaatctaacacccaagaaggaagggatggtcttgggagactctggtcccatttccaggtgtcttattgtcgctttgattaatattcagttcacagaaggtatggaaagctcaggtgaggcttttgtgaccattcacactttgaggaattaggcatcatttgtgcagtgaatgtctgagcgtgcgctctgctccggaagtacgatggtgaacaagacagacagggcctttgttctcgaggtctgacagtccagggggaggacaggatgacaggtaacaggcagtcacggcataatgtgacatggagacgcaggggggtcgaggaacttctagggaggcaattcatctggatgtggagcctcaggggaagctgctgaaacattaaccaggtgggaaggctgggagtcagagggtgggagggctgtgggggacagagggacagcaggtgtaaggcccaaagtggaagtgggggggctgcatttgagcagcagtccaggactggcatcacctaggaatttgttagaaatgcaaagtcttggcccctactgcaggcctacagaatcagaaactctgtgagtggggcaggccgagaagcccattttaagtagttcccaagtcatcctgatccacatcctagttggagaatcaccatgttagaggaagtgtaaattgtttaatccagaatctagcccaacaaagcatctttccttctggaagagacatgacttccatctctgccactatgggtgggggtccctcctggcaccctgtcctcctcttcttccccaccattcaactacagggttttattaatattctcagcttctagtggggatggtactcaactttctgacctccacattcccctcccccaaagagctacaaagagaaatagacatatccagttacagtcagagatttcatcagtcatctctccataactgaaggaagaagaaaaaacagaaaatcaataaggatagaaaagacttgcacaacaatatcacccaacctgacctagttgacttttatgaaacactctacttccaaacaggaaaatacacatttttttttttccaagtatgcacagaacatttaccaagacagcctacattctgagttataaaacaagtcccaataaatgcaaaaggattcaagtcacacaaaatatttctctgaccacaataaaattaaattagaaataattacagaatgatatctgtaaaattcccaaatacttgaaaactaaataatacacatctaaatatcatatgaccaaagaaatcaaaagggaaattacagaatatttgaactgaatgaaaatgaaaacacaccgtttcaaaatctgtggaaggcagcttaagtggtatttaaaaggccatttttagcatgaaacacttatacacaagaagaaaaacctaaaataagtgaccttagtttctatcttaagaaactagaaaagtaaaggcaaattaagccaaaaataagcaaaagaaataaagtaaaaagcaatgatgtaggcaaaaaacaaaatagacaggaatgaagccaaaatctagttctttgagaccatcagtaaaattaataagcttccagccagattaatcaggaaaagaggaggagatagaggaaagatacaaattgctaatatcaggaatgagagagataattttaccacagattctacggatattaaaaggataatcagggcataatacaagcaaatataccaataaatgtaaaatcttggataaatggacaaatgtcttgaaagacaaactacaaaagttcattcaagaaaaagattggtaacctgcataaccctatagctttaaataaactgaattcctttacattttaagtaaattcaaaacgttcccatgaaataaaactccagactcagatgacttcactggtgaattacaactgaacattttaaggaacaaatgatatcaattctataaaaattcttccagataatagacgtgggttatctcccaaacctttctgtgagaccagcattactctaataccaaaactagacagacattgcaaggaaactacaggcaatatccctcatgaatatatatgcaaacgttctcaacagaagtttagcaaaaaatagagctaaacagcatttgttgttgctgttcagtccctaagttgtgtccaggagaaggcaatggcaccccactccagtattcttgcctgggaaatcccatggatggaggagcctagtagg

SEQ ID NO: 53953 - DNA, 1636 bp, Bovine  19866880870015
agccttcttaaatgaaagtctattagtgtgagaattctgatttctagaatcaaatctgttttaggtcattatggagttttataaagaaaagcctcctctgctcagcctaacaacacgttgaagtcttaaaagtaggcagactattgatttttagcaagagttttactgccccagacactgaagaatgattctcatgactaaaatttataggttattaaggagaagaatgcagagaaaagactagttgaaagattcagaaaattagctcattttgttcgttagaattcactaagcaccctttcctgaaatatagatatatcagagtctggaaagggcctcttggttacatggtaaatttatatggatcagaaatatagtggaatcgtattttagcccacaaggacacgatcactctttggaggtttgcgaggaaaaagcaaagtgctctttttaaagaagcttaattcgaaaagatcagggttggcagatcggaccactggtggactttttttttcacctgccaaaaaacctgttcagtccaaactaaacagacataacagaaagcttcttctagattaaggaggtagtcatgcaatgttttgtttttaaaatatcaaattctgtgcttcagtttcgaataggggaatcgttctgaatccttgggggtactaatctgtctggtacctttcaaagggaatgtgtagagttactggaaagccaatcgtgtgaaagcagtaggggtactcttcattgtacttggattaaaatataaaatgtgccttatgccagaggcagggcagtataggagaaatcactgcacggggaaggtttgaaaggggcatctggtctcagctccatcattgagcttctgtgacactggacactctgaacctcagtttctgtatatgtgtgatggggttcgtagcagccatcatgcctccatcatacccaccctcagaactgtgatccagcctttcctataaaggaatcgagaccacgtggctcagcaaccggaaaagcaccggtcccatagcacctgctccaggaagtgaggtagaagttctcactacccaggactgcaggggtgaagtgtgaagtgttcgtcaatgagtcatgtctgactctttgctactgcatggactgtagcccgccaggtgcctctgtccatggagttctccaagcaagaatactggagtgggtagccattcccttctccaaggtatcttcccgacccagggatcaaacccaagtcttctgcattgcaggcagattctttaccatctgagccaccagagaagccccaaagaggtgatggtggtggtggtttagttgcttagctgtgtccaactctttgcaaccccatggactacagcccgccagacccctctgtgcctgtggaatcctccaggcaagaatactggagtggattgccaacccagggctcaaacctggtctccggcattgcaggtagattctttaccctctgaaccaccaggacggtgttctcagtatccagggctgcaggggtgaggatgagaccaaatcatctatacgaaagtactctttaaagtgtattgatgtacagtatactaacacatatatatggaatttagaaagatggttaacgatgacccta

SEQ ID NO: 53954 - DNA, 1371 bp, Bovine  19866881017331
tgtaaaaagccactttgctccagtgcatatgtatgtgttcatcatctgtattacatatacattattaatgtatgcgcttccctggtggctcagatggtagggaatccgcctgcaatgcaggagacctgggttcaatccctgggttgggaagatcccctggaggagggcatggcagtctactccagtattcttgcctggagaatccccctggatagaggaacctggcaggttaaagtcgatgaggttgcaaagagctgaacacgactgagcaactaagcacagcacattactgtgtgtgtataaatatgcctagtagacatcagtttttcccccagtcgggctgttgctttgttgaggaggttgggccaatagctttgcccagcagcctcggttttcttatctgtaaaatgagagttggggagatccttgacccaatgtggcctcctgctgacgctctgttttaagaagttttaagtgaacttgagttaataagagtacaaaaatgtcccatgctgcagattttgagtattgcccagagaacatgggtggaaacaggttgagaatgaggtggctgagaattaaggtgaaaagaagcacggttgcagaagtgtaacgtactctcaaggctttttggaaacatcagttcttgcctatgtgtgttaataatggaattcacactgggtggcattgcttttactaatctgaaaagaacaataaatcatagtttgctttctggcagcccagcccagctcgttaattgttgaggtgggtttgtgatgacagtgaccactgccatttataatgtgcttgacttaagctcttttgcatttttcaaatgtgttggtctaactgctggagttggatcttaggtttttcccaaccacttcagaaaacccatctgttataaaactctgaccctttagccatgaattatggtccccctggtaacattatacattatgaaatattgttttctttatgaatgtgggatttgggtgaataaattaaatctattgttaccacctccagggaaaaactccaagttgtcatatgatgctaactagtaaatgagaaaaatgcgtaaacattcttatggtggaaagtggctggttccctggtcacacttttctatgctaatatttatgttgtatatatatcatccccctttctgttcagactcagtagaatattccgagtcatgtaggaaatgcattcatctttccagcacaaactgaacattaccatttaatttcacgtagattcactttgtgtgagtgtgttgtgtaggaaaacgagaggcatatttaaataatcacattctctgagatgcttcataacattcctgcgtgggctctgcaagggggatctgtt

SEQ ID NO: 53955 - DNA, 1372 bp, Bovine  19866881023355
tgtccgtgacctcagttttttaaaacctcttggtgacttgagcctgttaaagggtctgatcatggtcatcttgttgattacatccttatcaagcccttggacagagcctgagcacccaggcttttggcctctcccctcctgttctattagtctcacaaaggctgtgctcacagacacagccatttctacccatgttttctgctctttgctactcaacaggagctagcagtgcctcccatactctagtgcaaaggtagtcttcccagcatgtgattattcttatgggcataagaataatagtgtctttgtttctaggttctcacaaatggagtccagtgggcttgtttcagttcattattagcatccacctcaagagcttcatcaaaatcggcgctctaccaggaaacacattacttatggatgacaatagttgcgtgcgatgatttagaagggaggagaagattgggcttctggacccaaggcttttccttattagaattgtggctctgtgaaaggcttataaacactgttcagaaatggaacaaagatctcagaagagggatgctttttctaaagagactacagacacaatttacagacaagtctagaaagaatattatttgaagagggtgatgatggagctatggaagctgagaagggatggagcttttaattggaacaaaaaagaagcttcaatcccagaattcaaaaccgaaacagagcttagaatccttaaaagaagataagaaggagggggaaagcaggtagaaagaggccaatgtctgtctgttgttggggatagaagctagaaagtaaggatgagggacaggcacacctcggaaatactgcaggtttggttccggaccaccacaataaagcaggtattgtaataaagtgagtcacacagtttttggttttccagtgcatataaaggttatgtttacactataaacatatatttactacacctagcctgctaggtgtacagtagcattatattgctaaaaaaagtacataccttaattcaaaatactttgttgctaaaaaccatcttctaaccatcatctgggcttccctggtggctcagtggtaaagaatctccctactaagcaggagactcgggttctctcccttggtcgggaagatctcctagagaaggaaacggcaacccactccagtattcttgtctgggaaatccgatggacagacgagcttggcagacaaaagagttgaacacgacttactaactaagcagcaacaataaccatcatctgagccttcagtgagtcttagtggtcacatcaaagatcagtgatcacagatccggtaataaaaataataataatggaaaagtttaaatacggtaaaatta

SEQ ID NO: 53956 - DNA, 990 bp, Bovine  19866881025113
ctggctttgaaactattagacatataaagaactattagggagagaagcgtaaacgcacagtttctagacaataagcctttctttgacaacagttcctttaactagtatggagttttattatattaatcacttgctgattgctagactgatatgaaaatataatgcagaataagatagttataatgacagtagtaaaaaatttttagatggcatgagtccatcaatataatgctgaattcttttaaaatcttgaatagtcacttgaaaattcttaagcaaaaagcaatgctgcctaaccagaaacagtttaggaagagtttgaccagcttatgatgtgccttcatagactgcatagactccaactccttaaagcttcagcaattccatgttctggttcttattgacagaaactgaaattactgagcaaaggactggctgattgtcaaaaaattacatcagatagatcctggacttcagcttggacttaagaacatttgtttctaaacaagcacttagaagccctggaaagcaataaagtgaaatgcaatttgcaccgactaacggagcagctaaaagaaagggagtggagaatgggtgctggtgagagaggataagttttgttggggaattctgttgtaaaatagtctttccctgatgatgaaacactggctaatgacatctagaattttcagctgaagccataatagcttcaagtttgggtggctgcacattaaaacgagaaacaatgcaacataaaggcaaagccatatactaaaatttggtatttggggaagtagcctattttatagggctaaatatctctcagttaaaaagcaaaacaaagcaaaccccccacttttatggtgtagcttagacatttaatgctaagtgctaattcagctcatgaaatagcttgacagttgtttccttcttgtataggaggtggttttattttcctaaatacaaatggtataagaaagaaaactatta

SEQ ID NO: 53957 - DNA, 927 bp, Bovine  19866881046296
acacacacacacacacacacacccaatagtaacactgaaagttcctgatacttttaggacacacttgtgtttggacatagaaacaagggaatggagtcatatccacactgatcgtggtgttttgtcacacagcaatttgcttgtccaaagtcagagtcagttaattttgttaggtccttgctcttcttcatgtatacagttcatatgtccaaggttagaaatattttaaaatgtaagaaagaatgtatttatgcatataactgaatcactctgctgtatagcagtaattattacagcgttgtaagtcaactgtgtttcaattgaaaaaaagtaaaacaagatataagtaaagggtaaaccacttgacaacttccagtaaacagctatatgtttgatcgctgaatataacacaatactaggccaccactgttgaaatccccaaaatgtctaaccaaacatttacctgccttttcctcttcttccaggccttgcaattgccagtgccctaatagatatttcacagcagaagccttcagatagtaaagacaaaacttcaggagtccgaaatcgaaaacaccacctctcaacacgtcaaggaacttgtgtctgaaaaacagaaactgctcctgtagattctgtcatgtttgactctgtaaatggcttccattaaaggctagtccaaggcctcagttttcacggagacaaatctctgtatggtcccagggcccaaacacagttccctctgaaaagggaatgacccgagtggccaaagaatgttcatgagttttataaaattaatagtattgatggtcacaggtgataaagttagtttttacagctatcttaggcttatcatagataacattaaagtactcggaaaaaaaagatgtatattgtttcttaatgcagataaaaatatgtattcat

SEQ ID NO: 53958 - DNA, 1597 bp, Bovine  19866881066355
ctgtaggcaggaggtctcccatacccacgaggccagcaaagggccagagagaacagtcagggccagtacagggcctgtgcaaaggagggtggggcaggttctgagggcaagagaagtggacaaaattagagggtagaagtcccttactaccatatgttaggggcttctcaggtggcactaatggtaaagtacctgcctgccaatgctggagacataagagacacaggttcgatccctggatcgggaagatcccctggaggagggcatggcagcccactctagtattcttgcctagagaattccatggacagaggagcctggcggtctaaagtccatggggtccgaaagagtcagacacgactgaagtgacttggcatgcatgcaccatatgttggattctgccaagacaagctcctactccagtgacatgtctgcacatttccccagccaggtggatggtgttgctctaggacttgacagaaaagagccacctctgcatctactcaccttttctcacttcatcatcattatatagaagctcattgacattccctcaatctgttgtgaagagttaagatggtttcaaatctagtcaaactcaaaactagtttatttgccttttatgatgatcgaaatgatgcaaactgtaaaaaaaccttatgttcaacactcagtgatattaatttcacttgactttatgacttaaggtcaaatatgttaatcaaagccgccatcattagcacagtttccttttctattaagtgattatgatcacttactattaatgagtcgtgaagttttaataaatttttgctggtgtgaaattgcaaaacagtaattatgacacatacggtatggatggcttgttccacaacgtaaatttggtctaatgttggtaaaaatgcaaaagaacattaggtaattaattagttcctctatggaaccaaaataagctttcaccacgacggtaaatgaatgaaaaaatggaaagccttttgctgttaattgtgaactgttaaacagtgagacctagccattcaaaaagacccagtccaccccaaccccagataatatcatgacttaaggagaaatagctttgcaagaatttcttgtgttgaatcaatatttttggcatggggctgattatatgacagtatggggcagtataggacagtatggggaggcttccctggtggctcagctggtaagaacctgcctgccaatgcaggagactcaagagatttgggctcgatccctgggtcaggaagattccctggggagaaggaaatggcaaccccctccagtagtcttggagaattccatgaacagaggagcctgttgggctatatcctgcaaacggtcagacttgactgagcacacacacatcatcatggggcaggaagaggatttggaaataaaattaaatgttgatacaaaggaattgatgggaatgggaccgaagaatcaccatctcaaagctgagagaggtcctccgagcctaggatagaaccagaggcaaggatcaacacgcacattggtttacagggcgcataagaatctctagatgtgggacttccctggtggtccagtggcgatg

SEQ ID NO: 53959 - DNA, 1274 bp, Bovine  19866881080471
ggcatgcatggcaagccactccagtattcttgcctggagaatcccatggacagaggagcctggcagactacagttcacagggtcacacagagttggacacaactgaagcaacttagcatgcaggcacagattacaaaaacagaaagaaaatagtggccaaacttttgttctacttgtctgaaacgttatcaagtagtaagtaatgccagcagtacatgaaaatgaccagtaattcaagaatagatcggacacagtagtttgttgtatttttaactacagaagattggtcaataactgtactcaatttgccgttgtttccccgtggaaagctcagtttgttagctttaggaaaggctcagtcaatggattcttttttactaagagaaatgatccacgggaagtccccagaggagtaaagtcatgagaaaacgcaggcagcctttcatgctgaacggcacaaccaggaaagtaagtaagactctgacctatttgaggtagcttttcaaagactgtgcggttggagctctttttaaaaaaatcaattcacattatcaaaagaaaactggaaatgatcgtaaaaagctgtttttattagaaaaacttttcttctattataataatacagtatttgaagtgcttgaaattggcctcaaataatattaacatgtattaaggaagacaataattacctttgtaagtttgtctctttgtagatatcctttgttgttttctagtagaacagtctgagaggtgggaaaagcacacatacttggatgagacgagcaaaatcctttatttgttaatagtttgtgacctgatttcaaaagaaggttgcagcacctcatgatccatacctgtgttaataagacacaaaagccataaataatttccccccattatatattgcttacaattaaagtccccatttgggcaaatgatattgaaaagcaatgtccttattgacagcattaggattttttccccattattatattctcccctatttccaaaagaggattgaggtgattcacagtgaacaggacagacagaagcacagtctttgtggttgatggtggttgttcgtgtgatttgtttatttttagtaaatagtgattcattagaataagctttggagtcaaacaagcttggttataaattccagctttttctcttgtttgtcttgggtaggttaattcaattctttgaacttcatttccttcaacaaaagaggtgcattaatgactacctaaggattgtttcagcaactctgggag

SEQ ID NO: 53960 - DNA, 1404 bp, Bovine  19866881082599
ccttcactcagtcatgtccagcttttgtgacccccatggactgtggcacgccaggcttctctgtccttcactcagtcatgtccagcttttgtggccccgtggactgtggcacgccaggcttctctgtccttcactcagtcatgtccagcttttgtggccctgtggactgtggcacgccaggcttctctgtccttcactcagtcatgtccagcttttgtgacccgtggactgtggcacgccaggcttctctgtccttcactgctcccagagtttgctcacattcgagtccattgagtcagtgatgccatccaaccatctcatctgtcaccccttctcctccttccctcaatctttcccagcatcaggggcttttcagatgaattggctcttcccatcgtgtggccagcgtattggggcttcagctccagcatcagtccttgcaatgaatatttagggttgatctcctttaggattgactggtgtaatctccttgctgtccaagggacactcaaaagtcttgagtacaaatggatggacatgataaagcctagagcccatggaatctcataagagagttctccagtggcaaaggcattggggtgaggatggagtagggtgtggaaagcaaaccggaggctgtgactctgtactatgaagagccccagaatcaatcctcttgcacctcttgcaacatataaccgcaatttcatgtttccaagactcaacacccagagccccagctttgactgtaaagtttagatagtgattattactttaaccaccccctcagagtagctgtgagagtcacgggagaattttttttcaagtgatattttgaagaattttgtcaactctttagtgccaaaaacaaaaaaaagtttgtagagattgctgtcactgaaagagactttaaaattactatagctgctattagccaacagcaataagtaacttttacaaccaagaagaaaaataatatgattaaattctctgacaaatagtaatttcatcttactcaaatactcttcttctgaggagatctcagaaaatatagagccgtttacagagattaatatgtcctaacttcctttttatgaggtaaataaaggaaaaaagctaaggtcatgaaaaatttgaggcctcgtggttgctagaattggggaaattagtttgtattcctatttttaaaaatgtatgggttccgtgaataggagtcatgtgtgtgtgctcagttttgtctgattctttgcaacttcataggctatagactgccagcgctcctctgtccatggaattttccaggcaagaatactggagtgggtggccattttcttctccaggggatattcccaacccagggatcaaacctgtgtctcttgtattttctgtattgacagacagatt

SEQ ID NO: 53961 - DNA, 1799 bp, Bovine  19866881157760
gtgaattcttttaatagaaagacaatgctttgaacaaatgtagcataaagatattttaaaatagatctgcagcttctatggatgcccataatatatgtaatggtacttggtctcattaacaagcagctcaaattcttcagctatcataaaatacaagtcatcagcagcgcattctcaggagcaataatatgtctgtctgacccaacttctgctctgcagttaacaattttgttttaatccgtaaaaaaaagaaatcattctcatctttaaattgggcaagtgatctccctaaagtctagttttcatggtgtctatggttctacattccacagcaatttctaggttccttttaaaatgactgaaaagccacaattaattcattacctacaaagacaaccctaagaccttccagcagaggactccctgaaaccacccccacccaaaacagcatttttgacttggattcttttggttctttctcctgctattcaaaacctaccagcctaaaatatctgagcttaagaaaacatacataaagaggtattttccaagctgtgccttaaggaacccttgggcttcctaggtggcgctcgtggtaaagaacccacctgccagtgtaggagatgcgggttccatccctggatcgggaagatctcctgaaggagggcatggcaattcactccagtattcttgcctggagaatcccatggacaaaggagcttggtgggctacagtccataggattacaaaaaatcggacatgactacaaccacttagcatgagatatttctcaaggtattcataggctttctttaaaaaataacagatattggttcaagatgatggagtagaaatgctcatttcctcctgtgagagcactgaaattccaacaacctgttgaacctctatctacaggaggatgccggaacccactagaaaataagagcaatgattctatacgaaaaaagtttggtaacggcattctacagttccctggagactcacaatgcacattagtttaataaggttctgagacatcctgatattaaaaaaaaaaaaaaacctaatttgtagagtttaaagaaatgatcccaaacaaatctggccatgacccttgtttcctgtaacttacttaaccatattagggctggggatgtcttgcaatctataatatggttccaagcctggtacggagttctgtcctaggcagctaccaaggccttagtcataggctattcagcttctttccagccaggcattctgaaagttatattcctgatctagacttgcattccagtaaactggtcttcaccaggggaacaagacatgactgtatattttgaatagagcaaatcatcactgataatttgctgctaaaacatgtttccttgatgacaaaaataatgaacatttgggcttttcagtggttcagtggttaataatctgcctgccaatgcagaggacatgggttagatccctggttcaggaaaatctcacatgccaaggggcaattaagcctgtgcaccacaactactgctgagcctgcgctctggagcccatgagcctcaattactgaagcccgcaccacagagcctgtgctctacaaaagaagcctctgcaaggagaagccggcacaccgcaactagagaatagccctggctctctgcaaaaatagagaaagcctgcatgcagcaatgaagacccagtgtggccaaaaatacatattttttaaaaataatgaatgtttattcagcacttgtagtatatagaaatgccatcctcactacttggctataaat

SEQ ID NO: 53962 - DNA, 1353 bp, Bovine  19866881168626
ggctgggaataaaaataagattgcaaaataaatagcacaatgatatctcagttttaagacaattgctatcttcgaaaatagcgtatcatcaccctgcctccacacaaggctacatctaagctatctaagaaaaaataatagctgaaattttcttaattgattggttttcagctactaataatggtagctcacatctgttatcccatttgatgctcacgacaattctgtgaggaagcagaacaattatgatcacggtctctattttatagatcaagatactgaaggttctgatttgttcaaatgtgcaagtgataagagttggttctagaaacaaaagtcaccacttttgcttagctttttctaaactgagaagccttaaagtctatagattctttgtccaattaaaaatttttttaacttcactctcttttaaagaaaggccagaaatcagtgtacacacagccaaagaccaccacgctgtctcttgagaaattgacgtaagaaactagcatttaattatgactaggaattatgttaattatccatcctgcaaagttatgtttatttaattttgcaaaatctaacataccttttatgatttttccattaatttttttcttaaatttcattttgaatacaaaccatggtgtggcccactcctgttattccaaatacatgttatagtttttctaaattgtatctcccttttgtacttaatcatcattcacaatgatggatgaccacaaggaaccatgtcttactactgttcagctgtttcaataaatcacaaacagtcgacatttccctttggtgtatatatccagctaaaagtgaatttaaatggcaactatgtgaataaagtcatgggaaattctgcccacaaagtgtgtagccctaagtactctcttccaggagcttcttctcaatttgatatctgcaatcagtcatatgttattcctttcatgttaaacaagatgaattataatgttttgaagcagttacacaaagatctatttacaatacaacccactgaaaagtttgccatgacttctgctttcacacaaattcatatttcagctcctttctaagaaatctattccaagtcaagagcccaataagcaaatacattttaaagacatgcagccctgaattatatacctacttcttatgggtaatataaacacaacattcatcgtcatttttgaatcatagacaactccactgttaacccacactacacttcacttagaagcttatgcttccttctgttttacaaagagaacgtacagctcaagccaaagattaaacataagcaaattctgaggcttgacatgttttggaagtgtgttttca

SEQ ID NO: 53963 - DNA, 1997 bp, Bovine  19866881172834
atgggctgtaatttagaacgatggcagctcctatgacctctatattggagagtcactggaaattaaaaaaaaaaaaattctctaaacaatttaagtttatatttgaaaatctggcttaaatgtctgacatggagccattttatttcatgaaaggattttcttgtcctagccacagctccaaatacttatcctaaagctggagaagattttctgccttttttttgtgtgtggtagaattctcctcagattccactcctaaccagattgggaacattctaatgagctgggtgtgggcaggtttgctctctttgtttcactagatgaaattagacccactctggtctgtaactatatctccttcctatcctgcaaggaggggaagtctaaagttgttacagtttccaactttctctttatacaaatgtcttgtctcaggttctgagtttgatcctcaaggctcccgttttgaaaaataggttctattactcccttaattgtgagagttaaatgccttttaaagagttatgtgagttaaatatgagctgggtatgcagtgtagggttttttttttttttttttttaccaaactgcaattctccaaacataccaatacattccaaaattgctagttgcaggccataaaatatttacattacggagtaaataatgtatgtttagtaagaaatgatgaaatatttacagtttttctaaagatactatacaggttttttcctctaccacagccattcttcttgaagcaggcaaaataggcaactttaagagctctgagaacagcatggaagcatctttgaaggaagagaatgttctcaggcagtaaatggagatgtttctataagggaaagaaacaacagctgatcccagatatcaagatatacatttcatatggtaaaggtctagggatgcattagcacacaattttggtatttttaccattaaatggaaaagtcactgggtccaggtcatgtcatgcagtcatttgccaaagccaatcagttggagttgtgaactcagaagatagtctggccatctacgcttccaaacacataccttttaaaacctctcccacatgctcaatgaccctgaagaagccaatcacagtgtcatgaaatctccattgcgtgtgtttagcaaagaccctgaagaagctctaatgaaagtttcccacaaaatcaccggagtctttcaaagaccttctcaggccccacccaacctaagaaattctggtaggatcactctagcatagggtctaagaatctctgttatttttattgagtatagatttacaatgctgtgttaattacagctatacgtacagttatacatacatatacatatataagcagtcttccctggtggctcagtggtaaagaatccatctgcaatacaggagacgcaggagacacgagttcgatccctgggtcaggaagattcccctggaggagggcatggcaacccactccagtattcttgcctggagaatgccagggacagaggagcctggcgggctacagtccatagggtcacaaagagtcagatactgctgaaatgactgagcactcgcacacacattcacatatacattctttttctaaatattcttttctgttgttttatcctaagatattgaatatagttctctgtgctataatgtaaattcttattgcttattcgttttgtatgtaaaagcttatgtctgctaaccccaacctcccagtccatccctcccttaacctcttcctctttgcaaccatcagtctgttctctatgtctaagattccatttctgtttcacacgtagtttctcttgtgtcatattttagattccatgtataagtgatatcatatggtttttgcctttctctttctgacttacttgctttcagttagttcagtcactcagtcgtgtccaactctttgtgacccccatggactgcagcatgccgggcttccctgtccatcaccgactcctggatcttg

SEQ ID NO: 53964 - DNA, 1192 bp, Bovine  19866881185525
aaaaatgcctcgtatgcagggagaacaagtgtcctgaaataaaatccaggagccacaacagacagttagctccacgaggaagtgcttgttagtcttgtcaccaccaattcccagatcttgtgccaggcaaagagcaggggcccaggaactgtgttaaatgaaaagaaaaaaaaataaatatatgaaaatatttggtatgaacaaagtctttttgtataggcaatgaatgtataaatgttcctttcaataacaggaaaatgctagaaaccaatactcaattcaatgtactgcattttgatgcatcatatcagaacctaaatgatcaaatgaatgagagccctgtactcctgtctataaatacagttgccagatttatcaaataaaagtacaaggtgcccagttaaatgtgaacatcagataaacgatgaataatttttcatataagtgttttccaaatattgtatggcaatctagctataatgtcatattgtatcatattttagacaaattgtaactttgtaaagatgttactgccttaacgatgatattatgcaggaagaaaaggaagtgctgtcaggagactgtgttcacaaatgggggcagacagtggaaactggctgtgctgcattgcgctgttttaaaagtatgcttcaccgtgagccagtgcccatggagcggggactgaaattcagcttctcataaattctgcagtgctaccagggaacagtaatcaacaaggataaaatctggagggaaggtcagtgaggcaggtaagaactggtgcatccatattacctaaagaaaacacggctccactaaacaggaccaagccggacctagaaagggcaagagggaaaaatagaatcgccctgtgtgagttttgttagattgcctttaggaaagagcccacatcagctcccacagcctactttaattttaccttcgtgttgtgcttgcttagcttatgagctagagttgagtgtaccctatgtactcagtggcctgctttcataacgccctgctgctggtgaagtaattcactgtgtttcttaggaaggacatggcgttgctgtgttcatttgtgcctgatctgaagaatctctattgaaaccttttttttttttttttttcccccgctaggcatttagatgctacctggctgttaggcctgaaaataccagatggaactggg

SEQ ID NO: 53965 - DNA, 659 bp, Bovine  19866881223285
ttgtccttgctctccccagagtgccatgaaaacattggagaacaacccaggctgatcttgccagaaaactctcccactctttgcaaaggaaggaaaccaaagaggaaggaatcagtgacgtcacaagcccagattgcctccaggagccaatggaagaaaggtgaccccaaagagcccccactcccccgattttgtttttttttttttttttttgctcccaaaacatggcatgcggtcagaaagcaggtactctggctattaaacagtcagcctctgaaataggttttcattaacaggttctggaggaagtagcagctgagaggtcaaatctgtatatcacagattttcagcaagagtctcagtggagaatgaaggcactgaatgtttgtgttagatttacaaacatgagccacctcctgcacacaaggaccaaaaaactgccattgtaatgaatgactgtaacaagtagacctgtccctctctaagtcatttctgtatgaaccaaggctgaaccacactagctggttcaagactcagatcatctaagatgacaattttttttttccccccacatctgcctttgattcaggttttggaggtggaggggatgggtaaagatagaatagattccactagactttttattctgaattctttat

SEQ ID NO: 53966 - DNA, 2170 bp, Bovine  19866881232842
tatgaggtgagtcttttgtttctatgtagccagcatttccatgctactaaaagaacattggtttccctggtggctcagagggtaaagaatccacctgcaatgcaggagactctgattcaatccctgggttgtgaagatccccccagaagggaatggctacccactccagtattcctgcctgggaaatctcatggacagaggaacccggtgggctacagtccatggggttgcaaagagttggacacaactgagcaagtaaccatgcaaaaaaatatcagggatccctctagatcatctactgggagaatggaaggtgacaaatgggggaaccttgtgatgtggaagaattattcaagtagcctggatttgaaagcaacagaaccttacctgtttcttagtgagctaaaacctgaagacatgtaaaactactgcaaacatttttgaaggttactttggacaagtgtaaaattaaaatatggattcttaattctacattgacagagatggcatcactgattttgactttgccaaagatgatctcatgtccagatgaaagaaataatgcagaatggattcatctagaagagccaattactcaggtactacttgatacaagaccatcttttctaatgagcaatagaaaatttaacagagttttgtaaggcagtattttgttctgtttgtactttttgacaattaaaacaaaaaagtcaaaaaatgaaatgcttattgacaattttggaagattactctggacacttaaaaagcatagtttacagcagataaaagtcttatttgttcaacatatacatatataaacaaataatgaaaatattaaagaaaaaagccgctacagaaaatacataagggttgggagaaagacagtggagagagaaggtgcttcagaccaggaggattacagaaggtctctgcggaaatcacatttgacctgaaaccttgaatactcagtcagagtaggtgtgcattctcaaaactccgtttaacacaaaaaaagtgtatttctggctcacataaactttctataactccaggtaacttcacatctggtaacttagcaatacggatgctccagtcctaagactcttatcatttcaacccagggattccttaagtgtaaaggcagaaaagagactagtgaatcctgcatggacttttcaatgtctcaggccagacataaaatatttccatagccatagagctcaccctaactagagaccacaaaatgcagaggaacaagtgcaatattacatgagtggaacaggaacaaataaagccaaaaagaacttttcaggcagaggtaagagcaaatacaaagttccagagttcctcaggctttaagtatgagcttgaagtgttcaacaaaaagaaagaagtttgagttttattaagcaagggggcaaagagcagatggtcaaaggataattttggttttatcaaggttaagagaaattgaaataacatatacatatcatcaggcatcataggattcaaaaaaatcagattattttttttaaacataatttccttttgtattgcacagacagcccattcttctggtgttagaagtagtttggaacaaacaggcaaaagaaataggctttaccctcctcaaataaagttattcaagacataaccagaaaatagcaacagcagttaatctcaaatacaatgaacctagctctcccagtaagaatcgaaaggtcaattttgtatgtaaccttctttaatacaaaaggccaggtggttgtaatttatctgagcaaatcaaaatgaacaaaggatgagtactgaaaaggtcatttaaaagctagatcactagaatggatgtttaatacatattactcctcaaagagcaacaatgagaagctaaataacttcaaattttgaaacctgcacttggaaaaaattttttacccacaaagaatacccctatagccccactgtagaatatattacttccccaaatgagaggcctaagttgcaagaggagaaaatagttgtgctgctctcaagaagagcaaaggaatgactttgacagccacgcggcactcagcatgatctagtcaaccttgacgcctggaaatctaaaagcagctgattacaatagaaatgacacatcgactcttgcttgtgtgccagtcatttatga

SEQ ID NO: 53967 - DNA, 1523 bp, Bovine  19866881267450
tgtgcgaataaaagatgaagtttggtgaatgggtagacacaagagcctggcaactctgaagtgacatcttgaattccattttacaaagtagtggctctcagcccgttttaacacatagactttttttttttggcagcaacatttttgagggtgaatgttttaaataaatcttgtactttccagttcactgtggtgcccatcacttttaactgtcttactctacaggttaagacaatctgcttacctagtacaggcagtgtgcataatggttaggcatacaaggtgagaagatagctatatttttccaaatcctggcttgttcacctgttaggtctgcaaccttagttatgttacataaactctttgagcttcagtatcacaatttatgaaatgggaatagcccctacctcttggaataggattaaacccatgtaaacatttggcatagcataaggcatatcgtaagcacttaataaatgtgagctattccttgaagtaatttgagttggcaagccctactttggcagtattaaaagttttggttttgttttctgttttatttttttaatgaagtatagttgatttacagtgtttcaggtatacagtaaagcaattcagttatatattcgtgcatgctcagtcatgtctgactctttgcaaccccatggactgtaatccgccaggttcctctgtccgtgggattttccaggcaagaatactggagtgggtagccacttcctactccatcagttacatgtaattctctcaaatcctcagcttctggggttagtttccagtgatgggcttcagtgtgatttctataagtcacccacttcctccttcacttactctttgagaagcaaacactggaggagggaacaagcagccagcttttgcccactgaagtcttctaaacacccagggcttcttgtagcagcagttttccaggacagaccccgggttcacaaggtggtttccgtttcagaatatgttactggaagttttaagaactgtaatcttgaaaatccttatgatttcagaagcttctctggtaacttgctggtctttgatagctcaaaaacagaaaaagttttagaattgctccaaaaaaaagcaagaacttaaagatatgagtacaatagtttcagaagtaactgctgtgaacaaaacaagtcttttgtaaaagctctgtgtgcttaataaacaaggattgctaattacataactgtcagtgatgttttctggcacggtctaacgcctggttcttttggtacaacaaatatgaaaatgcctagaagtaaatcacagttgctgagtgctgtgggcaaacaaacccatgccttatcgctttcaaaggcagccatggaaaatgtatgataaattgcacagttcagtgaacatgttatgtcattgtgaaatgattttgatgcatggctttgtatttattgctaaccaactgacaaactcaaggtatcagaaatttcattcaggggggtttgctgtcttctgttgcaaaacccaag

SEQ ID NO: 53968 - DNA, 1217 bp, Bovine  19866881294715
ttttaattttggctgtgctgggtttgttactgagcgcaggtttttctctagttgagaagagcggggactgttttctagtttaggtatgcagccttctcactgcagtgcttctcttgtttcagagcgcacgctctacggcacacaggcttccgcaggtgcagcacatgggcacagcagtagcagccggcaggctccagggtgcaggttcagcagttgtggcacgtgggcttagctctcccgcaacatgtgggatcttcccagaccagggatggaactgatacccctgcactgcgagtcagattcttaaccactgcaccaccagggaagacctgtctgttcaaatgtttaccccctcttctattgggttacccatccctttttactgatttgtaaaaagttctttatatattctaaatatgcttcatttgccagatttacacattgaaaatatttattcccactctgtagcttatttttcactatcttaatcatgtactttaatgaagataaattattaatcttaatataatctaattcattaatttttcttttatggttaagatttttatgtcctgtttaagaaatctttgtctactgtaaggttattaaaatatgttttaataagtaacacatattttgtttccacaaattttgtaatgtgtatttaaaaatacatctaaaatatttagaagtataatttatttagaatagatcaattgcatctactttttaaattactgagcataacgtttactactaggtagtaaaaaaaattaaatagcttaaaatcttttagattaagcattttcctaaatttcattcaaatagtaaaggacagttatgattttccaaaatacagttttactcaaatccattggcttatataggatatggctataccaggcttaatggactactaaattacaagaatttttgacatcttatttgcttactgtctggtggtaaattaaactcattgttccagtatgaattttatcagccataaaatatgttacattttacccaattctaagactctcaaaatccaaatatacatatcagtattcttcaaactattctggaaataggtcagtgtttaatatggttgattgaattcaagtgccattatagacactaatgaattgatactgtgtagtgtgaaataaaaaaatctgtttcactgcaggacttagaaaatagcaaaaatatttagcaag

SEQ ID NO: 53969 - DNA, 799 bp, Bovine  19866881311530
ttattacattctgcaaatattttctcaacttcagagggtaattttacagcaaataccaacagattgtttttctttcccatcatcacacatctttccgacccttcatcaactagtcagcttgtttccgcctgtagcagactagcactctcatatctctatcaatgcttaaaaaaataaataacataaaataggtcttgaacatctttgttcccttgtgacaatgcgcattggcagtggtaatctttccctttagatcagcttgtttgaaatacgatggtacttaaaaggaaggccggctggaaggacaccaataaaaataccagctcagcttaaaacaatttgatttcaacctaaaatgaattaccttgcagcacaaatagataatggcaaatgggatatcctacttatcaggactattccctgcggagagttagaactccaggttcatttgaagctcattgccctgtgaggatagagaatacggtcttctgaacatttatgtgcagatgaactagttggaagaggaaacaaactctgagtacgcaacatccagcccttgctgatttctcaagtgacaactccaatttgaccttcaacattgcaaaaatgcaatgtgttgactgttaaaagaaacaacccttctgtaagggaaaaataccaaatagcatcattttgtttctcaagaggctgtgtctctcataagctttacaaactagaggtttgtaaagatatataaggatactttgtttgtgtttttgtacataataggcactgttttagtgacaagattttccttttc

SEQ ID NO: 53970 - DNA, 1777 bp, Bovine  19866881334750
aggaaaggtttctgtaaatcatcagacttaaccctcccccacgcagtggcatgagcgttaaaatctctccaggtcagcttggttcaaaggttgtaagtgattgactcccaaataattcttagtggttggttagactggacggagatgactgccctcgaagtttgagaccatttaattcctataagtgcctagttcttgtgggttggaggtggtggacacatgcaccagaatagaagatgacaaaaggtatttctgtggctgatgtcctctgaggtctgcagttcggcaggtgtaaaatggcacagaatctaccttcgtctcacttattttccattcttctgtccatgaatcatttgaacatgagcctggatggctgcttctgtctggaaaagtgaaattttaaagaggatacccaagcagttattaatcagagcaaagagctaagtaatgctaagaatggaatgatttatgtcatagagtacaaaagacataaatttagagtgtaaattacaagataactcatgtgcaaaattgttgtaatatttatactagtgtttattaaaatttacatttgaataaaaaggtgaaaaatgtaaatgaagctgaaaagtggatttgaaaagaatctgaaatagcttatatgaaaatcaggagagttttctgggatagaagataggaatagtactctatgtaggtttgtctgttaaaccatgacatatacagtgggattggaatgaataaggtctctgattcctgaatttctgcctgaatttcctccctccctgcccactgatactttccagtaactcagatcagtactgaaagccatggagaggaggttgaagtttctggacggatgtcgaggctggatccgtatttgaaaggctaatctcatttcactgatgttttcaatgttggaaatttttttctgtattcattaaaggataatgataaatctctaatttgtactttgctactaatagggatgattttgtgcttcattaaggttaaatgaatctcatgtcgtcctggctcagcctttcacagacaccatgtgtgatcttgggagagatctcttccttctctgggactcagtttcttcatctataaaacaagggggttgtagcagatgagtgttgagagagaccagccccctgcccttccctcctgtgtgggaacaccctatgccaggcagttaggatccacaaaggccatcaagacgcatagctcttgttctcaggagcacatggtcttcataaataactaattatagtatgaactctaattgcaacatgcacaagttactctgggagcacagaggcggaaagagcgacttccttctctgcagggataggctctgagaaacttcacagtggccgtgacatttgaagggggaggaggagggcttctccaggtgtgcaggctggtcagagggtggatggttcagactgtgcattacaggcggcagatgcccgtgactgtggtaatttagggagctgcacatggtccttctcaccgtctctggaccgtcagggcatgggggccgagtagctttgtatacactgctgtgtcagaacttgggccagtgatgaattactgaggttagagagtaatgtatggcatgtataaattaaagcagggtttaagttttcctgtaatggcaccagtctggcccatttacattccagttggctttcctgagtgtgagagaaggggtggtgatttagccaactccctgggagttgtaagcctatgtggtctcatctgtcctaagcca

SEQ ID NO: 53971 - DNA, 1650 bp, Bovine  19866881380159
aggaattttttagcctaagtactgatatgggaaagacttgcagagcagatggcaaattaggaagccccttgagagtctggtgtcagggggggatgcccatgaagggaacagttgacagtctcctgctatttcaaggttaaagaaaatatgtctgagaacacgctgttggatttgagattaaggagggcattggatctttcaggggaggaacttccatggccggttttggctgaaatcagagttaaaggaatgggttggtctgttaaggaaaggataagaaaagggattgagtgttaactctactctttccaacttcaggacggatctgggattgtccatagtaccatggcaatttgaggagatgaggggaggtgttttttggagaggggatctgaatatatttatgcacagaaaaagactttgtggagagattgagattaactgaagatgcaagagataagggaagcggccccacaaaacaaggatagatatgggaatgggtttaattagccatgaggtcacgttcctgcctctgtctctctttcatgtgtatatgaggagggtgtgtgtgtgtgtgtgtgtgtatgttagaaagagacagggatagatagagagacacaaacagacagaccaagaccaaggcaggaactggaaacttcatagctgcacagtggcttccagaattgttctgtgggctgggagagtagcaataattccccagtcttatcctggttagaagtgatttcagggaccaaagaaaatactattaataactgtgggtgggtagttgatctgaatcaccactgagagagcagaaagaagggggaagcagaggatgagatggtgttagatagcatcactgattcaatggacatgaatctgagcaaactccgggagataatgaaggacaggggagcctggcgtgctgcagtccgtgggatcgcaaagagtcggccaggactgagcgactgaacaacaacaatccacgataggagatgcatatttgagtgataaaaacaaagtatcacaatgcagagtctttatatgtctgctcttttgagcattcttaagatgtttttgaccactgggatgtgttgaagacaggccaaggtacttaagagagagccaccaaagaaatttaagactagttgattcaaaacttatcgcaggtgcagagattttaggactaaaagctctgagaagcctggtgtttccagagaagagagtctgaagaccagttataaaatccagtaactcgttattaagagctgtctgtcctagcaaggtagaatgcgaaaacacaatattgggaagtagtgtcagtaacatatgtgaaaagaacaataggtttttttttttatataagaaatttttcgaagatttcttataaaagaaatcttccaaaaatttcgtataagtgatttcataagtgaggaacaagatgtcagccatacttttaaatgatcttttttgacactggtcgttgaaaaaaaaaacaagggatggtttttggagggaggacaggtctggtcaggcttccacttgctaaggatgacactgagttgctgctgtttggaagtggagtaaagatcttatttttcaagtgcaaatcgtatctgactctaatagtacgaattctgtcaagtagtc

SEQ ID NO: 53972 - DNA, 1032 bp, Bovine  19866881399606
tctaattgcttttctggcactgcagtggtggccatttagtaatatatgatgtattcatcatatgtataataatgtgctttaaaaattaaatgtgtcatttgaagtacctgaacaggaaaaaatattactgaagattggacatttcaaatttcactgtacttagagtaagtgttagatattgttatgtcacaagttctgaaggttttccataaatcatagtcacagaatgttaaagagatcctaaaatcatccagcctacgtgttcattttccccttgggaaaattggattcagtaataagcccaggatcacacagctaaatactgacagaactggttctggaactcaagtgttctgagccctgctcagaaatggggcagatacacacatataatttttaaatatgatatcttaagttgattcctcctattaatagtcaagctgagagaataagagacttcttgacttcttaagctatgttttttaacagtatcatacagttaaaaacagacctaggttccaatcctgaacctctcactttctagctgtgtcaccctgagaatattgtctgacttctctgaatttcaattcattcatctgtataaaatagaaaataagacagtaatcaaatatagtgcttagcacagctcttggctcctggtaagtactcagtaaacgttagctaatattctttttcagtgttttattttatccctttaatatttcataatttggatagaaactgagtcatgcccaccagttatctcaccatgtgatgatgccatgtattctttcttttactagttcacttaccatgtgtaaaaatgcattccattagatactgtgtgtgtgcttaatcattcagtcctgtccaactctttgcgagcccatgaactgtagcctgccaagctcctctgtccaggaagtttcccaggcaagaatactgaaatgggtggccatttcctactccagggaatcttcctgacccagggatctaacctacatctcctgcatgacagggaattctttacaa

SEQ ID NO: 53973 - DNA, 714 bp, Bovine  19866881508722
gtctgtgtcttcaatttagtccctctccccagcaccagggtgatccggacgttgcacgccagtggtccctacacagtgtcaaccgtccttgctgcggatgctccatagatgctcccactgaacctctgttcagctgacatcattcctgtccctgaagaggtctgcacagccctagatcccctgaggggatcgacaaaggacagccgtgcttcttagcccctcttgtcacacgggttctgtgtgccccagacagaatgctggctaattcagactgacaagcccaaagatcacactctcctggatggcccgtcacacctcagctcctcattactggatgtctgaatgcaccgtatccacgaacagcaaggcacaacctggggcgaggcagcactcacagagcatcaaaccctccagcacctctcctattctgtatttccctttgaataaaaattcaacactggccccctaaaaccctcagactgcttggtttttttggtagtttttgtgtaaccaattagtctcttttgtgctgtaggtcctgcttgggtttgggctagagtgaacagcatttaaaatgaaggcattgtttattcacaaatcaaataagctcctgacagctgccccagtggcttcctcattcagttaaattaatgcccaaggcctcagggtgaagggtcttctggggagaatgtgggcattattttcggattccca

SEQ ID NO: 53974 - DNA, 970 bp, Bovine  19866881547187
tggtttcttagttacaatctttaaacatctagtaccgtggcagagttcctttcctgtttgttggcatgtcacgcattctgataccatgcatgtccaactcctatgtattgcagtgtttggtaattaaagcttgtgtcgaaggaatggttgatacaaaggtagctatgtttttcaaatcccggatcacaaactaattccaatgtgtctggaaagtaaaatcttatttcctgtggttactctaactaaaaaaggaataaaaaatgcagagtgaaaaaagatttgtgggattcagaaatgagatagtttgaaagattctgagagaaagaaggcatgaaagaaaggaataatatacaggattttgtagtatgtagaagaaggataaaggactctattctcaaaaaagcagaattgtgagataaaataattattctgacccaaattatttaatggtcatgatgtggctcatttgaattctacacgtactttaagtgtctgcctgacagacttcttaaggcctttagtaccagtccagcctatggaaatatgatctttttctgagatcctagcatctgtttatgtcactgacttgacaactcttcacacatttgcatttctgacttgttttgccactaaagtattctattgtcagttaacatttcataccttaaatctcaattttgtaagtagaatataaatctggaagataagcactctgccctaattcttgttaaactccacagccttagccaagcatcttatattatggaagattctcaattttctagtgattgattgagtgtcccttggactgcaaggagatccaaccagtccatcctaaaggagatcagtcctggttgttcattggaaggactgatgttgaagctgaaactccaaaattttggccacctgatgcaaagagttgactcatttgaaaaaccctgatgttgggaaagattgaaggcaggaggag

SEQ ID NO: 53975 - DNA, 932 bp, Bovine  19866881732104
tgaacatgtattacctgaggagcgcttttttttttttttttaatgtttcgaatgatgctaagaggctgtgatgaacattatgtcctaagctctgtgaaaactgtctttaaaaccgatgctgtcttagttactgagccataaagagcgtcgagatccagaggctggccgggatgatcattctgcctgtctggaacgaaaggtggtaaggctgaacgatgttaaaaacattacattcttgtcgtgaaagacaatcgtttggaaagaatgacagaaaacaggtttcggagtgagcgagaccaggctgatatccagctcctccatgtgggctgggatcacagagaccagtgcctctcatcactaaaacccagcaaatgggttgttgctcccacgtcttcctcaaatccacagccctgggcctctatcccgtttctaccaccgctggtctcctccatgccgctcatcctttcagccctattcagagggcagcttctccaggaggttttgctgacccccacccaggccaaggcccagtcagctattcttatctctgccctcccgtagcgctttgcgtcttcctgaccacagactcccacaccaggctgaaataactgtatttgcagctgtcttcttttttgtttggctggtgagaaaccaggtctttactcctggcacagtaactgcagaccagctggatggatggacggatggacagacagatggataagaggatggatggatagatgagggatggatggatgggtaaactgggaggaagggagagatataggtatggatggacagatgggcaggtagatttcctgtatgctaaatccattctgaattctcctcttccaccctctatacctttgaatgacacaacaaggctcaccccacttttattcctaagaacctgatctccctcagctctgctg

SEQ ID NO: 53976 - DNA, 1057 bp, Bovine  19866880405536
taccaaggccagaaatctactatcctactcaacctcaaatacttaggcgccctttcctttcgttgaacatgcaaattgtccttttacagtcagtttgcaaattccttctggttaccttagagcaagacttcctgttcagtgactgcctcaggttttctctaagaatgcacaggcagtcacaagtcagactttcaccacccagaagcagatggtgggtagtggctaaaaatacagtaagtgtcaatgagatctgttaaaaaactggatgttgaatcacctctcgcagattccaggcaaaggccctcaatagcaatactttcccccttatctcctcaactataattataggttttctgacttagaaaataaaactgccagtttggggaataaaatcagtatttggaacacttggtaatgatgaattttggtaaaatatcagatctttatctttgatacgttgttctctataggtctcttttactccatatgctactttattcatcagttatcactgatgagtgattttatggatgggatttttaaataaaaggttaatttccccccaaaatgaataacatcattaacattcccagtaacattcttaaatattcaacaattgtttaatgccattttctaaaaatatttacatcagctttaagaaatgaattacttatattaaaaactaagctaagcagtaaagcagtaataaaatagtgacatagatataatcttcaaattataagaagagttttcccaagcctagtgttttccattttctgatagtttttactatgtgtgttaaagttgctcagttatgttcgacactgtctcacccatggactgtggcccaccagctcctgagtccatgaattctccaggcaagaacactggagtgagtagccattcccttcactaggggctcttcccaacatagagatcaaacccacacctcttgagtttcctgcattggcaggcagattctttgccactgcgccacctgggaagactataagtttatgcagatactgcttaggaagtatctattccaacctcaaaa

SEQ ID NO: 53977 - DNA, 1120 bp, Bovine  19866880415688
tatatatgcctgaatcaaaattctgttacatccaaatacattgcagacatagcaaacagtgccctgtactattttaaagaccagtgattccattccttttacaatgtattaactaaatcagatacttaagccatgatacaaattaaagtttatttaattctgctgttacatctagattcagattcctactagggatagcttgacacaccctcttataagttacccagagtcaaaaaggaaaaaggcaaagaaaaatctcaccagggtgatcaactttttcctcaacacataacaagattacttcttttcttcttagtcatgtatttccccttagaaaataatttgctgtcatgtataatatatatacatatatgtatatctctctgtgtatgtgtatatatccatatatatttcagcttttaaatgtgaaatatcttttcctagaatggagaaggggtaaaggcaatgaacagcttttcactctttgtagcaagtattagtaaaatatctgactagatacgtcaagattttaaaccatttaatttttgacaggctgaatgggtttcccttaatttgcagattactgctggaagaactctctttgcaatattatgaagtaggcaggaagtcatcaaatatgtgcactgctgggaatcagacagtagcaacgtcttccattgaatttatcactttgactacttgagccttttaatcttctgatcattggtgcttaggcttgacttatagactggctacaggaaattcagaaatgtcatacgtacattaattttcaatcaattgatttttagacagtgtactttacacagaaggatattatgagttgttagcctatactattacagtgagtgtgcttccctgagcactggtttccgattgcttgtccagtaagcccataggccatagcatggcagcatgtaaatcatttctctaagacacagatttttttttttttcctttagacaaactgagtgcctgcattccctgagggtgcctctgcagtctaaccattccgttcttggactttttactattctatccattttctttctttctttctttctttcttttttttttttttttgtctttgaaatatctctaa

SEQ ID NO: 53978 - DNA, 1330 bp, Bovine  19866880528967
cattggagttttagctttagcactagtccttccacagatattcaggactgttttcctttaggattgactggtttaatctctttgtaatccaagagactctcaagagtcttccccaacaccacagttcaaaagcatcaattcttcggcgctcagctttctttatggtccaactctcacatccatacgtgactactggaaaaaccatagccttgactagatggacctttgtcaacaaagtaatgtttctgctttttattacactgtctaggttggttatagcttttcttattccctagatacattcatatgtgcattatctcacttaattcttattacagccacaaataatgggaattatcattttttataaagaaattgacatttaaacatattgagtgaattaccataagctgtaagtgaagggaaagggtacaaagactgatctgcttgactccaaaatccatattctctcctattaacccaaataccttcccaagcaaacagcgatttcctgttgaactctactcatgaccaatcactagaaaggaaaaaactgaaatgtgtattgcactaatgaattgttttctggaattttttctttggccaacttcaaaggcaaaacagtgacttgtgcagattttgcaaataacagagttctttacctctcatgcagattagcatagttcccacaacagtatagatatctggtaaatatgtggtgaaaggtagtgaataaatttatttagttgcaaattttcaacattttcagaggatgagatattattcatttcttctatgagaccacatgggatttagttaggggaagatcagataaccccagctagtacactaatagcaggattcctcaacagagcagggaagggatgctcgtcattgcagggatccacgccccaaggggagtgatggtttttaaagaattagttgtagggccatgaccaccaatgcacactaagtaaagctttcaaatcctttaatgcttaccaactgattccctgaggccctcccccacccaccacgcttcatctacatcatgtatcatgctaactaacatatgctgatccctacaaagagagaggctctgtcccaaattctagggatacaaagatgatcaggaatcagtccctgctcccaagacagcagaaacagtagcaggagaaagatatatgaaatgaacaccctaaagtattataggaactgtgcatgtttgccatgtacagtgagaagcagctcagaaatggaacagtaaattctacctaaggagagggagaagtgggaccaggaaaggcttcaggggaaaataagcttttaa

SEQ ID NO: 53979 - DNA, 1366 bp, Bovine  19866880586377
ccatgaaatgtataaagaaaaagcactttctgtggaggctgaaaaactattaaagtatctcgaggctgtagagaaagtgaagcgcacaaaagatgaactggaagtcattcatctgatagaagagcacagactggttagggaacatctcctaacaaatcacttaaagtctaaagaggtaagaaagttataatacattccagcatatgagtaaacatgaggaacttaggctgtgtagtaaaaggataaattttgctaatgcttttaacatatattaatacttaaaaatttttttgccatactgcatggtttgtaggatcttagttccttgaccaggggaccaggaattgaacctaggcccccgtcagtgaaagtgccaagtgctaaccccttgaccgccagggaattccctaaaaactttaaatatatcttaaaattaacatttatttaaaacacctgggcacaatgccccagctgtagttggcaattttttaagtattagttccattccagaaaatgtattggttagtttacctcactaattaaataaataaaattcttacatacagttccttcacaaaatataatgtacttaactttattactctaataaagagcaggttactttgttccatgagcctttgaccaacccacacaaatttttattgagaaagtggtccaaacccccaaaagaaagccttaaagactattattaattgatatgtctgtgttacatgtattcatttccccttaattccttttatttctacctattttattgcaataggtatggaaggctttgttacaagaaatgcctctcacagcattactaaggaatctgggaaagatgaccgctaattcagtgcttgaaccaggaaattcagaagtgtctttagtatgtgaaaagctgtgtaatgaaaaactgttaaaaaaggtaagtgctatgctatgctaagtcgattcagttatgtccgactctgtgcgaccccatggacggcagtccaccaggctcccccgtccctgggattctccaggcaagaacactggagtgggttgccatttccttctccaatgcaagaaagtgaaaagtgaaagtgaagtcactcagtcgtgtccgacttttagcgacaccatggactacagcctaccaggctcctatccatgggattttccaggcaagagtactggagtggggtgccattgccttctctggttacctttgctaactactactaattgaaacaactggctcttaaattttggaaatggagtcagggaattttttaggtgttttgagacttttatcataccacattgcattgactctgaaatctaagtttaatatgtcctcatttttctctttatgaaa

SEQ ID NO: 53980 - DNA, 890 bp, Bovine  19866880646302
taaagcttaagcctttgcagtatcctcctaatctgtcccccatcctctcccacatacattccaggctatccagacacagagaggctctgagaacaggaaggtttctgtgacatgtgtgagtaaaataagacctccgggaacacagaatgaaaaaccaatcaagaggaaaaggagcattagcctataatttattatatttgtgcccctctgccacctgcactgaggtctaccctacttaccaggcatgggctggttcatgaagatgctcactagtgttgtttggtccatgaagccatctgcgtcctggcaacctgcattggttcagaacagctgaggcggtccttgggggcctgctcatgaccatgctgctctgtgtggccctggttctgcatatgctgtaccagccagtggtcactctcctaaagaacattaaaacagagccagagcccatggattactgtgggagatggtgttatttacagtcatagtcagatttctaataattaaaagccttcttcacacaagacagagagctagctattgaagtttctgcccttctggaggaaagacataaaaaatgtggcaagttcaacctaatttttacaggatcttaatcaactttaatagaagccagactcaagaggaaactactaaacagtaaaactggaagccataaataaagacccacttccttgggggctcagatggtaaagaatctgcctgcaatgtgggagacccagattcaatcccagggtcaggacgataccctagagaagggaatggcaacccactcagtattcctgcctggagaatactggagaataaagagctggaaatcttcaattccttgcttggaattaaaatataggcctttacaaaaggacttagca

SEQ ID NO: 53981 - DNA, 1028 bp, Bovine  19866880688038
attcaaccatccttttgggtgtaattcattagcctcatcttccataaggtttttctaccctagctcctgtcttaaatggccaaaatgcatctttaaaaaatctgctttaggctttctaagcattttttgttactactccttaggatctttttcactcatctttttgtatattacatcctatgaaagacatattgtactatgcactgtttcatccctcaggcctagctcacagacaatgccaagcatacagcaagtacagactgaagatttgttgaatgaataaatggctttatacatacaatatctctttcctgaaagaaatcatgttctactaatttctataatacctaaaattcctggcattaaaataaatgaacaaatatctgatgtgtgcttataacaatttattaaaatacatggaaattataattaaattagatttggtggatatgcaaagtaatcagtggatttacattttatcatgattctaataatctaactttcacatttgattgaaaagcaacctttttgttatcaggtgaaagtggaagcatataaatgttcttccctaaatttatttcaaatcagaactgatttcatatactgttttcataatacacatacatgcaaatgtattcatagagagtcttaaatattaatcaagagcacttgagcattttggttgttccaactgactctcatgtaaaaggaaatttaattttttgaaaaggctgctatattgcaactcaattatttcctaggatatagctgtattaacgttcttaattttaaattgccagggattgtattaaatgacaacaataaaattaatgtataatttggggtgaaggcttctagcttttaaaataaaatatttcaagataatcttatagggttatttaaacttataaagtgagctcttactttagaaggaagaagaaaaaaagtaaaacgatctgaaatgttccattatcaagaatatccattcacctcttgaactcagggggaatacttcagggctctgctag

SEQ ID NO: 53982 - DNA, 4745 bp, Bovine  19866880773691
gagagtcccttggactgcaaggagatccacctgtccttttgaaggagatctgccctgggatttctttggaaggaatgatgctaaagctgaaactccagtactttggccacctcatgcaaagagttgactcattggaaaagactctgatgctgggagggattgggggcaggaggagaaggggacgacagaggatgagatggctggatgacattactgactcgatggacgtgagtctgagtgaactccgggagttggtgatggacagggaggcctggtgtactgcgattcatggggtcgcaaagagtcggacacgactgagcgactgaactgaaatgaactgaactgaactaagtggactaatgggcagaatatgttaatgcaactgaaaggctttccaataaactagggagtggggatgttttaattgtcctagttaatatgcactttttactatatatataagaaatcttaaatgtgctacctttaggtgatgctaaaaatgcacctatattccaagtgcctactccctttgatagctgtagattaatgattgttgttgttcagttgctaagtcatgtctgactctttgaaaccctttggactacagcacgccaggctcctctgtcctccatgatcccccggcgttggctcaaatttatgtccatgggagtcagtgatgctatctcactacctcatctcagtcacatattggacagcttctgaccggagggttcatcttccagtgtcatagttttttgccttttcatattgttcatggggttcttgcagcaagaatactggagtgggttcccagtttgctcctccagtgggccacaatttgtcagaacttcactatgacccatccgtcttgggtggccctgcccagcatggttcacagcttctttgagttaacgcaaattcctctgtcaggacaaggctgtgatccatgagggattaatggttagggagtgaatttcaaagtaagctggtcaacaatggcccctctgaggacggctctctggggtgggatctactccaacaactggaggcgcagacaacacccattgagtttcaggtccacgtgtgatgaggacatcctgggacagagttggctcagagaggagggcagaggggagcccgggtgggagctcctctccaggggctgtggacagagggagcagagagaactaaagaagcaggaaacaccaccgcagcccagctcacgtctcctctgccgctcaccatggaatccagcctaggaaagtcataaaatattgcaaaccccaagtctgccagtgacttgctatgaggcgttggtgagccctctctgtttctgttttcacactaaaatgggagtaggtgtagattgctgggtcattgcaggtttggcagactcacttgtattatacagcacgaagttcacctgaccaattaatagccgtggttaccattatttctctggatctcccaaggacccagcaccccaggagctggctgtccagacctgctccacagtaacccttgcgccaagaccccttccatccctgaggcccttccatgcccctgcccccctcaccccgatcttcttctactccctgcttcatccctggcacattagcccacaggtgtgttcattcctcctacagtcaaatcctttgccttaggggttttcatccctgatgctctcttggtcttcaaataaatgggtgcccgtttcttgtggtcttagcttaaatatctccacctctgttaggtcttctctgagcatcaaatctgctaataaaattattgggaagacccagagggatggtatggagagggaggagggaggagggttcaggatggggaacacatgtatacctgtggcggattcattttgatatttggcaaaactaatacaattatgtaaagtttaaaaataaaataaaatttaaaaaaatctgaaaataaaaataaaaaaatttattatataaaaattatataaattttttcaaaccatcctacttaactttcccctagccagtattactgtctcatattttcttgttgtatttatcgatggactgtttttgccccactagaatgcaaactgcttgtgagcagagtttggttaatctgttctgtatctcctctacctactctggtgcttaaataaataaaggtgctcagtaaatattcattggatgaataagcgtgtagcacaaggaaatggcaacccactccagtgttcttgcctggagaatcccagggacgggaagcctggtgggctgccgtctatgggtcgcacagagtaggacacgactgaagagacttagcagcagcagcagcaagatggcttgggggttgcgtttacattttctaagtgtggggaagcccctcctgggtgcaggccttaatctctcagtgtgcagttggggggcgggcggttctgatttcctcagggtattctgaggtctttttccctcagatgcgggctgacgactgctcactgcttctccttttcttcctcttcctgtccctcctcctcctcctccactttgttctccttctttgtcttctgttccttcttttgctcctcctcgtccttctggctcagtttgccttagcctgtccagagacccaatgtaagtgttccccactcaggagcagtcagtgtggaatgaaagcagcctgaggttacagtcaataaggagcaaattaagaacataaacttgtgaattcaggtttccctatagggctcttaaccagagtgtggagctataaattgcctcatgtccactgagaagacagtaagtgaaagtgaagtgaagtcgctcagttgtgtccgactctttgagacccgtggactgtagcccaccaagctcctccatccatgggattctccaggcaagaatactggagtgggttgccatttccttctccagtacagctggataaaacgagaataatagtgtgatgacctctttcttttccaaaagacacatggaagctgcccagagaagctataggtccctcacggggcccaagacacactcgatgacagttgctggaagtccagtggaaatctgctgcggtcctgaaatggagcaaggcttgaggagagctgtttacctggagtgagtgtctttctttattctctaaagtttcaactctttgacttccaagaacatctgattcaaataatcatatcttattaattctgtatattgctgctgttgttcagtcgataagtcgtgtcctactctttgcgaccccatggactacagcacaccaggcttccctgtcctttactatctcccagagcttgctcaaactgacgtccatcgagtcggtgatgccatccaaccatctcatgctctgttgtccccttctcctcctgccttcaatctttcccaacatcagggtcttttccggtgagttggctgttcgcatcaggtggccaaagtatcacataatcatatcttattaattctgaatatagaagataagaaacatccagtattcactacctcctggtagtttaaatccctctcatggggcatttgttctgggtttcctttggccagtcatcttgctttgcctggttctgagtctgtatttggtttatctgggggtactcctgagtgtgcatgcctatctcttaggcaagtgaagaggtctgtgtgtagcttgacaccacctttcttctgacctccaatgcactttatagtcaggaaggtttcctcaatctcgagaatgagaaatatgtcgcttatctttaatcatggcagggctcagcttctatcgtgctcctgctttcttcacattggagtatcggtccacagggatcctgtgtgctaaccctgagcccttctagctcctgcctcagggggactgtatatttatttttaaaagtccccatataagtggaccagggcagttcaaaccaatgttgttcaagggtcaactgtaattttgccagccttgcaattttgtcattactaattgaaccttaaaattattcaaagttctattattttaaactttctcatgaaatgggttaccagtattaatctataggcatgcatagacctgtactttaatcttcaaatggcacacttgtactttagtcacagatggcctcaatcctagccagttacactttcaaagagcagaacgtgtttctaaatgcttagggtcaagtacgtgaatgcttaacagtatatactctcaatggtttatggcaattatctgagccatctttgcaaatatccaagtggtaataatgctcatatttgagcattagctgggaatgttattgtcttcacttacctgccaaatgtgcaataaaaaagcttatcctttagatggctattaaatctttaatgttcaattatttccaagtctgtgaccactattttatttcatatggttattttaattaaattattgaattacagttatcaggtatcttgtcgcatggctaatatttagtgaatatctgactagaatgatttctgcattgttgaattgatcaatcagatctcctcagcacaggaataatatttgatattatactcttcaataatagcagttacagtaaagaactgggccttggacttgataagatgtacatacaggaagtgcaaagtttggtggtggaatgatagtgctatggcaactgtatggaatggatgtgtttttttttgttttgttttgttttgttttgataaacagaagatgtttcacactttaatttcaattaa

SEQ ID NO: 53983 - DNA, 3604 bp, Bovine  19866880941067
atttataactataaaacttaacaaaatagctgccagtctgctgagtctgataaagaaatctgtcacatttagtgagaaagtttaaccacagaattcagattttaaaagaaaccagactgaaggaagagattctacaagcttgcttgtcataagatttttacagcttctcttggctggaaacatgcaggttgctagaaaaagtcactgaaggaacttttatctcatgactgctgtttttctgtaaagttcctaagctagcttaacttaaacataagaaacagaatgcagttgtacctgaaagttcaaagtaaattctgattcggcacacaggtatcctttcatgagctttcaggagtctcctttgctatatgaacacttgctcctctgcaagcacagttgagacaatagtctactgggaattcaagggctccacctaacactacagggaccactaagcagcagcttatctacggagttctcttaatagtcaagatccataagaaattcagtggggcaatcaaaaaaacagccaaaaataactgctttatccttcctggagaaagggcaaggatgcatctaaaccatttttgtatcatttattaaggtgtgccaaattgcaaacgctggcacacagcagttgatcagatacctatctattgatcaagtaaataaaacaaaaatacaaacatccatttaaaatcctatgaatgatctctgggtatgctgtgctggtgtgctcagtcacatctgactccttgagaccccatggactgtagtccatcaggctcctctgtccatgggatttcccaggcaagaatactggagtgagttgcgatttccttctccaggggatttttccagcccagagactgaacccacacctcctgaattagtaggcagattatttaccactgagccaccagggaagccccatgctgtactagtaacaggaaaaaaattcccacagttctccagcagggccatgcagcataatggttgagaacaacttacttttgctttaattcccagctggactctttcttatcacgaatcatctgatagttgggataattgttttataactctaaacactggttcttcatctttaaaatgggtattacaataataaaaccttatccgaaaaaaagtcatttatataacagctcaagcaggcttggcatgcaacatgaattgagtcactgctgctactagcacagtcaaatcctatgtcaggaattattgataaatagtgacctagtaagatctacttatacttttataaaataagtcattttaagcttatttaaagcttatatttatatttaagcttaaccatcactctgccacctaagtttaattaaaaacagagtggtgaacatgtaatatgtgtggactcagggactaaatgccaagaaacctgggttttagttctatccttcacactttaccaggaaaagccaaagctccaggccttaggtttcccatctataaaactcttaatgttccaactaacatttccaggaaaatcacatacaccccttaaaaaaagaagtcttaggattcctaaaactacaaaacacaattcatcatttgtactaaaaaatataacaaaaacaaaaaattaaaaatattggaagcaacataaatctgtatttgaaacaacatacattagtagggaaaataggtgggaccaaaaatatatgaccacaaatatatagcttaagtttcaaaatggtaaatttctatgagttaatgtccctaaaatctgaggaaaactgataactcaagttattttaataaaggacaatgccccagtacttgtagaaaaaaagcagcaaggtgcccaacagactaaacatacaaagaaatatttcagagtgagtatctagtgtttacggaaaactttgcttgatggcaagttactaaaccatcctgaaatattaggacaaataaatatgattactatgatctcactacccaagaagatcctgtttaactatgttttatctattacattattttgttgaattccaccatacaagtaattttaaagaaaaataaaaaataaatgatgacattaaaaataaagttttgctgccttcaagaacactagaaactgcatgtaaaaaaagaagtggctgtatcaaatcatgtgtcagtacaataattcatggcagctgatttatataaactccagaaaataatggagaggtgtttaagttactcattaaaaatggtctatgggttgtaactagatattagtaaaactaaagttagaacaatttgaggggaaaaaaaaattcaagggaaggagtgcaatgaaagggttaaattacaccaagttacacactaacgctatatggcttgtgcccggtaaaatcatgcaggtaacatgaaaaccaacatctaacaccgaaaacatttagaaaatttgtgcttgaacgtaaagttaaaaaaaaggggaggggggataagctgaaaaaaataaaataaccattcatttcataatccttccattgttgtattattcacttatcactacacttacattgactacgtataatttaacacaaagaagcaaaatctctaagcttctccctaccttgggtttttaagcaaaatgaatgcaaacaatcacgtgggattcagccaagcagtgacgttaaattctgctctgtcagagagagcatctgtcaagcccacatttaaactgctgcctgcctgtgcagcagctgaggaaccgtggatttcatattacagactaaaaccccagtgaaacggctcagtccttcctgcagctgccaggcaacgacgagagagttaaatcctgctcttttccaataccatcgaagcactccattctagctctggctgctttacattgcagctcagggttcttactagaaatatggatactgaaaagagaatagagcactgcattgtccggccaggaagacagcagatgtaaaaagcttcaatgcatcaactgtcagaagagtcgacagtgctccaaacagaacgaaaccaccacagctcttttgttaaagagaaaatgaaaggaaagacctcagaagattagcacccatatgaacaaggaagggtactcgaagacaagcagacagatggacactttggacatgtgataagcaatcgcaggaggcagactgttgggggaggtgtgtgtgttcgatagcgtctttttgctggagcgatggcgtgccaaaagtatcttcagtgggcataatcctcgccacataaatggcctgaccaaggaaggtatgtcgatatcttgtgtgtgatactcatttaaatgtctgttaccttttgatagcccaggaggcactaatctctaataaacaagttcatacatttcactgtccttgaaactgtgagagggtttctaaatatatgattttaaaatttgtcactgtttagaagacaagctgtcactgctttattcaagtaaatatgtaactcgcagtaattatggattacagaaaaggcaaatagtaacaagctgtgcttaaaggcttctctgaaaaatgaaacttaaaaaaaaaaaatctgaaacccgctaaagaaaacacagtatcctctatcaaat

SEQ ID NO: 53984 - DNA, 1452 bp, Bovine  19866880959537
tttcaattgtttttttggcacacacagaatattcttagaggttagagctggggttatcagtgaggttggtattgagcttgatactgctttcctaggacatgttctagaagtttacgagggaaggtgttctgggctgacaaaaaaaatgaagagcatttagtatatgtggccagggaatgtagtgtgttgggacagtttttgaaaacaacaaagactagtcctgtgtgctgcaggacttccaaatgtccgtgtgtgtgtgtgtgtgtgagagagagagagagagagagagagagagagagagagagagtcagtccccagtctctgggatctaatgcttgatggtcgggggtggagctgacgtaattaatgacagaaagtccgcaacaaaggtaatgtgcttgaatcatccttcacaccccatctccttgggtctatggaaaaattgtcttccgtgaaaccagtccctgctgccaaaaggttggggccactgtgttagaccatttttattattaaacgaacctaaaacataattggaatacactcggagaaggcagtggcaccccactccagcactcttgcctggaaaatcccatggatggaggagcctggtgggccacagtccatggggtcgctaagagtcagacaagactcagtgacttcactttcacttttcactttcatgcgttggagaaggaaatggcaacccactccagtgttcttgcctggagaatcccagggacaggggagcctggtgggctgccgtgtatggggtcacacacagttggacacgactgatgtgacttagcagcagcagcatgttgcctgtgcatttcattttaaatggttagaggggtcagtgtaaaatattcttaaaggggatgtgttgagtttgatagagttgcgaagcctactaggtccgcacctttaaattgtttcaggcatcttactggcccgtagctgtaattctttgattcccaaaataatcaaattaatataattccaaacatgtaacctttgatagagagagctgggcaacagagtattgtttatccacatgaaacaaaagaagagccaatttacaagctatagagcaaaattataagctgtataggtttgaagaaacccacgttgaattgtcttcaaatgtaatcatttaattgcacccttcaggttgtactgtaatggcattgttcctagtgaaaaagtattacttacattagaataatggaatttcagagtagaattggacctttgaggtcatctaaaaatctagtttcctcattttacaggcaaggtaactaagaccctgagaggttgagatttttctcaaaggtttgctcttaatgtagcaaagccacattaagggtagaacctagagcttgagatttgcaagtcaagtgtttttttgcattgatttactctgtcttgagttacattagtgtatttgttttt

SEQ ID NO: 53985 - DNA, 667 bp, Bovine  19866881005256
ctctttcctaccccatggactgtagcccaccaggctcctctgcccatcacattttccaggcaagaatactggagtgggttgccatttccttttacagggtatcttccccaaccccaaggattgaacctgcttctattgcattgacaggcgggttctttaccactgagccaccagggaagccctacgtacagatactaatgactaaaaacaagtattcattttgataaaaagtaaatgatcatgtgctaatttacacaacttcattgcaaagattggaatgcattttattactattaataaatgtattgccctgttttaatactcagatgaggtatggaacttgtagcaatcactcccaagtctttccttttttcagttaacggaagcagataacatttagggccttccaagaacactcaccagtgagaaattccaagggaaatatgaagtaacagaaacaatgacattaggggctattttaatggcccatgtggttgttccctactcctaccctcaatgttcaaaagggcacttttgttctagaatgaaaataagaagcaatgtgctagatgaaataggatctttttgcaccttgactcagagaaaccaactgctctaagaaactcttctgggaactacacaattctgttctcataaatttgcaaaa

SEQ ID NO: 53986 - DNA, 1197 bp, Bovine  19866881054511
tcatccaaacatatgatcccatgttccagcctgactgaataataagcctgtaaagagacagtcatatttgctttgggagtttctcagtgacaggttgacttctaaaccccttggtgactttcaaggtgtggtgataaaaataaatatcctatttatgttgtatgcaattctgatgagacacaccggtgtgagtcttaaagaaccatgattcctgttaattaacattatgctgaattttataacatccaaggaaggctagacagaactgactcatgttcattgctcacggtgtcctcatttagcaaacaagaacacggtggactcctgaaagttgaaatgcgcacatattccattaattccaaggaacttgtacattgtttgcacagctgttctgtcttattccttttacaggaggcagaaatgactttaaagtccctcagtaataataataaaaatcatggctgtaatttattagtctcctattttacattagttactgcaagagttttacctgcattatttttaattctcagagtatctgtataaaaggtgagtattattacacctattttgcttaataatacccttatagaaagaaaataagacatattatcatttgaatgtctttgtttccatttgtactgtggcaggtatgtgcatttctcatttttctcccaacttttggctaagcagagataagcattactccttccaactagcagataaactagaacaagatggagttaaataacttactcaaatataagagtcagacacatgtctggggccttaatttcaccttaggctattttttcattagatcaatggttttcaaattaacaaactcaacagttacatgcctgtggatggtgactgcagccatgaaattaaaagatgcatgctcctttagggcttccgtggtggctcagacagtaaagaacctgcctgccagtgcaggagacctgggttctatccctgggttgggaatctcctctagagaagggaatgactcactcactccagaattcttgcctggagaactccatggacagaagagcctggtgggccacagtccacgtgggcacaaaagtggggacatgactgaatgactaacactttgctccttggaaggaaagcatattaaaaagcagagacatcactttgccaacaaaggtctatctagtcaaagctatgttt

SEQ ID NO: 53987 - DNA, 826 bp, Bovine  19866881115677
cgtgtccgactctgtgcgaccccatagacggcagctcaccaggctccatcatccctgggattctccaggcaagaacgctggagtgggttgccatttccttctccaatgcatgaaagtgaaaagtgaaaacaaagtcactcagtcgtgtccaactcatcgcgaccccatggactgcagcctaccaggctcctccatccatgggattttccaggcaagagtactggagtgggttgccattgccttctccaattttggagaatagtctagatttattttccaatatttcaaggaacgttcaaatctattatctagacttgaagtttaaattaaacagacctcccctttcatttaaatggaagctgattagctaatcttctgaattatacaagccacgtcctaaaataagtaatcaataataatcattgttagataactaagtgaaagttgctcagtcgtgtccaactctttgtgaccccgtggactgtacggtccaaagacattcatttttttaaagagaggaaattccccttaaaaacaaaaacaggctggtctcagtatcataggcttcatacatttatttcttatgcaaaaactccatttctaacattcgcccacacaatccttgtatcagtttcacccagttatatcttatgtgggcctggttttcttcccaactacacagttttataatttatttcatggtgatgccaattaatttaaaatgaactcttttcacaactgtgtggaaaagggggggatgttgtcacagcagtaatcaattattatatgaataaagggcactcgctctgggttcctcttcgttttt

SEQ ID NO: 53988 - DNA, 1933 bp, Bovine  19866881120740
tgctgtcaaaccaaaataagacctttcttattttagatgtgactgacacataggttttaaatttttagaaatgtaactatacaaatgttaagaaaaatctattgaattaaaattgggagataaagagggtggctggcttcaggacacactgactgggtagaactgaacttgacatgcggtactgtacataaatggacattgtacatttccctccctccctctttcctttctgaccctcttggtttcctttttttctcttttatttgtgttttagttgcaactttacaaagcttttgtccagctcttctcctttgtgtgtgtgcatatatttcctgtaaaattgtgatgcatggtcagggtaacttgtgtgtgtgtatgacttgccatgaaaatttcacttgtgtatctggaaccagaatcacacttggcatttcatggggtttgggctgatttccttccttatgtgagtgccatcaaggccggcagtcctcatattacgtgtccagagtagagtcaggccagatgggaactgtgtgaagctaccagttatcttgctaatggtgcccgttagaacctgttgtattccattaaaaaaaatgtgagctccagcaactgagcggtccacactcaattagcaagcgggagattcacacaaggagccgggtgcttcaggaagtgacagctgctgccttaccaacagatatatctgtgttcaagtttctcagtccatgttgcaacagcgaataatttttgctaggattgtgtatatcttaggtctttaacctgaagatcaaataatttgggagagcctcacataaagacagtgggttttctccactttctaagcttgccttatcttagtaaatataaagaattaactgtaaacacatgcactgtgggcagattttagaaaagaaggaaaactcagttgagaaaggagaaaaagtataaatcaggagggaagacagcaattaacatatttataataagtgaaagaaacgcaacattgagactcatggagactcaagtgttttcatctgtacatcgtctgagataagaagaactttaaaaagcaactcacttcaccggcatttttcgttccactgtctgtcgcagatgatgccaaatttctctttctgacagatcttccagcttaagggaatgcgacagcaggaacagtacaattagtatgcaaatagctatcccctgggtcacaaactggcattctttaaatcaagctgtcctcagctttgtttccttttgttgttaacttttcactggtcagaacacttaaacttctaagtaacaaataactctctgaataagcatggcatttcctccagtctgtagtataactggaacaaattccatttggaagtttggtttctaaagttcatatacattcatttccaagacaactattgttcacatgaggttaaatcaactcaggaaaaaacatatagatgacgttcactttcacttttcactttcatacattggagaaggaaatggcaacccactccagtgttcttgcctggagaatcccagggatgggggagcctagtgggttgccctctatgggatcctacagcctcagacatgactgaagtgacttagcagcatagttctgtatacctttaggtctttagtctgactaaaaagtcattttgtttctcttctttggttctcaaagtctgagaaagactttttttttaatactcttattttaagtatatgtgtttaaggattttttattctagcacaaggcatcacacttttgaaaaaattgtgcatttgttatagtttaataacatacatttgtcaatttattttaccatgaaactcaaggcattctgtgccaatatttctttatgcaatgctgatgtttgagataataatagctgaatatatttatcaaggtaaaggacttata

SEQ ID NO: 53989 - DNA, 1564 bp, Bovine  19866881138593
acactatgtatgttatatattatacaatatatgcatatgtaatatatgttatatataagtataatgtgttataaaatttgtaacataaaatctaaagaccaagatgatgtatatgcaaactgacatacattttaaatctaataatatctattcaattctttcctcctaagaataggaatgagataaatatacttgttatcattatttcaatacagaatttacatgagatcttgaaggatacaaaaggcaagggaaaaataaaattaaaaaacccataagactggaacaaatgtataaatttgtcattattatgatcaaatgatttttaatttacacaatccagaaaaacctggaataaatataattaaaaaataaattcaacaacttctctgatataatataatttaaaattaataaattcctaaatagcacccacattaagcaatttttttaaatttttaaattatataaagtaacatcacacacatcaaatagacttttttttaaatatttgtttatttttggctgtgcttggtcttagttgctacaagggcttttttctagttggggagagagctaggtctactctttagttgtggtacatgagcttctcattgtggtggcttctcttgtcacagagtataggccctaggcatgtaggcttcagtaactgtggctcccaggctctagggcataggctcggtagttgaggcacatgggtttagtaatttcatggcatgtgagatcttcccagatcagggattgaacctgcgtctcctgatcctgcctgcattggcaggcagattctttaccactgagccaccagggaatccccacagggattctaaggtgaaagaatcaaagagaagatagcgtgcggaacatggaaggtagacagggccagaagattaaaatacatgggccaagtgtaagcagcaaatccagaggtcaaacagctacagaaacctcttagaattcatgcaggaaaaccaagagcaaatcccagagccactgggagggcagtgaggatgtagcttcaagtctcgtcaacagactggagtaaaggaagcattaggtctaagcaggctccacagtggaggagtacagcggggactgaagactagagaagccaggtgtgtggccaacttctgatttcttgcctctgaacttgttttgttcttgttaacaagcctagcaagggaaataaaacacttcaatgcttctatttttttaaaaatcacacagaagattagctgtttggaaataggttgccccatgcataggcagttgagctagagtttagaactcaccttgaatattctgttttgttctttccctctgcctttagcaaggccttctgcattttgctggatggtgttttgtgagtctgcaaagtgtagcagagaacagactgacttttgattgctctggttttgttaattaaagtacaaaggttgatagagggactgaatgttctaaaaattgggagagggagcaaggagggaaaatggttcatgctttgcagctaattgctctcaaacagttatttctttcttcaaggtgt

SEQ ID NO: 53990 - DNA, 825 bp, Bovine  19866881159630
aaatgaaaatgcctttcagttcatttgaatgaaaagaacaccatttcaaaatggcttcacaggaaaccttgtgttcccaagatttagtagatcaagggagaaaggaaaatcagttgcctgtcattgaggaaaaagtaaaagaaatggcagataggaaatccaagtactgggagatatcagcatgtgctccctgtcacccagccaccctgtgtggcctctgagtacagatattaccatctgagaatataactacaacagcaggagagaggagagcaatgcaaactggagcaaatcacacaaagtaatagaatgtaaaaacatagggactgcatcacacgagcatatttaagattagtcaccttgatatgcaaatataaattttataagaatgactggatgtgagactatcaatctttttaatagaaaccttcaattagatcattcctttccatagctaataagtaatttgcacatcacagctacatcatccaagatttttcttctgggtagcagatgttttctatggatggggacttatttcattaggatctttgtttattaaggggaataatgcatgatatatttacatctcagaaagtttatatcagaaacttgatttattatttctacatcacatcccccaaagtataccttcttcagaagacttaagtcaataaattttttgactgctttggaaaagatattactctgtcctgacagatacctagatttaaataaatcaacccagatggaagcatacctttaaagagaaatgaaggctgtctcaaaatgggggggaagactccttaaaatactataaataaa

SEQ ID NO: 53991 - DNA, 1768 bp, Bovine  19866881267593
agccagaagtaggggaaaaaccagccttactcacccaccccccctttaatttgaggtctcttcaaattcttttccctttggtgctgaggatgtttaaaatatgctgaaacaaagaacttttttcccccattacctcttttggagcttctttttctatgaagtcagtatatattttctttgcttttgaggacagcttttggggtgacttggtttttttgaagtcttcacaggccagccagaattcaatattttcttcacagaattcagattttaaaaaagccctgaatgcagcaagaccatctgggggagggaaggaagaaagcatgcagaaattgcactgagtgtccaaataatcccttatgtgttttcctagaactcccactctcctggccccatatttcattatttgccagatggaagcaattttcttgagtttactcaaacctgtaatcgtcaaaatttagctctttaaagactaagacgccagtcagcaaaatgtgtaagttggcacactactacaaaaatataaacacttagctttgctgttaacacaactgataggggagccctaagttctttgggaatgaagcctcttgaaaacattgtttgcaatggaaaagctgacttaaccttaacagacagcaactgccattacaatctggggctatttccccccactccccacctattgtgaaaaagccatgcatttccctggttaatcactgggaaataaaggagaaaaataggccccatggtacagggattgtaaagtcaaactctccttgggcaagctgctcttgctgtgtgaacacaaccataccatcctctcctgatacttgaaatggatcaaattcaagaggttaacttacatttactggctagcagctcatcaaatgcttctgaccacagctgggcttcctcaggagaaggcctgcaaaagaaggtctgcacatcagctcctgatagccagaggttccctcttcagctcagcagtgagctgcgcatattggcaagtacaagattttcaacttacttgatgaaggtttgctgtttgcttttcttgccagttttgggcttcccaggagaggaggaattttgcaagaagtagctcaaacggctcttccaatcttttaatctacagaagaaaaaaaaaagatactcacttagcggcaacacttgaaactgccattgcagctgaaggcatttttaccaaataaagtcgcccccaatagctacagacaagccaaataagacaaaacaacttctccagtcagtcttactcctttaatccagcacctaagtactcaacacaccagtttcatccactcatctgaacataattattagttttataagtaaggataagacggcctacaattatagggtattttaatgaatttagtttgcatagttcaaaggtagatgctatttatggcccacaaaaggcagccagtttttctgcaacggttaattacaattctgagacatttcacacttgaggaagcccacagtggacctgccctgagccagcccatgctcggtctcccttctactctcagagcaggaggctcgggaccacccgagaagctgtgcacaatgaggtgtgtgtgcgcgagattgaccgccccctctcccaactccagcactcattttaagaaggtgatgcagaacaattatttgttccacactcttgagtgggtgagacttgctgttcaattaaaaaaaattaaaagtatatttagaatcagcaaaaatatctccatcccag

SEQ ID NO: 53992 - DNA, 1609 bp, Bovine  19866881300893
tatcatgaatttaaattaagatgcatctccatcacatattgctacaaaatcacacaggaccataaactacgggtactatgccagattacaatatataataattggctcttttctgtaacactgaaatactttagaaacatcacttcaggcatattttcataaaaatacaatttactaatatatttacctgcattcatttttcagtcctttattcattcaaatatctgaacttctatttattgcttcttaaaccatcaaatttacactcttgaaagatctaaatgattagacttcaaccagatttcaagcattctctatcaacagaaagctgatacatttaatttagttttggaatgtttaaaatagattatcaaataaacattaaaagcaagttttgtttcttttaaatttacattcataaccctcgaagctattggcctctttatggggtagaggaagagttattattatttatctaatatttcatttgaaaataaaagcttagttttctcatctcagcagaatggccaactataagaaaaaaagtgagtttctaaattagaacactcagctctattattttcacaacagagttcacaacagaactgttttactggtacagtgaagtcttggtcttcatcagagtaatgtgaaattaaaattcaagtgaatatattctaataaataaataactagattctatgtttctaaaacctgaaaacttaaaaaaaaaaaaacattgctcctatctcacaagatgattaaataatttcttatttctgaggaaaacgataacttgtaaaagtacatttcatatactagaaattatcaaaagatggtgcctatactattatacttttagaagtccgttcaaattcccacctacttgctcctcctagtggctgttactagaatagtagtactttcattcatacatgtgtctaatactttcaaccaatattttctaaatacttcatattatataagtgcatgttattctagttattcaattttatgaggacttccatgtaaatgtcattatttcccccaaataattaaatttcatatcaaagtatatttggtattaaccataaacttctcagtatcacaagctagataaacattttcacacacatatttatataaaatttctaataaacaaatgcttacaataaatttttaattgaccagttttccttaaataattttcacgataaaaagttgaaaaagttaaaattaaacatcagtccccatttcaaaaagtttttattctcttgtaatagaattcaagctatagctcagctatcctctacccccacaccttgatccagaaaaactaagaactgaaaaaacatgaacaaatttgtgctatgcactgagaaacttcgaagaccggttcttaatacgtggcatcatgaatctcctatattgacagcccataatttttgtcttctaaatgtagggctctaagtgtcaagcaagtctaagtgtcatgcaagtcctacaaatgtaataaattctccacatgcaaatttagaacacagcataactcaaaaatcttttaaaatgcattctgtgaaatttaaaattttaaactgaggatataaca

SEQ ID NO: 53993 - DNA, 2639 bp, Bovine  19866881336183
tcacaggccacttttatcctaaattactctcagtctttcacttcggaatacaatcacagcttgtctactgtgagtgcattttaagctacaatattaaaaggactaagaaaaatatgcagtttatgtgatccacactgtagtttgagaaagaacagatacaaagctttggtttgaaaagcaggtggtacttagtagacctttgccctgtttacaatacaaaaacaggaaagtttacagtattaaatctccatttagcataaacctgtgtattctcatggagagtgatttcttccagaagtggccactgagcctggtaacctaaatgtcagaacttaaagtgctacctctttctaatttcttctacttctgttttcaaattccagaacttcacaaatcctataacattctacaaaagtgctaattagatgactaacatcttaggagcagctgagaacaacaatttcttaagtaattttgctcacatacagttatttctaggaaaaaagtcaatatccacctgctattgaaacggttaataaagtgtccctgaacattaaggcatatcttaacagagaatgtagagagagcccagaaacatcagtaaacataaaatcagtaaagtagcactgtccaacaaaaaagataatgtaatacaacataacatgctacatagataactttaaatcttacagccacagtaaaatatgtagaaagaggactttctctggtggtgcagtggcaaagaatctacctgccaatgcagggaacttgggttagatctgtggtctaggaggatcccacaagcccaggatctactactgagctcaggctctaggggctgagacccacaactactgagcccgtgtgccacaactacggaagccgatgtgcccaaagcctgtgctctgcaacaagagatgccaccgccaccacagtgagaagcccgcgcactgtaatgaagagtagcctacacttacaactagagaaagcaatatactcacaactagagaaacacaaagcaatgaagatctagtgcaatcaaaaccaaacaaattttaaatatgtagaaagaaattagtttaacactatagttatataaccctaaagattatcatttcacagaatataacatgtgattcatataataaagtatgaaaaagattttatatgtattttttctcattgtgtgttcaaatctggtgcatgtctttcacaccagccccatttcaaatgctcagtagccatatgtggctagtggctcccttattgcaaagcatgatagtctttgtctgttatgctgagtctgaggtgagagattataaaaccagaataaattgacactctgccttttttttccaatccccacgatatatttcatagccagcaattctcaacattctttgccatcttgctgcttttgtcaacagtcaggaaacttgccttctatgtgctgtcaaggcagtcaaggcagtcaagatagattgcctgagatcaaatcccacgtccatctcttcctggatgtgtgaccaaacagggacatgtcatgaaacctcctcacctcactgcctctcagctatgaggcagcacagtttttctggtcttctacaggtttttctgctcttttaatcttttttcaaaataaatggatagatacatgtaaaatgcttctattaatagaattgctagcaaatgatgtttattagttacactatttatttgttagctatgaacacaaccttgtgtaattgcctagacatgatggagatcagtaaatattgttgactgggagagcagtagaaaaccctgacttgaaagagccagtttctcaagggaagtgactcctttgcgaattaggatgttactttcacacattcaacaatactcagtcaggtagcctctaagcctcgagcaagacatacggtctccactatcatgggaatttctgttgcagtggatttccccctacgatctttttacatctctcacaggatgattttgtctgcaagtagtcaaaaaccccctatccagctcgcttgcaaaatacagaaatgcaaagacaggattgagcccagccactgtgccatctgggctcctgctgcgactggcactatctctctagctctcttctatatttcagacttgtcaacagactggcttccaccatggtcacaaaatgttgccactagtagagacaaaagactgctcctccgactatgggaggtttcttaagtctccttggatcaacctgtggcagtccaaagaagtcatgcacggattggcttatgattgggatttttaaggatcgctggcaaaggtgtggagtcatcaccaggatccagtgctatccagtctaggagagggatcgtgcctggggttgaggtaaaacactgaagaaaagtagggttttgttagtaaggaggaactgaacctgtgtaggcaatcaacaatgtctacacacaccgctaaaaaggaacttatacgtgtgtgattcttctaaagttgctgcagaggcagcctgtgactcaaaacagacttgaggagaggaccacaaaatggtcctcagtaacatgaaattgagaacacacattattttcaccccaactgcatggactgttgtctttatcagttcaaacacggct

SEQ ID NO: 53994 - DNA, 2304 bp, Bovine  19866881481660
ttgatctacagaaatgccagaggacactcccttagcaagtggccctgggctaatgagaccaagaaaagcagaagcaatgacctaaaaagtcagtatcattaagaaaggaagccatcagttagttccattcatttggttaattcaagcaccattaagtaatgttcttatgagatgcaaaaacagaatccattaaacatatttaggcttgttgttttgctgaagggggataatgaagtactaacttataaagtatataaacatatgccttgaatgtagtacattttagaaaaataagctgtccaaatttaaagatcctcatggtaaaagccatgttaagtctacaagaaataagaggcaggaatagactaattttacagtaaaacttaaaaaaaatgaaatttgttttgagttcaatgcaattgcaagtatattccttcttataactcctccccccacacataaattgttatttaatgtgtacttcctatgctttttaaacttcttttaattgctcaggaagaacagaattgaattttatttaccaacctgaaagttcataataaaatgagcaggtgagtaaataaacttgtcttcttaagctaaatgattcttaactgtgttcaattcgcctaaagagaagattgtcatgttcatgttgctaggacacctaattatcaacagctcttagtttcaggggacttagactctgtcatcagagctcatgcccagtgtgccaggctgaatgatggcccccaaagaggttcatgtccctgtagcctgaaacctgtgggtgtgttaccctacatggcaaacggaggttgatgtttccaggttagtgagatgggcccagtgtaatataagggtccttacaagagagggccaggagggttcagaccaatcgtaaaatacatgaggacagaagccagaggctggtgtggtgtatggatgggccaaggaatgcaggtggcctctagaagctgaaaaaggcagaaaaagaggttttcctctcagagcctgcagaagcaaccagcactgtccagtaaagctgatttggggtttctgacctcctggtctctaagataacaaataacaaatttgtattgttctgagcttctcaatttgtgaccatttgttacagaagcagtagcaaagtaatgcatccatggaactctaatctttaaaaaaatgctgcttaaaagaagacaggaatgaaataaaatgggcatgaattttgagaccagagtactgagttcacataaaatgtggatccttcctaccgagcattaaccttgacatctctgaggctctttgctactgaagtggagatagggtctctttcacgggttattgtgtgaaaccaaatgaaaatatgctaagccaagacaccttacatatagtacttgtatgtttgttttttattcttttcccttatttggcgttcacagagcagtgaatgtcgaataatggtggttaagatgtagtatggggcttatatgggcaatactaccatcatgcagtcaatggaggtttctgtgtaaggagttgagatttattctatgaatttttgaatgtttactctgtataatgagttatgataggtgtactaaatgacgtgcatgagaggaatataaaactttaatcaggcaatctgagattgatgattctggaaaattagcatgatgaacttgtatgtggaatgaattgaaagaatgtgataataaagtggtccacatatgagatgccaggggtttggataaggacaattatagaagagtagaagagtagccatcagtattctggtggctgtgtagaagggatggaagagagaaggtcagaggaccagatttcaaacctgatagcctgaaagaatggtattccctagtaaccatggtaatagcaaaagaaaagccagtttagggaaatcaataggtaaaagaaagtttagggatacacagtacgttggcagagttttgattaaatttcctgtcagtgggagatcacagcatttttgacagcataccccaagacaacacagagcttttacatctatatgaagcctctctgttaatttaaaaaagctatttctgtctacccttcagtacctttaagtaggagaaaagtcattttaaaagaattgaattctcttacaaaatttaatctattaaactaatagatccatgttttgtgaaagcataacattttattttggtgcaacttctagacaaagtttatatctataaaaaaaatatgctgaatggattgtatgacatccaagtgaggatgtcatgaagtattggtgtgtgt

SEQ ID NO: 53995 - DNA, 1971 bp, Bovine  19866880703708
ttttccttagggggaaaatgaatggtgaaaaagaacatatagcaacagattaaacagctgtcagtatcaccaccaactcagcaggctatgttctgtttgcagcccccagaatagtttaacaaggtcactgaaagtaactttttcaaaatatgtctcattaggagctacccctggaaaagtcaaataattctcctatttaggtttccaacagtagattccactttggcaagaacaactgcaccataatttccaagtctggagcaggaatatactgaaataacagatgctactacgggggcccactattatatacaaaatatacaaaagcatgaaggttatatgtgctgaaagagatctgagtcattgctcagcccaaagcctttgtttactagatgaggaaactgaagttccaacagggtaagagaattgctcagattcacttccatagtatcccaatgataccatgatagaaaaacgtatcccaatgtttgttctcttgatgaagttataagggtatgaagactggggacattgttgttgttcagtggctaagtcgtgtttgactctgtgaccctatgggatgtagcatgccaggctactatgtcctctgttatatcctggaattttctcagatgcatgaccactgacttggtgatgctatctaaccatctcaccctcatggatacatatataatgacattatatgtatataaaacaaatagctaatatagtcactgacatataacatattagacactcaacaaatgcatcccttcctctttctcactctttttttttttttttgggattctcccttcttatccaaggtggcacttcagttactctctactgtagaaagatagactaaaatcacttaacaccatttcagactctatgatatctatttctttgggaagatacaagttcactggagtgtcctgaaaccataaatagttagatatccaatgaagatacatccaaaatataaaataaatcccacaaaattgacaaagcagtataggtcatatacaattacacagcccaatttataaatggtatgctaaaaaccatgtttaaaatggctttcttttataattcttgcataaacacaaaaagtggcatattattcatttattttccaagatcatgctggtaatttgttttaactactaaattgaattgatgagtgtttctgatgcttgaacaggttgctagcatgcaaacgtaggtaatgagataaattgtatgtcatggcttattatatgtctgtacctgatatctactttattctctctgatacttttcaaagtcctcacagctaatgcgtctcttcaagtccctgtacaaataaattattaccatagaataacatatttaatttcctatgcgcttaagaaaattattttaaaggctatttcaacaaaataaaattacccatctaggtaatattttaacttattttaaaaattttagaattaattagcactttaactatttaatgttattttaaaatttgggcttattaaagaggtaatcccagaccctgatgctgggaaagactgaaggcaaaaggtgaagagggcagaagagaatgagatggtcagaacacatcaccaactcaatgaacatgaatttgagtaaactccgggagatagtggaggtcaggaaggcctggtatgctgcagtccatggagtcacaaatgttgtccaattaacatgctgataaagtcgtccaattaacaacatagacgttaattgtgactagtaataaaacatgtttcttaagctagaaatctcctctattttcctttctctgtgtttattttctctgtcaatagtgccccatatatctgaagtgaattctgggagaaagctgttatctagaattttctatattaggaatggtcaatcatgtaaaatgctacatagaactctgtgacacaatgaaggtcatagcaacaggtctaaaag

SEQ ID NO: 53996 - DNA, 1110 bp, Bovine  19866881074713
tacctctaacatctgcttattctaattttctctttctataataatagtcagaacttttcctgaaataggagtttttcttttatcttttctgctaaaagtttcttgaaattgaactttcagaaaaattttttctgaatgtttaaatgtgtattattttaaaataaatataaacaacaatgcagataacattttggtaccatttttacataacaacgtatcttttgttagtgtaaagtgatcaggtatttgtaaaaacccaaaggaaaaaaccatccaataggtctgaagtaggaaacagaatattaatcagaaggcttaaatcagggataaatcatatcattaaatgatatatacacctgtgattagcaaaaggctgctactgaggtggctctttcttatttccaccccataaatctaatcttccggggatgagaagcaacccaggatggtctatcagtcatggtctaatccagtcattagacatagtgtcctgggagactatgttcagttcctatttatgatcttaatatttttcacacaattaattcctcccacctccattttgtaggcagaaaacaaacaacattggtaaattgttactgctcgtaaataattcacactaagatcggtttgtagcttttacagaaaaataaatatctttattagaacaaagggaatagaaaatgcttgcttgtttaaaattctgaacatggactaatttctatctcagtgcaggtgtcctacatgcagtggttcagttttggtcctgacaggggtcagtccatctagtggcacagcatgaaggaactataaaaggtttattttatatttattctgagtaattttaaaactattgcaaaggttggaaggtaacaacacaattctgaaaaataaaaatttctcataataccatatatactttaaaaatttttttgcatgttttacttgtatggatttacttgcatagtttcatggtttaaatagtaagttaagttgcagtttagtaggcagatattaaatgacattttaatgtttcccctgctgtttcaagaaactattttcttgtatttgctacacatagaaacattaatatagtaacagcgactaaaa

SEQ ID NO: 53997 - DNA, 1856 bp, Bovine  19866880196731
ctcaaactcatgtccatcaagtcggtgatgccatccaaccatctcatcctctgtcatccccttctcctcctgccttcaatctttcccagcatcagggtcttttcaaatgagtcagttctttgcatcaggtggccaaagtattggagtttcagcttcagcatcactccttccaatgaatattcaggactgattttctttgggattgactggtttaatctccttgcagtccaagggactctaaagagtcttctccaacaccacagttaaaaagcatcatttcttcagtgctcagctttcttagatgacattaaaggaagtaaaatgcagaactgatccataaagaatcaaaccaaggatgtgagtgaggggtgctgtgctatttgtctgtgtgcccccagatccagtccctgctgtctctgttctactctgcatcctgacagggtgtgggcattgtggctagccccttcaagctaacacatagccctaagccatagctggtttctggctgggttcagccaggggagacaccgtgggaaattggaggtggagggagaaataaagccaaggtgtttcttgtccccttcctccatcctgagtagcttctacagcaacacgttcctctccatgactccagtatccccagacagctccttctcaaagtcacagcctctgccaggcagcccctgcctggcttggttccagcccccctagaatctctcataacaagaaacacaggcttctcgattggttatttctgagtgtcagtgacatcatcaaagaaccatatgccttccaagctcagtaagtcaaccttgccctcaaaatggtccttttcttggtctctaaatggcttccaacaactgttccaaccagcttcctgttcagattcagctgcttttctctagaaaccctgaggaagtccttctctgtgttttattgactccagttggcttaaacttgcccttccccaaaccattaaatggtaacaagaatagaatgatcatgattgaattaatctaattgtctggagtgttgggaagtcaaccacaatgttcactacaaaggactgatgttaaaagatcttcttaagtgcaaaaaaaaaaaaaaaactcaagaaactaaaagacaaagtgatagtcataaagggcagagagccaactcacagataagtgacgttattgaagaacctacagcaaatggatcagaaataatcatcaaagacataatagaagaaaacgtacctgcactgaaaagtcttcaagtgtaggacttgaatggatgttctctgcaaatcagtgatgggagacacatacctgtatacagtctagcaaaagcattctaaaaaggcacagaaagacctagcaaggcatccaagtagaaaacaggatcctaaaggagtaagaatcagactgcactctgaggtctctgcagtattatcataggacaactaaatatctacagattttttttttggaccgtaccatgtggcttgctggatccaagttctccaaccagggactgaacccagtccctggcagtgaaagcaccagaacctaactactgcaccaccagagaactccccatctacagatttttttattttttaattgaaggataattgctttacaatgttgttgttggtttctgtcatacaacaactcaaatcagtcatcagttcagtcactcagtagtgtccgaatctttgtgaccccatgaatcagagcacgccaggcctccctgtccatcaccaactcccggagttcactcagactcacatccatcgagtcggtgatgccatccagccatctcgtcctctgtcatccccttctcctcctgcccacaatccgtccttccag

SEQ ID NO: 53998 - DNA, 732 bp, Bovine  19866880440864
tggactgttgtgttgatagaggctttgatcttttctggcagttggttccctaagtctggggtttttcatgctgtgctgcttttctcgggagcgtcgcgtgggccccggcgctcctgtgtgcacagagctgccgggattaactcccacactgccaactcgagcattaagcacactgttagtagatgtgctctgtttagatcctcttgttcagagcctctcttttgctcatagaattaattttatcaatgccaccgaaaatggttctctgactacgttgctgcagcgtggcatcagagccgtgttttgccccaggattcctcctaatgactttagccagcttgaattagcttgatgtatcattaatgcatacaaatggcttttatttttgttcataatctgttcataatgccatggcattctgctctttcgaatgtttttgagatgattaaacggtggtgtactttttgacctatttaaccctccagcagagtctctgatcaaaaggacatgaagatatgctttccctagggtcgtcagaagttgttaccatctctggctgatgtttccaagttctttgaagtcttctgttttttataacatttttttcacttacagagcatggactctagccaggtatttttaaatggaagtatcgttggtttacaatgttgtgttcatctctggtgtacagcaaagcgatttagttacatcatatagattcttttctgttat

SEQ ID NO: 53999 - DNA, 703 bp, Bovine  19866880468883
acagaggcgctgacatcacacgctggttttcctttttcctcctcccctgagcattgattgaaacccagctaagccacgctggctttaggaaccgaatccggagtgtttggaggtatgcgggttcagatctccacggcggggcggccggtcctgtgcgtgcccgcggccccatgcaggtgcgattgaacccaaaggccctttcatgaccggggacttggcggaggggcctcggtctcatgaaagctaaactcttcatccccaccactcttctgtgtttcagagcaagaagaaaactttgagtttatcattgtgtccctcactggccagacgtggcactttgaagccaccacatacgaggagcgagatgcgtgggtccaggccattgagagccaaatcctcgccagcttgcagtcgtgcgagagcagcaagaacaaggtaagacccggagcagcctgccccaggcccccaccccagcccacccccagaaaccaggagccactgatcctgaaagggaaacggccgggggcaggggacggggtgcatcctgtgaggccatgagatgggtacaaaaccttcactttttccatgcagaaagggaagtgatcaagaagataatgaaacattgtgtcgatgcatgtcctgtatcatatattagtatcttagctcagcatggcagagtatcctgttttaaatctttttctct

SEQ ID NO: 54000 - DNA, 1477 bp, Bovine  19866880482348
tgaaacattactttgccacaaaggtctgtctagtcaggctatggtttttccagtggtcatgtatggatgtgagagttggactgtgaagaaagctgagcgccgaagaattgatccttttgaactgtggtgttggagaagacttgagagtcccttggacttcggagagatcagatcagtccatcctgaaggaaatcagtcctgaatattcattggaaggactgacgttgaagctgaaactccaatcctttggccacctgatgcgaagagctgactcactggaaaagaccctgatgctgggagggattgggggcacgaggagaaggggacaacaatggttggatggcatcaccgactcaatggacatgggtttgggtagactccgggagttggcgtgctgcggttcatggggttgcaaagagttggacacgactgagcgactgacctgaactgatgcatgtgaatggactgactcctcccgaaatcactgttctttgtccttttggaggttatttcctagaagacaagtcagctttgttattgtttgaatttggcctgctgggggtcacgtgactgggtggccaggtggcatgctgagcccccgaggatggcatccccttctattgcaaaatttgtaagacactttgtggtgatgtaggctccccatgctatggggaaatctcaacagaacttaacactagcatatcctgcgatcgtgtggctctgtctttactgacatggaagacttgggaggggggcaggagagaagccatccttctctctgtagaaagaaacatctggaaggtgctcaacttgctaacagcggtgatgttcgggtggtggcatttggggttgagtgttaaccttctttatgcttttctgatttgggcggtaaagataggatgtattgtgcatgagaaaaaatttttttaaatttattttttggatgctagagacaaacatctttattaaagatagcaccaaaattttggcatttaatattaataatagcatcatgctggaatgggtttgtttcctagccactttggacgccttatcacacatctagctcagcgcagtccagtgcaaagataacatccaaacgtatgctgcttcagagcttccgggccctgccgattcctggctggaggaaccacggcctcttggagtttctcgtaaataaaaaaagtcagaagagctgctccttgttttttatctcttgccatgactacagcccctgggccagtttcctcatgcaagaggctgtctgaccctaagagaatccctttggtaagtgagtccaattaatcatgacaaataaaccctccccctccggcccttccccacccccaaaacccaaggaaaacctccaaagaagcgaggtagacatatttccatttctttattagaaagaggcctctacgctatagccacctctctccattactttacacatttttcttttttcttttttttttcc

SEQ ID NO: 54001 - DNA, 3195 bp, Bovine  19866880483970
aggtacagtgaaggaacctgctagcaactgagagcgtgtcagggacccgcagcttccagcttgctgacggcagcacggctccacgtggctcccaccttcctcgggccacctctggagacagcccggagccctgggcaccttggtgggtgtaccagatccctcctgattggagcattaatgaatgtgctgtggtaacggttctgtcctaaaatctcacagttacgacttaccaagactggaaggtcatcactgaagaagcaccgagttccagccaggagactggcatcaagtccctatcaaaatactgcacgaggctcctaaaaaacccatccaggagctctccccagacagccaagggaacactgtgtgggtgttgttgtggccatcccagagccctctgtgtgcctgacgccctacagttctcagtaaatggtgagttcatcttagtcagcttgggggcatttggcccttgaagttaagctcaaaatacagcaatccatcaatagtccctaaaaatactcttactatattgattctcactgcttcccatccctttgttacgtttggctgtctggtgaaagatggtttgcttcatgtattcatagggtaccagaaagcagtttaacaagatcttagagcgaaacccaaatgcatccatgatgtgattggcatctcagagttagatcatcagaataaagcacacggctctgaaatgcaatcagcaccactccgatttcacatgtactttttaaaggattaacactattcgtttctgtaattacatgatggaaagaattatagggatctgtattccaattaggttttctcaataagttctggttcctaactgtacataaaatgctgagaaatttacacttttctattactctctaatattttgtctaagtgagataactgttaggacagactaatgctttgctttggtctttgtgtcatggctaatctaatcaagcattttctctttgcataatctaaattcagcaatcctcaaagtgtggtcttcaacatcctatcaggggattcacaggttcaacactattttcaaaacaaccccaagacatcgcttgctttttccctgtgttgaaatttgctttgatggtacagaagcggtgtgagtgataaaccctgatggtgtctcagcgtggagcgagaccgtggtaaccaggttgtgccgcacattgtctttattttactgattcctacgctctcaaaatgcaaacaaaaaacagcttcactccaggatgttcttaataaaccaaaacctaccaattaaaaacaatggtaacctctgagcctttaaatttctcgggtgatgccagggcaagtatacttcagggtttctgctgcactttgaaagcaggaaagctcttcctgaagtgtttcattcacaagctgaatttgtcacttgtttgcgggggcaacacttctacttgaaagaaggactatgtcagacactaactgtggtgattcagtcttgggtgcttggcagatattttcttgaaaatgaacaaagtaagtactgcaaggaaagcagctgacagtgtttgtggccagtggtagaatttgagctttctagtgatgatgtgaggagaaggcaatggcaccccactccagtactcttgcctggaaaatcccatggatgagggagcctggtgggctgcagtccatggggtcgctaggagtcggacacgactgagcaacttcactttcactttcatgcattggagaaggaaatggcaacccactccagtgttcttgcctggagaatcccagggacgggggagcctgttgggctgccatctatggggtcgcacagagtcggacccgactgaattgacttagcagcagcagtagcagtgatgatgtgaagtttgaaaacttgtaactctcaccatgagattgataacttctaaatacccagagacttttttctgacaagactggtggtgatattaatgaatgtgatttgaggggtattaaaagaccctgatttagaaaaggcagagggactagggaccaaattgccaacattcattggatcatcgaaaaagcaagagagctccagaaaaacatttacttttgattcgttggctacattaaagcctctgactgtgtgaatcacaagaaactgtgaaaaattattaaagagatggaaataccagaccacctgaccttcctcctgagaaacctgtatgcaggtcaagaagcaacagttagaacaggacatgaaacaacagactggttcaaaattgggaaaggagtacgtcaaggctgcatattgtcacctgcttatttgacttatatgcagattacatcatgagaggtgccagggtggatgtatcacaagctggaatcaagattgcctggaagaaagatcaagaatctcagatatgcagatgacaccaccctcatggcagaaagtgaagaggaactaaagagccctttaagaaagtgaaagagagtgaaaaagctggcttaaaactcaatactcaaaaaactaagttcatggcatccagtcccatcacttcaaggcaagtagatggggagaaatggaaacagtggtcgatttaaaagatgcttgctccttggaagaaaagctggaacaaacctagacagtgtattaaaaggcagagacatcactttgctgacaaaagtctgcatagtcaaagctatagtttttccagtagtcatgtacagatgggagagttggcccataaagaaggcagagcaccaaagaattgatgctttcaaattgtggtgctggagaggactcttgagagtcccgtggacagcaaagagttcaaactagtcaaggctaaaggaaatcacccctgaatattcattggaaggactgatactgaagctgaaggtccaatgctttggccacgtgatgcaaagagctgacttattggaaaagaccctgatgctgcgaaagactgaaggcaaaaggagaaaggggatgacaggatgagatggttagatagcatcattgactcagtggtcatgaatttgagcaaactctgagagatagtgaaagccaggggagcctggcatgctgcagttcatggggttcacaaagagtcagacatgactgagtgactgaacaacaagttttagaatcacagagcgtgaggctcccgtgttaaggagtctcagaaacatgtctccatttta

SEQ ID NO: 54002 - DNA, 3418 bp, Bovine  19866880569589
ggtgattgtgagtcctcgggcaacacacctcagaaggaacaagagccgtctgcattaagacgtacacgtgggggatttagaatgtgtggtgagtggtcagaacttggggcaacacttgaaatgccacacgcattgggaatggatacaggaaagaatttcagttctcccaaggaggaaggtgaagatgaagggatgatgagcgagaagacgggcaaggacccagcaaggggcgggctctgaagatgcccccagaccaggagacacagggccaaagatcaggctgaaaggcgtttcagggaaagcagaggctcaattgtccatcccaaggacagccctggttgaaagaactccgagtactttgcagcaggacgataatttgcagcagtaagataagtagccgttctttctgcttgtcaacataaatatccagggaccatgttttgctcagtgatatccccatgctcgtgtgtgagctcattactcttgcaaaatagagcagaaaaaaataattattatttatttctgcagatccatgtcagcatcccagtaaaagcatagggaaaagaggaaccagctgggaaaatggtgagaatgacgtgttctggacaacccttcaggtgtacatggggccccttacagagggcagagggcaaaggaacttcagaattcagcctcggcagataacagggccaagtgccgaacatacctgccctgcctggccatggggcagaagaggggtcctcagtcaggttttcccttaaagatgcaactcacctgtgcccttgggaagccacctgctgtcctgcaaagatgtccctgggatgccccgtagggtgctgggaagtgcatggaggtctctggtgggcattcaaccccagtcagacccagattggcctgctatgaggaaccaaggaggctgtcctggagctgggctctgtgtgtgtgtgtgtgtgtgtgatgaggggaacaagcctgagctccagttcatccacaatctgctccctcatctttcccacctaccccctcccaataaaaacatctccaccaggacaaaacccaggctcacctagacctccccttcttctagatcctgtagaagtccacttctccagaaagcccaccctgcccacccaacacacagacccacctcccccggccacaagagcgcaaagccctcagtctccatctgttactgaaacaaaaccttgcagagctcatctttatacccactgagtgtttcattctcaaatatgacctccttaagatcaagacctttgcctggtatccagagcctggcagaaggccttagccctgtgtgtgtgctcagtcattcaggcgtgtccaactctttgagaccccgtggactgtagcccgccaggcgcctctgtccatgggattctccgggcaagaatactggagtgggttgccatttccttctccaggggatcttcctgacccaaggatcgaacttgcgtctcctacatcttctgcactggcaggcggattctttaccactaagctatctgggaaacctatgaaagtgaaagtgaagtcgctcagtcgtgtccgactctttgcaaccccatggactgtagcccaccaggctcctccatccatgggattctccaggcaagaatactggagtgggttgccatttccttctccaggggatcttcccgacccaggggtcaaacccaggtctcccacattgcaggcagatgctttaacctctgagccaccaggaagcctatagaaaggctcaaactctgggtgggctgcctgcatgggcaggccaaactcctttgctaacatttacccaggtggacacagtctgtgttttcacagacatgattggagtgagtctttcagcaaagaaatatttgattctactttctgctaaagccaagtctgtgctgttcagtattagcaacagcggaattattcgacctcacctctttggaacacctatcagctcactgacttgagggaacacagcaagggagaaaggatggcgggggaggggtggagagaccctgcttgccccccaaatgcatcaactgtacaatttggtaactggcgtaatcaaactacttaagaaacaactgattactaattgctattattaaggatgtcagcattccatgattttgctgctgatatattatatacaagtcaagatgctacttgaattcttgattgaaatagaaaaactagaggcattatgttgtgtttggggtaatggtatttaagcatctggaggcaagttaaagaaatactaattgggtttttattaagagagctcgtgccgccggcacatataggtgcagaatgagtgcggtgaatgtgggatggacaagggccagtggagtctgccgtggaattcgactgctcactccgtcagcgcgatgtttagcatgccttgcggtcagggctacacccacctccttctgcatggaggggaaggtcccccacagaaagctcaacagttgaatgtaagttaaataagcacaactcccgccttggaggactcacatttgaacgaatggcaagtgcgtgggcattgacagtgtaatagacacgacaagagactagcaacgacatgacctgggttcaagcctggtgctcccactatatgtgtggtccttaacctgtatggtctgttcttctatctgaatcctaatttcctcatttgaaactattggactgttgagaattcccatgcagtccagtggttaggactcagcgatttcactgctgaggcccaggattcaatttctggtcaaggaattaatcccacaaaccgcacagtatagccaaaaagaaaaagaaaaaaaaaatgggattagcggggtcatctctcagggtgcttccaaatgggacgaactggagctccaagaccaacatgtagtgtttttggagatggatgaaaaccctgttgccttcatgggtgtgtagaacaggccccactttcattggaaccgtcagctccaggtcagatgggcagggaaggtgtctcctggtgagaagtgagtttatcagcttgactcaccaaagagcagcagccttgcccagagatggccttgttctgattgttaggagaacaagtctgcagaccagagcctgtctgtgctataacgagccccaagtggagacaatgacagaggaatcacgtgcagtgaggactctagttggtctgtgttttccaaggactcccacttccccagcagagaaaaacgaggctcagagaggttgagttccacatctcaggtcccacagctgcaggagggggaaacccagagctcttcccgctaccccgtcatgcctataattgccctatggctgcatttacagaccaggacaccagggttctcgtgtatccccttactgggcaacagtcaattaggagcagcacacaaac

SEQ ID NO: 54003 - DNA, 1796 bp, Bovine  19866880636377
cttcaaaatcccccagaaattctgatcgcaaattagggtgcggggtttcgttctgaggcaatgaaaatgttctaggcctgtgcgatggttgcccctatccgtgaatatactaaaagtactgaactgtcagtgataaacgggtgaattatatgtgctctgagtgttaatctcaataaagctattttcaagcaaaaggaaaaaaaaaaggcagcgatgggtggggagctgggggtcattgtattaaatgggcttccatggtggctcagtggtaaagaacctgcctgccagtgtaggagacatgggttcaatccctgggtcgggaagatcccctggcaaaggaaatgacaacctgctccagtactcttgcctgggaaatcccacggacagaggagcctggcaggctacagtctgtggggtcacaaaagggtcggatacgactgagtgactgaacaaaaaactgtattcagagatcaaagccacggaatgagggagacaaaagaaggtggtgcggcaggctagaaagactgcaggctcggggtcagagcaggtggtccaaggggcctggggacattcaggaacctaagctaagccagtcacaagcctcaggccacaccatcgagtgcagggatttacgtggttgcctgggtctccagccaccagccgggacctggttctacgtctcacacagagggtggaccctgtgacaatcactcctctgagggagccgccccacgtccccctcgtcctacggaggacagcacacgcctgtggggggagccttgctcttctcgagcttcctcatgtcctccccctctctgagccacacccctcccctccgacctcctgggagatgccgctgccccgcactcttcaccaccttgtcacctgtcccttcctgcccacgacagcaggctctgtaaggcgtctcctggggtccctttagtttttccttctgccggatgctcatcatgtcctgataccatcgcccaatctgggggaacgcaggccaggattttatatgtaagggtcaaatattaaattgttctctagttgatttttagctgaatcaagctgcacaagtttaaattaatccagtgtgctcccaaaaaatgcaaaaaggtgctatgagcagtaccgttaggtggaaatgaaatcatttcaagagactcccgcctcttggcagcctcatctctttttacataatcagccacaacccatttctcaagttgggctctgacgattgttaaatgacaaagagattctcttacacacgggaggctccactggcctagcaggctggggaagaggctgagccgtctagaagaaaactcagctaaatagagaagttaattggatgcatgatccttctttgataacaaaaatgtcccatctttagaaacttaactgtttctatgaagtcacttggaatcaaatttccagctcctacacaagaaatggttctgacggaggcgggaaggcaggctaaagttccacccatccctggaggggctctgtccagggtcctgaatgtgttcagttggttcattctgagcaagacacagaaatacacgaagacaaggctgcttcttcacggctcatccctgctcttcatctactgacatcatgtggtttgaaaaagtagagcaatggtgctcccagctttaagaaaacctaatacacagacgcccagactaaaacaggaggtaatttggttgccatagatccttccgttgctctagggtcacactgtgaaaaaggtaaataaagagtagagtgtgcttaagcatgcttaacta

SEQ ID NO: 54004 - DNA, 1111 bp, Bovine  19866880705770
cagtacacttggtggtattaccttgctctgaggcaaaatgtatttagaggtgcgtcccacctgtgctgacggccggagccaatgccatgagccccgtgcactgcctgcgagtgtccctgcatgtctcctcagcaagcctgcaggcctgccagcatcgcctgccagtgccagccgtggtgcctgttggtgtggcagccgaagtccctgtcccttctcctcccggctgtcaggttgttccagcagctccaccccatccccgattgcttcactccaacagttaatcttctgccgccctggccggcccgatatccccggcagtatcgcattgcttccactgccgcttgaacatttcacttcagcctgcctgcaccaggccactgtccgacctcatcagccccaagtacaaaagccatacccgtcttgcacacttccacgtggaaggtgtgtgtgtgtgcgcccactccccccacactgtgtaaccacacatcttcccacccgaatctgtggttatagggcaaccagtcctgaatctgaagcaaaaatttacgtatttgcaaactttcaaaaaaaaattttttttcatcatggacatttttttacaggactttaggctccccaggtggcacagttgttaaagaacctgcctgctgatgcaggagacactagagatgtggatttgatgcctgagttgggaagatcccctgggggaggaaatggcaacccactccagtattcttgcctggagaatcccacggacagaggagcctggcgggctacagtccgtgggatctcaaagagtcaagacacgactaagcatgcacacaccattagaaacacacgtttccactccggtccgtgtgccctgcacttcctttggtttctccctccccatagagccagctccaggagggacaggcagccctgaatttgagattacagagagtatgccataaatgtgggttctgggcatgttttccgtcaattcgttgattttagtttccacagctcgagcactttttctctctccttggcttctgtgctagcaattttagcatgtgaccagcaggtggcggtagtgaatggcagtaccgctctcatctgggagtttaat

SEQ ID NO: 54005 - DNA, 2587 bp, Bovine  19866880712848
ccgcgtcttccgctgggtggcgtggcactcattcttgccatgacacctgcacttctcctgcccgtttacatgtgagtgatgaacacttggctactatgcattctgaagatgctgacgagagcaaccatcacccgtgcgtatttacacgatgcttacttagccacaagccatttctcggtacaggttatatgaataagtttatatgcggtagttataatgaggtatgacaacattacacaaaaggaggttaacactaaggattttaagtaataaaacatgaatttaacacttacgcagtcagttcagttgctaagtcgtgtctgactctttgtgaccgaccccatggactgcagccaggcctccctgtccatcaccaactcccagagcttgctcaaactcatggccattgagtcggtgatgccatccaactgtctcatcctctgcctttctcctcctgccttcaatctttcccagcatcagggtcttttccaatgactcagttcaataatgttttataaaacacaaagtccaagatgctcatctcttgtcttctagtgccttgtttggctctgtgccctcaagaacttatttcaatcgctcagttccttctttaacgtatcccttctcctccatctgatatacgcaataggcatttttgcacaaaaccccctgtagctgagcggcgcactgctttgagggcaggtgtctctggctctcactgcatctcctaagccctttcaaggaggcggccgtgatgcccacaccaaggccccacgcccaggcctgtccacctggacttcctcctctcctctccaggcctcacagaatcatctcttaggactgaatagaggccgtctgtgaggagtgagggcgctgagcaactccgtgtttgcaactgtgaggatgtgaagggggctacttgtttgtgagtcaggacatttggggggctgactcctcactaggaacattccagagagaggcaaggtctctgcaggcgtggttacttgaaatgccaggccacaaggtttggagctggtgaagcatcaagatgacttggttctcctctgccaatgcgggaatgattacgtagcaagtaggccaaccatggacttgactcgcacagaagggctgtaacctgaggctccgaccagccttcctgaagaccgtgggtcacgtactgacgtctgtctcagagctccgcctctccagcccttttcctacagctcctccatgccgactattttgctgatcatgaaagcatcgtatcaacagctgaaatcctattctccactggacacacacatttttgagaggggagaaagtctctacagcaacttgtatttacttattggaatatctgttcccacagagatatacaacttagtattgccaacacccctcgtatgtttataatgaaaactatcaagggttaacttacttttgtcagttcttacagaaaggaacactgcatttggagtttaaacgactgaagatggtttccttaaactggaaggcgtggctttgatttctatgtgacctgtaccccaaaggtctcaaccacagaatactgcagtggaggaaccaccatctgaaagccaacatagttaccctcgatatttatcacttttacatctcacgtgacaggcgatattcaagaatatttacttcatgcaaaaataattgccgggtcatgacgttaggagaggatcacaaaagaagagaagtagtggtctccagctcaaagagtttacaatttaatgctggaaacgatatagccacgtttgactaagcctcaggggaagaacgtgcaaacagagcaacagccagcagtaagaaggcatttctcctaacagcagaaaacaccgaactaaataatggcttgcgtcatttcacttcagatgtcaccaactttctcaaattctagtcttagagaaaccccacgagacatgtttaacctcaaaataatgaattactacttagccatcaaaacctagcttgctgaaacctggtttatggaagcagacctcaccatgtgatgctgatttgggggagtattctcaagcaaattaattctcaaccaagaaagcgagagtctgcaagcgttctgccaagttataggagtttaggcgaggcggccaatttatgtaccggtgggttcgtgctgtaaatagaacccagggtgtgggcaataatcggtggccaaggcagggacggggtgagaagccaggctctgaagccctaacaagcctgagacgtgacccaccgggaggggatcgctcatctggctcacggaacaggctctggagttattaccatgtcttctagaccatctgaaactaaacaaagaaaaacttttgtttctatgagacaaccatggatccagttttgatgttgcgtgattttttttttttttaatagctattaccactgtagcagcagcttagcgactcggcgtctgcagtgtgagcagttttgataaacagcctctgcgggccacacaacggggataatgtatccttaagtaccgccaatgagctgccattctgcacagccaattacttactgtgcgtctgtcactcaaaggaaa

SEQ ID NO: 54006 - DNA, 735 bp, Bovine  19866880717359
tacttgggatttgacttactggtgaatcagcctggaaaagggcagaaactcttggtgatggtgataatgaagtttcatgcagtccgagagtggaagagaaaaacccaaagaggattctatgagcgtgtgagtatgaaacagacctttatttccattgtaggactttgtaattttttttaaaaaatcataattacaggaaaaagattgataggcactcactctttccctcggaggtctcaccctttgaaatacagactgctcttggaggccttttttttattcctgtgtggcttcaaatcttattaaaaagactcaagagttcaatgttaccatgcaaacctacggctatgccctggcccgctccgagcatgggagggaaaaccaggttggctggaatcaggaccggacagtggaggccttcctaacagctacatcacttcaaactaggccttcgccatctgttccgtcctctaattataaacccaaaaataatataattcacaacactaccataaaaagtgagatacaaatgatttaagtgcctgtgaggagggcccattcgcctcactatttgcattggaaatctgccctccttttggcaaccaggatttcaggctaagaggattttttttcccaaggacaccttcagtagcttttcttaaagatgcaggcattctggactcagcactacgtgacggttgttttgtaaaagagcacaattccacacgtttaccg

SEQ ID NO: 54007 - DNA, 904 bp, Bovine  19866880740176
cacagcccctgggggagagtctgcaattggtgagatcccgaataaagtgagtaaagccacacttgtaggcagacagcttccttctaataatgggagctggttatattgcatttcagacctaaaaaaaaaaaagagtaactgccatctcaactttttggatttagcaaaaagggggaataatgcatgatgaaaataatatccattgattgtgatgttcgtggtgagatcactacttatgagaccaatgctgatcatgtaactcacctatcaggtcctgttctcaaagttcttgtgtatctggtgtatccaaatgtagccattccacacagcacacagataactcttcctgatcctctcaacaaacaagagtgagaaacacacagttgcaccttgatcattttttccctctaacttcttcctcagcttgtaaatactcgggacagtttctctcatttgggctcttaatgctttcccactgtttgagagtcatatccacaacaactttctctctgcttctcaccgtcctctcagtgtctggggtccgaaggggcaagggctccctggtcgtacgtgtacttcagaggtgtcctggccatgttactccttaaagctctaagtaaaatgactttgctctgtggcgctctgttaaattggctggttaattctggtgttatttaccctgtaattcattagcttcaccccaccattggcagctgacaggctgtaatttcacgccttgcaataaaagatgtctcgtaatccgcttcatttagcagcaagagaatttaatgaaattaactgcagtcctaattatgccagtgaatactaaagaccgccatcaagttttctcagaaaaaaaggacgaggtccacctcatggaaggatttcaaatataatttcctgg

SEQ ID NO: 54008 - DNA, 1357 bp, Bovine  19866880784532
cgtgcagggcgcctcggccgcccgggctggcgtcggggtcggcgccgcggccgagcaggtggcgcacgcaggccgtgtggccctgggccgcggcgatgcacaggggcgtggtgagctcgcgcttgtactccagggtccagaggcctggggagcgggtggggagagggaaggtgagaggggggcgcgggtgaggggacggtgtccgttaagactgaaatgggggaaaccatctgttaggagaaggggccaggtgggcatgtgggaagctactcgaagatgctctggccttagggacagagaaacgggtgagatccgactggaacacagacaagggatggagggaggtctgggggtagaggttaaagaacgctgacagagaggagtagagagacagcgagggaaggcagtgtgaggggggaaagagagggcgaaacaggacagagagcgtcctggagagggcagagatggagacctgggggagagaagcaacagaaaggagaggctgaaaccgagaccgagagattggggcggcggcgggcagaggggtgttactgagaagagggttttgccaaatatgagggtgactggggactcaggtaagatgtgaggagttaaaagctgaacaagcaggagcatttaaggtggaattcacactttcaaggctctgaattagggcagccggcgggcggaaagtgagctgtggatttttctggaatccaagccctctctttttgagtccctgattttaccccctttatcattaagaggagaaaacaacaggcaaaacaaactgacccacatcaccaaggctgctcaagaaaaggactcggaaagtttagttgtctttggaagtggcccggttttcagaagcaccctttgatgtgctggtctgcattgagcacaatcctgggtttgtttctttgcgctttttaggggttttgtgtgtgcacgcatatgtgtgtctgtgtgtgtgtaaggttgctctttcttgaaggatgaatggagcaggagctatacatttcacttctctgaaaactttgggctttcaaaaggcccatggaaggttgttagcggccacgagcgctcctggaaatggggagagctgtccctggtgaatacacttcaagggacaggatttcacatggcagggatgccttctgataatgatggaagaatcgataccgtggctgtaatgagctgtggaggagacccttttcacaggccacctccttcatgggacccatgctgagcggttttgaaagaccactcataattacctacctcaatgtagcacagggttctagcctgaccccgggtccccagggcccagcgtggaggttgtgcactgctgggagaa

SEQ ID NO: 54009 - DNA, 760 bp, Bovine  19866880810122
tcctcttcccagcctcctcctcctcgtaaactatgacgatcaggtctcttcgaatagaaatgtaaaagcaaaaagcaaggaaaagaaaaagccagggcccggctcagcggcgagtgggcttgtcacgtattaatttttcattgctgtggagagttgcacatacataatcacttgattgcagtgggagttagggagctcctatggtgtcatttgcataaatcttgttaagtcaatggcagttaatgaagtacaaatgagcccggagaaggtgacatgcaaatcgtgggtggcagatgggaggtctgtttgggggacggcagctgtgtgctcttttttttttttccctctctcccgagttttttcatctctgtacgatggtccatatactcagcctgtcctgttttccttctggactcctcctgcctctgatgttcaccctgaaaacacagacctcagggcttcacctcgcacccagtaacacacactagagtgtgaacatttgaatttgtagaatcttggatgagagggttagatatcatcaccgactcgatgcatgtgaatctgagcaaaccccgggagacagtggaggaccgggaagcctggcctgcagcagtccgtggggtcgaaaagagtcagacacaacggagccactgaacaacagcgatcttggtcagttgatcctgctcacaccgttgaaaatgcctggacataccttttgtatgtgaggacaaaagggaaacaagcaaacgccccactgagt

SEQ ID NO: 54010 - DNA, 847 bp, Bovine  19866880813838
tttgccagcttcccagatactggttaggctgaacagaagggaagaggttagatgtctaaggtggaaattaggttttctcgaattggtaacccaattggagctattgctctatttaaaacctggtgagctgctgctggatggctctggtccttccagcttgaggaggccccggacagggggtgtttatgcggtgctggtctcagaccagctgctcggccactgcgggcaggagggtccctctataaacagtcaaatctggacatacttatgagacccaagaattggtcttttttctctctttcttgctcctttttttttttttttttattcacaagactgagattgttttaatgtcataacttataggaaaaataaactacattgaaataaattaaacacaacggagacgtgcttcagacagggctcataggatatgcaaccccaggaaagaaagccaggcaaaaaccaaagcaaagcgaatttccaggctgcccccccaaaacgtctgcttctcagtcaactaaaaaagccagaacagaaacaaaaataagtggtgaccgtgtttgttcttgcacatgatgtttacctttggaaaagtgtggaaaggtggctgctgtgcgtggcaagttgcagtggaggctttgttttcttcggggaatgtaggtggaggaggttactgggcagtttggtcctataactttcaaaatacggcagctgagatccaatctatatagatatctatgtacaaagtaggatagtataataaatatttagtgtgtcttccaggtgtagctgtagctccttcaaaagcagtctttcaagctcgttaatggatatactctcaatt

SEQ ID NO: 54011 - DNA, 1020 bp, Bovine  19866880830276
attctagatgatctgaaatagattcacacagttctcagatgccaactttgctttgtgggtgcatacagaacacgtttcttgtctctcaaacaataggtgagacatggaaaatccacccagacaagtccctgggcatttccttatttgacaaacagtatgacaatttcttatgccaactcttgcactgtcttcaagtaattttcttgaggcactctactaatgcagagatttcaatttcctgggctcttgaaagggaagaaatgccagcctttttatagtctgtaacacttatattacagatttttgcagtatattcataatttacatttcaacatttcccaatattagcaggcttagtccatcaactgataaaatggaaacaaatggaaacctcccacccctccagttcacaccatgaaccaagatgcatccttcagcccttttgttgtgaaactgcataaagaatgaataagagggcttccctggtagctcagtggtaaagaatccacatgccagtacaggaggaatgggttcgatccctgatccaggaagatcccacatgccgaggagcaactcagcctgtgtgctgcaactaactgcacctgtgctctggagcccaggagccgcaactgctgagcccacgtgctgcaactgctgaagcccgtgtgccctagtccctgtgctccgcgacaagggaggccactgcgatgagaatcccacgccctgcaactggagagtaactcctgctgaccacaactagtgaaaagcccacgccgcatgaggacccagcacagtcaaaaataaattattaaaaaaaaaaagaatgaataagaaacaaaacaagaaagactttccttgatgagccacagtgaaaactgcctggggcaaactgatctccatccaggtgtccttgtctgaggggcagccgcccaggcaacattctggggacaggactggcagcccgtgaactctgtctccagggctggaggaatcgccctgacttgatccagaaatgcaggg

SEQ ID NO: 54012 - DNA, 1774 bp, Bovine  19866880844236
tgggttccgtgtctgggtgctggtatctgaatgcccggctcctagtatcctgagaactccctttcaagaggaggtgtttaaacagtcccctggtttaaaatacgacccatcaaaacacactgggcttctgtgctgtgcttttccatctctgatgactcctcttgtctgacaaagtatccctcaacctgaaaagcctctgacagcccaaccccagaccctgaaaatgcacccgcagaacacagtccgctcctcctgagaacaaacaacgcatcttgttttgtatcaattagtggacaccggacaggtggccccgtcgatggccttaaacgtgagagggggcgaagcagagggcagaagaggggagacggggagagaagaaagccacagcaaattagaaaggggagcgcctcattacgccccctctcacccggctttgaaggagggacccggagcccccgagatgcggcgctgagccgggatgggccggtcctccgccatcccgcgcgctcaatgctagccattagttcttcccaatcgggcatcaatgttcaacccacaccccaaaaaatacataatacgagcaataatgataacaatctgcaggctctcgagcttcagtacgtgaagtatgagtcaaagaagcagtttaacttttcactcggagagctgacaagcatgactagagggggaataaaataacattccgtccgcataaatatcaagcagcctgctcgagactgatgggccaggaatgtattcttagccatcattccggcagacaggcccaaggacactcataacttattttacaatcatttagtttcagctcaagtggaaaacgtgacaacttatctctgctgacaagatgccatatcgaaccttacaattaactctcctccgattatctgcccagccgatcattagctgggccattttcgatgaactgttgcggggagcgtgcctcggtgatggccgtcggtgccaggtgtgaggatgggtttttgacatctccggcagctattcaaatagaccgggctccgtgcccccgactcccaaggccctgcttctcccaaggggtctcccagtgtgtgtgccgggcagggggagtcctgcgccgtgctgcgtgggagctgagcgtccccgtgaccgttagcactgcaacaaaacctgtattactacggccagtgctcctccagcagacgtgtgctcctcaccccccagtctatttcagggagccaggggctctggagggacacctcccaccactcctccttactgggcttgacctgcagaggggacaccaagaattccctgcaggactcccccgccctgccccatgcacgctgtctgggggtgctgctgatggtcctgagagcaggctgagttaatttcctagtgttgaagaaagagggcttcctcagtggctcagcggtaaagactccatctgccaatgcaggagacacgggttccatccctagatgggggaagattccccggagaaggaaacggctacccgctccggtatttattcttgcctggagaaacccagcggatggagcagcctggcgggctacagaccatggggttgcaaagagtcggacatgactgagtgatggaacgatggggaatgctttaaaaggcatgctcacaagcctggagggcgtccctgatggctctgcggtaaagaatcctgccagcgcaaggagacatgggttcaatccctggtccagaaagactctgtgcgttgagctgaagggaagtcacaacagcaggg

SEQ ID NO: 54013 - DNA, 2009 bp, Bovine  19866880891935
ctcttccccccacccaggatatgtgcctcatccaatcagcaaatgacccgcaagacccccatcccactccttatatcctgggtataaaagtggactgaggagccctgttcaatgtgggttctcccttgagctggcccactgttctaacagcgtctcccgctctaataaactttattctcctctcattctgccttctgtccagaaattcttttccagatcatgacattaaacagggcagcaggtcccaccctgctcaccccgtgacgtgctgtcaactctgtcatccctgctcagcgagtgcagccctcagaaaggccccaatccgtagaggaggatcatgtagaagtctccgacgcttttgctgcgtcttttgtgatttttcatttaacctctttggagacggctttctgtcctgatcgggcaatgatggaggcgacgaacatttttaaagtgcatcttttaaaatggaagatgtgttgtttctggtcagttaaattaaacattaattttattaatctagttttcacaagcaaatgtattccgctggatggaaaatttatttgcaagcaagaaggcaccacacacgttgttccagtgtttatataattacacatctttatttaatggagccctgcttcagttattatgaatacgtaatatttgttgtgataaacataatcttttggtgacatgtgcttaaaaatcagctgagcattagtgaatgaagctcattttaattcccactttaccctctttgttttcctattaagagtattaaaagctgtgttattgaattttttttatatgccagatggtataaaatttgaggggtactgaaaggtggcagtgacaagaaggtctcattaccttgtccccaagctggttccttaaccctagatcagcaactatgaagtacttatgcttccagaagtgttctccgcatggacagggttgtgtgtgttacacacacacacgcacacacatcactgtggctttgggatggttgcactttggtacactgaggcttttgttggtgacttagccttccttacaggaatgtatcccagagaaggaaatggcaacccactccagtgttcttgcctggagaatcccatggacagaggagcctggccagttatagtccatggggtcgcagagagtcggacatgactgagtgagcacataggaatgtatccacgtgcgtgtaaccagccctgggttgtttacaagcacggcaacagcccggctttgggagacattcttggcacaggtatttcatgttgatggaacagctggcatctgcttccctggactgttgaaatcaccccacccccaatcctacaatccacattcccgttttcctgagagatcagctgatgacagagagtgagtgtttgtgacctttctgatcaccctgttcgctgctgggaaggtgtggtgttggttactgtttgctgagtgcacacgagggctcaggcaggccctgtactagagcacccacggttaactcgtctgcagggacagcttgtctgggacacgttagggtggtgcccgccggccaaagagtgggtgtgcaggtacccaattaatgtgtgccccccgacacgtggcccccagctggctcacttccgtggggggagcagtggcccttgcccttccctttcctgaatgaacatctttccttctgagctcctttccgatgggcccgcttactctgccagttggccgggtattcgagtccccgaagtccagcatctctgctgttggacaccagtccccaccagctctcagctgcgcctcggaggccctttccagctgcctggcgcctcccatcccatcctgatcccccagcccggccttcctcctccctgtagtcctcctctgacgtgaggaaggcctctgagccggcagacctcagcctccgtcttcgcggggccggcggcgtctgtgttttcgtgtcactgtctgtcttttccaggtgttttcggtccttctctgcaatgccccca

SEQ ID NO: 54014 - DNA, 1209 bp, Bovine  19866880911623
accctcggggaacctcggggctgagtgagaggcgcccggaccggatctgggccaccctctttaaagaaacccttcttgctgcggtgggtccctcgtgcgctgggtggctggggggatgcagaccccactccattgccaccagctgcatccggggtctggcagggatggtccagcgggctgccaagggggtgacgaggttaatgggttggattcccagaaaacagcgctttagtaaataaccacgacgcttctgactggctttcagctccgttgtgtggtcaccaggggcagacacgggagccgtgaccggatgcccccaggtccttgcctgtcgttgaggcaggacggatgatattctgggaggatgtcaggagtggtcctgcggtgattctggcctcggccttcctgtctccacaaacgcggctttctctggataagacatcggggttggggggtgatgaacagcctttcccaaaagcccacgcagtcaagtctcatgcgttcatttttatgggaaactcacgccccaaatgctaaagggccaagaacttcctgagtgctcgtcaccctgctcctttcagaaacatctgtttgctttccccccgctcacggggtggggaaggatttttttcaatggtgattttaaaggagatttccgtagccaagtatattggagtggaggaatgtccttagggaggacgaggggaaattggaggagacccgcacagctttcacggtgacccaagaggccaggaagagcgctagctagcagcaaggaatttcccaagtgtcttttggcctcaagcaaaacaggaactgggaggggaggcgtggtagagggggctggaacaatatgttaggaaaacagaggggcttcctctctcggcagggggagaccctggcccgctgcgagccccgcacgcatgccttctcccctggccgcgttgccaagggggcccgggctcaggacggaggaggaggaggaggaccaacaaagaccgatggctgtttattccttaattaccgaaagcttttaagaaactggccactgtaaattccacacgcagaggagagcaggaggggacggacaaggatttatgctcacggggcaaagacaaaataaatatcctgcctgactctggatcgatattatgagtgtttttgccaacctgcggggtgctttatgagctcagaggaacagaagaggat

SEQ ID NO: 54015 - DNA, 2164 bp, Bovine  19866880918356
atgttgagaacaggatgaccgtaagtagcccaagatcagagaaagtcttcctgtctttatagaaattaagccatcagatagggtagactgtgcctaatttacttttttttctacatcgaaaaactcttctgtcttcttgctttaaaaaaaaaaaagtatatatatgtttttataatagcctgtgagtttgagtaaagcttctagaggaatccacgggacactgccttagcagtacatagcatatttcatccttgtacctaatctgcagggcttcccaggtgatgcagtggtaaagaatccgcctgctaatgcaggagatgtaggttcgatccctgggtggggaagatcccctggagaaggaaatggcaacccactccagtattcctgcctggagaatcccatggacagaggagcctggcaggctacagtcagcggggttgcaaaagagctggatacatcttagcaagtaaaacaacatcagcaacagctcactctgtatcgctttgttttccactgggaccctgtgagggttgttaattgtggctggaaatccttaccaaaggtagccaagtccagtccatccattttcttcactggcagcaagtcgctgtggagaactctcagtgggagagctcgggcgtgggggacaggcgggaatgctctttccctgctgccaagagacggggtttcatcattagactttataaatgcgtgctgctctggttctagcccggttgccggccggttgctaaagtgttgggaggaagggagcgatgcagactcggaggatggcttcttctcaggtgtgcccgtggccccagatggaaaccaatcaaggtgcgatttatgttcattaagtgcttgtcaaaactgaaaaattttctaatcaacagcaatctagcggcgtccccgtcgatggctgggagtgccgcctctgccgcagcggctatttgcctgttacaactctaggctaagaatccgctgatgattacattaggctaagctgcgaagtaaatgaaccatatcttatttaggtgccacaagcttcagtgtagtcctgccccgcagggcacttgatagcgttttatggctttaaaattagtgtagcttcccattggctgcagggcacttgcctgttatgcctttgaactcaataagcaaggggaagggggccttttgtttttctcctgtatttttctcccttgcatttttagcaattttgttttgcatcttttccagacggcgttttgcaataaaaatgtctgactaccctctatatgcctacccccatcccacctccccttcacaaaaaaaaataaaagaaaaaaggagaaagggaagaagaagtagaaaatgtcatgcatttccagaggacagtttctttcccctatcctgctaagtgagaaatagcattgcaagtcacccccaacggcttatcatgttgggatggctgcctccagtggggacaacacctatgcttcgggaaatgcccacgtgaaatcacagggcaaatatttcagtatatttattagacatgagcagtaagagccaaatttattaagggctttgggattctttcaagttctttctttattatctcagttaatcacaaaaacaattgcttgatgaaagaattattattatccttatatttaaagatgagaaatcagaacccgggatgatgaaacagtccacaagccctgacagacagagcctccaggcactcttactctgaggccatcctctggcctggagaagctctgtcttctgcagatagtcttaatttaggaaaccagagaactatgttagtgaattgaccactcttcatttgaaatgaatctgattatattactgtaaaccaccttggtgggcagtaaacagcattaggaaaacagggtcactcccaaaacagtgcatcagggagccaaaaaagtgtttttttttctggacaggcctcgtcagagttctgaaattagaggaaattctgtgatgggcaaaacttgaagtgggactttttctgtccatgttgggttaaaacggtagaagaagatagtgatcgttagtgtcctaggaagatgactttgtctgcttttctgtctttaaaaaatctatttctttaagtgcttcacattctagcaaatgcatcccaaggaatctggagttt

SEQ ID NO: 54016 - DNA, 1683 bp, Bovine  19866880981019
gggaagaggtgaccccagcaagcctccagctcagggagggagcccagacgtgcgcatcccacctcacactccggtatgcccacctggtccagccaaacagggagccagaggtacctgagctgatggatgccgcccagtgggtatcctcctcgagagggcagaaggtggtgggagacgcaggcgtcagcccaggggagaccctgctgagctgcccgaggggagcacccgctcagctccaggccgtgctcgtcctgctgttacactgccctgctgtgcaggcatctggccacagtgcacccaaggaccgctccctgtgatggcaggtggagaagaccccgaggagcgtgtgtggtggcccttcatggcacctcgctgagcttcggcgcccccgtccttgtgagatgctgcacacctggcccgctgccgtcccgaggggctgccgtgaggacagggctggaatgggcgccagcgctggttttgatgctgtcattcaggacatgagactttgcacattcctggggcgcgagcaagttctagaatcagaacatccgagctgggagggagacagggagctggctggctgcagatccccgaagcctggccgaggagccagggcgggtgcacttctcaggagcatctctgatctgtctccttgctgctgaagagcttccactgtagtttttatttctcttgcgatattcgagatgcacccagcttccacagcggcatatagtcggcatcgttttttaaggtagaaatatatttttaagagcaggatctttccgcttcgtgcgatgacagtgagggccttgtttgtggctgggccctagtttccgcctcttcactgctcaccaggactacaaagtccttctgaaaaatgtgtgttccctcgagctctaccctccagacctttggaatcaaaatttgaattttttttgcagctgctattttaaaaaaagctccatgggtaattctggtaattggccagatttaggaactactagtatgctccatgtatttaaaatcctgcaccatgaaaaccttctatggaagcaatttagaacttaactagttctaaacttaaaaaaatgggaggaatgtttaaaaataaaaagaaaccatttaataccttcaaagatctccttacagatgcaaggaactcgctagcagcaaggtgtgattggctgagcttcagagagaggcgcttaattatatttttgagtttgaaatcctggtgaccagataataattcactctgatgttgagcaactgattcaaatcattaagtatacaatggaatcgtttttccaccgcactgcatgctgtgaagttgccaaggttattttccctctgtgtagtctcttttgaaggcgaagagtaaacatttggtttaagagcctgactctgccacccgtgtcgcatctaggaactttgatttgcgttgatcctaaagtatagctggcccacgagaataactctctggcaccagacagtgcaatccgattggcgatagtttcgcttgcaccgattggttgacgcagcaggactcctccaggacccgccttgtctcgctggcctactgggaatatcgttgttgtttagtcgctcagccgtgtccaactccttgcgacccctggactgtagcccgccaggctcgtctgtccgggaattctccaggcaaga

SEQ ID NO: 54017 - DNA, 1085 bp, Bovine  19866881041309
acggggaagggatgtatctggaacatttgcatatcaaaatcaagctcgccggctttatttcgccctgcgaggtccctactttggaccactgggccccacgtcccacttctaaagaggcgacgttatttagaggttgtagcttcaattcctcaagtcccaagctggggcccaagatgaaaagggtaattcttgtaaaaccagaaaactcccgtgttgtttctcttgggagaagctagaagccagtgattcaggtatccacctgtttctgaaaacaccaagctgaaagacttgtgtggactaggaaatgcatcttgtaaaggttttagcaatgttagaggcttgaaatttaggaattgccaaacttaccctctgaatttcttaagaactaattcttctgtgctttgaagcacctaactcaagcaggaaaaacagatccctcagcctgtgctgagccaaagataaatgggtccctttgctgcattcagatctggagagctggcacttggtacatttctataataaatttaaataaaatatcctggttattgtatgttaaaacatgcctattaaaaaggaggccatgctgaggcttagtcactctctgattaggctcatttcagagcccataagccataaatgctcaattacactcctgttattgtattttaatttgttaagaattggcattaaagaagaaagttatagcaagttgatatttttaaaggagtaactatgcaagaaggaattcattatttacaagtcctaactttggttttgaaacttgaggtttgccccttttcagtagatatcaatggaagtaagtgaaaactgcttgagaacaaccttttttcacaatgaccttgacccttggtcctgtgctgactgaaggtcactttccatgtttttcgttcgctggcctctttataagctgcgtccagagacctcggtgtttcctcccatctgccttatccttcagcctaatctaaggataacgactttctttctatccttagtcctcatccttttgaaatcacaatttttttcatagtaaataatatttgtggtgggagtcggggggcgcagtt

SEQ ID NO: 54018 - DNA, 1793 bp, Bovine  19866881114974
aaaagctattgcagacagcactggctgcttgaggctaaagcccaaagacctcttgtcagtaaggggtcagctcatgccgggtggtgtctgagccacttggttcccgtggtgaagtccggatggtgtagtctggtgttcaaggacactgctgtagacacatgtaaagatgtaccacctaaccccaccccagttactggtcccagagttgttcatgtgggaacaagcattccgtgtggacttgtgtgttggagcccacctgggttccaccccagcagtccacagctcaggggagaggctaggcttgtccctgggttgatgcttatggtcatcttccctgaggtccctcccctctcctgtccctgaccctcctgggctgctcaaaacatgtccgttgaggagcacacaaccctggttgcggccataacttttaaaacagaaactgcaaaagtggatgcccgtgaaaacatggcttgcttgtcacacccatgtggttcttctcttcacgtgtgtcccctgcgtgtgtgacagaggagcccctctgagccagtaggccagctttgggatgacagcaaatacacggtcagttgctggtaaggaaagattaatagaagcatgttctgtgtgttcctgtaactgatttccaagagttcagtgtaaaaatctcttgcttttacacttttactgggtacaaagaaagcactgaaggacccagaggtctactgaagttcatcctgaaacatccccttttgatctgtgccgtgtgttttgtttaagtgtttgaatgttctaggtgagcatggctactttccacaaggctgccttggtgatctcagggaatttttgttttttctggcagaggactgggtaattgacaagacgccatgattgtacatcatttaatttagtattgccatttgggggacgtgcttatcttaattgcaaaaaccttcaattttgtataaattcaaatggaacacaattctgacgctatagcgatcttcaaattccaccatcaccgtaactacagaaaggaaactgaggctgggcacgtaacattataaatcatttaatttttctttagttgataaattaatattcactactccatcacattttatccaaggttttggaaacagggttaaaacatgaaaaaataacactgtagcatataaacacaacatctttagggaaatatgtttatcaaacttcttagctgcaagattctggaggactttttactgattaaaatcatttctccttctaaaagataaggcttagtgttttggtttttttggttttttttttaagacagtgaaccttcaagttggaaagctgacaggcagaacatacatatctacttgaatttgtttaaaatgtatcaatttagagggaattatttttaaactgtataaaattaagaaggcagatggcttaagtagttaggatgactcttctccagagatgataaaatgtaatgaatgtgaattatttcgctgaattatattttgtgcgcacccgtgatctgtactccgtacttactgtgtacatcccctttgtcaaaagttacaacgtatccgtctaccctgaaaggtccctataatgtgaaggtggcttgcctccatgcctgtgaaattgatgagctgatgagctgggagagactccctcatattttaatgccagccgtaccagtcctcacccccaaagagctggggcatcagcatcgatggtagcaaggagtctttgccgctgtaattgacaaataatacccctcataaatactgccagtcttttca

SEQ ID NO: 54019 - DNA, 848 bp, Bovine  19866881208017
tgcagaatcccatcccaaaaaaaaagattttttttttcttcctgggagtaaattaaaagatgcttttcttgactaatgatccccccggtttaggaatgggaagtcaatacggctttgccgccgtcagcttcgattgatctctgtgctgttcaagtttgaacggcagttctcggggcagctgagaatcgctggaaccaattatgagccgtccgaagctgccctaatcagggtgcaggggacagacggctggtcagaggaccctgcttccctgtgtcctgtgtcccctgcaggtctgggcgacaccgtgcaaggtggtttcaggttttttttttggagaagaatctgctgggttctacttccccatggtcttgagtgtgtgtgtgtgtgtaaggatctgctgggttctacttccccatggtcctcagcctgtgtgtgtgtgtgaaggatctgccgtgttctacttccccatggtcttgagtgtgtgtgtgtgtgtaagcatctgccgggttctacttccccatggtcctcagcctgtgtgtgtgtttgaaggatcagctgtgttctactcccccatgctcctgagcgtgtgtgtgtgtgcgtgcatgcgtgtgtgctgggggaggaacagcacatttctaattatatgccactgtcagaatgaatcttctgaacaagacagaatggacggagcttctcgggaaaacagctgggccccttttcaaagaattagactggatatattgcacttggcttttcctcagatggagataaaaatttattaaaatatttctttttagtattaccttagggccacattagcgagccctccatctgtttgtgctagcgag

SEQ ID NO: 54020 - DNA, 2442 bp, Bovine  19866881223972
aatcagagtgctctcgagaatttcccggtgaagtccttcttaaatgcaaaatgttaaaaaggttttctagcagatattttccccagtcttctcaggttcagctggccacaggggggaatgtgatggactgaataaccccaaagtgtatcatttaactccgcggttgtaggaagtcagctgcaaagatggcagatcaaatgcaacgtctgccattgttgaggctggtggtccagtgatcacagcccctcaattacagcccttccagggagcacgagcagcagtcattaaatcattatgtctttgattagttgctctaactggtcattgcctttgaaatacgatagcacaatttgaagttttattaaacttttttctggaactgctgaaaaagatgttgtgtttaaaaaaaaatcgaaaaaaggcttgccatgtattttattggaggagattgagaagaagaaaaaggggaaaaaagaaaagacgaatgtttcccattatcagtcattttggtggtctcagaaagcctaaggtggtccccgcgtgcccacagcccgcttctcagagcagctggcccccagggaggggacacgagacggggcaggtcaggagacccgaacccactcccaggccctgcagccgcctgcctgtgtgagcacagctgagcacggcacgcaaaagatgagcttcaccctcaccatccagcttgaaaaacctgattcaaacctcacttttttttaagtgagaatttggtttcctttttctttctttttttcatactgatttatttgcttttggctgcattgggtcttagttgccgcgtgcaggatcttcatcgcatcacggggatctttccttgcacggactctctagttgaggcatgcaggccagtagttgctgcgcatggactgggttccctcgcagcgtgaaagtgaaagtcactcagacgtgcccaactctttgggaccccatggactatatggaattctccaggccagaatacaggggtgggtagcctttcccttctccaggggatcttcccaacccagggactgaacccaggtctcccacatcgcaggcggattcttcaccagctgatgggaccttggtctcccgacgagggatggaacccaagtcccctgcatcgcatggtggattcttaaacacgagaccaccaggcaggtccctgctctgtgtctctgttttgaaggtcaggtgttcagtccttatactacagaaccatcagagtccagataaccctgttcactgaaaaactaggctttaataaaaaaagtcagaatgttctttgtgatgctgagaacccagcacccgaaagtggctcctgctcccacaccctcgttgcatcccagacgagagtgacgcccagaggccaagaagccccaacttcagcatcctaacaagccaccccccaatagccttcccttctcgaaatgaacagctgctccttgaagacatggaaagacatttccattacttggtgatgtatttctcatctccatctgagaatgtgccgaacctagagtgggaatatttctacttcaactcacttttttttttatttcagtccctattaaaagttacactctcggtgtcaagctgaaatacccaattaattgtgggtacacttgaacccttgctctgtgactcagtgtgtttctaggccgaaagggaaaccaatgctccacctaattggaacttctggttttatggcgtatcctggagttttcgcttcgtttttattttcgatgttttccggggttaatgatgttttccgtgctcgtctgcatcagcccactatgtggaagcccttggcagttttcaaatcgtaagagctttaaagaagccgccaatgttgaaattgtgtttgctgttaggaaagttgttatgagttattggaaatggaattaaaactgtataattaaggatcgattccttatttcggagttctgtttcattaggtatttcgtctcgtgttctgtgggttcagattacagaaaagaatgctcgtcttcgaggaaggacgaagttattttgctttctccacatttgtcctattttgcttggcctctggttttgtttaatcctctcaaagacccttttaatggacatttcaacacgactactcctctgtgtggtagcctctaggaaatgaccattatgtcaggcccttcacagctaaagtagtgagttcacatcgtggaagaatcttcggggttgcatcttatgggagagaaaaaaaaaaaagcccactgccttttttttttttcccacaaaagaacagaacatttacccagtcttgttgagcacatgaatgttcagatgctggcacaaaagaaatctccaatctctaacctcacaatgaaattgctccgacaaaagatcacggaacaccgggcgcactaaagtggaagagacacaaaaccg

SEQ ID NO: 54021 - DNA, 1962 bp, Bovine  19866881225353
aatactgttgctgggtgttttgtattacggtgggtaggtagtggtttagtcgctaagttgtgtccgactctttgctaccccatggactagcccgccaggctccttcatccgtgagattttccaggcaagaatactggagtgggttgccatttccttctccagggcatcttcccaggcatctaacccaggtgtcgtgcattgcaggcaaattctttaccgacagctccaagcgaagcccaaggtgggtctagatgctgtgaatttaacgtgaagtgctttctcacagggaggctgtgcagtattaggaggtctgttttttctttcttaaatgaaactttccagaactaaatgcatgcaggatgctttgaaggatttcagttattcgtggaaatgcatgctagtatgtggggatagtttggattcctcgtagtcactgaatcacagcagactgcaaactgagaaatcaatcaatattctctgctgaactctaattaacacttaaacacgattattcacaaacgtgaaatcttgatggcgatgacctcaggtattctaaatgtaaataaaattagatctagatcccttgtaattacctgcggtgctgtgagtaattacaatggcaattgatacactcaatttcttgttgaaggaaaaaactctcgctaagtttctctaagctgtgtacttaactcttcagtaaccgcgatgtatggaaaagaatgaccaggatgctgttttattttgcttcaaattgtttttggagaatgactggtttacaatgttgtgctagtttctggggtggttgctagttgcttctccaggggatccttccaacccaggaattgaacctgtgtttccggagtctcttgcattgtcaggcggattctttttgccactgagccacctgggaagcccgtgttagttcctgctgtacagcaggtgggtcggttctgtgtgcacacacctctctttcccatgtaggtcactgcagggcgccggggagggctccttgtgccatgcacttgttctcattcagtcactctcgtgactgactctttttcatccccatggactgtagcccgccaggctcctctgtccatgggatttcccaggcaagaatactggagtgggttgccatttccttctccaggggatcttccgggatcagggattgaacctgtgtctcgtgcattggcaggctgacttttttccactaagccaccggggaagcccgtactatacaataggtccttattagtcatatatttaggagctatactttgccaccaaaggttcgtctagtcaaggctatggtttttcctgtggtcatgtatggatgtgagagttggactgtgaggaaggctgagcaccgaagaattgatgcttttgaactgtggtgttggagaagactcttgagagtcccttggactgcaaggagatccaaccagtccattctgaaggacatcagccctgggatttctttggaaggaatgatgctcaagctgaaactccagtactttggccacctgatgcaaagagctgactcattggaaaagactctgatgctgggagggattgggggcaggaggagaaggggatgacagaggatgagatggctggatggcatcactgactcgatggacgtgagtctgagtgaactccgggagttggtgatggacagggaggcctggcgtgctgcgattcatggggtcgcaaagagtcggacacaacggagcgactgatctgatctgatctgatattaaatctatgggatcatattgtttctttacttgggcccttgaattcatgtaacttaaatgcctgaagaagtaaagtgaaagttgctcagtcatgtctgactctttgcaaccccatgaaccatacagtccatggaattctccaggccaagatactggcatgggtaagccgtccccatctccagaggatcttcccaacccaggg

SEQ ID NO: 54022 - DNA, 1229 bp, Bovine  19866881267551
cctctgctaactggagataatgaaatttgtaaccatgctggaggcctcacttcggatggcttagtgggtgcagctgcgatgcgcaattcattgtgatgtttcctctaccgagtaatatttcagtgttcatccacgatcaaccatacaatgggtctaaaaagactcagaatgaacaaccaagggatggagatgagaaggataaaataaattcccttctgagacctttagaacaaagcaccaagaacccaaggggacaaaaaaaaaatgaaaaaatcaaacaaaaagaaaacaataacaaagaaacaaacaaaaaccccaaaaacaacaagatttctgagtcctctcttgtataataagattgggtaaatccagactggtcccgcatttttaaagaaacatcttttctctaccacctctgaatttgatgatccatataaaagtcagggtctttacatggaatctgagaaatatcaaggaagccactctgcctgccccactcctagatttaaaagccgctccacacacctcaaagacttgctttttgcctggtggaaagagcttgaggcagagaatcaagagacagttctgtcacctaccagcaacctgaccctggacaagaaagccacttaacctctctctacttctgccttttcactggggaaacagggaaattaacgcctgatgcaaacttgcatgaatgttataaaactaacgagaactacccgattcgggacccggaaccgggactgcagagatgactggcacagtttcagccatgataacctctctcctggaccctggataagaagaatacccagaacggatggcaactcaaaggcaacggcaaaagatggcaagtcattaatgatctgcaaaatccccactgcccacgggatatccaggcacacgcccttcaacttgactctggccatgagcccagggcccctggggctcgcatccttccataacctaggttttactacggtggcccaaccagtgctgaacttgccgtagggggacctggaaccttgcctctcggggcagccccggctcggacaaagttttccttttaatatctgaaccaaaatccgcttccttgaaggttccacccactagtcccagtgatctccgtcagggccacccaggacgcgctgggacccgtctttccatggcttgaacacagttaggacgccctcatgcccctcgtgctggctcaccgctctccttcc

SEQ ID NO: 54023 - DNA, 1971 bp, Bovine  19866881268314
ctggactgcagtccatagggtggcaaagagtcggacacgactgaagcaacttagcacagatgtcgcaccttcctttacatttttgtgcagttcctttcgcttgaataatcaggtctgtggctttaccgtttctttgtagtctcttctgtttctccgtgttttgaaatcctcattgcagtcgccttttccctgcctcccttctgcctttgtcataaattgtattcttctgatatcactacctttatttgcctgtatcctgggtgtttctttcatctgactcatagctgtgttatgagtctgtgtgttagtctattttgacctgtaatttggcctttaaaaaaaatctaaaaagtgagccttctggacgcaggaacaatggcaaggagcttccgtggaaagcatccaaggggagccttccccttcgggggtgtcagaagcctctctgctccagaatcatccactcagtccacaagacagcttgatgagttgagaagaagtgacaggttcatttttccccctctttgtttaagccatttatcttttagatccttgtctgccatctaaattgtattgccagtttgttgggatcttcacttgccttgtcttgaaagacgctgatttgcatccaacttgagcataaaggagagagaaagttaatcatctcttagcctcttgaacagatccgcacagggtttcattgttgcctgatccgaatctgggtgaaagtccctgttcaccagggtcttggtgagaatatccctgagccccggtccagaaagcttagctctttgaaagctctttaatttatactttaggcaaatctttctatatttgcagttaacctaagctccattcatagatctttactcattaagcagcatcatagtaatgaatgcccagtgagcactaagtcgatggtactcagccttgtagctgtgagcagcaagtcagggtagagctttcttccttctgagccggtgaggttacgcaggagaagtccttttcccataggaccgggaggccagcggtgttccagcccttggtgaggtctctgcgcctgtcaggagtaccagctcccacccccggaatctccctttggtgatgctcggaccccacggccagcagcagccgcctgctcctggcttctgtgagtctgagaagagtgcttatcttctcctgccttaggcgtgagccactaggcacacctgcagcctttgctgcaatttctagggacacacacacacacacacacacacacacacattttcattttcatcaggacctgccctcatctggtggtgattgttgctgagttttcaggcaggacactttgatacattttgtgctcctgtaatcattgcagtcatgcatcctgatttttcctgccttttaaaatttttaattttttaagtgtaagtatagttgatttatggctcagcagtaaagaatccacctgccagtgcaggagacatgggagtcgtgggtttgatccctgggtcaggaagatcccctggaggaggacgtggcaacccagtccagtactcttgcccgggaaggcccatggacggacaagcctggcgggctgcggtccctgaggttgcagagttggtacgactgagcaactgagctcacacacacacacacagttgattcacaatattgtgttagtttcaggcatacagatagcagttcagttacatgtatatattcttcaggttctcttcccttgcagattgttacagagcttcatcagtagagctccctgtgctatacagcagttcctgtggattatctgttctgtgaatagttgtgtgcacctgttaatcccagactcctcatttcttttgctccgcagcccctctgtccctaagtcgtccctgcttttgatgatttcctctgtgtctgtttaatacattcctaatccgtcagcatttccctcctgggaactgtccccgctttgtcacaagcaca

SEQ ID NO: 54024 - DNA, 853 bp, Bovine  19866881323167
catctgctgggcatcctgagggcacacggggccactggagctggtgctgcaaagctagggggagtgcggggctgtgtggcatgtctgccttctttctagcgcagaaatgctgattccagccctgggcagactggccacgggcaaaaccagctacaggacatttggcagcatggtgttggagtgtgttgaaacattttctgtagagaagtgaatgttcgtagtcctctgggtgtggacacggggactctgtgtccttcagggcctagaatcccagcagtcagcgtcctgcggcccactgccccccagaccagcagctggggcagctgggacccagagcttgctgttggcagctccactctggggcttggttttaagggacagtgtgctctgaagaaacgggaaaaagtgggatgtggtttccgacgggatgacttgatgtcccccttgtcacaaataataactttacatcagacttggctacacgtgtaaaacacaccgcatagactgtatttatttcagtttgagtttctaaaaatgttatgttctttcatgaactctgtgaggacagaggaaatccagctcccggggacacggtagaaacttcccctcgtgaaattgtgaaattaatgtcaggagccgtgactttgctccgtcctgaaggtaagtgtttattacagtcggcatttaaatcccccgattaataggagcaattaaacaatagcttcatttccagcaaattaacaaccctaataggtaattgcgacataaatgaagataaatttgttttaatacaacgagataaaaagaatacaggcaagaacagaatctcagattaagaattcagacttcatta

SEQ ID NO: 54025 - DNA, 852 bp, Bovine  19866881394269
cctgcatcttaaggtgaagccttaaccactggaccgcaagagaagtcctgcaagactctgcttttaagagcccgggacatacccacatccactgaagccagtcacacagacatcagaatccaaaacatggacgtagcctaaccttctctccaaataacaatattagcacagcacacctcatttaacaaagcattaaagcatcgtgctccctcagatcaagtgcatctattaataatgacttaaatcgtctgtactgatttcacattattaagaaacctcattcccatcatgtggaagaatacaacagggtgggggtgggggtggggacaccttgctaacttatgtccgaagagcacaacccagctcggggcagatcctgccaagacacaccacgaatgctgtctcatccaaaggtcaagagctgctctcatccagagtccaggagggctcttctggatgctcagaagcgaaggtgcccttgagcactgccatccacggtggccgaggggggatggagtagcctggtccttggcaggcacaaccacgggtaaacagccctggaaggacatttacagactctggggaaccgtgcaggagagcagcccactgaagctctccccgataaaggtgatggcgtctctttacaactgtcatggggatttaattacatgataaaattgcagctcctgcctcttgagacaaattgcctgttcagactgattgttttttatgaatctcacacagggagcaaaatgcttctctcctgaagttggcttggtctgatggttatacctcatcatcctttacctccctcctggaaatgagaagcttactgatcctgcagttgaggag

SEQ ID NO: 54026 - DNA, 1363 bp, Bovine  19866880167098
agacactgatgtatagaacagtcttttggactctgtgggagagggagaggatgagacgatttgggagaatggcattgaaatatgtataatatcatatatgaaatgagtcgccagtccaggttcgatgcacgatactggatgcttggggctggtgcactgggacgacccagagggagggtatggggagggaggagggaggagggttcaggatggggaacacatgtatacctgtggcagattcatttcgatatttggcaaaaccaatacaatattgtaaagtttaaaaataaaataaaatttaaaaaaaaaaggagttaattaaatcccctttaggtaaggaccatttttcagtaaattttcaagaaaaaaaaaatactaattgattgtaaagcagtttaaatcagtttctgtacatgttttcaagctgtgtgtatgtgatgtgagtttgaaaagccacagtatggttgttagaggttgttctctttctctcacatacacacagagtcatgtttcttcattcatatgacaaataatctatatgatgaaacagaatagaaaaggggaaggacatcttgatgttgaaactgccttctgtcctagctgagaactttatcataaaaatgtaaaacttgtcatcatcacttattagccattgatggttggcaggataggcattgaagaatgttataaaaatgtaaatatatggccttctacaaaaaaagaaaccaaatggaaaaaagaaataaaaatatgtaggagtaggtgtgggcatttccatttgtgcgttttttctttactctcccaggtaacagctgtgtgactatttctgggtgacagattcttcctgatggtagttggctgctgcagcagaatgaatcacctccaaacttaggggcttaacacaacaagcatttatgatctcagttttgagggtcgggaatttggaagttgcctgagctgggtggttctgactcgagatctctcctgaagttgcagacaaagtactggcaggggccgcaggccgatgatggctcggccggagctgaaggaccagcttctaagctcatgcctgcggttattggcagaagcctcagctcttcactggctgttggccagaacaatggttccttgttacctgggcccctccaagggctgcttgtgtacctcaggacacagcaggtggcttcccccagcatgagcagacagagagtgagtgcaccagacagagagagaaccaaggaaatgccactgtatctttcaggcctcagacacagaagttacacccatcagttctgccacagtcagtgaatcaggagtcactaagtacagcccgcactcaaggggagggaaacggctccacatt

SEQ ID NO: 54027 - DNA, 1675 bp, Bovine  19866880389237
tgattgctcacagcctcctaatcgtgagaggcacaagatgctttaaaccttctaaaaacaggagggttcaggatggggaacacatgtatacctgtggcggattcattttgatatttggcaaaactaatacaattatgtaaagtttaaaaataaaataaaattaaaaaaaaatttttttaagtcacccaattaaaaaaaaaaaaaaaagaaaagttagaaaaccattagtctaagtatagtgggctgattagaaactgtattggtgaagggtttttcatttgttgagccaatgtttgttgctaagtctccacatctcctgcccttatacacattaatgaatatatagaagaaataagtattaacctttgatattaatcacattagaccttaggctaagtaagttctttccttaactaaaacccactacaccctcaccctataggaatgtaactttatctggtaccttcggaaggtggagtctttttttaagaataatcacccctggagaaataagtgtcctggttgactgactgctgtcacaaggagagggtcataaattgtcagcaggccccctgaccagaagatgatgtaacacccctaagacttctgtatgaagtcttttgtatgaagcatttgtatgaagcaaaagatgtatgaagcatcttttctatgaagacatttgtatgaagcacctgactttgataaaagtcaggactgctgaccccacgtgacttttgcataacatctcagtgtataaaagtagaccatggaaaataaagaattgggatcagtttcttgaaatactggtctccccatgtcgttctctctctcaaactctggctgagtttccatctggagcgcggagcccgccatgcttactaattatgcttgggcttctaagatccgaccggggaggcctcagtgtctcctctccttcgggagaacggaaggacgcctgcggcctatgtaagtggtgcaaacttcgtgtcttgaagttttattggtctcctgtgtaaaccaagctactcagtctcttttctccactgaattttcctcctgagctatcctcattctattactctttacatctctaattaatatctaattgaagctattgtatcctgatcctcgccgacgccatccccgcttcgaactccctggatcagccagggctggacctcgggcagaggtcccatgctcaaaaaggccaggtttactgtgaataagtgtgactttgcccctccctacagtctcctggaatacttggtggtaagagtgggtaggggtgcaagtgttgaggacaagcagaatcatgagccagtgaaattcatgccacttctgttaatatgacctcattcacgcactaggaaattgaatcctcaaatcagtgttcacaaggtattcatgagaatcatttagttaaagagtattaatcttgcaaaggcctaatgctgcagagacctaaaattaaccatactgagacctaactgtgtaagaaaattaggggaacctagtcaaacataattgtgctgaaaagcagaaaatgtgtgaacttggttctttctcttcaatgtatatgcacaggaaatatgacatttctgccctaagttgaatggcaatttgcctatgtaatgtggttttctggtgatggtgggggtgcctacatttttaacta

SEQ ID NO: 54028 - DNA, 3008 bp, Bovine  19866880420740
gcaatgcttattatactcagatttctcgacacttcccttggagaaaattctcccctctcaacacccttaccactacccttttcaagtgcaaaacccaaaggctagctcctattaaattctaagtcaatgttgctcttgtcagtcaatcagtcatgtccgactctttgtgaccacgtggactgcagcacgccaggcctccctctgcctcaccatctcctgaagtttgcccaagatttttaagtggggggagggagacaacattttgtttaaagcaaaccagcacaaaaattttcttccataaatgaagtcataggaaaagaaagaaaactggaaaccaaccaatatagccctcccactcaatcaagatttttgtgaaaagtccatgacctgtaagcagtacacacatacccctggctctcttctgctgccagagaagcaaaaggtatgtgaggtttccttaagatatgatacctgctggccagagacaagaattaactatgaatagccaataaatattattttatgaactttaaggccccagggcgactttattttaccaatgaactagctctttaaacaggatagatgagtacatgagcacatcagagatgccatcctatggccgttaactgtctgtgcatctttctcggagataccaggtggcaaaataaactgcagccctgtaagatgaagccataaaagatgaaaattagtttcacgtcacaatgaactatgccctgttatattccacccctgcagaccaatagcatcctctgtctgtctctctctctcaccttcctctctgaatatcttttctctgtgtctccatctgtggaggaagaaggccggaacaatgggaagaattctttctcctttgtctctctttacctggtctctttaccccagtttctctccctcaagtgtctctcctccccctgtctcactttggtatttccatttgggttttcctgttttgcggggagtagtactgattttacattccaggaaatgagaagatacagctgggcaaggagctccctgggactgaatcactattgttcccagtggttttatctgtcttctttacaagtctccttgctgcccacaaaagtgccaagctcctgataaatgggacagcgaggtgtcacatttttcccctctaaatgcagagtaaactctcacaaccttgcttcactgaaaaatgaaactataactacatgcaggaggctccttaaagaattcctttctaggttcagcccgagtagtttccacatggctaatcaagagcttcagaggaaaaatatttattctcatgaaatgatgtcccacgagataactttgtttctacagctacctgttccaggaatcctagtgacatcactgacgttagaacccacacctgtaataagaagtatcttgagggggaaagatgagcagcccttcccaatgagctctgggtcctccagacctttcctttccatccccactggctggcacattttaaacaataaatgtgtattggtaatgatgaagcctatattttatggcctcaaatcctgccaatactggagtcctgatccatcctttatccttccagaattttattaattcttgaaaataatagaagttttcttacaggtttcaataagccaccactacccagaataagagcctccctctacaactatattatttcatgcccgtagttcctattgctccaaaccaggggctggcaaactatggctcaagggccatatccaccccaccacatatttttttaaatttcagtggccatcatgcctatttgctcatgtattgtctatagctgcttttgcagtccaatggcagggttgagtagttgccacagaggctatttgaaccatcactgaaacaatcagatatacctgctttaagcaacagaacatctgatgattataccaaaaattgtaccactcactgaatatttaccatgaaaagatgctaaatgatttatacagatatctcatttaattgtcacaaccaccttataagttataagcactttcattaccatcgttttaagaaagaaaccacatacatcatgtatctatatcaaattaccatgatatacacttgaaatatcctttgattttatatgtcaatataattatacctcaataaagttgaaggaaacaagctgggtatcttataagaagagccagagtcaaatctaaaaagacaggttagagagtccacacatagtcaccacttttccaaactgtctctagatttgaggatgctaatgctctggtaggcaagagattggacttcaggaggacacagtgcaaaacaaaacaaagaaggtttattttcatgaagaaagtaggaccaaagaatgagaaagtatttgcgttcatcaggacaagagctggagcagtagacttcaaacttgtacccacttcaaactttaaaccactttcatagatttccagcatgaaatccaggaaagaaagaacaactagctaggcactgaataaatgtttgatgaatggatgggtggataaacggatggatggatggatggaagaaaaccaactgatctcacagagtcaaagggagaactgaatgtctaagaactgagaaaagtaccacaataaattcaaaaaccaacctcaacaggagaatttagaaattttctcagcagaccactatcatcaacatgacagcccacgaaacattaaatttctgggtatttccatgccagatttcaaattccaaagagacaaaaatcttattaagtcatcctgactcaggtatacacctctactagagggtggctctcatccctggttgcactttagaatcacctggggagtttttcgagcatccaaattcctgagcatcacctaagatcaactgaaactgactctttgagggtgaagacttagtgaactcaatactctgttcagtgattatgaggcggcaatcatcttacaagaccagcggaagcagagcagagagcatctcag

SEQ ID NO: 54029 - DNA, 1490 bp, Bovine  19866880467285
cttattaattattacaattttaacttggaagcaagccttattctctgctctggcttgttcttttgtttaggttaaaactttaaagtccccaatgtttctggtttgttcctctcaggagcaaattcacctgccatcccctgatgttgttctggtgacaattagcacttcaggccctgagccatccactagccaccaaccaaatggaccacctgcagaaggacaatcggcaaatgcctggtttctgtgtcactaattctctagcgccatgtttgtgattctctggtactgtgtgaatccagatctcctggaccccacagtgctatgtgctcttcactgccagaaccggaattaacgtctagctgtccaaaagtttccacttctcacccatcccctaccaaatacacacacgctcacacagaggtaacaggactctcttgccacctgctaggcactaaccaatagcttatgttagtttcaagtctttgttttattccctttaaggatgttttctccataagcagaggaatcctgcctcttcatcttcttcccttactgactcctggacaaaagctactaacttcctattgggaactggtgatagaaaagggcgggatgaggttgaagccaggctgttcaagcccaatccccaagcccagcaaagcatgcccacccagcccatcggctttcaagccaggactcaggggcttaatttgtacacaatgacagaggttaattaattaacagcttctgtcctggttgcccctagcaactggctttggctcataactaaatcccaagttagagatatttcttaaagagattttaacttatgctagaagaaaggagaaatttgttcagcatttaggacagaaaattaactggaggtaagagaaagcttttccattgattaacatccctaaatccacatcttctaacagtggtcctgcccttattactcaggtcacagtaagaaagctcctgattgcatgatgttctattgagttaaaggaacaagcatccactggcctttaaaccaatcaaaagcatctccttgcagggccttggaacaccagtatgaactgaagctaagggatctggagtggggatgacaaaggcttcataatacctggtggccaggtttagtcaccagcagtgtttgcctaacacacgccccaaccagccagcctccatcctctccattacggaaatcactcagtgccgcagcagaaattgtttgtgccttttccaccccattaatttctctgtatttaagaggaacagcatttccatctcttagattagattttgttcattaaaccctcatctcacttcccaacctgccaaattttcatcagtagagatctgggattcagaaccacaacccattaagcacaacatcttgaaatttacaattccattttacaaaaccctctaaagataatccagctcacatatagtagcctattaaagattaaatataaattagatgt

SEQ ID NO: 54030 - DNA, 746 bp, Bovine  19866880533463
atgattctgtttttacatgtcttcatggtttttagatggatggataaacactgtaggtggctttgggtactttatttgtatttttaagtctcaatttctcaatctgtaacatggttaaatagatctgtttggttaaacaagagagactctaaataccagtctggcactaaataaatactcaataaatagtagtagactatgttgttacaaagagaaacctgaggcataaagcttgaaatttgcaaaatagtagtctgaacaattttattgtggtttcagttttttaaactatgcccaaaatctgagaatagaaatcagtctgtttgaaaggaagaatgagagaatgcttctgaagagcttaaataatgaaaaatagctagataaaagatgacttgcatctgactccagttacaggttataactcatgttttgataatcccttgtttaatctttatggctatttgaaattgagttacattctacaacaaaattaagtagaattggttttaagtttctttaaaatcaatgggtgtaactgcatggattgatattttcaataaaaagtgaactgacattccattcatctcaaatattagaaatgtttttaatattgaaaaactacatgactatgattgatcactggtttatcgcttcttactagttcaaacatttagaaaaaattgttttaggtgcatagaaacaggttaatatttggcacagagtagcaaaacatgagtttactttaa

SEQ ID NO: 54031 - DNA, 1387 bp, Bovine  19866880534390
tagcacagaagttacatcagaggaccctgaagtcctcttcccacaaggatgttgaaaatgaatgacatggagccctttttgagggcattcactgtaacaaaatctcataagttgtgtcatctttccagtgcagtgccataatcatgatggctgatctctattactgcagaaagttcaaccaattttatccatatcactaacaggatattcctgaatgcctctgttttggctacataaatgtgttcagcacttctgtccttaaatgataaaggactaggagttacattttcaacgaaaatgcccccatgaatatatgagtgagcatctcaaagcctcgaggactgtgaaactaacaattatgcttgaaaaactccctgtaggaaatgcgatggtttgctttgttctgcagttctcttgttcctgttgtggggctatgatcatccatgtttgaaactcaagatgaagtagaccttcatcttctattgaaaggcctgaccttcagtttcctgtgatcctttggttaaaagaaataaaaggaccttttctttccaataagattgtctagcaggcattgacaaccttttcaattcctctgtcaagctagggggggcatactggagtaagatatgtccctgctgagttacctttacctatgacctgacattttaagcatttcttgttccatcctctccccagaagtgtagaatctttgttactatcctattttcagagtagaggtagaatctgatagaaaaaaaaatggagaatagacatggatggaaagaagaggtaagagtagatgatggatcaagtggcagctggagacaggccaggcaggctttctttttcttacctgctacgatcttttccccagatttgacaaacccgggtggagaatttggtgtttatgcttctttattacattgtttttaaaaaatctattattctatggcagtgtaagtctcccagtttattttcctgataatgtcattctatggtactaaaaaatagtggttctccatcaccacttatttttgaaacacagatcttcatttttatgttatttttttggttaaagccatttactatttcctagtatctatctgagagaataagttcaagctctttaggtctctaacatgagatttatttaatttttttcttctgatcaggcctaacttaccttcttcttcctgttacttctcccagcatactctgtgctccagccacaatgattcataagcacacttgattaagagtcgagtttcatgctaagtcagagccagagttcctttccagttccttttcacctcggcagcagctcttcatttcttatatttaattcaaatccctttacttccaggccataactctgtcatttctttca

SEQ ID NO: 54032 - DNA, 1402 bp, Bovine  19866880543278
ccctcccgccccgccccctacaaaccaaaagcagtttgtttttggacaaaatggtgaaaaatggaaaaccacatcaatcagtctgttctctttgacccagttcctacctacttttcctaaggtctgttcctaaggctgtaaggtctatttctttgctaaaaacatttaaagatgcctatggtatgggggtggggagtgtggggaaggatgcaagccatgatattgtctttccctgggttttcatggagtttcagatgcactggggaacctggaactataacttaggggtaggaatattttgaaacctggggaccatggatatttttatgcttttttgtgttatgattggacaatagcagcagagtgagtttagccatgacaagccacatcagctcagctgtagtaacctttgtatagtagtatcagtttctgatgtttaaatgatgaaggatagaagtgtgtggaaggtaaaactctaacctgctcttgacttcaggggcagatgacagtggcatgaatttttactacttggaatttggcattggggtttgtttatagctaatgcagctttcctgttattaagacacacctttagattgctgttccaagagttctccaaaggctgttcacatgtattttgaagagctctttgagcatcaaatggctcacacgaaagaaggcttttcatcaactgaatgtgaaggggaacatgattcataggaaaaataaaatccccccatcggctttttgtgaggaaaaccacaaaggggagctctgggttggaaaattgtgttcagttaagcttattatggcacaaagactgtagggttcttatcttcctccctgtatttatgggatccttgaaaaaggtaggtgttttttttttttcccctagctctgaaaaatgtcttttggatttttggtgtattttagtggctgtgtcatttctgaaacaaatggttattgaccagaaattcattttctttgcagttagtgaacaaacaagcaaaagcaaagagggagaatccttcccccgaggccattttctgaactttgctaagtactggatcagctgggtatagtctatctcctggacaagtcaaaaccagggaaaaccaaaaaataagctgtgtgggagatgcttcccattttagtaggaggggagggaacatctggagtttagctgggagggaaagcaagctgatctggctccctgctgctggggtctgttggaaggaagctgtcagacagcaacatgatatattatcctctgcagacaaaacaatacatgtaaaaataaatagccctggatgttaagatcctataatgcatgttgacacatgaaagcagaaacatcacaaacaggttagtctgccttgctcccctgtctcctgtgatgata

SEQ ID NO: 54033 - DNA, 2873 bp, Bovine  19866880682075
agaatcctgtggacagaggaccctggtaggctacagtccatagggttgcaaagagtcagaccaccattgaagcatctgagcacaactccccctttggtaaccataaatttgtttgggtctatttctgtttatttctttattatttatatgcaacttttccaggaatctgttgcttcaagggaagcctgatcattgactagggttttataactcactctagctgtgttaaaaggctcaatgaaagtttttgattttcatattgaactctgcagcaatttgtgggggatcaattatgttttatcctgtagagttccggctgagcttgtgactgagcttgcaaacctgggacttgggtaggaaataggagacactttttgtttggtggtggtgagagaagatatgatttgtctttataaccctccagtgagcttttcttatgaaagcttgctttgaatctttaggcttggatctgttctgtgatcattatagcttttcaatgtaataaaaagctgatatgtacttctctgttttgtaggcttctatgtgtttcagagttttaactctttatgactccatgataagtgagtaagcagtgggaagccgccatcactatttcttcctggagagtcgaaaagagaaaggtttatagtttatccagacaacttaggcctgtgttaaaaggcatggataatcttaatgcctaaataacatactgatagtttgctaaatatgtctagcaatttctcaagcctgtgaaagccaagtaatgtttaaaaaataggtttaatagtatttaacatcaaagaaacaaatccctataaattagaataaatattgaagatgagaggcagctactgactaaagagtgggagcacaatgatacaatcaaccacatttgttctttctgacgcccagtggttgagttgattaatccgcattctgtgacataaatgagatgtcagtctgcagcattaactcactttttatacaagttgtcccattattctgttattaggataagctaggtgaagtcacaatgacaaacagcccttacattttgatggcttatatgtaacaaaaatttacttttttgcccatgccacgtgatcgatgagaattgacaggagggctatgtttatctcaattatgcagaaacactcagaataatggtaattccaactcagtctgagcatctgtaattcccaggaagcataaatggagttctgcagagtatcaacttagtaattaaatgcttctgcctgcaagagacataccatttctactcacatttcattgcccaagttcagttcagttgctcagttgtgtccgactctttgcaacccccatggactgcagcatgccaggcttacctgttcatcaccaactccagaagcttgctcaaactcatgtccatcgagtcgatgatgccatccaactgtctcatcttctgtcatccccttctcctgccttgagtctttcccagcatcagggttttttccaatgagtcagttctttgcatcaggtggccaaagtattggagtttcagtttcagcatcagtcctaccaatgaatattcaggactgatttcctttaggattgactggtttgatctccttgcagtccaagggactctgtcaagagtcttctccaacaccacagttcaaaagcatcaattctttggtgctcaaagtgagtcgcatgtccacacccagttaaggggtcagagaaacacagtcccaccaaggctctgaaaagagtgaaaaaaacaagtgatacagctatgatgtagtagcacattgaattggtaagatattatctgtaatactttactttgctctttgcattttcaataaatgaaataacaggatgatatttccagtgataagtgattgatttttatttagaaggtcaagtaggttattctgaataccttcttttattatttctacgtggttatagtatatggagaccataaccatttaatttatgtcatgcccagaaaacttacttgaacattgaattaaattgttaattttatagtttccagagttagaattactctttgcttattaggtttcttctagaatttttaaaaatttgttcaattacttgggagtctctcatagaaaaattaaaaaaattgtcatgtcatacatgacaattagaaccttcgatctacaaaggctgtagcttgttaaatatgtccaatgtgagaggcacattactagctactttatctatgttatctcatttaatctccctatcaattctatgcaatagatattatggtctcttttataggtgtgaaaacagactcatagtagttaagcagttaatgtaggcacactgcatttatagagctggaatttgcccttctccaggggattgttccgacccaggggttgaacccaggtcttctgcactgtaggtggattctctactgtctgagccaccagggagcctgtatcttacctacctaatgctttatgaggattaaattattatttgcaaaatgctcagaacagtggtgagaacagagtaagtgttgtacaattgttttatgtgaatgaaatctgtggcttttggtcatgagagtacagaattggaaatgctgaacaatgaagaattcccaagacagtaggggcataaaaacaggaatatctcttttaggtggagggaagctctccagtttttgatggaatgaaactctaatcttcagttatattttggaggagaaggtataaaggatccatctattttttaggtagttgactggctgtgacttttctcatttatttatacaaactactgagttacctgataaaaacagaatggtgtttagtcactcagtcatgtctgactctttgtgaccc

SEQ ID NO: 54034 - DNA, 1851 bp, Bovine  19866880798810
aattgcttgcttattgctttccatttctcttcaaccactttgccctgctgcttctttttttccatttagatatcaccactataagtttcttcttctgcagatacttaatggagcactgtcaatataaaacttagaagatctcaagttgttttagttttttaagcaataagagctatggttgttaatactacagagaagtgaatgcaacagcatctttacaacttttttgcttcttagacaaaaaaagatgttcatgttaactgaatatcatcagcaatgttttcaaaagattgaaagcctactctttgtgagaaaggaatacacaaaaatatgtccaattcctcacaagtgagatctttacaaaaactggggaaagaaacattctttgaaacattcttttaatctcataatgtttacttcaccatctgtacagataagaaatttccctttattgttcatgaatgttgtgaacatacactgatttgtgcagtactggaaaatacaaacacaaaacattatatgctacttcttgtggaatggaagaaatactgaaccaaatttaaaatcctaaaagggacaccgaccacatcaaatgcaggagattgtaaaaatggctgcaatagttcccttccctgtctttgcctttggtaatcacatctcatgctgactgtgtgcttggccacttgacttgctttgaccaagaggacaatagcaaacatgatacaagcaggaactcaaaaacttgcgtctttctggaaagaacttgcaagttcaggaacttgcctttttctgctacttttagtaaattgcaactaccacaatataagaaagccaagtcagttccatcaccccatagacacctaggcaactggaagacgtgtgagagagaccatcttatacctcccagccaagccaagtctaccccaatgagaacaccacccaacttactcacagggtgtgagaaataatcaatatttcttgtttaagacattaggtttgaaggtgatttgttacaaagcaaaatctgagagagaaatctaatttcagaactagagcactagtataacagagtgtactagtataacagggtgtactagtataactagtaaaacaggcagcattggttttaagaccaggtagatagcaggacctggaaaagaagcagatacaatttcagacaatgctgaaaaatggcaagctaattgttagcagaggctgacaaagcaatgaagagcctgctccagcaggctggaaaatgacacccgtgttaggtgataaagaaacaattggcaaaactatcacttatggtaacttagaagatagaaaatgagcataatgaaactgtggaccttggcaagatgatttcctagcagaatgctgaaagtgtccactggctccatctagctgattctgagaaagtataggaagagagatgggctagaggaacaactgctcagtttgcaagcagaattagaagctacagagaggagccagaacttgctggattggatgataacattgtttaacgtttcagtttctatgggtggtaaaggattctcaaaataagaaacaacctcagaacaaagatcaaatcaaggtgaccctgaatgcctgtttgttaatacctttgaaatattttaggcagcaactggtaggctctctcagctgtacaaagtgctttcattcaagttattgtctcacggaagcaggatacagctcccatagaagagacagacctagctcagaatcgcaagtgagacttttattgcatggagtagatctgaatcagtcttagagaaacccacagacattttaggagttgttttgatgcaagtaatgtagctctttcat

SEQ ID NO: 54035 - DNA, 1229 bp, Bovine  19866880802564
ttttagaaataagagtgactcttctgggcagttagacacaagtccaggaaaactattcttttcctgacaaatggacagattcagttggtacacatcatttacctctagcctttcctctttcctttctatgggggcttccctggtggcttggtcataaagaacctgcctgccaatgcaggagacacaggagactcagattccatacctgggttgagaagatcccctagaggaggaaatggcaacccactccagtattcttgcctggagaatccaatggacagagcagcctggcaggctacagcccatggggtagcaaagagttggatacgactgagcacacacacgcttctcctttctactgctgcctagaaggaagtcatcatgtgaccatgaggacaagggccacatgctaaagatggaagagcaggggattagatgaagcctgaatcactggtgatttctttgagcatctggttccgccatggttggcctgcttctgatttctgcctctataagaaaaataaaccctaatttgtgaaggcaatcaagtcagattcctgctgcatacagcttaacacaatctgaacagagccttatcttagttactgaacaaacataactcagcctaagtgagtgagttgtctgaagattcctgtctttgaccttcaaaattgtgtgttccgtatcagagactaagggtttttttttccctagtgaaaagattcttatttattgctttacaatataactatatctctagctgtatatatctaatgtaattattttttgagccattatgcaaaaaattaaaaatatcctgaggatcatgacagatatttgtgtatgtttagttaatatttttttgtgtcctttgtctttggcattggctgtctgttttatgagaaaccgaaattaaaacttctaatatatgaggtgtcttttcctgagagactcaggaggaagacagtgtcatttgttgtcaggttggtgtctttttttttgttgttgtctttagagcatatagagtcgattattttctcctggtgccaggtttgaaaggggtgctgtcaaacagtaataacgtaatattgttttagataaattttgtatcaaagtaaaagcatgtgggagaaacatctttttcactttgttgatgggttgagcttgttttcattaaaaaaataaaaaatagtttgaaagctcttgatagtgtgcgttaaagggattaa

SEQ ID NO: 54036 - DNA, 906 bp, Bovine  19866880815015
aatggtgtgctccttatggctggggacattcttccttctccctgttttcctcctcctcctctttccgtcctcggccccttccttctttcctgatgcctcttcttatttccactgcagctcttgaacctagaggcccccagatgctcattgagaaacttccattaattctatcatataggagaaaattgctctcattgcctctatgcttagatataccccagcctgagtaggagggttggtaaaagggctgagtactgggacaaccaggtccatcctctctgaaggctgtggcctacactgtccagagtaagaaaagagaaacatcatttgccagactggatcttaggagattttgttgaccacatgacttcaatcaactctcagaagatggaggtagttcagagagagaagatttaagcaccaaacttacaatagctccccagatcctttccaaaagccaacaagtccatccttctcatgaaattgctggatgacactcgctgttcacactttgttatatatatgacaaaactgatccttggtcctttgaagtctaatcttgtttttaaagaatctgaaactatgatcagactccttggctccccaatgccaaatctaaaaaatatgaagttattgattttatgtatcaaataggaacactaatattcttttcttttcccttcttatccctgtttacagagggaatttaactgggctcaaggttttcacgcaaagttatttgatcgagggatgagaaggagcaaaggaaagccattaagggatatctgatcactccaagccaccttgcctaagttgttccctagatggggaagaatgggaagtgaatggcaagaacactctgggttcactgctattttattttacatggcatgtaatatcacatgc

SEQ ID NO: 54037 - DNA, 1283 bp, Bovine  19866880863528
attcttaaaaatatattaaaatacagttgttaaattataaagtggtaggttacattaccataaaatgctgggttattctaactacctaggtgatcactgtttctaaaataactggagttaaattgagggaaaatttaaaatagagcagcaataatcatgaaataaaattaaattcttattatccaggctagatatccaagaataatgaaaatttgaagagaaaaggaaaggtttagattggtttgaacaactcataagaatgaaggaagtaaagactaagtctttttaataaaaatagagcaaattttccactggtactcaaacaataccagaaggtcattggtaaaatcctatcttctacatacatttcagagagaaatttttacatttactgggacaatttaaataatataaatggatataggcagataaagcagaaagtatatcagaaaaatttccaagtctgatattaaaaatgaaattaacacaatattacactgtctccatgcttcagactttccgttccatcttcagtattccttacccagtgttccttctgaggtccctgctatagtatttatcagaaaaatgtatccagatgaagaactttttaattttcctagaggaatgtttaactatagttttccactgcataagataagcatgaaagtatgttagcaaatacgatgggaaatgctaattagaacattaaggcaattttttcaatgcaaaattaacataaaaataagcattacaggtggtggaacattgaaagttcataaatcagactttgcacatttggagaaaaatgtcaaatatgtattattctcttatttcctaactatactaagtgtgttattaatttggctagaaatctaaactcattggtcaccaatgaataatcagaaacttggaaatactaaacaagaagtcccatggtaaagtggtttctaatttctattttcaatttctaaaatataatcagagatcctacataaaaatcagaatctgagtctgccttgtcctgttcaatgtacatggttaaattttcaggttcaactatccctgtgctagaaactgacaaaccgcacccccctcctgctctctccccacacacagactcagtggagtttaaaaattactttcaggggtttccctggtggttcagggatgaagaatccgcctgtcaattcaagagatatggtgggtttgatcactggtctgggaagatcccacatgcttcagagccatgtaccacaaatactgaggctgtgctctagagc

SEQ ID NO: 54038 - DNA, 1948 bp, Bovine  19866880966183
tttcttaaccccacattagcctagctgtttttctgtcctggtgctcagaggttttttccttactgacaaggccttggcacgtcagattctacctcacagtataatactcctatgtgattgattgactgtgatgttaggtaaggaaaggatttcattccttgaccagaagactttgttcattacctgaaacctgaaatagatctggcatacatgtcaccttaagttcataggcttaccacataatctgtagtccaagggcccttttgaggggacactattaataattataccaggacaataggtgtaagcaggcactatattacaagccaaccagcacaccccattaatgaaggactgctgagtgaataaatgactaaatgcccttccttcattccctgttaatgtactgtgttgaagtttaggaaattcaaacaagtctagctctgggtcctgagaatgtttggctcatccagaatctcatcagtttaagcactttgcatctacttccaagtagggaacaatgggaagatcaaagtgttatggctccaaccttatacagtttcctaaaacggaggattctagtacttacgtagaacacagatttaaaagatcatgttttcaaacactttctgtccttggaatctgtgtagaggtgtctccatgactttgaagaaaaggttgatggcattttgctatgaaacacatgacaaggtctatccttcagataagctcctgcatctttgtgagagataatttttctaaacttgtgtatttttttgtagtatatataattcagcgataaaaggcaaaaggtcaacaatgaatgtgaagctccatcctcacaatctattcaaatctatgaatgtctttagactagacatttacaatgctctcctattgcctctgattggaagccatgatgggattgtatttttattcaaataaaaagacattgactttggaaaagatctatagtgaatcccttctggggttcccagaaatctgctgaattcaaatgcatttggatgctataaatgatactaatgtgagagaagaaggactatattcaggagaatagctctaagatgatcaacctgggggtaaaacaccacccaccacttttcatgtcatttataaaatgttaactttgctgaatttctgcatccaattgagaattaatcacctctttgaagcagaagtttcaccaaaaaatatactaccttcatgcaggataaagtgtttgatttttaaaaatagctctcagtattttttaacaggaggttgacctttaggtagttttcgattattttactctcatgttgtgtcaacagcctctgtctatacataaacagaaatattcttggccgttaaattttgtgttttctaaagcatgagatatattgagtatcctatctctttttaaaatcaaagtccaaatggaaagttgactattaagcagttttgtgtgtggtattactagtgagttattaagaaagggcatattgtaatgtgctttgagggcaggctcattccttgctaatgtacatttgagagctgacccataacagctcttgtatataagaaggattaagcatcagaggctactgtgttattaaatacataattttaatcattttcctcaagcatcttaagtgatgtgattgaaatacaaattagaagcttctaaattcaatcctatacttgagactgtggatgtatatacttaatatcgaatatttggaaacaatgggaaagacataaaagaaatggggggtatgttgaaagataggaaaatgagaaaatattacattatttcaaggaagaaagaatagccacttaaagtacattaattagtaatagtttgcctgggggtgaggtggagggagtggatgttgcttacactaacaaatactttgataatggactagaatgagcttgtggagtgagt

SEQ ID NO: 54039 - DNA, 1094 bp, Bovine  19866880971993
ccccaaaatctatgaataagtgtatctttctaagttattttccatgacacacattctttttctatctttacctgttgtagctgttaaagtttccaagtacaaatgaagtgaccctcatcaggcaataaacaaattctccagccgctatttccggtctgacagttggtgtgcttcactgagtactgtttagcctcgaaaccttcatcataagtgtcatttggttttaacttcgcaataaggtaattatagtgctgggcttattaaaaacagactccatcacaggagactttgacagatgttggtggaagttccggcttgacaggcaagggggatgagcaagtggatggcagagctaaagacattatattgcaaatgctgtttattttctgtcaactataaactatgcagtaaataacacattataaaagagatccagaaataacattaagctaaaatggaaccatcaattattctctcttctttagctttcagaagatttttttcctgttcactattggtacttttttcctttattcgttaattgctttttttccatgactcccctgttctgctccagtgcctataaatcactgtaaaaaagataaaatgttactattatgaaacaagtataaaaacagtttttaaataaatttgcttttgccatcaagccaaatttatctaacttttaagggaaagtttaaagtttctactgagaacatagtaaactctttggggcagagtgcatgtatttttagcactcacactattttaggcagtagacagagtccagaattgaaggagtcagaaattttgcagtgagttttgagatgtaactttcaaatatactatgagaaggaagttcaaggttttactctaagaagtgactttgaaacatattcgcctatggtagtgaatcatacaggattttggattagctggcagcaacagaaggatgataataaatggagcagataggaagaaggagaggaagaaaagagtatgtgaaaatttatgtctaacctaacttgattccccactggcagtcatgctcacatccaagacttaggaagttagtccagtttcccttgcatgag

SEQ ID NO: 54040 - DNA, 1103 bp, Bovine  19866881038721
atattcagagttcagacttttgaccctgctgccctgcggaggtttcaacctaacattttagttgtgaaagatcagtacacaaattgggctgtaaaccaagacatttccttataatttcttgaaaatgtctcatactagaaacaaagtcaaagataacagtatataaggcacttaggctaatcctcaggaaattcttaatcatctaaacaaatatattaaatagcaattactttcacccagccttctgaccttttgagaggaacaaaacttcctaacctcaaagctcagatctttcaactctgagggtgctcaatttttctcaaggatcaataacaaagatgctcctggtgaacaggtgagcatggtgccaaggatcaatcatataagagctatttcacagctctcatgaaactccaggaatatgtaagtttcagtttctgcaactaaagacattcaatgccagatcactggaaataaagccctctgtctacttgcgtttctctgttactctgcgtctcactaggtaataaaaatgtgttatactatcgagtgaaacatccaaacttactcccattttacaacaagcacctatttaactccactatttatacctgcctgctctacatttccctgtattctcatagcatcagcttcattgttgatctcctgtacttcttagtataaaaggagttttgtcttgttggacaaaaggagttttgtttgtggtggacattcttaaagtaattcttgatccttggtggtgcataataaacatttgatgaattcatttttttttctgtaggacatatttatttgcacactaaatgctagatgaacaaattaacatagactctcccctcattcattatccagtgctgcattaaaatatcaccacaaaatttagcagcttaaaataacgcacattttattatctcacattttctgcgggtcatggatctgagcattggcctcataggctttatagcccagggaggcatccagtcaaattttgttccattgcattctgataggcagtacctacacctttagatgcaagaggaagttcgtatgaacaggcgtaggtgtgtggactacacacacat

SEQ ID NO: 54041 - DNA, 1026 bp, Bovine  19866881153908
atatggcctttggcctgaaggcattcccaaccccagacttgcccacttgtttgattttgaagacagagaggtgctaattttaattagcattttttttcaaataaatttttgctgcttggcttaaggatccacccctgttgctggaaatctatgctttctttagagtctgtagagatcctgatgatgtttctaactcttccctttgaatggagagaagaggttctgtggcctacatggttttctctgaatagagaagctctcacaactgttttctcaagtcttctctggagggaaaggaaagcttgagggttttgattttagagctgttttttcccccaagggcctgcttgggaaggctattgctcctagttttcttgaattcctaggttgctggatggagaataatgcaatgaattcatgtaaacctgggtgcctggctctccaggcacttcttctataatgaattagctcctctcaacccaattcattggtaagaatgaatgattctgtcatatagattcctgaggccttacacttgtggcctttccagctcttacttcctgcatcactcaaagtccaacaaagagaatagaagccattctgtgcatttaaattaaatgaatttaatacaaggtatttgttattatcagtcaagggagagatgggtagtcaaggggaggacagtagatattcacggggttagaaacaaccagaagcttccctatcgttatgtggagaagcaaagggagaaggtgatggtattggagctcatggcttggactcacccatagctggctgtccagtatgagctgggatcaaggaaaaagcatagcttctgctggagatgctacttaagacagactgggaaggagtgggggaattgctgtgacttctcactttctcctgcctcccagtctccttttagtgctcctgttggtcaaatccagttggaagccagttgatgagacaggatgagaagcagcctgatacagggggcaggtccctctgcagcatagtagagcaggg

SEQ ID NO: 54042 - DNA, 998 bp, Bovine  19866881174113
ttgtaaagtaggtcatggaataacagtaaacttgaaactaggaaacctgggtcttagccctagtttttcactaactggtgccatggccttggacaattttaaatcatatttcttatatatcaaatgcaagtcagacaccctatgaagctctgggtttgggacaacgaacaagagtcattgtggaactgatgagacaaacaagtaaacaacaactataatctggtgaatcctttcaaacaaggtgcctagtagccctgtggcatcaggagaggcttcacagaggaggtgacaattaatctgagaggtaaagaacaagtcagatccaggcagtcccttcccctctctgaaccatggtttcaataagaataaagcaaagcaggttgctaaaggatccctacaaactcttttggctgtgatagtgtgtgatccaatttttttatgacagaacagagctgggaaaaaaccttgaaatgctattcataagaaaagataaatgcgtgcttaaattgcagaggtgggtggggaatgagaaaaagaaacggtagtgctcaaaaagcacaagagaaagagtcagagacagcatgctcaagtgagagcatattttctagggcataaaggatttctgtttatttttaacataatacaccaaaaaataaatacaattatcccaatttctgccccccagttttcagcattgtgcagcctttatttaatgatacatcaaaacacattctctgccaatccctccgttgctaaggaacaggcagtcaagagcctaagctcagagaccaaagccatcattaaaaggctttgtgcattgctatcagtaaaatgttaattttataagcctgactgataccctcctgttagcaagttccaggaatgagaacccagatcctgctaatttggctagttctcctttattgggctcagtgtggcttacatcaaaataaataaataaaatactgtgagccaataactaggagcattttatcctg

SEQ ID NO: 54043 - DNA, 2211 bp, Bovine  19866881269242
taaagcatatagtacttcttaagtctctaagtgcaacgaaaataaaaatgaagaggatcaagactgcagaacagtaagaaggaagaatatctgtatattttattacattttttttaccagaaaatagctaatgcttgaaaatcactagtacaaaagtgtttgcttctcttacatgagattttccaatacaatattttccatttttcttcacatcccttatatgtagctaaaacagaagagagataaatatatggtcatcttaaatctgatattatctatttacttccaaaggtggtgtcatgtcagttatatcaatcaaattgtgttctgacactgtacactaaaaagagtatctgtaattacaccagatatctccaggggaaaaaaaaaaaaaaagatgctgcctgagaacaggtgtcaatcgagtatagaactaatttattccagtggatgtcataactatgataggtccaataactttccaatacagctatatgaccatgtttattttgtaagtcactgttactttcactgtagaattacattttgttttctgtgtctctaatgacttcactgttatcaaaaactgggtattagtaacatcaagatgtcagccactaatgcaataatcaaaacaacatgtatattctcagtctctctgcaaaactgcctttgtttctcctttagaactcaattcaagaaacattaattgaatgctagcaatttcaggattcttgcaaagtactataaggaatgtgatgttgaacaaatcgtgtgccttatcctccaatagccatctcttaaaagggtttgcaaagtgcataaagagctataaagtttaaggcggtcaggaatttaatacacatgagatattttgaactgtattctgatttagccattgttattaatacttagcattttctagctcttggagattatatcacaccaatgtcttggacccatattttgttttttttaatttttcctatttcaaataacatttgcaaatttgaaatttccaaagtgaatcataacttcaggggaagtgagctctcatgcagggcaggaaggcaaggcacatctttgaaaaaacatccttgacagtactgaagagtaaggaaaagaaagagattagagaaaagaagctgtttgtggtctggctacaaccagggcatctatcaaaggagagactcttaacctttactgctggggacctgttgtcaaaatatgctttaaatgcatgaaataaaatagtaaagaaaaaccagtggaatagaaatatcacagtttttattgtcatacagtaatacttgtgcttctttattagcacattaaattacaaggggtagcagtgtatctaataacaccaataatttcaaagtagtgttgactgtaaatgattttgaaatatctgcaacagtatggcataaaaacacccgtgatttctattaatgacaaagtcacaggtgctgctaatagagtgtctgttgccttcaacatataattgaaggacatactaaatttcacaggttatattttactgatcataaaatatactgctcttcttcctaccctctgtcactggcctgtggtacagacctaagtcctaccaatgctcagcgtcattcagcaatttaatttcccagtgcctcacaaaagcaacatcttatcaacctcacacattttgcatagaagcataaatctcattatgcccttcaaacttccctgtcactggtacaactgggctcataataatctgaactcggataaatagttctatttacccagtcttgggtctgataaaaggaccaccattacctgtcactaaaaataaaaaataaaaaaataatcaacaacaacaacaaaaatcctacaatactaaacgttattgcagtctgtcaggaacacacaaaatacaggacagagcacctagacaactctataaagacatacaatcaagcttagatgtttgcagtcaagacattatcaagaaatcaattggttaacaactgacagcaacaagaaaaacaagttgaggaaactccctgagttctgttattctaggactaggctgtcaaagctggtgctaaaaggaaaattaccttgaaaactgtgtcaacaaaggcagaacatctgttgggatgcaggtagaggcctggcttcatcaggggttcaaataaaagcaaggcatgccatttgattcacgtgcta

SEQ ID NO: 54044 - DNA, 2159 bp, Bovine  19866881350565
tgaatattttttcagtgaagtcttgtaagttggggacagtgctcttaaatcttcttggctgagttgccatccattgaattgctgggctgagataggatcaaagtcattttttatacctaaaaaagttaagtttttattaaaaaaacagactcagtccagagagtatcttcagtcattgaaagggaaggtcactatatatttttcattcttgtaaattatcagctgaagtatttggaacagttctagagaagaagaaagtcagatttcttgctatgagaaattacagctcatgctaaaatactctcatgatttgtgtttttaatcagtttattgttattatagttaatacacctactatctctgaggagtaggttaaaattattaaccctactttacaaagtgtggaatcgagacacactcatgttaagtggggtcgcaagctcccacagtaactcactgactcagggaggattagtctggtgttcatgggctgtatttagtccatgaagtctttgatttacttgtaatgaattacactgttgcaccctctgttcctatttggaaaagaagtactgacatttgaccatcttccttttttttttttttttccttctgagccattgaagataaacttatggtggtaaaatcctttgtaaaaatctttcgtaaaatgtgcatattttgtggttgtaactttcagtttcattttaatgttaaagaccttagacaaatctgaaaattaaatttaagccataggtacatttcattgcttggcttctcagtggtaaagaatccacctgcagtgcaggagacgcaggagatactggttccatccctggcttggaaagacccctggaataggaaatagcaacccattccagtattcttgcctggaaaatcctgtggacagaggagccttgtgggctacagtccatggcattgcaaaagagtcagacatgactgagcaacaaagcatgcatatttaattgctattcttttcatttctatatatttggatgcagttaatcaacaaatatttattgagcacttacagattaaaatttgtgttgagtgattgtcagccacagactttcctagtaagtgttgtgatatttttctctcaggtgagatattgacagtacttgtagcaaattttgggtcacaactcagctttcctcagatggtactggatgacttagataagatcatggtataaattttcagcattggggtgcttaagagtgattagttcattctcataccatattgctgctttcttctctcaccgcacacttggaggcacaccttacacttcaggtacaatttgttctgcttgatcctttacattccaagctccagccatctggagaagtaccttgaagacactctactgtcttctgtacatgagtttccttaatcaggttacaatactttacctccctttgcaccctctgtcccatgtcccaggctgactccctagctcttaactccagttttcaaatcttagcttaagtactaagatttaaagatcagatcctgcacagtataaacaaaatttaaatttgtggtctatttcacaatcctaaacagaatcttcccttttctttctaagcagtcctctatggaattatccttagaaacaattaaccccaaatcctttctccagttcagttcagttgctcagttgtgtccaactctttgcgaccccatggactgcagcatgccaggcttgtctgtccatcaccaactcctggagcttgcttaaactcctgtcaattgagttggtgatgccatccaaccatctcatcttctgtcatccccttctcctcctgccttcaatctttcccagcatcagggtcttttcagatgagtcagttctttgcatcaggtggccaaggtattggagcttcagcttcagtaacagtccttccaatgaacagtcggaactgatttcctttaggattgactggtttgatttcctttcagtccaaggcactctgaagagtcttctccaataccacagttcaaaagcatcaattcttcagtgatcaggtttgtttatggttgaattctcacatccatacatgaccactggaaaagccatagttttgactagatggacctttgtcggcagactaatgtctctgctttttaatacg

SEQ ID NO: 54045 - DNA, 1975 bp, Bovine  19866881571437
gagggaaaagggttcaggatggggaacacgtgtatgcctatggcagattcatttcgatatatggcagaaccaatacaatattgtaaagtttaaaaataaaataaaaaatacctaaataaataaaaagtggtccacatcaaaaagaaaaaaaaaatcttaaaaaaaaaaacaaaacttaaaaaagactagggtggacaaccagggatgggaaagggagagggtgaatctgggaagtcaagaacaatttttttctttttcataaccttgcctggtatctacctagacatgggacaggagggaatgacatcatccatggtagcattcacctagatttcactttctgaagagaaatgggtctcttgaatttctcctggctctcaggggacaaagggtgaaagaggctctgtcttcctttgaccagtcctcaattgagccttatttgccaggaaaaggggggcccagctctttctgacaaagttgaccaagaaaggtatttactggcaaataactgttttcagctccctaaaagccaccacaaggctccacaggtacctggtaagaatgtacttgattcaagaggtgcaataacagaatcaaaagaggtaaagtaggcagtcctacaggactcactttgatgaagagcatatctgcaggtcttatttcattttaaaacatccttgaagaaatttgctatgtactctataatggttctaaatgaaaaccattatattctatatttcattacaggaaatataatcataaattgtatccagattatacttatatattttaacattcagaggattgatgtggcaagagaggcaaaaaaaaaaaagaacaagcaagtatatatatataaactagataaccaatgaggacctactgtatagcacaaggaacaatattcaatatcttataataacctataatggaagagaaagtaaaaaaagaatgtgtatgtatataactgaatcacgttgctgaacatctgaaactaaaacactgtaaatcagctatatttcagtaaaaaaaattttttaataaaaattacattaaaaaagaatacataactctacctggtgagtaaaataattaaaacaatattctcacaaacagtaaaggaaagtggaagggacttaattgtgctatttttgtattaattttttattttaaaggtaagattttacacatagagagatgacattatacgtaaatataataatttcttctttacccatacataagaatttgcctgggtttttttttttttttttttcatactctatagagttgtacttggtttgcatttattcctgggacccaagagatacaccacagtgactgcagaaattatttatctcatgtatttgttaggtttgaatattcatctattcttgaatagcagcctgattgtgacattgaaatctcgcataatttttttaaagatgctgcttaataactaagcttaatgtgcattcaaaacagcctctgagcggccacagtcccttcagtcctaccgagcttcccactccagtgtaagtcaagcgacagcattagccctctacctctcggcccatttgtgttaagctcagactaaactctttctcgggctgggaaacacatcagtcgggccatttttcacctctcaaactaaactggcaagaaaacaggaaagagaatttatgagatgcctattgtgtgcctagcattgcactggatcagtggtttttaaactctttttcattactttttcattactattccccctaaggaacattttttcagtgacaaagaatctgccagcaatgcaggagatgaggtttccatccttgggtagggaagatcccctgcagaaagaaatggcaacctactccagtattcttgccttggaaatcccacggacaaaagaacctggcaggctacagcccacggggttgcaaagagtcggacttaggactaaacaacaacaagcagc

SEQ ID NO: 54046 - DNA, 855 bp, Bovine  19866881794657
aaccaatcatttgccaacccagaattaaagatatagcatatgtcttagtgtggtatcagtcttctgagagcaaaagaaggcttcaaaactctatactttgcagcttgtaatagcttttagtataaaaacaggggctttgaagctgctgtaaaggttagaaatgagaagacctccttgaacgatcttaagatcttgtaagaaatcacttggctgtgtcacttctatcaataaatgaccttccagtgagcatggttaaaatacagcatcaaactctaaaagctagaaggcactggcttaataaagatcgtgtttggaagtacttttgtcaggaaagggtctcaatttttttcaccagtcaaatgtatatcgaacccagtttccaaagacttctttgagctctacaattcttataatattaaagacttggagatctaagctatttctactgccagtccccccagtggatgaggggacagaaattattagaaatgcctgtcttaaatttaccagttagggatttaaaaatgctttctcaaatgaattcaacaatcacttattactaatggggatatcactagtaatcttactagtggggatattactagtgatattactagcaatggggatattactagtgtcatctgacttttgtcctagagatattcactattgaggagggaggcaagcatttacataatgcaagccgagctgtgataactgatctatagtgatttaaaatgggaaaatgtgggaaaagtgagacagtgattaattcttggtggtggatggctttgagaagtaaccctttggcagaacttttgaaaataaggagtttgccttttggaaaatgaatat

SEQ ID NO: 54047 - DNA, 951 bp, Bovine  19866881971525
acgagattatgaaacttttagagaccaaggaacacactgatgaaggttaaagaggtaacatattaaatctacagtaaatgaaaatttaactccaaacgacaagcagtatttactgaacccatagactctagcttttcataatcatgttcagagttattaatactggattgccactgctgtacttgtaaaattatcacttaactgtaatttcactgctcatgatgatgtaattgctgagaagccatgtggttggtaattatgcaatgcagtgtatggaactgaattaatgccctgaaatctattcattgtttgatatttttccttttaattaattccactgccggatgttcactttatggtctagataaaataaaatacagcactcatattccctcacctagccctggagagtggaggcatgtgagaatggaggaggagatgatataagggactccagattattctgagttccaggggagcaaacactgaagtcctgataccattggttgtttctccatttcaattatctacaagccatcagcactatatgtggctgccagttaacatacatttaacatgtgtatatgtgtgtatcaggcttccctggtgactggcttagtggtaaagaatctgcctgcaatgcaggagaccagggttcgatccctgggtcaggaagatctcctagagaaggaaatggcaacccactctagtattcttttctggagaatcccatggacaaaggaccctggtgggcttcagtgcatagagtcacaaagagtcggacacgcctgagaaactaacacttcacttcactttacttatgcatatctattcatctatttaaaggtacattggctgttaccagcttatttgacagattctaaatgtattctcattagaatccatataaagcacagctagaaaggaaaattttaaatgtttagaaaaata

SEQ ID NO: 54048 - DNA, 830 bp, Bovine  19866882078894
tgcagaatgactcattcagagcattcacattttttctgtggagtctgaagaaactgttatgaaaatgttaagtgcataagaagtgaatgtcacttaaagttagaattctctcatgtttacacactgcagtaataacagcctcttgtccatgttccagatctagttcatcacaaagaaagttggcctaaggatttgggtaatgtatggtccttcaaccagggaggcttctagttgtaatcctttcttaagaagtttttcccacacaaaaagttatctcactactatgaatctgtttcatcttttgaaactgaatggaatatcaacttatctctcataaatataaggatgaataataataataaattatttagctagaatatagatgaactatagtgtgggcttccctggaggctcagacagtaaaaaacctgcctgcaatgcaggagacccaggttcaatcccagggtcaggaagatcccctggagaagggaatggggttacccactccagtattcttgccagaagtctatgaacagggaagtccatggggttgcaaagagtcagacacgactgagctaactaagctcagcactttcacttttgatgataaagtgtattttgttagcacaataaaaacataatagaacaggaaataataaaatagtaatgtagaatcggttcagttcagtcgctcagtcatgtccgactctttgtgaccccatgaatcgcagcatgccaggcctccctgtccatcatcaactcccggagttcactcaaactcacgtccatcaagtcagtgatgccatccagccatctcatcctctgtcgtc

SEQ ID NO: 54049 - DNA, 1360 bp, Bovine  19866880360688
ctagcttggatataatactgtctatcctatggagactaactttttatttggtctcctcgctggcactgttagaagccagtaacatccagtgacttgattaaggtcatttcctgggctgagacagcttaggctgtctagatcctgagcagctttcaaaatgactttccttcaatcctagatagcacttgtctcgccccacttcaagtgcaatcagacattgcatatacggaagtagctgaaatagaaatctgtaggaaagtataaaactagacagattagtccacatgcacatgttccctttggttgttgataccattatattcaaaggagaccctaagcaaaattgttaaatagaaaagataatttacagatatggccatgccttaaatgctgagtactttttttttttttctgacttctatgtgtcccaacaaatgttgttttttccctgtagttttgctttaagtatgtgtgtgtgctcagtcgtgtctgactctttacgaccctatggactgtagcccaccagggtcctgtacctatgtgattctccaggcacgaatactggaatggattgctgttttctcctgcagggaatcatcctgacccaggatcgaacctgcatttttggtgtctcttacgttgcaggcaggttctttaccactgagccacctgggaagtctactttaagtatgccatagactaactaatgtcttaatttatcaacagatttgataataaggagtgttttctgagcacttatattgtgccagatactagcattgaagataagattaatgagccaaagcagatgtaatctccattttacagaccttaacagtcattaaggagttaatcgtgctcatgaaactatgaaagcaaacagagatctgaaggaaaggaatctggttttatgaacacatttaaccatggcaatgaccagatttttgagggtatggcaatcagagaagtgatcctagagatgtgaaaggtgaataagaattacccagatggaagctgtagcttgtgaggagagaattcctctgagagaggacagcaagtgcaaaggcccagtggtgagcctttgaggtgcatctttgaggaactgaaagcaggacattgtgattagagctcagagaacaaggcaggcagtggtttgggatgaggtgagagagatggataaagctaggaatctgaggacaggtggactatccatggagagggatcatgggaattgtctaaagcactttaaataggactatgacacaatccgatttttaattttaaaagaaacattcatagtgaaagaagtatagagtgtgctctcagaattaggaattatattcattttagaaatttgcag

SEQ ID NO: 54050 - DNA, 1711 bp, Bovine  19866880439171
caaagtctgtcttaattgggtgatggtcagtattgtgttctattcagaccttcaactgattggatgagacccacccaaacaaggaagagcaatctgctttactcatgctaccgatttaaatgctaatctcatccaaaacacatttataaagacacccagaataatgtttgagcaaataaatttctgagcactccctggcctagtgaagctaacacctaaaattaaccatcacacttcccgtacatcatttgaagaccattcattattcctgtcaatgtataattcttcaacctaaataccctagacctccagttattcctcttacaactgagtgtcagatacactagctcccaggttaccctcctgtgacttgcgctatgccttgccccaccctccctcatccccacagtcctatcccaaaggacagagctatttttccttctccatttctccaaggatgaccagacctcacttaccttttcagctttattctcctaaggcactcaggagaagttattcctgggtgtgcacacaaaatgaagaactccttcagcctccaagaatcaccatttatttgtgatattattggttgaatgcatgtattaatttatttgtgtttttcaatacacacttgagatagtttatcagactaggggaaatggcagtgtggggcttgggggtttcactgctggcttgttcagagtatagaagattagaatattaaatcctcgttgtatcaggaacaacagctctgagctgattccaagcattatgaaaaccattgaactatgtttctgaaagtcatcaaaaaaactaatatttgaaaagaaaactcaaactttgcaaatggtatagtgaaaggttctttatcctttgattaaataattataagaaatcaactttagtccatttataatttttcatgtcaattacttgcagaggcattgtttttacttagataacagtttataaggaaacctgagaaaaatcctgataatgtccatagcactcttgacatttctttgttagctgtaataaaactttgtgggtttagagtatgctgtggttttttttttttttcctgttcccatgccgttttttctgcctggagcatcctctcatgcttggcgtgccaactgggcttcagctcaacggtgtctatttctctgccttctgcaagccaactaaggaagaattttgaggcaataaagctccctgtgcattcttttattatctcacttgtcacattgtacgttgttctgttttcacatctgtctttctgtttgcaccaacaccttggaaaacatcacacagaagcacatacttttgtatactcctggcattagagattcagtggtgagcagcacagactagctcctgccctcatggagcttccagcctcatgtaaatttaagccgtattgtctttgtaaataccaatgcttatgaaatcaacaaataaaaacggacccccccactagactcctcaagaataaggacagtgtcttatggatttgtttttgtttgttttgcatttgccaaaacttagcatagtaaacaacacaaaccaagcattcagtaattatgtgttgagttagtgaaggaatgattaatttaggtaatttcgtttttgactttcaactttatatgagcaagtagcttttcagaaaaaaactcatttaaaggtttatgttaatttcttttcataaatg

SEQ ID NO: 54051 - DNA, 3075 bp, Bovine  19866880451916
cagtagaagatgaagggcaagctgcaattttactcatgcctgacattgatggaatccttgttcacatctttgtaagtctgcaacttgaagctttgcatgtaggggacttactgtattccataaccaagagagatgatatggcttagaccaagtcaggaggcaaaggagacattgggaaatggtcaatagcccccattttcagggggaaagaaccatcagtgtttcctgttggattgaatgtggggtattggaggaaagaggagccaaggatgatgccaaggtctggagccctcgaaattggaaagatggagtcgccatcaactgggatgtcagctgagacagaccattgaaagtgctatcagggtaaataaggggggtgctgtgatactgcatggatggcagggatggagaggaggagacagtcatttccactgggcagtcaaaaaagactgttgttattcagagtccaagaggatgagccctggatgataacaaggaatccgccatgccaagcattctagagaagagctttctacacagaacaacaagtgcagaggtctggagcaggaaagcaattggcaggctcaagggagaaatgcaacatcagggaaggaaagctatgacaaacctagacagcatattaaaaagcagagacaccactttgccaaaaaaggtctgtatagtcaagtccatggtttttccagtagtcatgtacagttatgagaaaagaccctgatgttgggaaagattgaaggcaaagcagaagtgggcagcagagaataagatgattagatagcatcaccgactcaatggacatgaatctgagcaaactccgagagatagtgaaggacaaaggagcttggcatgtgcagtccatggggtcacaaagagttggactcgacttggcagctgaataacaacacaagagacagtggttgggaaatatcattcaaagccaggataatggtgcaaaggagccgtcggggaaacttcaaaagtaagagaatgatgtgactgatagatattaaaggctcattcagttctatgaagaatagattatgattaggaaggagaaagccaggaaaccagctaagaggtgagtacagttttctgatcaagagaagatgggaacttggaagagaatgaacagtggaggaaataatttacagtcatgagtccacaatctgtgtgaaaagaagtcatttttttcattttcaaataacagaaagaaattttgccttcaggattccatttcctgagaaagaggaaaatgaaagcattcaacttaactcactctcttctcagttaccctgtctctttaaagtaaactgtgatgctggtacttctccccttctctttctctttgccttcctctagggtgatctgagctaagggagtttatggagcatctttgcatagcctgaaagagatacagtctgtggggagtatcctattcccagagcctttgccccaacagtgtacagtcagtctcacctggactcaagtggaggtcttgatttctgctgggtcctctgctgcctttttatgacctcagctgtcatgtccacatgatctacatcttactcaaccatattgtggggccctttctgtctgctagtctctttggcttttcctttggcctcttctcaagggaacacttccatctaaatcagtgttttttaaccccaccagacaaagcactcatttttattgaaccaatgttttaaaataattcctttaataatctaattttaaatatcatagataatagaatctacctacatacttgcgccttccctggtggttcagatggtaagaatctgcctgcagtgtgggagatgtgcattcaatccctgggtcaggaagatcccctgaaggagggactggccacccactccaggattcttgcctggagaatctcacagacaggggagcctggtgggctacagtcatggggttacaaagagtcagacacaactgagccactaacaaacatacacatacacacatctacacacacagtttaccaaactaacctaaagtgctcaaattgtaacgttgagatacaaaaataaattaatagtagaacactgtatattttaaagcgtaaaggctcagacctgacttcagtagataacataaagaagtagtcagatgcttgtgtctcttaaataccttgtttgaatacaagagaagtaagatcagaagccatccctttcaagaagaacttgaaagatcagaggtgttggtggatactagaatttaaaatagtgctagaataagtaagaatagccctgatttataaatatacatatgataagaagaagcaaaaataatacaccaagacaaatcgcagatttttggagtgaggaaaataacgaagtgtgattctcatcaatgagctagattttctttttcaatgttggatcaaaatacttctccataatataaaatagctcaaaataatctactttctatctcaaaagcatactatacatcaaggctactccgatttcaaaatgtagtggaatatttaaaagtcatgtagaagcaagacaattctctcattgcaaccatcaaataaatgcagtagagtctccacattcttgtgagaagcccagacacccccagggcattaataccacttctattgattctggttgagttcagttcagtcgctcagtcgcatccgactctttgcaaccccatggacggagacacgccagggttccctatccatcaccaactcctggagtttactcagactcgtgcccattgagtctgtgttgccatccaaccatctcattctctgtcatccccttcttcttcaatatttcccagcatcagggtcttttcaaatgagtcagctctttgcatcaggtggccaaagtaattggaatttcggcttcagcatcaatccttccaatgaatattcaggactgatttcctttaggatggactggttggatctccttgcagtccaagggactctcaagagtcttctccaacaccacagttcaaaagcatcaattcttcggcgctcagctttctttatagtccaactctcacatccat

SEQ ID NO: 54052 - DNA, 1020 bp, Bovine  19866880467598
tgggaagttatttattctctctgtgctgtattagcatcaactgtacaagaggataataaatgcctacagcacaaggctgttgtggggattctgatcaacgcagtacctttctcctttctgacaatagagagccgaggaggcttaaagggagatccagtcaaaaatctaacacacagggacttccctggtggtccagtggctaagcctctgtgctcccaatgcaggggacccagactcaatccctcgccagggacctggatcccaaaatgctgcaggtaagagttctgtgtgccgcaactaagacccagcacagctaagtaagctttttaaaaaaatccaacagccaacataaatatacatgagccgtaatccaaacaggcttcccgatgactcaagcaggaaagaatctacctgcaatatacaggagacacagaagactcgggtttgatcccagggtcgagaagatcctctgttggagggcatggcaaatcactccagtattcttgcctggaaaatctcaaggacagaggagcctggtgggctacagtccatggggtcacaaagaatcagacatgactgagcatgtgatagatggataatccaaacaggtgaggcaaagagggacagagcagctaagaaaccaaagtgatgagaagaataaaggccagatacgaggacagatctgaacagaagggtgggagggtgggtggccctggctattctgtggggccccagtggtggctttctcagccttttccatggattgcagagtgcaagcagttaacatgctgacccagcgtgacactccatactctaaatcattcttcactttcacttacatctatgctctcagaagtttactggaagagtacaaaattatgccttctacttcaggaaaatgcacactagtaaaagcacacacaaaaatagaaagaaatcatttgttcctgagattgatgaactcaaggagcctgtttcttaaaagcaaagcaaaaaaaaaaaaaaaaaaactgccttaaa

SEQ ID NO: 54053 - DNA, 1610 bp, Bovine  19866880473633
cttgggcttcccttgtggctcagctggcaaagaatccacctgcaatgtgagagatctgggttcgatccctgggttgggaagatcccctggagaagggaaaggctacctactccagtattctggactagagaattccatgggctgtatagcccacagggtcgcaaagagttggacacaactgggcgactttcattttcactttccaagggtctcaaattagcccgcgggaagaacagtaccatcaaaaagagtttgggtaggtcatggtacattcaaaataacactggacaggaggcaagggccaaataatttagggccttacgagtcatggtaaggagtttgaatttattctaagtacaaagggaaactcctaaaatgtttaaaagaaggccctgacataatcagattttaagaaaatgtcctgcctactgtgtgtagaatgaactgtagaaggccaaagtgagacgaatgggatgagtaagaagactatagccctcatccaacagaaataagatgacctggatgtatgcatggggagagttgtcaaataaaatacaggcaatcatactaaatttggctttcaaataaacaaagattcaatttttttataagtaccatgcaatatttgggacatagttaatcaaaaaagtatttattgttcatctgaaatccaaatttaactcagcatcctttatttttatttgtaaaatctggaaactctatgcatgcatgaaaggacaaatatctgcataggtaaacacagaataatacatactcaggaaatgagccaactgggtatttttctcaaatggaaaactacaaggttgtgcatgaatgatttctgtatgtgaaagaggcatgtgttcaaatatatattgcttatacaggagatcaattaagtgcctaatcaatcttgacatttatatctcccattcattagtttaaaatctccaactaacttcaggttatccctctagtatcttactgaaagtgaaaccatatgtaataaattgattctcattgttccctaagctgttttccatccccatcaactgggaaccccaaacttaaaaccctggcataggattcttgcatgacttttattttcaaatgtgaattaatagaatgtataagtcctgtcaattcttttgcatttctcttaagctaggctccccttgttgttgttcagtcactcagtgctgtcttactctttgtaaccccatgggctgtagcactccaggcttccctgtcctttaccatctcccagagcttgctcaaactcacgtcctttgggtaaatgatgccatccaatcatctaatcctttgtctccttagaagcatcaaagaaaagaggggattggaactgggcagaaccctgcaggcaccccccaagtatgaagtcccctccttctacctgccttttgcttatagaaaagctgaagtctcccaagcctccctggatcacaaaaaagcaagctcaagcagctaatgcttagatcaatagagccacagactcacgcaacaacctgattcccagtggctcagcaggaaaagaaacatgcctgcaatacaggagatacagggttcaatccctggctcggggaagatcc

SEQ ID NO: 54054 - DNA, 1223 bp, Bovine  19866880480311
ctcttgcagctgtgcctacagaatccaacctttgtactttaattaaaaatagttcatggtgtaagaataacatttactcacacccactttagattctagggacttcctcacatggtcttgctccttccttaaatattttaaagccttttctattgagtacacgaacaacactaattttagctccaattgttatattttgaaaaaagctaaaaaaaagtgttaagcctgactgttttcaaagagggtttctataacaagaaactaggactgttagtttgaaagtgattggtcttattaactggagagagaagtatggcctgatggaaaaggaaaaaggagcaagtaatgattatatcttacacttccatcctaggcttcccaaagtacttgaaaccaagtctcattatcatttctttaaatagatgaagcaagagagatagccagttaagtgcggcttcccaaggtcatactccagcttgccaacatagcgataaaaatccaatacacttgattagtgtccgctgcctactcaccctctgagcattgatttcacgcacgatgaggagaggagacgggcagggtgatcttctccgtctttccagccccgccatcttgctcagtggctccccgtttattcttcactgattgcatctgagcaagctttccttcacaccatttttgttcaggcaggattcttgccagttaagaggtcataatgacaagtgtattcctgcctgttctcctttttttttttttttttggagtagatatagttctatatatagttctaatccagtgctatactgtaggtccttgctcattattttatatacagtagcatatatattttaacctatttatttcacttgctgctgctgcttctaagtcactttagtcgtgtccgactctgtgcaaccccatggatggcagcccttatgtatctttaaatttggcaaagaaaagtttgttttattggaatatacttgctttgcaatgttatgttagtttctgctgtacagcaaagtgaatcagccacgcatgtacatatatcctctcttccctgaatttccttcccatttaggtcaccacagagcactgagcagagttccctgtgctgtgcggtcagttctcattagttatacataggagtggacatgccaatcccaatctcccaatctgtctccccctccctttggtatccatacatttgttctctgtgtctg

SEQ ID NO: 54055 - DNA, 1795 bp, Bovine  19866880512438
caaatgagtggaatcatagaatatgtactcctttgcatcttgctgattttctgcattatatatatttttggatttttctgggctgttttattttatttatttatttatagttgacttataatattaaattagtttcaggtatacagcatagtaattcagtatttttacaggttattctccattaaaatttattacaagatatattgtatagcatagggaattatagccattatcttacattacatctttgacattcatctgtgttgttacatatactgagtggcaattcttcatgaagatataatttgtctatccattcttctattgatgaatatttgagtttccagtctgacggctcttaatgaagttttagtgtatattcttatatgcatcttttgtggatatatgttcatatattcatatatcacatgttctttcaagagatatcttcatttctcttataacgcctaggaatggaatcactgaattgcaggggagacacatgtgagctcttaaagaaactaaccttttctaaaatggtttttttttttaccattttcatattcttagtagaagtgtgtgattcctagttgttccaagtctttactcacctctgtctgtcatttcagccattctcatggctgcgaagaggctgtcattatagttttctttttcataaattaatttgaattggagtacagctggcttacaatgctgtttctactgtacagtaaagtgagtcagctatgtgtctacattgatcccctcttctttggaattcctttccatttaggtcatcacaaagcatccagtggagctctctgagctatacactatgttctcatgagttgtctaacttacacataatatcagcactgtgtagccagtcccaatctcccagttcatctcaccccatcttcctcctcggtatccatacatttgttctcttcatctatgtatagtcttcgtttctgctgtttccctattgactggtgaagaaggattttgcatgtgcttgtcggccattcatacatctaactttgtgaagtgtctattcacgtctttcgtcaatgtttaatttgtttgtttttgttattaattattttaatgtaatttgaacacttacttatgttacaaattatttgtatatggacagcacatttattatgtatttaatccatttgtcaatgggaggaaatccctgccagagtggttttcttatcctcaaatagactcagtgaagtttcagtacctttgctgcagagtttcacaccaaaaccagagccaaagcaggtgttgctaccatctgagagtgataatcattcacagatgctacatatggtatctctaggaactcgaagtctacataatgtagttctctgcattcttacactttttgtgacttaatcatccccttcctacacttgttttaatttatctgttaaaggtgaaaaaaaatccctgtgagaatatgagagtaattaatttctatgaattgagtatttaaatcatatctttttttagatgagagagcgactgtctcttttttgtaggggccattacattctatgggagcttcccgggtggcactaggggtaaagaacccgcctgccagtgctggagacgtaagagacctgggttcaatccctgggctgggaaggtccccaggaggagggcatggcaacccactccaatgctctttcctggagaatcccatgaacagaggagcctggtgggctacagtccatagggtcacgcagagttggacatgaccgaagctacttagcacacatgc

SEQ ID NO: 54056 - DNA, 1919 bp, Bovine  19866880526836
accgccatgagggagcaacaccaccaccatcatcaccatcactaacaccagctcaccaccgccgccaccactacaatcaccatcaccacctcctctgtcaccatcgctaccatcaaccgtctcgactactgttcctacgaccgcctccatcacccttaccatcatcacctctaccaataaatcatcaccattagctggtttcccactataatttctgaaccatgagttgctctttggatcagtaatttctgatagggctcatccagttgcaaaacatttctgtgccactttgtctcctgaagctcctttcattctctggcggtggtggtttagtcgctaagtcgagcctgactcttgcaacccatggactgtagcctcccaggctcctctgtccatgggattctccaggtgagaatacaggagtgagttgccgcttccttctcctttccttctctatttgtataataaacgataatcaatagacagatgtaggccagcacccagggcagaagtgcagaatgaaggctcggggcaaggggtggaggagcaagtaccaagtaacaaggctgcaacaatgacctggttttcaacacacactgatggatttgtgataggaacttataaaagtagcatgtgcagccagggctttatttttaatgtcccagcattgatcaaaaaaaagaaaaagtgggggggaggggaattcaactaagccaatgatggagaaaactaatttcatggtaaaataattccaaaatgtatttaaggtgcactggcaagaccattttcaaagaaatctgcattacaaaacatgcacgggaattgaagactccattcagataacctccagctgctaaggaaacactgttttcttttgctctttcccactgtttcctgtaaacaattttatgaaggggaaaagcttccttaccacatctgcccttgtcaaaagaaaggcacagcatggtgcaaatatgttgttttgtttcttccattagcaaatatttcttttctctcctaaaagacatgaataaacaagaagaaaacagtggtgctgaaattactcactagtctccttgaaggagatcaatatggaagagtaatcgaaaatggatgtttttaggtcttgtcaaagagaggagcttggtgaaggcagctcttcttgtgaattactgtattttacattcactgccccaagatccaggataaatattttatgtcttaaaaacatctaaaattctaaatgatcacttcatagcctctataaacagagctccataatatatgcacagtagatttgtctttttgtttaaatggtgacaccttgactcagcatgagtgtgttgggtagacttaaactttcagtgggaaaaaatcactcaaacacagttatggattagcatggattttactttcagatggattagcatggattttactttcagcgtccctattttccttgcagaaaaaagacatctgattaaccacatgatgggggtggggtggggtggtgtagtctattaaaattcaaatgaccacgcaaaatatattcagccaaatgaccacaaaaccaaataaattcttcatcagttcaatttctatgttcttactcacgcttttttcaatttaaagatgcagtttcttgctttctgtgctttctcataattcatgagggaacccattcaagatgcctagggcgtcacatcgtacattgtttgcatgcttgcttctaagtctgatttgtcgttttcttaaacttaaggcacgaagttttcgtttaggatggtgtgtagcaatttctgacattttgaagtataaacagtctctgagaaaagtcaacatttagatatacgtaaagaaaacagaagttttaatcattaggcagacacagacctgaaagtcaatataaaaaagcacag

SEQ ID NO: 54057 - DNA, 1214 bp, Bovine  19866880538210
gaaaagcagtacgtcaaggctgtatattgtcaccctgcttatttaacttaaaggcggagtacatcatgagaaacgctgggctggatgaagcacgagctggaattaagattgcctggagaaatatcaataacctcagataaccgcagatgacaccacgcttatggcagaaagtgaagaagaactcaagagtctcttgatgaaagtgaaagaggagagtgaaaaagttggcttcaagttcaacatttagaaaactaagatcatggcatctggtcccatcacttcatggcaaataaatggggaaacagtagaaacagtggctgactttattttaggggggctccaaaatcactgcagatggtgactgcagccatgaaattaaaagacgcttcctccttggaagaaaagttatgagcaaaaacggtccttggctaatgttgaggggaaatttgcagagtgatcaggacagaatccagactgcagcgggctgaagagaagatgagaaagtataaacaaggggagacaactcttcaaacacttctgagaaccaggacagtggaagaggcagggcttcaggtggaggggacatgggctgggttgaaaaattattttttcctgttgttgtctaacaggaaagatgtgaggaataggtgttacaggtcacgtctctagaagaggaaatcttttgtgggaaacaatgaagataacaaagaagataaagacagcccactctgaatatgcgagtttagtcaaactaaactcttcttattataaaccaactgcttgggaggagattattttgggtggaaaaatgcattgccatactcaaatggagtgtctgaaaactaattactgttcgtaacttattcatccccaataccttaccaacatgatccttctgtaatagattcatatttcaaagtgcagaatggaaaaaaatgtgccagctagcaatgacagagagaccatagtcctaggtataaacgcagtgggaaacgtgaatatggggagatttttaacacgacttcatttacagggttaattttctttttataactctcattccccaagggtactgaatgtgtgcccagcaaatcactgaaaatgtgttttgctgactttgaagtatcttcaaatgtatgtagcatgtttgataaagacttcccttgtgaaattaattgtatttttaaatacagaaaaatattactatagaaaga

SEQ ID NO: 54058 - DNA, 2840 bp, Bovine  19866880568225
caagagtactggagtgggttgccatttccttctccagggtatcttcctgacccagggatcgaacctgggtctccctcattctagacagacgctttacccgtctgagctaccagggaagccccaaaaggactagagaaagtgctaaaaactgtcttaaaaagtctatccaaaaaaaaaaagagatttgtattcttttttttttttttttggtagcattcagttcagttcactgttgctcagtcatgttcgactctctgtgaccccatggatcgcagcaccctaggcatccctgcccatcaccaactcccagagcttgctcagactcatgtgcatcgagtcagtgatgccatccaaccacctcatcctctgtcgtccccttctcctccttcttggggagacccaaatacactgaataaatcaaatatctggcctagtgacccaatttagttctactaatgtttatctagtgcttattttatgcaaggtactctatgagattctgaaacacagtcacaaaattaattaaaagtgactgagtgtaagcaatatctggaggattggaaagtggctggcaaatcctcaaaaaaaaaaaaaaaaaaaaaagatgataaagggcaatgtgatgaactgcaaaaagatgaccagaaggagccaggggaatgaatgtcagctgcagtttgagctacaactttattaatgatctgaaagaaggcgtacattaatgaaaattccagatgatgttaaatagggaattgtcaaacacaccagtgaaaacagagaaagaatattatgtgcaaagtctaataatagcaagaaataaaggttaggcatacagaaaagctataactgcatggcattctacattaagaaccactgtattcgacataaagaacaaagattcaaaaaaataaataaaggctaattggattgagaatataccagaggtgagagagacaagtaaaataataaaatccaaggagaccaaggtgttatatatacagaaaatgaaggaagttggaaaaccaattgctaaccaaatggactaaaaatattttgcaatgttttgcatatagaaagtataaaccatttttaaaagcctcaaacaagcagtgaaacagaaggcaagactgaaataggttattggctggagcatctgataccatgtaggttctgtctccttcctctgtctttttctagttcagagtgcagggcagctccctacccctttgaaggcagagcctcttttggcaaactgctggctgaaatgatggaagagcactacttttttaagtcagtgaaggttctgtgttcaaaccacctctggacattgggattccagctcagattgggcattctatttattaccccagaggagagatgccctccccagggactctgtcattacctactgcaactagaaatcccctcttttcatctccttctctttcttagatatactaattttatctaagggtgtcctgggattagacagtgaaaggagacttcagatctcacttctcaagcacccaatgtgcaatctcatagatgatttatggtgcttgataaggcatggattactcacctacagatgaaaacttgcaatttggtattaagcaaatgtctggttcttttgctttctctccttcacacttatatcagatggaggaagtaacttccattactattactactcggtttcatagtttggttttaggttaaatagtacaaaatactgtttcagaaagcaagactagttcatttggcaataactatatgccagaccactggcaccccattagctgttttatgccccataacaattctatgacatgaagatcaccaactccatttttggaaagcacttcttttaataagacccagaaaaaacatgttgctcttccttgaatatgattatttttcatgtattggaccaggagtggttgattaaaactgtgattgtgggaaggtaccagtttcataaggttaccagataaaacttttcaacatttgagcctgttatattgtaaaaattgtgacaaaaagggatgaagtcatcgactctataacaacgaaaaggactattagattttatttagcataagtcaacagatagaaaaatatccaagcagtgggtgccctcctccttccaggagaagacatgttaaatatcagaaaaaagcacactgtctttataaatatttaaggcttttgccaagttatgtttaatctcacttctaagggtatctttctgttttatctatattttaggatacaaaatgatgccatagagacctgaatccaagttttagataaggctaacacaaatttggtaaatgaatataacattgggcttctgtattctttcagtaaatatttactaagcataaatcagaagtaatatatctcacttctgaacttatttactgaaagtatatctcagttatttaccttgtattgatgtccttgtcctttctactttatttaatcaataagtatttattgagtgggcccattctgtcaggccatgtgggactggttttgccttcaggaaattcatgatcagtggacaagacaaacaaggagatagacagttacaaaactggtgttctggagaggaaaatatacataaaggaactggccaagattagggaaagaaccattttcgagtataagagaaaacatcatttggcttgtcactcaggtctgggaattgtacttgttcccattaattaaactagataaactcaaaattcatcggttcctgaataaagtaatattacctgatcccacctgaaaaagaatagatgctagacttaaagaatctgtttccaagaaaatta

SEQ ID NO: 54059 - DNA, 875 bp, Bovine  19866880570659
tgatcccatgaggatgatcccttcctacaggctctgctctcagctagaagtccgagttggagaggagtcaggtaaatccttggtgggaaggtactggcttatgagaactgaaagcattccctctccctggcaaatgtgcaaagggattcatttaatagcaaataaaaattttaagaaccaaagtagtatgtcgctgataaaattccaggggctgagggaagaagtagagaggaagggagatttttcaaccaggggttctcttgtgcctctgtaaagcatctctattcaggctgccactgattcaaaatatttctaccaccaagcttccctaaggagtacattcccttgggcttcatcttgaatagtttttggattggatggggtggacgtccaatgagaggtgtttgagtggtgatgcttcaagatttccctgtaacactacccatctcttggccgtttcactcttaataagaggcttcctcctggaggcagggagttgatagccaactctacccctctccttggcgttttttgagtccctgcagttctatgagaaggcaagggaagctataaatcaatagagattgagatttcacagtcttgcaattctcaatcccaatactgatgatgagttgcataaagtagcagaaaaatatgaagtcaaaagactggggctgtgagtacctgtcttgctaataaactagaatctttaggaaatctttcaacatcactgaatctccatgccaaactatcgaatgggattaatgagctattttacatacaagactgtgagatactagatgtaaaaatgagatgctagatataaaaatgttttgaaaagcatgaaatactatacaaaattagaaaattttaat

SEQ ID NO: 54060 - DNA, 930 bp, Bovine  19866880573821
tcaattaagcaaattaacaaattaaagtcagtttgttatctactcagtgcatttttcttactttttctacattgtggtgtacccgtacaatgtataccactgtttcgtgtgttgcaaatgcacataaatgttcatataaatgcacactatgttttattggctttaatctctccagagtgctgtgaaggatgtaggagcttcccttctgaagttgtactgccttctgggaagaagccagtataatcctaagagagaaataaagaaatgaagagagaactttttctgaaatggaaaaatgagactgaaaaaaaaaatctgatgaaaagttattggaagagaggagacaaagagaaagcctaaaacagtatttcacaatgagatatcaaaagagttctagaatcataaaataggaattaaaggaatttaagatgaaaccattaaagagatctttaagaggcacaggaaaggaaagtaggataaagcagaaaagtaatggaaaatgctttatgtaacaaactactggttaatttgagatcacgttgaagggctgggagaaagacggtacctgccaggccaaggaatggagaggaggtacccacagccgggctgtgaacgcaccattggaattaaccaataagcccaaactggaaggttctgaacatctgcacagagagtttatgagtgccaataaaaagcggattgtgagtataactcaagagaaccaacatgtattgaaagctttaacggttagaattaggttcagctgtgtcagaaaccccacaataacagtgacttaacaagatggaccttggatgcaaaggcaggctgtgcagcactgatgcttgctccacagagttgtacgatgcttcccaggtatgctcgttactccaccagcccgaaggtggagccctctatcatggctcaagcatg

SEQ ID NO: 54061 - DNA, 2385 bp, Bovine  19866880604819
ctaaaaaaacgtttcctatgaatgtttaataagaaggaattattcacattttaagtggaaaagtttgaacctaaaattgtatacattcctctatttactgagtgtctgtaatgtgcaatgcatgattatatactaggcaatacacatatcttgggcttcctggtggctcagtggtaaagaatcctcctgccattgcaagagacccaggagacagagttgcgattcaacccctgcttcaggaagatcccctggaggaggacatggcaaccactccagtattctggcctagaaaattccatggatagaggagactggtaggctatagtccaaagggtcgcaaagagtcagacttgaacacacacacacacacacacaccttacaatctcggatgaaaacatctttgccataattgtgatattagtatatataatgctatgcctaacaaattcttagtccaaggatagaataaatgcactaaattctcctccactgtggaagaaagtcaattcagttcagttcagttcagtcacttagtcgtgtctgactctgtgaccccatggactacagcatgccagacctccctgtccatcataaactcccagagtttactgaaactcatgtccattggagtcggtgatgccatccagccatctcattctctgtcatcctcttctcctcccaccttcatctttcccagcatcaggatcttttcaatgagtcagttcttcgcatcagatggccaaaggattggagttgcagcttcaacatcagtccttccaatgaatattcaggactgatctcctttaggatggactggctggatctccttgcagtccaagggactctcaagagtcttctccaacaccacagttcaaaagcatcaattcttcggtgctctgctttctatatagtaatggtggagaaagataaaggaatagccactacagggtcactcagtaggggtggtcactagccataagagcctattgaagctgaaactcaaggtaaataaaattaaaaattcagtccctgagttgcactagccttatttcaagcattcaatagccatgccttctctctttcagtttcagcctcagcctttgcatctctagagtggaaagtttggattaaatgactgtaagatcactctggcactagcgttctgtgatttttttttttttcccaaggacttttcttgggtttggcaatactaccttggattctgtgagcagaggctctcctcccccgcaatctctctctctccatctagcaaaatgtacctctcatatattcaccttgtatgttggaaccaagtgcttgacaaagaatatggtaatgtattcaacaaaagctttgtgtactaaatatagcctcagagttttaaagagcatttttttttcttttatgagtgttggcagctgttttactatgaaataggtctcagaaagagatgaggacatattctattttgagataaaagcttcatctgagatgtggggatgacactgtaataaatgctattacagttaatgaaatcagggtagcacctgatttttatttgattgtatgaggcaaattcttccaaatttccatgtatacattctcagcataaactagcagtagagcctgttgccaatcaatccgaactgtaagttggtccctgttccatttttcttagccatcctgaggtagtaaggggggaaaaaaagcaagaaaaatagaggttaagatggtgaagattggaatctccctttctttcccccagtgtccacatgaaaggacaacaactaattatccagcaagaaacatttttgaacctcagtttacaaactaaaacaaatgcttaaaaaatcatataatgcaaaatttctgtttcaatccctttgaaaagtaaatgtgacaatatggtgttagtcatcttaaaagtgggaattttgaaaccttgaacgcagccaatttccaacattcggatgacatgtgctaattgtcttttgcttatttctacctcttaactaggaagattctttagcatatgtctattcccccctcctcctttcttcaggcagaaattcccttgggagggagttgcctgagaaaatcattaagtcgaagttttatgagcctaggtgggataacatttggaggtgactgattacatgattgtagctaattgttcatgggactcagagagtctctagcatctttaagaggaaatctttccacatgcaagccagcagaaatattgcagctttctgtaaggggtgtcacggagaaatatttcggaggtaaccttgcatcagcatcactcttttcattttctgatgaaaataccactgccccccatcccaggctttgtcactgaaatataatatatagctataagg

SEQ ID NO: 54062 - DNA, 1128 bp, Bovine  19866880608748
tgggtaaaaaagggtatgaattcttttgtaactccagtaatttttttttttttgcctttcatgaaatgaaaggaatgtctaatagaaatgtcagctgatagattatcaaaaatcattttgaatgctaggtgactatttggtttttggcatttaactcaggagtttaaaaaattgagtgacattgctgtaataaaatccttccatttctatctacctatttatgtaaagaatgttctaggcacgtccatgaaaaatgaaaaacaaacctgatgtagaacattgtctaattctggcaataagttatattatccatggacccatggaataattgaaaaaacctcattttaattaattaatagttccatataaatgctctttgatataattaataaatatgtcaaaatataaaatatgttacattgtgtttatcaattgcatgtaatggtaatttaatgagaattcaatccagaagaaaaatgttatcacttacaaacttatggttccaggagattaaaaaaattaaatttaccaacatatttttttgtagagatgtatgataaggtgatcaataaaagactttcaagcataaaatatatcacatcagactgaaattttgctggcacagtagaacagaataataagttccaagactgaaaagaatgatatagcaatttctgatgttaaagaagagcttattcatgtatttttttaactggatgaaggtgggaataaaatcactagtgatttcacacattttaaacattggacatatttaaaagaatgaagtacctgttgtactttttaatgttgctacaaaatttacaaagcagaggcaattatatccattgccaatgatatctagtaccaaattagatggtaatttttggatgtcaacttaaaaatattagaaagatttttcaaaatcattttagcaggtacatgacaataaatgttttaggactactggcttaggatgaaaagagaaaggaggttagtccccagaagcgtcattattcaaaggtcttgctatcagtaccttcaccagcgtaacgaagaaaggaagcaaaaaaaggcttgctagatgtaggtttggtcgggttgtctctatgggactggaattaagccatt

SEQ ID NO: 54063 - DNA, 1429 bp, Bovine  19866880636156
ggttgttaaaacttaaccccatttttttttccagttttaaagaataactgtcttacaaaattgaacaaatcagaaagttttattggcagtgatattgtgttgcttaaactctggttgccttggttactcttgaatattaaaatactctgggcttttagatagtgaggactggtcttctacttattttgggcccatgattgtattaattaaacactctctagggctggggaagaggaaatttatgagctgtctagaagggaggatggctatggcagccagcagttcggttaatttctgagcccaaaagacaataacatcattgatatggaggatcattgtcgttgagacggatatgagtccttttctgaatgtttccggtgcacaaaggcacatctctgaccgattatttaaagttattattttagaatagagcagggagcacccagtggtcctcacccatgtctgttcatctgttctttaattatccttctccaccctcacccctttctcagagataacctgctgaaagtggcgatggtcacagatcacttctgaaaaggtagccgttcccacatgtgtatttcaggcctgttattgtgtctacgatggtgactggctgcagccttaccccagaatcagaatttcaaagctgaaatgaaacattaagtgtttgctgagctcagcccatgtttttcagatcaggtgaccgacgattagagaagtgcatttcagttctgaatttcagatttacagcatagtgtttttgctctcgttccagttgagactgcagacaatcctgccttttccatgtaaatcaaagtctcttatttaaataacaccactgtaggaaaattgtatggtagggttgggagttttagaagtctctcttggtagagttatgaaatcacagagtggaaaggaaccttgaacaaatatataatctttcactccagccctggattccaacagacttctcatacccacatgctctcttattcctttccaatgatgagctctcaaaatgtgtgggggaacgtccctggaggtccagtggttaagattccgtgtttttactgcagggggcatgggtttgatccctggttggggagctaagatcttatatgctgtgcggtgctgccaagagttaaaataaataaatacaacagcaattaaaaaaatgtgtgtggggtgcaatgtgagtatagcagggcttagaagcaagggaatctgcgtaaagaagcttgttgtgttcatttagcccatttttgttaacccacctagttagaattattgcttatagtattgctgaaagatgggagcatagctttgaggaagaattagaacttacttatgataaaaataaaacgacctgacttgtatgttagtctttccactcttattgttttatgtaatctgccacaaaatccat

SEQ ID NO: 54064 - DNA, 1305 bp, Bovine  19866880645683
ctctgggagttggcgatggacggggaagcctggcgtgctgaagtccatggggttgcaaagatctggacacaactgagcaactgaactgaactgacccttattttaaaaggcaaaataccttttaaaattttcaatttccaaattaatcaagatggttttacatctgtttgcattttaattttgttctagtttaaaatgtaacaaacatggtcctgttatccagccccgggtgtttgtctagaaaatgtggaaacaccttatcttagctttccaagcaatgatattactttaattcagatgctgcactttgaaattttagctaaatattgaagttcgaattctctgctcatgcttcattagtggtaattaggtaacacaaatgcatctctgatttatgcatgtctaaaaacgattctgaaaagccatcttgttcagggttgattgttcttgtgtacgattttgtcctgcgaggctatcttcttcaaacactctgatcaaggaggccacctttgagagataacactggcagactacatgtactcttcaaagtaacattatagaagcagttctagaaattgagaagacagatatttttgtgataatgagaggctgggactaaatttatagaaaacagatttacactaagacagtttttttttaagatacatttctaaattaatttctgacatttgggagtattttgacagtacttcatttgtataaagcgttatgtgtagcagcctcattgacttgtttttgtttagtctggtttttatgtgattgtttttacctctgttgatttggtgaaaaataatttaacttttttttttgttttttttttttaaggctctagctggcatgagaaaactctgaatccagccagggatttttgtatgccctaatttgtgcattgcaatgagcataaaatttgcatctagttttatttttcaatctctttactggtatttgtgtaatgcaaaattaaatgttgcagagcattaattaaccaaggagaactataatcatcaacagaatctatataggaaacctgtgaaattcgtagaggctcagaacttgagagtaaaatagccatgttttgaaacagtatcactgagtttgcgctgcaaccaaatgacacagttgagcagaagagacccaagtgttgaaggagacattttttcatattccagggaattgtaagtttccctttttcatctcaaaatattgaccaaaaatagagacagaaaaatgactgaacttaaggttaatattttgggggaaggctgccttaatatatagggccat

SEQ ID NO: 54065 - DNA, 1335 bp, Bovine  19866880661589
cacgtgcgcgcgcatacacacgcacacacacatgtatttactgtcttaactttttaagtctgagttatattctagtgattttgtttccaaattttatctaactagtcccatttaatggatttctaggttattttcctgggccttcagaagatcccatactgtcactatgaaaaataaaagagtgagttcaaatgcctaggaagaggaaaccaatttttaacaaacttctgcttgaattcttgtttaccagttctttttgtctatcacttcttcctgctgaggttttaatcaaggttactaaccttttggtttgctcaggactgatgttttttctggcatacaggacttttcagttttaaaactgggagaatcccaagtgggggaaatgggatagttgatcaccctgtaacccctttaaaagatcaaatgaaaggaaaactaaccagttccaacaactgcaagtgacttcctcaaagtgacacaactgagtggctaagcacagccagtagtgaagaaaggagttgagaaatggtcctgctcatctcagcttagagttccttctgtggcctccaaaaaataaatatgcagtgtctcctctttttaacagcatattttttaattaaaaaaaaatcttaaaaaaaatttggccacacttcaaggcatgtgaggtcttagctccccaactagggatcaaacccatgccctctgctgcagaagctcagagtcttaacaactggaccaccagggaagtcctgcagtgtctgtctctaacacaaaaatgaaaggaagactttggattttcagaataataatctacttcttaccatccagagtgataaaccgctcaacctaaaagagtagtatccacacagggcttggattagctcctcacgaaacagcagagttcttctattatcacttgaagaaagtggccatcaagctggaacaaataggccaggcagagagagcctctgagaaagaagaggatgcgaattttacaatgtttggagtcagacaggctagaggcctggagccaattatgtcacggctctgaatctcagttttctcatctgcagggccttgtagacggtaggtgtttaatacatactggtccccattctctccctctccatagcggggatgacaaacattccacaaggagcaggcaagcaagttgtaacttaatgccgctccacacggtacctgtcccgggaagcaggcactgaacagaggctgcagagagtgtgtgaccctgccccccgcacacagacaggtggagagcaagctcactgaacgtcctagacaggcagatccagagacagagatagggccgat

SEQ ID NO: 54066 - DNA, 1177 bp, Bovine  19866880674779
aactaaatgcataagattagccactctatatatgtttctccatggtaacttttattttatctttcagagcttcacaattttacttattattgctgccatttttagagggaaaaaaagagagacaatggtgtcataaattagcaaactttgagattttcccaattagctaaaatttgtattagtctttttctgtttgttttgcctttaagaaaatgacaatctttggaaattacttaatggaagaaatgcctttatgtgtttgatatttacttctgtagctgtcactgtttgtatttttaaaaagatacacttacttatttaaacttagaggaattagcttctttagaatgctgggaattctttgtgcataactgattaagaaatctcatttacatgatggaagggccttagaaaaattttggtaacagcccaaagagaactgcagttccatttataatgagaaaggtgctatcaggttggtgagtgaggcttattgctttaagtaataatgtgctttctcttagacctatcatgtaaacaagatttttaagcattgcaaaacagaaaccacatagacatgctatactgcttaaatctgaggtgtatccaggagctgactatttgctctaagagtttacatatggctgaaactttccaggaattttggtcattagaccagtcattctcatcccccagtgctgaccagtgatgaatttgttttgttggtttgcatgttgtttttttctggttttgttgtgaattcatgtatttaaacatgtttgtagtttgttaaagactgatcatgtttccccatcattcttatcttaaaatcctactccccagtatgatagtattaaggggtgagaccaggcttccctagtggctcagtgccaacataggagacagaggttcaatccctggtccgggaagttcccacatgccttagagcaagtaatcctgtgcaccacagttgttgagcttgtgctccagaacccaggagcacagccactgagcccatgtgcagcaattactgaagcccaagtgccctagagctcctgctctgcaacaagagaagccaccgcaatgagaagcccacacactgcaacgaagagcaacccctgcgcaccgcaactagagaaaagcccagccagcgatgaagacccgacacagccaaaaa

SEQ ID NO: 54067 - DNA, 2687 bp, Bovine  19866880701948
ctcagccttctttatagtccaactctcatatccgtacataactactggaaaaatcatacctttgattatatgaacctttgttggcaaagtgatgtctctgctttttaatatgttatctaggtttgtcatagctcttcttccaaggagcaaacgtcttttaatttcaaggctgcagtcagcatctgcagtgattttggagcccaagaaaataaaatctgtcactgtttccactttttccccttttacttgctataaagtgatggcattggatgccatgatcttaatttttgaacgctgagcttttttactctcctctttcaccctcatctagaggctctttagttctgcttcactttctgccattagagtggtatcaccagcatatctgaggttgttgatatttctactggtaatcttgattcccggctgtgattcatccagcctggcatttcgcatgatatattctgcatataagttaaataagcaggacagctccatggcacaaactaaacaacactcagtcctatgccatggaacattgtaactagcctgagccacactgtgaaaagtcttagaaatgtctttcaaatacaaagttccacctgaaaaggctttttactgggaagagcagtcctacaaaggggccccctttcttgttgcacttgctgttctgactgtgtttttcattctaatgggagtcagcctgctcatattttctcacattgttttgatagttctaaactgtagattcccatctttggggaattctcccacatgattacatgggatataaagtagcagttacaaaggaataaacttgtcccatagtaaagatattttcagctgcttggagaaatcatttagaaagttttggaaacgtttctatcatgttggataagcattatttacacccttataaggaggatgtcaccaaaatttagtacttgacttgagtatatattataatattttgtgtcagaactttctcattttggggatatattttcccaaagcagcaggcagagaagctagactttcgggtcatttgttattttgaattttatctgtacatttcaaagtttcggcttgaagttctagtattattttattgaattttctagtactattttcaccttgatattctagtattactgttgcataagagttagactacagaatttacacattctatacatttttgtaagccattctatcgtaactgaactttgacgttttggtctgacattacaacattctcctaagaaacacattgaaagcaaaaactaaaaatgaaccccattttctttttttctcatttaagtataattgctgtacaatattgtataacttacaggtgtacaataaagtaattcaaagctttgaaacttatattccatttatatctgtgtgcatgctcagtatgtccaactctttgcagccccatggactgtagcctgcgaggtcctgtccatagaattctgtccatggaattttccaggcaagaatactagagtgggttgccatttccacctccaggagatcttcccaacctaggaatcatacctgagtctcctgcattggcaggcgattctttatcgttattataaaatattgtctatattttccatgttgtacaacatagcctgtagcttatcttatacctaatagtttgtacctgttactctgctacccctataattgcccctccctctatccctctccccactgataaccacaagtttcttttctatatctgtgagtctgtttcctttttgttatattcactggtttgttgtattttttttttttatatcccacctataagtggaatcatgtagtatttgtctttctctgtctgacttatttcacttaataccattcaagtccatccatgctgttgcaaattgagccaattttctaagggggaaaggtcctatttaattatgttagatactttttgacgatgtcaaagccacagagaacaaggatgccactgactgtcattgtggtgaaggtgtgctccaccctgtcactctgtagcgtaaccaccctttcccctctttttctctctgttgctgtattttctttgtgtgcctccttatttctgcctctgtctccttctgcccctgggtgtctccttttcctgtttacctcctaagacttgctgaactgtgctggcaacatgcattgctaagcagctgctaacacgtgttcagaatccacttcagatatctgaagtttccaagactccctacaagtataccagttgtccacagccactggccaccagaggggcaaaatggggtggccatcacaggtctgttcagagtcatgctgcttgggttccaaacccacctccaccacttagcagtgatatgacctttgggcaagttactgaacttttccaggccttagttcatgttccgttaagtggaaataacggtagcgactacttcataaagttttggaatcattaaatgtactcagagatacagtactcagcatgtggcaggacacatgagtgctcaagaaatgtgagctattatcattagtccaaaccaccctacaaccccttccatttacttgttattgtagaacacaccatgttcacatacatgatcacgtcttccccaagagtggacactcatctcactcaccgggcggaatgccttcccacacctttccaa

SEQ ID NO: 54068 - DNA, 1536 bp, Bovine  19866880702806
ctcaggcagattctttaccaccgagtcaccagggaagcccggcaggaacagtctttgtcacgagttttgtttttccctccagttcccagcccatgctacttcacaggagataattttagtgaagagcctagaactgttgctcatgtttgagtctggtgcgccattttcttttcccaaaaaagccccagtgactccccaagctttccccctaagggctgccgcttttcacacgaagtttccctggggaccagccatgagccctagaaggttcctgtatacccccttccccttgaggtagtctgcttgcactaaaatccttacataaaagttatgttttcagatctcagatgcttcacctggctcacaggtggtcttattctcttttacctctgcttaaggttcccaccttggataattgtcctattggattcttggcattattccttccttctctcttatccattttaacttccagtgtagttttatcatccttgtgaccgtattttaaaggtggaacatcatctaaataacatgaaagaatcgctgtgtgtgatagaggttgtgtttcctgagaacacaactttgtggtcattatttcctgcaactataatttgaactctattcttccgacatggcgtgttgatgaaatatgccagagtgaagagtggaggcagatgtgaatagtggaggcagctcatattagcatagataagatccttaaattccagtagcatcattcatacattcatttattcattccaaaaacatttattgataccacttaagtgccatacacttttttttttttttattagattctggcaaattggagatagacaaagcagactgcagatgactttatgagataaagaaaataatgtctatctgggagggtgatggtttggatgagacgatgtatataaagcagccacatagtggttgcttaataaatctcatttgtcatccttttccttcagatactaaacatgataataaatacatttttaagattcttgcaaaagatcatctgaaaggaaaatactttgaaagacctttttaagtagatgattttaaagcatcactaaagctttaaattttctagtttgttttcttagcttttgagttgtaaagtaagatgcattttgtaagggtgcaaggtagaggagttctctttcaggcatctaaagtcacctttctctttttctgcctctcaaacagctttaattagaaacagtggtgattttctcttcctctaaaccgtcggcttattccagctagtgaggttgtttgtgacaatctgctctatgcagacactttatcttaaagaaaaatagcttcattgaaactttattttaacttctttcccttctcgtgattttatatcccctaataaacctgtgacatttcatctagcccagggattctgtaaattcatgtattagaaaactaagtcatatgatgtaaaactttaaggctgttacactgaattcatgaatttaatcttgtaattgtcgacgttaatgggtctgacaatgt

SEQ ID NO: 54069 - DNA, 1051 bp, Bovine  19866880773398
tgagaaagtttaattgtaatcctattctccttcaaagctgctagcaagttattcaaacaatcacaggaaatcagaatctgcatgtctttggacttcaggggctaaccaatgggcattcttaggcttttctctaccaaaattgagtaagactgtcagggggttgttttcctggtaagccaagcttctacatttcaggtaacatatattacaatttacaaaattctcagccttttgaacaagttatagtctagcttttaaaattaaaaataaaatgatacacacagaagcaaagcagaaatcagaagctaaaaaaaaaaatcaatagatgtttaatgattctcatttctttatagctaacactcagttatgaaaatgaattaatgctgactaggcacttggccacataatagcccactaattcccatccagtgagcttataattaattttaaaaataatgtacttcagagaaaatatttaactatccagagatcttctgtggttgttcttttctcaaataaagcaatcactaccctgtacacaaaatctcaccttcactacagttgttcaacaacatatgtggatacatttgcctgtagccaaagctctatttgaactcaatgaagcaaactaatttacatattccttgtatttagacatacgttggccctaaaagccaaagatagtttccatcatctacttatcaaatatactagattacctgtcatattgttgtcagtgaacctgtcctgcatgaatcatatagatccatctggaggtcacacagagaaagagcaacagagctagcaacatgaacctcaggatggtgcagaaacactgctcagaaagctgtgtttcagaacaaggaaggcacttccgaacccggagaaataaaggctgtgagatgattggcagctgaccattgagagggctgaagagaagccatgaccttggggaccagccaggtttcagctcaagtcaaggagatgagaaaaacatctagagacagacatggaataaagagaaggaagagtgcagggtggctcacgaaga

SEQ ID NO: 54070 - DNA, 2899 bp, Bovine  19866880792655
tgacttacgctttgtgcttctgttttctacatctgaggttctatttataaaccatttagtcatatgggccactggatcgggaacctaattagagctgtgtattacggcgtggtggccccaaacctggcagctctttcctccgaggcaggctcgtcattgcttgtggagtgctggctgcactcgcctccccaggctgtgcactgattgcatctcagaatgcacaagatggaatggcttgctcacaccagcctcagtgactggagacaggctttgggaaggtcccaggtcaccatgcagggctctgataccctaacagtccgctggcactaacgatcttcaaggttaaagcccatttctcctcccattttggatggaagccaggatttaaataaaagaaagaatgagaaaaagaaatcaaatagaaattcagccacaagagtcaagggcaagtgaaattgattttaaagggctggcttccagccatagaaacaaagagggtttgaggtggaaactgttgctgttggttaaatcgcagccattggggaggggagaggtctgtaatgagaacgtggacaaaaatgcttcatttttagcttggccggtgtcctgaagactaaggcagtgacgcactctttgaaattaaaaaaaagaaaagtgctcctggagtagttctgtctgcctaaaacttaagcaagaggcactaaaatcaggacaaaatgggagggtggtgggaagaagaacacagcttgaaatccttcgactccacattgctcttctagggtttgatttctctaaaatcatacactttgcatggtgtaaatagcatgtccaaatttagacattataaccccacttttcaattgcctgcaaacaatgtaagatctatggacaggcaacagcctgaattcaagtgttagctttgccacttattagctgtgcggcctcaagcaaattgcttgacctctttgagcctcaatttgttcatttgtaaaatgggaatatacgaatcatatctagataatatgaactgagacacgtaaagtggtccaaggcaatatttgcacataataaagtcaatataaatgatttgcttttgttattaaatattaatattttaagctgcttatcttaaatttttctcaaaaatcatctacacaaaatattcatgtgccaaaaaatgaattttgaagcatattaatataacatacaaaaattaattccaggtaaattatagctataaataataaagtctcttcataaatctagaggaaaatgaagaaaaatgtcttcagtactgtgtggtaaggcaaaaaagattttaagaaggacataaaaaggatatactataaacattatcaaaaaattagactactttaggatgaagaatttctttagtcaaaaaacatattgaaagaggaaaatgcaagctttggcaagaaaagatagttgcaaccatacaaaggagccatatccagaatgtacaaaaattcttgcaactcaacaagaaaatatcagacaatacagtagaaaattggacaaaagacttgcagataccttagaaaacataatttccaaatgctccaaataaaaagatgttcaacatcactagtcaccagacacatttaattgttaaccacattaaaattctttatgtatctgaccagaatggctaaaaaaaaaaagatgcagtgtgtacacactgctgtatttaaaatggataaccagcaaggtcctcctgtatagcacagggagctctgctcaatgtcacgtggcagcctggatgagaggcaagtttggggaagaatggatacatgtatatgtatggctgagttcttttgtggtccgcttgaaacgatcacaacattcttaggtggctttactccaatataaaataaaaagttttaaaaagatgcaaaatactgagtgctggtgagtatgcacagcaattgggactcctataactacggattgaagggtacatggaaagaactattttgggaaattgttcaatagtatctactaaaactgatcctgtgtgtgccctatgacatggaaatttcacttctagatttttattcatagggatgttccccaaatggagaaagcaatggcaccccactccagtactcttgcctggaaaatcccatggacggaggagcctggaaggctgtagtccatggggtcgctgacggtcggacacgactgagagacttcaccttcaattttcactttcatgcattggagaaggaattagcaacccactccagtgttcttgcctggagaatcccagggacaggggagcctggtgggctgccgtctatggggttgcacagactcagacacgactgaagtgacttagcagcagcagcagcagcagcatatgccccaaaaggtatgtatgactgttatatcaacattatcattaatagaataaactagaaagaattcaaattccaacagtataatgaatgaataaattatgacaaattgtttatcctacaatgaaatactataaaatagcaataaaaatgaatgaacttttgttatatacagcaatggggagaaattaaaaaaaaaaactataatgaaataagccagattcataaaatagtagcactgactggctcaatttatataaagtctaaaacaaacaaacaaatatatgatattagaagttagacctatggctgattcatgctgatgtttggtagaaatcaacacaatacgtaaagcaagaggcttccctggtcgctcagctggtaaagaatctgcctgcaatgcaggagaccccggttcaattcctgtgtcgggaagatcccctggagaagggatagactacttactcactctagtattacttgggcttcccctggtggttcggctgtaaagaatctgcctg

SEQ ID NO: 54071 - DNA, 1408 bp, Bovine  19866880815675
ccctttggactgggaaggttacacgtaaagcaggttaagatatagggcagactcaggacaaaagtcatagttttgttgaagagaccagcaaaagactagtcaaagtattaaattgctgagaagtctaagagaaatgcactgttctgagacctgaatggtccacccagatccagcaggctacgggcactctgagatagcccttgtttcatcttcaagggttgggatggttcactaggcctggtttcccagggcacaggtaggctcagcttccatccggaattctccagtaggtcttctcccagatggaggaagcatttctctgtacacagagaacttctggtgcctcatcaggggtctcttggtttggatttggagggggggaggttgcctgggaggcagcacctgccaggagatggagggataatgggtggggggggagtcccactgcagtggggtcagcctggcaaaaggaacctgggggctggggctgtgcctggtttagtaggtatttaataaacacgtgttacataacaaatgaaagaaggagttatccacctaatgtctgcatttgttcacagagagagtctccattattctttgcactctcctacaaaatgccaacacttcatatggctcagtattatcgctttcatctctgggacctgaagcagccaactctgggtgggctgtgctgccaaagtcttgctggtgggtgtggggttctgggtaacccagggccagctgcctgcagacagacctctgctgagtcaggcccccaaatgaaagtagccggctcagcctgggcactgcactatggtttaatttctaaatttattgttaaatgacactgcctaatacttcatcctatttcttttggctgtctttttagcctttttcaaaatgttaaactgtacatttagtaggctaattatatatagtgggaacattagaataatagtcattgcaatagacattaatagcacgaagcaattacttactatgaacagaattggtttagctaccatgcctcccttatatgtcccagtgactgagaaagggctcagagtggcatttagggacatggactgtagatgcaggttcaaatatagctctgccacttggagccctttgcttgaattctaaattattttctttacatcttcttcacattacaaaatggtaatcataataaggaagatgcagctatttcaatttaccacttcacatagatattaaaattaaacagtatctttaagtgcttcaccttgagtcatcaatctgacacttattgattgcttactctctgtgctcaggctgctaccacaaagtaccatagaccgggtggcttaaacaacaaacatttacttcttaacattctggagcctgaaaatgtgagatcagggtgcca

SEQ ID NO: 54072 - DNA, 953 bp, Bovine  19866880815690
ttgaatttagtttccttctagctggcttagttcagcagcctgaccagaggcgttaatcagttgaagagaccggctatgatgaaggctgtttctggtcctgtggttgaagagaaactcatgactgtgcttcatattttcatctgcaaaatggggatgagcacccacttcccctctccccagccatcatttcagcattgctcatcttggaaactggctgtggaataagcagaattaacaaggcgggcagcagggaggtaggaaggcccttgggttgctggttggaagctgaaagctggaaataattctctctgatctattgcctggagagcaccatgagccagctggcctgagaagataagagaactgttcttctccggcctgggtggtactgttacctaacaaggagttgggcaagatgcttagggagcaggacttttactgtgtgccaaagtctgcctgcttttcatctggattccaatttttatcctttgccacatttaaaacattattttagatgttccctggaggaagggaccacaatttctccagttcttttcagacaatttgtcctaagtgtaaaggactgaaggtgggggatggaaacagacattgaattagccaaatttgagaatgaaaaaaaaaaattgctgatattttaaaagcataacttggagtcagtagatttgcctaatttctctaatgcccttcatcccttccttggtctgattgtatgcttgctcttgcagtcatactccgcctgaatagaagcagagtctggaaaactaagaggaagaagagggaagctgttggttttcactcctgtaggctggtggcataagaacagaaatgagcaatactgtgtcagcttgactagcgtatggttccatttgttggctccaagacctatctagatgtttgcagtaaagatattttccttcaacgtgattcacatt

SEQ ID NO: 54073 - DNA, 1369 bp, Bovine  19866880832308
tggaggagcctggtaggctgcagtccatggggttgctaagagtcagacatgactgagcgacttcactttcacttttcactttgatgcattggagaaggaaatggaaacccactccagtcttcttgcctgaagaatccaagggacgggaaagcctggtgggtgccgtctatggggtcgcacagagtcggacacaactgaagtgacttagcagccgcagcagcaatgtggtatagtcaggcccgcaccactgggccattttttccctagagacaatcagtctctgggttgtgtatgaaggctactcagttaaaaagcctgaactatttgtagagagggcaggggccatatgaagaaggaaaagagagaggacattattattggtgataagaaaataagtgaagggtattagcaatattagttaattgaattttagcaaatattagcaaattgaatattactgcatcagtacttttctgacctttctcagtgaaacagcctaacagaggccagagaaagggactggtgcatgctcggattagactgaccgtgccttgggaagtcagaatactattactgaaaattgcatgttacactctgcaaatatgaggtctgactttcacgcggtctcataattttcagaaacttaatgcagtcactagctggtctcagataattatgggggaaaaaatgtaaagtgacttctaagtgcaacactttttattttccacaaacatactgtaaagtaggggacaggtaaacaagagtcctggagtgatttctgatcgctgttttcttgaactcatgacaccagcacttagtgtttttctgcaggctgcctgaaaggttcacaaatccaatatccccaggagttatttcattagatttcctaactttcaaacccatgtgcaatgcccttattcctttgctactcttattgactgacactgattatgccatcagcaaagcttactaactccactgcttcatttagatcattaatggtcaatagagggtctgagatggttcactattaactgctttgcattcagaggacctttcattcagaggactttcctttgtgtttcactgcctgcttagcttggctctctgttgggaaaaggagaggagagtgagataaatcctggatcattcctacatccttcctatgtggacaccagccctgggactttcagagaccttttatgagcctgagcacacagagtgcaaagaagtatccagggagtctggctcccggtgtacgaatgtagaagccagaggaaacatggccagcatgaaccactggcatgaactacatacagcccgctacagtagctctccagtgtcagctctttggttcagcctggctgga

SEQ ID NO: 54074 - DNA, 1327 bp, Bovine  19866880837898
tgaaaagtgaaagggaagttgctcagttacttatatttacaactaattttttggtataaatcatagattttactgtacagtcctgattttaatattatttttcagtctgaggtcaagtactaggatgctgtctagagttttctctttggaaaatgtagctactgtatataattataatgtttgcatatttatgaaataaattaatctttttgaattattaccatagctacccgtagtgtatgcaaataatttctcatctttagtatttatggatgcaatattttaataaagtagcaaaataataggcaaaaaatgttgatatgtttaaactctaacaatttcatggagacttattacaattagtttaatggccctggttagaatctctcctcttattttgtccttgttcggatgtatacttcaagggtcaaacacatatttatccttttaatggaaaatttctgtcatttgaatgtggcaagattgagatttatctttaaaacacttgatggaaacacttagcttaagttgcaaaaatgcctaacatcacaagcttgataatcccaggttgggtctctttaaaagaatctcaaactgcaaaccatataaaatgatttcccttaccttgcaacttctggcagcataggtggtacaaacagaaaatagttatttgcttggtgacaatgtggcagttctataaatgtgatgtacaaagtgaacacgtaaatagtatttcagaaacagagaaccatctaagactctgttgattatagtataggtgctggacattttaatgggattgcttcttaattaccaaactctttttgatagccatgaaaaaaaattgaattggacagtattgattccaagcacttctgttcctctttagggatattctgagctggcaaaacacatacagatgggcagacaagactgcttagtttgccctctgctgaatttgatcaataggaacctatttctgtatcagggagaagtagctctgttaatttaggcctggaaatctcatcattagatactcttgagtaagaagatttcacatgttttagttaacatataaattccaggtaggcatttttaacagtaaattttttatcttttttgtttttgacatgtcaggtgtttctttgaggattatttttttctgaataaaaatgctaagagagccttagctagtgtaccatatccctgttctactctatgctgctatagtggaaacattttttccatagtattgcatgtagttttaggaactgggaaaacagaattttgaaagaaaagaactatttgaccaatagcaaggtagtga

SEQ ID NO: 54075 - DNA, 3935 bp, Bovine  19866880893975
atatgctaagaagtcctgatgaaggtaggaatatatagtctacaaagcatcaaataagcctcgttggatttgttgcttgatgagccagtttgtgaacttgacctttgacatattccacaaaacttttataatctagtataaaattgtaatggtgaatgaagcaacatttcaaggaaaatgagacttaattcttgctactccttatcctcttgcttatatttgtccaatccttcccttctctccttagacctataaccaaacacatgggcagtaaatcaggactgtttgttcaggctctgcatgacagatacctaacttctccccctcaaggaaagctggactcataaataacaatgttctagcagccctcaggtaccctaacctcactgtgtagactgctgtcttcagttcacttcctatttctgaccagattggagatttattttaggagagatctgaaatgccagtctctgatatcttgcagtttcagggttctgggcacctagcagacattcagtaaatattggttgattgattgattgatttgattttcacaccttctggttaggaaagtgccagagtatcttacattgtccatgttggtcaacatttatatcacattcttttttttatttgacagtgttggacactctcagagggaatgggtcagaataagtttcaacatgtacaggcaagcagttcaaagtactgatttcttccttacatattctcacaaatgagcttttaaatattattaaagaacctatttattagcaaacagggacaaagcaggtacacattctgaccctgccagaaatagtcactggagtcagatatacagtattctgaagtcaggataccatggaaatttctgtaggtggctttttgcagctggaggtcttctgatgccaggtctggaaacaggagcagacaccagtcctcacagcggagataatgatactgtgatactttttataccttattcagtcaaggatgttgttcaaaacaaaagttttgtggtgtatgtcaaaggtcaagttcacaaactggctcatcaagcaacaaacccaatgagacttatttgatgttttgttgactgtatattcctaccttcatcaggatttcttagcatatcaggagtgtaacggatgaattaggaaaacaataaatcatacataatgtgttgttcttccatgtgtgggaaaaggaagcatgtgagctgggtggaaagaactcagggtcctaggcagaacttggtttgtattctggttcatggagcatccttgaacaacatgggtttgaactgcctggatccacttatcagtaggtaataggcatgcatgctcagtcattttcaactctttgccaccccatggactgtagcccatcagcctcctgtgtccatgggcttcttcaggcaagaatactggaaagggttgccatttccttctccaggggatcttcccccaaaccccagggatcgaactggcatcttctgcattgacatgtggattcgttaccactgtaccacctgggaagccagtgggtccaattatacatggatatttttcaacagtaaaatgttacaatgcttcacagtccacatttaattgaatctgtaaatgtggaggaactggaggtctaactgtaaattatatgaggattaacccccaagctgttaagtgtatttctagaatattttaaacaaacccatatcttaaacaccaaggagaacagttctaacgtccttaacgtggatgaccaaaccatgaatttcaccagtgaaaacttatttctgacagtcatactaactagcaaagtttctgctattgactcaggctctgataacagaatctcctgtatagggtggtgagactagtatgtgagctatcatccccgggctgagaattcctgattagggcagttggttacaactgagtgtgacgtaactagatggcatccattctatccagctactatttatgctgtgagaagagagctttttatagtaaatgggctttcagtgaggttcattttgtgtgatgattagaactcctcctgcatggacagggttgttttctaaatgctaagactgaatgaaatgaaagagaaaatttggaaagcttcttttttgtggttacatgcacagcaaactcatctagaatgttcacaaaggagcaaagcgacacctgttcggaactacgtttaggtaagggttggtttccctggtggctcagacagtaaagaatctgcctgcaatgcaggagagccaggttcaatccctgggttaggaagatcccctggagaagggaatggctacccactccagtgttcttgcctggagaattccatggacagaggagcctggcaagctacagtccatggggttgcaaagagtcggacacgactgagcgacttcacttcactttccagtgttcttgcccagaggatcccgtgcacaggggagcctggtgggctacagtccaagggatcacaaagagtcggacacaactgagcacattcaaactgcaacagcaagagggaacagtcccctcaacactcccttcactcctgacgtcaatcacaagttgggaagtggggagagaatgggtttccaaaaccagtctcagtttcagcaattctctagaaggacttagagaactcctcgaacgctattatactcacagttatggtttgttacagggaaatgatgaacatcagtcaaaggaatagatacacagggcagagtctaagaggatgacaaatacgaagcttctgttgtcctctcccatggagtcaggatgtaccctcacaggattgatctatgacaacacacgagtgtagtgataagcagggaagctcacctgtgctttggtgttccgagtttttactggaggacttccctggtggtccagtggttaagaatccacctgccaatgcaggagacatgggttcaatccttggtctgggaagattccacatgccacagggcagctaagcccttgctctgcaactgctgaacctgcacacctagagcccatgatctgtaacaagagaaaccacagcagtgagaagcccaagcatcacagctggagaaagcccacgcacagcaacaaagacccagcacaaccaaaaataaaataaataaataaaatttttttaagtttttattggagcttcatagcatagtcctgatttcccagttgttgaactcagtctgcaagccacctgacgccacgtgacccaaactcccaccataaatcacacggttggtttttctggcatggccagcccccactctaagattgtcagatgtgactagtgccacaccaatccagtgtggccagcccccaccctaaccaaagacacttcactcgtgtatgacaaagattacttcccagaagctgagggcaaagccagacatctttgggggaaacaagtccaagatctttactacaaagtactgctatatgaatgacggtccttaatccaacttctctggaaccagatctatcaacccatttatagatagacaggaacaaagggtccaggttcaagaaaggagctgtaaaaaacagagaaacgaaacgaccaagtaacatcatcttaactatattctttccacaagagatgtctcatgattcttaatgttatacccctgaataactctcctgagatcccagctggttttctaaggcaatttcagcaaaattaaaaggttaagacacactgaaacctcaccctgcttctttctattaaatatagtttcagaatctctttccttccccccagaaatctgtgttgagaactgaagagatctttactgcagaataagcagctctatacctttgttttgtggctgacacctttcagaagaaaaataataatttagcatgtctcttctatttaagttgcttgacaaccagactacccaa

SEQ ID NO: 54076 - DNA, 1850 bp, Bovine  19866880951122
gatgctgcaagatatttaaagggacagaaattctttttaaagaaacactgaaaaagggcttattcagccaaaaaaagaaattgctgattggggatttaattatatcggaggactgagtgtgtgagggagttcttaaaccgaggagtgaccagctgtttcaaaactttacaagaacagatttcaagtgaacagacttaaatggcagtgaatgagatttagagtagaatagaataacaattttcagacataaaattttgatggttaaataccggttcaataacagatggaagaagcatgattttgtaagaacacgggtgttggggttaggtacctctgttttagctaccatctcccccttttagctgtatgatcttggacccagaacttaaaccctagactccttatttttaaggctgaaatgagctactataaataattttagcagatttaatgtaaatttagcagatggagaagagaacttgccactcagtaattgttagtttgattgattgttactcccttgtataatttcatttcttagatgtgtctaaaagatacagccagtatgctctgctcaatctaaactggcatatatgatattatttgaagttcaaagaaatgatatttccagcctttttagctctgaagactttacattttctatcacaaagtgattttggggcctaaatgcctaaccttctgagaatccaggtaaaacagataggctgtcagttcaatgcaaaattatagggactaggtaaaactctttttgctgtcagaataatgcaggggcttgtgtttgggaaaaagcctgaattatttgacaaataatagtttataaaattcagctacggttaaccaccgtgtattactggatttcacagaaatatttttctattgtagatttaaactccttaacagataataaaccccgacagaaaggcatgtaaaatctagaggctcgttcacggaatccaaattgacgttgatcactatgccttcagaaattgctgtagtttgcctgctgggtattcactccctgagacagcgttgcagccagtgtctttgcttagctttgggcactaatttggggtattacacttttaagtttgagaaaatctcacagtctttcaatttcccatggatgaatttaaagtagccctaatttctggcttcatgggggttattgattttaagtgtatgcagatgtatcctagacctcaccagcatgaggaatacaaaagatgtcacatttaaattaaattcaaactgctccctttgcctggtacactgtagtacatgaaatttcttccttttggattctttagaatgacctcctttcgctaatgtttttccaggacagtgcctccgtaagcctgtgctgccaggctgggtactgcctggcctttgttccattaaagagagctgacttcagggtttccctggcctacggttcctgttcctcaatgttgccacgattaaagcctccatcccaaatatctgcttgtgttgccacctgggcttctgctgccctctttgctggcctcagagggccctgatcttctctttaccaccatggagatccagtcactccctagagcagcagctcagaaatgacccaggagaagtacaccacccagacagacttctcattggtcactcactcatggctcctctcaggcttcccaggtagctcagtgataaagaatctgcttgccaatgcaggagatatgggtttgatccctggaagggggaagatcccctggaagaggaaacagcaacccactccagtgagatcccatgagcagaggaatctggtggactatagtccttggagttgcaaagcgtcg

SEQ ID NO: 54077 - DNA, 2476 bp, Bovine  19866881015099
tgtatatatatatgtgtgtgtgtgtgtgtgtgtgtgtgtgtgtgtgtgagtagataactgagtactcctccatgacttttcaacacaaattaaaattaatctgagtcttctgatatattgatcagaagtgcagtagttacccattgggggagcctctctctcttaaaatttccatgaaacctgagggcttttccaattcaaatagggactgaaagttcagctcaatttccaatgtaagagtggagagattgaatcctcttcagtttgctaatgctattgcttgcggctgccaagttgggtggctgttgacaaaaccctgctccctgctctgacagatgctgctaattcacatctctacactggccaagggcactctgccagtgttgacttttgagcgaggacaactttaatgtctcagagccacactcaacaaggttgccctttacttggcttcccaaggtcatggttcttgctattcggttaatttcattccttttcagaactagaaccgattattttcttactgcccctggagacctctacctggaagttgggcagcttttctctttctgttcttaaaacacaaaaggtctgtctatacccattttccagtcggttcactattctgagacatattctgtatgtccctctagtcactctcctcaaggttttcctcaaagaattcaaaattattctttgattcattttcttgatagaatacatatgtaagaatcacagtagagcacttcggctacatatatacctaataatgatcatcacttaaattttagaatgttttacagggtttaccattattaattaatgactcattattttattcttcataaccattctcaaaatcaatgttacggtgtttctttgtgatggtggtggcacagtatggagtaatttttctctctgggcctatagtttacataaaattgttaccctcttgacttttatatatcatgggggaaaagttagcatgccagaatatgaacattgtttcctcagtagcaaaatatgacatgcgtcctggatttgctttgtcaaaacctctgacaaaagggtgagttttctcttcgttgttgttgcttattttttcttatggtcgtgtcttttaaacttcaaatgccatgtgctagaaattacagagaagtagaatggtaaaaagagataggtattcaaaattagggcttccctgatagatcagttggttaagaatccacctgcaatgcaggagactcctgttcgattcctgggttgggaagatcccttggagaagggaaaggctacccactccagtgttcttgggcttcctctgtggctcagctggtaaagaatttatgtataatgcggaagacctgggtttgatccctggattgggaagaactcctggagaaggggaaggctacccaccccagtattccggcatggagaattctatggactgtatagtccatggggtctcaaagagactgagcaattttcactttcactttcataaaaaaatatgagataaatagcatgatttattgaaatgtcaatatctcatatatttaacataaggactaaatattattataaatcttgcatagtaattgattacctaagaactcatggtcttaggtagtttcttaaaagttgttagttcaaagtcaggactcaagtagaatatccttaatctctgttcaagtctttctaccatgctggtcagttttagtctgatgtgtcagaacaacctctggagcttattatgattagaaatgccaggaattgccacatatttagtaaattactatctctgaaggtggagtctaggaattagtactgttatcaaactcaattggaagttttgcagtatcaaatttcaaatcaccaaaacacatacacacccactaagaaaaggctaagaagaagagaagtgtgcctttgagcacaaatactggaggaacccattagtgtggggttttaacaaaggggtaatggcgtgactgatttctatattgttactggtcctgcaagtaacctacgcttccttgtgactagtattgtccagacaccttgctttgagccctctctttgatgcatgctaaagaatgtagcaatatgaagaataattaggaatatttttgctgtaagaacaaatagactttgactgcttacagtgatgggcccagttattttactctcagttccgtgcagttgctcagtcgtgtccgactccttgcgaccccatgaactgcagcacgccaggcctcctgtcttgtaaaggcatcgctccattctctgcctcattgtctcatggctgtctttgcttcttgtgtctctgtgcccacgtggcattttcctcttatggcaccagtcttgttggattagtgataaagttgcttcagttcagctgctcagtcatgtctgactatttgcgaccccaggaccgcagcacaccaggcctccctgtccatcaccaactcct

SEQ ID NO: 54078 - DNA, 1524 bp, Bovine  19866881023043
tatcttaacatataaactaacaattagaagttacttagggctttctgtaacttagtttgaactgtgagaggtcatgactgtcctccttgaagtgctttcccagtgtccttgaagtagatctttgtgtgtgccaaagagcctgattttagcggtcatccttcgtttggtaacagcacaccactttcccttaatggactgactgtcggtgtaggtgccctgcccttcgtgggtcaaggactgagtgtgtaattcaagttacacttactggctgtattacaaagaataagaaaatgaaaatgaaataatattaaaatcttttatattattaatggatcaagtaagaatagtataaacatggcagatttatgaaatgttctatcaatgatgtactcatgcaactaggaatggatgtgtaagaactttaagatatattgctttgccttttccaatatcacttcttgcattaaaaaattaaaggtggacacatctaacataattatcgaaaatagtcctatctaggcagtgaggaaagcattaaaaagtactgatgttcatttccagtaaaaatgtgccacttttggaagaaacatgacttttagaatgttaagtcttctatttttaatttgtggactttggaaattattcgataattcaaaaagagagttccgagtcccagaataaactcattgtttgcacctcctagtggagataatctgtaatgacagcatcagtgttcccactaggtatgtccccaggatgatttaattaggccaaacgccattggtgcccggtttacttcttaaatggccttgtatatgggtatacttgtcaggtacaagcaattaaatctcctgtctacacaggatgccctgtgatcaaaattcacattgtaagctcctaaaatacttatgatgcttggaggaaatgttttattcctagtgactccctcaattgccgacttacaagctaatatattgctgtgcataaaccatgcattcaacttcagaataatccaattaccctttagaaaaaattaaatgcacttccagtaataaggcaaacatgctccacttaaacaaacataaaagtttgcccaaattatttaagaatggcctaaaagaaatctaagtaatggatgactggatgatggagaagatattcatctctagggagtataagattctcaccagaagaaccctgtaggaagatcactagtctagggaaattgttttgtgaaacaattacctggctctgcaaccttgggctaagctaatcctatctggctatctctaactctccattcttttatcctaaaacaaagatgatttatattccgcctagaacataagactgtgaacatatataaaaatgaaaacttttcttcttaatttctaatacatgccaaacatttaatctcaggtttctcgtcttaaaatttagtgcaagcctcaaagtttcactcttccttgtccaaaccagcagtgctcacagttatggggctcggagtctcgttgccatcgtagc

SEQ ID NO: 54079 - DNA, 729 bp, Bovine  19866881086096
tccagttgacctttctctgttacctacagccaaagacattatacaaagctcaaagaaatggccatctcctgaccccaagtcctgtttgctctagaaatgcaatatggcacatgtataaagaacaccagcaacagagtcagacataggaatctggataattcagactctgccagggactgtatgaacttggataagccacttgcactctaagcctcaagtttctgtcaataaagggacaatagccactattttacagggcatgtggaaagattctgtaagagaaggcatgcaaagtgtactcagtaaatagtaaccaaaatacaaacacacatacactctaaaggcaactctggtagctgttttcaaataggaaacaaatcaagtgagaaaataaacaccattcaagcagcaggataaataaaactggaaaggcatacggcatcctggacaacatctaagtataggacttaaagcctgttttttttttttttttttttacacttcatgcaagacaaagtacaaaaatatttctattttcttctgatctcttaagaacttagcatctgaggggaggatccctgaggaacccaggatctgagaagtaagtactcgatgttttagggcttggagattatcagagaaggatcgtataatgaggatgagatggagaagccggtgatgtaggtagggcaaaaataaaataaaataaaattgaatatactgatgcag

SEQ ID NO: 54080 - DNA, 996 bp, Bovine  19866881086878
aataagttcatctgtattgtttttctagattccacacatatgcatcaatatacacatttgtttcgctctttctgatgtggaattcacagatgaccagtatctaaaaagtgattcttcatgatttaagggtgcctgtccatttttcccatgttgctttatgtataatatataaagttgtgaaaaaagagaagggggatggcatgtttgttcttatgaggagaagaaatgtccaggagccagaaaagtagcatctgctcctgctgcctgtgactaaaattaagccctaatttagctttcaactaaaattatcataattgaaataaaactaacaaactagaagtgacttgcaattttctcatcatttagaagagaaggggccaaatggtaacttgaggatagtgatcttcttccctgcagggtggccttatggtattaggtggataaagaccattgatggagttgtacttcttcccaagtcctccaaatccatgatcagtgagtttatatggagaaaactcaaggaggcgatggaaatgagcatcttgggaatgctcagaacctagagaattatgtcatttttctttatttgactgttctttggttcttccttaaagagagactttcacatgcattcacactcactcactcactcactcacacacacacacacacactacatacatccgtatgtggattacatatacccatttatggactactatagatataagattatatacacacacacatacacactgctgctgcatacacacttcagacacccgtatgtaatgtgtgtgtgtgtgtgtatgtgtgtgtataatcttacagctacagcagtccacaagtactgatttaagaaaacaaaacagcacttgctacaaatatgtgctccaaatatgtgttcaatacaaactgtaaatattaacacaatgatgataatttaaaaatatacaaccagaagcgagcactccagggttcggaaagaagccaagt

SEQ ID NO: 54081 - DNA, 1144 bp, Bovine  19866881104212
ttcgttctccaaggacgttacataggagtctctggttatggcttctgatgagatttgccactgagtgcttcaaaatggcagtgaggatttcagttactcctcaaatgactcctttcaaaacagaaacagaaaaaaaaaaaaaaaaaagactaccagagctctccctgacatagtatcttggggtcgtgtgggtgtgtgctcagtcatgtctgactctttgcaaccccatggactgtaaccctccaggcttcctttgtccatggagtttttcaggcaagaattctgcagtggtttgccatttccacctgcaggggatcttcgggacccagggatcgaagctgcatctcctatgtctcctgcattgtcagggggattctttaccactgcgccccctggggccatatatcggagactgaatattcaacttcacatgttttccttcttcctttgtcctgaaaagtcattctcatgccggagtgagtgcttggatcttttactcactgttttctttgcaagatagttgtctaatgctcttcctcttcagattatgaaattgttgtttacttcttcattcaaagcctgaagcatatctgagtgtgtttcttgacctgaaagggaacttttagaggaagagagcacaaaccttcacaagcgcctggttctatattgtctctcaccctgaagttttcattgagattgtgaaaacattcagttctaatatgttttcctcactcttttgcaattgtgcatagcagtgttgttatgcaaatagactgtgttgaggcatcaatgtgtacagaaaactgacagagaaacacaaaaggtttgaaagtgagccttgttgaaattcaaattggggtgagattcatcacatgctatttcccatttgaagttttctctgacacgagagtgggtcgtttttatttctgatcgggacatcatttagttaacttcaacactgccagtggccagcagccccagcatgggcccgcagctggttggagggcttccggatggccttcagcatccccaactcagggaacagatgccaagacctcaatttctcatagtgagtgggatcttggatcaatctggtctcaaacctttgatgcttctgtgagtctgcttcctttctgtgccaagg

SEQ ID NO: 54082 - DNA, 1332 bp, Bovine  19866881108999
ataaaagaacaaaagaagtccaaaaggaaagctacttttaacaagaaaacaatttaaactacaaagtatcaataatataacattttagataaaaacacaaaatttaaacttattttacagctttcttttatgtcttttttaatattcatttcttgcattaccataaaagagcatacacaattttatgtcaccaagaaatcattccgactggtaacacttgggaaaggcaacatttctttatatgatcagttggataaactgactgccatcggcagttcacatctagaattcaatttaatgaaatgaccaatgattttctctccaagctatccaagttgtgtctcattacccgttaagaaccaagaattactaatcaccgggtgaacagaaagccatacatgaaacatcacaaaacagagccctgcttctttggggaatactgcttgtacacagcatcaccaattggacaaaacgggcccatgatatttataagctgctgttgtgatgcagtcacagagaaaggtaggatctgaagagcaaactgccttcactacatcctcgtgggtgtctgttagtcccttcagtcgtgtctgactcttggtgcccccatggattgtagcccatcaggctgttctgtccatgggactctctaggcaagaatactggaatgggtagccattccttctccaggggatcttcccaaccagggattgaacctgggtctccagcattgcaggcagattctttaccatctgagccaccacatccttacccagtcctgaaaccttgctccatctctgatcacctgctccttccatgaggtggagtggaggtgagggaagggatggggattagatacaattttgtcaaactacattcaggctggcaccaaatatctgttatagcccagctcacattctagcatcatatctctcttttttctcagaattcagttgtatttcaagagtctaaacctcaaattcttaactttgctcctaaagttataatgctcctcttactttcatatataagcctctttgcctggttttctgtttaagattttggagataaatatttctattctttgttggtctcctatttatgctaactggacagacattcaggtcacaatctactcagggctccaggctcagttatattctgaccagttctgtgctttcaataatttacttccacagtgtttagtaaacacctttaaaataatggtttgtggggataggtagcctaccttagaagctaacctagttaatacagtctctataagcaataaagcttttttgaacattgcaataatattaccaaaatgcaagt

SEQ ID NO: 54083 - DNA, 1757 bp, Bovine  19866881194290
ttgtgtgaactacccccagactgtggattcgagtgtggtcacagtctgcttaggagcccgcagtgccctatgcttgagaaatgtttaatcgcacttgaaaagggcatcgtactgtagaaaaactgaatgatttagacacttttttgtttagattcattctaaaccataaagaagatcgattaatcataccaatatcttctccacctaaaaactctcattttctactttaaaacatgatttagggttttagtagaaattagaatttctttatttcctttgcataaagcatttcaagatctgcgtcatccaaatatatcacgcacatctcagtcctatgcttagataccggttaagttgaagtcagatgaactttctgaaatccgagagcacatgatctaggattcttgtcaaggctctcaagaaaagctgaggatggaaagtgagaatctaaatgtgtctgttgattacaaaaggcaatcatgacaagaactgtgtttcttgcttttcctcttgtgtaagcagagaagaaagtggtgtgttcctttcagggaagattcaggatccatttttctctagagtaggtttggagtaaacgttggtagaatcagttaaaggtagaaaaatgagatttaaaggatttcttcttttctagaggcatctttgcttaacccccagactagtatagtaccagcagttacccaggctcctcctctgaaagtgttagttgctcagtcatgtctgactctttgtgaccccatggactgtagcccttcaggttcctgacccagggcttggaccctggtctcctgtattgcaggcagattctttactattaagccaccagggaagcccaggttcatgctctgacaacctcaaaatgtggagtttctttgtccccccaccctcagagatgagttctgctgtcagaaacagagcagatccatcccactcctccactcgctggttctgagacttcaggtaacttacatcctctccgagcctcaggtaatcagctgaaaaagaaccggggtggtgatccctgcccagtctgtctcacagacttaacatgaggcaggataaagtggtgtgtatgaagtgctttggaaactggaaagcactctgcaacaagctctaaagagaaattaattatttgtcaaatttctctttctctgcctgtgctctcaccctgctcacctttgtttcttccttcctttctctgttctctctgtgtcctactcacctctgttctcttcacaacaagctcacttccttgctcttagatcctcaccctgtgtgcttcatcaactccccaactgaaagaatacgaatgggggaaaagatctgttactactgttgaaagtttcagcacaatgctctttcctattttctccttcttgtcctcaagtatattattcacagggcttctcatacactgtagaggctttataaatattcctattcataataacccagagagtgatctatttctgcatcagcgatggtatttactagttacctatatcactgatcttcaggggcttttctcctggggcaaatgcaagctcattatggtgctctgttaatctgctttctttcctgtacttcctagtggagactgattggaggctgaggttgcttgggaggttatgatactgagtcattagctttcaaatctgactccttgaaaccaaacagaatgtattttctgctcttgcgacaatatttttcaatatcataagattcacattcctgctttt

SEQ ID NO: 54084 - DNA, 1032 bp, Bovine  19866881253109
tttaaaaataaaataaaatttaaaaaaataaataattaaagcaaaatacgattaaaaaaaaaaaaacctctatataaagattccagtaggttgcaaaccccacactaacaccaggtaggaaggttttcatcactgttttacagattgagtgtgtgaatgtgagctaatttacatagtaatttgtggtaggatcagttctgagtgtgctgtgtactcagttgctcagtcatgtctgactctttgcaaccccatgggactgtagcttgccaggttcctctgtccatggaattttccaggcaagagcactggagaggtttgtcattttctactccaggggaccttactgacccaaggatggaacccatgtatcttgtttctcctgcattggcaggcatattcgttaaggctgagccaccagggaagccctggtgggtagaatcagggcctaaacccaaatctgggcttcagaactgatgttctttgcctcttggctttactggatctaggaaatgctgttgagacagaatcagccaggtaaaggcctttctttacctggaaaaaaaataggttcacattaagtttggaagtacaaatgaatgtcttgcaagagtctgctcatttagctatcagcaattgtctggctacacagagttctataggacagcgtctcagatgactgccctcaactgttttctacctcacagcactcactagcaagttaacctgtcccgtgtatcattagtaattcatgacttatttgcgaaagtgcaggaacagcactactacagacctaatacaatgaatatcctattaggaagaaattaacaaatgaattgttgctgatcaataggtgttgaagagaaaattacaatgatagtaaagcctaaataatttatacacgatattgattttttcattacattaattattccttatagcacacataaggaactaggagaataaaactttcaaagcaaagaaatttatctaccgtagtggattgtagcctgaagtatgaatttaaaagacaaa

SEQ ID NO: 54085 - DNA, 1465 bp, Bovine  19866881270044
atttccatgctgctttgtcaaagcaaatttaatcacagccagaacatgtggcatccatcatttccacttcagaagacatcaccggggacagatcagcgacaaggagcctggctgccatgtctgtcctccactcataggaaaattaaatttaactatagatccttgataaatgaggccaccaaagccatcaaacatgatgactaagtgctcagtattaaagtaatccccagaggcccccaaactagaaagaagcacagtctcatttgatctggccttgaggtcttggcacacattcacacccttgcaagggacagataaatatgggcttaagtgcatagccccagggggccagagatgatttttctagaaatctttgcttggcctttgcttttccagaatcactatcacagctctccctctcacatattctatctgtcttttccttatacatctctttgctttctctttgttctttaccttatgagacattgatcatccaagccctagaatgactattgtaccttgattgcttttaaactgttccttctcccacatttcacagtattcttgccccagctccaactcatggaaaataagactagaaatgttgttttgtggaatgcccaaaactgtgagctgtttgagggcagggactatatttcgtttttttatccttagaatttagaagtttgcatatggcacatggaggtagcttgattaatgtctattgcatgaatgagtaaatagtaaataaatgcttatgaaagtcagctgagggctctaagagccatatatttttgagtttgatggagatgtatacattgactgtattgttaaatgtctcaagaataattatgtatacctatctctttgaaattgtttaactgtctagctaatctagctaattgtttaaaggtctagctgacctttgtatgcctctgtttgctcatgtttaaatggtgtgtttaaccatatctattccatgtgtttattatgagatttaaatacaataatgtattgaggttgagtagcacatggcctgccatgtaaacaaagaatcaatatatattagttgccatcatagtcaaagtcatcctcacttataattagttacatgctctttgctcagcaccagtgtttgtgttgtagaggaggtaagaaacttattaaattctctcttttcttagaaggaatttctaactgtctgagaagacaaaaaataaaaaaaacaaatcaaacacatacaagaacaacataccaaggaaatgcagaacaaccctcaaaaggcacagaatttcattgttgggcctgctcaggtgtgtaggtatggggaactctgcgttagtgggagagaatctaggtcgtagaggctaagtcattgcagcagagagtcctgaatgacatggagaacaggggtgtgcctggaactgggtgggcccaggaggatattaaggaggccagccta

SEQ ID NO: 54086 - DNA, 1462 bp, Bovine  19866881273738
aatcgcttcagtcatgtctgactctttgcaaccctatggaccatatcccaccaggctcctctgtccatgggattctctaggcaagaacactagagtgggtttgcatttccttctccaggggatctttgtgacccagtgatcgaaccagagtctccattgtctcctgcattggcaggaaggttctttaccactgaagccacctaggaagccagtcagaaattctagccatttatcctctgcccaaatatttatggtttaagaagttcatcagattattgtctctagtagcccctactccaaatagaatcagctaatttgtccaaaactgggagcttggtcacataaattatggtacatccataattggaacactatgctcctatggaagaagattaaataaaatggaaaatacattcccctcatatttttaaggttttgctcagttgttcagttgtgtccaactctttgcaaccccatggactgtagccctccaggctcctctgtccatgggatttcccaggcaagaatactggagtcggttgtcatttcctcctccagggaatcttcccaacccagggatcaaaactgtgtctcttgcatcagcaggaagattcgttaccactgaaccacctgggatgcccttttaagttttaaatacttattaaaaatacaatgtacagtatgatctcaaatctgtaaaagaaatatatatttaactgtggttatatcctagtgacgtgattctaaataattttcattctcttctcttgtttttatggtttttcattgctcatattttccataatggcaatctactgcatttctaactggggttaggcatggggatcaatgattaaaaaaaaaaagaaagaccagctacctccaaagtattctccctttaatgttaccaagtaccctgggaaaaagaggacacagagccttggagggaagaactatgggctttcctctccccaacatcctcccaactaaaaagagtcaagatctttgggtaataagtcagataaaaattcctcagtcaaaagggtctggctgctttgtaagtaagtcaccgtcagggaggaggtgacagcagctgggtggggggaacgcatggtttctgtgtggggcaagataaggatatgtgaatgttcccattttctcatcacaatgccggacatccttaaaaccaatggctctgacagacgccattgtcagcccccgagagttctttagtacaacatttaacaatcatcgttcccaatttcccatttgcttagaacatcattcttaaatcccttaatttgttttcaagactggaataaaaggccttttcatcactgtgtcaaagggcattctgattgccaagctctaagtgctgtgattccccctatcagatacagaacagtgcagataatactccactgagataatgaagaatgggcggtccataatgagcgtgccg

SEQ ID NO: 54087 - DNA, 1205 bp, Bovine  19866881280340
acttttgcttgggtgagtttgagatatcattgagttcaatatattgaattttaatctaacagagtctatcaccatgaaactcaaatttccatagctccaaatcattgagtgatacctaattcacctgtttcatcctttattggtgttctaagttcttacaagtctgtcacatcaggaggtacctacagagatactgctgtcaagaaacagattatctgtatctcttagtgttcataccctagaactgtgtttaattctctctagcatttaccttagttcaattcagttcgatttagccattttttcacaaatctaggcagccttgacacaatccctcggccaagagttcacaagagaaaaatcgggactggttcacacaatagacaagaaatgaaatcagaccattcctggctggcatctttggacaaatgtgccatagaagagtaagtgatgcatctgttagtccataaaactggagttctaacaagtcatatattttctattctactaggacagagaatcagaataagaaatcttaacttcacagatagaatactcatcggtctactcaatctattgcaactatcagaaaccatgctttatatgggatatccctgagactataaaaaattcagattgagcacaatctggattataaaatcacaaggtagggatataaaaaaagtatgaagtcataaagaaaacccacagagagagtgtggcacaaaatatacagggaagcacatgggaagtctggaaggagacacgcaatgacacataaatagaaaatatgtgggaaggcagtccctgaaaaaaggcctatggatgtgcaggtgcttaattgatgctttagatggtagcttaataaggagacatccttagaagttcagagaaaaaaaatatgtatgcaaagtagaaactaaaaggttcatagaaggacatgaagtaacaacagccagagagaatgaagacaggcaaagatgaggaccatcttgtcataactgctcagattccattttcatagagagaattacttaataaacatatctttgccatataaaaatgattcatctcaaggttaaagtgtttatttattattattctattactacttattactttattaataaattgtgcatatgtttgggaatttctgcattatatgtcattcgagtgcccagctacttgttttcaccatgtcatta

SEQ ID NO: 54088 - DNA, 1542 bp, Bovine  19866881345174
atataacccataagccatggggcactgtcatcatgggaaatttgggtctcgatgtcttgacagacctggggcccaaactggttttgcaagtgtaaatgtacaaactggaaaatattgagcaaattgacactgaacctcaatttcctcatctgtaaaatggggataatgccttgcctttctggcaaagaatatatgagatagcataggtaagattccccagaactacatttagaaagtactcagcagacaacagttatttatgtccctaatcatttgatcagcttggaagtggtgttctcagcagtatacttactcttcaccagatatcggatagaaatgtgatattgcagaagctgctgcaaggtgaacagaattcaggcaagtacaaaaggcagaagaaaagtgttttaaaagcacactgaagaacaacctcaaagagcacgtttatccctgcaaaccactgataagcagccgctgccgccgccaccaagccacagaacgtgttaggatgcctcccttgtagcagcggtgctagacaggatcatgagaacgaaagccaggacccccgggtaaatcagatctgatcatagccaagacggccctgtgccacaagccgagaaacagttttcatagcaaagtacatcgcagaaacggttaatcacagtggcctcttcagtcacatccaacccacaacacaagcctcatcacagacagcagcatccttgaacttgaaggacaataaactaaaaaatggctccatcggtccactgtgaataaaggtgaagaacacacactgagagttatgagaattcacacttagatctataaaacaggaaagggaacttatctatcagcaaggctgattagaaatagatatttaaaggaacatttgggggcagagggagtagcttttctcagaaaagtgttttacatattggcccgcagagtcaaacataacagaaaatagtcgactgtgcacaatttacttggattttcaaatatctttagataaagctttaagtcctagggtgttttatacccacacacaaaggtctccatagtggaaggcatccaggcattactttgaatcacatcaaacttgcaagacccatccacagaacaaccaccgagtgcatgacaatgtaaagtcaaagcttaaacttgtggacgtgtgccacgcggctcagcaggagaaaggtcactagagacaggggagagaaacattcgatcgttgtctacaagcacgcgtgctactgcactcaggagtcctgctgctccagaagacccgatagagcaaattccaatgacatccctggagctccaccttcctcagatcttgaccctgagatgatggaccttgtattctttgtgctctaagcccgcttacctttcctcttcctcttttcacagagggaacatacttcggaggacctcctctgttttcactgcacagatggaaggtgatgcctcaagaaaaacagcaaggctagtttgttcgtcaggaggaaaaaaatatatacgcatacatatatgcacatatga

SEQ ID NO: 54089 - DNA, 948 bp, Bovine  19866881375585
tctgggttccccttctgcaagtcccacttgctaagagggaatgttgatctgctgtagtttggcctgacagagcaaagttacaagataattttttattctaacaacaggagaagagagcatttaccttcctaggtggagggtaattttcaagttaaacagcaggcaaaaaggcaaatctaaaaggaaaaataaaatgaatctccccaaagtctgactgtgagaaaagatagtattaaaaggagttcagcaaagacagctacactgcaactcaggatcacggaggtgaagactctccgggggactggtactaaaatataaagaaaaaacctggagtgtaagagtccattttaatgctagctctatggagagaagcgtgacagagagcaaagaaaactgcataaaaagactatgaagtgtatcgtagaaatggctttgcaaacctggtttcagacccaggtaatgaaaggaaaaacaggtgtggctaaaacgtggtcacaaggtacttgaattggactagtgacttgtcatgggcccagatttctgaagcaatgttatagacaaagctttttctgtgttattcattgtagacttatctgtaagtctgtgaaaaagcagtaggatccctctatcctttccccttctgggtctacagatgtctgaagtccatttgtggaatcccctcaatttagttcaagcaccccatttcctcacaactacttttctttctatgagactgaatatacaaattaaccatgtgccaggcaagaatactctgatgggttgccatgccctcctccaggggatcttcctgacccagggatcgaacctatgtctcttatgtctcctgctttggcaggcaggttttttttttttttttttttaacactaggaccacctgggaagcccaaaatagaccaggctagaccatatatataaaactcgacccgc

SEQ ID NO: 54090 - DNA, 4012 bp, Bovine  19866881484492
tatgaaatttaagtcacttgtctttaacaggaagttaagtaaattaaatcgtgtatctagtaggtagctctttttatgtacagagagtgcatgcagaaaaatacacaaaccaaagttctagcatgatttggacataaagaaactgaaatctaaataaaaatgaattaggtgaaaaatccctggaaagttgttttatggtgacagatggaccgaatgccttcagggacaaagcaacaaaattgattcttgagaataaatattgatttgacaggaagtcagacaaactaattatgtgagtaagtatatctactgtattttaagcaaagtggtgccaaaaacaagctgggaagaaatttactgcaggtagttgctgatgtaactttggggtttctccagtccacagagatactcttataacctggaaaatcacaccttctctcccagaagttctcccacatgtctccatttctcccaggtttcatgctggaaatctcaggcattttgacccccttctctcctttggttcctctttgtcactttcctttttgctcttgtataaatgctgagcatcagttgaacaatagaaacacagacctcgtctcctgaagcttgcttttttattgggggttacttctggctgaggctacgaatgctgtgagaatgatcttagcggagtggggtcttgctatggtcaaattctggtagaatcactgccttattaatttttatgatgtataaaagtcactgttttaccttttatacattctttttaaaaatatcattttccattattacaggatggtgaatagagggccctgtgctatacattagaaccttattgtttatctagtcactgttttacttttaaactagagactattgtgcattctgtgtccctattgttttgccaagtcaaggccaagttcctgatttcataattcgaagatctctatcggttgtttactccttccctattcacagatcttagccccagttccatcactttgtactgccatccatccacctaatctattcccatctgactcattatttctctccccacaactatttatttcacgagattcaccaaaagccacatttgctttatctctctcttccggggtgtgtgtttatttatagatttgtttcttcttctttttttttttttttgtgaaccatttgagactaaattgcagacatgatacatcaccctctaaatacctcagctgcatctcttaaaaataaggatgttctcctacacaaccattatcacatctaagaattcagcactgatttataatattatctaaaatacagtacatattcacatttctccaattttgggtggaaaaagtcatttctctttctttccagaatccaatcaaagaactgtattgtgttaggctgttagtctctttaatataggacactcctggacgatgttttgtgacactggtatttttgaagaatatacatgaagtgttttgtagaatatccttctattttggtttgtctgatagtttgcttatgattatgttctagttaaaccttttagcaaaaatactgtgtaggtaatacgctgacttgttaccttttctttcttcatgttgctctcttggcttgaaacttctcctacttctgttttgcaaatccattttagttaaattcattgttatgtggccctcttactgtactaggtgatctggttgtgtgacgggaacatgaagggtatctttccagggaagctttatgatacacactctccaaggaatctttgattaatactgtttccagtgatcttgtctgcctgaatttctatagcactaacagtggcctattaactgtaagatgactttgactacttatgttcaaccttgtaatatggtataatgtgttagtatataatatgttagtgtatatgaatgtattgaacaagtttccttgtccagtaagactctaagttccctttaggcagatgtatgctttttcccatttttttctcttgttggttatagaactcagcactgtgatagaccaaaggcagtgtttaagaaacattttttgagttgattctggtaatgtcttcttcatttgaagtaattgttaacagtcttctgcactgaaaagaagctgtagcatagataatacaataatatatagctttggaatgcattacatgactcttgaaaaatcatccttttatgtcatccttattatgtttgcctaagaccatgatcactttgtgttccttgagtatacatttgaacactgtggaaagataatcagaagtgtgttgagtgattcagatttttaaattaactatgggtgatcatcaaagcaaataatccacacctgcaaaattaatcatttaaaccctctgtctacatgtaagattagatggttaaaccgttatgctattcggtacaggaatcattcttctcatggagctatttatcatctgtctgtgcatgttggttaacacattttcctttggaaatcaaaaagacagcacagaatgcagagaattataaaatcatcacatccatgttgaacagaatagagtggggaggctggtataaaggttcttaaattttgcattgtgctttattattctacattaggggaaaaatatggttatagtcatgggccaactggatcactccagtttcccaaaagccctgatatcatctgccccatgcagaactaatcaattactaaaaagtgaaactttgatgctttattgtttgcctgtttattcattcatttatttagtttggatccaccaatgcacagaagctttgcatgatgctctgaacagggagttccataaagcctgtattttcttccactttgtgcattaggggccattgtaggttactgtgccaggtctcttgattgctggccatctggtatagccatggcctctgagtcttagagccatagagcccccagcatgaatttaccacccattctggtataaaacaaccatttggctaactttgatgatttttaaactgtcaactaccccctggtctgccttgactgtcacaaattcatctgtggtttggtcactggaaaataagcttcaaggtatttaatcatatgcttctggttacatccaaacagtatgtgttgcatttgaatttctggagcttaatcaaggagcaagtgtgaaaatattctatatggatattcagaatgggtcaaaatgcttgttgagttattttagtaataagttagatgtggttttaagaacagtgagtgcatggattgtaattagaagagtttaatattcacaaggatggagtgtcatagtttctaaaggattgccatcatacttatgcctaataaacatattctccatgaatatgttaaggcaatattagtttactaaacaagatggtgattataagcaacaattaattaaagtgatttcaaagacttctgcaaacaaagcacattgtataaacaaacctttgaattagaatgggccgtaggcctagatatgtcaaaaaatgtgatcatatctaaaatttctgacactagaaaagaaaaatatcattcatcttaaacctttttaaagcctctaaaacttcttgccattgggtaccattcttttttccccagttccattgagatatagttaacgtacatcactgtatgatttttaagtgtacagcataaaggtttgactcatatatgtatatgtattatgtacatagtgaaattattaccccaatacatttgattaacattgtctctaaagatacaatacaaagaaatataagaaagaagggaaaacattttctccttgtaatgagaactcttgggatttactctcttaacatctctcatacacaacagtgtgtgtgtgttagtcgcttaggcgtgtctgactctttgtgactccatggactgtggcccgccaggctcttctgtccatggaattctccaggcaagaatactggtgtgggttgccatttccttttccaggggatcttccgacccaggg

SEQ ID NO: 54091 - DNA, 972 bp, Bovine  19866881529756
acaaaccttctttagaaaaaaagctgtctagcccaataacaacaaaactctgaaacaacaatatgaataggaatatttcaggtaaattgctagaggctatattttgttttctaagtaattgcatttctcaaggattgatgatagccttctgaaaaacaaggcactgtaagctcactttgaggaagatttctcccaaaggctgcctaattcaatgcaaatatatctctaaaagaaaacaaacagcaaagtgtccctcagtaaccctcattctagggcgtttctcaaattctgccttaatccatgctgtggggtgagattattactaacccaaatgtttcttcaacatgaaacctgaagataatttgcctagaaaacatggctctgttgtattactttggttcaaatctacacacaattgaaagagaattttcctgtccttattatttgcatgcagacaatcaaataataagaaagcaagacagaagatcatgtcataatattcctcatctacctaagggcaacacaggtgtttgcataagacctgaatcagcaggctcagtacactgattcttaggcgggtggtctagaacaccaatgacattattcacaagcaatgaccttcactaaacaaaaatacccagtatgaaagcaacttcaaaaagaggacgtgaaatacaaaccaaacacttttttgtagtagaggatagttcaaggtcagtgtgtgttactaaccaccacaggagagagtacaaattcaataaacatacccaaatgcaatatgcctactcaccatgtttaaaaagtagccaatcaataacaaagagaaagagtggtggcaatgcataaccaaatctataaatattcattaggcagcacagtgtcatatgacacaaaactcatatgcttggaatcccaagtatctatcaactaccaaccgtctgaccttgggcaagtcttaattttagaatcact

SEQ ID NO: 54092 - DNA, 1520 bp, Bovine  19866881590728
tattttgaaactaaattttacaaggatgtagaaaatgaaaaaataaaaatcctccaaggtataacccacagagaaatcctctctttgcagtttggtgcagttgagacatttttatgttcatagtcatccaaacagaaattttcttctcattttgggccatttaaatattgactcattttatttttgcttcatttttgcccagtcttcaaattttaatggaaacttcttttgaataaaatgtgtaatatatatcattcactttatgcattggggtagaatcgtttcaattttactagatactctggttagtattggttgtgggagagaacatgaacaatttatgaggctcaagagacttaagaaaatataagtaggtaatatctcttagacaaactctaaggagtaaataaaaagctatcactttaattcattctgtccaacagaaagaagttataagtgaaatatgatgggatcaaaatgtgtgcttctaagatggttcatctacttcagacctgatgattagtgaattgttatatttttcagaatttagtcattatttcaaaataagattaatgtagaagaggctcctataatccacagggacattgttaactaattattttccatttcttctgtacaacatattccttatctttaaagggaataatagatctccactgataggaaagattactctcaggtcccaaaacatataagaacgggagtggaggcttttaaaaaacctgttgataaattatttaaaactgactgagttaggaaaccaccagaagagaaaatatttactaaatgaggtagaagtcttaaacccatcaatgctggaatactttaaagccccttgcctgctcttcccacctctccccttatccaccagttctccaaatgtcagcttgaaccctctggccaaatcctgtttcagggaatatacttgtggccttggcacagcaggcattaaagatgccattaagctgacatctgctcctggacacgtgaaccttaaatggcctgaaagataatgtgccatgccaactaaagagaaataaaaagcaaaaaaaaaagaaagaaaagaaatgaatttaaagtatacttaaatgaaatttgaatttaaaggtgtgcactggtgtgtgctcatacacacgtatatacacactcatatgttccacttgctttagattcatagcactggtacagaattggaatgccataagagctgctctgatagtgacatatgtttcacattatttttaaagaactcatccttatactctttttgccaaagtgttatattatcattggtgccatttatatctctgtgacctttgcctgtacagagaaaagttctcttcatattcttttcaaataagcccaaacatacatagctaatgcaacaaaggtatacgtcacccaacatgatttgtcatcccaaagcactgaaattctttccccagaaccctgactccaaagatgctctcagtagctccatctctaaaacgcattggaaa

SEQ ID NO: 54093 - DNA, 966 bp, Bovine  19866881735739
ttacaactctttttcctggctatgatttattagaccgtggtactataaatcatgctttctgattccctcttctctttctgaaataagtgactcattctgtagggccaagcttcctcctttttattccttttatttttcattttcactgaagaccttgttttcatctatcccagttgtgttcatgtcatttttcttgttaattctctcactatctgggagtgctcatttaaagaatatttctataaaagtcatagctcatctaagaaatacaagaagtaaaaaaacttaatatatgtgagtccttaagaaaaatgcataggttttagtgtataagccatatttttgctgggaagcatgatataagtgaaattttatcttattttgatttttttctctttctgtaaagggtgtaattttcactgggcttggagaatgtgaattcaaattacaagtcaggtcataagcaatgtttatctctttaagtcaaacttctagaaaaccataaagaaaataatcctattttttttttttttttttaacaacactgcaggtgaataccatacgtatttaggagctaggagagttttaaagtgaatgacggggtaaatcaataactcccacatggagggaagaaatgattttctattcagggtatcaaacaaaactaacgtgatattaatggctgaatgaacaggcttcccatttgcacttgcatgagggggaggttgaggattggcagttgctcatataaatcaagtctggtaagaactgtatgaataagtgtttgacattttcagttggaaaggagcagcttgtcttcagttctaaaaagtcttacccttgtgacagtcatcttttttcctcttttgatgaaccagatttttaatatcaactttgcataagcaaatgcactgtaggccagagagcagagttttctgaggcagcaaggtagccaagacgacaggg

SEQ ID NO: 54094 - DNA, 800 bp, Bovine  19866881872867
ctgtcctgatactgcattggaaaatctccctgatactccatccagaagggctaagcaaaatcaatatggcaacaacagactgctgatgcattccagcttttaagtgggatgttgttatgattaactatggcccagctccttacctctctattatcccagtgctatctcaaaacacctcagtcgctcatcacattcaattaactctatatgcttcctaaaaatgcagcataagactgaaagaaatataaaaggggaaaaaaaaaagatcaattacacttagctttcagcaagattggaataatacggttttccctttttgtctattttggttaaagaccaatcaatatataagaatatcttgtgttttaaaataggggctgtgaaaatcatttacacaatctgttcttttaagtgccatatgcttagctagaaattatacagaacccttgaactttttttccgtattactaccccaaagaggaaagaatctttttaaaaactttataacacctaattatattaagcaatctgtcactgttgatttttcataatccagctactaatgaatatgtgtatctctctaattattagaggatagcaggagaaggcaatggcaccccactccagtactctcacctggaaaatcccatggacggaggagcctgggtaggctgcagttcatggggtcgctaagagtcggacatgactgagcgacttcaatttcacttttcactttcacgtgttggaggaggaaatggcaacccactccagtgttcttgccggagaatcccagggacagg

SEQ ID NO: 54095 - DNA, 790 bp, Bovine  19866880354223
gagaaccatgaaagaaaaagagagagaggctccttgtcacctcccttttttataagggcattaatcccatcttgagggtatcacagtcttggctatgtctaaatacaaccgcctcccaaaggccctacattttgatactctcctattagggggttaagttttaaacttatgaattttggaagagaaaactcagtccatagcaccaagtaaccattcagagtagatgctgtgaagaccacaatgataggtgaatcagagtatctccctgggaaacttgctgcaagattttaatgtatacattcatgcagagccccatattatttttacctcttagtagagccaactaaaacattgggagatcaggtgatttgtccaggaaatgcacatgaaggacacatgctggccaacttgctttgtttgacaaagattgcaaggcaccgattctaagagatctgtacatatgactaggggactctgttatcagcatgggttatttggcttttgtccatattaaatgttttcatggtaaaagcaatgatataaaaaacttttaaaattttaagagaaacactaaatcattttaaaactcgcatggttacatctatgtgtatttgtacacagtaattctcttatattgtgtgtatatatattgtttgtatataggcagatatgtatacatgtgtggatatgtatgcataggtatgtatatgaactcaatttttattagtgatagttgtgttctacaaaaactagcatatattgaatcattgttcctagagaaaatacaagg

SEQ ID NO: 54096 - DNA, 2126 bp, Bovine  19866880395022
caagagcatcaccaacaggacgaacagcagaggctgggaaggtctcttacttacattaaaaaacaggttgtctcggtcaacaacgttggcataaccagggtgtgtgctatccgtggcgggggggtgggggggtgtgggtagggtggtgaggggggagatgcatgcgcactcgccaaccggaaggccacagcccaagccctactttcaacgctgcctatcctggtgtcaacagcctcaagtaaacagggagaaactttgccttacaatcctttttatggatgaataaaatatcatgttaatgaaacataaaagggcaaagttgctggctgggggaatctctaatagagggaacaggggaatgctagcgaaaggactggtgagctcctagttggtaacagatttgccacaacgcatcagaggaggccagaaatacacaattctgcctctctaatggaccaggacaagctcaagcacttccagggacataggggtcccagggtgaagacagcattcatcagagtattccatgctgttttatcatccaacctcctcctggggaactattcaatgggcaattaagatttataatccaaatgatctcaaaattctatctctgggaagtcaagtccaaattaaatcagaccaggcttttaggcttccaaggatcacattttctcttttgagccagtgcatttcaacactcggaacttctcctcttacagattattttcaaggccatctctggatgcaatctcctatgcaaaatctgatgtataaaatgaaaaaggaaactggtaaactccagctctcagagaaagaagctaagtgggaggcactctaacttccttaagcagatttttcaaaagttacttattttaacctcctttctcataaatattactggaactgctcctaacccaatatacacagagaaccttatgaaacaaaaatgtccaaaacttaagttattgcatatggaaagactaaaacacaccggcagggctttgaaatataaagtgtataagaatagtatataatagacatctattatttagaacattttaaattatcacacttctcccagtgttaacagcaccaaggcagtgaaacaggtaactgacacacggcccagccctgcacctctcttctctgacttctccccagacttgagacaacattcatgcccaggagggacccgcctgaccagcctagccctagaggcaaggagaggacgaagaaggaaaaggaccaggaactcacatttcggtgatgttctcaggatctgcactggtagcctccagcttcggaaatgccacgatgccaggagaaggatcgccgcaccagatccgagaggcgctgcacttgcaggatgtgggacaggcaagagcggccctccagaagcccacaatcaaccagcagaagccccagagccgcgccatggcgggtccatgccacctggtccaggacgacattcctagccaccagtgccagcccgagtcagcctgagtgcgtgtcgctgagctgtcccggccggtctcccctgcccgcgccgagtggcctttgccgcgctcaccgctgtctcctctcggtgctggtctcaggcgcgcagagccgagcgtgtcaggggctgagcgtgtcctgtcgggcggcaccgttcacagtggcaggggcatctcgggccttctcacagggggcgctaccgccgctcgcagctccgcggcggccgccgctgcatggcccaacgagccgagcaccggcccgcggcgctcccgggatgctctggggctcaggcttctggctagacgcgcgctgcgatccgggacgcacctcggggctgaggacaaacagatatgcgtaaggctgagctcaagaccccatacgccactaattggggtactctccctccgcgctcgcgtcacccccaccgcaagcccagccgggatactggggatagatgagtgcccagttccggccggccccagaaataaacttgcccctcgatggcactgacgccgcggggcaccactgtgcccactctctccctgtgcctaaggctgaaggagggaaaaatggggcaagggacaggatcccatagcaccggccagggtaggactccttaaagggag

SEQ ID NO: 54097 - DNA, 2810 bp, Bovine  19866880408381
tagggtcagaaggtcacagggcttttcaattgttttatccaatgtaataaaaacttcctcagcgtagagatagaaggtatgaaactgagatttcaaacggctgtgctgagctgaactgtgtgaatgccttcactaggaagaaaaagtgtttttaacttgtttgcaagttgtattgaataatgaatgatgtaaataagaccgcctaatttattaacaagtccaatctggcttatgcaaccacaatgaaaacaggctgtagttcttaaatgcatgtaaagcacaattcaaggctctagaactcccaatggaggggctgagaagtaaatatcagagtgataaaatctgatgcctttgaatccttttaaatgccagaatattttagtacaattaactgcagcagtggaaaagcttacgcaggtgaaagagccaaaattaatgtattaatgacataacattacaattgcttaacaaagccaacaatgaattgcacacagaggcttgagcagcagaagctacaaatcctatttatgttgtactaagaggaaaaatattagattggtctccaaatatcaatcccaaatcagcaaatgtcaccaaagaaatttacaaataaaaagtcattgctggtctgcataaaatatgggcaatataaaaatgaatgccctttcacagccatgtgaatacacttaacacgtctgaacagtacattaaaaatggttaacgtggtaggtagattttatgtcatgtgtttctttttttttaattttattttattatttaactttaccatattgtattggttttgccatatatcaacatgaatccgtttctgaccatgatttttaaaactccatgatctgttttatgtttgaaccatatctcttaccaccgggtgagacagaacatgtcttttgcgaagcattttgacatattctgaaacttaaatggctgattacataactctaacaacagactttactcttgtatcctgtttatgtgtgacaatagtattgtttgtaaatttaacttagcactgctttgggataatcatctccaaataacagaagctggcacattttggcagggtgacgtcaggcaggtgtgaagtgtaactatagatggatatagacctagacatgggtcacatcagtgggtaaagaatatgagacagatactgtgaagggaagatttttaataaaacagcttcaaacaagaactctgaaaatgaaatgtcagcatggcttaaaacatacatgtagaatcaaaaaataaaattctctcccttaattagtctataggtatattttttaaatgttccaccatggcttctctctgaaccttaaaaggcacagtgattgcgacttttcccctgtgtgcttagccgctcagttgtgtccaactctttgcaaccccatggactgtagcctgccaggctcttctgtccatgtggattctccaggcaatttccccaacatatagatattaagagatttactatttttaaatgatatagtaaactgcttcagcaagttctaatcacaatttagctacattagtcctacttttaaaaaaccgaaacataatttcagctaaactttattaaactagaactttaaagcaggttattttaggaatatcattgggtctaacaacaaagtaaaaaaaaaaaagagtgtaatttcgttccaactgtagctggtatccactggccaagaattgaaaagctgttcaagcaaatattaatatgtaagaaagagagcacagatggtgtcatactaaggatgagagtgaaacaagcccaaccactgatgtcattttgatatcaaagcaccagaattcaaaataattatatgaagtgctttccaaacaaggatctcaatacattttacagataaagacactggggcagaaactgacgagtctcaaataaagctgagggaacgagcaaagaaaagtacttcttctcagagctcacctctatcagcttgactcctgtttctaaactaattccccattcctatacactgagcttacacacctctccattccctgaatctcaatggattttcaaatcagaagaagaaaatgagtagaaattaggaattatgattactattattagatgaataactgtgacaaacgctttagtaaatgtaaaaaaaaaaatgtaagcctgaaaataggaacctgccatcagataaaagggaaataacaacagttgtgagaactgatacaggaaaactctactcaaatctgttatgaataatttcatatctatcaggcagctaagaccactcaggcgtaaaatagtattttttaaagagagttttcctccaattacggccttaaaaatactaaactgaaaaaaataataattagccctatgtttcctccttcattatctatctagaacctaaaacagagttttaaaacaatcacaaaagaaaacaacatctaactgtttttaggcactcctcgtggtctcaaaatagtctgaagggctctgaattccatatggcttcctccatctaactactgacaccccatctcatgaaaaatacacaaatcccgacaaaaggccacagactctgaccaacctgacgagcctctaccagcccaagccggggtcggcgtggtcaggaccctacccacccttcctctccagctctgcctgctgctctccttgccagaaggattgctatctgagcatcctggatccagcctgacagctggctgctcccggcacatcttagcactgctgggccggcacgttttcctctggtctggtgtcatttccttctgcctgagcc

SEQ ID NO: 54098 - DNA, 1374 bp, Bovine  19866880452894
ctgtgctaaggggtgctgggttccctggcacttagaaatatcgctgagctatagcagggaggataagttccttgaagtgatggaacttgaacttgtctttaagagacattccagagcaggtagaaaaatagatcaaactttccaaaaggcatgagtaggtttggcctgggtgaggagccacagctgtttgctggctgaattcagggcatgaactggagattgcagaagcctgaaacacaaagtgagccatcagaatgagccacagggtgtcctgggggaggggttatgtgtatggctctagataagccactccaactctctgaatttaggggcattatttataatatgaaggcaagccgatgtctactcaagagggtaattactgggctcaagtcaaaccactgagcagaaattctttgtaaaggtaagctgctgtgtggtgacagatgattatggtgggaaagtagtggcaagtggttaattacagagcaaaaattccagtctcttgggttgaggaaaataaaaactgtaagccaagtcagctctccagttaagtggattttcccatgttgtatcagctccttctggtacatttagtgaagagcacattcctgaccaaggttgatcactggaaggtctctcctggcaccaccgtgtgtctggcaatcagagcagcagttctgactccccatgtcatacttgggatcactttccatctcacaaatatttaagcaagagtgtgagggccagctgccaagttgcacaatacaggacaaatacctcattgtgtttgtcgctgcacagtatgtggtgttgtgagatccaaaaccacccggtgactgtgactggaatgcgacggtattctgtaaccagggtggctctttctttttattttgggggggccacttttgtgacatgatccaaactcctgagaaaaggtggcaaaacaaatactcggatatgttctaagtgggtttagaaaactcgtgaaccctgtctgaacttttattagaagctcccaccactggcccatttgacattagaacaaggaaagcattatttataatggcatgtgtgaaatctcagagggggtcttggaaacattagagtgaaaaatctgtcccaaagagactgcaagtgtaaaataaatgatcagatgggaaaacatgtaaatcaaaatttgaatccttttttttttcctccgttaaaggacacaggagccttttctttggctatgagcaacacaggacagagaacctgtgagagaagtggttgtaatgagaggtgccctacagtaccggtcactgcagagggaggacgtgaccgccctccgtgggaaaccagtagtgttgactcttcttaatgtatctagaa

SEQ ID NO: 54099 - DNA, 1610 bp, Bovine  19866880454686
ctgtataacacagggagctctactcagtactctgtggtgacctaaatgggaaggatatccaagaaagagtggttatatgtatacatataggtgattcactttcctgtacagcagaaactaacacaacattgtaaagcagcttatactccaataaaaattttctttttaaaaagaatttttaccatgttggaaacctgaattcagttcatcctcattttagttcaagaatctctgacccttggggccaagagattctcttgggtggtcagaggtactcaggtttcatcaatgttaatggatggaaaaacaaccaccaggagatttggagtcattcagcctagataaccaaatggccaaagtgactatttctagccacttgctttttttgcagtgtcaggttgctgtaatggactatacacactccctgcaattaaacagtctggtgcatttgacctagagaagatggatgtgctctattgaatgttgctgtctgacgctgctgccttataacactatatctgcaactgaggacaatgtatgagcagcctgtcctaaactagaccacgaaaaatgtagtctttattgtacttatactccctcaacatgttctagaacaatgccactaattcttagtacaccaattcatacacatacataagacaaaatgttcatgaaataatgcctgtcatcactatgtgtgacatactctgagatgtcctattcttttgtttaaggacaattatcacgcactgtatcaaaaacttcacaactcacgaatgggtcccaacccacagctgtaaaatattgttccagaaaagcaataagaactaccatttcatttatctaagaattcaacaaaggcctgtcaagcactcagtgtccaagctgctgatgttgggctcagacatctgttctccatgaagttaacagtcagtcaaggcttcataacaaaagagatagtaggaatcatctcctactatctttgattttgaaggattgtctccttcataatcaaaggagatagtaggaagaggttgcagaggactacctctgtctgaggaaatgcaagaaggcgttgcggaagcgaagggcttgagcagtgccctgaaccatgaaggggacggtgacatggacacgtgggcatgactgctggagggaggggaactggagaatgtttaccaaggggctgggaggtcccagctggggtctgagtcctttgagatcctggagattgtgaatcttctatacaggagacagggttatcttagaaatcctgtccaatggcctgaaagtggtcatgattaaatgtgcaagtaaattccttccgtttagcctcaagtaggagaggagaggcctgcgttgggaggcacactgaggaaagaggtgtatgcagggaagccagggttcaaagcaagcacagggcgactgggaacaccagggagaagaaaggacagttgttgtgggtaccaccctgggacctctccagactcccttactgctgtacaccatcttccttggaagaagtgatcagatgcacacatggcttgcacactccacaccaccctgtaacaaagctctggcagaaacaaagacatcaacaattccagaac

SEQ ID NO: 54100 - DNA, 712 bp, Bovine  19866880458548
cgcaatcatgcttgcaccatagccagtggatcaaatgattttgccaaggtgaattcaccctgtcagacattcccctgtctttgagacagcttatgaactgctgcacaatttctgccagtgctaccctagcaaaaacgtccttggcttacaaatgtctgtgcgtttgtttgcttaagggacccagataacctgtgggaggcagccgaagagacctccccgtgagcaaaaagagctgaaaaggcaagacatcatacaagtaccagtaaatggagaccaggatgttgatagaacatacttattagtgactcatagggagcctaattctccttgaaattaatgagaagcacttgaacgtctacctttaaaaaagaaaataaaccagaattttttttttctttcagtttcttttccctacttgaatcaggaaaaccaggattgagttcctaaattttccagtttataaacccgtgaacccaagcaaagtacacacaaagcaaagaagtacacctgagaaagtagttctcagactttcatatgctaaggcccgcccaaggagctcaccaaaatgacaaattcttcaatccacttgctagaattctgattcaggtattggcattttaataaccccaggtaataattcccatacagggaacagggaaaccacactttgaactagctgaacactgacccaaaacctgcaagacttcttttt

SEQ ID NO: 54101 - DNA, 2562 bp, Bovine  19866880473368
attttttaacttgaagtgattgaaagtgaaagtgaagtcacccagtcatgtctgactctttgcgaccccatggactgtagcctaccaggttccaccgtccatgggattttccaggcaagaacactggagtgggttgccatttccttctcgaaccctggtctcccgcgttttaggcagacgctttcccgtctgagccaccagggattgagaaattacaactgttgacagatttaacctaaaggtaacaagatcccatgtttctttctttttatttttggctgcactgggtcttaactgctttgtgtgggctttctctggctgcagcaaatgggtctactcttcgctgcactgcgcaggcttctcgttatggaggcttctcttgtggagcgcaggctctaggcacacgggcttcagtagttgcagctcacgggctcagtaagttgcggctcatgggctctagagcactggctcaatagttgtggagcacgagcttagttgcttcaggtcatgtgggatcttctcagaccaggggtcaaacctgtgtttcctgcactggcaggaagatttcctattcacagcaccagcagggaagttcaatcctgcattttgtgaattagaaaaagtggaagctcaagatcagaaacaaaaatgttattaccaaaaaatacactccattttgtactgctgaacttgagaattgtgaagtttgtatccactacacttagatttgctccaaggactcaggtatgagtgcaatccaagcagaactggcctttctcatcatcctgaatttctccaagtcttcagagattgttgaactgggaagagaagggagatggggaaagacgtggaatgaggcagcacctggaaagattatgagaagtacaagtcggaaatgagggaaggaaggaaacaggaggatgcaaagaagaaagcatcatcatctgtcttttctgaagtcccagaggggacagattccctcgctcatcatttttcaggctgggggcaatgcaagagggaaaggtcaggagttccaggatagtgggaagatgtctgcagatgatacagaagagatggatcagatgcatgctttgcagggagcatctagcttagaaatagtaattttgagaaatacaaaaataaaacactttctgtataagagtataagaaagatatgtggtgaaataggcaatgcaactaacttccaagcgcctttatatttgagctgccagagtgatatgatcatcttcttacatccaatgtctgatagcttattcacttctagtgctgtggcgcaattccagttcagataattacactctcttacctaactcctcttggaacatctattaaatatgtttcccatccctctggcccctggttatttcttattccaaatctctagtacccaagggatggtgagccatgttaagcagcatttatcacatatcttgaaatctctgaatgagaaatgctgtaaaagtgcccattgatcttctttagcaagagcaggccagcattccataggtggtccaagtcatttcctagatctcccctccttatttgcaagcccctcacatttatcttgactgtttcccacttccttaattgtaaatatctcaagaacaaggagtatatctttttctggtagcttctagcaaattataaatacaccacaaagcctggtgacagattacttaatcacacttgcaccaagctgcagccgagtcctctttgggcctgtcgtaacctcatactccagaacctccctcaccaagtctgctttccaacctatctaaactaaaatagctattaaaaaccatttttccttgtctatctgacatggacaaaactacacagtaaagaggaaaatatgaaaaagatggataaggtgagaaagacatgggagcgctcataaagggtgtcactcaggaggtgcttacaaacatccctgaatgtgcacataaacctacaaaggagtgaaacgatcaatcaatcagtggagatgtaagcatagggccctttgtggttgcagtggcagatactcacttagatggaaagcataggaaaaaaggcgtttgggtctcaattcagaatctagggaaagtcaccccctgcccccctgcccagctgtactcagagcagctgcttgtaactgggcctcaggaatgaagggaagcaagcacactcaggccatctctcaatgctgttttcctccacatatcaggttcattctgttttcttttgttaattctctagacatggaaggtatctaagagttcccagatgatatatctgcagcttattcacagcctggagagagatcctaaaatgagccccgagtccaaatgacctaggaaggccctctctggtcctgctagagtcacatgtccaccctgggaccataggatatcatcaccaggagagtgtgaatgggggagacaggctggggtagctcccgggtgtgcaaccccaaaggtcaagagctaagaatggactaaagattgtgtagaattgaatgcattttagcttaaatatccagtcagtcagatagaacagaaa

SEQ ID NO: 54102 - DNA, 3355 bp, Bovine  19866880498575
gagaaggaaatggcaacccactccagtgttcttgcctggagaatcccagggatgggagcctggtgggctgctgtctgtggggtcgcacagagtcggacatgactgaagtgacttagcattagcattagcatcactgtttaatttcactttattgataaaatgaagaatcctcatttctagatcccaatgtgattcctaaacatgatttaagcttaaaaattgcagttttaagctttactgagagaagacttctttgctcctgattggagagaatgtaaaatcaagtgaaaactacactcacttctaagactaaggtggttggctcttgaaactgtatagagagcacaagcaggggcaacaggacccatgagggatgtcacttgaggtgacatggagcctgggaagtccttctgcctttatctacaaatgatggggaagtcctagggtctgcttactctctcttagctacccccagaggagctggggtagagttggtggacaagatgaggactgagattgccctgaggtttgcagggaaacaagctgaatctggggctgttatggaacaacagcatctgctaagttctggaatcaattgataacagggaaactgtcaagatctacctaagaagggaagagagcagtggcttgggccttcacttgcaggcatgaacaaactgatgtgcgtgtgtgctaagtcacttcagttgtgtccaactctttgtgaatggaatgcagcctgccaggctcctctatccatgggattcttcaggcaagaatactggagtgggctgccatgccctcctccaggggatcttcctgacgcagggattgaacttgcatctcttgtctacctgcctgggaggtgagttctgtaccagtagcaccacttgggaagccctgaaaatctgactgaagactacagatctgccttctggcccagaattgtgcatcttctcattttgggagctgttcttgctcctcctgggagtgttctggaatcagaagggggagcagtagcaagcagagtgctgtggactgagtgtgtccctccccaccaaatttaggtcttgaagccctaacccctatgtggctgcatttaaaaacagagtctctgaggaagtaattgaggtcaaatgaggtcacagagtggggccccatcagcaggattagtgtccttataagaagagacatcagaagttcatactctccctgcagtcacacaagctacacaaagttgctaggaaaccagagctctcaccagagactgaactggctggaaacttgatgctgggttctagtactgtgagaaaataaatgtcttgttttagctccccagtccatggcattttgttatggcagcctcagcaaatgaatgcagagagcctttcctagccctgagtctgactccatatcagactggaggcagaatgcttctggagagacgggtcctggtgtagactctgccttctaacctgtgtggtctctggtaggtcacattgcctctgggaccagagattcctcatctcttaaactgagatgaaaggacatgcttggcttaccccagaagattaccaggaaatcaaattcttagtgtaacaacagctaatatgttttgaacttttgttattaatgtgtaccaggtgttatcctgagagctttatgacatatagttaaattcaccttttttagtgtacaattgtgagttttggcaaacagtcatttaactgccaccacaatcagagttcaaaacgttgtcatcaccaccctcaattccctcatacatctgtaagacaaactccccacccaaattcccaggccctgacaaccataggttttctaggcctatagttctgtcttctcaagaatgtcatgcaaatggtatcacactgtggtaccacaaagcttttctaatatcaactcattgaatcttcacaaacatattctgaggtatgtaccattattatacaattaatagatatggaagtgctatgaaaaagcagaaaatgtatacaaacagaagggattttcccactatttatattattatttcatggtgaacaaagacaaaacgaattctcattgggaaaaaaaattcagaaaatattttgactaacccagaaaccacttgacttgaaattagtgtcacaccctctatgaccagattgataaaagataacggaagattttctaggctgtaaatgacagcgatttcaggtgaggcaataatcatttcccactggaagagagagggtgaccaggttatccccggcactcctcctgaccccattcattcatggctgtgttcatggagctctgttcactcacaacatctaggaagggctgaatcacttcccatgaagtatcctctggtttggtagccacacaccacaaaagcagccatcactctttgtaataggagatgtgatcctggatatggtcataaagtgttcacagtctgaccacagcagtcccaagttctccaaggagaagattttgcacaaattgtttctctctctcttttttttaaacttcctattacagatgcagtacataataaataaatacataaggtccaactatttcttaaaatttacagatatcatgaatttttaaggaacagctcaggagaaactgcagaaacaaagcaagtgggtgtagagtgtgatcaggagatctaggagtttcttcaatatttaatgcagccaaaagcctctgacagctaatcatcccttaatggggcttggcctttggcctgcctgtttctaagggagtaaaatgtttggcttccaaatgagttatcactcactcactaaagaccacaagttgaacgtggcctcccaggcatcgttgatctttgctccttgagtttagaaggtcccacattagctgtgttgttgttgtttagttgctaaatcatgtccaagtctttgtgaccccattgaccacagcccaccaggctcctctgtccacgggatttcccagcattggagtgggttgccctttccttctccaggggatcttcccaaccaggggaatggacccacatctcttgtgttggcaggcagattcttctttaccattgacccactttattcgcctttaaattcacctttacaaagccagctgggcacttgctttggatctatagaggggctccagcctgccaccatgcctctgagattcacagaggggagagtaagcatcaccgtggttggagaatgagctgtggggaggacaagaatgatgctttgggagataaaagaattaggcaaaacaaagggcaatgttggcatttgaaagaggactagacaagtgaaatttgagagacgattcagagcaagggactcagaga

SEQ ID NO: 54103 - DNA, 777 bp, Bovine  19866880564516
acccgaggatcgaacctgtgtctcttacatctcttgctttggcaggtgggttctttgccacaagtgtcacctgggagtatctgtattctaaaaagaccaatgtacaaaaaactgctttttgctctccctactgaaaaaccactgctctaaatgaattcttttatttcttcagctcaaaagacagactcaaaaggcctgaggggaactgatctgtcataactggtgtgaagttattattgtgctcaggagatttacatggaggacctggctacccttgttattaccatctcagaaagaaatagaacttgcattctgaggaagccagtttcagttttccaaaatcccacaaacccttcagcttgcaagagaattctatcggcagtcccttggagctggctgcagtcttgtgttaaaatcatgatcccattaaccatggacctattaatcttcttatagactgttagacacaaaaccgcaggcagtgaaataacagctggttgggagtgatgaaactttaaagggcacggttgagaggcctggtgtgaaatcacgccaaagctcagcccttccagcagcaaactcgattgccatcctagacaggctggctgaaacacgtactgagctggcaagagccaccagataggtgtgaggagcctgggatgcccagctagtcatgtaactcacagcacaagccttggaagaggcagccaaaaaataaaatcctgaactcgcacagattctgaccagcccacacacattttctccctccacttccca

SEQ ID NO: 54104 - DNA, 750 bp, Bovine  19866880651947
tgagcacaaagccctggaaaggccttcaagattgcacaggcaaacaatctcctctctgctatcttggcaatatcttggcaaatcgcctatgatcagctggatctgaaatttgccccaggtcattgcagacaagtcctgagctggttgcacttaatgttccaactttgacacattccacttctctttgctagttaagagctttagtcttggaattcctggggcaagataagggtcaggatgacttcccccatcagggccctttggctcagtgtctgccacctctgggcccagccagtgcgatattttggatcactggacagacactgagaaagactatcctttaggaaagatctgctatcaggctcgacgagggaaaggaaacaggcttctttgtatggatgggatgaacacgcaataggtggatggtttagaactagaagactgaccctggtatgcttctcctattttacaattttccctataaccaactttgctaccaaaataaatgctaaccaacagatagtcaagatgaggccagatcttggaaatgcacaggcaagatgtaaagacagtgttttttcatgccttctaagcaattcctgttcattgtctctgtacccatagaaaatactgaacaaattagaggccctaggagatcacacctgattccaatcctagtaatgagatacattatctgcactcatttggtagctacaaactctactttttcaattgccggcacacagtctg

SEQ ID NO: 54105 - DNA, 644 bp, Bovine  19866880748525
caaatattgttggccttctgacagcatgtggagtaacatgacaactcttgcattctgggggtaaatgtgcagcctggaatctgctgagaaatgccttcactgcacacttcccggggagctcgggtagtagcatgctttgctaacctcgaaggaggggacagctgagccaggactggagcaaggaagcccatggagggaaggtcttattgacaagaagaaaccttagcatagcacatttccattttccacctctgggtttaagctctaggtgataggggcctgtcaaaaagcaaatcataaaacaggaatggttaagaatattagaaagaacttgtctgtataactattcttggcagaatttccactgtttacaaacaccagtgagctaggctcaagatgagcacaaccagtgagcttcccttggctttgagtgtttggtggcttctaaattggctgtttgagaacttgcttgcagaagtaagccagagtgtatcattaaaggcaatttaaatacacatccccttaagagaatgctttttaaaattacctataatagcagttggctgcctcttacatagtttaagacagctagctggggaatgtccagttgttatccctccaaacagtgataatccccatataag

SEQ ID NO: 54106 - DNA, 2584 bp, Bovine  19866880881468
aagctgattatatcacgtgtgagattagtctgtcgcctttccttgacctgcccttgagtgcgagcagccaggcattgctctcctgaaggttctgccttctcacctgaagatgatgtttggtcaccccttagcctacttcccctccagctgaataaactcctagttttcctgaccaggactgtgggtgatataaatgcaaagcaagcttgctggtaatttctgaagaccccaagaggataactcgcagaatgagaccagttctgattggttgagttttcattagcagagatcgttaagagcctgacccatgaggctctccgctggtgtgagcctccgatgtgtgggtgtgtggtcttcccagatgctattagttgctgctgtctctccatggtggtttactttataaagatcactttgtgttccttttctgcagaacctatttttttttcctccagggtaattcccacttaaaaataacgtgcaactttagtgatttcatttagagaggtgatgaagtgaccactaacatatttagcaaattgataaaaactcttccacaaattcctcaaaaaataaacattcctatcttcaaaagtttgaccagatacagcccatgaagaactaatcacttgaatgtatactttttgtcattttattgctccaggattcagttttattcaagttacggtgataggcaaaggttaaaatatgaccccagggcagagagagaggtcattcactaagtcattgctatgggatagaggtggcatatcagaccatcaagaccaaaaaggagtttctgggagcaggtaaagttgtcttcgaaggatacttcaacatcaggccaggctaggataagagtaactcgggttagttgccctctgagttgggacagcacttggagggtagagctagaagagcttagaggaggcaactgcagaagtttgagtaaatgtgcaaggaggcttggattatgtaacagtggacatgagaacgtgggcacattcagggcatgctttgcaggtcgacctgaaagaacctaatgacgacttggatatgggcaatgagggagaatagggaatcaatggtgaatcttagctttgaacaaaaatatggtggtcagtgggcttccctggtggcttagacagtaaagaatctgcctgcaatgcaggagacctgggtttaatccctgccttgggaagagtccctggaggaggggatgacaatccactccagtattctttgtcctggagaatcccatggacagaggagcctggtgggctacaatccatggggtcgcaaagagttggacacaactgagcaactaacacacacacacgcacagagtggtccatgaagatagcggtgatatttagggaagaagaagggagagacagggattcaaacgggaaagaaatttgaggacatttaagagtcggacaagactgagcaattaaactgaactgaactgaacctttaggtaagcagaagacacactaccattggaaaggggcacagattgttttgaagttcaacattcttaagttgggaatcatttctgatctttttcccccagtgttcagttaatttgcagtagcttgtttgttctgtataaaccttgcccttctctgtagtgttcttgtcttcatctctgaagacaaattcaggactgaagagaattgttatccccgagtctgtgttcacagaggagattaggagtgcttgaagacctttatgtgtttcatgcaagctatttccgtaaatggagtcaagtagatattaaccagtaaatgtcatatgctaaatgccaatgatctgtacctaaatggatgatttggtataaacaaaatataattggcaggcatagagaccttgggagggaatttgcaggaaaaaaaaatgtcatagtgggttgactgagggattgagaggcaggaagcaaaatacacaaagaaagaataggaacagacaagcattaaggacaccaaggctctgaaatcttttcccaattcccaatgtccctggtgggataccaccaggctagttttcctcctcaaaggaagctcaaactttttagtagtcaaggggtgacctcagcagagatgtaatcatataactgatggaatattgggggagtcatcaggaaaaacaaggtaatgtggagggcgcttcctacttatgtactgacagagagaagtgtgctgggaccatcagcataaatcccaaagttcaacatcatgggggctataactcagggtcctgagaaactcaggaatgcgtctgtgctacttaagggactagaagttaaagaatctctctcctgccccctcctccttccattgacagaaagagcaagggacccatgtagtcagactcattttgtttcctgaatccatcactttctggaaaagaaaatatcagttatcgctgtcgagttgtgtagattggggaagtagggatttcctcctgagcagaactcagagaaagtggctaatggctttagctggcttgcctggctggtcatccaccaggtggatttgggaaagtggtgcaaaacaaggggcaaaaatcaaagagaaaaaga

SEQ ID NO: 54107 - DNA, 2721 bp, Bovine  19866880882410
agagaataagagagaatatatcctcaaaaacacatttgggcatctctgaaaaatgaaccaaaagaaggtataaaattgggagataaactagaaagactcttggctacacagcctggaacaagacaagtgtttgtgaaacttccaactctagaaagctttaaggaaggatatggtcattagttggttcaaagtcatagtaagcacttaccccaaagtcctaaatgggctcaatgaaggtggaccaaggtcaggagagagattatttcaaatgcaatatttgtatatatatatatttttttttttttttttttatcagtaggatagtttgaaatttccaaggcttggcaccttgtctaaatatcctaattctagtaactgtactgagctgaggagcttgaaaatggcttggggagtattaggtactcatatgaactctactcacttcagtatgttagatttatttcatcactgttctagaatgggcaactgaggctcagagaggccaggagagccaggatccaagctcagttctgctggcttcaggctgctttttgctctctaaacagccatccttgtggttttctttcaggcctcatgcaattaacaaagaagataaaaacatagggaaattgtacttactaagattctgttacaatgccagctataaataaagttctagaatcttgtagagttaaacagtggatggtaagtggccataattatgaagaacggaagaacaatttataattccggtcattacttctatgcccgtgtaattatactctatcctttcatctatgtgacattatagatttttacaccttgctcataaggcagtgcatttgtccatcacatgtcctttgaatgcctcttgtgtttacgtagatgatgatttctgttttgaactaataatgtgtgtagagttacaaggtaaatagcctttcccttttaatcactttgacttactaaagaacttcctgtaaggtatggaaagcattccttaaaataatgtcagatgtttggatacactaaattttcattataagaaaaaaccagaatatattgttttcccagtgtcttggttccagttgattcttggcatggttgctataattcttaaccaagctgttatatttggtatgccatgtatgccatgcatactttatttaaaaaagaaaataaactgtgaaatctggtgtgtgtaaaaatgcactctcttgaaaattcagagttttctacatgtataaattgtacctgaaccaaggaagtatgaagggacttcctgtgttactattgcgtgaaagaattgaggcagagagaatcttgtctttcagatatgggtaaatgcttaaagcactgaggctgacatctgttccagctgctctaagatattgctgtggggttagtcagggttgtgaggtgggatgggctttttctaaaatgagctcttttgagcaaataaaaatgtcacaacggtggagacttccggaatttgggggttaagtcaagtcagggttcagctggctatccaagtctgaatgcatatgaagtcaagtcaggggttcagctggctgtccaagtctgaatgctgtgtctatgggattgattttgcacttttcatgtttcctattgcaatagagtaggttctccatattatcaagactttttgaaacgggtcacctgctgctgctaagaagtggtcagaggggttggctgtggtattaacatcccgggggttccacctgatggggaaatgcttttggaccatggatcctgttcttggtggctggaatggactggtgttctttcagactagtgagcacgtctgggacattaccttatgtaccttgctagagtaagagatgaccactggaatatgagttggattcacttctgaagggtctgatctgggactttcaatctggtcatgtccctcataggctctccaagggcaggtgaaccaccttccagaccccattgcacctcagatgttctggaggagaggcatgttttatttctcatttcaccatcataacttctgagatgatggaagtccttctgttaatgttatcctggagaaaggtcccagagaagaagggcacttttgagtggaggacctccttcctgccccgtgatagtctcctgtttctaaactcgggcacacacacttttctgcataaaaggctggggccagacaagaatcttggaagcctggcagcttcctaaatgtgcctgaagcagccatggaggcagaactgtagtctgggagcaggtccctgcgcagctgacagtcatgtccttgcttgtgcgggctgggcagtgaggaggaggtggtatggcggcaacttatgagagagggaaccatcacaggattggggagtggccacagtaactggactccttgaagagcaagagttaagccctcaggatgtggcctttggcaatttcaccttgtctgcactagagcatcaaatgcagtccacctcccaagatgtccgtttccagatagctcaaaggcctttggtttttgatcctgttctcagtcagatttggataattcatgtttattgtagtcagagagtagagattatcaacctcacttctctttgttttgctttctagaatatttggtgcttagctgaggtttcattatcttgtgcactttgctaattgaatggagatgagatttatgaggtacctctattcaagagaaggtaattt

SEQ ID NO: 54108 - DNA, 1545 bp, Bovine  19866880973450
tgatgggagtgactggcagatagctttatggttgccaactataggttataagacattcttcaatgaatttgtggcttatcagcaactctcaaagttgatctctttaaggcaagtgggtggacccaaatttgtggatggtgtgcagcaatacatgtcggtgagtacatttccttcccaatatacttcaacacatacatacattcatcaaatagctgctggtgcctctgtgtgccaggtaccatgccaggtatttggggtacatcagagaagaaaacaggccccaaatctttgacttcacaatcgggctacgttgagttaatcacagggcatgcatgtgcacatgtgtgtatgtgattgtgtgtagaaagaaacacggctaatctttaccactatgatcatttacttttgagccactatcagtgcaagtccatgagctgggattatagccaatagctcaactgataaagaatccatctgcaatgcagaagaccccggttcgattcctgggttgggaagatctgctgaagaagggataggctaccgactccagtattcttggacttccctggtggctcagctggcaaagaatctgcctgcaatgcaggagatctgggtttgatccctgggttgggaaaatcccctgggaaaagggaatggctacccactccagtattctggcctggagaattctgtggactatatagtccatggggttgcaaagagtcagacacaactacgtgactttcactttcacttcactttcacatcagatatttatggaatgtcttctttgagcactgtgctgtggatggctgccacagtgttaaatgagtgataaagcctctgttctcatgggactcgtcgtctaatgatcatgaagttctctttcttcctgtttaagaaactgtttgatctctgagaaactgcccaagtgccgcctagtgcctatattaaagaggcagtgagacacaacaactatcctccaagtgaatgagggaagaaaaaaagctcaggccctataattatggcacgatttcaggtccatagcctgcaaggagatgctcatgtctacttggccttgaatgggatgagggaatccaggtgaggctgttatctcagccatatttgcagctgagtctccagcttctacttttctgaagaacagaattgtcacacatggaaactctaagggaaatggcgaacatttcctaccaccattactcatcaaaacaatctgcttggaattaacgtcctaggcacatatttggctttaaagggaaagggaaggaaaagcatgctgttcaaggttctgagactgcccacctctgaccatctctcccagcctcccaaacaccaaacacgcagattactcccacgtgttacacaaatataacagcatactccagggaagtattgatttgtatttatggtcaggggcattttgacccacacatctgagatgaacaataactctgcaggtctcctgtttctcagtgttcattcttcaactgaccacacaatggagcttggccaaacatcctcatc

SEQ ID NO: 54109 - DNA, 1043 bp, Bovine  19866881055817
catcagaaaagataatgcatttgcaacttggcatggatgcaataaaactgcagcaaaatatacagatctatgggcttcccaagtgactcagtggtaaagaatctgcctgccaatgcaagagacttgggtttgatccctgggtcagcaagatcccctggggaagaaaatggcaactcactctagtattcttgcctggagaatcccatggacagaggagcctgccaggctaccgtccatggggtcacaaaaagtcggacacgactgagagactaaaccaccgagaatgatggggaaaacacaatgcttagatcttaagacaacctggggcaacaatgtgaacaacttagcaaactcaggacaggggaggaggtgaagggtagagaggtgcagtatattggccgtaagataaaaagaaagaaaagaggctccatggactttaaactctttttttaatgtcttaaatgttaaggacatattctgcaactttccagctctaatgtttaagcaacgatgttggtacagagacttcccctttctctgaagcctggatgtgagtttagcagtggagaggttgggaggttcctagcgcatctgatccactacctgtcacatcagcagtttttgatgaaaggctttttaaattgcttttccctggaaatgattcttcccaagcagctctccttgccttctcctgcttgtcgtcctgtcttggcagccagattatcaaaccctagagagggggacggggaacttgctctgtgtgtctctggagccagtggccaggtatttgcggccaccattaagaagcagggctcagaagagcagggtccatctgtgggaccgccttggcttcttggtaaggtttatggcttttaaactagagcttatcgcctctttaaatgttaaagaaggaagtccccatgaacccctgatggcattcaattatggtcttggttataaaatgtttcagatctttggggagtgtgagccaatcgatagactattgcagagaaggatcagagccctgtgaaggctgatctttg

SEQ ID NO: 54110 - DNA, 4245 bp, Bovine  19866881090767
ctcttggtcttcctggagcgggtaacctgggaagatgttgtgggtgctttgacacttgcaacattgctttataaagctcagtaaatgtgtgcacttcaactggctcctcgaactctcggcactctgaagtctgtctttggagaaacagatctcaagttcacctaggaaaagtgatgtgcttatcttggaggaatgaaaggtgttcaagaaagaatcaaagatctatgatatatgattcttttcctaggattttctgaaataagacaaaaaaatggcaaactttttagagtgggctgggctatgggaaggcttccctggtggtgctagtggtaaagaaccctctgccaatgcaggagatgtaaaagatgcgggttcaatccctgggtcaggaagattccctggagaaggacatggcaacccactccagtattcttgcctggaaaatcctgtggacagaggagcctggtgggctacagtccatggggttgcagagttggacatgactgaagcaacttagcatgcatgcatgcatagacagggttggggaagtaggatttgacatgattttaactagcaaaaaataaaagtaagggtttattattatttatttatttattattcatgagtatttagtatttctggtaatgactccatcaagaagacctacctgctgcccagtgggctctgctaaccttacattagagaccaggcctggggtcagtctaccactggctcctttctcctctaacaataagctcactacctgccatctggcacttccctgcctgtgtgtttgaaggttaatacactcagcttaccttgatcagctcacatgaaagggacaacaccaacagtacaattcttcttgcagagtttgaaaactgctctccattatttttggaaaagatcagcaggaaccctcagctggaaagagccccagacttaaaggaggccaactggggactgaacagaaactctcccacattaggactataatgggggttcattatttcccttcctagcctctctgagcctcagttttctcatctattaaacagagtaataatatctatcctgtggcgctgacagggattcatttgtttttttatgtgaaaatgcaactcgtaaggcctggcacataaaaggcattcaatattggttgttttagataatcaaaaatgcacacattacaaagggggctcatggcattaaggaaaaggctgagtgaaaacagagtatttaaaatctcaaaaggtatatctcgaatttatcaaactcatactaaaattccaaatgtggggaaatgaagcaatatctactatctaaatttcacttttattttaaaattttatccaatttttttctagattaattctcaattttgctaagatctcctgacccgcctctcctttctgcctttttaaaagaatctttctcattctgtcttttctttctttctctttccctttctttgtttcttttctctttctctctctttggcagtcttgttcattttatcactctgagtcacatatgaaaaaaagtccatcagaagataagagtgcctgtctgtacagatatttcagcagacagcactggatggttagtgctggggatgctgaagctggctgattctgaggaatgcatctccaggggcagatgagatgtggtgagggagaacaattaggtcaggaatgcaggaaagaagagaagcctgaaagctaatcagcccagcagctaatgtacacaaaatggcattttgcaaagaccagaggtttatacaagatcccggccggaaggaatctgagtctagggctgagttaaagtgagcagagtgagattcttgccctgtgcaaaaaatttaagggaacaccccagattcagtcattaacatgaataatgttttttattctccattatttattatcactttttcattgagttgatgtacagtatcatataagtttaggtgtacaatagtgattcacaatttttcaagattatattccattcatagttagtataaaatatactaaaatattaaagcattacaattaatgtcctaatgccatgtttttaaaaactaaacgttaaaaaaacagtgaaggaaaaaatatgaaaattttaaagccaagatttgaccttggatttgtagcactcaccctagtccctgctttctcaagtctgtctatttaaaatttggaaattttcttcagaggtttttcactaatttttgtcttttaaaatattgcattcaaatgtgatttatcttgatggctgatattctttggtgctcctttaaattctgcactttaattgagggcctcacccatattacgctaatgctggctctgccaggtgcagtggaggctgttggaaagcccagaggagcttcttaggagctaaatgggagtcaatgaagacaacttctaggatgctgttggtagtgcttttaggaatcccagcactgaactaaattctcaagtttatgtaagaataattattagttggtgataaaaagtaggcaacggacaccacaaatctgacactcttgtctttattggcataagagtttggctctgaatgattaactacatcacaaattccaatacaacagatttcatttccatcaacgagcctctatagtaaagatttccaagctccattatcattcatacatatgcgggacaagccctggagattctgaacatagtaaaagaatgcagatcatgtttcaggcctactctcttcaaacataagaaagggaaataaagttaagcaacacatagcaatcagtagagtcccctccctatcccacctccccagatcctggtgcagcatcagagggcagagctgttgagatcagcactgaaaggcagcaggcaggagcccagcaagcagtaagaggctcattgcttgttgtggggaagcaggaagaccttcgagacaggaccacactaacactcagactgggtgccccttagctgaagtgtctccttggggaacgtcatcaatgtgaattcatacaagccccctctttccaaaagtgggcataaggtatgaggaccacgtggattcatccccaatcctacaacccctccctagcttagcccacacacagaagcttggcccttgataacacagagctctgctaagagaacaaaagagggccccctgggatgtcaacaccaaggaccatactcacatatcagtgatcagaccccgatctggctaagatttgctttaatttaaaacttgggattcaatgtgcaggaaacatcagagagtatatacaaactcagagaagacacatggttcaggaagtgagtgatacggttattccctctgctacttggccatcaacttcctcgaagtccaggagttcaggaatctaaggcagagctcctggtcatcaaaatcttcctagttttcctcttcagaggccaatgctaataaaggtctaggtagggctctaggcaaactaaaatcttatatgtacacaaggaaattttagtcaaaataaaggttcttaagagagataaaaatatcctaaaaatgacaacacttggggaagaagaaaatggccctctctaaataaaagctaagaaccgatacagaagcacaactacttctctggatatcaggtactggcattagttgaactaggaataaggatgaaatgtcatcattagcatcatggttcctgaaccttcataaatagagaaaaggagggagcgtggtagaacaatatgaacaaaggaatttatactcatgggccagaggaagtaaagccaggatagagacaatgtgaggccagttcgtccagctggccgggtactctattaatagaaagtaggaatttgtccctgggtaacagtttctctctgttcattagcaacaaactaaaggccaacccacttgtaaaagcaaactcttttcaggaacaagggtggagatgagtattaggcatgagagcataaatgaatctgaaaatccatccttctttcaggaaaacatgttgggtggccactcagtggtgcagagatatcatgtaatctcctgtaatgaaggcattccataacatggagaccagctcttttaatataattagatagtgtggcattgtatcctgtcccccctatatcaaccacttattggaacattaggaatatggcacttagtctaaatgccatcattatctaataatcacttgggttccactttaatgcacccagaaagtcaagg

SEQ ID NO: 54111 - DNA, 1772 bp, Bovine  19866881137318
aggagatatcaaagcatgagatgctgaactactttagagtagacgtaatgaagaaactgggaccatggaagcaagagttagtgggtcaaactgtgagagagcaagtagcctgaaataaattcatataccatgccaggtttttaataggaatttaggtgatgctttcataggctgagcagacctttccaaacaggctggaaaggacaaatggcaaagccaaacacttcactttctgtaacccattcttgttttctctaatctaatgcagattttctgcctgtgtgctttttacacactgaggtctaaattatttttttcaatgagtaattccttaaaatatgtgggatgtgattgcatgtgtgcatttgtgtgtatgtaattactcatctatatgtaattaagcaaatatttttcctaatccatggttttttctattttattttggaaacaaaacatagtttgtttaacctatagttcaaattgtataatcattggaaattgctaattttttcattgtttcttaagtcatttgagagtgcatgatactccaatgtcctttttctccataagtgaaagaattgcatttttaaaaaaatagcatttcacttcagtcattatgtccacagaatgaaaaggaaggagttctagagagagaaattgttttgaaatgtctgtgttgtgaatcatttagcagtttaacctttaaaatgatagtttctgggttttcattgattagtctaaagagggatctatacagccaaaataattaaattgtctcagtcaaaaaattagctaaactctatgggcaagaaggataacaatccagttgatggatcagcatcatgtggaataactacccaagagagttaatttctgaatttctagccagtgcctttgttattgcatacacattctaattagtacaaatgtaaactaaagaatgttttgcattttcttagtgttcccatgcaatagcattttcccttttgattggattgaattatgaattacacaatcccatgccataaagttttactattacatgtcagtattagaggtttaggaaagggagcagagtttggtggcctttagccaaagtggctcttagaaaaactcacccatggccacactgtgaagactgacacacagcagtttccctcggctgctcttactggcaaagcacaattgttcgggattctttctcagcagaaccttgaccttaaattgtatcaaaggaggcatctaatctaagtccacatggtagccaaatgcctcttctgtgtgtgctaaggccttctcatcctcacaaaaatccttatgcttttttcagatccaccttattctcgttttgccaatctctccatttattttccttcttacgaactcatttgctaattacaaaatcatacttttgcacacgtgccacggaatacaaaaatgtagggtacagaatgcagagatgtccagtacatagtatttgttattgttgttcagtcactaagtcatgtctgactctttgcgaccccatggattgcagcacgccaggctttcctgtccttcacccgctcccggagtttactcaaactcatgtccattgagtcggtgatgccatccaactatctcatcctctgtgacccccttctcctcttccctttagtctttcccagcatcagggtattttccaatgagtcagttcttcacatcaagtggccaaattattggagcttcagcttcagcatcagtccttccaatgaatgttcaggactgatttc

SEQ ID NO: 54112 - DNA, 2343 bp, Bovine  19866881167301
aagagacaaaatgctttggtccactgacctcagccagcctctatcctcagccattgcagtaaaggcacaaaggcacacgtgtgaaatgtacagatgaccagggatgaagcaggcacctgagccatcagcatgtactccaacatatcgaggttgatctagctgtcttcatggctgaatgtccaacccgcccattatgggggccaataatgagctcttagtattggcatgaggcaaaatggccacttggtatcaagttgtcaagtcaactatgttgaacctcttttactttctcaatcctgcttccttctcttctcatccataagcattcatcccaagagcgctgtttaataaacatcttacatgctgatctccaacccagcatttgcatcccaaggaaactgacctgtgacaaatgtccgcccagtgtcacgatctatgctgggtgacttgcatgtgtcatttctgctattgttcacagtaccctgtgagatgttttcaatggtgcctacctttaagagttgaggcaggaagtctcagaagttaatgaacttgtccagggttctatcactctcaggttcagagcgacttcaaaggccacgcctgggaagcctaccatggtagctactcctgttgtaagaaaaagaaaaggacactgatgatcatttcctccaatagaccagacattttgctagatccttgtgcctacaaatcattcagtgtcactaaccaaattaaagtagagagggttatccccattttaaacatcaaataaagccaagtataagggacttccactagatgagcaaaaaagttggttgtggaatccattcctgtctgaattcaaaggcagcacactctcctccaggtcaaactgcttactcagatcaagagccacccagagagagcctgagagattggagaccctgagacacgtatttacctagaaaccacacaaactatgctgtattcactgacttatcaactgaaaagatggctatcttctttctcagtgagtttcacagattttccaaaggggtctcccaacagcctcctagaccctgcagttacctataataagtgttgttgttgtttagtcactaagtcatatctgactcttattgattccatggacagtagcccaccaggctctgtctgtgggattttccaggcaagaatgctggagtgggttgctgtgccctcctccaagggatcttctctatccagggatcaaacttgcaactcctgcatctcctccattgataggccaattacttatcactgagccaccagggaagctctaataataatggtgcttacataatttttgatccaaagcatgatatgtaagagtatcatgggacaataggagaaaaccagatggccatgagtaaatggagaaaaatgctctccctactattgcgaaaaaatgttctatgtttcttacatacactcttagttcacaattagtgcctcaaaccaaatcacattgtaagttgggttttaggagagagcgcttcactgaatggccctggctttaatgcactaagttttcccctgaaaattcaaccacaatcctggcctcttaatcacatagccgcttgagttccactctgatataaacactgcacatttccgatttgtggaattgttttcctttaattaaatgaaggggggaggtgtagttattttcaactctccgcacaaattactacccagtggaaacagaattgtgtattgtaagtagtactcattctatttattgtgccgtctattgatgtgtgttggacttgttctattttggaggcactgccatggtaactgggctcctgacaaaggcctgtgtcagagccaaacttgtacatgcagaacttcagataagtgatgaaataaagaatcaacctcagtaggctcaaaaataacaatttggagaatcatgttttgctcctgagtgttttcatccacaaagttgggaagttctgagaggcaaatcatgggatttactggacatcaaactggatctgagcaaaagggtggaaggaagtctattttcacagtctcttagcacccccctgtcaacttctctggctctgcctttgggttaggctcacagttttagggaaaaaatacaagctggtgttcagcctttagagaaccagggtgtctttagaggatttgccttgactccaccgccctgagatgtggccctgaatctgcccttagatagctcaggggcttcaccaaaccaggattctgttgccacttctatacatggaagaccttggaaggcacaggtgccctaatgtcaggttccccctgaagctggtgcagggaggagatggggag

SEQ ID NO: 54113 - DNA, 1199 bp, Bovine  19866881211297
tgtggtattggagaagactcttgaaagccccttggacagcaaagtagtatccaaccagtccatcctaaaggaaatcagtcctgaatactcattggaaggactgatgcttaaactgaaactccaatactttggccacctaatgggaagaactgacttatttgaaaagaccctgatgccgggaaagattgaaggcaggaggagaaaaggatgacagaggatgagatagttggacggcatcaccaactgcatggacatgagtttgagtaaactctgggaattggtgatggacagggaagcctggcatgctgcagtccatggggtacaaagagtcagacacgactgagtgactgaactgaactgatgatgttatatggagttccactcaatggtgaccttgtgcagaatatcctggaacatactgaaaccctctgtttgcctctatcggccctcccctttgctcttgggcacattccaggcaggggaacatgattctgtggcaagggtggtccttgtttgtttttctttctttaattaatcctaagcttctttgtccaaaatatctattccaaataggccagcctcatcacctcctttaactcttcataacagccagtttcctgttttcagtgatttctaacaaaatgtcaggaaaattattccagtggatgttaaaatgcttacattttaatttcctggtttataaaatatttaaatttgtaaaggcactaactccaagaaaacatgagaaataatgaaatggggatcatctctgaagccaagctacatacaataaccaacccttactgagtgagcacttgcaaggagccattcattgcctcatttaattttgaccccaacttactattattatccccattttacaaataaggaaactgaggtttgttagtatgaagcatcttggcaaagacacacacctgggaagtggcagaccggaactcaacccctagtctgatgtcagtgattgctctcaattactgccaggggctcctaacaccagtcacagctgggcctggctagtaacaatgcttttggcatcagcactgctgaagcaaaatatattcattttctcaaaattattagattatatcctttctacatttttttttttttttttggtttttaagcactactcttttcatgtaatagagatacattagggcattaatgttagcttgtcc

SEQ ID NO: 54114 - DNA, 1593 bp, Bovine  19866881235836
actgaactgaactgaactgaggatactcattaggattgaaagactaccttggagtcctttccactcagtactggtgggaaagggcatatccggggtcaactttcaggtattccacctgtccttgtgaccttgcttgtggcgttgtgccttggatctctctacggttggtaaaataaaggtactttaagttatttttaagggcactttcatctctggtattttgtgacttcacatattttggcagaacatttactatgttctcactgccttttgaagttccaccctaaagtgatctggagtagtgattgtaataaatgggcttaagagtgattgtagtgtgggtgtaacttgtcccttaatcttactgggcagaggacctgggggaaatgggacctggctgaactgaagaacttcaccgttttaggaaaatggagaaatttcttagtgacaatatgaatcagaaaccatatgggctgaagtaaatttggaagtccctaaaggtagttatcggagaaggcaatggcaccccactccagtagtcttgcctggaaaatcccatggatggaggagcctggtgggcttcagtccatggggtcgctaagagtcggacacgactgatcgacttcactttcaaaggtagttatggacttccctggtggctcagacggtagaacgtctgcctacaatatgggagacccgggttcgatccctgagttaggaagatcctctggagaaggaaatggccacccactccagtactcttgcctggaaaatcccaaggatggaggagcctggtaggctacagtccatggggttgcaaagagtcggacacgactgagcgactaaactttctttctactttcactttcaaaggtagttatggggcttcccttgtggattagatggtaaagaatccacaggcaattcaggagatctggatttgatccctgggtcatgaagacctgcccagggaagggaatggctatttattcactccagtattcttgcctgaagtattccatggacagaagagcctggtggactacaatccatgggattacaaagagttgggcatgacttagcaactaacacacacacacacacaaacacaaaagtagttatagttcaaaattttcttaagaatcacaatcatatttattcaagatgtactgaaattttgaattacctgtttggctccagcctcttccttgcctcctccatctctgttcatagcaggactggagactctcagccaaacatgccacctgaaatcgcctgttattcagcagaggactgagagattggtgatgagttgggggatcactgggtggctctaagtgcccctctcctccagcacctccactataatccttctactatggggaaccatcagggaacttagactgaattcagtcactgcactacagaaaagaatttgctcaaatgggtttttaaaataaaatacataagctttgtggttttttgttttgttgcttacaagtattttattttatatcaaattctaagaccatagaaaaatgttaacagcatcattattctatgcaatcaattttaaagacacatataaacaga

SEQ ID NO: 54115 - DNA, 1454 bp, Bovine  19866881235911
tcgtggcttctcaagaataattccggagttttccttccccgtggactaccatgttcatacatgcagtcgctcagtcacgcctgactcttttgcgatcccatggactgtcgtccgccaggcccctctgtccaggagttttccaggcaagaatactggagtgggatgccatttcctcctccaggggatcttcccaaccagggattgaaccttcatctcttgagtcttcttcgttggcaggtgggttctttaccactagtgacacctgagaagccctatggattaccacagtgccacccaaagtaccagttcaatggagacaagaagcttacctcagaatgtgaatcaagacctgtttccttcatcaagaaaatctccttgtgaatttctgggactcaaaagtctgcttaatgatgtaatggatttacattcacttgccagttctttgtcttgttaacagcaaccagcagtgtgaggagtggcagccaagtctacagccctcacctgaagtagcactagtccagagctttgccagggagaggaaattctaagagtgtaattagtttctctctctctaatgctgcttcctcacagaaggcacagagtgggagagagggcagcttttgcatcagaatgatgcttccagtctgcacaaaatataccattttctttctaatcatacgggaataatttttctccacttaaccaccagttttgtcctttgaagtcagatcttgtgttaactccaatttgcacagaatggtcctctaggaaactttctaatcactcacaggattggcctgtttctaatgcagaattgccttggtccctgaagtgagtcacatgcacttatttggtacatttaccaaaggaaaactttttaaaataactgaaaatcagattaacaagaatctaagcagaaacatgacacgacttggctctgctccctattcctgggcaggaggcatatatttctgggagcggttgggacatttctttaaggttaaaggaaggagccttcagtctgcttggcaagtctgtcaaagtctttcacagcagtgcactgtcaggcatctcaaggcatctgctcgagacaggacaactttttttttggtccaaatgaaaccagggatggaaatggcagtgagttaattaaaaagtatttagttgagacctgccaaggttcaaaacattatcttggacatatacatgtgaaggattggattaaattcattagagggattagaaataaggagaaaaataaataccaaaaaaaaaaaaaaaccaacaaatgagacataaactatataaatgccaaaaatacgttttcttcaaactctgaaaatagatgtgccgacttctctaggaaacatgtattttaaactgttggaaaacaaaacagtatacctcaaagtaataagggtgtgagtgttagaagtaagcctcctaacagcagg

SEQ ID NO: 54116 - DNA, 1074 bp, Bovine  19866881242104
tataattaacatctcaagtcctaacaggccggaagtgttctgtcacccctaaaaatacaaagccccatgttggtcttcttcctatggtttattaagaatttctccagttccctagttcctccatgacctctctcacctttacacatattcatcccagatgtggataatcagcactatttttttttatccaagttgtgaactctaccctgtagaaaaatcataagattaccatcagtggacatcttagtcagtttgctttttaatctataaagatttctacacctgttgtctcaatgcctccacggtccccaactctgctcccggctcccccatagcaaggggagtgtttgacaaactggaggaagaatggattaaataagggaggaaggcatagctagcatgataactgactcccctaaatggaaatacccaggatcccaagagagaagactgttgagtgggaaagcagttgtctctgttgtttatgggagggggagatttggggaaagagaaataagaagtaggatcagagagaaatgtgggattcccatcatcaataaaagaaaactcagacagtgagagagttgaggagagctgggtcaatccaggcccacatctgttatttctgacccaaggaccccttattcacagaaaccctcaagatagtcaagccttctggttgaagcttggggataggggagggccaatgggagtaccaaggactgaaatgctttagggtgtagggggacaccaagggtcatgaggcgggacaccacatgttttgttgcagtactaacaggatggggcactaagcttacccttctgtgttaagtttacaatcacctctcaaatattggggataggaagtgatggctaatgtgagaagttgggattcctagataatcttacaaattttatttcagccaggtgagaatctgtttctctaataaacagggaaatccctccattttcccccttcttcttgtttgtgccctggttcgttctcactggagtcaggaaatatacacagatggtaccattcccattaacctgccctctggggctcatggcttc

SEQ ID NO: 54117 - DNA, 761 bp, Bovine  19866881270523
cccactgcccacctcctgctgtgcagtctggtttctaattgtgcagtccacagtcccaagggttggggacccctgctctacatagcctgggtgccaaccaaatatatatggctagtgaagtaccacactctcagcagatactttttggatggatggatggatggatgcacagaaaaatgaacaaagaaacaaaggaataaacagtgtacactttttctgcatgcttaaaatcatacactgatcattaatattctacttgcaaagaatgctcagcaaagctgctctcagctactgtacacaaacgtggtccaacccagtagagacatccacagcatatatacaaaatctgggtaatggtaaccttcacagtctctctatccacaatggcaattagataattaatagcaaatagaactcattgatttaaaggtatattaccacaatggggtatctgcaggtttgccagtgaaatattcttgctgttttcatccagacagtacaaatcctgagtttctggactaggtttagtctcttgaagagtcttgatccacataacgtcacaggagcatgtaaatgggttgcccaccaggattctacatggaacaaaaatgaaattcaatcagccttctctttctcagttttagctataaaagtgtctaacaaagcactaataacattatgaattccttccatctggcaatctggtggaagacacactcatctttatagtataactacttattattcaatcattaattgaa

SEQ ID NO: 54118 - DNA, 1568 bp, Bovine  19866881305786
tgaagcagttgcttgggcttccctggtagcttagctggtggaggatcttctgcaatgcaggagaccccggtttgattcctgggttgggaagttcccctggagaagggataggctacccactccagtattttggggcttctctagtggttcagatggtaaagagtctgcctgcagtgctggagacctgggttcgatccctgggttgggaagatcccctgaaagagggcatggcaacccactccagtattcttgcctggagaatccccatggacagaggagtctggcaggctacagtccatggggtcacaaagagttgtacatggctgagcaactaagcacagttctccagtgaggatacgtgaaggtagagaaaccacttcagtgaagatgcgggtcggggatgtgaagggaaggtttgcttgagaacacatcctgccacctccatggagagggtctggactttgggacaaggtgttggagatggctgagcggtttcttgcctcagagacacaagacagagcagcatctgagccgcacggtcatgttgctgctcctgtccctgaatgtcctgtccgcagccagtgtctgagacggactgccaagggcacatgctaattttccagtcatttggtcaagtcccatctcatataccacagaccccggggcctgtgtttactgaatcaaaaatctctgctcaagcataaactaatgaacagacaattctctcttcttttaacatttttactgtgttttggaggaagaagggcaaagcctcttttgtgttggtttgccacccttccatctctttctaccagttctcatcctatagtaattagtcttgctgaactgataaataaaatgtagattagattgctttacggattagaattcagcttcaggtaagctcacacaatttctctgaagaccctggagctgggtgggaagcacagaggtgctagcactatttggactttcgggggagttctaggtttttaacatgaactatgaatcctgaactaagatagtctatttcccagatggctcagtgggtaaagaattcacctgcaatgcaggagatgcaggagacttgggttcaatctctgggtcaggaagattccctggaggaggaaatggcaacctactccagtattcttgcctgaaaactcccatgtgtccatgcctgccagaggagcctggcaggctaccatccatggggtcgcaaagagtcagacacggtaggtattgctgagtagtaataatagataatctatgagggtgcttcaggatattcagatattacactctgaggaaatatttctctctgcatttacctaggctcctggattcgggggaggccaactacctctctatggccctcttgctctaaatactgttgagtttaatgctggtgagctcctttgtcccttcaaccctagaggtgggaaaaacttccctctgtggtcagtctccatgacttgccacctcttgtttgtccctttaacctacgcaaatgtctctacatcatccctatatttcttcatgtgaaatcacctggggtgaattttttt

SEQ ID NO: 54119 - DNA, 860 bp, Bovine  19866881313058
gggcttagggacacagggcttggagaagtaggcagataagcctgtctggcccacctgccagaatcttgtacaatcactctgcataattattcttgaaaatacaaacattgctggggctgactgacaagtattgttccagcagggagggctgtcagggcaaatcaatccaactctaccacatgccagagtgtagaacagatataattttggctgttaggggctgtcaaagcgaaggatgtgccgtatgtgtattttgaagtgtggtgttccctttagtctaacagcttgaaagatttctggggctttccccctctctggctgttttctacaagaagttttgagtattttaatttgaaataactcaagtcttttatctaatgtgaatttcaggttagactaaacccaatcttacctttcctcccatagctgctctgcactcattcaacacatgattttaaaatttgatttaggaggaaaaggtcctttgctgccattggatgtcataaggggtatccaagtaggtacctggtgcactcccagcaaggcaaactcaccttataagagtctgttttgtccatcactagacccagggcaaggcttagcccgaagggtcccactgggcctcttgggagtccctgaaagtccacttcctccttcagtggcccagcatcaaagctgaggcccttagaaggggattcactcaaaacctttcctctctctgaatttttctgcttcatccatcttattggattctcagtgacttcccagtcattgtcccactagtttttcttttccttccttccctcctttttcccccttccttcccatttgtggtacctatttaatttctttctactatt

SEQ ID NO: 54120 - DNA, 1080 bp, Bovine  19866881376545
gaaggcaaaatcagcaacattgcttataagccctggaaagatggaagtttccaagctgtcataaataaggatggaagcacttgccaagtcagaaagttggccaagtttgaatccactcaatccttatatcttggagctcagaatggaacaccaaccttttgggatttgtaataacttctcagcaaaactttttgctatttataaggaagtaaaaacaaaaagcaaaaaatacaatacagaaagttttctaaaggagcattaaatcccagtgagcagtggggaggtgataatagtataatgtgctggaattaacttctaatttaatcaaacaaagcttaacatacgcaatattccttttccgtgtgtgtgtgtgtgagagagaattattacgtctttccttccttcctttctctttctcactcacataccatctcacttttcaaatacgtattccacccagccaattgtaaatttaaaatttaactgttaaaattaaagaatagataaagcatagctgtgtgtgtttatgttggtggagaggcagccagaggaaaagaaaaaagaggaaggaaaagaaaaaagagagacaaaataggtaccaagagctgggacacctttcacaaatttatagtgggtcaaaaagaattagcaccaccaaggtgaagagcagaggtctcatggctctctccgagtttgcagccgggggtccctcaagagaacaaaagagcactgtcctcagagagtgagggccagaagcatgaattcctaagcagacagatctcattagtggcttggacaagttaactttttcaagtcttttttccctcttgcaaagtatgcatgataacagtgtcaacattgcagacactctaactgtataaccagggcccaggaggtcaaagaggacgtctgttttgctaactgtggtatcttcccagtgcctggctcatgtctgatctataattgatgattaatacttaccagattttgaataggatctggctaggataaaacaagataatgtattaaagaatttactgatagttccctggggctcagaggtaaagaatcgcctgcaat

SEQ ID NO: 54121 - DNA, 736 bp, Bovine  19866881379088
cttcttccttaatgagagtccctttgccatctccagccaaggtcaaagtcacatacgctaaggccagtgcttggaacattgcagactacttcttactcccacctgtgcttttctaaattcttccgttcctactcctttcttccttcttccctgacctaaagaccttgtactctgcaagggaacaaggaagtggccatgtggggcaacagaaagccacaaatatgcagtttcctggaaacgtcctttgttgaatctgcccctctttgctggatccaacataccctgtttctagacctttgcttctctcctgctttgcttgcctgcatctgcccctcaattaagcaaatactttgtttcaaacctccctggctgcacaagtcagaccaatactctctaaccaacttactccttgtatatgttcctgaacctttagtcttgagtggatgagaaactcagaatgcaataactagaattagaaaaataaagattttttaaaagctagagaagttataaagtaatatggatgacagtgtaggatgatcagtacatttccaaagctgagcaggtcagcagagtaaggtaactggtgtggtccagaagggggagctgttaatgcctattctggccccttttagactgtgactgacactttctcatgatgcaaagagccttgtctcatattaatgggttactttctgatcatgtttcatagagaaatatacatatatatttaatt

SEQ ID NO: 54122 - DNA, 682 bp, Bovine  19866881594788
gctttggtccccctgaatataagtgagctccttgagggcctgactctgcattatttatccataaatacccaacagtgcatagaaagcaccctgctatgtaataagtgctcaataaatgcttgttggcaatacttttatcagtaatgctttgagtgtgtgagtatgtgtatggtgcacagttaaaacattgattgctgcaaatgaggaagacattaaagaaatgcgtcatggagcaaatgaatgccatccttaaaaaagcaattagatcccttgttttgaaactagtgttctgtttatttttctttgttttcatcagattacaaatataattgatgttcattgcaggaaagttttaaagtctagaaaagtgaaaagacctttcactatactattttaatgactggacgagttacttatttgacacgctgccttcccaaagtagttcacctccattttcttgttcattgaatcatcccttcatcagacttcagctgctgtgctgtatttagtctctagtcatatctgattctttgcgaccccgtggactgtagcccgccaggctcctctgtccatggagattctccaggcaacccaccgggggtgggctgccatgccctcctccaggggatcttcccaaccaccagggaagcccaagaatatcagagtgggtagcctatccctt

SEQ ID NO: 54123 - DNA, 1189 bp, Bovine  19866881648989
tgcttttacgtcagcctgctgtgtatctcatcgtgaaggcataaaaatttagctaattctgggagaccagaactttgcctttttatctgcattctgaaatatgtttatgaccaaaacatcttatgacccataagatgcttttccaatcgcataagaacataattgtaaagatgccctaaatttccaatctggttgcagcacttagcctgaccagaaatctcttcctattatagaaaatatagttgaaaaatgacacagcaggaatgttcagcaaatttccttttcttgattttttcaagctacccaggtttaatctctcacaaaggagcatttaaaacaaagatatacttgcttcttatatgaacatatatttccatttagtattttcagacatgcttatacaggaggagaaaaaggtctgaaagagctaagagagagccttcatcttttgtgtgcagtcccgatcaatcattccatttaccacatgatatgaagcacgggtttgactgcattagggggcttattgagctcagctctttgagaccccatttactcttctagaagtatgtgctttgattaataatagatggttagccacatagttaagtagaatgattggcaccttttattgtttgtttttaagactaagttcgtgaaactggctgaccagagcagaggtttgttgctgggctggctaacaaatgcctgcctgtttgtaaactcagaaagccctccttccaaagatcaaaatattggtgctctctggacatttgctccattatttgtggtgctcaaatccttgtgaatgctatggcccttgagtcttcttttcctataaggataggtcacccttttggtaactggaaaagttgttgctggcatgatcttccctctaagcagacagcataattagaaatttaccactgatttggtgcagttgggcttccctggttgctcagatggtaaggaatctgcctgcagtgcaggagatctggatttgacccctgggttgggaagatcccctggagaagggaatggcaccctacttcagtattcttgccaggagaattccatggacagaggagcctgacaggttatatagtccatggggtcacaaaaagtcagacaggaccgaatgactaacactttcactttttttggtacagacagtcttcagggctacataaag

SEQ ID NO: 54124 - DNA, 1222 bp, Bovine  19866881955771
aaccccttattgttttcctagcgactgcaccattttgcatggaatattttatattaagcttttaagggaaaaggaaactcaagacagaagctcaattcagttgtaggaaaacaaagacaattacatttgttttccacacctgtgtttgttgactgaagaaatgtatacctgctgtgcttgtttgaattaaagattctgctttttccctcctgaggtttgaattcaacaacttgcccttctttttttctcatctgcagagtgccaaaagaagataatttgcatggatttttgcctttgcatcctgcatcttagcactatgaaaacacagcctttccctgccttctcatgggtggagaagtaggctgcagccctgactgtaaacactgctttttcttctagccctcctcctccttcttgacatctttgttgggctggatcttgcagaacagtctcctttactctttgtcgttccttgattcctgttcctgtttgctttctacttctctgaccacgcttcttcctcctcctgttccagagatgcaccaaggatatgcccatggccttcctctcctcttggcagtccagcagcccctctggcccacgattcttagggaaccctaggaaagcagatcagaggccaggagtcagaaacctgttgacactcattctgctgtcagtggccaacttcatggtatggctggctgagtgttggtaaaagccaggacttagatgactcagaggttcccatttgggcaactggattgtgccaccacctgtgatggaaagctagaagaagataagggcttcggttatagacacattagtctgagctgcctgcaggagatctaggtggcatatgctgcttcctatctctcacatctcctcctgttctgatcccctgccagtgccctgatcactgctcacctgggctagctgaatagcctgaacaggcctctctcctagtttctacttcatatcccaaactctagggttaatcaccctagagtgagaccttggtcacatgctactctcccctacaagtcctggtgtctgctaccacccagtcatgtcacatacatcatcctatgctgcctttacacagtacacactgctacacagtcatgtcacttactgtcgtcatatgtcgcacagcacacacagccacacaatcatatgacacattgtcataatacactgcatgtcacatagtacacactactat

SEQ ID NO: 54125 - DNA, 3689 bp, Bovine  19866880468442
cttctagtaccttctgtccatcttcattacttttcttgaagctcaaataactttatcttgtaaaaagatccattttggggacttccctggcaatccagtggttaagattcctcgtttccaaagcagaggatgggagttagatccctggtcgaggatctaagatcctacatgccacggggtgtggccaaaagacttaaaaaaattaaaaattaaaaaagttccttccttccaccaaggatgaagatattcttagcaaagcattactattattattattattgacaagtagcatgatatgcttaacatcgtgtgcctctgtctgagataattatgaattgacttggaattaaatcacctttcttaggtcaaaccatttcccatgagctttccctgctgccagctaacctgaggatgatgtaaaatggaggaggcaagtctggggacccatgtccctctgatctgcaatcctctcttgagtgacacatgctttggacaccctgcctgcatattccatttctgtttacccttttatgcagcctgagttcactcaatttcccgtttttcccaccaaatgtatctttttgaaagcttaagtttacctcatgttcaagctctttttgaatcatgtcagtttctcactcagtttctgcttcatttccattggttttgctaagttaaggtccactcttgactaaataagcaggaatgatattgacaagatggaaatatggcacagatgtcagaaggatgtcacccctcattcctgggggaggagggcttggtggcacccataaagaccaggcatatcctaggacgtatgatcgtgatacataggcagttaccctggtgcagtagctaagccatgtattttaggaggagaaataagaaattttgagataaaaacatatacaaggtaagggttatacataagagccaaccagttgtttaggagaggcattggttttctcagttaagaaaaagtttattctgcatgactttagttaattttttaaaactagattttacttctgctattgctgtaggggactagagagacattgaaaactaatgcttttttccataaaggattttcttcaggggtgtgagattggaggagtctttctctccagttcattcatatgatgttgttggtgaggaagttctgctctagggaatagatggatcagagctttgatttttatttttctctccaatttctgaaaaccctgtccatattgaaatggacctagaataactcaaggccttactgtaagcactgtccatagggtgcagccacagcaaccaattttatgggaccctcttggtcagagcaagtggtgtggctaagagaatgggctggtgaccataaaccattctgtatattcatcctcatgcaggaaaactaagtacccttaattgacattgaacttctttcatagagaattgtaccgaaactaaacacattgtttttcatgaaattcatagtagacctattatttttccactctatatagaccaaataacttagacaatgttttccagacttagtgtttactggtaactggccttgaactaaaaatggactgaatgactctaatcgtgactgaaatgaaaatgtaagtgattcaggccccaggtggccttccccaatgtttgatttcaagtctaaattgaggcatttggcccaatagccatacagaggtgaccttcagccttacccaactcttcttttctcttatgtggtgtaaatcaagtgtgtaaattaggtaattttctccatgagttattagatcagtatttaggatcagaatagctatgttctttaccaagctgttatatatatatatatatattcacatacacacacacacacacacacacacacacacatatatatatatacacttttaacagaaaggtcaagatgttttagtaactcaataaaatgttaccaattcaaatcagacacatctgcattgcaaaagctgccactattctttggctatagagaatctatctttctaaccatttagtagtgacgacagaggatgagatggctggatggcatcactgactcgatggacgtgagtcttagtgaactctgggagttggtgatggacagagaggcctggcgtgctgcaattctggggtcgcagagtcggacacgactgagcgactgatctgatctgatctgatctgggttgtttggggaacccataagataaattaaagaatgtggacaagattaaaaaaaaaaggtaagaaatgtcttcctagaagttaggaggaacaaactaggatataaagataaattttctgtaactttgggaaagtaacatgagaaagaaatatcagtgaagaggaaagaggatgaaacaaagaaagttggaggtaatgctgtggagaaaaatggggattgaagaagagtcttggggataaactgttgtttgtgcttcctgatccaggcattgaaattatcctgaaccagcaagatgttgactctagggtacacagaacagaatattccaacacagctgcctgtgaaacatgtgtcaagacccaaggtcccagagggctaggctatagatagggatcaacctaggggagaagcagggtgattaagacttcctgaactttaggatattcaagttactggtgcactgactgccatcctgattttaggtttatatggatgtagtctgtctctttggttttagaagtttccccagctgttctttggttgctcctttcttatatgttcattttggccaagcatcctccatggctggacagcctgtgatcatagagggccctccttccttcttatcctcagccagagctcattcccttttgtatcggctgttttccttggaagcgtgaagcattagctttaatcagtttatagagcccctgacctaattttacatctgcaataagatcactatgaattctctgcttccccatggaggataaagctctgcctcccccacctcccttctgtaatctttctttgtgatggacgttagagagcctggcaggttctgttccacactgcattgcttcaagagaaaatttatttatatattaatattatataaaaaagatttctcatagggagccaaagattgaatcatagtcagaaacctaatttgagattgaaggccggatagtagcaggcgaacaatgtcaaagagcaaaagctctgggggtgggcaacgcacaggcattaaacgtttgctttgcatcgtacacctctctgttccttcggcatgttggcacatgttgcgggccagccgtgtgtatcagttttctcttgccatataacaaattactgcaaatgtagtagcttagaacaatattcatttgttatcttacagttcttgtaggttaggagtcgggcctctgcttagctgggttccctgctcagggaacaaggctgagatcaaagtattggctgggctgtgttcttatgtggaggctcaacaagggatgaatctgtgtccaaactcccccaggttgtttgctgaatttgtttctgtgcatctgtagaattcatgtcagtttgtttctttagggtgagagagtgaaacactttgctgaagtttctatcctctgagtgagtgaatgagtgaagtcgctcagtcgtgtccgactctttgcgaccccatggactgtagcccaccacgctc

SEQ ID NO: 54126 - DNA, 1570 bp, Bovine  19866880507822
accaattagccagcagtaatcagggctagaataaaacttgcccatctgtcacttagagctctactgtcacaacagcctctactctagcatcagaagtccagtttaagggatattcgcatcaacctttagagtccagagttccctagcctgccaagtgaatgaatattcagtcacttcagtgtgtatttgatggtagttagcaacacaaagcaagcccaatgcccaaagaatgtgtagaggaatgttaattctagaagcgaccataacttgattttcatgatttccttgagtttaaagcctggaccacagtattacattaccaagttatttgcatttgaaatataatacctgggggaggggtgacatttaattaaattacagtgctaccctcaggctgcagggaaccagactggcaccaggctgtgtgtggaaggtgctggatgtgcattttgtgcttttcctgaaaggcaaggactgggaggaggaaactccaacgctccccaagaagcataccagtgctgagcaggagcagttgactggtttggacttaaaaattcagagtataaagtgcatgtgtgagcgtccattgaatgtggaaaagagcacatacctgcaggcttcagtctccacattttctaaatgtcctaagagaagagaaagagtgagaatcccttggcttatgacagacatagcccagcctaggtcagcatcttccccagtgagaaaggaaactcttggcttttgagtcaatgtagctcatgataactgggggactgtggtgcccttgctcctactctcttgagactccatggtaatggttagaaaaggccaccaaagtccccactgatcaaaagaccttcctttccatgcccttaagcccccattcactaagcaggtacagaggtgggaacattcaagatgtctacacagaactctagccatcttatctcctatagcatctgttttcaactggcacagatttttccctcctagggggacattttcaatgcccagaaacatttttggttgttatgattggggaggtgctactggcatctgttgggaagaggccctggctgaatatgctgaaataatatacaaagcatgagatagcccctcacgacaaagagtcgttcagccaagtcaacagtgctgaagttgagaaaccctgttctgacagaagatgagattatgaaagagtggattctagttactgagttggctatcaaaatagaaaataacctgtaaaattgccagtgtgtcattcagagtccaactaggaaagtgggggccactttggtatttaaaaggaaacaaagttttttaaattgaagtatagttgatgtacactattgtgttaatttctgctgtatagagagagcagttcagcacacacacatacatacatacattattttttagtgttctatttcattctggtttatcacaggatatggaatatagatccctgtgctatactgtaggaccttgatgcttatccattccatatataatagtttgcatctactaaccccaaactcccaatcctttcctccccacctccccacct

SEQ ID NO: 54127 - DNA, 829 bp, Bovine  19866880877449
caatgcaggagacacaggtttgatccctgggtcgggaaagaaccccctgaagtaagaaatgaaaactcactccctgtattcaagcctgggaaatttcatggatagaggagcctggtggtctacagttcacagggttgcaaaaagtcagacatgactaagagcacacacacacacacagaaacccaagacctattttcaaattttgatctccagaattacaataaatttgtgttgctttaagtcactttgtttgtggtaatttgctacagcaccatagaaaattaaaacctttgtgaattatcaacaattaggtagtaataccactccagtactcttgcctggaaaatcccatggatggaggatcctggaaggctgcagtccaaggggtcgctgagggtcagacacgactgagcgacttcactttcacttttcactttcatgcattggagaaggaaatggcaacccactccagtgttattgcctggagaatcccagggatgggggagcctcgtgggctgccttctatggggtcgcacagagtcggacacgactgaagcgacttagcagcagcagcaggtagtaatacactgatacttatcagtatcaaatgaaatatttagataacaatgtcactctcaaacatatgagttataaaaagtaactatgatattgaggtgagcaatgaaaataaacaagaatataacactgctatctggaattaatccaattggaaaagcaaataacaacgcagggttacgaaacacacaggctatcgatcagcccaaatcttgtaattgtcaagaacagggtaaaagaacaaaactgcaga

SEQ ID NO: 54128 - DNA, 786 bp, Bovine  19866881125970
ctccctaattgggaagggtagcgtgatacagaaatagactgagattgcccaaaggacactgcaacttacaccaaaccaatgagaagtaaccactgctttggtttcacaagctccatgtactaacctcatggcagcaagcagcctagtgtctgagagcttcattcactcattcacctattcatctagccatccattcactcattcactcaacaattaacaatctacaattcccttcagatatcaagggatgtgtcttacctccgtgatggaactgaagaggaaggaacccaacagggagaaagaaaccaaggctgaaagcctcccctgggtttggtaagttgtatttgaagagccagccctttcataaagagaagctaggtgagtccttcagcactgtcatgggaagtaaaaacagccctaagtcaaccccagccatgagcggacacggacagaactgtgaaaagaaagtcctgagtgtatgatcagcaaagatacacagctttatcctaccaactttattaagaatcaagaaagagaggggaatattgtgttactattatcatgataatcacatctacagatgaaactaaattgggaggtgttcctaacagcagttgaagactggcacacaataccaagctatacacagatcttggtaatatatgtcaaaagtaatacaatgaggcacttgttgaaaaaatgcagatgatctaactggggatgaataaacttaaagatggaatttaatgaaggggattccgggggcaataatagagaaaacaacca

SEQ ID NO: 54129 - DNA, 1944 bp, Bovine  19866881137618
gcttaaaacttacacaatcccttaaagagtagcagcaatctacattattttgtttgaaacttgattttaactatttttaaaaatcagacagggaaaatcttaatctgagaacaaccacctgatgatgtattcacttattatctactcagataatattttagataaaatgtagatatatgtagataaaatgttttgtctacaatcatttcccatgtgtatggctttgcagcatacgaaaggacttaaaagaccttaataccttgttcttgccttccaagagcttacagtctcatctaattaataaaaataaaaagataaaatgacaatgtaggatttaatcagcagttcaaactaacacagtgaaaccatatcaatgtaaaaataatgtccaacaatttgtacctgagttcaggtaacgtcaaggtcactccatagtaaggagttcactgaaaggggattctctaaatcttgagtaaggtccagaatcttgattagtgaaaggaggacatctcatacttaaaatgcaacatagatggtaaataaatctctgaaaggagaaattattcttattctgtggaacattaatcataagggttctatatggaaaattcacaggtgagtggaaaatgaacttggaaatttctggggagataagccagaattaagtgttttctctggtatcatgggatgcatctgctctggggtaagccccacacgtcctgggtcctgccccagggtgagtatccagctggaatccccaggagatggccacacagactagaatgcagtaacccacatctcatattttgaagacaaagactgtcatatgactgtagcattcctaaattcccaaacatttgtaatcatgtatcttgggaattctggacatcacttttctcgttactgactgagcccaaattcacatatctaaagaccaccagggtatgatcagtgagtccagtattggaatgacacacacaatccaattataaatgactgtccagaagttaatttttttagtgatgtggataattcatctgaaaagatagccacaacaatgaaagaggaggaggagggaatggggggaaagcagagggagtgtcatttcattctgggatgtgattgagaagaaaaccccaagaatgaaatggcctttactgggtcctaaaatcctacacaatgttcattcgttcattcattttctcatttactctaccacatccaccccatgtgcaaggtgaaatgtttaggctctacagaggtagacaccatcctagtctatgaggaccttaagccagagaatcccacaaatgaaaatttaagacatataagcacaattcaggaaaagccgaaatggagctacatacactcttattgggcagcaacaaaggtcacttctgatgaacctattgtcccaggaattactaagatcttcttctctctcttcatctaacttagacttccaagtcaagacggggttttagccaccatgaattcctactatgttccagcaaggcttattccaattgaattctcatgttgactcatctttccctgttaatttctttcacttatgaataacctcatatttttaaaagtgtatatatggcagactgcctcccatgaaagtgtaacagaactgttaagtgtcattactattcaaaggctgcttttttcagacacctatttgctatttacaaggaagtccctgggtacacatgaaagataatatcagttacgctgtaacaataataaagaagacttgcgtgtaaaagcaacagctttcacttcttacatattaaaagctttagcagtgattatgatgaacaaaacagaaagggataatttttcttgtgaagatgagaaaattaaaataatttgggaactatggaggagccaaggggtggttaaagctagttattttaacattccctgcctcattac

SEQ ID NO: 54130 - DNA, 2660 bp, Bovine  19866881179539
tacatatctggatttttcctaaatttggatatcagtggatctgaatgttcttgcactgataaaaggaagaaaaggaaagaaagagggaaaggagggagaaagagagaaaccaatcaaaggatgtcagtgtcagatggactgcatcatgtttgagaaaggtttgtataataatgaatgttatgcatgcacatagctcagcttctgacatgactttgatgataatatcagttcccacatctcacatgccagaagtccctgctgccttacctggaggtgcccactactttcttctcacaagtcacagtttttctttgtagccattatattttttcacattctgctttccatcacagctattttgctcaggtggaatccctcagtgccattctctcatcctccttgccctaccacatggtggatggaatcgggtggaacacggccattcatttgggcaaggctcaaacctgctgactagatgatggattccctctagtccagaaacaagtaaaacctgaacacaagatcagggcagtgcagaagctggagggggtttggggaggcggattgggagcagtctccccttggtttcatttttgaagagtggcacctttcaccaatttttaaaggacgcaagattttacatgaagattgtcaagatgatgatgataagggaagaagcaccaggaaacaaaggtcactgtgctccaagtatcaggtgaggccttggaacctcacggcagtatgtcaccatgcggcccttttacatccacgctcccgtccatccactagtgtatataggtgttataggctgaaactacctgaccgccacccccagccccaagctttcccttcttgtaaaaacctgtgtactcccacatgaggcccagcctgcttttccccacattgccctccacgtacccagctgaactaaacccatggcctcagaacccttgagggtccagccctgcctctgactctggtttctttttctcttactgtgctgttttcacatgagcttcctggatgtccctcaaacgttctgatcatgttcccgtctcagggcctttgccccttctgttccctccgcctgaagtgttctattccatatgtgtacatggctgatatacttcctcatttcttttaaatgtcaccatctcatcaaatgtcaccttctaagggaggccctctctgaccacccaagctaaacacattctccagtcaccctctctctccttactctgctacactatttttcacatgccgctaagcattgtgttacgaacatatcagcttgttgtctgctccccaactagaatgtaagcttaatgaaggcagggactttgactctttagtcctttgctgtatcccactgctggagcagtgcccagtacatcataggaactcggttaatttgttgtgtaagtgagtgaacaatgagtgattttcactcatccatccatttagtgcataccggttgagtgcctacagtatgcaaagacaaagacatcatagtccctgccttctaggacatagcagtcttgaggagatagacataaatagatacagatatataaacagatatttatgaagaagatttgcaggtgcagtgatagagttatggcccggatgttttctcaaatacagtgtcagagaagcagcagataatatgctgacattaagtatactcccttgcttaagaattgaagccacaaataaatgtgtgtgtgtgtgtgtgtctttagtgctttggcattataggatttcatagagtttggagaaaggctcaaaatagcttttcagtgatgttacagtatgacagaaaggtgaagaattcactttctttcccctcaaatgaaatagaagcagtggcatttctcccaggtgggcccaggcattgtacaagacccacatatttttcagtaagaggctcacatttgctgtgatgctagaagcttctaatgggcctctgagggttgtaaattatatcaaataattttccagatactaagctgttgttttttaaaggatggagatgggaggggtgaagatgaagctttccttggatcatgaaattataccttcttccagccacattcaataaatctttttgaatgtcaaatattcattcattcagtatttactgagtatcaactatgtgagaagtgccatatgggaccatgggactgtccttagttggcttaaaatccatagatccttactggaaaaactgctagaacttgatgtagctttttgctattgttttagcatttatattaaattactgtggtttttattatatccttattgtagcaagtcaaataaaacagaagtatataaatatgtgtaaaggaaaaatgttcaatgatccactcttccccttcattcctaccaccccttgtaattaatctttcagtaatttgttggatgggcttccctggtggcttggtggtaaagaacccacctgttagtgcaggagactcggatttgatccttgggtcgggaaggtcccctggagaaggaaatggcaacaaactccagtattcttgcctgggatatcacatggacagaggagcctgcaggctacagtccatggggtcacagagttggacacaacgagtactaagcaacaacaaatgtgaggatatctttctgtatcatta

SEQ ID NO: 54131 - DNA, 891 bp, Bovine  19866881270072
cataaatactgtttcagctactgaggatattccatgaagtgggtattctgtgtctcctggttttattctctctgctatcttcatgccagcattaccaatttgggtgagacctgggttcattagatattcaagcagcatttgtttagtcctgggagtgaaagggagtaggtttcatgtagctttctcttaatgaaagtttattatgttataaatctgatgtaatttcaggggcttgctgccttgcatgatggatgcattacctggcctaggaattgaaagaactgtctttgtaacatactcaccacaaatcccaacattggacagacctactcgataaatcttctggatactctgtcttcttaaagtgtatatatgtgtgtatacgtatgtacacacatgtgatctgtatatacatattttaatcagccaggggaccagcagaagacaatatgcgcacactcaaatagggtaactgagaagagtttaaagaaggaaccatttgcagaggtgtgagcttcgtttatggaaaccccgaagagatggtgaagcaccttggggtagcaaggcacaaaccattaccattcctaggcctgaaagtcccaggggagggtgaggttgatgaaatctgacaagatcagtagctgtgggagagggctggagctatggtcttcaacagagaaatggaaccaattctgagccagaaagggagggagccagaggaataagtaccacaacctcactctcctcctgcctcccattcttttattgagccctcttattacttaaaccaaagtagaagctgcatgacaaggatgagagtgttgcagtcctaaaggtcatcctgcaaggcatagtgagaatggtcacttcagttcagtcgttcagtcatgt

SEQ ID NO: 54132 - DNA, 2319 bp, Bovine  19866881332429
caagatagactctcttgcctggggttgatggagacttcctggggcgggagtgggagtggcgtggagggttgccagactaaatacaggatgcccagtttagttcgaatttcagataaacaatgagttttttttaaaacagtataagtatgtcccaaacattgcatgagacatacttatactagaaaggttccttgtgtatctgaaattcacattaaacttggcatcctatatttttatttgctaaatctggatagcctcaagtgtcctctggtgtggggagaaagtttctgcgcctgagacatctcagagctctaggaaaaggcagctttctccaccttcttcctctttggcttggtctgagacttggtttcccttcgatttgggactaggctaaggcggatgaagaagttgcttcaggcacaaacccaggaactgagatcaagaatgaatgctgtattgaaaaaaaattctttaaaaataaatgatcctgtattaaaatgtattttattttactcccattctatcctatcccatcctattttattttttggctgcacctagcagcgtgcagaatcttaattccccagccagggactgaaccagtgcccatagtgccgagtcctaatcgctgggccaccagagaagtccccaacatacttcatattttaaaattgtaaacattgtgattttttaccataagtattttggttgagaatgttttattaaagtgtactttattttaatgattaagttttttttttttggcacgcttttaagttttgcttctgaggtggtgagagtgttaaatgcaagcttgaagtcttacaaagactgatgccagaattctttacttagaattgaaatatgagtgtttctactttatttgacctcgaatttacacataaatttggagacacctatgatcttcccttgtcagtttgaacacgatggtgacactgaacttgagtgaaatttcttacctccattgctttctctaagaacatatttttggttccaatttccttctttcaaaacaacagagactctggtctcttactgttttagatgtgagatgacatctgaggataagatcctggttttgcccagtggtagaatcttccagaagaagcttggagagcttgctgggcttggatgcatggagcagaactcatcactactgactgcatgatgatttaatatcatcttcttgagtatttaaagtgtgatttgtgggttacggttcaaaaaatgtcccaatattacatttagttgattgatgtacatgtatgaaataaacggtatttagcaatacaaataattggtttccttagggtgattgtcttgttagtatttgtactccatggtatctaggaattcttgataaccatgggtatacaacccatgatgggtgtatataaacgctgtatttcagactctccaaatgggataaatgtagttaatgctagtatattacatcatccattggactaaggaaggcatatgatattcacagagaaggcatgtgtgcttgggtatgcacacacacacacacgcacacacacacacatgctctttctttttctcttcaatgcatagacatttaaaggcagggattattagaagactgaaaaatgcagaagagaaaaaggcttgggcactactgactgatgtaggtttaaggtgtgaaagaatgagtgaacaaagatgcagacttttgttttgcatcttttaatatcttctcagtattctttaaattttttaaaaatttattttcatattaaagtataactgctatgcaatgtaagttataggtgtacagtatagtgattcacagtttttgaatgctggctgccgtctatggggtcgcacagagttgaacacaactgaagcgacttagagagagagagagagagatactccatttataattactataaaatattgactatattctacatattgtacaatatatccttgtagctcagtttatacaccatagtttgtacttcttactccctcaccctgtctttctcctgccctcctcctcctccccactggtaaccgctgttttgtgtctctatatctctgagtctgtttcctccttctccccactggtaaccactgttttgtgtctctatatctctgagtctgtttctttttttgccatactcactagtttgttgtattgttttggttccatatctaagtgatatcatacagtatctgtcttctttgactaatttcacttatgataatgacctccaggtccatccatgttgtttcaaatggcgaaatttcattcattcttcttttttttta

SEQ ID NO: 54133 - DNA, 1009 bp, Bovine  19866881746924
ctattcaaagcttcaaagggtccatgcaggctcccatatactttgcccatttgagttatttcaatttattttaggaaaagagaaaaaaaaaatcttacaaagctgacattatatagtaaagtttcagggatatgggagctatttaatcattttgtgtgttaccctggcttttctgcagtctctttttcctgtggttttgttcttgtgctgctcattagcacctccccccagagagtgggcaggagcagggaaaaaagagataaaactgaaatcagacaattttatcagtcagcctgtcaacaagttgaatatattgagaacccagggggtgcagaggcactttttagtagctctgataaaaggtttggtgggggaggaggtcaaaactaatggcaacattgagatttttttggattatcaagggatggtattgatttgggccctccacatctccattagtgcacataatcaaaagtggggcaaaaagtattaagcatccatacaactctcttaaagaagactctaaaaaatttatcacttttatccccatgactttgggaacttgttgggctgttcaaatagaaaacaaataaaattaatttcctttgctttgtctaaattcttaaaaatcacactgtaagaataaataaaattcatcacagcagtttctctagcttcccaacagctttctacttttagcctgtttccagaggggcaggacccatggaaaggatatacattcgagtgaagcaagaagcaagatcactgccaccaaaatgagctgaagcctgacaatgaaggattgagtttgccacagatccagtaaaattaacagtgtgtgctctgcacactgacatggatttccaacaaactgtgctgtctacacagagacaaaaactctacatcatgtcacaaggccactcaacacatgaagttggctacttctaagcctgaatgagaaagaaataactgtatcttctctttgttattatgggaattttaaaattat

SEQ ID NO: 54134 - DNA, 864 bp, Bovine  19866880188243
gtctgaggcaggtcaggtggtctggtattcccatctcttgaagaattttccacagtttattgtgatccacagagtcaaaggctttggcatagtcaataaagcagaaatagatgtttttctggaactctcttgcttttcccatgatccagtggatgttggcaatttgatctctggttcctctgccttttctaaaaccagcttgaacaactggaagttcatggttcacgtattgctgaagcctggcttggagaattatgagcattactttactagcgtgtgagatgagtgtaattgtgcagtagtttgagcattctttggcattgcctttctttgggattggaatgaaaaccgacattttctagtcctgtggccactgctgagttttccacatgtgctggcatattgagtgcagcactttcacagcatcatcttttaggatttgaaatagctcaactggaattccatcacttccactagctttgttcgtagtgacgcttcctaaggcccacttgcccacattccaggatgtctggctctaggtgagtgatcacaccatcatgattatctgggtcgtgaagatcttttttgtacagttcttctgtgttaccatgttaaaagtcttacctaagctgtctttccatgtaagaaagcccaggaccaactgggtaattatatctaatgtcaggattttgttagaaattccattcagcccccacactaagccaacatagcctgtatcagtaataaagatgctattttggcctcagcatttactcttataaaaaagaaaacctttcaaattactctgaaagaagtagagcagggtattatctaatgccaactcctttcagagaacatgtccag

SEQ ID NO: 54135 - DNA, 3170 bp, Bovine  19866880203154
ttccccatctattacccatgaagtgatgggaccagatgccatgatcttcattttctgaatgttgagctttaagccaactttttcactctccactttcactttcatcaagaggcttttgagttcctcttccctttctgccataagggtggtgtcacctgcatatctgaggttattgatatttctcctggcaatcttgattccagcttgtgcttcttccagcccagcgtttctcatgatgtactctgcatataagtttccactgtttccccatctatttcccatgaagtgatgggaccagatgccatgatcttagttttctgaatgttgagctttaagccaactttttcactctcctctttcactttcatcaagaggctttttagttcctcctcactttctgccataagggtggtgtcatctgcatatctgaggttaccatgtgtgaaatagtgagaagttgctgtataacacagggagctcagcctggtgctttgtgatgacttagagaggtgggtgtgggagggaggctcatgagggagggttatatgtatacttatcgctgattcacgacgttgtatggcagaaaccaacacaatattttaaggtaattatcctccaattaaaaaagaagaaaaaagaggtactccttcatctaagcccattgaattattttactttctattctttgactctctttttatgtaacatgatttcataattttctgagctcctcctggtctgattaggaaaagtctccagagaattctgctcaatggactgtctggggacagcatcacaatgtggttcagtaattccttgggtagactgcaggttgcaagggatgtttcgtctaagttgttttgtttccattcccacctccaaaaggaatatggcttcaggctcagacaccttttgcttgtgaggctgagctttgccacactcagggagtagcacctgttttagtgttcatacacattacttatattaacctcaggctaggtctttcacttttcactttcctgcattggagaaggaaatggcaacccactccagtgttcttgcctggagaatcccagggacggggagcctggtgggctgccatctatggggtcgcacagagtcggacatgactgaagcgacttagcagcagcagcagcagcaggtcttcaaattaaatttcaagtaaatttcttaaaattcataagaattcctgtggtccttgttaccgtgcaaagccttgactgaaaacacttcatctctgtgtcccagtgcctgacatagagacgtcatgagagaagccagtatggagtgaaataggttgatttcccttgactttgaagacaatttcacctcatcttgggcagatatgtctccctgacaattttgtataggtagatatgttccatattgaataatattttaaatatactagctttttatatttactactagtaaatacactagacaaaagtacaatgacttacttggtgggacaaccactcaatcatatgtccatacaataactttacatgggcttcttggtaaatcacccccacttcttcatctgggaagtgaaaattgaatttcactggctcctgaggttcttccaccactaaaattccttcactgaaacttaagtttttatgtaacagtttatattaagttataattgctataattagcattacagtttgtcttgaaagaattttaattctcaagacttacaagtacattatagtgattatgagcacatattttggagttggacaagcctgggttcaaatttcaattcatttatcaaaagcaaattgtcatgcctctatcagactcatttttctcattgataagtgaaggtaataataagatctgctttacagagctgttgttagaattaaatgagataatgtacatacacactttttaaaatactgcataggggttctctaggcaagaatactggagtgggtcgccatttccttctcccagtggaccacgttttaactcttcactgtgacccatgttgggtggccctgaacggcactgctcatagcttcattgagttatacaagcctcttcgccaccacaaggctgtgaccccctgaagagagagaaaaaaaagaaggggtggcagaggataaggtggttagaatgcatcaccaactcaatggtaatgaaattgagcaaatgggagatagtgaaggacagaggagcctggaatgctacactcccatgaggtcacaaagagtaggacatgacttagcccctgaataacaaccattaacacatacacatttaggacaatacctgtcatgagtagctatttttcttactgtaagcacactgggattgagatcatgatgaagaaaaacactataaatatatttgtttagtttcagattgaagataatgactgcaggaaaagactaagtaactttatttattcagctgtacttcagattcactagaactctctcatctgggtaagaaaatgtccatggagatgcgaacagccgttacacatcagaatggcacttggattgataaatcatcccttgctgttgtacttttcaaattagcaaatgaaagagcatcttttagcaatggggtgatatttataaattaaatttattgatacacatggtcttggttattattttaatcttcctctctaggtattttgtaagaaaatataagtcttgtgtttacttctgtttgttaatgctttgataaatcagacatttttagtattctatcaatggcaaaagtctaattaccttattgtattctgatttatttctttccttactttctttgcatctgcagcccaacaaatgagtctctaaagagatatatgttatgatacagtgtcagtgaaattaatcctaatcaattttaaagttcacgtttttatttgatgactttcaagggaatcactaaaactgagattgacttggtctcttcttttgttggttaaatattgttgtttgaaagcagtggatccaaagtgaagaaaaaggccctttttatgctttcaactctgttccatttccaaagaaaaactgtggcaattcctcttgcctatgtataaaatgaggctaattggtcaaaaagaacacagaggctctggtgggcttataaattggcatctcgtaaggccagaagcctaattc

SEQ ID NO: 54136 - DNA, 3034 bp, Bovine  19866880573030
gatatgaacttcttgagagcggaattcatcttattaatctttacatcttcgtgtctaagataatgagacaatggcagggggagaaagtagaatggagagacaagtataagagtggagagaaagaaaggaggtaagaaaaaaggatgaacttagagactacccagtatatgaactttccaaatgcttatcgaagtaaactaacctataagtattgttggtttctaattgatttaaaggagacaagaagtatatctttttatctattactgccaaataatcaggtaagtgcttgctggggaggaaaaaagtctgaatcaacagaggtgttctaaatgtatgtaactttttctttaagagcctagtaacatcattatgattccatttgttaagtggtaagtttaaaaactactactgaatcataatgctctcctattctatgtgaatctcttctttttaacaatgtgttaataagacaacatgtttacttatctcaaagtagtctctaatatgtctttagcaaatctgcaaagggctggttccagaactacacttaaaactctttaccattacataaatacagttactatgagaagtagggaaaataagatttcccactatggagaaaaggcaaaacaaattgataaaagaagatatctttttttaaaaaaggaaaattcacatggtactggggcatcccaggtggcactagtggtaaagaacccacctgccacggcaagagacttaagagatgagatgtaagagatgcaggttggatcccaggctggggaagatcccctggaggagaagcctggcagtgcatgggggtcggagagtctggacacaactggagtgacacagcatgcacacacatacatggtattaaaaactcaagcttgcacttcccctggtggtctagtggttaagacttcgtgctcccaatacaaggagcatgggtttgatcttccctggtccaggaagatcccacatgccacgtggtgcggccaaaaataattaaataaatctcaaactttacaaagaagtaaaaacaaaaggtctatttctctaccctttccaatccccaatcccattccccacttaatgttttcttagggatccttcaagaaaaagatgtgtgtatataagaaattcttactttttaatacatacaacatcatacataaccttttcttggtatcttacattatacacttaatatatcttgagaatctttccatatcagcacataaaattaataataatattctatcaatgtttaccaagcacttacaatgtgccagatgttgtttacagtgttaaatttcttatacctcatttaaccttcagaaaaactctatgaagtgggcactataagaggacactgaaatttcaagaagttcaggtcatattaatcaataaggaatagccctaagatctgaacttagagcacttactcttaaccactgttctcctcttatctaacattgactccatgaaatggataagctgcaacatatttaaccactctctactggtagacatttaagctatttctggtctgcaaagttcatcattagaatgtaagcttcattgagagattttggtctaaatcaagaattacaggcgatttttactttctcttttgggccttttgtatttccaaatttcctgcagtactacatactaatctacagcaagaaaaaatagacatttttagataaatttcaaaaatagagcaaccttcccaagcttatagggtagatgctgggtttgaattcagatccataaaactctgaaggcctctttccatggaagagtttccaaaggtaaataattctaattatagttcatactgggcttctctggtggatcagtggtaaagaatccacctgccaatgcaggagacataagttctatgctggggtcaagaagatcccttggagaagaaaatggcagcccactccagtgttcttgcctgggacagtcccatggacagaggagcctggcaggctacaatccttggggtcacaaaagagtcagacacaacttagagactgaatgacaacaaatatttcatattaatgatttctctattctccaaaatctagcctatgaggtcagttaaagatacccagcgaaaatgtctgatacacattaacatattaataggaacactataataattactaccactggtacgatctgtttcctatctttcatgaatggttaaataaaactcccacctgaggcactgtcattcctaagttatcctgcattaaattttttatgaatctaggtccagagaggaccagtaacaactaaaagtccaagaaaacaaaaacacatacaggttgatttgtgaaaccaaagaacagaaataatccttctctataatacacttcacattttaagtcagagttcctttaggggaagaatgaaaaaaaaaaaaaaaaggatgtaagatgactcatgttcccatctgacactatctggggataatatttaagttaagattcagaaagcactgtattaaaaagacttggaggtctccatcattctgatctacagcatttcactattatctcaatttcctcacctaaaacatggtggtaacaatgctccctacttcatggaacatattaaacatagaaaaaaatttaaagtcttagtatttgtaaaaattatcactgaacttaaattggcaactaaaaagaaaactgaagggggaaaatccgtactgtaaaaagtcaatcctcccaaaaggagataaatataccttaattccactagttcaggaaaataaagccagaatctccttacccataaattctaacactgtataccaagataagataacatacaaattatattctggtgtaaactgtatacaattagttgctaaactctgttcatcttaaagacttctcaaatctttgtcccctgcttcagtttcctacactacctgcctcagttcagttcagttcagtcgtttagtcgtgtccaactctttacaaccccaggaatacaacacgccagg

SEQ ID NO: 54137 - DNA, 1615 bp, Bovine  19866880590160
aagaaggaggttttgaaggctctggcttaagtgaggttttagagaagtcaggggaaatgacaggagagcttgtttcccagggctgccttcacagattactccaaacctggcttaaaacaaacagaaattcattctctcccagaccggtaggccagaagtctgaaatcaaggtataggcagagatgtgcaccttccaaaggccctaggggtgaacccttgcctcttcgacctgctggtggctctgggcatcccatgctttgtggctgcataactccagtctctctctgtcttcgcgtgaccctctcttctgtgtgtcccaaatctacctctacctttctcttattaaggatacttgtcattgaatttaggctacacctgataatccaggattatctcatttcaagatccttaaattaattgcatgtgcaaagactacctaaagagacttgcattcacacgtttgtgtacatacatcttttggggggccatcattcaacccaccccaacaggtaaggagggatgtaatcagaactaggagcccaccctgaaggagggcagagttgcaccagtgtctttgggtctcgtttggcatatatgacacatatgctgatatatggtgcagagggggattgagaaggtcaagtcggggaataatgatattaatagttgtgacagccaatgtttcaggaatggattccttgagaaggatggatgaaatggttaaaactaagtggccagtggcaggtatttctctaaagtcagtgaattctggaggtcttctgccgagggtgttaggagaccaactaccaagactttaaatattgatgagagaatgacactgcaatgatctggaagttccattaagacccaggagaaggctgaccctctttttttatccctctcagccagggagcatgggacctatgtgggaagatagtttctttctcacttctagatgctactcatggtttcactactccacagagaaagtacccctccacacacctcaaaaaaattctttaagccaatggaagatagggcaactggatttcaaaatttttacctcccccctttaaaaaaaaaaaacaagacaaaatttttcttttttatgtttctggattttctttctttcagatagctacatctctgtatctatccaaaatagcttgcttgagagcagggaccatgtctatttgctccttcttttatctttagagtccagcaaagaactcaattagcagagtttgtcaaaatgaatgagtggatgaaagaatatataaatgaatgtgtgaatgaaattgtgttttcctagtttcatatgcacggaaaccaccagcaggactgtcttttagcaagtgttgaagatgggctcacttgatctgtgtcccgtccttgaattcctgtaccagtatggataatagctcagcgccttgtcaataagtacagcgtgttccatccgcagctgccaaactcttaacaagccatctgacggaggtgcttgtgtgaaggtgacacttgcccccaccaatgtcatctaaggaaatacccatcttcccttaagtgtctctcctccctgccttcacatatcagtgcactgtaaatgatgatgagggag

SEQ ID NO: 54138 - DNA, 2074 bp, Bovine  19866880605785
gagtgattgattttgccaatgtcaactccaggcagcaaacaagaataaaaacatttcaccagggcaaggagggatgatcaggaccctcaggccctcagaaaggtgttcacagatccaaactctggaaattttgatgtagaacacctaatctcttgctttgcagggggggcaggatgcaggcaagaatttaaggattgataagagcctctgtttttcaactcccatcaaaataatccgtgcacaggtttacaaagctctttgctccacctaaaggacaaaggtgaaggtcatagaaaacttcttatggggactcttacctgtgattctgaagtgtctcctctgagactgattttcttatctattcagggtgggctcttactctattcaactgtttaggatttttaaactcttctctccccctctcaggagatgaatggtgtgcaaagtgagaagatgataaaataacatgtttcccacttgtcaggcctctctgtgataagcctgttcccttcctctttttcttactttcctttcaaaaggggtcattcgagagagagagagaaagaagaacaataattttattattttattttcagaaatgctgttataaacttcatcagcaagaattgttagaaagtattagaaggcaggtttcccatccctgttattgaaacagcaataaaagtattacaaggcttttggaagacaggtagtgtgaaagtctggaaagaagctatttaccatctgcaccccagaaacatcaactatttcacctactttgagattcgttaagaaaagactaatgtaaaatagaaacaccattatcttaccaccttccaagaagaaaggtatattttatgtattttaaagtataatacataaactctacattgaactgactcaagcaaaataacactaggtatttttgtaagtcatgaaactaagaatttttgaaaataatgctgcttatacacaaaagaaaacatataagagtttgatttataaaaaatccagtctcacaaaaaccacttattaaactttgtaaaccttttaaatcagttcaagaaaaataaacctttgacccataaactccagacccaatttaacagatattcttaattgacagtatcaagctcaaaaataaaaacatattctatcatattaactaaaaaagtaatcacataattaataggtgaaaacagagagaaagattgcagaagattaagattaagccctgcagaagcgaatgttctaactagaaattggtttaattaatagcacattttacataatgattacagtgtaattgcgctgactagcagagtgtcattaaatatatccatgctcctttacaacaccctaaggctaaaaataatgagttacattgaaaatcactgtgcaacaggttcataaataacatttaagcctatacaaggcgaatacttataaataataaatatttgccttttgtaattgaagaaaaaatgacagccttctttttctactaccttgtagattgccatgttataatgctgaaaagatttttccccttgctttctctagaaggtgttgaataatttattcaaatgctaatattccacgtagcccgactttgaggaacaaatattcctacataaagaataaatgccaggatgcttattacctctcttgctttactttatgccatgaatcccccccaaactaccacagtctattacagttgtcagaggaagtcagtggtcaaattttctggcagggaagagcatttttctttatttaaaaattaccccatctccccaaatgttcaacatgctcagggttgttatgaagcagcagctgctctgtgacttcaggaaagaaggcaaagatgtctgctaacttcttaacttctcactcttctgctgagaatcaataacatctgatcacaatggctgcagttccttatccatacacttgactctggcctgggctcaggtgtacaaaaggtccatgtccaggagcctcatcttcttcatcttctcagttccaagaggaagtcgagttcctctggtgcctaagagaaagcagagagcaa

SEQ ID NO: 54139 - DNA, 1369 bp, Bovine  19866880658361
ttctgggtattctttggaaggaatgatgctaaagctgaaactccagtactttggccacctcatgcgaagagttgactcattggaaaagaccctgatgctgggagggttgggggcaggaggagaaggggatgacagaggatgagatggctggatggcatcactgactcgatggccgtgagtctgagtgaactccgggagttggtgatggatagggaggcctggtgtgctgcgattcatggggtctcaaagagtcagacacgactgagcgactgaactgaactgaatgaatatatttcaatgctactctttaaagaggacttcttgttttataaatatcaatatgtgtaaactcaactaattcaatatccttgtaagcaaagtcagagaatttcagtgattttgtcaaggtcaaacatcttgaaatgagaaaaagaaccaagatctcttgacctcggttccatgattcttccactgtcccagattgcttaaaccagtatcaatgcacagtacatatataagaaagataggaaaagagtagaaaactggtacacttacttaatgatgtgtgtatatcaagatggaataaaattcacagtgtaatttcagacaataaagctacaaatttctaacttcaaagttattttgaacatgtccacaaaaatatttttatagtctccacataatgagatacactgtcttaatagccacttacatgaacccatgagcattaaaatataagacacaaacagctcagtatactatctctaatacctaagacttttctccatgcagtatagaaggcccccaaattgtcattagcatggtaagttgctcaacataaatgtcctcagattttcaaattactttgccatatctgacctgtcatggagtcaaaagaagaaaaagcaaagattggaaatatcctgatatgttgaaagtgacagtttctttggggtttgactttctgaattataaattcctcaggatggaaattttcttcttcatttggcacatttatcagctgcaaactattacatgactatgtaaaaattggcaataaagaaatctcaagaatatggaatagaaactgacatgtagtaagaaattcaataaagtatttgataagtgaatgaatgaataactcttattttcttcaatcactttccaaatgatatcaaacaaattgcattcacaaaaaattacagtatggttttatataggtaaactttgagctttcttgaggagagtgagctctctctaatttgtgctttatagagtcttctttgaaatataataatctatgttacaataacgtaattaatacaaaggtgttgtatcactcctttttctttcagtgatgcaccatttt

SEQ ID NO: 54140 - DNA, 654 bp, Bovine  19866880691485
taacttccattcacgggcagtcatggaaatcacttcatcagaaacagggaagaaaggaaagaaggaaggaacagagtggggagggaggaggagaagggagggaaggagggagggaatgggggaaggagggacgaacaggagcactgtgtcatgaaacactaccaaagacagaagacagataatacttctcagtgatggggtacaaccccacacacactactttcctcttcctaagcgacaatttatatcatgtcagtatatacagagaagattgtttcaactgcccttctagagaagtacttaagaaaaagaatggccatagatctttactctttctggctttcaaagggctcctcctggggctttgggacccaatattgtttgcaatctgttcttccctggaggatgttagggaaaatagaaaggcccaagacaggtaatgcttggtgtttaatgatgataggcagaggtgggaaagcagagatcagctttttcctctcggcagagcctgggctgttaggaagagggaatttagtgtttgatttgctcattctccattcctcatcgaggctttggtcccaaattgctaaacctccattcaacagttaaattaaacataactaactttgttgatattatttcacagccgaataa

SEQ ID NO: 54141 - DNA, 1951 bp, Bovine  19866880705804
tccacttgtgtttttggtatcctctgctctgtagaggctttaaaatttgtcttttatgaatttttgtggctcatgctcagaaatgtcttccttacctataaaataagatctctttaatgctttcctgttagttttatttttattatttaaaacttgggtttaatctagaattcattttgaaaaagtggtgaaatatgaaatcagccttaaaaaaggctagtcaggtatctcaacaactcaacactctttattgatctaccttctctatgttaacttaaaattcctctgaaggagtattacaaatgcagggtaaagacttactagatttatgtggaactttattagtggagttagtagtcaaaagaacctggtctaaatgcgtgcgtttcaccttcagaggcaaattgaatttaaaattgtattacttatattagaaattaagcatagcttaacatttagttaattcccatttcacttgaaaatccaaactccagaagagttaagtaaatatttatgtgagttctgtactattcattcattcagtcaatgatttattcataggagaagctatcctaagcatcagaaatagagcaactaactagatagataaggtccttgcactcatggagtttgaccttaagtaaaggagatatataaacaagaaataatatgtaaacaagataagttaggattattttaagcagattatttgagttgtgaatggaataacaaagtgatgtcatgtttgagagagaaagtgagcctttctaaaacttaaaagatggaaagggactggttatgtccacatccacaaatctaaaacagtagtaatccaatgcagaagttgaggggtgggaggaaagtatgatgtgttttgctgtgctgtgcattttgcctgtctattttaaacttgcaattttctcattgaaatttgtgggcagattctttagtttttaagtccccttgtgggcccccaaagacattcagtgttcgtaacatttatcgttctgcattataattatttgcccgtttgactctccttccagacgtgagttctatgaagtcaagaactcccttattttcagtatctagtatactgaaaatatactcagtaaatgtatactcagtaaatgtttgtcacagtgaggaattataagcatattaaaggccagtctgttgtcaagggctttggatcctattttctcccaccatttcaggaatcttacattcttgtttagtgtgtgcaaactctgtctcacctacattctttccattaggatttaatcacacttcaacctttccagtcttaaaaagcttcccaaatccccatgttttgtctccaaatatctttctccctttctcaactctactcttcagaattttactggcttcatttttttaatgcctactactcttgaatcttacttttgtctgttttcagcctaaaattatcagtaacttgtgctcagttgctcagctgtgttcagttctttgtgacctcatgcactgtagccctctaggctcctctgtccatggaattttccaggcaacaatattggggtggattgctatttccttctccagggaatcttcccaacccagggattgaacccatgtctcttgtgtctgctgcattgcaggtgaattctttaccactagcaccatctggatttgattaattttcctgtagtgctaaaagggtaagaactttaagagcatacctatggtgctttacacttctaccagttatttcagagaaaaggttaagagttggtctatgaaagccttatttgcaatagccaagatatggaagcaacctaagtgtccatcaacagatgaatggatagagaagctgtggtgtgtttatgtgatgttgctgaattcagttgacatttttcatttctttcctcatgtggtccctgaatagcaattgatgcttaactctttaatt

SEQ ID NO: 54142 - DNA, 1376 bp, Bovine  19866880718585
atctgcaatgattttggagcccccccccccaaaataaagtctgtcactgttttcattgtttgcccatctatttgccatgaagtgatgggaccagatgccatgatcttagttttctgaatgttgttttaagccagctttttcactctcttccttcactttcatcaagaggctctttagttcctcttcactttctgccatgagggtggtgtcatctgcatatctgagtttattgatatttctcccagcaatcttgattccagcttgtgcttcatccagctcagcgtttctcatgatgtactctgcatataggttaaataagcaggatgacaatatatagccttgatatactcctttccctatttggaaccagtctgttccaaatttttgaattctaatctactctctgaaatttcttagctgcttgacttttggtagagatatctagcttctctatgttcagtttcttcacctgcaaaatgagaataataatagctcttaatttataagattttgtgggggttttaagaattaatgtaagtaagatacatggaacagtgctagagacacattttctttcttttttgtaaaatttatttaattggaggataattaatttacaatattgtgatggtttctgccatactagacatacattttctgctcttatgttgtacagatcactaaacatcatatatcctgttgttaccattcttactgtaatagtttagttggctaacagtaaaagaataactcctccatgtgaatatatgtacttcaagttataactatgatatttagagatatcctccataaaaagtatggcaaaaagattggtcagattgaatttagccagaaagttaatcacagtatcacctatggaaatatatttgtcagagaatcctgataaattaaacagatttcaatgagctaccagtagatggctctcttaatttgctattttatttcagttcagctttgtgcttttatgcattaagtcacacaatcaaacaaccccaggaacagggcagaaatggctctccaggaattgtctaatatatttgtctatcttctggtagggtttataatccacagttgtaaattaatttgtagaggtccttcttcagtgggtacttctgagggttcttttttctttattttttaagaaaatcattttggaaatattttttggagcctagaattttgattattttatatatgtcatgatagatggatgaacataatttatgtcttaaattttcatggagaatgaatttcccatttttcttgatatctcatttttttataataaatttagatctggttatttctaaagttaactcttcccttagtctttctctgtattggaaaactaaatg

SEQ ID NO: 54143 - DNA, 1324 bp, Bovine  19866880773527
aagatgggagcgatggcacaggacactgaatgtaatgggggcatttgacccaaaatcttcaacgtaatttctaattcaaagcaaagggcttgctcttcagattatcagcaccatcagggtggcagctcccattgtgaagaacttacttctgccaactgtgttaaggcatgtcatgtattgtctcataatcctcctgggctatgaggtacataaatgtggggcatctgaggctcagcaggtgcaaacgattagttcaaggccacacagcagatgtaaggatctgtccagagtcccaggttaagaagtactgggtcacacccacatctactagtctctgaaggatcccagttcacactggcacctgaagggaggcttgggtcacatcgcatgtcttcctgagttcctcactgagaagttgagatctaagtataccagtaacctggggactatggcgttttttttgaagagcaaagctgaaaacctccagaccttcaactcaaacagcctggccaaatgacttccttttttggattttccttctaaattttatacctttattttttgccagttacagaatccatggaataaaagaaaaaagatttgtagtggtaccaggtagaataagggaggaagaaaacactgacattagaagccaaattaagaaaggggcttcccaggcagtgctagctgtgaagaatatgcctcccattgcaggggacataagagacacgggtttgattcccaggtcaggaagttctcctggaggaggccatgggaacccactccagaattcttgcctggagtgtctcatggacagtggaacctggtgggctatggtccatgaggtcgcaaagggtcagacacaactgaagtgactaagcacacacacatgcacgcaccaggtagaataagagaggaagaaacactgacattagaagctaagctaaaagattagaaaaataaaaaaaccatggcatgaggcagagtaacaccccaaggaactcctagaagctgcacattccccggactcctatagcgatcgttcacttaagcccacatcccccaaacctagagagaatccaggggaacaattgagccatccatttagcataacttattttaactcctggcccgaagccaggcttgtagctctgtactcacagtgtgtactcacagagcagtgaaactgctccacatccgggataacaaagcaactgttaatgggagtaattaagagccttggggggtgatttataccttttgttactgttcaggttcgaagttaccaaagacaacaattattagtatcacagggtgatcctta

SEQ ID NO: 54144 - DNA, 1223 bp, Bovine  19866880874405
cgagaaggaaaaatattgttgttgaagtttaaatgtaggtctcttttcaggataggataaacatacacaggataagagaatcttagtggcatgagacagacaagactcgcttcccctggaatataaataggttcatgagtcttcctgtcaccccctcagcacccacccacttaccggacattcatctacttcagttcagttagacagttcagccgctcagtcatgtcctactctttgcgaccccatggactgcagcacgccaggcttccctgtccatcaccaactcccagagcttactcaaactcatgtccactgagtcggtaatgccatccaaccatctcattatctgttgtccccttttactttcaccttcaatctttcccagcatcagagtcttttccaatgagtcagttcttcgcatcaggtggccaaagtactggagtttcagcttcagcatcagtccttccaatgaatattcaggactgatttcctttaggattgactgggtggatgtccttgcagtatgagggactctcaagagtcttctccaacactacagttcaaaagcatcaattctttagcgctcagctttctttatagcccaactctcacatccatatataacatgactactggaaaaaacatagctttaactagatggacctttgttggcaaaggaatgtctgctttttaatatgctgtctaggttggtcataacttttcttccaaggagcaagcgtcttttaatttcatggctgcagtcaccatctgcagtgattttggagcctccaaaataagtctgtcactgtttccattgttttcccatctatttgctatgaagtgatgggaccgggtgccatgatcttagttttctgaatgtggagttttaagccaactttctcactctcctccttcactttcatcaagatgctctttagttcttcttcactttctgccataagggtggtgtcatctgtatatctgaggttattgatatttttcctggcttgtgcttcattcggcccagcagttctcatgatgtactctgcatataagttaaatgagcagggtgacaatatacagccttgacatactcctttcccgatttggaaccagtctgttgtttcatgtccatttctaactgttgcttcctgacctgcaaaaagatttctcaggaggcagatccagtggtctgatattcccatctcattaagaattttcca

SEQ ID NO: 54145 - DNA, 2656 bp, Bovine  19866880903292
aaacacattattgaaaatgaaagactctggcataggtaggtatagaaatataacacagctgttaatcctccataaatttgtttttaataacactgatgttttggttgcatataataactatttcattaaatctaaattaaatgcatggttaggcatatttaaaacatgtaaatgtaatgtgttgggagcatattccattttatgtttctacactgttctaataattttccgaattcaaattgactaggtgtagggaaatacctggtcatttatatgacaccttctttctgatatcattaagggctccagaaatttaatacccctgagttctaaacacaccactagtcagtgtgcaggaaagacaatgtgtttatctgctggaaagaaatgcttatggacccaaatgaaaggagggaaaatgcttttaaataatagtaaaatatgcattttgctttttaaaaaaataaaacaaagaattgaatactaaaacaagctatcttggaataacaatcaagagtgtgttgtgcatgatttttcatttatggagagcaggaggcattaatatacttgcctatggcttgtgcattactattcccagctatgcagaaatggaacgtgatttacagcaacacattctttgttgctgttccaacatacctattgtcttccctgcattctgactggctggctggctgggagaggggatggtgctggaccgcactccatcattatgggtgtctacaaatagagtaggtgtatgtgaactgggatttttcagctttgtataacaagcaagccaatcagagcacagaaagaacaatagctgaaggttttactgctctttaagtttccccactgattcccattgcgactgattatatcacagaagttatataaaaatcacattaaatgccaactaaatcaagacttttcatatctttttttcaaagcaatgaaattcaggacaaacactatactatgcatgaagatcaccacctagagatctaaactcttcattccagacgtcatatttgaaaatggaactagagaaaagtgtagtttattcattttgttattttctgtggtgcttgcaccgctgttttgaaagcccaccataggagagctcaattaagaagcttcataattttcactggttaactttgattaaataggctgtcttggaagagcattgagtaaatttaggctgtaaatcacctgtagtgagttctcaactctgaaattctggagtattagttgcttggccaagccatttctttcagaagggttatactttaccagctgatttggaatggatgcacttcattttatcagagcaagaacaagagacagaaacttctttctactggctggaacaacaggtatgtggaaagaaaagattttcctctctactgtcagctgtatcaataaaagggtagatcagaggttctctttaaccaagtttgttttttttttttaaacttactaattgttagctagctttccaggtcacggtgtttgccaaacattagaaaaaggataactaaacgaacaggttctccatgatgtgctacttcttagacaagaacaacagtctcttcaaataagcaagctctttcccactgagcaaatgggaaaaccaagcctgtttcaaccacggctggtaaatcaaggagctgaacccatctgaggtgatagctggcagtttatagctactcacatcactccctctttcgtatttttaagggcaaggctgaaaattcgataacatttgcaaattctgtataatgaggatcagttttagtttcctgctgtatgtcatcaggcaagttcgacagtcttctaaacctcagttttcctcatctctgaaacgggtatagtaaccacactcgccttactgactttttctgtagattcagtgagatagtgcatttaaggcacttatgcagggcctgacatgtaatactcaataaatgttagggcttaatgttattaacatttttcttgggtgtatctacattgtttaacacatgtctgtttaataaaaacagcttataagtttttcctttgacttttaaaactttatcagcaattaattaattccatctgaacatcagtcttgtcagttgggcatagcattattttatcctccttcgttgctgagaagggtgagataaagaggaattgagtagcttgcacactacagcgctaatgcaagtcctagaatctatatttttgactcatttacttctatcacaagagtggggctgggggaagaaggtccaaagcctccagaatacaaaaggttttctctgcggtgcagaactatttgcagattccagttaaggggttataaattttgtgttgaggggggtaagtctgttggtcaagggaagtggcagcatttaaagacagatagccaacgttgccttccaaaaaaaaaaaaaaaatagtgtcagcagcattcacacttctgaatatattaagtttgtaaatccagggtgcaaattgtttgtagaatctcaattaaagcccttataatattgtcattcgtaatcagctcactatgaaaacagggcttccagagggcaccaaaatcatttgaacttgcgatctgtaatagattgaaattcagataaggtcagcggtcagagcagag

SEQ ID NO: 54146 - DNA, 1143 bp, Bovine  19866880949108
ctcataaaagtgagatgccaagtcttatttaaaccaaaaaagcgacagtaactggttaaaactccatcctcacatcaactcaacttgttctcagggtttcagggctctgaaaggagtagtttataggcttctaatgaacagaaatatttaaccattcattattactgcaacatgggccaacttgagccaacttgagcatttttctcttgtcctttaaggaagttctgcctgtctgcttaccttttcatttaggtgatctttgaacacaaaagaaaatgccagtgaatgaacatgagataaattttaatatgaaaagtaaagatacttacataaattaagaaattatctccctatgtctccctctctttcatcagagtatataagcattgtactcttgcctggaaaatcccatgggcagaggagcctggtaggctgcagtccatgggatcgctaagagtcggacactactgagcgacttcactttcacttttcactttcatgcattggagaaggaaatggcaacccactccagtgttcttgcttgaagaatcccagggacaggggagcttggtgggctgccatctatggggtcgcacagagtcagacacaactgaagcaacttaacagcaacagcagcaaacccccaaagaaagaagtctctgttaacggagaattctgttctaaaggctacttacatgcttttgcttccttggcacaccagaactttgttttaaattgatcagtagtctccatctaatccagatatccatacatgatggtaattacagggattcttccattcagaattttatgtacccaaaagatcccattttagggaaaaagtgactatctgtttcaagggttcctaataccgcagacatgcatctttagcatttaaacgttttaaattccccaactttaactttctgtgaagaaaatctgttaaccactctatatgtagaaaaaatttcttctggttcttcttcctttctgccacaaatgatttagcctttcccactccgcccagctggaatgactacaattgttcttctatattcttattccactttgctaatatctcccttacagcatctaattcatttctctttgtgttgtagttagttatatatatgtttgcctgca

SEQ ID NO: 54147 - DNA, 1195 bp, Bovine  19866880990192
ggatcaaacccacgtctaatgtgtctcctaggttggcaggcggattgtttaccactgagcccccgggaagccgctgaatatacatatcctgcccttactatgtttcttgttccttttctcaatctttttatctcgtattgccatttacattgcttaacccttagctccgaaagaggacaatccaagtaaatattgcttgtactctccctttcttcatatttgctacttaaaacctttctaggtttaaaagctgaacatttttaggctggttttagttccgtgcatgaagatagaagactggcaagtataggaaaagagggagtagaagtgagtgtaacagttgatgtttctgtaaacaaagaactgagatggagataagaaataacaacagagatgcaggccaacatattgagagacattcaaggtcaaacaagggattgatatttgttactaaaaaaggaagcaggtagaaaaggttgctgctgctgctgctgctgctaagttgcttcggtcgtgtccgactctgtgcgaccccatagacggcagcccatcaggctcctctgtccctgggattctccaggcaagaatactggagtgggttgccatttccttctccagcccttttgattatatgacttcaaatgagttcctgaatgcctcaggtccctcgcctataaaatggaggttataatagtatgtaccttatatgggtgtagaattaaatggaatgacacttgaagagtgcttaacataatctctggaaagtcatgagtaccaataattatgaaaaaaatattgccattagccatatttgtgttattggttagttgatcaaactcgcatctcttatgtctcctgcattggcactcgggttctttaccactaacaccagctgggaagcccattggttagtgacgagggtacaaaatgagacagaagcttcactttatgactttcttggattgacattgagactgaaaatctcaagtggatgggaggattggatgtgtattgccagaaagctcagcaagatgtgttgtatccttcttagccttaagtcagtgttaaaaataggtgaaatgtacctgtactgtgtgtgttcaattgtgtccagatcttttgcaaccctgtggactgtgccctgccaagcccctctgtccttgggatttcccaggcaagaatactggagtgggtt

SEQ ID NO: 54148 - DNA, 2854 bp, Bovine  19866881065811
tttccaaagggaaaatacatttaatatacaggctgagagtgatcactctgctcttactgcctcctttttaatatcagagttcagcatggatctcttgcctgtcctaggtctttgcccttgtggctgactacgggctcaggagacagatactctctcaaatgctccttgactgagccccactggggagcacggaggcttcacctaccatgtctaccccatcccaaactctggctgtctcaccgtttgggtggtagggcttttcacagcaggtgagtgtggaagtggggtaaacaattcagaatactgggaggaacctggatctgggggctgggcccaccagctctggacccgggccctgccacatcccagcattgacttcatcacacccatctctaaaataggctaactattccccctggttgagttacggagaggaatagagataatgaacagaagtagaagaatctgacatttcataaacaggaataaaaatatcaagatgatagctctgtattttgaggtaagcagagaagcctcaaactgaggatggacaatccatcagatgaaagggagggttgagacaggacactggaggatgaaagctggggggtgtctggccaagtcaggagcacagccccactgatgtaggcagcaggttatctgcaggtactgtgaggagggtccaagggtctgtctgagattagggagggcacggatgaatgaagaagcaagacttttaaagctaggaagtgtgacctggtggccagaggcagacatccgggctttcactttttctagtcctaacagggagagcccatcagactctggtgccacattgccagggtttgacttctgaccttgccctccctcactagctgggcaaccttgagccagttacttaacctcgctgaacttttagtttttcctctggtaaatggaagttataataatatctacctagctttataagattgttacgacaatttaataaaattaagatgtgaaaaactcttaaatagttcctgacacatagcacaccaaaaaagatgctgatatttttaacataattcattcctttaaacaaattcattcgacaaatgtatccagactagacactgtgttaggcacggcaaagcagctgtgaagtggtttgcacagcccttgccctcatggaactgaaagcttagcttccaaggatttcttcttgttccttgccaacagctcagccaagataaggttttggtgtttattctcagatctgtgatctggactataggccttttctcaggtttcatttatttcttagcatacctgcttctcctgcaggtaattgagagttgttgggacattctataaaaagcttactgaattgagggtactcaatcaatgttgaataataacaagagaaatgtataatgtataaacagattatgttggggtcttaaactttccttcatctcattaatatatatgggagcacatttcctctgctttgctgtccaatgtgggctgtcctccagccagcaaggaaggccaggctccactgagtcccgcctggggactggagagacttggggtgctgctcgggatccaagcaggggccttcttcacaagtgtcggccgtttcctttcacatgaagagttgccctttgtttaccctttatggtctactgggcttcccaggtggttctagtggtaaagcacccgcctgccacttcaggagacataagagacaagggtttgatccctgagtcgggaagatcccccagaggagggcaccgcagatcactccagtatcttgcctggagaatcccacggacagagaagcctggtgagttatggtccatagggtcacaaagagtcagacatgactgaagtgacttaccatctatcaggcttagaacagagcaagttcttctgtcattttgctttatccttaaaacaaccctgggaagtaggttcttctgacttctcttgtgtcttaaggaacaaagtcagaaaggcatgccacaatttgttcaaattcacccagtacagctggggtgggattctaaacccaggcataggcttacactaccacatccccttttaacaaatctctccagcctctaacatacttgttcctctagaaaacacgaggccattctcttctgcataaaatcagctgtatattttaaggaaaccccaaagccttcagtgcagaataccctgttctctatacaggaattcctatcacgctttgcaaatctcttattgacttgtttattttcagtgactctgctactgctgctgctaagttgcttcagtcgtgtccaactctgtgtgaccccatagacggcagcccaccaggctcccctgtccctgggattctccaggcaagaacactggagtgggttgccatttccttctccaaagcatgaaggtgaaaagtgaaagtgaagtcgctcagtcgtgtctgactcttagagaccccgtggactgcagcccaccaggctcctccatccatgggattttccaggcaagagtactggagtggggtgccatcaccttctccattcagtgactctaagttctatcaactactgtacctcagagcaatgcttggtacgaaacagatgctcaataaatatttgtggactgagtgaatgaatttatctctaaatttgtatatcatttaaaggatctatcacaggagatgcaaaataagtgctcaattcttgtttgtccaacatatgtatggaattacggttgcttcatttagtgcctgcattttatcattcttgctagttaggtaaaaaacaaaacaaagaaccacccagacaacagactaaccaccactcaggctctttttaaa

SEQ ID NO: 54149 - DNA, 679 bp, Bovine  19866881217159
ccctttagcttctctctgccccagcacatatacacattcctgccaaataaataagataaattaaaagcctaaaaggtagatagtgtgcaagttctttctccaaagcgtaatcaggatgatcatccctatttgagaaatgacactaaatgttaatctaattgaatctaggaaatgtggcaataaaaagttaataatttacagagaaattgttcttcagaaaattctaagtgaatgcccactaaatgaatttcaggaattgtgctcaaaggcacataagatatgtgacaacagcaacggcttactttgaatatgtttttcaccacacccaaactatttgttttaaggaggcattctggtacatatatgtgtatgaaggcacacacagtttgtttgaaaactatgtagaaaaaaatgagaaaatagctccttgagtcaactgaaaataacaggaaaccacttgagtgtttaaattttaacctaaagattggtttcaagtgtactcaatgctgtttctaaaatcagatttactacaattaatacatatagaaaatacataaatcttcattgaattttttcttctttaaaaaacattatttattcatggctgcactgtgtctttcctgctgtgcctggctttctctagctgtggtgagtggcggcaactctccagctgcagtgt

SEQ ID NO: 54150 - DNA, 910 bp, Bovine  19866881270972
atgcagatcattaggaatctttttgtaatctctgaaatctaggctttcgcatcataatcctagcattttcctaagtcgtgtgtgtctgtgaattactttgtctttgggggaaaccgaggaaagaggcagattattgcctgagctaaggaaatactggcacttgttgagtgtttgatatggacattaaggtggtaaaaaaagttaagatataagattgattgagaaacaaaaactgagatctagacacaagattataatggattaaaggtggtcacaaaattctttgccatttttctcctcagtaaatggaatgtttttcctctagctgtaaatctgagctggtcttttgagttgcttttgctcaatagaacttagcagaagtgattcttgcaagattctggtatgagctttgagaaggcccagaagctaccacatttgtgctctcttaagtgttgccaggcactaaaaacttcaggttagaatgacaagagataacttgagagtgatcttagaagtaagagaccattttggatattctagtccaagacatagctgactgcagctttaccatgaggagcagaagaaccttgtaactgagctcaatccacctgcagaaccatcaggaatgacatcgttcttacgttaaggcatgatatattcaggtgatatgttatatggcaatagataactgaaacagattttacattaaagatctccattcatttttttctcatatcttaccctccttttgaagttatagcaactggtagttatcacctgtattcctatgcctcttgcagaagtgactcaataacaataacacaaaaagccaagatatgaattgggaggaaggggtagaatttttcaaggagctcagattgattccctctgctattagggtttttttttt

SEQ ID NO: 54151 - DNA, 1609 bp, Bovine  19866881342616
cattggagctttaatatatcaagtataaaagtaataatacataatttaggtcaggtaaaaaattaaaatgtaggctagaatttatagaattgattttgtaattttaaagcatcagtggtgaaattgtaagctctcttgtcctaagacattataattccctttaatcagcaacaatggctaaaacatgtgatctaaaattgtagcatttgcttacaaacagaaaaaagaagaaacaaagagaaactatatggacttgcaggccataagaaagccttgtgttacttagcatttaaaatcgtcaaagatagaaattaaaagtacaaaagttgaagcattggtgaccacagcaaggcctccagacatgagtcagccacaaaaaatgctcaaactcatttaaaaagctctttgtcatggtccaaaaaaacaacatttttagtgttttcctttgacttcacatcccgctattgcaagtacatggctaattattatctgaatgatatctattattcctgtgttccaaccggatatgatccaaatatggccacaaacacattatagtgtgcagcaaaatcaaaagaataattctgtttttaagggttaatggtagtttcactcctcctcagtttgaaacatggacaattgctctactgttgtctattctaggcagctgtgcagaatagtaaaggtttggagatctttgtaggcaggagaaaaattaagcctttgtatactttttgttcaatatattctacccaacacccatatgtaagagttggacttgggagttgcaacaggctaaggaaagtttgcacagatagacagagttattcaaaattctgtgcctactaagctctgaatcacaaagtgcaattgcaaatcttttagaaattatatataaaaaatcctttctctaattctgcccactgtattctgtgggcttcacatattatttttgaataatgaacacatgaaacagaactagttgaaagttagcaattacttcacctttttcagttctcaaactggtgctgttcttaagcctctgaaaaatggagtggtcttatgaaagaacatgtccatgtgtagaaagaaaagcgaaaataccagtttagttttagatatctgaaaaatgaatttcaaataattgaggactgtggccacaattgaaaaggtagagttaaaatcatttgtgcctccatttggtttcccaggatgtactattctgtatctttctttatgtcccctaagcttggcatgaatgcaaactattcctaacacatatataactgggaagagtgagccaaggtgacagggaggtggaatatgggataagaaatatcactggatctaggattttattccatttgtcactttggaaatcatttctaagaaagatttaaaaatccgaatgccctttcttatctcactcttgtaattgttgggaaaggaataataataatagctacctcttactgagcacataatatgtgttaggcactacctttctagtatcccatttaatcatcacaacagcttcacaattaagtcaaatgcttaccgtgcctgaaagggcccgatatacttttggccccagtgacccctctgctct

SEQ ID NO: 54152 - DNA, 951 bp, Bovine  19866881458127
tgactgaatatgcatttcccgctctggtcgacttgctaggctggcccagaagtttgttcaggttttccataacatcgtatggacaaacccgactgagctcttgggtcaacccactatttccactggttcgatattctccttcttaaaatcacaggtgctttgacatggatggacctggaagacgttatgctaagggaaatcagccagtccccaaaggacagatgcagcaggattcctcttacatgaggtccctagtgtagtcaaattcataaagtagcatgatggtggcaggagctgggggcaggaaggaatgaggagtcattggttaatggaaatggagtttcagtttggaaagaggaaaaagttctggagatgggttggtggttgatgatcacacaacaacatgaatacccttgatgccactgaactgtacactaggaaacagttaaaatggtagtttcatgttgcatgcattttaacaaaatttaaaataatcagctaggtcccaagctgcagaaggctgtggtccatgtctccccactctggattcctctcccggccttccatttccagctcttttagtagcaggataaatacttgtggaagtgaagtgaatggcattgttgcctcgaaattgagaaggaaaattagaagcggactcttcgaaaatgcttttaacacgtctcacgtttcaccttgccgctgtctcttcaggatgtaagtggaaaaaaacgtcagacctcaaagccaacaagagaaggcgttttctgggctcagatgaagaaatctacaaaattaggaaatgtttgtgctatttctggaagccctggacaggctcagttcacctccaagtgatttacctgtggctctccgtgattatttacttggctcttcagttcaagacaatcacaggaatgtacggcccataaattagaatagctatgaaacaca

SEQ ID NO: 54153 - DNA, 1450 bp, Bovine  19866881474476
tcccttaatttggacccctgaattagaaatagcagtcaagtgttggaaacagctgtagtgcccggcctgacacaagtccatttgttatacaaggagaaccaactgagattgttttcctgtcaaagaagacttttctctttatggaataggctgtcatttataattttaagcaggcacggatttgttaaacagctacacggtaatgggtttctataagaagatccacagacccatagttctggaaagaaattgagcttatgagatatttaaaaacctaatgggaatggaatatttggggtttcttgaaaagatggtttctgctctgcacattgtcaagggaatttaacaataaatccattgttgtgtgtctgagagtctgtttgaggcaattatattttcatacatcctatggagttgatcttagggaaatccaccagggcaccaagcccacattttcatgtcactgcactgcgtgggactccccagggtgaacatttaacggtagcaggcaggtttaaaaagagtcaggaaaacagctaatttatgagtggtcttgacgagaatggactgcagcattccacctggcaaagaaattaatatacacagagtacagtccaaatgagaggaaaggtgtgtgtgtgcaaagtccttttcacttcactccacatgtacataccctattatgatgtcacactccagcagcgttgctctgaagtctcaatggtctccctgctgttaagcaccgttgaaaacacatttgtcctgactgttcttttcttcttatgcccctctcatctgtgtaagatgaatcactcctggatccaaactggctctgaggacagagctaggtcctgacgaggtaaccagcctcctatggcttaaacattttaattaatttcaacactaatgcacaaatgagagttaatcaccccactgcagtgctgtctaatttactaagtttattcattaaaacttcccttactaaactttgattgcatgtcatgcttttttggaggcttttcagactgccttaagggttttaaagtgatatcttgagcagctgctgaaagctttcagtgtttgcttaaaaaggaagaatggggagaatctgatcagcaagaaatcttctctgtgctgaacaaggagccttttaggtggcaggaggcctgtaaaagcaggtttgtttttaagcaatatataaaaaggaaagagaaacttaagtatctaataaaagaaataaaatcagtcaccttagtacttggcaaaacttggaaatacatttcagggtaagaggcagccatcctttaaaaaaccaacagaatgatagcagcactgtgtattcatgtgaggaaagatattcataacagatttgccaaccttattattttggaatcaatatattacatatcttaggtacacagttttgctcattaaatgctagtacctaaat

SEQ ID NO: 54154 - DNA, 733 bp, Bovine  19866881585842
tttcccctttttttctattgagttcttaatttcattgttttgtaaatgtgtttgtatattaacacattagccctgtgtctatgacatatgaagcaaatattttcccccaggatatcattgttcatggtgctttttatgatagaaagttcttaatcacctttatcgtttaacttgttcccactggaaattccattgtaaaattccagccctcttttactgtcctttcctctttagccagggagcttccgacattgacaccacaaagcttttcaaaaggagtctgctactgctaagtcgcttcagtcatgtccgactctgtgcgaccccatagacggcagcccaccaggctcccccgtccctgggattctccaggcaagaacaatggagtgggttgccatttccttctccaatgcatgaaagtgaaaagtgaaagtgaagctgctcagttgtgtccaaccctcagcgaccccatggactgcaggcttccaggctcctccatccatgggattttccaggcaagagtactggagtggggcgccattgccttctcccaaaaggagtctaagtcataactaaaaccagccaccaaggaaaattaatcatttggaaacaaggccatggggcttcattggatgcttcataaaatgataaccattggctggatttgatactggttcaaggagtgtctcattttcatagataaatcccttcttctagcagatggtgtgtcaga

SEQ ID NO: 54155 - DNA, 1095 bp, Bovine  19866881656496
cctctcttcctttcctccccctcgacccctcacaccgaccttcggcggcctccacccagtcctgcacacctaggctggcggagcaaactctcactgcgcgcccgcggggaatatctttccgtacaggtaaaaccgaaaaccgatttttccaaaactgtacccggacggcgcctgctctcagtacctgggggatgagagggaaattctttgtacatatttgtataaaaattattgactttccttttggggtttttatttttttaagaaaaaaaaattcagtagatttagagctctgaactttcattttttctgaaggttcactctccgcagttttatgtgagaaaaaatgtatagagacgttgggagattttaaatataaaattttcagaagacgaaagtcattctatataaaagtctgtttatatataatgaatatatatggtattctaaatgttattccatcgtgttgtacacaactttgtaaataaaatttttaaaggctcagcttaatgtttcatttaggtgtctgaggtaaatgacaagattttaaaataatatttgcattttattcttcccagatgagtttcaaggaatgaccttttcaaacttcgctaattcataatttgagtgtaagaaaaatttaattggaaaaatatgcctaatttaaattgtactaatattttcttttagttttcacataacatgggtgtgtaggtgggtgattttcttcctatcaatacgttacatctaaatgactagatatttctgaagataaagtaagctgccatttaaaaaaccaacctaattctaaacttcagcacaattttaattatttttaaacatcagacttcatctttcacaatggaaactttccaaatgagagttcttaatcatttcagttaacctttcaaaagaatgttaattccaaacatttccctcatcttagcatttaaagccttgattttttccaaactattttcataccctaagtggaagtggtaataaacccagttaactttttaaacatatgtaatagcattttaaattttgtagtgaagttgtattaccctatatgaacttcatagatgatacata

SEQ ID NO: 54156 - DNA, 1558 bp, Bovine  19866881660474
aatgctttatgttggtgatggtggtggctactctgtattgtacttggaaaatccagtcttgaaacctgtatctgtgggaactcttgggctctgtgaagttatgtgggcatggattcaaatcctgacttgctagttctatgatgtctggcaagccactcatactctttgtttctcagtctttgcatctataaaatgggtacagcaataccctttgctggattatagataggatttgagataatgaatatagcacactggaatgtggcagcatctccataaatagcagacattgctattataagcagtatctagagaatttctgcaaaaatttaccaagtccctcctcctcttttgaagtggcaagtctgccacacagccagttattgtcactgtttgtgaggcaggctgtagaggagaccaccctcatcttctctgttgaagggttccttctcctctggaaaacaactggctgcttgagccagaggcaggcaagaccatcatcttccacaatttgtcatcagacttgatggatagtattcccaagttaatgccataaatgctgtttggaaattacaagtccatactgctggtggtccagccaaaaaaagaattaatttataatcatgaatataaatttcaaagatagtattattgtcattcagggtttgagttatggtacatatggggagtggcttgtagaatagaaaactatgtcgctataactcagtgtaattccaaagacaatagttatatctatcattttgttataaatcaatcgatatcctgtattaagtgaacagtccttgcctcctcagctgcacagaggggagtggcagggaggcctcagagctttgtttaaggtattgccggccatgctgactcatgctgacaggaaggcagaaaagagatgcttcagaaattcttgcatgaactccaaatgccttggtccaccggacaacgtggccagatctataaacattttacaaaatgaatgacgtacccaagggtttaaagatatgccttttgcttgcattttgtataaaagaactacgtttccagaactgggaattatttactaattgcagacaggattctgactgaaacagcatcaatcccagaagagccagtgtgcatttgaaggcctctctaaatgccatgaatcaggcagtatatctttcctgttaatctatattggttccctcccaaaggcaattgaccctggggaaaggtaaaacagaaagaatctgagcaccactgagctagcatataactggctttgaaagtgcactgctggggagaagaatgccgaaatatcacagggagcagtagcttgaggagaaaagaagatggtttgaagtcagtggaaagtaattttgccaagtgcagagttatctagttaacctattgttcaacataatgaaaaagcagggctattcgggagtgtgttacagtgtgtagtttgtcaattacccaatcagggggcattgttcattcagccaggatggagggcattacccatactattttattactattaagcctcaacttggcatatttt

SEQ ID NO: 54157 - DNA, 1689 bp, Bovine  19866881670307
tagttgggtgcacaggcctagttactcgcagcatgttgaatcttcctggatcagggactgaacccatgtctcctgcattgacaggtggtttcttaccactgagccaccacggaagcccgtgttagcattattctcttttgatgattgagttatctcaaatttgattagtcccttcaaagtagttcctatgacctttgtatatgtccatattggtatttgggcaccttcttccttttttgtacaataaatgttgcaggcttaccttatctattctctgcttgaggcttggaatcagcactttgaccacccttttttaccgccagcacccttgttcattttagtggaaaatggtacttagaaaccaaaattgggcattgaaaaaactcattactactggagtatcgttgctttcgggccctttaaatggacacacacacacacacgttttaaaagaaatcgtgattttataggataccttcaagttcaaaaccacagagttcaactttaccttccctcagtttatatttgtgtctcccttttcctacagggagaattctgattctcagccatattaatatatttactcatttatatttactctgtcttacacacatatatgcctggaggagggcatggcaaccctctccagtattcttgccctggagaattccattgacagaggactcaggcaggctatagtccatggggtcgcaaagtcagacatgactgagagactaagcacgcacgcacgagtacacacacacacacacacacacacacaccacacacacacacacacacacacacacacacacacacactctagttttggaattactatactgatactccctcctacaacagatttaccaagtaaagatttctttgccagtttatgtccttggaatatatccctctaaagatgtatagtcaaagtagatgttcagagttatttgaattattttttctgtgattatattatcaatttaaaatatagttaagttcctactaaactactttttaatagatttcctgtaaaattggttatctgtaaaactactaaagtagacataataatttaaaatgatatcataatatatagtaataggaaactctagaatagagaatatgcagtttttatctttataaggctttaaactcatactttattttcaaactggtgttatttttttattatttaaaattaaaaatgttgagaaaaatgacatcaaacaatcccagttgtaagccagaacaattgtgtttgtgaacattttaaacaatgctcttcttttgactgataatacaattcaagcattaatctttaacaacagatataattgttcagggtgctttaactcactcctaaaaactatggctagtgttttcctgtatttacacccagaatagaaagatattatataagtccttgttcttcatatttaaagaatgccttttcatgtgtgaatattctcactggaaagggaaaaaatatttctcttaataattgagcattttatatttctaatgtgagacataatagccatattcagtcttgcattctgattagttataaacatcttgctgattaaaatgccgggttaatggggacaggaactgggttttgtgcttattgtatttcctataccctagaagtgagcactgcaatacggagaatgaataaatatg

SEQ ID NO: 54158 - DNA, 1386 bp, Bovine  19866881736238
aatgccaagggaacacgttggtcctggccagtcaatctgcatcttagaagcagatgggccagattctcctgaggtgcttgggagtgcatagagagatggattcctgaacaaaatcaggttctgctggaaaggaagacaggtggggaggaggaatgctgggtgggccaccaacaatgttcatggtattctagatcttgcctatcatgccatgccaccttttttttttttttggtcccagtttctctttataggatgggaatggttgtttttgttttacttggaggtgagagaactgaacttggatttataagctaatttgatttatgtaaatattgtccctcatagaacccgaagcccagcacttgactcaatgccaagaacgtagtagatctcaaatggcgtagggtggtgcattggggaaatttaccatccattgctctgttagtgtcccagttctgcaagactgtcttgtggggtggaagggctgaggaaaggagtttgtgattattttggacatacggtttcaagagtaattaggaagataccctcacctccatccttcaagagctctttccttctgcttcactagaagaaagtcaggtatacaattgtctgtgtcttccactcaagccatcctggtttccctgagatccctacagctggacatctctgtcttttaaagcagacccatcccttagtgcagacataaagacgatgaaatccattaacgggtcctgaataagttggggaaaaaatatgacaggataagtatgatgtaatttaagtattttggcatagcaaatggaaagaaattacattttctattatcttccaacagttattgaaaatgaaatgaaatatattctatactcccccaaaaagtcaagattttttttttcccacttaaatgcaatttttcccgcagtttgttcatttggtatgcatttccctcctttcatgacatggaggcattctgttatgaaacattcaatgaaaaaaaatggacaaaaaagtatactacttctttaaaatatattgcaagaatactcattttcagctttttattgcagcactagctggtattcttgcatgcagttttgtaatttattctgaacattctacttaaaccttttttcaatagcatgattttattagagtcagctcactggactttcccaaaaaggtatttaagatcaaataaaaccagtgcttggaaaaatatcattacaatatgaaagcagttacaaaaacattagtactgcaaagttttatttcaaatggctgagcttgctgtaccccgggttatggtacttctacttctgcagacacacttactggggaaatggaaaaaactgtcatcttagcagtttttgcacatggtggggg

SEQ ID NO: 54159 - DNA, 1383 bp, Bovine  19866881762605
acacacacacaaagagtgtcatgggaaaagaaagaaaaataagcaaagtgaagggagagggtgcagatgatgtggcaaaagaaagccaccaagcagtggtagcaagggacttgttgctggaccctggatgtgaaatcttgtctggctatttaccatctgtgaaaactttggcaagtcaagtaactgcttgaactttggtttccacattgatcaatgggagtggtaggtggtaatgctaatgaaactacagcattgtgtgaggaatcaaaccagatttccaaagaagctctttgaagggacaaaatttatgcacatttcaggcaaacctgaggccattcaagtgaagttaagggtctctgggtggaggagtgtggggtagagaattacagatggagtcaagacacaaaacttgacatcccaggatgactgattccagttttcaagagcagcgagagccgtgctaacactggcaaatgattgccatttcccttgtcaggcagtgacaggagttagttgacctgaaaattcactaatagttccattagagaagccttggaagtagccatctttttactcatcctggtcaattaacaatgaattaatgccagacgtattttcaattgagctgaatgctgactttcccccattttgctaaaaatatctttttatagagagacagccagctaggaaatatccagcttttcttcccaaggatgctctggagtatttctgaaccaatgtcagctctaggcagtggtgaggtagcaggtcaaatcctgactttgacagaggagactcaggttcaagtgccagctcccccacacacccgcttcatgctcttggaaaaataactgaaaccttacaaagttcagcgttttcacatgtaaattggaagtgtagagatgaatgctaaggttgctttcagagataaaatgctgtgagaacattttaaagaggtttcgggtgtgtcagtgttatggccggctagacctggggggatgagggaggagccctggatttcttctatgtacttggaactaagagtccagaccctgcactacatctcaactcttcattttagttcagtggttctcaagcagggaaggtgagtggaggtggtctgagattgggggcagattttgctccctctgaacattcagcaatatctggggacattcttggttgtcaccatcggtgatgctgttggcatctagtgtgtagagaccagggagactgccaaacacccttcagtgcacacaacacatccccacaacaaagaatcatccagcccaaaatgtcattggtgctgaggttgagaagggcctgccctttattattggataataaagccaagtgatagcttttttgtgttctcagtgctct

SEQ ID NO: 54160 - DNA, 1597 bp, Bovine  19866880446927
ttgcgtggcaactgggaacatgcctgatcacataaggaaaattctgattgaggccaagccgtgtctgaagccatagttcaactttgagctttgcctctgacccagatacatacaacctagggacttaaaaaccatgtgtggcagttatatgtgggaataggatggaattgacattctctctctgtgtggaaagagatgaaggtgccgacaaaaagactacacttgttaggtttcagactgttcagccagctgaactccattaaaactggggccatggggtaaagaaatggccacatattggcatttcaaagatcccttacatatatgtgtaccacagacatcttctgaattgtagcaaaatccaaattcatcggatagtaagactcaataagaacactattacttttcttagaaaatgtttaggttttgctatttttcacttgatgtgagcaactctctttgcattcagaatttattctaaaattaccaggttgtcatatgtgtgttacctctggcttatttcatttgacttgaggaaaagaattaaaaacaaaccatttttctgaaattaccaggttgttgtatgtgtgttaccctaggtcatgtcatttgactggaggtaaagaattaaaaacaaaccatggagatattattttattccaattctaactgctgaacactgttctcacaacaacaaaaaaagcacaggtagcaaaacttcatctcccccaaatgcacttcaatacgttttaagtgtaaaaacctaatttaaaataatgtcagcacctttgggttgtagaatatgaggctcagcatctttaaattatttaagaggtccacagagaaccagttatgcttataatgtcagatttactcaaagaaaagggagagcaaagcaaagtgttgaataagggtttcatatgcagtttcattgttatttctacattcagtaattgtaatagtagtcctactaaactttaacacaaaacaagatatgcatgtgcataatgttatgggatctatttagtgtgttttgtggttttaaagcaactatttgtgttcaactgctgctacatctctttttggcttttgtttactaacaacaagatctatcagaaacatactaaaaaaattaatgcctctgccacctttaaaatttgttatgatttcctttaagtaagagacaggcaatctctaaacatatatagtatacagctgccttggtttcctcttttccaatgatctgggggaaaaataaacttttttccttcaggcaaggtatactatataaataattttagcagtatattaatctataaaatttccattattacacaaaataaaaaataataaaatatatagtgtaatgctcagaagactctttggctatctggaatggtaagaaaggacactgaaaatttttgaaaccagaatctctatccataatgaacatgataaaatgatgagagtttattgccactatgttaattactagagtttgccagacttcccaagtgggtcagtggtaaagaatctgcctgccaattcaggaaacagaagatgcaggttcaatcgcgggtagggaagatcccctaga

SEQ ID NO: 54161 - DNA, 1419 bp, Bovine  19866880481194
cttatttgttgtgcttcttcctctcctcccctggaatcgttgcttcactataataagtaacattccttccaattatccaagctcctcaagtccacagagctgacccccatgactttagaacagactcactgtttagagtcattaatccgagattataaacatggagggagattcatgagaaagggatgaactcatggttcctgaagaaagacaatggcatgcagtgttttctcagaggttccgtgctgtgtgtgtgtgtgtgtgtgtgtgtatgtgtttgtgtgttttgattttgaatccttcctctttcctgagaggatatttcctctcatcttctgaactgctattatcctctgcttgttctgaactggagtggtcagtgacacctattgcaactggtgtgttgcaatggtttagtttttccttgtgtctttacctggacagcagattccagaaggcaacaccctaccttgatggagcagtgtaaaaaatcaggcagatcagatttgaaagcttttatccactaggcaatgccaaaatttaattgtaaagtgcttatctttcctgtaaacctattgttttttttttaattaaatatgttgataaacatcattgatgactccatataagtcaggaccactgagacatgtttatatgaatttaaggcattacattatttctatagatcatcctgaaggttttgatgttctctgatctttcttcttgacttatacaaactttttgtttttgttttaatcttaggggaaaagaaggaactacataaaatagacacctatattctataatgttctatttataagttaatgttgtaattaggaatcttgaactcatttttgtgaacttgatatgtatccaagtctttcatcttcactagaaatctgattaaatcttctgagatctttttggaagttgaagagaaatagcatcctgaatctgcatgattttgatactgcattacataggaaattaaaacattctttttgttgctggaattggctttagaacaaacagcatgtgtcccccttggtctggagctctgatgtcaatgtgagctaaaatattctccaatccatttccaacctcagctgcttttgctgcttccttataaagattatacatacactttgcaaatgaagaaaggaattagtgatgctctctcatttcctgtctccccacagatggtgataaattcaaattcagaccccattaaacctgagtagagaaacccagcaggtggctgtactaatggaaaatcctggctttggaataatgggaattacaaccgacagctcttctacaccacaaaaaagatgatgtatccttattgacagtgtcgcatttgagtccagaaggctgatctgatagttcattcctggcacaacggaagctaaaagcccc

SEQ ID NO: 54162 - DNA, 1175 bp, Bovine  19866880532299
tacttcctcattccccttggacatattcttttctggaattattgaggcattttcacataatactgttctaaacttgaaaattcaaatgcatcgacattccaagcataactggaacaaattcaaatgaacatcagatttccatttaaatccaattttactctttctccttcctctgtttcaagtctcagaacactctttcctcttatagctgagctcatctctcaagagtcaaggaactcacttgggtcatcttcctacctggggcagcagccatcttcaagggccttcgtctgtgcctgcataccaaggagattcccacagcagagccctggcagtatgctgagatgagtcctgaagtgctccctgaatgtaaatgacctgaaacaataggactgcaattaagaagaaggcctgggtttctacgagtgcaacattccaacctttccatacactgcctgaactgaacacgtggcaatcacacccacttggctggcagcagctctgccatctttctgtgtgtgtgagacccattttatcagtagcatgacaatgaagctggaggatatacaaaatgtgtataggttctagtttgaaaaatgaaaaaagggtctacaattttttcaaagattctaacaagagaggcaacagaattggtaggcagggtatgggctctgggttcaaatctttactactcagcattttgtgattttctgcaaattccttaaattctcttgtttcagtttcctcctatctaaagtacacataaaaatgtatgcctcagagtgggggcttggtgtatgtgtgtgtgtgtgtgtgtgtgtattcatatatatacatatacatagtacatatttattattatagtgcattttaaaactctaagggtaagacagaaatgtgtggtatttcagacttaataaagagaagtttctcttcttctttcaaatcagaaagaaagattctgtataatttgaagaaagctttgtgcattctattttcatacttagtcacacataggggttcacttacatttgagtacagcaccctttctgccagtcccaggtaagtagaatacagtagttacagaaatattttaaataacagaacagcaacaaacatgaataatagacacataaattcatgttctgaaccttaactctgttctcaacattccg

SEQ ID NO: 54163 - DNA, 1077 bp, Bovine  19866880536523
ttatgtaagaagaaaaaagcagaattaaatgataactattaaaagtgatgtgtgaggcaaactgaaattgattttatattccattaagcagggcttgtgatgaggggttaaaagactatactctgaatttaatgttaattgtgtatagagaaaacaaaagtcatactccaaaaagcaaagatgtggaaagttctaaattttaacaatttaaagggctatagatgcaattcacaagttgctgatttttttcttttctgtttttttttttggcttcaaactttgattcagacttgtcttctcccagtgtccactacatgaagtaacagacagaaactctaccctgggaaaactaagccaaaatgccagggtgtcaaaatagttacagataatggaaattagatgaagaggctactgaacaatgttctctggaggcaaataggtctagtcaatattaagcaccaggacactgggcagaaggctatttacagtctctgtggacttgtagggaagattctccaaatatagtaccaaatctctgcttagtgggcatttcaaggccaaaaggaaggttgtatctatcatatccaaatactctccaattcttcctgaaacttaggccaaggttgggaagaaagttgttataaagcaggagacttcccacaacacagatgtgcattactgactccagtgacatgtaagtagtagaaagatattgaattcagggtcttagatttgaattccagggtagtcacttataagaagtctggtcttgagccatccttttacctgctctactccatcactgaaaggatataacactaacattttatggttaaataaaataatgtgcagtgcatgatacatagcaggtatgtaatgtagcacaaataatgctatacttagaagaatattaatattattaattattaatattaatattatactttaggattggccacagtcaatcctaaaggaaaatcagtcctgaatattcattggaaagactgatgctgaagctgaagctccaatccttttggcacctgatgtgaagaactaactcattggaaaagaccctgt

SEQ ID NO: 54164 - DNA, 1648 bp, Bovine  19866880567042
atctttagtaacacctttcatatacaaagagtttggcagtaacaagtctaacgaaggctggggaatgctgtcatttctgagtgtttttgtttatagctagtattttataaaccctttgaagaggtcacactttccacggatacttgtgtaaataaggcaaataatttttgttgatatatgagcaagaaatctaaagagaaaagagaacactggctgactattgtatgttttggcaattcagaagtaactgtaagagagtgaaagatgctaatgcggtagcattctctttccagatgttcatcttctggacttattttctttgcttaaaccttggtgaattcttggaggtgtgaatttagttggaaagcatatttttgactggtgataacgtcatggtccacaaaaagattgaggaattttctaattggggaattagaaaaatagctatgtatggtaaataacctatgagggaatagttacagaaacaaaaaatacacttaaaaaaggataacaatactttggaaatttcagatttcactaaaaataactagtaagggatcactataaggcaaacattctggagccctcaactttcctgtaggtgactcagaatatgactttacatgtaaatttctgacaattgtaaaaccatatgtacaataatggataagacttataagcatatatagatgtaaaataaaactaatatctttgaattgctaagataataaaaggaaaaaacaaaggaatcaacaagaagtcattaaaaaccaaaagcatggagaaatatgatagaagttgtcagttatgataataaacataattggtttaaacttatctactaaaacagaatgtcttgccaattgtcttatgagacaaaatctaattacatgctgattgcaatagatatgtaaaacaaaatgaggttgaaaatttaaaactaggcaaaaaaattagttgaaaattaaacactaggcaaaattacactgggcaaggtaaaatatcctgaaatggaatatgaatattagttgaagttaaaacaaaacagcctcaaataatataaaaaagtatcatcatatattgataaaacttataattcctaataaagatacggtagtttttcatgttagagacaccactttatttttgacaccaggagtatacaatgtacaagcttgataagaccttgctcttaatcaaaataatactctaataaaaaatttaataataaatacataattaaatttttctgtaagataatatctataagcagaataaaacgcgagtcaaggacaaaatgaaggggatactgcattaggaaagataatcagatggcctctctgagaaagttcaatttttgctgagacctaagtgatgagattccagatgagctatttcaaatcctaaaagataatgctgtgaaagtgatgcacttaatatgccagcaatttggaaaactcagcagtggccacaggactggaaaaggtcagttttcattctaatcacaaagaaagacaatgccaaagaatgctgaaactattatatgattgctctcatctcacatgctagcaaagtaatgctcaaaattctccaagccaggcttcagtagtacttgaaccatgaacttcctgatgttcaagctggattt

SEQ ID NO: 54165 - DNA, 3121 bp, Bovine  19866880577882
gctcctatagtggtggcactctctattcccccatccccctcttccattttaagagaatttttaaagtgctggctcgttgatttgaattgttctttggggcttcgatctgtcttatgttttgtagtaactggtactcactttggctttgtgtaaataattgcagaggccattaacagaagattaattgttgacagtttcattactcttggaataaatagaaagtccatgagctgagattgaagaggcaacagaatagctttgaaactgtagaagacagatttccaggatatatttttgagatggcaatgtcagacaaataggtatagtatgaattcctaaagttcccaccctaatgtccctcaaatgacataaatgaattgatggggaaacagaagcataaaaccaaaggaaaaaaatcattttcaaggcaggaattctcattagtgaatgcaatagcacatttgaggtaagtggaaaaaaattcagtttgtcaacaaattgtctcatcaacacaaagtcaaactaccagtcttgatagattctcgcactaactgaccaagttgattgtttatattataatgtgaagttaaaatgtcaattcttgtcagtcttccacctgaagtagtattcaatacacacaggaggttactatagtacctcctgatgtttctttgtgggtgaattcatcaggtagtattggtgacccccaaaacctcaagtgtgatttatcagctgaaattctaattgattatattgtcaacagcctttgtagtcaattatgcaaaaccacagggtcaggttaattgaagatagcacttcagtccagcatgctgatgttttactctaatccaagaggagtaaatacctacataaagattaccatactggtcagtccagaatagccctaacagcccaaatcttcataagtaaaaagggggtatgacccatcacaattgatcagagtcattgattgacaatccatgtttttgacaagttcctcttgaccactaaatgacttcttatttcgattagatgtgaagggcttacaactcaggcttaaacttggacatttttctatctaaagaaccattttgttacccttatattgttttcctctctcgctaaaatgttgtgatttgaatggaaggcagtgtttgcagtgtttgaaacagctagtgaaaggtttttagggagaaaagcatctaattactagtgggaaaattcctttagctctcctcttttttgaaagataaatgaaggagctgtaaatgtttaactccaattatgtttccatttagttgatgctattgaggttgatttgtatgtaaccagagtgagttgttcatgtctagaatcagggttttttcttgtaattgtagagatcacagtggcatttacacctgctaaccataggctttcattacaatgattgattgcttgcattgatttatttgatatgtgggcatttctatggtgtgagttttctctgtaaaatgtacacagttcatcatttgggctcttctcttgcattgccattaaggaaattttgggcatgtttgcttccaaaaggcttttcttgattaggtaaaaatgtattgcctttgaaggaataagatatgaatcactgaatgcttttctgggttggagtggtggaggggacacttaatgaaaatcatttttattaacatttagatgtctttttgacttgatagctgtggttgccagtttatttagacatctgctcctctggttgaaagcagacttaaaatcagagggatgttcaatgtttaccacttaaaagggtagaagcaactcacattggttcttcctaggctccggattgtactctgaagctccttttgcgctatcataaatgaggtcattgaattaaatcaatccctgcttactaggaaatcccattaaaaaaaatctttactagatttgtaatctagtaaattgaaattgtaaactagatttgtaatctagtaaattctaatttgaaagcataagaaacttacatacttatagttagttgtattgtgtccccccaaagacatatccatgtcctaacccaagtacctgtcaatgtgacattatttgagaatggggtccttgcagatgtaatttagtcatgtttctagagctgagactcattttggatttcagaagggtctttcatccaacaattgctattcttctaagagagggagatttaaaaaacacggtaaagaaggtcatgtgaagatggaaacagagactgagtttgttgcctcattccaggatgcctggggtgaataactagaatgtcaggaagtactaaaagctgcaagaagtaaggaaaattctcccctatggcctttgagaaagtgtggccctactaacaccttgattttggacttttgggcttccagaacagtgagaaatatttctgttgctctaagcaccaagtttgtggtgatttgttgcaggaacactagaaaatgaatacagtattcatgttgtagtctgtgtgaacagcatcctagatttgtgtcttgtaccaccctgtactacttgactggacagcccctgaccttcatgcttagaaaataccagctgcaaaatttactaccaaatatttgcattcgtgcaacttgattcattggaatcactatgtttatactttgatttattttgaaattttagtcaagaaattataagaccatataaagttttcctgggcttccttggtgactcagttgtaaagaatccgcctgccaatgcaggagttgtaggagagcccagtttgatccttgggccaggagtagaaaatggcaacctgctccagtgttcttgcctgggagatcccatgaatagaggagcctggtgggctgcagttcatggggttgcaaaagagctggacatgacctagcgactaaatgataacaacaaagctttcctagttaaatttcaattgaattggtcttgagaactgggtattttacttaacttaattaacagctcactttatgttttctatgatggtctctttaacttttatacaatggttacaaatttagcatttcatataattgtatttttcattgttctgcccacagagccagtatatacaacaacaaaa

SEQ ID NO: 54166 - DNA, 1130 bp, Bovine  19866880581827
aaaattggagcccctgagagaaacaaatgtttggaactgctaacccttctgccctatcatattccaactcaatcagatggtcacacccatcactgccaaaatatgccatgttattgagcacagagacaggtttccagcctcacaggatataggatcgtgtgctggggattcatatgagttcacaagaaaggttcttcatttgcttgtacctgatgccgaggtttctaatgactccttttctaagccactattctagattttatttcccagggaattttagattctattctcacctaactttacttattacattttacttgcatgaatcaaattcagggtcactaaacacaggttcaatatccaacaaaaactatgtcccaactttttgctgtgtaaccaacttaattattccaaagcttaatggtaacaagagaacaaccagtttagtatattcactgttcccatggaggaattcagacagggactaaaaggggtggattgtgtctccaccttaccgtcaactgggaagactcaaacagtcagggatgatacacaagtgaggtttgaagaccagagaacctgtatgtgacctatacaaggttctaacaatacagaggcctcagggaagtcagacatggaactcagggctctaagagcaagaattcaagggatcaaagatgaacattcatcgcttcttatgacctaactcagatataaaagaatgtcaattctgtcatgctttttattggttgaagccaacataggcccactcagattcaagttaagggaacacagaaccaaaatgtggattcaaagaatgttcaaaatttttcagtcatgctttaaaactaccaaaatctacatattaatgtgaatctttttatacatttttctctcttcatgcattatttctgtaaactgcctattcacatagttgctcattattatcactaattgtttatcactcattgattattggaatctttatactttttattctaaatttttgagagtgagatgaatgcaagcatcttctctttgtattttaagttagtttgtgatatcttttctggtattgtcaaattaaagcaaacaaaatacccaatgagtaaatttgactgagtatagaa

SEQ ID NO: 54167 - DNA, 1126 bp, Bovine  19866880612294
aataaagtttatttataggaaataaaatgcatgtgaaatttacacagaaatattacccaagggtctgagttgacctactttttttttctgtaaaaattagaatggaataatatgagtagctgtccctgaggtcctttacaattagtcagtcaatcaatgcatatgtttgacgctctagcaggtaggaggcatcatgcaaggcttgagaagaaagagactggcatattcatctctgaccacaagattgcaaggaaaaacatggaaagtaggatgtgaagagacagaagatgaattttcatgttctaacactttctctttcctagtcacatggctttggtaaaactgcttatccctttcaaacctaaatctcctcatctataaatgaaagaaatattctaccctacagtgattttgtgcagatcagtaagataatacatatgcataatgttttgaaaatgatggaaccctattctaatgaaaagtattatttttaaaaagttgggctagatcattctttgctgtgggtctgttctgtgccttataagatatctagcagcatcaatggcctctacccactagaagccagctgcagtcccatccctaggttgtgataaagagaatggcaaattgccaaatgtcttctgacgggtggtgtgcagggaagattttcccattgcttgaaaacattatatacatgttcaagaactaaaaattcagaaataaaacatctagtgtctacagatgtcactgacaaaaacatggtaaacaaacacctacctaagaagaggacctgtttggaattaatgtttgagggggctctttcagacatgttttgcatggtcatacagacagactactttttccttgaacaaccaatactatctccatccaaagtagtgtgacctctttggcactttctcccattatagtggtctcactagttaaaaggaatatttatttattttctaagtgattatagaagttaaatgctaaacttctcatttttatcagctttattaaaatatctttgaaaaggataatccagtgaaatggatcaaaaggagagtttatgttagaagaaccaactgggaaaagctaaaagaaaggaggagacaagagcggaacc

SEQ ID NO: 54168 - DNA, 791 bp, Bovine  19866880617333
ttcttaactcctgtgactgaacaccaaagaacgcaagtgcaaaactgatcatgagtatgtatagctttctaacaaactgtcaaactgacttccaaagtggctgaagaataatgaattcagttaaaaagaaaaaaagactatcaaaatgtattttcaagctatggaaaaatatccattattcaaagaagaatagtatttattcatatttcaccctattttcttgaaacactcagaaagataaattatttatccttcatactcagtctgtgggagaaattaatttgaaaattgaagaacatagagacacaaacatttagttccattttaagggtaatttatttgtagagatttagcttttccaaacattagtattaattaatctttttatatttaaaaagtacttcatcattttttataacttatttctcatccaaaacatatggaccacccaaaaacaactggaaaaaaaaacaactccttttattttaggctttatctgtgccagttctgcaaataattttgtaaggctaacaagactcccataattctattaggcatgtaatattgtattaaacctctccacatttaataatgtcaaaattccattgaaatgtttaactcttacttaatctcatggcaccaagctgatggaaaacttgcaaacttacatgggagaggaatgaaatgtaagctttctaaacaccttttatatgccaggaattattcttgcttgcaaatactgtatatccttcttccaacaattctgcaaggatgggacactatttttgtaa

SEQ ID NO: 54169 - DNA, 1942 bp, Bovine  19866880658197
tctgtctggacaatggatgagtagtaaccatcaactaaacttttccctaatcaattcaggtaaaaccagtgtagttataagttctcagttttgtgagtcctgacaatacctttcctaaatcctgcttatagcactcctctaaaagacctatcttcccctttccctagcttattgggatctgtccttgccaagaatgtttttcactatttttttctgtgttttgcctatgtgttaattaagattaataaattactctgctgtggcaagcagtcccacattttagtgacttaaaactacaaaggtatattttccccattaagttatatgtccattgtaggggaacagaggatatgctcactgtactctttcaagaatcaaggatacaagggactgtcttgaatacagctagtcatggtaacaaatgaagaaaagagttctctggaatgtctcacagaggcctatgaatactcaaccagaagaaggacgcctccttcccactcccaactccttgtttagaaccagtcacttgggctcatgggaatagggagtagtgagaaagtgcaatcctgtgacacaccctgaaaatagagagcttggaatgttgaggggcagagggagagcaagattggtatgtatcagagtctctcttcatagctacaatatgtggaagcatcagtttggataaaaactacatgatttggggaaaatacaggttattcaggtcatacagattttagatttagtaaattactgataaatcttttatgtccttatgaattttttcaactcttgggtgagattattacctttaaccagaagctatttgaactgtatgcaatatatccttacattttcaggtgaaaatattctaagagagcactgtttttagttcagagtatcagtatgtgtcttgtagaatcacaattttttaatggaatgtgacttgtgggcaagaaaaaatatgtatagctaacaaatcaaaaggaagaatggatttaaatttatattagaaaaataagaaagatccaaaggaatttgattatctaataagtgaagatgtcccaggaaaatgagaagttattaaatctaactggcaaaaggggaaaaaaaaagataccgtttgctttctttgtaactttaataaaaacaatgcagtgaaactacaagaaagcttattattacactacaatgagcttaaaatattcttatcaaattctggaatagtatatcataaatttggtgtgatgcaatcacttcagctgtaaaatacatcatcatatgaaaaaagagcaggtcatggaccgattcattaattcctattttcccacactttatcctctctattcaaagccttatagagataaaaaataaatcatgtagtcactattagggcatatgtgtttataatatatgcaatatataatataaaatttataaattatgatatacctaatcatcctggagctagaattttgttagtatatacatcatgaagtgctttgtgtataaattgaagaaatggtgaggaaaggaggaaaaaaaataaagtttatttttttcatgttaacctatctctgcaatcattaaccatgatggagaatcatgtttccagttattttgataaatttactttacatttataaatatagcaagattattactccataacagggaagaattttcatttttatgcatgtaagggtaaggataatgaagtggtgagaagggagagttttgctcagcctttgatcttgacagtgctaacagaatctatccaaaagtggatgtaaataatgctagtctatcatcagagctgatatgggaattgaaaatgcaacagttgttattcccctagctttcttttagaataatagctttggccttttgaaggccaaagggaaaccttgctgcaaatactgagacattttcctctagaaatctg

SEQ ID NO: 54170 - DNA, 1165 bp, Bovine  19866880743647
tagagcttgaataattaatggaatgataccctttagtgcagagcaccatatctttaaaatataggagaatataagtgcactatttcaatatttaagccaaagtaagtgatgtagtttctgcatgtgaactatatgtctgggcaaaggattgaacaaatgcttcataataataaaatggcttttaaatgtgaattggtctcataaggcataaggatttccctaaccaacacaatttattcagagtaagattagcaaagacaatttctgaagcaataatattcattacctccacattttataatattgctagttcagtgtatctgaagtggtccagtgtgtttagattgaactttcatcacgtctaaacagcttaactgatagttacttgataactcttttatgaagcagtttttttattaatgctttcatatttctggtttatgatgccattaaagtcatcatttgtcacattagtaacagagagattcttaaaatatccctagcagcaattcaggatggcttttaatgtcagcataaattcctgtactactaaactaactatttgaaatattaacagcgttgtttgcaatttcaaaatatatatgacaacctaagtatatgatgtagatccctggttcaagggaacccagttagaaaacctaaagaaatgaagctaaagtattttggcatgacctaacatttgcttaatagcaaagaaaatacaaggttcctcctttggttgtgcaacagattggtgaagtttctgccatagaattgtgtattctccaagggcaaaacaatttaaaatgggaagagataagaaaaatctaaattgtctagagtgctattctatagtgaatccatctcagttcataaactcacagctatggtttccaattttttagaagctaaaacactgtatcagacattgttgttttctctcctggcattgcatcctgatttggggacattttctagaaggccatggataagacttcagagatctaaaattagactggattaaatgtggtttgctaccacaggcttgtgtacatatgtaacaccatcctaacacattttagctgttctgtacttggaaataaatggagtattactgtcatgaaccccactgttgggctgctttggagtcaggcttcacatgatg

SEQ ID NO: 54171 - DNA, 1335 bp, Bovine  19866880804362
aaaataaaactaattcatgaagaataattaccatttgcaagaataccctttctatgtacattatatatgtgtatgtcacttttaattcataaatttttatcttacattagttcccaaataataattattttttttactgtttgtgccagacattatttacttattaaagatatagtaaaaagcaagatagacatgatttcttccctcagtaaacttacataggatgaagggaaacatttacatatttattatttgatgtaatttattcattttatatattttgctctgcatattatatggaacatgaatacatatcacattatttctagtttaaatatgtttattttactgaagacccatagtggttatctatgcaatagcacttaagacatatcatattcatgtactgtgaatgtccaacagaatacagtgaattgtatgaaatgagtttgtataataatatcagtgccatcagatctcaagttgccttctttccatcgtgatatcagagtcttcaaagcctatgttacatccatattttgaatgtagggaaagcaactctatgattaagtatagattttatttttattttatggaggtctattataatgacagaaagtcatttttgaatatggcaaagactatatggcaagattatttaatattttttgacagtcagctttttcactgaacacccccctgatgtttattgccagtcaacaaactgcaatccttcagtatcttgtgatctgttttctctcatcactttgtactgtcaccataatgagtcgagtgagggtctaaaactacatctagtctaacagaagcttgagtctcatccatcgataaaacagtgaatgatattgaggcttaactataaataccttcactgatgaggagtccttatctttcataggagcccatttccacctctggacagagctaaaaatttctttattgtattcagatgaaatctctcttcttgtagcttccatccatttcccccagatctgtccattgaggcctctttgaataggtataaaccattttcttctgaagaatccaatttagaaagccacatgttcttctctttcacagcacttattataactagcaactaactaattacatatgaagtcattgactaaaaggctctctcctaaaatcttctgtcttttttctcagcacttttacaatgaaagctcttaataaatatttgttgaatgaaggtgtgtgaatgatgacattcataatctatcttgtcttgtgtattaggtagggtaaaccagaagcagtaactataagaaaatgtgtgccaagacttattaagggaaa

SEQ ID NO: 54172 - DNA, 1173 bp, Bovine  19866880812459
ttctgaaaataaggactctggaatcaacagaactagaattgaatcttgtttttgattcacacaagctttagaatctttggcatggactgagtcttattttcctcatttgtatattgggcatatttataattatcttgtaggattattttgaatatgagaaataatatgtttaatttgttttactttggggatctcattaaattataactgatttttattactatagtcaggattagatcatcacacaaggcattccataacactgctccacttctgtgtctagattctgctccatttttctgtacactaccctaatcttttctctgtaatttggccatattctttctaccagctcttgcctatatccctgaataccctagaaatctcttactcatacttaaaagtgaaagtgaagttgctcagtcatgtctttgcaactcctggactgtagcctactgggctccttcgtctatgggattttccaggcaggaatactggagtgggttgccatttccttcttcaggagatcttcccaacacagggattgaacccaggtctcctgcattgtagacagatgctttactgtctgaagacagctcaaatgtcatgtcttttgtgaaatgtttccttattcttcaagatagttgatcactccttcttatgctagcccataactaagatataaattttatctttgtatgttgagaaacatttttacataagtctccttgaccaaaatataagattttccaagacaagaagaaaatgatgttaattttacatccttagcaccagacatagtgcctccacaataagtgtctgctaaataaagagattttaaaaatagatgataaatatatgattactagatgactgatagatgcatcacattcttcttttcatgggcctcacaggttaagatacactaagagcagaaattaatattgattttcaaaagcagggttttaaagtaaaatgcagatttttaatgtagcaggttatatgtgaagtatttttaaaatatgattgagttggcttggtttcatatgtgcaattagcttcttcttccaaatatgtcaaattattcagtgattgccaagatcacacttagtagcatgccctatagtaaggattaagaactcttataacattcattctacggagccaaggaga

SEQ ID NO: 54173 - DNA, 1126 bp, Bovine  19866881202901
cagatgtggaatccatggatacacaggccaactgtgctgtgcccttttatataagggatttgagcatccttgaattttggtaccccttgacagtcttgctgactcgatggacatgagtttgagtacgctccaggagttggtgacggacagggaagcctggcgtgctgcagttcatgaagttgcaaagagttggacacaactgagcgactgaactgaactgaatgacagtcttccacccaataccctgtgaattttgagggacaactgtgctctcaatggcttggaagttgagtggatgttgtgggacactcatttcagagtacgaaagaaaactaaaaatgtttaggtcatcggaacagaagaatcaaatcaaacagcaggtgttgctagactttagtcacagtttagaagaaacagaatgagacaagaaagagaagggagacagaaaaagattcaaggcagttttgaggactgatatgcaataatgctaaagagacaaacatatcctcaatagaaatgactttaaaagcactggttagatttgaaaaacagcatgcatatttagcttcatcaaaaagagggacagacagagcacagttattaaaatggacttatgtgtgttcagtattacaacttattcaggcacaagcaagtcactcctggatcatctctgagaaagatccattattcttacaataaaatacaaggtgaattgaaagccaggtgaatgattagtttaaatgaaataaactgtttctgcacaatgttaaaaccattttttcagtgtctatttacatgaaacaaatatgcttatatctaataactcaattaaaacagatctatcagaatattcattatttaataaattattagctttagtttcattactgtgtatgctgaaaagttttttataacagtactttaaaaatatttattcattgaaacttttcataagctcagattgagtctcttgaataaactggatgaataattttgtaagaaaaattataattaattttcatttacatgttcaatcaacaaattattctaagttctaaatatatacaaatgaatgaaaaataagggatccctgccatggaaagaagttcagagaaaaattaataca

SEQ ID NO: 54174 - DNA, 1768 bp, Bovine  19866881252790
tttactaattaataacatataaaataattttattgtttttgatactgtgaaagcttttagacttggattttttccaattcaaaattatcaaaaatacatgttttattatttgtgaatacacataaaattaaaaggggtcctcttattgccaaaagctggaaaccactgtcttagaagataaacatgaaaaatcaattagatcaatttttcatgaacagcctctcagaactcagcttctgaagccccttcctgcttgttcattacactgaggaccagtgttatgtctgtggatgactgaagttctgactgatgttactgagtactaattaatacctcattctgtgaggtagaaatctggtggaatcactctgaaactaattttcagatatgcttgtcccacctcaacagatgctgtaccactcctaatatgaagggttatgttgtataatgcaaagggttagtctagacatgtcagtctctgtacaagtcaattagcaatctctactacagaagatttgcattcactatagcatatagaaagtacttgcaattatggatttatgtaagtgttgcttgtttattcatacattagtgtttatatagttgtcaactccatgagggaggggattctgactgtcccccattgccagtgtgttacaaacaacaggcatgagagcaggccattaacatatactgagtggatgaatgaatggatgaatgaatgactgaagcagacagatctaaaattcaagtatgtcaaattatctgactgatgttggccaagctattcaacttctctgaatctcaattctttaaacttgtgaaatattaacctcactattttaagcatgacatgagatgatgtgtataaaatttatagcaagcatttgataagtgatggctattacagatgtctttcaaaaagtttatatctaaaaggagcactaaagaatctaaaggaggtagtgacagacaatgaagatacttagagtctcacaaaggatactcagtgtctcatcaagaaatgaaactgaggaagagggctaagaatgtcctgctaagagtaatgtaatgcatatatgctaagttaaagcacagtaattcaaaatgaaatgtctcactgagaatgccttgtaacctgagtgtgtgtgtaaaatgatgggccgatatttatgaagccaatagttgcacacagagactaaagcaagctgacattttaaaacccaagagtatcatagaaccaaagtaagttacttgatatgaataaaaaactttaatacaaatatgtacaaagtagaggaaggagttttattctctctacttatgtagtatgcattcagttcaagtttccattgcacactgggttcgatccctgggttgggaagatcccctggagaaaggaaaggctacccactccagtattctggcctggaagattccatggactgtatagtccatggagtcgaaaagagttggacatgactgagctactttcactttcactttcatttttcatgaccctggagtcactcactcacttttgcttttgactgagctcactacagtgtccctttccattaaattctatcttgatttgtatggtagttagttccatgcttttcaaaataggtttatcatcccaaaatacttctctaaacacttgcctattttgaactttgtacagtagaatcatatgatatctatatgttttggattttactaaaagtgggaaaattagaccacattatattaatgaaggacatcacta

SEQ ID NO: 54175 - DNA, 1643 bp, Bovine  19866881270995
atcctgcccaattaaaggaagccaaggaaaatgttcaagagctacaaccagacaatagtcaattactttttaaagaaagctgaattgtttcttataactttctttatgaaatatttactcagcatgactaattgctgattgaaaataattctatagaatagcaattgcttattctggaaggcagtgacttaaattttatgtccgtttcttttgcttacaggtaagtggttatttgcttatttaacaaagctaatgtaactaagatgaaaatttgtttcccctttgaggcattatacttttctataaagaaatatcaaagaaatttaaatgtggtctcaattaaatgcactggcccagatttcaggcctgagctgaatttctcaaatcatagttctcatgcttcaatattcctgtgatgcttattgctatgcaggataacaggctaagagaaacttcaacactggtggacttaagggaggtagtaatagctcccaaatgaccattaaaatagaaaatgatttgaggtgcaggaggaatttaacttaaattctgcagatatgcacaagtcagaggattctgcacaggttgtttcaggagaaaagtcccagaaaaaaataataatattagaacattcgcatgagaatgatggctggcaaatttcatccagtaaatactatgaagttgaaatccaaagtgactggtaaaaatcttcctcttttttgattaaaacagcagcctccaacaaacattacacagaatcttcaagtcactggtcactattcataattaatgttatttattttaattcttttaattcacttgtgatcattatattttgacttttcctctatcattgccacttttctgggcttcaaaagccaatgccgctttccctcattattccaggtagtgttacttaatgtcagtttcaaaaatggaagcacagaaggatagaaaatttcctgctgtgtctgtcttggttccagaaccttacaggattgattcgtatggaaatacaaaccacaggaataatgtttcagaaagagaaagatgcagaaaaatctttattgatgagtagagggctaggtcattgcattcacatctatcccattgcaagtgaaatttacaatttaaagaaaaaaaaatcctataaattcagacataaggatggagaggcagattctggctgcccctctgggtaggacagatattttaattcctgagttgtttcctacagacacagatagcaccatagcattttatttaattgtttctcatgatatcagttgcctgaaggtaacatttctacatattatgataaattatggagaataccatatgtggttaaactagcagtgtcttaatgaacagatataagcaataagtatgtggatacttctctgtcattcacaggaaaaaatcaccagtgatagcaaagttaccccgtaccttttgtacagggaaggtacagtttccctgtaccttccacataacaggtaatataaaatctcaggacctttatctaaggcacttttttatgcggtgtggtggtatatagtcagttttctgaatttggttgaaaattctctttaaaattgactaaggttcagctattaccattaaaggagggctatttaaggcag

SEQ ID NO: 54176 - DNA, 1101 bp, Bovine  19866881319408
aacaatgcatctatgcatctagttaaattgagatggctaaatggatatgaatattgcattcaacaatatgctctcgacaaaaagaaaatgagaagagacgaggtcaagaaatacagtgtataccttttgctttttctgtggttggcactgaactttgtctaatctcccctttactataaaaggagagaggggagtcagttaaactgagtttctcttatgccaacatttgtaacactaagaataactttttgactgttagttatttgtccctcaggtttctctaaaaaagtaattaaactatcaatatttgagtgggtttctttttcttttctctcttgccctattttcaaaccttattttcattagtattttgctgttcttcagggaaatctatggggctgaccccaatgtggctaactggaggtggaatcactaactagatcaatcattcactccctctgttcctgagacagaagaaatccaagcagtaacattttacactaacttctctttggtgaatactgaaataattcaggataagcaagttcaagctggaattcatgatgaggtaagtccattagcactccagcaaactcatgtgaactctggaagggttttagggactgaactaagcctgctaattatttttagactgaatcatattagaaattgaatctattccctcttgtaccaggctctggatgtaagatgctctgggaggagtgttaacccttcagggcctacaaggtcctactttgggtgggctgacatttaatagcaaagatctcatatttcaaatgagtacctctgggtctcttccttatgtgtgggctttatgtgattgatacttcccttctcaaaaaaaaaaaaagaaaagaaatataatcctgatgtacttccatttacataagactggcagctacttttgtctctttcataatttctcttattatctagtacagaaagatttcagatcctgcttaatgttattactctttttctcgcctctaaaattttgcactttctcaccaacttaagtattttgatttgtaggttctaaatacacaacaaattcagtaggacaaacacaaaaatctaggt

SEQ ID NO: 54177 - DNA, 696 bp, Bovine  19866881320973
gacacctgaaaaatgatgcttacgttatagatttctcttttacgagcatcatctcctcatcacgttctgtcaattttacctccaggttgacgcttattttgtctcctcttctactttttcatcattgctgccataattggcatcttcactgctttcctcctaaactttacaataagccaactacttccagttttgtaccattctattctctatactattagcaaaattcaccttaaagatacttatatctggtaaaatgccagtcctgcaagcatccttcccagattgaagttattctttgaatctcaaatattttcaaagatattatttctccagtaacattttcaggattcattgtgctcaggatttaatttacttcaccagctcttctattactactcagcaatattggctacttatacttctctaaataaatcttattatttcatgtttctgtgctttcttatatatggttcatactgcctgaaacaacaggaaacattatccctatggtcttgcttagttttggttagcatgaattcattcgaaatgagtttagtaacttttgtcctgaaaggcaagataaaggaggaccagacattatcctcatgtaaatcatggtttattcagaatgatagggtaaaaaacttggataattaatttagctctgatatagtgattggaatattagttttt

SEQ ID NO: 54178 - DNA, 695 bp, Bovine  19866881329166
aatccttcttggtagaatcctcttggctgagtgatgtacgtgccaccagaaagaccccgagtcagaatgattggccagctatagcctggaaactaacccccatcatcataaaacccaagactgcagtccacatggcagaatagttctcctggattcccttacctgttgctcttcacctgggtgccccttccccataaagtttcttgctttgtcagcacatgtgtctccttggaaaatttatttctgagtgtgatagaagagcccacacttgcagtatatatacttaaacaatggaacttgggactaggcttttattttctgtattttcaattcttacctaacacttgccaccagataggctaataattatgttttttaatgttttaattattactcaaaagtaataaataataaataaaagttacaaataaatgccacctaaataaatcactcaactatgtaactgttctattggttagcagcttcatttaaagaaaggaattaagtctcctttaggatataacctcagaccattacttcttagttgttcaaatcttttctgtttggttctgtgatactgtgattactcagaatggctaaataatcttggaaattactgaacctgatgataactttaatttcaagactttgaagtactctccttgatgcctcgctacttttatggtgtcttcaaa

SEQ ID NO: 54179 - DNA, 1069 bp, Bovine  19866881463588
taatttttttacttttttttttcttttttaactttacaatattgtattggttttgccatatatcaacatgaatccgccacaggtatacacgtgttccccaccctgaaccctccaccctcctccttcccagtaccatccctctgggtcgtcccagtgcaccagccccaagcatccagtatcataagtgcattgaacctggactggcgactcgtttcatatatgatattgtaagctcatgtacagcaacaaagactgagtacaatcaagaataaaaataaaataaaaataaataaatacagaaagaaaaccaccaataccatatttatttatttttatttttgattgtactcagtctttgttgcacgcatgaactttctctagttttgcaagtggggatgggtctctagttgtggtgtgtgggcttctcattgtgatggctccttttgtcgcagagcacaggctctagtgtgcacaggcttcagaagttgctgcacacagactcagtaattgctgctcccaggctctagagcacaggctcagaagttttgaagcatgggtttgggtactccatagcatatggaatcttcgcagaacagggattgaacccgtgtcccttgcattaacaggtggattcttatccattagccaccagggaagtcccaacacttgagatacatttaaagtgaatttattaaaaacacgttgaaaaattccaaacatcattactccctttgaaccatcccattaagatgaaaaatattttgtataagattttaattgtgaaagggtttctttttagaggtttatctcttacttcccctctctatgcaattaaaacttcaaatactgcatttataatatacactgcctagaacttaccagtattaaaaataactaaaaaaaccttttttttaaggaacagtgttttctattagcacatttaactctaattttcatgatattgtaattatgttggcaagttgtttggattgatggatttcagctcaattaaaccatcctgttatgaagcagagagttgaaccaaatgactaaagacttccaactctaa

SEQ ID NO: 54180 - DNA, 856 bp, Bovine  19866881523635
tcatgcaaagagttgactcattgcaaaagactctgatgcttggagggattggggtcaggaggagaaggggacgacagaggaggagatggctggatggcatcactgtctcgatggacatgagtctgagtgaactccgggagttggtgatgaacagggaggcctgatatggtgcgattcatggggttgcaaagagtcggacacgactgagtcactgaactcaactgaactgagcatgttctttagtgttaaggatagtttttactcagtaaggcatattgatctcaagttatacattcgtttagccctggatacgatatcagtcaggacccttcagtactccctgggcatgagacatttggctttttatcctgttgaccactttcttaaattgtcttactgtcatgataatggtgatttaataatacttaccaagtactactggtctagagaggactgactggagaaattggtcttaataaaacgctatagatcagatactctgctctcatgctgttgagaaattactcaaacaagattattatgtatgattaccaaagacccaggcagctaaaatgttgtttctgagaacacagacactgaatgtgtagtcatgggcagagtcatcaataaattgtactctcttcagaagccaagaaagctgaggaaactatctaaggaactggctttaagtatgctttttgaagctaacaggaaatagtgttcagtgtttgccaaggttaaaatgctcttactcaaggctaaattggatgtggtcacagttagtaaagtatttactatcatttatgaacatttcagatcttttcaatgacacatgagtaactactgttttgagaga

SEQ ID NO: 54181 - DNA, 798 bp, Bovine  19866881860430
tggagggtgctgaatgaatgttttttgaataaatttatgaatggatatcagcagcactgctctcctcactcaaaacaacatgaaaagctaaattgctttaaatgaatgcctttgaaatatgcttacatgatatgtgtattattgtattatgtttactgcctaaccatggaatatcgtattgttgtactttgagatacaaagatatttcagattcagatcagagaatacttgaaagattttaaaatcataatcccttattgccttgatattgaaattgtgcattcttatttagataaaaaaccacaaaatttaattctaaatgtttttcgttttgaaatcaatgacaagtgtacttaaccagtgaaatgctaactgctatggagagtaaggctcactgaagtggtatggatttaggaaagagtgcccaagagagtggtcaggtgaaaatgagcattcagaagtcaatgagcaggtttaatgcttttatcccctcttctgatttaacttactagatcctaaatttgaagatattctcttttttaacatttttattagcattatcatgaccttttcataactgtgtattcacaaaaatcaaagaggtgttttaaggagacagataaatgtatagctataggtgaagttgtagagagattattttaagagtgtatatatatatatatatatatatacatacatatattcatatgctatgatttggaatattgtttaacattaacttgtggtaattatttcccttaacagtctggtatatagtttatatatcctgtgtttcag

SEQ ID NO: 54182 - DNA, 1215 bp, Bovine  19866880109674
tgtatagaacagtcttatggactctgtgggagagggagagggcgggaagatttgggagaatggcaatgaaacatgtaaaatatcatgtaggaaacgagttgccagtccaggttcgatgcacgatgctggatgcttggggctggtgcactgggacggcccagagggatggtatggagagggaggaggccgcagggttcgggatggggaacacatgtatacctgtggcggattcattttgatatttggcaaaactaatacacttatgtaaagtttaaaaataaaaaaaataaagtcccatgttcaaatggtgaagcatttgtttgtgacagacaccatatgccctgaatccttgtacctgtcgaagagaagccttgcagaacctaacatgtggcatgtctgcacatggattgttctggcatgatcatttataatgactttcaaagggagtatgagtaatttacatatcaaaggtcctatgtcaggaatgtctatgaaggaaggagctcactattattaaaatttgaatcaggaaacttcttgagggaccagatcgcaattttcatggcatttctagtaaagacaacttaagtaagtgctttggttgacagtgtcaccttttgtatttgaagatattgctgactcagattcatttctcattccatcctcattataaccctgagtcaagtattaggacccgcatatgtttgtgacttatgtactgtctacaatgccagtgtcccattatcccaccttgcctcaaatgagactaaatacaactaaaaccaagcaagagagagatgttctgaaatgggggaagtgtttgccagccctgtgatgtcacagtgcaccataactatttgggcgaggtggcttcatagaccacctttatttaatggtctagctcattgttttctaacttgtatattggagaaaaaaactagttgtgttgttgttgtagttcttggttttttaaaaatatctaagttttcatgcagtttgatttttttttaattatttattcttggcttcactgggactttgctgttgggcgcagactttctctggttgcattgactgggggctcatctttgttgtggtgtatgggcttctcattgtgggggcttctcattgcagtggcttctcttgttgcgtagcacaagctctagggtgtgcaggcttcagtagtgtgtctagggctctagaatgggggcttgg

SEQ ID NO: 54183 - DNA, 1554 bp, Bovine  19866880196667
tacttttgcctagaaaatcccatgggcggaggagcctggtaggctgcagtccatggggtcgctgagggttggacacgactgagcgacttccctttcacttttcactttcatgcattggagaaggaaatggcaacccactccagtgttcttacctggagaatcccagggacgggggagcctggtgggctgccatctatggggtcgcacagagtcggacacgactgaagcgacttagcagcagcagcagcagcagcagaataagaagaaagtaggagagagaaggtgaatacaaaatttcattgtcatcagtaaataagttgatgtgtttatttgcatgttttactataatcttataaaactggggcttagtatcaggaaattctataacagatcaaatatataattgtattttaatagtataaattgttttctcatgaaacttgatgcttataatagaataataaagtcttttaataagcactagaaaaatcctaaatgtaaaaccaagtaatgaaaaactataggtttgaaataaaacatttggcaataatgtaatttgtttggcatcttaattaagttatctgaacttagtcttataagttcagtttgcaattagataatctctcttccttggaaaaaaagataattcttaaaaagttatttctcatgtaagttattatgaataagaaaatattaatgtactttatatgcacttttccaagtagtgcataggcaaggacagagagaaaattagaaaactttttaaaaaatgcatgctaaatagtgacacaaaagttgttttctattgaattcctaccaaaaaaaaaaaaaacctgaaagataatagaactaagaaagataaaagaactaactaatagaagtaactatatccagtttttaaatattgcattaggaatagcttcatttgaaggaaactagtgaaaagataagaagcaacatatttcttagtaaactgagagagtatatttgactgcaaacttttagtatttgcaagtgcagcttaagaatgatattatttcttaatgtaacccaatcaaacaagtcaatgggaaaaatattaaagctaagaacatttggtaaagggactattttcaaaataaatattacaaatcaatagctttatcagtaagaaatattaaacagaccaaaaattacactgaagttgtaaaatatgaaatttctgggaataatctcaaaatttgtcatacaagcaaatttaagacatattgaagaagtaaataaaagactgtttttctcctcttttgttatctctaatgctttgaatattgctagacttagccatgagttatttgttgaatagctaatgactcagccttgtggaatatgtagaaaatagtttgggaaatgctttggggatgtaaaaatattgcaatgttgatactctgtatatatacatatgtgatgaatatatatgtacacatgtttgtgtagctgttttctattaaatgaatattactttaaaatttacatccagctctttatataacagagacataatagaggcttgtgatt

SEQ ID NO: 54184 - DNA, 1765 bp, Bovine  19866880384477
aatgagggagctaaatcaactgcttaaaacaatcatcctcaagtcaagtaaatattttgaagttctcatctacttctttgcttttctgcatgccaaggacagtgtggccccctgcataagagtgcctcatcagcctgtggataaatcattctgaaaccaaaacaactttagaaaagttgtgaaatccatgtggcaaaagcaggaccgaaagcactctacctactttatggctcagaaaggtttagtcaaggctgctgctgttgttgctaagtcgtttcagtagtgtccgattctgtgcaaccccataaacagcaggccaccaggctcctctgtccctgggattctgcaggcaagaataccggagtgggttgccatttccttctccaacgcatgcatgcatgctaagtcgcttcagtcatgtccgactctgtacgacatgttaggaattagagataatttggaggacagtgttttatactttggagctgatgaaatttcaaggaattgtctcaggttttaatatgatttttattgcctgcagtttcttcttaggtaaatattcatattgcatattattaattttacttattggaaagctcattactggtaaaaaaaataaactataaatttaagccacatctttctttatttcagaatcttaattataagccaaaaataatatatctttatgaataagaccagatgtctattttctatagtctataaagaggcattaactagactttgaagacctaatttctatttagtggtgaacagagtaggcttttgtttatttgaaaacttttttttagtaagttgcacaacgtacttcagttgcaaaaagaaaaatatggtatccttcgttattttggctacctattaagttcctgtatttgaagacgtccatgctacaaacattgcacagaaaatacctgtaacaatattttacacatacatgcacatcagactcaacttcaatgcagatagatatgaatcacattactcaaaacaaaatgataaaattagagattcaattcaaccataagtactcaaacccactattagtttataaaattaaaatcattcttcaaaacttaatattaaaaaaaaaagtataccataggggtcaaaaaataaagtatctatggttaaaacgagaccgtgaggattaccagactatagtgaacaagccacaacacaactgaagtactgaagaaatggttgtacacagttggttaccttaagagagtgtaccacgggttcaggctgctgagaaggtgtggtatgtccactgaagctagctggagagttgggtgaactgttactcccatcagccccagatgacaacctaaaagaacccttagtagaaaatcaacaactttgttattaaaacaaaagtcgtttataactgaagagatgtcattcaatattcaatttcactgccaaatgagaattagcctttttttccctagcctgtcataagatgctatcaacctgttaattggaatacacttgctgcttgaccagcaaaaaaaaagctaaccaagagccatctctatgcatttccagatgtcagctctgatttactgaagagagcaatgccccctaaggaatgcccattaagaacattttaagaatgatttttgaaacttaaagatactcaagagtagggaatttgtgagttactccacatttgagttaaaatgctcactcagcatgacaaatgccatattccatatgtctcagaaaatgcagatacatcaca

SEQ ID NO: 54185 - DNA, 1465 bp, Bovine  19866880404215
aatcccagagaaggcaatggcaccccactccagtactcttgcctggaaaatcccatggacggaggagcctggaaggctgcagtccatggggttgctgagggtcggacacgactgagccacttcactttcaattttcactttcacgcattggagaaggaaatggcaacccactccagtgttcttgcctggagaatcccagggacgggggagcctggtgggctgccgtctatggggttgcacagagtcggacacaactgcagcgacttaacagcagctgcagcagtctaaaattcagtctagtagtataacaacttcggtgacctccctctactggtcattatgaacccgcacattggaaggaaccatcttgtcccttgcacttgctacacataacatcttaattttagttgtctgtgtattaagtgagttagtggactgaattcatggagttcaagtcaaaacctctgcactatacatttcagtatattttattttatcaatcatgcagtgcattctacattttttgccttcagaaaaatgatatttaaaaacagtttagttaagccaaataacctgattacttctaaaacaaaagtaacaatttagtaaatacaataaagtaacaacttagtaaatacattaaaaaaattattcaaatattttgttgtaactttagaatagctttttgactgttttacaattttatttatttttacaatattttatctatattaaactagctctacgatatgcaacatcttattctaaaattattttaagaccaccagagaaaactagacacacatgaactctttttactgggtaactggctacaattgaaaacagtgtagtgtcttgattatataagaggcctggggatagtttacctagcttgaatcctgggtctactgtacagtagctgtacatcttgggcaagttacctaacttgtctccactctagttttcccatctataacatggagataataatggtccagatgtcataggactgttgtgaagattaaaatagttcatgtatattaagtgattacagtgcctggtacataaccagcactcaaaaatcgtcggcaatcattaacagtggacaaaaagaaaattattttgagccacttacatgacatttattaagcatccaactatgtgtcaggaacccatgctagattaaagactagcagacaaggactaagacaagattcctgctcctaagaaactaatagtcttgtgttctaaaatctttaaatgattgcctccattaaatatttcatttcggagaatatccatcaacctagcttattgaagagatgaattttgaaaagaaaaaaaaagtatctcttcaatacatgaagaatcttaaaaatgtatctgcaaaaaattttctttttttgttgttcaaaatatttcaatttcagacaaatatagctatttagatgaatagctttaatgg

SEQ ID NO: 54186 - DNA, 689 bp, Bovine  19866880505208
acacacacacacacacacacacacacacacagaggaagaatttgcaatagcaagttttctaaagtaaatgctccaagaaaagaaaagtcaggggcctacagtcagaaagaaacttatttaaagtttagtcaagctgagtggaatgttaaggctgccttagtcagaagttgtagagaagagggtaagacacatggaaatgatgttcggataagcagattataggtctctatttggccaaataattttagatgttggcatactggtataagttagtagaaaacaccagtctcaataatgacattctttcctattctgtgaaatgcaaataacattttgcatgttaagaccgtgtgatatttgttctccgtgttcccttggtcctttttatacttgaatgaatcctttgaagcaagaaaactgactttgtaaattgtgccttaaaaagtaaatctcaagggaaaaaggaagaaaataagcatttagtgtacatataccatgtgtcaatagattatagatatttcctcatggatcatcacatttaatcttcacaactcttagaattaagtaagaattagttcatttttatgggtgaaaaaagtacatctaatgaactttttaaaaagttatttaatgttttgatttagctttagtgttctttgggtattaatgaagacctcttcattgtcatt

SEQ ID NO: 54187 - DNA, 1102 bp, Bovine  19866880536467
tgtggttaaaatgaagactcctgcatttaggagactccaggatctgaaattccatgatgtttcctatctatgcaggcatctgactggaacttcacacaccggaaccctcacttccgtaattacctctgtatagaacacagagcattggatattacttcagtcttgcatattctctctcctgctgccatttctcaaccaggactattaagtcaacttccaattatccccaaacagcacaggttgccatttagcaaatgcatccacaaacaaggaatcatcatgtttcaacataacatcaaccccaggaaggttccatcgctgtgcaagacgactccagagtttggagcatgaccttgtaaatttctgtggccctctatggaatggcacaacctgggaatcatagctaaccctttcccagagtgactacgtagctgatagcagatcacagagatttaaacttggaacaggttgaaaggtaccaccatttcacagacttctttttttttaaataaacaaccctaaatactgccaatggttggtgccaagctctgtctgccaagtgccacccaatttggccaaacggctaaggaagaatgcagctctggacccagttcaatgtactgacacccaaggccccaaaagcatttcaggaggcaagctctgacacgcacctgaatttagtgagaaaacatttcctaccatctacactattggaattgactgagaatggggcatacccttggtccttggggacctcagtgtaacacagaaaagctaccaatgaggaaccactttccttggccctgcactgtgattccatttgaaatgtatcagcatttagttgattaactctcccttattatgtagctacctcacaaatgccataagtcttggccctaaaacttgaacaaccacacacacatgctttagaaacagaaaaatgtacatatgtcacataaaggtcacataatggaaaacacagacaagtacaaagactggggtccaaaaaagctagaagaagggcattgcctctctgttgtcctgaatatgtttcccgaactcatccatattccacttgacatactgataagaattcagttca

SEQ ID NO: 54188 - DNA, 979 bp, Bovine  19866880759394
cagagtgttattagctataaaccgcccatggttatatattagattcctattgtcaagagtttagtatgtctttcttcccttgagatttccctaattctgaactgttcaatagacctttctgccatgatgcttctcacatgtgattattgaacacttgaaatgtagcttgtgcaaatgaagacctgaacttttcattccatttaatgtggaagtgagtgaatgaaagtcactcagatgtgtctgactctttgtaaccccatgtactgtagcctgccaggctcctctgtccatagagttttccaggtcagaatactggagcgggtagctgttcccttctccaggggatcttcccaacctagggattgaacccaagtatcctgcaatgcaggcagattctttacagtctgagccaccagagagccattctacaagtgaactcagtgttccttcatggtaaaagcatttggcttggtttagactggatcattttagaaagttcattgatagcaacatttcctctcactatatctggaggcctgaagtagatggattttttttttttttgacttttcatttaatcgcaaacttaatttggtctatatgtaaagatttacagtttctccagatatgaggattatcaataatagaggagatactgggcagtgtgctgcttctcatcaaatattcagtgtgtgatataaagatttatcttgtaaatatcactgagtataaccttgtaaattcagagatacatcatctacagttcagctttgaatatagagcaaatgaaggaagaaatggattttttaaatgaaaagatcaaaaaggataattaatatttcataatcttaattaacttttccattgcacattggtttttaatgttatttggggtgtaaggtgtgattattgctttcatagccaaatcagataatctggtcacaaacttgaatgtcaaaaggtaatgtgaacatcttgt

SEQ ID NO: 54189 - DNA, 883 bp, Bovine  19866880810329
ctatgaggtcacacagagtcgaacatgactgaagcgacttagcagcagcagcagcaagatttgtcaaacttttaagtggttttgattagagaaagtgccatccggtctttaagatttcagggcaaaagataaaatttggtaatggtccattctaaaacacattacagcatttggaaggatgtgcaggaggaaagccatcttgaagacttttgccactgtgggtttacaagcattagcttttctgaggccaagttagtctccctcagccagagaaagtccaacagccagatgatttcaaatctgtaggcaatctctttaataaaccccaaactctaaagacactccttgaattagttccaaattaatcccaccatccacaggcttttacatattcctgagggaaagtcctcagaactatatattttaaaaattattatggttctaaaagtgttactctttcttcctcaggcaagcaaagttcagcctcctacttaagaattaatattagctccagaagtataagtgattatcatttctcactataatttgatgcttttcttattaaaaaaaatcttgttggcatcagcattttaggatttgcctggatatttaactcagactgctttattggcagagacagaattttttatttttaatgggatctttaattgtcctcagtaggttaaaaaaatgatgtcaggtctttgctctgattcatcatctatgaagctaattctactcttgtcagacccttctctaggtggcaatctgaaagaaatagagatggttattttctattccaatcctcccatgtggaaacctgttcactgtttttcactggccccaacttctcttagctctgggtctctgcccacaccttccg

SEQ ID NO: 54190 - DNA, 1410 bp, Bovine  19866880822819
taaatcctgatagttagatttttgacaattacatttattttaagtgtaattctgggtgaagttcaaaatagtcctgaattacagtgaatcccagtccccagtgtttctagttgaaatatgagtctattggttgtcttctgaggttaaccatttaaaacacccagatttatgctccatgagggttgtgagcactcaataaacctaccccaatagaccctcccatccccccgccccgggttccctctggatgccagcacacccagccatgctggcatgccacatccttcccatctggtcccagtcagagtgaatacaagggtctgtgcactctgatgaacacaccaattacctttttgagaaagaataaaaagctaggtggatcaaaacatcattcaaatgatttaggtgtgcaccatatgtaaaaaggccatgagcacttgaaacactatcatttccaacaggtttaatcaatctttttacaagtctgcatctttttgtttagggaaaaaagatcagaaatagcagtactggttgttacagagatctgctcagggagctggcttgactcctgttctgtagccttcactagggatggtgcaaactggcaggaaaatgggtctggggggtggaggaggaggagttcatctctatttttagggtcagcaaaaactgttcaacttcagaacagcttctacttctcagctggaaatatcacaaaccaagccaataaacatagttcattgtccataattacatattacactatctctgcattgtatatatattttttaaaaaagctaaggccgtcttcatgtgtgcaagcacaaggagattcacaaatagaaaaatctttaaagaccttgttctcaaatagtcactttttatttaaagcaaaccatattccacccatttaatgtcaaaggtcttttatcccatcttcatataacaatagggaagtcttaattaactgctaacatatcttaagcatcctcatttggacaacttactaagggtcgggttataagtaggtgataacagcagcgacagtgaagtaacgggacaaagaaaactgaacaacaataggaatcaggaggcggctgaagccaagcaagaccctccgtgaaaacacaaagtcacgaaccctaaactatacacttcaaggctttcttcaactcatcttgtatacattaaggttaacctttggtagctgtgttaatagaactgtcctcacagaagggatcaatccagaaagttgatttaactataggcaactttgactggtatcaaaaggacagctgttctttctatagcttgccctttccttctgatgcctcttcttttctcctcttcccttttcctacccctcaagtaagacttaggagtgccagcagtatccatgagcaatgcttg

SEQ ID NO: 54191 - DNA, 1514 bp, Bovine  19866880852092
ttaagcatctgaaggtgggttctctgggagggatcaaatataagtgaggttataagattggggactttgctatggaattagtgctcttataacaagagacaccggagagcttgctctctcttctctgtgaggatatggagaaaaggaggcttatgcaagtcaggacaagagtccttaccagaatctgaccatattacagcctgatctagacttcaaaactgtgagaaaataaggttattttgcttaagccactcagtctatagcattttattatggtagcccaagtagatgaagataattatctaaaatttttagcaccgaatttggaaggaaataataattatgctataaactgctgaccatcaatctttaagcttatgtttctgaattgggaagtaatttgaaaagaatataggtatgtatccaacccattcaggtactttctgagtattcaggtactttctgaatacttcctgatatcaacaagaataatattttctatatgtgtaataaaaaaaaatggacatatctttacccataccaaggaaaatagagaagtgaatctgagactatatcacaacttataaatattattgagaatttcagttacagggatgtaattatgattacttcagggaaaataattttcccatactcctgaatatctacagaagaactaaatttcctatagaaatcctatggactcttacacttccttctactgatgatactggaaattatccaatggatgtgctgacatccatttgtctaattccttaagaccattctgagattaaaccaacagacagtaaagcacatttaccacattatcacagcctttcaaagaagtgctttcactaaggcccagcttaatgtaatggtcttttcctctattgaaggttgatatagggaccattagtttaggcaatgtttctttgctgctgctgctgtttagttgctaagtcatatgcaactctttgcaaccccatggactgtagcccaccaggctcctctgtccatgaattctccaggcaagaatactggagtgggttgccattcccttctccaggggatcttcctgacccagggattaaaactgcccccttctgcttggcaggttaattttttttttccttttttttttttttaccattgagccacttttaagtttgaagattttatttctagacattctctgcataaggacacaaggagaaaatttccactttttgtcaggaaaaaaaaattgtcctcaatcttctttttgtcaaaaaataagttgttaaactcactactattttattttccttaacatctgaaaatttaaaaccaaacctcatttgtgctcaggatgtgtaatctacttaattagagtgcaaaaaaaaaaaaaaagtctactcttaatatacataagtcaacatacctcttaacggtatgagcaagcatttctttaagacacatggtacagtaacgaaagagagtaatttgctttacccagggattcaatcttccag

SEQ ID NO: 54192 - DNA, 1630 bp, Bovine  19866880985741
cttttacatataccgtcttatagaaaagcccacgggaggcctacaaaactaaggatctgaagaaggaaaaaactaaaaaatatcactccccatactttcatctatttataattgaatgtgtgcctaatttcaaaccagggccaagatgaactcccaagactttgtgcacccttccataatgattcaagtatgttagtgctgcaatacatttaactctttggcacatgaagactgtaaacaactcaatggtgtgaataacttagccattgtccttccttaagaaggacaaaccagcattgcctttataaggacaatgaaacaagctgctattcttctgctcttttctcctctctaaacacctcttctgccactctgctgctcaaggatctccactctctgaaagagcagccactctttctattggaaactctcaaatggcactctaaaagagaaggcaatttatgtcaggagcagcagtaacttgaacctcactctcttgcagattagagacatagaaattagagctgagatttcacacatctgatttctcaagtgtcccatggtctactctcttgatgttgaatcacaaatttcctagaactcttgaagaatcagcccatttcataaaatgaaacttttaatatttcccaggatcgagttcaaaataagtgtttttcttcaaatgttcacaaagcttgtcataaacactatgcattaaagtagtattaagagcaacctggttgttctgtagtacccaaggagcaaaaattgctgagttgctaacaggttctcctgctatcagaaaaaaaatgagcgatcctatgaaactgtttgtaagctgaaatggcgaaaagtgaagcagcaattacctcagacacatcttgctaacagatgcacaaagcaaattgaggtaaagcacggatgctcacaggcacaatgcaaagctacggaggcctgacgctgagtgtgcttcctggggaaggagcttgggggtgccgccctcaccgctggggtgtccactgggtctccagaggctcactgccaaaccaaccctgaaagccatttttgcttttcacttttccataaaattgaatatcctctttagatttctttaggttagcgaaaacaggtactaaagtaggtcttcaatagagcaaatttttgaagggtagaggcacccctgtattacagaaacactattatctgaaacacagtcaagacccagaaaacaagcaaaaacttactttttcagcccaaataactgataaatgcatgacacatggatcatgcactaaagcccatgcactttactcacagaaggatacttcaaggtcacttactcttgttttcaacacagttctttctaatcagtgtggttatccattttcccaaggtatgaaaaccattagagcagagcagaatttagaaacagcaaggacatgagttaaaatcaggccaggtaagggcaacaaggaatactgctgacaccatgctggtactagagtgactgaaaatctattaaaagtagatattggaaaacaaataaagatgagccatctaacatagggactcaacagctctatctagcttcagagtttctaaatatcagaagggctaaaacgagtaattt

SEQ ID NO: 54193 - DNA, 1193 bp, Bovine  19866881063536
cagatttctctggtcacacactgagaaaacccccataattacaggatatttatgacagcagcactgccatttcagggaattgcattatagttcacactaaaaataaaagggcaacacgttttacatactggtagctggtttcccttgatagatgcgcttattttttctatagacttaaatttatccttcaccatctgctcttcaagtattccagaaaatacaatattgcatctgaattcccctgaaagtaagttattcttcctccctacagatttcctttttgggttcatagtcttactggtatacaaaatgcccaatatttgagaagctctagtaattttgtacttcagactagataaaatttgggagagcatccagtcaattactcctgtaatgtttgggtttgattgatgagaaaatagaggaattttttttttaattttaatgttttcttttttaaacgttattgctgaagaagctgtgagggttttgtttgtttttctttgttcatttatgcattccttcaacaaaatttattaaataacttttcttaaaataattttgaaaagaattgtactaatcctatttatacagaataagccagagttgtgtgttgccatcatttgtgggagcctgaaaggacacttacaccctctctacctagtatagttttctagtacagctggtacaaactaaaacttccgtcctttggtatcttctggaagtatcctgtaagaaaaacccaaatctgcaaatagccatgttaattatttctatgtgattaatttcttaaacaatagggccttagggaaatcatcaggtacttgtctttgaaaagaaggagaaaggcagaagaattaggttctgaatactgggaggacttggctttctacgtaatttgtagtcaataggatatttgttgaatgaatatgagcgagtgcatagaaaactctaagtaaatcttccctattgtaagatattgccccgagccagtctattatcttgatactaacagcttcccagaggtctcaaagcattatcatatcaatcttgatgtgaaaaccaaggaattccttgagtacaattaattagtcctaaaacactctcacattaaaaaacttaaccagaggtgactgaaaagtttgtagccacttagaaatggtgtaattgatgggtcacaagttggtgaatgg

SEQ ID NO: 54194 - DNA, 845 bp, Bovine  19866881083513
caggcaagaatactggaatgggtcgccatttccttctccagaggatcttcccgacccaggaatcaaacataattctcttacactgcaggcagattctttactcacagagctgcaagattctttcctaatcattgtttagacaaagcttgccctattttctctttgtatctgtacatgagcactgaaggatatagaatgcagtaaaaagtggcacatcttatcaattttgtcattgccttcttgtattagctcctgagccaacttattgatcctgagtaacaaaacagatgagtttgcttttgaatcttaagagccttctctggcagtctttaatatttcacagagaacatcacaagctgtgatggacctccaaagcactattccaattcactttctcatttctgttgccctcttccactttttccacatctactgctaagtctcatttccccagtctattgccatagattgtttgtctgtattaaaaaaaaaaaaaaaaaaacttgccttagaaatgtcaaacataatgaaaaaatggggaaaaacatggccaacttggcattgaaattcctgggagtctcacattcataaagcacaccagttttgcaaattcatcaactaaactttgaagtgaaggaaatacagtctgttcgctcttgtctctgggcaattctatctcttatttttctgctcatttaccacactgagatatttcactgcaaaatacaatagtgaacatttagagagtttcatatatttctataagacaatccaaatcgacttttaacctttaaaattttagttggaaaataggaaacgaattagtaacttgagagaatatttta

SEQ ID NO: 54195 - DNA, 1234 bp, Bovine  19866881094003
attcaacgaagctcattttataattttattatgggaattcagatatgctacaggctaaatgatatcctttcaaaacatgattatgccatggtacaggttctgcctaggaaccatgactgactagggtgtgtgactctgactgtctaatgtgggggaatttgaaggtgaccagaaggggagcctggtgggctgccatctctggggtcgtacagagttagacatgactgaagtgacttagcagcagtagcagcagcagaacacagtaaattctagaacttttcctattttatcatgatctcttgtttggattggcgttgagactgtgacactgggttgcagtgaaaatacgttacttggagactaacagtaacctactgatatctagtggcattgagtgctgagaagtttaaactttaatatttatctgggaactatagacttggaatgtgacaggtaacattgttttttgttcctgggaggaagaagaaagaaacttgaagatacatttttcttctgcagttctgccttgcatggatcacacacctggtgtgtccctctacaatcttaaagcagttggagtgttgtcctggtttttctcattgaaagtattttggcttttaatgcagtaggaggccacagaaagaattaataggatccttgaagccaccttgcttatatccttgaagtgttttgtttggatatttccagactgtcttgttttgatggggactgataagtgtcttcttttctactttgataaaaatgttaaatggaaaagactagaccgtttaaaatacaaacaaagtaaagacatcatagaggatgtgaaagacacaaagagagattttttttttcccttcttatatagttctgtggaatgtggccctgtttaatcctctccaagaaaggacagaatgcactgatggaacaaacaagtggggagtctgaggatattgaaattgggacccatgtttggctggtatctgaagctgcttagagagggagaggagagtgcttcagaaatatcctgcgcgcttcccggggaacagggagacatgccaggtatactaatgctttacctgctcaggggaaaattacagcaacttgatctttctctctcctggattgtttgagagagtgacaggggatataagtgatattactcagatggctgtttctagatgtctccatttctggaagtcagaatatatcactggataaatgctctttctgt

SEQ ID NO: 54196 - DNA, 793 bp, Bovine  19866881096671
actgaactgaactgaactgaagatatttttaaagttcaaatgcttatctgggaatatttgagactctaaagatttaaatccaatacaatattccccaaaactatgaaagtagaaaagatggaaatagaattgaaatagtagaaaaataaagatttttttaggtaattgctgagcttatgaagataaatatacttctctgtaattacaacaggcatgtctaaacatcatgggattagagttagaataacctgaagatcatttattttaattcctggcatcacaaatgatgaaggtaagactcaaaaaaggtgaaggtatcactagttattaggcaaatgagtcataaccaatctcttgctgtttcttttccattttatgatgcataatgcacaactctctttgaaaataggccttttttgcccagaaggatttccttagaaatctaattatgtgaggattacagagctgagagatagtgatacctcaatgtcaactcactgatctggtgcagattcacaatgaatgtaattgatacacaattacagaattatcacataccaatattaggtcctttcatcttaattacttgtagaaaagatattttattttcctttttatatacagagatgagccaacaggtctcatttcttacacctctttttaaaattccagacagaaattcagtttcctcactggcatcattctatggagagctcatttgaaaaatggctttactctgctcttcctgatgccccctgccttgttattggttgttcagtcacttaactctttt

SEQ ID NO: 54197 - DNA, 1208 bp, Bovine  19866881130643
aaatgcatgtgcataggagacagcacacatgtggagcacatcctgtctgccatcgagatctggaaggaggagggccaagcaagcagcctgccccactgcagagagccagtggtgctggtggtggcctcagaacccacactgagcactagaagggaggcaagtgtgaagagtagctggggcttaccctgtgccaggcgctgtccgaggtgcttctccctagtaactcactcagtacctacgtcatgagtggatgattgttactgatgcactttgcaaatgaggaaactgagtttaataactcacacaaggctgcagaggaggtggctgagtgaggatgcaaactcaggcagtctggctccatgctcttcaccactagtctataccagatcccagatgaatgtctttgggggctgcactgagagcaataggaaaataaatttcaagtgagttgttatttagactaagacaatttatctctttataaatcagttcattaaaatggatattatggaaagatatatacctttgtaaatttaagaggcattcctcattttccatggatttgaatttacatgggccatggacctactgttttattctatcttaatgttcctgagtacttcgtatggacagacagcaaattaaaaatactttatcttgtcccattcctgggtcaaatgtgatgatttaagaagccttttctcaataaatctgctaagccaatagccataaacaggagccccggttagtttgttggtgctaatggcagaaagctgagctctgcatagaggggagagggatatatttataaacagttccattagtggatcctgccccccttcttgcattgttgtaaattcttgcatagctttattctcaaggagaaatattagactcataatactcttttcacaatgatgatacccacccccagagcagtgtactcccagaggagtaggaatagaataatgtttaaaataataattattaattgaaggaatacacaggcaaggggtacctctttgaccagtctcctacctacgccctaagatatctctttagaatgcaattttcccaagggtataaaaacatcatttaattattgttttaattagaatccttcactcaacccatctgagaccaggtagaccttttttcttaatgtgttttaaaggggaagtgtttttattgggatctgatttgcacat

SEQ ID NO: 54198 - DNA, 1103 bp, Bovine  19866881152399
cttgaagatcatatcaggtgggtatctgtgtcagggctcagaacaaacaggtggaactccttgacaaaggttaaggcaggggtaacctttggtgaagtgtcagatgtcagcccacagtgccatgggagggagttgttgggagaatgaaaaccaggacctcgctctctgcctctgttcagtgtcctccaatgcttgctcagtgacaccccaggcggaagccagaggctgggagaagccacttctgtaatccatatggatcaggcccacagggacaagggtgcaaggggaagacgtggctgtcaacatgagagaggggcccccagatatgagtgctgcctgaagtaggagcatgtacccactgccaaaccacagcctggctgggagagaaccccagcttttctcttttttgactcccatttcttgccaaggcttatcatctgagcccaatgctaaaaggcagggaagctggggtgaggcagctttctggggcacagagcaggatggagaaggggagagtgaatccggatgaggacacaggaaatgtctttgctcatagcccatctgtgagcccatccctgaaaccaacctcagaagacacactgtggcagcttggaggtcactgggtcgttggtcagcagctgtatttaagtcagttacctttgtacatatggcatctttcactcgaccttgttacatgttggttttctctgagatcttaggaagaagcttgcatcaatttgctttgccttcttagtaaaaaacccagcatatttgcagagggctagtctcccctctttcatgcattggagaaggaaacggcaacccactccagtgttcttgcctggagaatcccagggacgggggagcctggtgggctgccgtctatggggttgcacagagtcggacatgactgaaacgacttagcagcagcagtctcccctctctggatgtctgtgttgtttgcaaattcttgaccttgagtggcggtggcatttgttatccctctgtctatgcctgggccctggggcatttgtgtccttcagatgccccttcctctgataaactttccgaaggttcagcattttccgtgtctcattaaaatt

SEQ ID NO: 54199 - DNA, 756 bp, Bovine  19866881169161
cttatgtattgatagccttggttattttctgaagatgtcttattatataataatgaactcatattgatgataatccaacaacaaatttttatcaatacccagaactatacttgatgcttgaaggaaaaatggatgttttatagtttataaaactgagacagagataaaattgacttaccccaaatcccataatcagtgagaaacagaaagagaattaaaatgcatgcctcttgagtctcagggcctaacagtggtagacatccatagagatttcttaagcataaaaaaattgatgatatctgccagcaattattctgttgaagaagtatgttataaatttctatctgcacctcaaggttttctctgctagaatggctctaaaaattgtatgagctgtatcataaagtgtttgaaatatcacaaaaaaattgatgtttgaaaaaaatagatgtatatgaaaatataaagatcttttaaataatataatgtatactgggtttattttttgattaatgcatctgtgaaaatagtgaactttaactgtcttaatctttttaagttttctctcaaatgctgcacctattacactatcttattatccaggttattaaccagcacttgctgactaatccaaagaaactcagtttatcttacatgtctcaatattccaagctataaaaatatagggttaaactatataatctctgaaagcctcttctgcttcatgtaaatacaaacataaatgatcatgcttaa

SEQ ID NO: 54200 - DNA, 1866 bp, Bovine  19866881222134
aaagctgagtgctgaagaattgatgcttttgaactgtggtgtggggaagactcttggactgcaaggagataaaccagtccatcctaaaggaaatcagtcctgaatattcattggatggactgatgctgaagctgaagctctaatactttggttaccagatgcaaagaactgacccccttaaaaaagacccagatgctggcaaaaattgaaggcaggagaaggggacaacagagaatgagatggttgaatagcatcatcgacttgatggacttgaatttgaacaatttcttagagttctcctgtgggagaacatctgcaatatgattattattttccagttttggggttgcccacccagcaggtgtgtgatttgattttatcatgattgtgttctttatatcatctcattgtggcttatactttgtctttggatgcaaaatatcatttttggtaggttccagtcttctcttcttgatggttgttcagcattcagttgtgatattgtttgttgttgttgttttgagagggcatgagtcaatgtctttctactctgccattttgtcctgtttcctccctgttcctttataaatgaatgttctctacaaacatttcaatatatatatatagaagaacaaaaaaaagcctcttaacagttatgaaataaactagattaattttaaaactgagacattcaatttcaaggcattttattaagtcttgtgtaatttttatgtgatgagtggtgttttcaggtattactattgagttttggttgttctttggtggctaacatctctgctgttactgaacatgtttaattaaatgtgtgatctatactttcacacactagttaattaaatccatgtctgtagacataaggtgaattttccttttattttctctaaaactttgcagtccaaagtttttttatgccataatttttggggatacgtaattaattttgtactgttttaaaatatcctcatcaccaacagcatcttacaccctactgcaagacatgcagacagaaaataaaattataagttgaaatgtggccaatatacattaaaagttaagttctatagaagttacctcacttggaaaagtctaatgtcagaatatataccttaatatttcatatcttctataaaatattaaaaaatcacagttctctcctcttagggagaagaaaaagtttcaacaaaccaacatctataaaatatagtgatatatgaggggtacatatctcttagtaagtattaaaggaaaatatcaagaagtaatatatttattaccagactggaagtgctagttactgtttttatcagctatttctgaaaatttttcatagctttaaatgtttgctctggtgacactcaggtaattctttgttgtttcttccagtccaattcattttcactctttcttaccctaccagaacccttgtcttttcattctactattcttgtgattatgtttagaactaattgcatcagatagaaaataattttgaatcaatgaaatatgcctcaaactaaaataataataataataataaaagtagatgagagtctatttagcagcattccttgctaaaaagaaattcttagtgaaaactctaatttcaaaacttaatctataaagaaatagtaaattggacaataagtcatatttaactgagaatataaatggataattaagctaatgtgggaattctctattggtccagtgataaagtcagcattttgactgttgtgggcccagatttgatctcacaagctgcttggcccagcaaaaaaaaaaaaaaacctttgggtctgtaaccacaatccacaattaaaggaaagcaaatacaaattacaaatt

SEQ ID NO: 54201 - DNA, 1337 bp, Bovine  19866881260369
tgggttggggtatgcaaggctgcttgatgctctgccagaaattctggcaggtagggcagaaacacaaagagccctggaaccatttgcctggtctctttatgtctgaactgtgctttcctttaagccctgtctggtgataaaaggaattaaatgttcttatcaagtttgggaaggctggcactgctggcttcaaagggtcacttttgattatgcagcagccttcagcttcaacaaggaaggggaagggaaaaagaggattttgtcagtacacagcattacaatactcattttcacaacacaaactgccttagttaaatatctctagcttgatttatgacgacagatcatagctcacagttccttgtggtctcacagtagcgtgcatgcaagaaaacacatccaaaacctaaattggttgcggcatgagtttcacagtcaacctgccaagaactcagcacttcactctttaccaaagtttgaacgagaaaaagcaggcatccaagacatgaaaaataagagtttgaaatggagattgggctggtaattaagagccctggactttggttgcagctcggagcctcagattaccctagtgtaaaagaaaagaattggattatgtgatcttcagggtctttttggctcctaaaattctttttctgactgtgctgttacataaccacactgtctgtcctctcaccccactaagtcattctcccccagcatctcctgattgttggactcaggactggatcattttagcatgacccttttgggtgcattaatttgccttctgtttatttttcctccctctctccaacaaagtagccaggcccttgtagtttcttgcctttggtatttccttttttccagggttaacatcagaagaagtttgaagtcaagagatattcttttatttctatagacataaactcactgagaggattactctgaaaatctccaaagagaggggatcaaagaaaataagttttagaaagatgcaggagagaggaaagaatgtttttcctagactgggaaagtgagacagaaatggtatttgacagcatgtttcctacatatgctttcctacaccttgaagacaagggtgtgacttgccacagcatatcttaggggcctggacagtcggaagcagtgttcccagacttggaatcacaccaccaggtatgccacttataccagcagaggttggctgtgactgaagtgaagactgaatgatgacaggggaaagagacaatgagtatcagttataatttcaagaaaagctgcagcagcagagtctgcagtgatcttactaaccttcctattataagttttcacag

SEQ ID NO: 54202 - DNA, 1611 bp, Bovine  19866881264862
attgggtcacaaattccttaaaatatgattagtccaagattcagcatcacttcttctgttacccagatatttatattttggtcgtctatgtgcattctttactggcttccatgtgctttgcaagtagctactgtgctaacaggagtagatgagtttagagagagcaaaaaatatctctgattcctcatcaatttcaaagcaagaggttcattttttccctaactttgtgttttattaaccttttgtgggatgtgtgaaagagtagttaataaatgcttgaatatataatttcttctactgagagcttacttaacttcttcaaggaaaaaaacatcaggacatggtcctcatctttaaagctacactattttgcattttctctttttatctaatcccacctgactctcctataattaaattatagaacatgtgccattttatgtcatttattattctagactcagggaatatagtggtgaataagacaaaaatgccccctgatcttgtggaattttcatttctagtgacaagacctattaatagttaaatcaactgaatgaaaaaagaaagattttagacaacagtgaagtctgtgaatgaaataaaacaatgcaatattaaagagaacagctgagtccaacacagcataagtcaggacctgttgctaaagaattgtatttatttgggagctggaagaaaagaagtttctaactgcctacgggtggggagaaaaaaggtaaaggaagagatatatgcaaatatcttaatgcaaattttatggcagaaaaagcatgacacattaaggaatgcaaaatgtcaatatagctgtatcataaaggagcaagagagagttaagagttatgaaagatgaatttggacaactgaatcagaacttgcagtgttctgtagccaagctgactttgttttgtcctaagagcaagcacatcattgtaacaacgaaaacacaaatgttacatgctctgatttgcaattttaaatacaaaataggactaaataagcagaccatgtttttatcaagcttttattctatgtaattgctacatttcaaaacattaattagccattgtctttaaagtaagataatgagcattttataatgggttttggttatattattttcactaacacatataaaatacttttacacataagtatttttaaatacttggcttattttattttaaaccaagtatttaactttaaatacttggtttatttttttctgatttacagaacagtgtgcttaaattagaagattatgacaacaatgaaaatttaattgttgcttgtaaactgcttaaatattaaagatgtattgatttcttgtcctggaagtctcagtagagattcagactgatacaaatgctgtgtgaataatctctgtaagaagaaaattaaaaagtgtaagaggtagagaaaggggaaagtattacagcaatgaaaggaagggagtaagcattttgtgaagaaatccatcagataacattacagaattcagcaccggatattacttgctttagcctgctggagcattcctataagaaaaagaaatgcaagctttatttttagcctcacaattctaatgaaagg

SEQ ID NO: 54203 - DNA, 1484 bp, Bovine  19866881272146
gaaaccctttaaggattgagtacaaatcgtcatctacaaacttgaccgggagtttggacctcatattctcttgtgcagtaaatccttgctaaataatcttctgtaaaaatgtcttacctttaagtgggataaagagagagtgtggtatagggagattaggaagaatcatgatttctttttaggagcttcctactctggttctctgcagcccagtagatgtgtgtcttattttccttgacttttgatttttgtccttaagttatcctcagcagtggactatttgtttccttacataagaaaggtttcctctggctatggtgtcccctgaaagcagacatctccatcaattctactaagtctgggagtgatttataatggtaaattttaaccctgtcccctggagctgaaagtttatagagccaaatatagagtaggcattatttccactctgtaacatccacgaagagcacatcataatagctgcaaaatgatgaggaaatgtgaacctctcctcaacagaaaagcctccaaagctagcatagaagtcacaaactaagagatttagctcctgtaacctacagataattgcccattcatttattgtctcatttattccctcattcatcagacaattactaaggcctcttatatgtccttttgtgtaatgtacagaggagttggttacaaaaaaaaaaaaaacacatattgcaaatcaaggcacttctggagctcaaacctgacttttttttttttttgtcctggcaagttacataaactagttcatgctttagtttctccatgtataaaaggaagaagtgaatgttatagcatacttttcttagtcggttaagtggtatcacacaacactagttaattcccttagctttttgacttatctttccttatgattctggaactgatgcagatatgaagatgtggtttctgtccccaaggaactgactgaaactgatgctcctcaaaactatggaaagcctttcaaatgagttaaatcagacatatttagcatagggacacaaaaattgttagcatacatatgagggaagtaaacatatctgtcttttgtctagttttggatttaaaggcttatcacaatttctgtcactttccagtgaagcacaattcctgtgcttttcagtaaatactgaatggataagagagcctcaaagaagaagaaatcaaggactaagtgatttcgaatgagggagaaatgatttcttacatataaggtattgaggtcaggcacttgagacacagattgtaaggttgggatttgtgtgcagaaatattattagagatggtttcaggattaacatgtacagtattcaaggaaacgaagcaggattgggcagagaggggaattgggctgtgtgatatattcaaaagactcataaatccactgggatctcagagactggagcaggtttttggagttttcctgagcaccctcactttgagcggatatg

SEQ ID NO: 54204 - DNA, 762 bp, Bovine  19866881337878
tgagagaaagcttcatcaggaagagtgaactcatttcccaggagttgacattgatgcagagatgaaggatgagagctgttgtccagatgaaagtggatggggaagatggttccactcaaggggaatggtaggtgcaaaggccctggagcaggaagaacttgatactggaagacaataagaacagccagtggagctggagtatggagtggggaggcaagttggagaggtaagccacacacactcgagtagaacatagcattgggaattgttctaagggcaatgcgaagctttttttttttttaataagttttaaacagagtgtgtgtgtgagagagagataaaatccattagtaattgactacagggtattggttaggggacacttgaaaaagcagaaagaacaagaaagaaattagaatggggcagacctgttgcaataatatatatagaggagcaagcagttggcaaatatttcctgttaagggcctcatagtaaatatttcaggctttgagaggcaacagtctctgtctcaatccttcagctttgctattatagtgtgaaagcagccagataatatggaaatataagaaagactgagttccagtaaagttttatttccccaaaacaggtggtgggccagatttggctctcagcccaaatggtactagagctgtgccagggggcaggaacacaaaggatgggctaggaaaaaccgtggatgaaaaactgctaggctttgtgactacatgcagggactgaga

SEQ ID NO: 54205 - DNA, 841 bp, Bovine  19866881381442
cagtgctcaagagccctaggtatgaaatttgggatgatgtgaatttcaagtgattatacatttagtcttttaaaaagcccactttagacaaatgggtaacatttagtggcctgttgcaatgttaaaaaaaatactgttttgaaaaagacaacccaagtcttaaagagacagatttgaaaaaactagctcacaaggttattatcaagctggttgcttagctattcattagaaggcaaaggaaatagctaaaaattggagaggacataatatttgcaagaacccaggtggcgctagtggtaaagaacccacctgctaatgcaggagacataagagatgcaggtttgatccctgggttgggcagaccccctggaggagggtatgggcaacccactgcagtattcttgcctggaaaataccatggacagaggagcccggtgggctacagtccatggggttgcaaagagtcagacatgactgaagcgagttagcacgcatgcagtgaaaaaaaggaatagtaaataaatgaaataaaaaaaaggggatactgataaaactgaatgaggcaatacctatcccttcaacctcaactagaattctgacacttgagcaacacaggtttgaattgctcaggtccacttttatagggatattttcacgagtaaatactgcagggctatgatctgccattggttgaatccgtgattgcagatctggtgtgtatagggccaactataagtttcatggcttttcaacttggccagatgtcagcacccatagcccccagcttgttcaggggtcacatgtatatatttcactccatttgggaagcaacccatggtgg

SEQ ID NO: 54206 - DNA, 1004 bp, Bovine  19866881401157
taaaattacccaatttatcttttctttctgagctaatataatttagtatcctgaataaaagctggcttttcaataaatagatcttctggtcagaactcagaaatgagtcaatgaggccattaaatgacccctaaaactcaaaaattgaccttttcaaatggcaacctactgatgtacaataaagatcacatttatctaattaagctaagaaaacataaaatttgcccaagtagttccacaaaacagagaggaaaagggaaggctccaacagaaaaaagttatttgttggtagattcaaggataaacattaaggtacatttctctagaaaagtttgtcactactatgaatatcactcaaaatgaccagccacacacctcagcagctccctgcagaggttaacaaaagcttggtttccttcaaagaatgtacattttgtttcttctccagccccagagggcatcacaaaataaagaacagatggtggagactaaaggaggagaccctgaaggtgaaggtttttgaagatgcactaatttaaacacctacctctgaaaaagacagtccccaggcctataaattaacctgaatgtgtgttttcataacatgcctatcatcacagctgagaccaagttcacaccctcagcgacaagaagaatcaagaaatggtgtcatctgggaccatctattctctggtccagaaacccagctcatgcatccaaatgttgcttctgttggcctctctgggttagatcatgggtgttcaaactttgtaaaaagtcacctttgttccacagaagcttaagcagaagtgtgaacaagccagttaaatgcagggctgccccagatgaagagcacatgtggtcatctgcagcgggtggcagagtctggctcctcccacctctgccagggctcagtggaacactttaaaaaccatctgagactgaatatacagcaacaagggctaaactgaggtcaaaacagtacatttggcccgtatatgaga

SEQ ID NO: 54207 - DNA, 1005 bp, Bovine  19866881439813
taaaatgggaggtttctgattgcctgctctggagaactactccaaggtacattttggaaatgtgccttcattatggaaagtggcagctagccttgctgatgaaaattctttagctttcactgtctttggcatatgctggtgcctgaaatcatgacttcttaatactccactagttcaatgcactctgcttctaatgttccctataagaagttagcaaatctaaagtgtgtaatagtatattctatcactgttttgctggtcatctttaagaaacacatagagaggatactttagttaggaaaaaaagaaaaatggtaaattatttccattctttaattttcctaatatgaaagtggaaaaaaaaaaaggaagattagacaggaaaatcaaaactgactgcctactgggttaggtattgtacttactgtttctctcatcctcatggcaactattaactccattttacaaataagatttatgagattccaaaagttctgaggatcaaatgagactatccaaggatgtgcattgtaggctacaaagcacatcacatatgaaaagtcctattcttttattttaggtatgattaaaaatctattaacagcaattaatggtgtatttatagttttctgatttctatcaattctaataccagtagccagaggacatgacttacactcttatttatttaacccatattcaatttgtcttacagcttagtaagaatcaatcatattatttagttaccttcaactatagcaaatataaaatacttatttaaccttgcctagttactcatcttcaaattataaaggcatgaaatgatcataaaaataactcatatattccaaagtattaatataggtctatctttattctaggcaatgccaaaaatgctcaaactactgcacaattgcactcatctcacacactagtaaagtaatgctcaaaattctccaagccaggcttcagcaatatgtgaactgtgaacttcctgatgttcaa

SEQ ID NO: 54208 - DNA, 1341 bp, Bovine  19866881465789
ccgcaaatagttactttacatctgtgatgcgtcaggcacagtgttgtgtgcactggccctgcagccacaaacaaaatacaggacagtctctgcctcgagggagttgaggtcttaacatgcctgagaacatcttagagggatattatcaatcagtcgttaataaatgaactgcagcattgtgagaacaaataaaataaacatgtatcaaaactaaaggtgaacataagtgtttaaagatctcttatccacaacagtctatatttcaccaatcatgaaaataaatggaaaattgtggaaacccgaaatttcgtgtggaggagggaggttagaggttactgtggaaacaatagaatcaaagtaaggttttgtgtttcatggttcttgaaccccacaactccaaaatcaaggctgtcattcaaaactgggtacatggattaggcttcaagcttaagccaatcactgcctcctcccaacccaaatttacactgtgggaaccctattctcaaggacagaaaaggcctgatagaaaaggtatctatcaagtatcccaaaggcaaaaggagctagatatgaaaactcagaaccaatggaatgtgtagtggtgactcctttttgtgtgtgtgtgtgcgctattgggaatttgggacatatagaaaatggtagagatagagatcagaaagtagactttgtccaaattagcttctcaattaagctgaaaagaaataagaaagtgcaaaacaagaaaatattaatttcctttatggttgtttttagctgtatagaagttttaaaatacagacagtaaaaatgtcatgctttgttttggatttcctcctctgcttttcatcttaaaaatgccttttgtcaacttgagaaaaaatatatatcacttatattttatttgtcattttattagatacattttcccacattatgtagcttaaatccataaagttattttatgacagtggattgctttttatttgtatataagtagattgcatttgagtctgttccatctttagtatctttttttcatgtctgtgtcatgtctgtgctatagggatatgctggcactgcactattttccattttactgaattgtcatgatttttccttatttatcaacttgagtagctcctttaaattcctctaaagtagcagtcttgaaaatgtaatcccacttcctttgtcctgcatttttctcagcttagcagaatgtcttgtgaagtggttttattgatgcctctagatctgtcctgcagagtgatggagttgatgggggttccagtcctcttcggcatctgcttcctggagcagctttatccatcacctgacagg

SEQ ID NO: 54209 - DNA, 1232 bp, Bovine  19866881672270
aacccattcctcattgcttttcttcttgatttaactgcttcatgcacacttaaggagctaccttaatctaatcaatcagtactctaaatcttgatgtaaaatagtgacagttaattcttaccaaaatggtcagtttccgctaacttggttctcagaggtattctgtaaacaagtatttaagtttaaaagtttataataccttgtagcaaggtataaaaccttttgacaactaaccctatcattgtttgtctataatgttaacatgtcacccagctcttacttttggagtttcatgttatattctacccagggattgtatggaatggattttggtggttttcttttctaaaccagtcttcagaaagagaaagttactgaattttcaaaataaagatcagtgtcacctgccctgataacctttggcaatcctgtccccacccctgggtggcagaaatcggcattccctgtttccagcaggtatcaaaaacaatagcaatttccttaagcacatcaatttctccttgcggatgggcagcctgtcgctataatcagatctgtcagctctttgcaaaagaattggaaagtggccttacttgtgtggaaatctaatagcgacctgtcactccctcttggcagcactgcccaggctgtcagtgtgatgtcctgtgtcctgcagttgcagagggctgggtccctccctgaagaaaagctgttgatttgagccactttgctcactcttgcagaatttatgatctgcccggtgtcttccctctcatgcttgacttttagaaaatgaatttgccaagtcctgggtgttttagtctgtcagtaactagtacagattctggcatcataattcactctataaaaactcattaatgaaaacaatccagttgttggtacactgtgattttcttgtacaatgaaaactggggtaccctgttgcagtgagttgttatcccatatctctctctacactctacttagaaattgtatcaaatgacagaagcaagattctttttaaaaaaattcaaagtatatcccagtcagtcactcttttaaacactagatgcccccaaaatcaaaaatttaattgatttttaagtttttactttttagctccattacacgttacacctcagtatattttggtaccctctcgcattttgtagaggtaagatatctgatttctagcttttaaaagaactgttcagtaagtaaatcaatccctg

SEQ ID NO: 54210 - DNA, 1128 bp, Bovine  19866880256832
gaaatggcaacccactccagtgttcttgcctggagaatcccagggacaggggagcctggtgggctgccatctatggggtcgcacagagtcggacacgacggaagcgacttagcagcagcagcaccagtattactgttcagggagacatggctttgggaaagaacccgggtgttctccttacttgctgcaagtagtaataaatccttccttctggtcttcagcatggttgttttggctcaatacccatcaagaggtgaactctgaaaaaaaaaaaaaagaggtgaaccctgttctcaggtaacactaggggtgtacaacaagaacttgatgaatccctgctctgaacttctggccctgatagagctgactacttgatatttatcttccaaacccaaatcaggttatagcatgtaaccatattctcttggtggaggcactcatctgagcctcttttgattttgattttatatgtgtatgcacacacatacacaactatgctggctaatcttttcttcttttcccgaatccagtctggcttctcattcaattcagctgatgggagactctggtagaacagagggcaggaacaaagtgaggtcaggatatgtaagttctccctgagctcacctgctggatggtagggttacatttctccacggaaggccacggttccatctggctgccctcacagacggcttctagtctcccttgttttcttcaccttgaaatacctccctgaaaattccatacattaatttctttttgtttgagcataccatcactttcctgccttgttataccaggctttacttacaacattcgattacaaaaatattatatggggattactacggtatacgtattaccaacattaatattattttactatagaagatcaagggtacaatgtaatcaatctaagatatttcattggaatttattataaaagaatagctttatgtgattcttgaaacaatgggtaaaaatttgccttagtatgcatcagccaataaattaagtttaaacttttaaagtaaacagaagagagctaacatttattttaagtcctctgtgtactggagaatttatatatttttcattccagctgtatttttcactgtttgactc

SEQ ID NO: 54211 - DNA, 2934 bp, Bovine  19866880411498
tttatttggtgctactagttagaaaaactgaagttgatatgtctgtcaaagctcaaaactattttcggtgcatttcacatcagaggcaggtggaaacacccactctctggaggaactgactcagaaaactggtgacagatgggatatgggtcaggaaaggagaagtgagtaagcaaaaggtgatctaaaatcttgagcctctagctgtgtattcactcaactatgcttacagagcccttttcttttctaccgactacaaaacagtaggaaagaaaacagctgaagtcagcctgctttcctacaacaatcagtcactgagcaatacaaggaggaaccatttaaggggatgcaatttcattctgcaaagtgttgggaggttccccttagtctataaactgtgtttaagggaattatctaaaagtaaattaaaagaacctgatcaaaatcttcaaagcacttttggagcttacgtagaaatgaagtgcaggtctggtaaccaagattcagtcacagatgagtcagatccagaaccattttagacaaatatctgtgtatcgtatctgctcaatcaggactctccccattttccaaacaaatcactgtgtagtatcatttaagatccacaattcagtttcatctcagtctacatatgaactttgacatgttaccactgtgttggaaagaggatgcaaacaagtagatttatcagaggttgagaaggaaaataagagctactgttgtggaaggaaaactattgccttgcctaactgctgacgtaatgtctaacgtgttaaggcaaagttaaggaacggatcagatctcaacattcaatctctgagcctcatggtttgagctttatattctgaacatagacttccacaatattatagttcaccatcatcatttcaggaaagaatacggggaaaaagagttgttgggagagttaattttcatcacaatctggttaatatttggtttctggcaaatcacataatgtatctaagatacatatgtcaagtaagtaccaatataatacactaaaatatttgcatgcataggcgcacacataagacttctaatattatcataaagcatgttgaacatgcaaagaaaaaataaacagccctatccctaaaatgttgtgtaatctaaagatacaattatactgtacctaggagaaagacagacactcagaaaatgggtattcaacaaatactataaaacaatagaaaaaaatccaatgaatacaactaattttctgggactgctgctgctggtccagcctttaggactcatccagtccaacatttcgcatgacatgctctgcatacaagttaaatcagctgctaagtcacttcagtcgtgtccaactctgtgcgaccccatagacagcagcccaccaggcttcccatccctgggattctccaggcaaaaacactggagtgggttgccatttccttctccaatgcatgaaagtgaaaagtgaaagtgaagtcgctcagtcgtgtctgactctagtgaccccatggactgcagcctaccaggctcctccgtccatgggattttccaggcaaaagtactggagtgaagtgccattgccttctctgtttctgagactaaaggtatctaaagggcaaatccacattatctctgtttctcattttatattcttctctaaaatgctattccttaaataaagtgtaaaaaatttgcattccaaaagtgtgaggtggataaaagtttgtcaccttaatctaagtgtacaagattatcacaggtacagacaattaataagcagattgccctacacccagagtccttggggacccgaaactagcagtaaagggatagttgagatttcaggtcagttacaaatagaattaggcagagaaaacttatacaccctgttctcattttctccatttttttttttgaaattgagaacatacttgagtcactttgaagtgatattattgacttgcataacattttttgtttttgctctgcaatgtgaatgtgcatttttcaaatattaagactttgatctgagttgctccaccagagcactctagaggctgaaaaccatttctatataagggtttgctatgcttagaggaagactactctagcttggaagaggttggaaatatcccatcagaaagctcttttcagtcctcctcagcctaaacactttactgagaagggtcaaagtcaccaactgctataacaaaacccaaattacccaatgcttccacaaggaagctaagctaagtggaaactcagaggtcaccagctggactccttaatgcagcaagggtcaaacagtaaaaatgcccttgaaaagcaacaggtacattctcctaaattctactgatttttacaagttgtccaataagtttaaaagactagcttcttaggtatcagtgtagaaattaaattcaactattcaaaaaggaggagggagtggtgacagtagtggtgtggtcagcccaaactttgaactctcaaagcaatcagtctgcaaactatgaagcgccagatggttttataaacctgaaggtccataaatctttccttacagtttctaattttttttaaagggtagttttctttgtggggttggggaaaatttttgccattgggtacctgaaccccaaaaccctaatagctttttaagttttcttgctctgtctgtaggagacaagtaggatagatgccaagagaacaagctcagagcacagtgtcatctggcagctttctggtggggagagaagactgagcttccatttctcaaccttgactgtctcactgtagtcatcacaacttaatgaagttctaagattttaaacattcatggactgagttcacagattcctccttcaattggaaacttagtataaatttctattttcaattacaactccaaatctccag

SEQ ID NO: 54212 - DNA, 727 bp, Bovine  19866880456118
atatactttgaaaatttccctaagaatactatagtatgcaccatttctcaaatgtatttgcccccagaatcctatttaaaggaaacctaccttgggactcaagtcctgtgaaacactctgagagtttatgacatctggtcctatgttgctacagtggaaataatgaaaatggctttatttttggcaactggaatgccctctcaggtgacactgctatccccaaatgagcaaatacttcttcccaataactatcacacacacaaacagttcttatatccctgatagttggctatctcaacacatggtttgaacttgaaggccatttgaatgaagagtctattagaatatgtataatcacatttgctaaacaaaataatacaccgtttaacaggctccttaaacctatactggattaacatatctaactaaaaattattgccttataatacctttgattaatagtataagatatgtttttaatcataacagatatgtttttaatcaaaattcagcatcaaaagtgacaagcacagaggatttttcgggtggcaaaatgaatctgtatgatactccaatggtagatacgtgtcattatacatttgtccaaacccactgaatgtacaatactaagagtgaaccctaatggactttgagcgataatgatatattaatgcgggtttatcagttataacaaatgtatacctcaggggtgggatgttgagagtgg

SEQ ID NO: 54213 - DNA, 1726 bp, Bovine  19866880457677
tttggtgggggggtgaggggagggaataaggcctgccaagaaaaattagtggtggaacttgttcccctttcctttttccatggaatatttcaacactcaaacacaaatacagctcaatctttcctttaggttaactctgggactgcaaggaaggctctggctgcactgataccttagaaaaactgaaatacttcacgctgcaaaatcagtccctctgagttccttccctggaaccataaaaagaatcacagatgtgagaggggttattatttatatgctataggaaaaccctcctccagcacacatacaaatgagtcgacaaagttcagtcaaatcccctcacctagaacaaactggccaaaaatgtgcaaaagtgcagcatcagctgaaaataaaaaagttagactggcagaaaaacacttaaccaaaccaggccactaacagcttaagactcagtttgaaaaccatttactcttttgaagggtaagaccccttggaagtatacttgcaggatctcttaccttctttctcatctgaatcccaaaccaaacctaggggttcttaatcaggactgcaattagcatcacctggaaagccttcaaaccaacatggcgctgggaacctccccgttcgcgtccctccgctccctactcccagctcagttgaaaacggaaactcttgagttcagggcagggtgacccggtgtttcttaaaagcctgctaggtgagtccgctacacaagcagaagatgaaaaccacagctttagaaaagcatgtgttttgttttgtttttcaaaagaagctggtttctctaccaaatccactcaaagacattagagctctaatttcctctaatttcacccaggctgtcctgttgcaaaaagctctagtcattacttccaccgcctgctaccatgcacgcttcctaatgtggaagcaggctaaatctgaagctctccacagctagaggcgggagcacgcttggaaccgggcctaggaggccatgaaaccccagacgccatcttggtgattgaaaaggagatacaaactgttgggtgtaaaacactcaaggatgtatacacagggcagtgtcaatatgttgtaataactaaatggaaagttaacttttaaagagtgtattaatatttaataaaatgaaaacgaaaagcaaaacccctatttctctttacctgcataccacttctgacgccaaatatgcaggctttcccacaccaagcaattttccaattctcgacaggcacggagtggatgtcttgtactttaattcaattctgaccctaactgccccaaattaacacaagcctcacaggtttaggcctccggcctacaagactgctcgctccccattgcagacaccaatttcaagtccaggttgcagccagagcttctgatccaccaatgtaagtcggtgggggcggcgggagggaaggtgtcccacgaccccctccttcaggcttcacaatttactagaacggctcacacaactcaagaaaacagtttactcaccggactggtggtttatcatcaaggacacagcccaggtacaggcagccaaatggaacagagagaggtacagggcagagtgtgtgaagcttccacctgtgtccaggacgccaacctccctccaccacatactcaagggagccgctcaccaaacaccacccataggcttcttcaagggcgggtcttcttacgtaagcccgta

SEQ ID NO: 54214 - DNA, 2032 bp, Bovine  19866880467180
tctcagtcacctatacttaacatctccagggttgtgtttctttccttttctttctctttcctgtctctctcgactcacactcaaccagttggtatgttgcaattcttccctctctaacatcccatagcattttcttttctcctctctctaggtcatcttgacctgaatatttataatagcttctcttccatcttctcctgattatgtccatttcaatttcaatctgtttattcatcaggaagactaatcatcctgaaggacaacttcccaaaacaatctgtaatttgtctaaatcatcgtatttgacccatagagttcatctaatcaaatatctcattttgcaggtgaagaaaatgtattgaccatatgtagttattaacagaactggcacaggaaccctatttttttgtcataccattaatattttttccttctataatcatacctgtacccactgaaattcttatgcagctgatggtgagtcttgctgaggagatatgaggagatatgacattgaaggcaaattaagaacacattacttcaagggaaaatgccaaggtaactgggttcccaaagagagaggagagagaaatagcatgttgtaaaccctttggagtcactaaggaaatgttactactgccaaggagaatttgagaatgattctaaattatattataaaacaatccatttgtttgaatatgtcttaatgagttatgtagataagggatgaaaagctagtgattttatttcttcttcaaattggtctttggtttatctgccattttggtctcttattcttttattaatgcaagtcttgcatatgtcacaaaaccttcatttaactttttcatttgacaactctacatcattagtacagtgaaagtcagagaattcttgtagattaaaaaaaaatagaaggttatctgtcagccacttgacagaagcaatattattattaccattataggtgatgtggcatttgaatgtcctctttttcactggccattttgtactcatatcttataaattaacttagtagaagaaaaataggatatttcttccagaaaggagtttcacttcatagagaaagacagaaaatgagtataagctataagtttcttttagtaactgcagaataacagctcgactttactttcaggagtacctgacaaaagggatcatgttcatttggataaatagaaaatcatggatgcagatgtgggcaacagctatgaaattgtgaaaatgttttcaagttcggtgtatatgaagtgttctcattctaggtcccattaagcgtatagaaacatgtattttatcatttaagaacattttttgaagataattctatgaaataactacatcttcccaacacttgtgtgcataagtgaagtttaaaaaattaaataaggttcatatgggtccatctaaagagaactttaatctcagatatccagacattttgctcttgttattttttttcaaggcatctcaagaagtacagtcctttgtcatggagggggcactggtttggggacctcagtggatacaagatccacaggtggtcacatccctgtgtaaaatgtcatcgaaatagaattggccctgcaaatctgcagagtctgcatccccagctatggagggccgattgaatttgttgcatgtgcttgtccagacctgtatcttatttttgtgcagaaactttaaaatttttgtttactttacacatgagcaagttaaatagttaaaacagccaatcaaattgcttggtgggctttgtagcttctaagcaactggttagtgaaatcattaataattttgacttttcaaataccttgattacccaaactatgatgattaaaagagtgaaaccacctttttttcttccaaggaacaagagtcttttaatttcatggctgccgtcaccatctgcagtgattttagagccccccaaaataaagtctgtcactgttttcatttttccctatctatttgccatgaagtgatgggaccagatgccagatcttagttt

SEQ ID NO: 54215 - DNA, 2273 bp, Bovine  19866880522051
aaatctctaaaaggcaagtggaactttagcagcccatgaaagatgaatttttgtcaccttggccctagagtggcttgaggtcagagaattaaagctatcataagttaataacagtttgtgtaaccttacccttaaggaaagtgaacatgactgtttagaattttgttttactgcatttaccagagtttgtgtgtgtgtgtatgtgtgtgtgtgcccttgaaaaccactgtcacttccccagtatgaactccctaaagttaggggtgagttttgtgttcattgtagaagagagggcaacgtatgttggaggattcattttccagccctcttcacatccctcctgatttctcttgaagtgataaacctttcggtatctaacttgactaattctatatccttgacatttaaactccccatcccactgtttctcaatctggggacgaaagatataactttacatacatgttaaaatcaaaagacttatgtgaaaatgcacattttaccacagagatatatccttttagaaaggacaaaacagaatgtgtaaaaatcaagaaaaaaaaaaatgaggaaaatgtattgagagtataacaggaactgaaaatcttacttactcatccttattctatatttcttagtatttagtgtgtaaattttgaaatcttgacttcagccagcaattttgaatgagaataaaatactctttgataatacatgagacacctaagtgaaagataatgctatattcaagaaactgcagagaaataaaggcaaatgttacaagaaatgactgctataattttatagttcctctaactcaaactagtctccagatctcaccatcattatctctctcatttcctttcagtctaattaatcaaaatccttcctagatgttcatttctggtcagtatgtcttcctgaatatgaataagaaatagaataccattcaatgtttgaaattatgggggtaatctcaatgacggaaatagatgactggcaaaagggaagggaatgcctgattaaatatattcatgaagatgtcaaagccttataaagccaacatctggggaagagaaagccataggacgagagcttcctggtgaagtgtgtttcttgaaatcatcaccaccatggacagcaaaggttcgtcgcagaaaggtatgtacagcagcttgtggagttgttgggttttatccatgttccaatgggggcattaatttgaaatttgaggaaatattctcttaggtttcaggattacagagtttagaagaactagctaatcctgctctagaaatcaattgtataggggcacaataggacagtggttcttgaatggaggactgtcttccagagacatttggttaatgtctggagatggttttggttgtcttaatatggggcaggggtgcaactggtgcccagggggtagagaacagagatattgctaagcatactacaatgcacaagttagcccccagaacaagtacttatccagctcagggtgccaatcatgtcaaagttgagaaaacttagactggaataagaccaaaaatgtctctgagtccaattcatcacaactccagaaggtagaaacaaacattttctagttaccaagattcttatgtggtgtggctaagatgagtcagtctgatgaaacttttaactctgaagctataatacagacagtgacagcagagtagtctcctacaatactttgttgactgggtttaatccaaatgatatcttagaagaaaacacaggctagtaacaataattgcctttacttgcttggttgacattcgctagaaaaagaaattgcagataactaatgagaacttactgtatagcaaggacaaatctactcagtgctctctggtgacctaactgggaaggaaatccaaaaaagagggtatatatgtatacatacagctaattcactttgctatacagcagaaactagcataatattctaaagcaagtatattccgataaaaattaatttaacaaaagaaattataaggcaaagacaattacaaaatttatcttatgaaacaacaaaaacatttcttttttatctcatcttaggctgtggaaaaaagtccttcagatgataaaggttcagataaatgtagtcagagttaaagaatatctatccagttatgaatttcctagaaccaatattccaatttctctatctgtaaagtactttatatttatacttgtagataaaacagttaatcagctgtgttacatgactggaaagtacctaa

SEQ ID NO: 54216 - DNA, 1114 bp, Bovine  19866880547024
ccctgtcctaactccccagaggacacctgctgaacattaaaccaagattgagtttcaaaaccaaaaaagttacaaaataagaagtcagatttttcaaagcacttgccaacaagcttctcagtgttctttcaaggttttcgtgaatggtgtcaagttttcccaaagatattcctatctgcttttgcctcccaagacatccgaggttgccaaccatccacatggtaggaaaaatctaactatgtgagacagtgtagagcggataaaacatatgtcaaaacatgaagcaaaaggtcactcttttagtcttaatatttacatgtatatatcagaattttcacattggtattattaactctgttagtaaagccacacaaaccagtgtatcagaagtgattaagccattcaccatatgagaagtacagagcaagacaatagagccttgtatggtacctggcacacacatatcactgaattaatcaatcagaagcctttgatatctgctaaacagtcatctcggagaaggcaatggcaccccactccagtactcttgcctggaaaatcccatggatggaggagcctggtaggctgcagtccatggggtcacgaagagtcggacacgaatgagcgacttcactttcacttttcacttttatgcactggagaaggaaatggcaacccactccagtgttcttgcctggagaatcccagggacggggagcctggtgggttgccatctacggaatcacacagagttggacatgactgaagtgacttagcagcagcagcagcaaacagtcgtctggggggatacgcacttttcctccttggcttctataagaatttgtagatagcttttatgcttaaagtactatttccataattgccctttgctaaagcaaactaaagatatctaattattctcaaatcacctagagataccaacttttaactttatgtataacctcccagagtatgacaacgcctagccacattcatggatacatataaacaaggtattttttttttaagtgagatcgcagaaaaatctacagcattctttgaatgcctcatttagtattttactgggatatgtctactataatgtatctgacca

SEQ ID NO: 54217 - DNA, 908 bp, Bovine  19866880566859
acgagaaagtacacagactgactgaagagccacttctattgactcgctaagtggctgaaaagcaatcatggccacatgccctgcattttggttgacagggcgacataaacccaactaacaccagactgtgtgacctcaaacctgggatgggagccagaggtttcacctgagacccaagttatcagatgtgggagctgtctcatttgctttctcttttagcagaacaaaagggagcaaggaccgaaggaggcaagaagatagaacctgaagttgtccagactccattaccctaaattacctgatgatgaataaatattccttgttccatggtttcaatggaaggtgaactactactaaaaatatccgatgttcatcatgctttcaatctctttcttttctatcagaaagaattattcatgatttctgaccaaagggtatccctttagtataacctcagacaaaccctgtatccttctgctatctttataccctctttcactcccatcagtccttgtcaatccattaaccacgacagagcccagcaccctattataaacttccctcccagcatgcctcagtggaaaagccgaaattgcactgctttaaagcatcatcctgactcctgacggctgaacgatctgggggaaatgtcttcatccctctgggcctcattttctacacccataaaatgaagctgatcttctgcacccccgttaccacctaaaattctcacagtctttagcccacagttttcaagtcttcagcccatagttttcaagtgagcccagacacagaatcacaggaggctagacgtcacttttaccatgtgggtgaaaagagctctgtgaaaacatgttcttacgggcaggaaccacctggagaaaatattaaagacaactgaatactgt

SEQ ID NO: 54218 - DNA, 1542 bp, Bovine  19866880574356
accagctggctaccacaggcttcagatgctaagcgtacaatggagatgaatgcaatcttatatttacgtgtttctgaattcccggatcagcctataattaaaaaaagaaatccttttgtaggaaagaggtggtcctaccagctctcaatgtagctggttagattcaggtgcggatgttgttcatgagatttgggatcacgatgtcgcatttcgagggcgtgtgccatgtggcagagcagagtcatgctccacatagagaaagcctgcatctaccttgccatctggagacgcgggtgccctcgaaacagcctctggtgaggttgggggaggcacctgaagcttgttttagattccgatgtgtgggctctggtgctccaagcccagctcaaaactgggggtgaggtgctttcccagttgtcatggggagctcttctgggacgcctgtctggcccttccactgtttgttactatttctacaaaggcggctctgtgtgttggattatgtttggccagctgttggcgcattcctgcgggtggggctgggtggagacctgattactgtacttggaaactgtagatctctgtgcggtggagagcagggagggaatgcaaagaaagcaggttggagaagctgatctctcttagagatttgctccaggtagttctacagcacgtgcagaaaggcttccagtgtagagaaggaaagaggggatgatgcggggcggggagcagtgagggaaggagaatgcaactgagcaagcccatcagagagaaaaacagactttagaacttcaaagctgcatagacaagcagaatgtcagcagcttgtaattagtggttcatggttgcgtcagcgcctgcacctctccaagaataactgtgtgatgtgtgccacagagtgaagaagacagtcataactaagttatcaaacctagttcaaaccagggcaaatggagtcaggaatttttctgtgtttgtaaatcaaatcctgatggattacacgtctaagacttgctgggttctgcataattgaaggctggattatccatttatgggggagggtggagggatattgtatgttcattaaacgaaactatgaacccttaaaaatgcagatgaatcgtgcatgtaaatatcagcgcgctctgcgtcaatacacggtatttcctccaatagccccaagcagctgttgccaatctccccgaatctctgcatccacacagagtttttatttgctcggtttttgtgcattcacgtggagaggagttaaaagttacagttcagatgaaatagggtcaattaaatgcgaaaaatcgcatcttggaattgggcaactgcagcggggttctgatttttgttgctgcccccgtgtaaagcttgccggagccttggcggtctcgcagccaaacagccgtctgttagtaagcccgtgggaagtcggggcaccgcagtggtggggaggcgaaggccacgttcacttccctcccttgtctctggcgcttagagattgccgtgtgtggactccagccccacaaagagccg

SEQ ID NO: 54219 - DNA, 1684 bp, Bovine  19866880594078
acggaggaccctggtgggctgcagtccatggggtcgctagagctggacacgactgagcgacttcacttccacttttcactttcatgcattggagaaggaaatggcaacccactccagtgttcttgcctggagaatcccagggacgggggagcctggtgggctgccatctatggggtcgcacagattcggacacgactgaagtgacttagcagcagcggcatccaatattaattagggcttcacaggtaactcagtggtaaagaatccacctcccaatggccaatgcaggagatgcagtttctgtccctggtttgggaagatcccctggagtaggaaatggcaacctgctccagtattcttgcctggaaaattccacggacaggatcctgccaggctacagtccatgggactgcaaggagtccgacatgactgactcaacatttacaagcatccaatattgcgtgaaaagcgaaagtaacttcatcagtttgggggtttatgttttcctacttgtatgccccaaggggctcatttccagggagtgaggtgaggacagatgggaccattccacctacccagggccttgctgactcatcttgctgcggtcagagagttatagcaactaaatctttcctacgttaagtgagtcactgcttggccattcagtcctggtcagtttgagggtcctgcctgacctaaaggtctgttctctatgtgttaggaaaaaggcagggtcagctaagtagacactccaggtcatgctgacctgtgatcctaagatttgaacattggactttcaaaaaaaataatgatttcctgtctgatcttttcctagtatatattttcctccattcaaatttgccccagttcctttctgaaaacaactgctttcctgaacctcatgttggggtaagcctctttcacaagccatattcctctgtttggggcattgcacagcactctttgaaaatgctttccagtagtttgagagagtttaattagttggccagtacgattacagcccctcagtagattttgtgttgccttatgaaaatgtagtttcactatactgttgcaaggttgtgagtttatcacagtcccaaatgtttagatagaccctgaaaatatagtcagttaagccaagtgtgatgtatcttaatgacaacattgattcaatcattcagcttccatttcctttctctaggatgtgagtagatttttaaaaatttaacttggctgatttctggtcctctgaagacggtgtctgtgattaaacttcatcctccctttcccacatccaagtgtctacctcaaatttgttcctggtgagttacagcaagttcacagtctcagttagatttttccttcttgcatttctcaaaactgctttctcttctttctgcatatcttagggttttgtttgggcatgtatttaagagttttttagggttttgtcttaagctccttggattggaatctttaagttcaaatatcacccagaagctagcagccctgcctttccatgctggtctgtcagcagcatcacttaatgtagaggccagtctcatcttttccccagaaggatcactgaaatagcttgtaccagtgtgcatgctgagagaagcaccctgctggactttacctcctgagtgaattttcaggcttagaaaagccctccaaacat

SEQ ID NO: 54220 - DNA, 996 bp, Bovine  19866880613923
tgtctcacactaaatatccgagctatctattctgttcctcagttacacgagcaatacccatctcctattttagaaaaaagtaaactattgtttaaagacagtaaacacggtctatgacctaagtgttttttgattatttcaaaaatctcccagagtacaaacaaaccaaaagaaaatagcaaggcacatacccacacattctgagaatactttaatttaaaaaaaaaagaaattccacttggacgcagagaaacttttgaccatttagggtcgcagtgaagcagacgagctcacctaaaagatgagctggaagcatccactcctggaaaaagccactccccctcaagactcacacctttctactttgcaaagtagaatttggactaaatgcagttatttctttaagatgacatcaagatttattttgcactttaattttcctctcatttcccctgattgcagtctaaatctgagtttaaaagaattatacaagcatctggcacatgatcgctggtaagcatgacagctttcattaaaaactgatgtttcaacctgtatttctaaagaatagattttaattgaaggcctttacaactaacaatcaagctaattgtattttgattctccttacatttctctggatcaaatactcacttggatatttttcactaagacatggatttgctaccttattttgaaacttggaggagaaaatggtgctaatgaaactcagaagaaagcaaccagggatgtcttgatgaaatgccatgtcctgtgtgattctatctcaaactcaggtaaagaaggaagcaatttttggattcaacctttcgtgagcctgtgataatccagagttgacaacacagaacacaagtatggacaggcggcttggtggtaaagaacccacctgtcaatgcaggagaaggaagggacctgggttcaatccctgggtcgggaagacacccggagaaggaaacagcaaggcaacccactcca

SEQ ID NO: 54221 - DNA, 795 bp, Bovine  19866880627859
gcctgacctacttagagttattctctctggctggcagctgcacggagcatccagtcttctgataggctgaggctgttgctaggggggaattagcctgaatttttccacacacagactcagtgactgaatgataaaagctgactggaattaaagagatttggtttagtattatacagatggatcggccccgtttttctttctcaagtgcaaaggaagagtgcaaaatacagatttttgtgtccatcttgttccttgaccctctggttctcccccaccacagaaccgccagagcaaggcagttatgaaatttcggttaatctctttaaagtcgggggtcatggaaatgatgttgcaaatggcaagatatttaagcttaaagaccgctgagaatgactaacagaaggttagattatttttcctcttctgtgcactaaactgttttgaagttgggcatgcatctttcatgcactgtatatttaaactctctcccccttttgggcttgaacaaaacatttatataaattctcttctatccaaacagatagaagcttgcagtctctggcttgtttaaaataagatggtaaggattccagatttggatgggggagaaaaatatatataacatttttttttttttaattacaaagtatttttttctgggatattttgggtttggcttattttttaaaagccagcctggtgtttgttcttgtggataaaacttaactgctcccaccctaccctacttggcttcacaatgtacagaaagatacaggttttttttctccagaagat

SEQ ID NO: 54222 - DNA, 1240 bp, Bovine  19866880644090
tataagtagtatttatatcattaataagacagtacagtactcaaggcaagtagaatatgtatgttgttcctgtttattttaactgaaaattgacttcgaaactgtgcgccatagtgtatttttgaccacttactacatgctgagtcttacttaaaattaatttatcactataattctcagttaaattgcattagttacattgcatatgtatttttttcattttcagaataacgagacaggaagatgtatgtgtacaattcctcttagggagaacactgcctttgggaaaattatttaatccatgctttgtgcagcctgggagttcttgtcttttccctccctggagcctaggagctgtctcacactaagatgtcagaacatgtgctaaactcttctgcataatcagaggagaaaagtgggcagttcttgagggaaatccagagtagaaaagtagggaatcagggtgttgggtgtgacatattatgaaaaaatgtatttgttttagtactgagtgaaaagacacagtggcctagaaagccactgaaaaatattttaaaacttagcaccagttgagtagaagaaaatagtttacatctgttgacagtggttattttaaatggtgggattagatgactattctttttataatttttgtgcatttgtatgttttcataataggcttatattatttttaaatctttcactgtaaaatgctgttaccaagctgcataaaatgtatgtgtgtgtggtgtctatgtaagtgtgttagtatgtatatgtgggtctgggagtttccatgtgtgtgtgtgtgtgtgtgtgactttcttatatttaccaaatacaagttatgtgacactgaaaaaagttatttaacttttctgtatctcagttttctctttcttaaaatggggataatactatttgtttacaatactacaataatactacttctttttaatatctttcacagaaatacatgaagactaaattagttaatgtttgaaaagacagaagatgctcaataaatattagctttcattattgccattattcttgttattgtatgggcagtttatagataggtatgtgtacacagacagacagactccaaataaattgaataaaacattaacatctgttaacactcactgatgggattatacgacattattttcctacttaatataacttttttatttccagaataaacatctattatttccacagttagaaaaaaata

SEQ ID NO: 54223 - DNA, 1472 bp, Bovine  19866880657482
ccctacctttgcttgcacaccccatggaccactggccagtaagtccaggcctcaggatgctcaccagctcttgcaccctgtgtcaaggctaattccattaccgagattagctgcatgtgaataacttatctgtgacaattaaaaaagccacagttggctttttttttctgttgccagcctgccactgtctgcagtcgttagttggcctgtgctgcgggaatataaaatttaaaatcattctaaactaaacttaattagggagagaagtttgttgccaacttgccaccctcatataatacaactaaaaccaaatggaaatgatttttggatgatccaaattagtttcctcttctgccaaataccacggagccccaagattagagagtaacacaaggcctcctaataggtaggttttggaaaggattctctccatcttaggaaagggcattgggaagaatgcccttttaggagcacttaaatatttatttttggatttttgataccagcatattggcttcttatttgttccttcattgttgagtgctcagattttcctctcttgcttttgatttttatcttggcaaatttttataactttgaaaataacagcacccattgcttagcatatgggacaggactcttgtttccctcttgtgtgtggtttcttttgttttgtttttaagaaagcaagtaaaactttttttttcttttctccctgttcttctaggcctcagtgacctaaggattagggggtcttaggtcagattcttttcttctttgcttcacacacaattgtctttcccttatattgggatccttgtgacttgaatggggattctgcgaggagcagcatgtatatgggttgtgtataaactacataagttttaagatgtggcaggaagaatctctatgctttggcctaggtgggggcatgtaagaaataagatgactttgcttacatagcccctaaataatgaggaccgcaattcctcttttccctttgaatctaattggtttcctttggaccggatttagtgatgaaaagggtcaggctacagtcactgtctttgcatgtttttggcatgtagaaaaggaggcttgtcagagccaaaccaaaagaagcttgtagacactgaatttgccctgagcagattattaatttctttttctccttgtacattattaaatctgttggaaagagacatcagctcaagagctgtcactctggctccaggccagcatgccaaattctgtcatcttctgcggcatggccaagcatctttattacatgttacaattctgggattgggctggatccagcagtcctgatacagcatcagatggttaggggtgtggaaaaggaaaagggttatattcatctcctggcgaggttttgcgagaagtgtcagagcagtatgcgtgttgcacttgtttagggcacagatttctttttttttttttttttccttcat

SEQ ID NO: 54224 - DNA, 749 bp, Bovine  19866880658532
gtgttgctactgaagcaatctgaaaaatacagaaatgtgaaccatgataaagaaattggtaccagaaacaaggtgatgacttaacaatatgaggcactggccttggaaccaggtggtaggtggtgaggaaaatattatttgaagctgagaaaaataatgagccgtgttatacagtgatgtgacattgttttaaaatgtcctctgtgacagcatggaagtcagctaatatacttattgaacttgtggctttaggcaaagaggtcaagaagcaaaggttttgctagggagcatgggttgttattatcagccatctttgacaaggttttatgagaagaaagtggcttagtagaattgattgaaagcagataaaatccaggaatgaggatatataaagagaatccagaaacttcagttctagcgggctagaaagatggagctatttttttcaactacaaccagtgaaagaaaatactgaagtatctgagcaaaaaactgtgactagatctcaaggtgaagacccaatcttgagtattgttgtcaccttgggagttaaacactattggcagtttaagattgtccacagaaaaccttttaatttggaaaataaactgctcagattaccgagaatgcgtgtgtgtggctcacccatgaagccagtaaactcaaaatagatctacaaagacgggtatctcaaaaagaactgtgggtacaggtgtatgcacagggagctgtttagaaggtaataaaag

SEQ ID NO: 54225 - DNA, 2049 bp, Bovine  19866880715661
ttttcagacctctgtggatcccatctatttctttttcaccatgctgatctggtgggggcggctctttgagacctaatttgcttaagtagccacacaatacaggtatttctttcctggggtcttaccaccttcccaggacaataggctataagtcatctttcctcttacatcttccaagaactcatatctaggcagcgatttctctgaagttcacagagtttaaacatccttgctactgcccctctttctctgtggagaaacatgtctggtttgaaagtaaaatagcctgtttttccctattgactatagtctcaagactattgcttatttcttgagatatttcatttttccctgaggactagccttttcaaaacaagagttgactccctttattttttttcatcttctgctgggttattctttctcaaaagcaacaaattaaaaaatgctttaacttaataaatggggcaaagatcaaggacgacaagctaatatttcaaatactgtccaactataagtaaaagtatggtttaagttacagtggtcgggttacaggtacatgaaacaccacttcactcattacttccaatgctcttgattttcggaatagtagacagggagtcttcctgggcgtgttactattgcttcctgggctatttatctgatatcagacttactgtgttagtttattaccagctgactattgggccccagcggaatgacagtcatggatattaactagcaagcagaagtctcatgtttccaagttctgattctgtcactaattaatctgaaatgctgcatttagtagttgccttctttatgtctcatttaaaagtatgtaatgaagaatgggttgatttctaagagttatgtttcagttttattaatttttggctgcacttggtcttcagtgctgcatgtgggctttgtctagttgcagtgagtgggggctgccatctaatgtgtgggcttctcattgtgggggtttctcttgtggaggatggtcttcattgcttcatggcaagtggaatcttcctgggccagggatcgaacccatgtgttgtgcgttattggcagatgaattctttaccagtggaccacgaaggaagccctcagttttattctgattcaaatatataccaccttgggggagtctgggatacaaggaaagatgaagggaagacctggagcctgaacatatagggaatgcaggttactggaggatgtcccaggagtttgaatcccaatgcgcggaagagttaggagtttaaatgggatgctgcctggtaaataaacattccctactgagtatttttcttaaagctgtaacaggtccacatggttaactgccactcagttgaaatgtttgactcagtttacatttctgatttaaaagcctgtgctgtagcaactgtccttttgctattgtcagtccatattataaagcgcccacataggttattgaaaaatccatacaaaatctctggtcccagagatttgtgtttataattagatggccctttttattttcacagatcggtttaatagaaattacttaaacattttaaaatgacggccttaaaatgtgggagtgggaaggacgaggacacttgacctccctccgtaaaactgaattgctctttgtgtttgcagttttgacagagggagagagaacatccttatttggtcatggtacccattaagagagcagcatagttattacatttcagcttcctccttcacattcctgccttagggatttgcgaacagagtgctgggagacttctagagttaagaggctgagacaggtagtttggagcaccttttaaggggctctccataatgtgtataggctgagtggtgaagcttaattaacttcaattaaatgcaaaacataccgaacagctcctgtgtgtctggcactgtgctgtgcgctgaagtggcataaaggcaaaataagagtcattgactcctagagatgggaaaaaaatcttagagcagttcttgcccaacacgagtgccttcttttaatttgatcattgtcgg

SEQ ID NO: 54226 - DNA, 788 bp, Bovine  19866880750943
ctccttttaagaatactaaaaagcagttttgtgatatagtaaatgtttaaaaccaaggaaagcctttaaaatgtgagcatttatttttttcattgaaatctaaaataccaaatagatgcaaacacatacacacttaacccaatttcccccccaaggaaaacactaagaaaaatatgtgtagttttacataaaaatgtttgctacaagggaaatctttaagctaaaaaaaaaaggcaagataaaagcaatttattattatgctgcccaacattactatacgagattactacagtgatgaaagatgttgtcataatacatgcagccaagtaagctgaattcaagtattgttgggagttttccatcccttcttctaatgcacagtcctgtcagtctgaagcctcaggggatgtacagaatgtaattaccaaggttcatgataaggaatgaaccaagccaataggcagagaccaattctaaaatgccagccagtcttcaatgtctttcctgaaatgtgtcttctgcacaccactcttcattttacaatgaagaaaacactgctatgtctgtgttctaccttctggtggaattttctatcaggtttaatgttgacatggaaactaatttattgcagggagttgacaggtgtaacgattccagtccagtgaagatcttacacaggtgcctcgaatatgagttttgctgaatacatctcaggcctgcgctggacagtcccaaacctgaattcagcctgggacaggtatggcatgtaagagtagggctcagtgctt

SEQ ID NO: 54227 - DNA, 961 bp, Bovine  19866880849803
tcgaaatctaatacttcagtgattctttatttttccttcttagagaaaccctctgctcttgcttctgatcctttctttggctgaacttctgctgtatcacccgcctattttttaattcaacctatattctatcagacggtattcccagcttccttttatcaccatggtgacaccatacgcttatgcctttattaaaaatttatcttaaatagatcttctaggaactagtcttttaggcagtgacagtttttcagtttcaaatccaccataatgtccagatactgggaatttgtgtgcaaatattattccactattactataaagggaaataaagcaaaatgtttaaaattagatagctactattcctgctggatgcttatgcatggaaaaagacattttatatgcattccattcttactttccaagtgcacttggcacacagtctttttaaagaagaactttatgtaaccttgaattagcttatatgatcatctacatttggtcaatttttaacttttaaacttaatgtcaactttccagaaatatgtcctatgagaaaaatcagaaatgctgatgaagattaacaagcatataaacagcttaaaattacttctatatccagtaatgagagaagaaataataatataataatttatactttgatatagtatgaactggtatggtacagtatcatattattgctatactacaaattgctcaactgtagtaatgactgaataataagcatttcctaagaaagatattgcaaataatttttagtaatgaagaaaggattataatgcagtaattgagaatatactaaatttatttgtgacactgcttttgtctttatagctatgtctatacctctttagttaattaaacatctttagttatatgtctatttataaaattgaaaaaatggcaaatactaataatggctatacctagttgatgagtt

SEQ ID NO: 54228 - DNA, 1461 bp, Bovine  19866880872615
cttttcatgtgcttatttgtctgcatgtcttccttggtgaaatagcttttaagatctttggcccgttttttcttcgtgttgttttcttactgttgagttttaagtgttgtctgtgtatattttaaatactagacctttatcagataaatattttcccccagtctgtgccttgtcctcatgcttgtgacattttcttcgatagaacagaggtttttaactttaatgacatccagcttatcaattggcaccccactccagtactcttgcctggattatcccatggacagaggagcctggtggactgcagtccatggggtcgtgaagagttggacacgactgagcgacttcactttcacttttcactttcaggcattggagaaggaaatggcaacccactccagtgttcttgcctggagaatcccagggatgggggagcctggtgggctgccgtctatggggtcgcacagagtcggacatgactgaagtgacttggcagcagcagcaggttatcagttctttctttcatggattgtgccttttgtgttatatctaaaaagtcattttcatacccaaggtcatctacgttttctcctgtggttaacttctgtggtgagttatatggttttgtgcttgacatttaggtcttccatgatccattttgagttaatttttgtgatgagtgtaaggtctgtgtctgggttaattttttttttttttccatgtggatgccagttccagcaccatttgttgaaaatacagtccttgttgcattgtgtcccttttgttcctttgcaaagaccagcatttgtaggtatttatgtgggtctgtgtctagactccgttccattcatgtgttttctgttctttcactggtatccccctgtcttgattactgcagctctatggtaagtctggacatcatgtagcaatgatctgcttttaataatctgtttatttggattaaaacatttctaactggattatctccataaaaggtagccagatcttgttgccagaagaagttctggtgtgaatagtgtgctttgcagacatggggagataggtctcgttgcgtttaagcagctgtggactatgtcctttgctgtagtctgtataaatagcattggctgccgtactttaaccttgtgccaggacatatattctaaagagctctaattgtattaattccattgtgccacagatttcaaccgattctatctttggtgagtggacttggtcagaagcagccaccgactcaaactaatttagtataaaatcctaacacagagagtcttatgttacagaaccacttgcttcagttcattttgtagtctcgagattgtcctacagaaattcaccctcgaggtccgcagagagttcagcagactgtctggtggctgtctgtccaagttccttgaggcaaagaaaggagacaacggatcctgttcttcgacagcttta

SEQ ID NO: 54229 - DNA, 1646 bp, Bovine  19866880938365
aactaaaacgggtttcctcgaagatgggaagagggtatacaaatagacatatgaatctgccatttcacattccagttgatcctttagtgtccttgacaaatggggcttgttctaatgcatttatacaatacttaccatggaaatataaataaagaatgcagttctagcttactcagagtatatgcgatttaaaaacagttttaatttttaacactgatgtgttgttgtgttgttcagttggtaagtcatgtctcactgtttgtgaccccctgatcggcagcacagctggcttccctgtccttcactatctcccacactgttttaagaattaccacaccgtgacaaagagaaataaggtgagcaaatgctgctggaaagatggttccaatagacttgcttggagaggtctgccacaaaccttcaatttgtaaaaaatgaaatatctgcaaagtacaaaatgaagcacaataaaatgagatatgcttgcatcttccatattgaactggattaaactttttcaaatggtaagaatgtttagagatttgttaaaaatctcttaaacatagcatcaagggttgagatcaggaaatatggcggaatgaggtggataagacagcagtgagatgtgttccatgcatgtcggtgtcaggtggtcaatttgttgtcaccaaactcctcctaaatcttaaatttgtgttacctgtcatcatttatttgagtggtctggaaagaaggagaagtaatatagtattaagtgtcttaatcatactgggtaatgttaatcacatttcatgtattttattctaatacatataattctaatagtcttatgggggtagaaatgtggagacatggagaaagaagatacttggtcttctttgtgtataaaagtaaaatactcttttttgcaaagctcatttgtggcactagagaggtcgtttcctacctgtaggtttgtgatggattgaaggcagaattctaataactttttcagcacgtgttgacacctgtagtcttttctttcccaaggtgtgtggggggtgggctctagttttgtgcagaattgctatgaagatgccctctgtcataataggtgccagatgcacagctagtgctcagtaactaatggataatgatagggtatattcacaccttggaaatgaggtggtgaattttttgaattttctgatagagttcagcacaatgagaatccccacggaggtacatggggtgagaatctgtcccagggatagcaggtgatgacaggggactctgtttcaatatgttttggacggaaaatcacagctttggtctgccgaagctggtgagttgtcatcacttaaacaccagtggtgttacagacttgtgggatatgtcattctaaaaggatttagaaagccagagagtgactcttatcccacatgacactggcatcccctggcattgaaaattaaatgtatgaagtgagaacttctccaaaaacagtaacacaaacgtaactatgagggcagtaagaaagtggtgctgttttccaagttgaggctagaaagaaagaggtttgatctcatttatagaaattcaaattactatacaaagtatagacagaccatgtttgggatgaacttaatcctatttaaatttttaaa

SEQ ID NO: 54230 - DNA, 1841 bp, Bovine  19866880959322
gctgctccctccactgagtgacttgagagagccgaacagctttcccgttttgactctgcatctcaatctgagacatctgtcatcactaaaaggacttttccctcttctgccaaaagagaagagaggaaaatggagatggcacattagcttttaaatgcttcagctcagaggtgacactcatatttccactcatcatgtcatcagataaaaccagtcatatgccccactgcctgtaccaagtgtaaggtaacacatggaatatttagtgagcacttctggctgccacaaggtaaatattttatttctcatgattgtcaaggagacaacacttgagagagatgatgatgaaccatgtgctgacctcgtcaaaaaatgaaagaactgactcataaggcagtcaatgactgaaggtcatttagaggtcagtgactgaaaccagagaatgggcagtagagatggctggcgtgaaaggccaaggatctgagggctcctatgctagaaatgaccttccctctatactacactctgcctgaaatttgtgtacatgatgtcaaatacctggataaggaattaaatattcaatcacctagatctttcctaaggttgtaaatttcaagctattcaggaatggactgttgatggatctgattaatacagagctaaccatatttcctatgtgaattctcaggttttaaagaatgaaaatgtgggaacgataaaattctactgaacataatttatcctttccttgatgatttagaaggcacctttagctcctgtagtaacttagggacatgcctgtgaacatcaattataattgaactgcggatgtgcgaggctataactcacgtgagctctctgcatgctgggagcacaagcagggcagcaggaagactgatgacagcaggggatggaagggcctagagctggggaaactaaccaggaggcatgacttgcccccaggggtaaaaccagcagttgaaataataaagttcaaggagatgaaggactctgagtttcaatcaaggctgatacatacatccaggatgtactgcccagatgctgggaacataagaccacaaagtctctgtacgagcaaagcaggcagatcgtatgtctccaatctagtaggttaattgggtagaagcagatgtggagtctccaactctcgggatttccaagacatggtccatcaagctgaggctttcaaagataagccactaatcactgtaaggtccagagcagagctctggttccagcaggaaattgaaaggcaaaccaggaaaccagaaagtgaggcagaggctgaagaagtggggaggagggcctcaacttagtgagcatcacagatatgaggcttaagtgagcatgttgattttagaacacagtcgcctggggataagaggaggctcctattcggctatattctttaaaaggtcacatgaagacataaagggaatttaaatgcatattactaagtggaagaaatcaatctgaaatggctaaatactatacgattccaactcagtgagattctggaaaaggcagaactatggagacagtacgaagattagtaattgcttgggtttgagagggtggaaagcgatttacagaccagtgaaaataccctacatgataccataataaggtatatgttccataatacactggtccaaacctataaaatgcacactatcaagagtgaaccctaatgtaaactgtgaactttgagtgataatgatgtacaggttcaccaagtgtgggggacgttaataacagaggacgctgggcatatgtgggggcagggggtatatggagaatctctgtgtcttccaagtttt

SEQ ID NO: 54231 - DNA, 1600 bp, Bovine  19866880989661
cctgagcttcccatagtccaatcttaggaagcagctttgttcatgttataagttttgaccactttccttttatgtcttttgagttgtatgccacacatagaaatgttttcccttttccaggattcgatttttagaaataatgcaggttttcttctagtacttttatggtttactttttttaatgtcagtacttggcacctgtgctccaattgagctgtggagaaatcctatcacagctagctaatttgctgaaaatagcttgaagacttttaccatatattaaatctggaaacaagaatttgcagactacagagataataattaggttttagagcaagaataggctgtgaagatcatctagtcagatgttctcattttcaaggtggggaaagggaaatgaatgtaaagaattccagcatagtaaaatattttacctagggtcctgcagggtcaggtgccaacaggaagatctctttccatgctcatgaggttgcttcttactgcattcattcctccactttgccagcatttaatgagcaaatcatgatctgggcatcacatgattttagttggccacatttattgatcatcttgttcaatttaagaggataaaatgtactccaggtttttaaagctttttggaggggaggcttgggaacctagtacatctcaagtgtcaaactgcacatatttcacttcttgctcagattcagaatattgttaccggttattatgaagtctaggtttagttataaaaatacctgttaatgtgaaacaaatctgattttatttagcacttgtaagaaggtcgagaagaggagaggaaagagttgctgctgctgctgctaagtcacttcagtcgtgtccgactctatgcgaccccatagatggcagcccaccaggctcccctctccctgggattctgcaggcaagaacactggagtgggttgccattgccttctccaatgcatgaaagtgaaaagtgaaagtgaagtcactcagtcgtgtccaaaacttaggaaccccatggactgcagcctaccaggctctgcctccatgggattttccaggcaagagtactggggttgtttgccattgccttctccgagtaaagagtcgagaatccattaactgccttcagcaatataacagtatcctaaataagcagaatgttgctcccctgtgtcattctgtagtcttactggaccaccaagtcagccaaaggatgctttcagaggggactgagatttagtgagatggaaattgcagaactcagttttctattacacagacattctctagtctcatcaattaatatggtgcattttcaagaaacccatgaaaagactagatctgtttctttgggggaatacacttgctttgtagagactgaggattcatggagccatttctctgaaatattgtccttgggacccagtatttaaactcacaaacctgcatgcagataattcttaataatggttattgttttaaagaaaccatattgaccaccagacaccacagtgctccttcccctcccccacaaataaatacctttacctttctcactccctagtagcatctcaggctgtttaaaaaa

SEQ ID NO: 54232 - DNA, 2088 bp, Bovine  19866880992123
tacgtttctttagacataacgctattgcacacttaacaaactagagtatagtaaacataactttatatacaccaggaaaccaaaaaactcgtgtgactggctttctggcaatactcactttatggcagtggtcaggacccaaaactgcagcatctccaagagctgcctatagataaacaagatttactttcatgtagatgctctgagaaaaacacaaatggagattagagataaaggctgactgagatgaggaatcagtttcaaaagtcttcagggatggcccttctacagaggtcacgtttgcacatgcaactgaaagatcaaacagaaggagtcaaatgaagatctgagagaggagccatccagacagagggactgtgaggaggccagaacaaggctgacacagtcaaggacccacaagggcctggtatggttagagtacagagtgaggaacagtaggaaacggcacagaaaaggcagatgggaatcagatcatgtcaggcttttaaaaccatgatgagtggcttgggtttttttttttaattaattaatttattctaattggagaatgattacttcacaacattgtgatggtttttgccatacatcaacatgaattagccacatgtacacatgtgtttttgttttaactgaagtgaaaacacatttgtagggctttaagcaagacaaacgcaatgcgtacactttgagaagatcactctggtgtgcaatatagaagcctgcttccatactgagaaaatttggaaatgaaatacctttgaatcatcaacagactgactttccaatgaacaaaacattctctaaaatgctttataacagcacccagctcagtgctctctcctctacatttttcaggctgtttatttctaggaattttatgattgatagcattaccttcacattcatagaaatctaaggaagatcagaaataaaggacagtcttatcccaaggttgtctaaagagaaactgagttataaagaaatagcatataggacgtccctgctggtccagtggttgagaccccatgcttccactacaggggacacaggtttgatccctgtttggggaactaagataccaaaggctgcgcaggccagccaaaagtttttcaaaaaaagaaatagtatatgactcaacatcatcactacacaatatgaaaaatccctcaggttgccagaatttgtaaccacgtttatggcttgccttcctcacagttctgcatatctctaactaagtgagtgaaaagacgttttaggtatgatttctaggttttgtgaagattatcatccctaaactcagagatcgtttcctctgttaactctgatccctaaaaataaggttgtcaaaaaaaaaaaaaaaaataaggttgtcagctcactaattacagctcactaatctttgttctcaattcatctgaaaataggaaatgtttcttatcatctttgtgagacatgaagtcacaaatatcttagtttcccctataaaacaaatgttcgaagcatgttagaacatcatctcccagttggctatcacttgaggtcactctcaggtgaaataccagtgactagaaatgggtcaaggataagtccaatttcattcacatctgaaagctttcatctgatagaacagccagtgctcctctcattgccaaacagatccctccaaagaaagttattagtcaaaagggcaaactagaatcccagtggtgatacttcttgtgccatgagtactagattaagtgaggtaaataatagatggtctgttcactggggagttgattccagcccttctcaagatgcagatggaaattttaacccactcacatccgatctcagtctggagccatctttcttttcctccaaagaatagagactgaatttcaggctagttaaatcatttcccagctatcctgttgtaacctgataaggtaggggttcccagaagaaagagacccaggaatggctttcttgagagaggagaaaccgtttttggcctaagtcattttgtgatctaaacctggccacaatgcttgcccttaaacaggtctcagtaattaatgatctaag

SEQ ID NO: 54233 - DNA, 696 bp, Bovine  19866880992366
gttttgtttccctccagctgctgcttttcttccctcacattctgggactagccctagtctgaggctgagctggatctgggctaaacataatggagaaccggtggaaataaaagtcctttcatgggggcacagccctgtttttcagatggtgtgaagcagatctgtagtttattattaataatagcacatgcgtgacaccacatcttcaaaggacggctcgaacattaattcttttgtgatgtgaaaagagcagcagtagcgtctctttcaaatgaatctcctactcttctggagaggggcgagaaaacctagtttcggctagagatgaatggatcgccaccctggaggtctgggatctgggtccaattgaggagcactttgaaaaaaaatcaggagttttatctgaactatatagcatgttccaaattctacaccctttcaaactcacatggaagtctttcgaagagaagctggggtatcttttgttccaggaataaaacaaactgaataaaagagagaagaataaacgtgtgttttctacacggatgaaatttgatctgaggtccccaggaagaaagagagaattattctcaccactttagcaaagcacacccttcagtttctattaataaatgatttttttttttttttggtcaaagtcaccatcttcttttaaaaagtgacagtattccattt

SEQ ID NO: 54234 - DNA, 1958 bp, Bovine  19866881035551
gtcagagtgggggctggcgtgaaaccacagatgaacttgagaacaaaaatttaacttagccttgagtctgaataaccaaaaggttaccccagatggtgagatctgcctgagacactattaaaaatgggaaagaggtttaaataataaccattggtggctcttatgtgagcaaagccatttcctgttaattgcccagtgagatggtaacactcaataaatccagttttgtaaactttccctctctatgttgttatgatatcaaatactcactggaatatccaaatccatcctaggagtgttggtgtgaagtgattagcttccaggagtttcattgttaagcttgtagccctgcttcatactctgtatggtgtgcagtatatatgatgactcttggtcaagatgtttacttaagtgaattatttgtgatcattcagtggtctctttgtgattagaaatgtcttcatttcaagaatttggggttctgttgtcaatagcatgtaggggcagacccttgagacatacggcggatagatactagacaaaatcacagagaaatatacagaattattgcattggaggcgcctctgtgctccttatttgcttaagaagactgtaagcattatatgatagcatgtcaacatagctcataaaggaagaagtggatacaacaagcccttcttaatgttccccagaaagtcagtgagtgaactgagaagtggatccaggatttcatgtatcagcaccataggtcttatcatttatataatcctttttttccccccgttactgtcaagattttagagagggattatgggttgagttagagagcaggcaattgaggcatactacacaaagttgttaaatctcagaggcttgagatttcttggctccttttaagttttggaagcacagcactcctagagaatctattaggaactggcttcatggagaaaatgtagctcttggacagttcgcttttgaagctgagggagaggataataggttgctgaacgtgaagaggggatttgcttctggtttaggaaacagagggtgcgaaggggtgatggtcctgggcggactcaggctgtaatagtgcttcaggagggccgagtgctgctccacatcaacttcaattttccattgaggtcattttctgagttgcgacaaagcctggggaccctcttatggggtgtctatctctttgtgccctgattgctagggctgccaactgcccatttccttcgagtctgaagggaattaattccaatcagattgtgcagatttaaggcttgggaagaaggaaaaaaaataatctgcaggtcttgtgtctagggtagaggttcctaacctccaggatctaatacctgatgaggtgaagtgcagctgatgtaataataatagaaataaagtgcacagtaagagtgatgtgcttgaatcatccctgaaccaccgcccctgccgccccacgcaccagtccatggaaaaattgttttccacccaagtggtccttggtgctgtaaaggttggagactgctgatctggtggatacgtgggaatgagttacacaaagatgcgaacgactcaggtgtgaggggagagaggaaagaaagagccccccacctgtgctctcctgagtgggaagtttcctctaggctttggcagaatgagacatgtgcgagagtggagggaagaccggggcattctcctggggagggcgttcccgaactgtcttcacccagcagatgaaaggattccatggaagagttccccctcagtggccccaccccaggctctgtgctgactgctttttactgcttcacaggcattgagtcaccttgttaagtgtcatccctagtgtggagatggagttattccttgcccccaagctactgggaacctattcaggaaagacacaggtccctgcaccacaaacgcagaggcttgctgtcgctcaattt

SEQ ID NO: 54235 - DNA, 1450 bp, Bovine  19866881041039
ggaaaggctacccactccagtgttctggcctggagaattccaaaggggccacaaagagtcggacacgactgagcgactttcacttttcagcagggaagcccagtccatactaatttcataccctgacacccattctagggaagagatgttctatttcctaacttttcaaagggccaactgagtttgctttcctgcttgtttttctaagtgggcctgatttcttctcaaagcccttttcaccagaacaacccacccagtgtggctgcccagaggcatgttagcttcaggtgtcggtgccgcggcttttcctgttcagcctctggggctgctcgtttcctcccctgcaccctgggtcccaggtagtgcgcgctcatttagctttactgcctgttagaggcaggggcaggtgggaattaccacacgtttttttgcctctggttctttcttctactggagagcaggtattaaagaggagggggggcaagcagagagccgtgccgacaggagggagggagtggaggccaagcagggttgtgggggtctggcgggtggttggttgcctgttaatgtagcccggatgttaagaaacaactaggagaaggtaaataaaagcagacttcctctgggtccctacaaaacccctttcctgcttaccgctgccttaggccgtaggtctgctttcctgcctgggttctataaattactagcagttatcacctcaggtatagatggaatgaaaaacaagtttctgtagtaggtctgtctggaaacctaatgactgtttgatgttgtttctatgagaaagctatattctgagttcccaataaattaccaacattccttaggaatatgaaccacgtgcacgttagtaaacgtatcttttgtttctgagtctcttcaagtttgtacttcattttagaatcgagagttgtgatggatctgaaggtaacaggagggccgagagcatattcttccccagcattaaatctcttttgctacttcctcgtactgcttaggtctcccatgttttcctttcggtgactatctttcagaggatcatgttttggtcttgggataattctgctttcagcatacaacatatagctggggacttgcgtgaaactacccagagctgtctcatttagaatattttttccccttggctgacttcactaaattttgttaatgcaaggggagctagcttcatggctgcagatctggtatcgattatcattaattcttccctttatgactttgccacttaaatacacatttagaaacaaaccaaataaacataaaatagcataactaaaattttgacttgggtggtccagttagtttcaacatgtgcttagctttgaaaggtggttataaaaacactagagtttaaccaaaccattaaatgatggcaataggtttttttttctttttaagtttattttacaaggta

SEQ ID NO: 54236 - DNA, 1065 bp, Bovine  19866881115408
tgtaccttcttagtttgttttgaggcatttttttccccaacattggttaaatagctatcattttaacatttgcattcctcccacctccccccacccaagggaggatagtactattgtaattatactacattcttctgaggttctataatgagctattattttgctaatggaatattcaagtagtctgtagtaatttatcaaatagtcccaagtcccattttctcagtgtgaatctttttgttcacaggtaaattgatgtgtggggggttatcaaggcttttttgtaattcaaattatccattccacctctcttcacacacacacacacagacacacaatatatacaatcttagaagagtttttagaaatgtttagaattaaaattgtacagactttttgcaagtagaaatttctgcattttaattttcttttttatttttgcattttgatccctaattttgaaaatgcacctaaaataaaggaggaagggaaaatgtaattcagtttttttcatgctacaggctgttcttttgtcagcttgaaccactagcaggagagcactgttctaaattagacactaagaaacaggaaaccatctcagcccaagctcttctattttcctccacttttaaaagacatgaatttaaactggtgtggttcttattgaaatggacacccccttttggcacagaaatgttaaaggtatattattatatctttaattaaaagtgttgcgcatatattaatgaagagctcctgagcagaaaactatgcaaaaaaaaaaaaaaaaaaaaacacattgggagacttgtttaaaactatttaaacaaacaacaaacaaatgcaaattacctatacaattaactaagccactaactgtaaggttccaattcctgtcatgatggtaaaatgcttgttctgctggctgtttcctcaaatcaaccttaaagtttattttgtaatattgtcctgacaggaaaacatctttgagaagctaactaacagaaggccctgaggatgaaggatgtctagaatcgctgctgtgtgataggacagggagttgca

SEQ ID NO: 54237 - DNA, 1764 bp, Bovine  19866881148278
gcaaggatgctggagtgggcagccattcccttctccaggagaccatcccgacccagggatcgaacccaggtctcccgcgttacagacagattccatactatttaagccaccagggaaaccggacataagtaataggcagtatcaaatcagaggactttttggatggcaaagggtcttgaaaccaggccccataggaatagctgaagggcagcagcaaaacgagctgggagctgagattaaggacaaacgtaatagcggttttcaaatatcagaaaagttttgttacagaagagttgatttgttatagatcaactgggggtgcagaattgggcaaggtggatggaggaaccagtgaacagagaagaaatcagctcaaagaggagttttctcacaattaaaaggtctgacagggcactgtttcagagcagtgactccctcagcccttaaagtgtgaaggaaaagttagatgtctgtatggccagctgtgtggaaggagagggtggcagggtcagactaaatgggctccaaggtgcttctccattctgatagcttgatcactggggggtatatttcggaaacccaggtaagtttcaagtatgggtgcagagaactgtaggggtgaacaaacacgtcaggggaagcagggggagacctggaaagttctctctcgtgtgtggtgaggagtggcaaaagcatcagattgaaggttgagaactttacacattctaataggcaatagggaatgtcttacttcctgttctggggcaggatatgataaaaccagtgtttgaaagctttgctctaatctgtgttcaaaggatatagaggagagacagagagagaccaagagagagagaccgagagagagagattcagagagagagattcattccaggcaggggtactacttaggaacttcctggttatcagaaaagttcatcttacctttattatggtgggtggcaatggaaacaaagaaaagggggccaaaatcagaatttaatggaagggctaacatgggtctccttgaaaatggcttggaaattggattcttcaaattatgacttgaaagatatatgactgattttttaggtcagccaaccacaattgggtatttatatttcatctaccattcccactgaccagtgacttgaggcaactcataaaaattcctgttattcttattccttggtagtatcaccccaataagaaagagtgtttatagagtagtccgagtcctagatgtaaggtgtcatgttctattcatatcgtgccatactaattcttattattggggttactgttctcagttatgacaatgatataattttatatttcttatcttagggatatttttgtcttccggcagtattctgaaagtgagccttcctgtaggatgttctttgaaagactggcaaatctttcatatttgtttgaatgttggtccatcaggagaaagtgaaacatatgtaatattcaagatgatcacacatattccctcctttatttaatatctctaatatctaattggaaatcctctggtctcatctatttacatgaagctataatgattcagatgggtgctttcctggggtactgattttttttttttcctgtgggattctctgaacagggctttcctgaaaagaatacattaagactgtcagaatgattcttttcagcaggctaagctttgcagatgtcctttgttgagggaaaaacgcattattctgaaagtccttctgatcttcaggaaaactgaaa

SEQ ID NO: 54238 - DNA, 1685 bp, Bovine  19866881159381
acaaacctgggccccctgcattgggaacgcggaatattagccgctggaccaccagggaagtccccatgctgtattattttcttctctcattatttatttagttggctttgcatttgctggtaagtttagccctcatcgatagggctggagagagatcccttgatccagagcacaggcaggaactctgataacagtacttcctgccctagaagaggaaccactgcgaccccgttgcagccaggctcacagttggcctcctaaccggctgccagtagcctccacggagcagaccctcgtcttgaaggaagtgagctggagccatcatcctacttaaactagggcagagagcccaccatttgtcttccctttcagagccagcaatttttccctgtaataaatgacttcattttgccgctggagttacagaggttaaatttacagctaagtgcaatcctttactcgttacagcgccttccagagaatttgctcatttattagcaaaaataccacttggagtcagcaataaaggtgcggatgtgctcatagaaaattactaagagtccgatgtggaaaaagtataaattatgacaccaaaagtacttccacttttttcctcctaaatttaaaataaagtcctaagacatttaaggggttttggtgtctccaggcccagtttcttcccaagaattaatgcttgattttctaatcttcttgtaggagacctgcctatccacactaaccttatcctctgtggctttgagcttcacgaatcccatccctgtacccccagcctaggttgttcttccttgaccaaacatgtgtaagtccagctgctcactggaggttttcaccctcaagtcccacatatgcctctcatttgacatagcttaagctaattttaccaattatttctcaaaaatcagaaactcttccccacaatccttcttactagcattactattgtttaactaatcataatggataattagatgtcaacatagctaaacgttgcccagataactggcaaaccataccaaagtatgtctgttagggtgtttctggaggagatgggcatttgaatggatacatcagtaaaaacataaagatcaccttcacccatgggggtgggcatcatcccatcccctgagggcctgagtggaacgagggggcgcaggaagggtgaatttgctctctctaaagcagagacttcatattctcttgcccccagccatcagcactactggttctcagaactttggatttagactgaattacatggtgggctttctcggttctttagcttggagtctgcagatggcaggacttctcagttgactcacaagactatactctgtaaatactcagggctctccagagaaacagccaataggatatacacatatacacacgtaaagagaacaaaaacacgggggttcctctgtgctttacccctctcccctcagtcctcaattaaatgcctaaatgcccaaaaacaatggttgattttgtttccttgtcatctccaacatccttcccctcctgcctcatagtgaaaagtgaaagtgttagtcactcagttgggtccgactctttgcgaccccatggcctgtagcctaccaggctcctctgtctatggaattctccaggcaagaatactggagtgggtgccattctcttttccaggg

SEQ ID NO: 54239 - DNA, 1366 bp, Bovine  19866881193977
agggggcaaaaatagtaactttccgagctgccatttgcacccttaaatccagttaattatctccatgtattttgcatctcaaattagagtaagaataccacacaagggtgatccatcacaaataaagaactccaaacccagcagaacctggggtctatttgattgttgctgctcagtcgctcagttgtgtctgactctttgggaccccatgggctgcaggatgccaggcttccctgtccttctgttatctcccagagtttgctcaaactcatgtccattgagtcaatgaagccatctaaccatctcatcctctgtcaccagtttctcagccttcaacggagttcctggagaattccatggccagaggacactggtgggctacagtccatggcgtcccaaagactcggacacgactcagcacgcacaagccttatcaataaaatccactgcacaaaagctgccaacaaggtaagcgataccatgaagttagcaaggcaaagccatactcctagagaagttctaaccggggaaatccacaagggaatcctcatcaccagtgggcaatcctcctcacccacggtctcagaagatatcaaacaagtatttttaaaatggaactaagtccagctgaaaactatggcctagattttcaaaactatatggagtcagaattaccaccactccaagggttccaatccggttccgcttagggctgcgcgcctttgcacgtgcgccgctggctccacccccgcagtccccgcctccgagaggaaatggctccagacaagcagggtcatgaggagagcatcccgaggctgcagcagcaagaaccaccctggggtggtgatgccgtcgtccctcgaggcgcccagttctcagaccacaggagttgccatttacgacgtgtggcagaaacaggctgggagggccagaggaacgtgatgagttaattcagcggcggcagtaaaattcgcatcggcacccgcatgatgtagtcctgtgactccggcaaatctcgagataatgagggaagcagtgtggcgtgcaggaaaggcagtgggctgaatccgaagacctagatttttgtgccgactctgccggctgatctcaagggaaggggcaaatcgcgccctctctgggactcaatttcctcatctgtaaaataaagagcagatgtgctcttctaactcagaattctaacccacaaggaaactgatttggaaacacacgtcctcccgtgtctggcgtcctcctgcgtctagcgcaaggagcctccgggacattttggccagcacattcacgggcttgggataagactgaagacagtggtatgagaaaggcacctgctgaagcactcttatgaccc

SEQ ID NO: 54240 - DNA, 1302 bp, Bovine  19866881195397
tctgtatatttccatttggcctataaaactcgattgactggtttccaactatgtgactttgagtaagtcacttaactgcttgagctttagtctcatttgtgacaggaaatatgtgctagttggttcccaggcgctctcacttctgaaatgttaggactctgcaattctgtgaatttaaaagttgacattaaaaagaatcatatgaagcagaaggtatactattgactccactgtagaagggaagagatggcaagttgtggactaatcaataaaggtctaaaaatagcatataatcctgagccttctttaaaaagtcagtcttatttattgccctgtttattgaactatgcatatggttgagaaaatagatgggacatctggaaaaagtattaaaacatatttgtaggcaaggactatgcctcagcaccttaaatatgttgtgttacaacagtgtatgctgatgttgtcattaaatgcaatgctagccacgtgagtcagccccatttagaatcattttggatttggccaaatggtattttggtggtttctggattgtgggttagaaatcagaactcctggagtgagtctcttgtttctacacacatataacaccccaggacagagagaagtccttttccttttaattttccacatctttttgtggttgtctttgctttccctcctgtgatccatttctggcatgacagtaagagtttctttggggtaattagtagtcctaagttatttccattaaggattcttggggattagatgtaaaagcattgtagaaagactggttatatagagaagaaacatagcaactttttttttttttttttaaaggtattctcaagatcagacatgggttgttgttgcaatctggttccagcaagcacagcaagcctggggcaagccattttgatatgtcacggaggcagcctttgggcaaacgctgatgacacatgaaggaaggctgttcacagtgtttcatttaggttcctttgatcactcttaactggtttttaatattacaccaacatcatatcagaaaccaaagcatttcttagtcctctcactctggaaatcgtttcccccacttttctgaacctagaatgaaagatggatgtttggttggtatctcgtgtatgccactctttcttaaacactacagtggtaaagacttacaagtgttccttttcatttgttttgaagtgatgagagagggcagagatggtatcttgttagtgtcccagggccccagtcaaggcttggagtagagtggggacttcctgtaattggctt

SEQ ID NO: 54241 - DNA, 1037 bp, Bovine  19866881272151
ggaacagaagtgagtgcattggttcctaaagtcttagaaatacagcagggttcaggtcagttgctcagttgtgtctgactctctgcaacgccatgcactacagcagaccaggcttccctgtgtttcctcaaaacataaagactgtaagtatatattttctgcacagcatcacatcagtacttccttccaaggatttcatagttatctattcttcccatgatctcccaaaagaaaaccaaagctcccctacttttaatttccaacaattaccaacacagagaatcgggagatagcaggatgcaactgttcatactccatttgctggcccgtatctgaatgggctttaagtgattaacatttcgctaaaagggtctttctatgtgtatgttttgcctaaaataaaccttggggcttccttaattgtttaattatgagtttctttaggttctagtaaaaattagtgattgctcagtatcactccaactactactgtgtttctgctgaaaaaaatgtgaaaagcaaaatttcacaggatattttcacaataaggaaatgtaaagagattcccttagtaaaaacacaaaaacaagttttattctgccttgcattctgaaaatacagtatgttaaatggaccagtgatcactcttgcaaaacaattttggcattcctcatttttcacaactagaaacctaaaccaaagagcctctgtggcacgaactttgattgttatggtcctggaaaagaaaaacagatgaagaaaaggcatctctgtaacagaacaagggaaaaacacataaacccataatagctgaagaaggaaaaatacagcaaacccaggagcatccagcccatatctacagaccatcttttgttaagactgctgtctacctctgctaacgagaggggtagacagagtctaatgtcagagactcaaacacatttgaaaagaaaacgggggcagaaaagatcacttctataaggcaccagccaaatgccgatttttatgtagggtttctttcaaaatactcaatcaca

SEQ ID NO: 54242 - DNA, 1464 bp, Bovine  19866881274862
atgatttttagtgatgaatcctataacaagctccttgagttttacagctttttaatgcatgcttgagtgtaaagggtcttgtcttaaaaaataaaaagaccatgtaaaatatcatgtaggaaacgagttgccagtccaggtttgatgcacgatgctggatgcttggggctggtgcactgggacggcccagagggatggtatggggagggaggagggaggagggtttgggatggggaacaccatgtatacctgtggcggattcattttgatatttggcaaaactaatacaattatgtaaagtttaaaaataaaataaaattagaaaaaaaagaccatatctaagaaggcaatttgttaaagtttcttgttttcatttattagaaaagcaaaagaaaatccatccctacatttgagagaatgaagttccgattaaaatttgtcaaaaatagcagaagctatcattacacagaagaccattaaaagcttactttagaattatagcaaattattctgggtcaagttattagaatcaatgaattagataattattcattgagctggttatgctaacaaaaagaatgaattctcattctttatgaaagccagccatgtactgtcagccaactttcatggtgttattataccagacaatataagtgctgtgcaccttcctacccaaatagcatgaggtttactgaaatatctagagatcattatacttctgtcttagtcctgctggggtgctaaaataaaatatcacagacttattaacaatggaaatggatttccacaacagcatcaggcagggcccccttgcagtcacacacttcttactgtagcctcacgtcgggatacggctacagagctctttgtgtctcttacatttgtaagtaggattgatttcctttaggatggacttgttggatctccttgcagtccaaggggctctcaagagtcttctccaacaccacagttcaaagcatcagttcttcagtgctaagccttctttatggtccaactctcacatccatatatgactactggaaaaaccatagctttgactagatagaactttgttggcaaagtactgtctctgctttatagtatactgtctaggttgatcatagtatttcttccaaggagcaagtgtttttaaattcatggtggtgtggcggattcatttttatatttggcaaaactaatacaattatgtaaagtttaaaaataaaataaaattaaaaaaataaaaataaaaaataaattcatggtggcagtcaccatctgcagtgattttggagcccagaaaaatagtctctcattgtttttccattgtgtccccatctatttgccatgaagtgatgggaccagatgccatgatcttagttttctgaatggttgagttttaatctagttttttcactctcctctttcactttcatcaagaggctctttagttgctctttg

SEQ ID NO: 54243 - DNA, 572 bp, Bovine  19866881303634
tcacatgttccgtgcctgcaaatgaacatgaaaataccatcccagccacgaagcagacaagtccaaacacagtgacagcagcccctgggttcaaatagatctgcgctgcaccccatctacaaaccggcaaaatttccagaaaggtagatcacaaaagcaaaaagtacctgcaggaaccactcatcccctaacctttcttgtccctctttccccttcaactttgatgatttggcagttctggaacccttccgagagaagtcaagactcactctgccagccccagctgttcaaagctcagctcaatctgttccatacagttggctgtattatcacaataatgtggctacagttcaccttcatttgctgcaaagatcattaactatccctcagagagatccagtattcaagacagagcgtgcccgaggcataataaacggaggtctctgggtaacacagttcaaaagaaggtaagacgatgccagccaggccacctgacagttcctgcagtcagagaaaagggaagaaaacaagggcaggaaggatgaagagaaaaaggaaatgcaagaacgtgc

SEQ ID NO: 54244 - DNA, 1455 bp, Bovine  19866881317520
tattaaaagttcactgataagggttcagattcctatgggaagtaccaattgttgagttttggtgtagtataagggaaagaataatccaagattattagaaaaggctattgttatttctccacattcctgctatatttacatattctaaccagaaggtcagtctcaacagattgaatgcagcacataggagacttcagctctcttctgttaatgcagggatgaaaaatttcacaacactgtaaaacaatggcactacattttgaagggaaaatctaattattgcttttaaaagtctctcacgtatgtaaatatgtttttaggttatttttaatgaattaataaatattaaagacttgttctaatttgcaacatggtaagtgtttttctctgtaatttttaataaaagagtctggatattaactgacttaagaactggtctaaaggaatgtataagtaaattcacctccaggaagttcaagtgtggggttacattccttgagatccaagatctgttcctacttctcagtttgaagtggtttcaggaagtttaggtagtctccttcacagttaggggccccccatcctgggtggagtgacaaaggatgaagacaaatagcctgaatggtaatttagtcaatagagtccatctttaatctccaggctcctgtgtccaaagtcatgaaatcctccaggaccatggaagagtttcaaactattgctgcggaagacgaagcgttgtacaagggctgcatgacatgtattcttggagatacagcttgcaactccgcatgcgtaaaagggaatcacagctgcttatctgaaacgtcttcatcatccatttggaaatgaaggattccgcctgctctacttccatcaccacaggaagccacacccagctgacttctcagtccagacttgttctcaaggtcacctatgtaattttttttttccccctgaagcctcagtgttcttcgtcttctcggagataatagccctaagcccttcagtcatcatttccttgtcctcaattttcttcctggcttcctgcaattttaatcccaagcccctgcaattccttgccttggaggtttaagtggccccatttacaaccgattttcagctaatatttgatgcattcttttcaaataaaccaaactgtcctcctctgcaggcttggtgcttttgcacctaataaaatcagagggttgatagtgggcttttaaactgatgtggtttctcttctgtgacttttacagaaaaatagatctttcaaagtaggaaatagacctgttcctgatgggttaatttcagaatctcgtgctgtcattaatcaagggaaagaaatcgctctttcatctgccctttgctccagttcttacaaaggagagggaatgagagtggggtagatgagtaaagaaatcatagactctttttctgggggctctttccttctaa

SEQ ID NO: 54245 - DNA, 793 bp, Bovine  19866881318577
ctgcatggttttgtgagctaaatttttaggaatgaggggggaaacacacaaaataattcgacatgctccacaatattccaaataagaactaaagtgaaaaatttctgaccaactctagcaattaaagaatatttaatccactataattttcaataggatctaggggaaaaagtcactggtatatgatttcattatcatcacaaatcaaagaacatagtaccatggtttgaaatagcagggtttttttttttcaaatagaaagttataatagctactgaataaataatcagtatttggaaaaatattttaactaatcttttcccctcctttctcaaaagctaaattgtttgctatttctgagactaataccattgtacttgttggataatttacagtaaacacacatcctcttaatcacatcacagaaacttaaatagatttgtaaaaccattaaaaaatcaatacttagcttttaggtgatgaattaattaatggagtgtgaatgcttgaagtctgcattacccagcatgcactatggcctttcataatatcactgtcaatgggaacagtatgcaaagtaatataatgtaactagtggggaagtgctgataaaaatatatcaatctctgctacccaatgagaatattccagtaaaaacttccttttggtaagaaatgcaattcaatatttttctgttatgtataatgatggaagaaagaagcattgttgacaaatgaaatccagagaaaaaatagtcagaaatgtcccaactctttttattatcaggcaatag

SEQ ID NO: 54246 - DNA, 983 bp, Bovine  19866881321182
aatatattacatgaaaaatgtattttaattcctcaccagtgttttaaagtttttagaaaaatgtgtctttaaaagtacatgtagcattttcatcatatggaagcatttctagcaacacaacctcaaaaccataaacatggtgcttttggagctttcagtgactctgcagaaaaatcaaagatatgaaaagagaaataaggtagcttttgatggatttaaaattttatataacatgtacgcaaaataaaagatgaaaacttagatctagataacatctaaacaccccaggcccatatccagtgataaccactgcttcctttaaaggttaattaaattataaacgcatacctgcagaatatttgtgtgtttaaaaaattcattaaaagtggaatataccttcctatttggccaattcctttatgaatatatttgcatttaataatagcagcccacctttagagcttttttgctcattttctctgcctttatcctaagcagccagatttctaaggttaagaccaaaggctttgtgaaaatgtcacgtttgtcctcatcaaaaaaaacccaaaaaaacaaactgcaaagtcttttcttgaagtttacatcactgtcattccaagcataggaaatttcatcatcccaaatataaatcaaaaatatttttataatgttatgaaagaatttatatatattcttcattttggctgacacattttagcacaggtcacaaaaaatgacaatcaaactgttttactttcattacaaacacaaattacaagtgtacatcttaagccttattttttagaaatggttatgtcagaccaaactccaacattcaggatgaaaaaatatgcttattctttggaccacgttgtttgtgattcttaagaaatagacttatgaataaatcattgaacacaaaagaggaattttgaattatactgtcgatccatttctggcttactgagtctgtagcctcactg

SEQ ID NO: 54247 - DNA, 1308 bp, Bovine  19866881327413
tcagtgaagctggcaaacattcattctctttgaaaagtcttctcccaggcaaggaacctttaagctgagtccaaaaggatacatgagattcaaccaagcaaaactgtggggaaagaggaaaggcaatccccaggcagagggcctggcagtgcaaaggtcctgtggtagaaaagatgaccaagaaatcatgaataagatgggaagaacttgatgaaataaagcacacaagtgagcagagggcagtgcataacgcatggcagaactggtcacgggttccctgcatatcagaaaaaatttccctattaggccaaaataaaagcaggcataagcaacaaacgttcaaagttttaccctgagaattttcagaataaggctaattactaccccacctacagaatgggctctgaaacatgtaaagatagtgatcatctttttcacatatcttttattttccacactgaaaccatcccagcttctttaactaagtaatatcccagccatgacaatctagaggtgaaagcaatggatctgaactgaggaaacaggtttgggccttgatgctagacttactacatgcatgatcttaagaaatcactgacattatctggaaagttgcccacatttataaaatgtaaaagaatctactgcccttcagatctcatagaattattctgaggattagatgaaccaagaaatgcgggagctccgtacaacactaggtatcgatgcgtgtgtgctaagtcacttcagtcatgtttgactctttgcaccactgtggactttagcccaccaggctcctccgaccaggagattccccaggaaagaatactggagtgggtttaggtatcgttagaagagagtaactgtaatgaccataccagtgttcattctttctatagcatggtcggctaaagcagcagtcctcgaccgtttggcaccagacactggtttcgtggaaaacaatttttccatggacaaggggcaaggggtggggggtggtctctggatgattcatgtgcattacatttattgtgcactttatttctattattattacatcagctccacctcagattatcaagcattcgatcctggaggttgcggaccactgtcctaaaggataaagaggaatgccaatatgttgaactaatcaacactcttaatatgtccagagctgtatagactgtaatgtttcaaaagcaatttgtcacaagaccaaaaaaaaaaaaacaaaaaattaacaatataaggtgatagatgttaacttattgtaggatcattttgtaacatgttatatgtcaatatcaa

SEQ ID NO: 54248 - DNA, 1446 bp, Bovine  19866881685249
aaacatacacgcatagcatctcacatatcactttactctagcacttgtaatattaggctgtaattgccaatatttttcagcctcccacaaagaaccgtcaaacccaatgatggcttccgttatggatttttgtcctccttatacttgaggcccccccaggtgctatcaactaacaagattgtttttcttccagattaaaaaaaaaaaaaagccagtcaagccctttgttcgtttactcatttacttcttttagtggcactgggtcttcctggctacccctgggtcctctctagttgaggtgcataggcttctcgttgcagcggcttctctcgttgcagaccacagactctagggcacgcaggcttcagtagccgtggcacaggggcttagttgtcttgtggcacgtggaatcttgccaggcaagggactgaacccgtgtcccctgcactggcaggcagattcttaacccctggaccaaccagggaagtgccagtccttttgttctttaagtgcccatggactggcacttttaaaaaggcagggttgttgtgacaatgtgacagaaatcccaaggaggggcagggaagaaacaatcctgagttctttggaagatttctcttacagatgcatttttggcaacttcacagatgagttagttatatgtaagggccagtttgatggtccacagaggctctcctccagctgggaccctagttggtgaagaaaggtcatctatttgctgctcttcactcctgaactcagaaggaaaaacataacttacatatgtcctgacagtgttgaccagtgtcataggtgggagaaggggtacagggatggaattgttgcttcttatctaaattaagtaatttagggtaaaacagagtgaaaagggagcaaaccagcctaaagggtcatagggtacaaactggttgcttggcaatgtctccatttactttaattaaggtttttagatatcatgagtttgattacttaaagaagtaagcatttgggaaatttagagattatcaaattctctcatcatccctgttagtgacccagagcagaaagtgatagaattaaataatttcataaatgtgtcttcacagctgcttagctcaaaagaatgttcaaatgaggatgcaaatgaggaagattaaaaagtgacaacgccttttgatcagagaagctagcagcttaaaaacctgagccagatgacaagtgttaaatgaaagttatacaaatatctgccggaaacgggcaaaggatgaagaagccatgctgtggaaagtgggacgtaagactcggtggataagcctccatggaagtctctagcacatacacatctgctaaacttctggcctgcgagagtcaggaaaacaatcaaagaaggagaaagagaaaataactgagtaggcagactgccagtaggcagaaaaaataaaaggt

SEQ ID NO: 54249 - DNA, 789 bp, Bovine  19866881847788
acctggaaaataaaaaaatatgtaaaagggacaacacacactcttaacatcctaaaagaaactgcttaaatagtgggagcaagttgtatgaacagtggaggtactgtgtgatccaccaaactcagatggaaaatagaaattcctcagcaaggaggagaaacccactttggtatgtacacaaattgcattatccgtcaacctggctggctagcaaatacattagcaatgaaaaatatcattgaagaaaaccctatagatctatttctatgaccaatagcccaacaaattcacctagattgaatattgagaacaaaaagcttacactgaaaggggacatatcgtacacaaaaataaacaggagaaactgccagtgtcaaccgacaccctctctcccaatcctaaacgtacccatcgatctaagatctgggttataggtatgcaacatgtacacacgatcactctcctgaaaagtatctgctgaagcacaggcagcgtttcagggctctaggtcaagatcaagaatataagccataaatccactaatgctaaagatgaatgaatagccagagatgagatggtctctattactgtgtattgaagctcatcagaggtttgccatcgtcttacaaaatatccttgctctctatcctttatattctgtctctttctgtctactacgtggctaaatccactatacatcaagtaagagtaggtcatttctaactcaataataacataaaccttttggaactcagtcactctagacgctgacatgacattcaatactga

SEQ ID NO: 54250 - DNA, 645 bp, Bovine  19866880493352
cttctaggtttgagacaggtaaccgcgtgacaacaactgagaaactgaggccagttatgctatgtttgaccagttacatgtcctgtaacctacatttctgtgatttcgtaacttccatcacatttcaggcccacgtgtagttaagggattgcgtgtttggacatccagacagacacccttcccactaatcttgctttgagcctggagacactccagaacagaaagcaacatggtacatgggcagccagcgccctccaactctgaagcaactgctgtagtcatggggcagcagtgtgggtaagaggacacaaccagtaaggagagggagagaggcctgcatggtcaggaaagagcctacctgagcggaggccaaacgctggaagtgccaaaggagaatctcagaaggctctggaagtaacagcagagaaataaacattcagggaaggtagagcaggaatcctctttagtcaggttcctccccttccaccagcaagaaatggtttcccacgggatggaaggcctcaacccaaagcagatatacaggagaacaagatgaggaaatggtctgcagtgagaataatgcagctccagattatccggaccagacaacacattttcagcactcactcatgaggtcattaaatg

SEQ ID NO: 54251 - DNA, 1665 bp, Bovine  19866880536148
aattccagaaaaacatctatctctgtttactgactatggtaaagcctttgactgtgtggatcataacaaactgtggaggcatgggaataccagaacatcttacctgtctcctgagaaatctgtatgcgggtcaagaagcaacagttagaaccctgtatggaacaactgactggttcaggactgagaaaggaatacaagactctttactgtcaccctgtttatttaacttaaaacgctgagcacatcaggtaacattcccaaggacacacagcgagtgtactgcaggattagaaatcaagtcccggaagctggctcaagatctggaggctcgaaccatgcagtgggagctgctgtgagccctctcagactcacagaatcgacagttgccctctgcatggccccccttgagaagcatggcatttgggttcatagcaatgtataaaacacaatgaaaacaatgcaacccagtcctgacagttacgggaagctttcttataccctagcgcttgcaggttctcctggcctccctgtgagaaggggagcaggtatgccctccctggtttcacaggaagcccagggccataccacaagccaggcacgtttgaccctagagccctcaacactgagtcctggaccactgcacacacgatccctctttgcttttctaatatgcatttttcctgattaccaaagtaatatatgctcaatgtaaaatgtgaaaatagaagaaaaaatagaaaagagactaaaaatctctccctaatcctaccctgccccctctaaagtaacccttgggaacatgctggtatatcttttcttttccatgcccagagcccccatctgcctcactgatctttcctgggtgtgagattcacctgctggcttcctggctggaagagagtggccttgcccagtccccatggagtagggggccccttgcagccacctgatagacatgccatctcctgctccctgggatccgtgaggcccacccactccccacgctccctgggaccccacattactcaatgtttcctggctcttatcaggaaacagggatgtttgtgacattgatgaaatcacaacaacaacccctccacccaaagtttccttcaattaataaaaactaggtaattttagaacccggctcttcaaggagctgctgcggaagattttcacatctttcttgaatcatttttgctccccactcctttttttttttgcttctcttgttgcctgaactttcaccacttcagctcctggttttcatttcaccattatcctggggtaaaaatgaaacactcaccccactgccactacccccagggagagtggtatactcagcatggtgcagcatggaggaacagactacaggctggttcacttcatggctgagcatccatgagcgaattacttaacctctctgagccttagttttctcaactcagaaatgcttccctggtggtgtttctataatattagttaataattaaataagtgcctagcacatgactattggtttcccctccaggccctaaaatgacacttggctcaagttgggatggataaaaggatatcctggggctgtttgggacagatggagggttaagatcttgtcagggtttggggataaaaagagaaggatgtgggcttttaagaagaaag

SEQ ID NO: 54252 - DNA, 949 bp, Bovine  19866880563834
atacatcacattgcagggcggcccctctgagggtcgagtctcactgcagacctgttgtggaaccaccttcaggttagagagcttgagaaacagctgggacagacccggagccggtccgaagaaacagccagtgagctgtctgtctatcctgactcaaggaagctgtcagcccaggagaaaaatctgctgcgcatccgcaacctggagagggaaaaacaggaaggatgggaggtaagtgtgcccggcaggaggtcaggggcatgtggggccgggagaccacagccacgtctgtgaagactcagaggctctgaggtttggggtcacctctgtgcatgctcctcatgccctgctggtccaccctgagcagcctgactggttcctcaccccgagcccatttcatgaatatcaaggtggccccattatggctgttatggagatgctgggcctgaaactagctcttgatggggtgagacacttcagtttgaacattaggcttagtgttgtccaccgaagcatggcttttctcttttcaccacccaggcagggattgagggtcctcagaagacacactgggacttcccaggtggctcagtggtaaagaacccacccgccaatgcaggagatgcaagagatgtgggttccctgggtcaggaagatcctctgaaggaggagatgacaacccactctagcattcttgcctggagaatctcatggacagaggagcccagtgggctacagtccatggggtcccaacccctctctgctctggcctcatcagtgagtggcagtgaaggctcagctgtgaccaagggtcccactcagccctgcagcctgtgactgccccctctgattacagaaacttgcggcggagcgggatgccctccagagagagctcgaagagcgaaaaagaagtttgagggcatgaggtcccggaacaaggtgctgtcga

SEQ ID NO: 54253 - DNA, 1433 bp, Bovine  19866880583235
ttatttccattttacaaatgatgaactgaggctcagggagggagagtaacaatcgcaaagacacacagcaagtataccacaggattaggaatcaagtctcagcagtccgcttgagatcgagagccttgtcggggagctctcagctcggcctctccccgaggtcactcatgcccattacatcttcctggaccgtgagcccgctactctcagaatagcttgacggcagggcctgttgccttctgagcacagtggccaggaaagccttgaggtactggcggaagcggtggctggagaaggcgtagaggacgggggtgaagcagcagtgcaggaaggcgatgctctccgtcacctgcagcgcatagtccaggtgctggctgaccctgcagtccccaaagacttgcaggtccagcagcgagtgcaggaacaaggtgagattgtacgggaaccacagcacaaagaaggccaccaccagagctacggccatcctcagggcccgcctctggcccgggggcctcagactcaccagcacagagccaatgcgggagtagaagaagatcatggcaaggagggggaggagaaaccccaggaggttctgctggaagcggaggaagagcttccagatggtcccatgtcccccaaaatctgcatagcactcccacacgcccggggagttctcatgcgtcctcacaaagaccatgtcaggaatggagacagccagggccatagcccacacactggctgcaagcaacaggctcttggctcgggtcctcagtcggtggtagggccgagcgcagacaatctccaggtacttgtccaggctcatgcagctgatgaagaagatgccactgtagaagttcacggtatagagggtgctcaccaccttgcataagacgctcccgaagacccaatgccatgccacagagatgccccagaagggcagtgtcaccacaaacaggaggttggagatggccaggttcagcagataggtctcggtcatccgtcttcgaggcacgaaccggagcaagaccgctaggaggaggaggtttccaaccaggcccagcacaaagatcaggctgtagaagacaggtagaaagactctgccaaatgacagcacctcgtccttcctgcacagcatgaagatcatgtcctccaggtagtactcatagtcatagaaggagctgctgttctcagaactggccaccttggtggtgggcggcagaggggaggcggtggtggccatggtgggaggacgcacccagtcctggagctctgcgggccagagagcagtgtgagccacaggagatggatccaggccttcccgccctctctccaaacccactggagccccttttctgggctggccaatagactctccacatttaccccagtacctgtgggctagcgactaggagtacaagtgcgggcagcccaag

SEQ ID NO: 54254 - DNA, 2813 bp, Bovine  19866880631576
aagaattctttcttgttcttccttttccccccattgtttccccatctttaccgaggtataactgacaaaaccacaacaactgtttttatatttaaattattgaccatgacgatttgatacatgcatagcctgtgacatgttcaccatagttgttagttaacacatccattccttcacacagaccttttcctgtgtgtagtaagaacgcttaagatctactgtttttgcaaatttcaagtaaacgataccatattactaagtacagtcaccatgctgtacattagatcctcagaacttattttacagctgaaagtcttttttttttttttttaagattctacatacaagtgatactacacaggatttgtctttctctgtctggactatctcacttagcttaatgtcctccaggtttatccatgtttgttgcaaatggcaggatttccttctttctttagtggctgaataatattgcgtcgtatgcacgtgtgcgttttctggatccattcacccactgagagagagatacgtatgttatttccacgtcttggcgattgtgaataatgctgcagtgaacacggcggtgctggtgtctcttccagacatgatttcttttccttcagatatatcctcagtaggcctcctccaattctggagatctcccctatttggggctccaggggcctcctctctgtggaagatgcttttgtgccctatgttatgttcccctggacccctggctgacgccagctgccctcacagtggacagtccccctgcacattgccagcttcccacctcaagccccagaatcattccctgctttcttgcccactatcagggaggcacagaagaaattaacacctttagggacaaccctcaaccaacaggagacaaaagtcagggggtagggcttccctggtggctcagtgataaagaatccacctgccactgcaggagactggttcagtccctggtccaggaacatcccacatgccgtggagcagctaagcccacgtaccacagctattaagcctgggctctagagccagggaaccccaattactgaagcccgtgcaccctagagcctgtgctcctcaacgagagaagccaccacgacaagaagcccacgcaccgcagctagagaaagcccgtgcagcaacaaagagccagcacggccaaagataaatagagtttttaatgctataaaaaaaagtcagtggataaacgcccagcctccatcctccagagggacaattgtgagtggcattctgtacgttgccacaggatatgccccgagggactgagcctctattctataaaacagatggtccttgtctccctccaagatgcctttctttagcggatgatccttttgaagtgagagtctaaactgttgtccttatttattatatatgttttaatatggcttttattactacttaacacacgtatgtgtgacacacttcccaggtggcccagtggtaaagaatccacctgccaatgcaggagctgcaggagaggtgggttagatccctgggttgggaagattccctggaggaggaaatggcaacccaactccagtattctggcctggaaatttccatggacagcagagcctgggggtcgcaaaagatttggacacgactgaagcgactgaacacacacatgtaatacatgcatagagaagcactgtgaaaaactcaaataatgcagctggtcctccataaccatgggctccccagattcaaccaactgcaggtaccattactgacgttaacttttcagttgaatatgagttattctctcctctaatccttaaaacaacatagggaaatgggaatgactcagttcctattttacgaaggagaaaactggaaagtccagagtgctcacttgcccagaatcacaggccggccagaacaacagcatttttaattaaaagtaggggtggccatggacaaagaagtctgtttgggtttctttttctcccttctgaaaagaaaaaaataggttttcaagttggattcatagcctagattctcaaagttctggatgccactagggaaacgtcttttaaaaatgtttcaagaagacaggctgttttgatccttctctcggcctcacttggccttggacaacctggggaaagctggcaattgtgcagttgtgcagagagaaaggttcaaaatgaccgtgagcagatgtccctgaagggccacccaagtaaagctttggggaaaaaaaaatacctgctttgatcgaactgtaaaaacatcctctgaggagaaatattcagctgaatgagagcacatcagagaaaggagtaaagggaatgatgcctcatgtcctagaaagttagctgctggatcctaaccgcccccactgctgcaagcgtgccagtggaacctgcccccccaccatctaatacatgatgggagacgcgctcacgacgctggcggcaggagggaaagaagatggttctacagttgctctgcgtctcctccctgctcagatcccacctcccaccctttcaccaagactcccccttgattcctcagagaagatgccctcttccccagcagccccacccactcacagctgcagaggaagaggggtggagaaagaggggagccagaaaagctttggggaagacacacgcgagttctagatcagcttgtggcccttctgggctgtgttacaatgggtaagatacacaaccgctctgccctatttcctctgttataaaatgggggagaatgagataatccctccttacaaagattgacgtgaggaaaataaatgagtcaaaata

SEQ ID NO: 54255 - DNA, 1126 bp, Bovine  19866880656908
ctgcagactgaacgaaggagtgtgcttcccttctgctatcctgctgcctggaatgtggataaaagtgctggcactgtggccaccatcttgggtcatgaggatgaaggccacaactggggaggaagagggtaagctggcaggagcctggacccttggccaggtgaggttgagggtgatggggagccacagacaggttttacaaggagcagggagacaatcagatctgtacttcagagaggaaaggtttgtgcagcatgggctggggagccagatggaagcagggagccgaagcagggccaggtaggagatggtgcagcccaagggaacacaggtggagagaagaggaagtggctgaggcttctctgggtaatgggtggacttgcccaacttgggagccagcaggctgagccagtgccccgctcacctgcacactgagctgcccaatctccagctccagctgccgcaccttggcctcccgctcagccaccatggcccgcagttgggccaccaggctgctgcttcgctgagcctcgctgttgagctgctggtctaggcggtgctgggacactcgcgtcttctcctcttgcagactcaggctgcccagaatctcctggagctgtttcagctggtcctgtggggccgggtgggagggtgggcgaggggagccacgactctcgatagagaagaacaagagaagaccagcaacccaccccttccctgctcctcgggaacctaacagtgggatgctagtgttcccttgagaaggaagaatactttgcctgccctcagcgggtattcaaccaggttttcctgtcctcagctcccttctccttgagatcagggttaagaaggacatccaaagggcttccgggagccccatccaaggagattttacgatcagataagtctggtttgaattcagttgtgtggccttggatgacttacctagctgtgaaattggattatgtgttcctaagggttatcttcggagaaggcaatggcaccccactccagtactcttgcctagaaaatcccatggatggaggagcttggtaagctgcagtccatggggtcgctaagagttggacacgactgagctacttcactttcacttttcactttcatg

SEQ ID NO: 54256 - DNA, 1067 bp, Bovine  19866880899538
aaccccaaggaggggctgctgtgcgcctccagccggccgctgctgccacgtcatctgagctcggcgtgcctcctgctcagagcggccaagaccggctcactccactggtccccctttcggttttactctcttaaagccgcagttatttattactttctcgttgttcgcctgacgacgtgacaaatgcatggtctttgtgcatgctgctagacactacttttcttttccagctgaaaagtctcgtgtcatttttacatttataattttaatgtggatgatcaggattaaattaaaatgtatatttggaacctaatatccatggagcacttagaaatttgatgttctgcacttaacttagagaaaatgcttttccttgtgaaaaatctaaattcccgccccgaccttcagtgacatgggaactccgtgctctgaggcatactctggtgtctgagacagaaccaaagcaataaccttgtgatgccgataggcctggagcctgcaggcgtggggtgcccagcctccagggcctgtgcagagcagagtgcagcaagcgtctgcaccgacaaccgtaaaaccatgatttcagcataacccacacctgtttgtcttaagctatagtgtgaaaacagtttgggctcttaaaatttaactgaaaaagatgttcttgttttgtactaggtgagaaagtacatagattcataaggcagcttcctccgcagtggtcagtcgcaagcagacagtctcattttgtaatgtggtaacgtgaactgaagatgtctcaccttgacttctagagtgtgtgtctgtctaacagaacaaaaggatgcttggtgtaaattcccttgaagagggcgtaccccaggcttcctggacaaccatgtaggtagaagaaacgctagggcctaaataacgtggaagcaaaggtgttggcaaagtcaaaaccccattaaaaaaaaaaattttggcatttgatttttaggactttgataattaggttgtctgttggtaacttccattcttttatgtcctttagctcaactacctatgggaattggctgattaaaaag

SEQ ID NO: 54257 - DNA, 881 bp, Bovine  19866880903514
cgtaaaattgcatccggggcttcccgccctttcttctgaataatgaagatgcacttcccaacccagcgccccaccccattttttcttaccgagaagatccaagcctgccagcatgatcgcccgctgaggctgggggcttggtcaggccagggtcctcagggagcttggtggaggcccggctgacctcgggcccactggagccctcgtctactcctttattccgaagatactgcagggaacagacgtgggttccatcatcagggccttggctcagaggcctggagaaggcaggagggggccttggcttgatttcggggctttcaggggatatgaaagaggcttcttttcaggagtgcaaagcgaggcctgttgggtgaaggcactgcttgcatgataataacagctcataatgcctctcttcagaaagggagcttcacagccagaggagggtgaccaggccaggaagctgttccacattcaggtcccaaggggaggtgagggggcaggtccacctctccgggcagccccacccacacggggatgaacaccaggtgtgacttcaggcctttttcaactagagatgtgaagaccttccaaacacctgaagccaagagcaagggttggcagcctggccaggaggctgggcttctcaggcccctaccttcccccatccctccctctttcagatggctggtggggccagtggaaggaggaacgtttgaggacccccaacgggaggtctggccaccatcaacagtgggacagttggtgtgagccccgaacaacctggcacgtcccctaagcccggccaccccgaggaaacttgccatgtgtgcccttttgtctggggtagtgctcggtccccaactgctcggtgtgac

SEQ ID NO: 54258 - DNA, 851 bp, Bovine  19866880984316
tctctggcaaaggaaaccactatcctgtctgtattgagatacggatctggtttagatgtcagctacaccataagccctcaattcattaagtcatcaaggcaaacagatggtgcctcgcaatcagtgttatggcaaaatgattcggagagtggagattagtcaataaaaacctacttgcagtgccactgagtgtggcagtgcgttccggaagaggcacctcattctcagagaattatcagacttgtaaaattagccctaagtcgccgttgggagagacagagtcggggaaagcagagagccaatgggtacccaaggcagctggggagaggagaggagggttctgaaagggagactgtctatggggtggtgatcaagagaagaaggagccacaggagcccaaagcccctgcccagctaccacagtccagtagcagaaatgcagccagagttactgaactctcgtactcacctctgcagagaaacagtcttgagtcattcaaccaacattttccatgggcaggataccaccaagtgctgtggtggaaacataatggaggttctgctgccagggtgcttgcaaaccaacgttcatgcacaaccacaggactctccatcataccaagtaccaggagccagctggggagcccaggtagaaaatcacatttatcctttctagtggaaagaagctgtttacctgtggtaaacaggtaaacagcttttcgcttccagtgctcaattctttgtgtaatctagtcaaattacctgtataaatacagataataaaaattagtcaaccttttcacttacatagtttatatgagactataaattttctaatttttaaaatcaata

SEQ ID NO: 54259 - DNA, 1522 bp, Bovine  19866881251622
ctcttttggggcattacttcactgaaaaactggctcaacatataatcatccttttattcaacagacattctatggcacttgaagaaattgggtcctaagaagtgctagatttggggcagatattagagacacaaaggtgagcatatccaggacatagtaggatatgtgaacaggcctaatcaagggaagtgtgggctatcttgtatcagcatctatcctgcaaaggtgcaacaaggtgggagaagtgggaagaaaagggccagggaagaattctacagcgtcagtgtctctgggagagctgggcccctctcctctcctactgagcacggcggaggaccacagagtcgcggagccctccaccatcctagagaagctggaatggcaggagtgcgccggcctccacctctcgcgtgaagcaatctggccaacacagaacgtggagagctgcatgtgggggttggcgggggctttgaggcctgcgtctttccaggtccgctcccgggccgatggctgggtatgtcagccccgaagcggttctggagccttcctcccagacacctggccgcccccggtctgacccagccagcagccggtggccctgggaagtggggcccgtttcagcccagcgctcaacctgctgccaggacagcccacgttgtcaaaggtgagccgatgccaggaagctggctataggcccagatgagaggcggaaagcaggcagtgcagtgacggggaaattgggatacagtcctgagtggagggacccgaggaacaggcaggggcagagtggatccggcatcccccaggcttgtggcggcaggggaagcagatgcacaggcctgagccagtgctggggtagaggtgtccacagaccgctgtgtgtggcgatgaacggccagaacttccacgactggttttacagagctggttttgtttgaggtgggtcttgagatgaacgggcttccctggtggctcagatggtaaagaatctgcctgcagtgtaggatacctgagtttgatccctgggttgggaagataccctggagtagagaatggctgcccgcccactccagtattcttgcctggaaaatccccatggactgaggagcctgatgggctacagtccatagggtcacaaagagtcggacacggctaagccactaacactttgacttaacacctttagatgaacacaagggaggatctggatcttcaggcagggctggggcccgggggctgcaggtctaagggcacagagctggacaagggaaaaggagccagactggagacaaactaacatatgaggagcacattcttgacataggcatggtttcgtcccagtgtgaatcctctgatgtacaatgcaaagtgatctaaaactgaaattcttcccacattccttacatccatagaccttctgtccattatgaactctctgatgttgatcaaagtcttccttttgatcaaaacacttgccacattcttcatgtacatagaacgcctcttcactgaggctttcctg

SEQ ID NO: 54260 - DNA, 996 bp, Bovine  19866881272634
tggttggggttcctgtagcataagaattagaaacaaatatcaccattacgcattctctactgttcaagaaggtgagaagtctgacggttatagggtttctctccagcacggcacctctgatacataatcaaaacagaattctaagtgaaggctttcccacagttgttacatgtctagggcctttccccagtatggattctctgataacaagtgagatgtgcctcgcaaataaagctttcctcacagtcaatacattcatgaggcttctctccagtgtggacccaggggtgccgagcgagacccaagttccacatgaagcctttcttaaagcccttacattcataaagtttctccctagtgtgaatgtgattggtagttgtaaccaggactgtgcttcttcacacccagggggaggaacagggcaggccttccttaggctctaaccatggtgagtcacagtccacgtgttgctctactcaccatctgaagtcttacgccggctctaaattggtcccatagccagggagaagctgtgcactgactgacttggcctggattgctggtctctgaacactctctcatgtagtgacttagatgggagaacttacttggcttatctcagtgggggcctatgctagtagctggagttgggattactcccacccaaagggcctggctactccctagtcggggagggggaggagaatggatgtagggagggaaccacagtgtcctctagattctctcaggatctcaggacctactctcgctaccactccagggaatttcccatctctgctttagacagaaagctaacagcgagggttattccttgaataaaacctgaactccctgacctgcagcagcccttcctggagctcatgttcctactcaatttcccttggaaattgtagaattggtctacagttctccaggcttggatgggagttacaaagaaacagagcttaactaactcgaagaatttattagagggac

SEQ ID NO: 54261 - DNA, 693 bp, Bovine  19866881325296
aattcagtgggttttaatatattcacaaaggtgtataaccatcacctttaattccagatcaattccatttttatcatgcccaatgtgggtgatacccattaactatcattccctattgccctttgtcttgccacctcccacctcgtccccttaccagcccaaggcaagcaatagctcagagaccacaaggattccagatcccagctacatgaaagagcaaattagccagaagtggtcataggtcttttaaaactgttggtgaactccccttaagcaacaacttacctaatttcacaagcaatcacaatctgcacaggacacaatacttagccatctcgcagcttgcaatttccctctaatcagccatactatactaggcaacagaccaaggttataagctcattttatctagttattttaatactcatcattctcagaaaaccgttctgactctcataaaacaaaacagcaggaggactttgatggctagcacttgtctgctgattcatgagtaaaactcaaaactcaatttgagtcagacagataatttttcttttctggtttttcctgacacagggcaggcacgtccctgtccctaaacaaaagcatcagcatagggagagtaatgagggccaccaatttgggtgaagtgtctatttgcataatccatttttctctcagaattataaaata

SEQ ID NO: 54262 - DNA, 1210 bp, Bovine  19866881486701
ccgaaaagtagacttctaccaaggcaggcaagaagatccgccactataccatgccgtggggctcgggtgtctccatctgccctgggaggttcttggccctcaacgagatgaagctctttatcctgctcatggtcatgaactttgacctggagttggtggaccctgccacacctgtgccacccgtggacccccagcgctggggctttggcaccacacagcccagccacgaggtgcgattccgctaccgcctgcggcctgcggagtgagctctgtccaagaggccgaagtctggctgggggtgctcccctgggtctctgcctcctctcgcccacccctctaaagccccagaccacccctttcctcttcctgcttgtcctccctgctctttggcatccttctgatcacctcacaggctgatacttctctcttgaaaacaccatctttcacagcagatgctgcataactcgcctctcataggaagtccaaggaaggggaaataactgtgggcaactcagtttgggggataatatatgccatgataaatctcatgcagtacagacaccggttacagtgagtcatatagcatcttgcaaacattggtctccaccctcccactctgctttgcttgttttcctcaacactcaccctgtgggattcagggcctagaacagtgtcatccgatagccatatgaggcaagccacatgtgtaatttttcatctcctagctgacatatttttaaaagtaaaaagaaactggtgaaattcatttttctactgtattttacttgtcctgatgtatctaaaatattagcatttcaacaaggagtcatacaaaagtattaattaaatatttttacatttctttttccctccaagatctggtctgtactttttaacccttcacactgagtgctcaatagctgtgtggcttctgtaatggacagagcagctctagaaaagggtggcctttcatggaagagatatgcaaggtccctcctccctgccctcctctcccctctgcacccccaccttggggtgatttcaacccttcacttggtttccacaaccattgctaagctcagagctctctcctacctccagacccccaatctccccacagcgatctcccagcacctctgattcagttcagcccacacagaactcagcatctgtgcccccccacacacacctctgccctaaccacgcccat

SEQ ID NO: 54263 - DNA, 1372 bp, Bovine  19866880385781
cggcctcatcatgttgttccgttttcttcatcccctggacttctttgtcagcttgtatgtaaaccagatgcctccttgaaatgggataagggctccaaaaagacagaggttttgttcccattgttaactgctgtattctaaacatctgacacagtgattgtatctcaggtaacatcagattaattaatgaataaataagaagtgaaaatgaaataagctttgtgattggagaatcaattgagtgaccgtgatgttaaagaaagcccttctaactctctgtggatgaggacacaatgcctagttgtactggttcagcattctaaaaggctgtgcataagcatggggtcattttagattcgagctgactagtgcttgaagattagaagttacagcttcagtttttgtaggcagcagaagcactcacatttgaaatgatgtctcagcaaaagatttgactcttttccgtgtcccatggactgaagtattattgtccttcagctgtattttccttttcttttttaaagatacattacttgcttctttctttctaaaacgaggcaacggatgttatctgcccaagtccccttttctctagatttttactttttgagacatcactgtggacagattattcttgctcttagcaaacattcttcctgggatgtattaatgtatttatctctgtcagaaagcagagacctaataaccaattccccaaacctcttgcaatatagcatctaatttcctctcccttgaattgtcagccacatgcctgtacgttcattccccagtagtactcccttctccactcaaatgtcagatcgaatccattggaaaagattgttttcaagatttattgctctttttgcctcgttctctgtcttctttctgatggcatcgtgctgagagggccagctttgcatgcactgcttcagtaactgaaataggcaacagataaccgcagggccatcctgatagtctttcttggagcatcagtgtctgatgatccttggagagagtcatcagtctcaaagggcaaagggagtcagatgagcacactgcagagatgactcaatagaaagagaaatcattatacaaatccgcaaattcacgatgcatgtcaactctgataatgatgatatttattactttttaaattctttatcatttataaatgcaatcccactcattcataaaaggatgcatatttactcaagaacatagtacaactaagcccccatgctttcccagcatagaagatctacagtgatttctctcctgtcttcctgatggggggaccatccaaaagttgttatttttttatgtaccttttgattcttataacagccataagcaactattcaatttccac

SEQ ID NO: 54264 - DNA, 1332 bp, Bovine  19866880413248
ttagaagaatggaaggtcttattcattatgatcccacaacttagccaaataattgacatatagctgtaaatagtgaatcaataaacacaaaagtttttgtgagtgaattgaatgagagtatgtgagtgaatgaataaacattttacacttgctgcacacagcttttttgtgagcattctcatacactttctagcatttagtgtcttaaatataataggtacagaaatgtatggctgtgctttattgggggggagacttgttgttttcctacaaaagattcactgtctctatagtcatgtggccaagtctgactgcaaacaagaatgccgtgctcatcaagagaggacagcgggtcttaatgtagagacagtcactgcctgcgtaagaactgagcccttaatttactctgacaactacttttaagtagccaaagtgaattggaaaccttcccttgagacattcattggaaaacacagtttggattagtccaataaccgaatgtcaaccacctcctacaacaaagcagtgagacatgcttccctctctacagatcaagtaacccagaagcgtgcagcctgggtaaccgctaataagggttctcagagaatggaggccagtagaagaattgtttttccccatagtaaaagtccaaacaccttaccttagcacccactgccctaaataagtcagtcctgacctccccaggcattgaagacactcagtgaaatcccacaagcatttctaaaaaagcgaaggggacaggacattcccagttgaaggaacagttaatttttttgtaatttctattctttttttaaattttatttattcatttattgatctgtttttggctgcttcgagcctctgtttctgcaggcgggttttctttattttcagtgagagccgggactcctcttcggctctggtggccggcttctcactgcagtggcttcgctcgtcgtggagcacaggctctagaacactcaggctgcagcagttggggagctcaggcttagctgccccttggcatgtgcagcctcctggaccagggagcagacctatgcccctgcactggcaggcgggttcttcactactggaccaccagggaacaatttaaataaatgcaaggaagtcagttaaacttagcaacccagtgactccatatgacacatacgtggaggaattaataataaaatagggaaacgaaggtcttatactgagatgtcttggtataaatgtcgctcggtcttctggtgtgaactcgctgttgttgttcagttgctcaatcgtgcctgattctttgcgaccccatgtactgcagccaagaatatt

SEQ ID NO: 54265 - DNA, 1133 bp, Bovine  19866880499150
ccccaggggttaagaactgcaaaaagtgggagacaatgtatctttctgtactttctatatgggtggtgtgctttgtttaacgatgtttaatgctcactcacatgcttcctccaaattgtggatacagagaagtgtgccttgataaaaagcccaccgcctataatagagccaaagcccgatgttaggcctcccacatttttcttcagaatataaatacacatgcaatccttctctgaatgaataataagacatgttctttctgagttaaacttttttaagagaattttagttttctcatagtgatatggttgttttaaaatttgtggaggctttgctataatcaggagagagaagacacacagactcaggagtgactgtccgggaggaaggcatttttacacttacagattcctggcaacaggaggcacgacgcacgtgtcccagtcagtcaggaggcaaagaagaggctggtgactgtgggcaagagccttcgtgtggtctccacgatgaagaatgctcaggccgggctgagcaggtggggctgccgagtctgaatgggatccacgggctttggagcctcagaactctcctgagtcatctgacgcctggccctggtgtgtgaggggtgacctctgagcgcccagaaaaggacttccttgtccttgaccccacagtaagtttaccaggcgcagcgcaggatgtaaatctgacgacccacggccactgacaaacattaacttggggcctagttcactagttacttcacatttcaaaaaaaaacatctcatctcttcttggcttgatgaacagaaccggtttgaataaacttgtgcattgtgcctgttttagctttcattgacgataaactcttcagtgaggtataattaatgcatctcttttcttccttctcccaaatataagacatatactttcctcaatatcttgtgtaacatctacatttcctttttaatatctatatatttgcaagatgcaattcatcatacatttctaattaacatctaatttgggatgaatttcctctttcttcctttgggcttttctaatgagacaataagttacatttgcaaagggcccatattaaccatacttgcttaatagtaacaccttgtggg

SEQ ID NO: 54266 - DNA, 3370 bp, Bovine  19866880546752
tgaatgggctgttatctgtaagtctggtcttaaataaggggcttttagtatctaattttatattattagaagaaagcttgaaaatttttctacagcagtaattgcataaatatatattttatctggcattaaaaagacattattgatgcagaactctctattaaggagaatggactacttttagatgagaagaagttcaaaggtaccatcacattcatcatctaaatgtaattagttatataatgtaatagaatctgaattatattaatgtagtaagactgaaaaacacaagtctgaaaaaaatagctatgggaaattttggttgatgcaatctgagttacatatatattaaactccagaagttgagaaaggcccaaagagtagagcgaaacccagtggtatttcttcaacaagcaataagggctcacttgctatgttctgggtaatatgctaggcacagataataaaacacagacatggtctttattctgaatttacaaactagtactggagatgtgcagcgataagattataccacatatatgttgtcaaagcaggggacttggctatggaaactccccatttcattaagaaattactactagaatgagtaaactgaagttgttgttttctctatttgcatcattcctctcataattgaaatccctgtgatgcaaagagtagcaatttccaataatgaccctgtgctcactctggattgctcggacaacctcattctctcagccagggcactgtgctcaggcggtttcccttagcatggtgtttcctcctcgctgcataaaatcctattggtctcaagacttccagatactgggcatcagcatccgcaggcaattcctgtagctagattgtgggggggtgtgccttcactgataaaggtgccgtcatatctgcttgtaaggagtgccgctgcgttataggaagttgggagtcactactccttaaagaaagaaaactcatacagaatgttcagcagatcaacccagcccaagcacactttgcagataaaacgggaccattagacgtgtcttctcccactcaccctgacccttgtcatagatgtatccccaacaattcttttccgtaacttgctgagtggaagttgcatttgaatgtgaattcagtgctatattctatttatataaaacccaagaggtcaagaatggtgtcgtaaatttcataggtataaaaaaagttattcatttaattcattcatttgcatgaattaattgcaaaaaatcaaaatgagtgagtgatcaaataaatgctatcaaataaatacttgccttcctataagatgggcttccctggtagctcagctggtaaagaatccacctgcaatgcaggagaccccagtttgattcctgggttgggaagatcccatggagaagagaatggctactcaggccagtattctggcctggagaattccatggactgtatggaatgtagtccatggggtccccaagagttggacacgatggagtgattttcactttcactttcctataagacaggcggagggacagacagagatattgtatcctactccgaagccagattttggactgaagaaattagagacaagaagaagactacatatgtggagtctgaaatgaggaagaaagaagggcagtgggagacaatgtgggttataaaatgagccccaagtgaattttcaagtactcccaacaaaactttgaaaaatggagaatcaaattcctcaagaatcagatgggaccacagataaaggtatccttttcaaccagggaactctggaaaattgattcttgattttgaaagtaaagcaatttttatttgattcaaaggtatcttcagagggcaagagaagtttaacgtgtatatagtgtatctgaagacttgtctagggtccaagaaactcccctttgggtaccataaactggtttattatccattatctataacacaaaaataatgaaagcggtacaattctctgttcagaaagcccacaggaattccagaatttgacagccgtgatatatctcagttagtttttcctgtgtaaaaccatcacaaatcatagagcagacagtgtgttggttaaagagactacacattgagatgatgaagttattcatttatcttcattgaaaggactcagactgcactatggctgataacataaatctcatcctatacgagatcctctcccctaataacttctcttagcagtttgattaaaattgcttttgttttcctgtacataacagtgatccaagtttcctgactagtcactgaaacttgcaacccaatttgtggtgctaaaatctggtgaatgattagagtttaataaaatgaagagtttaaaaatggccttgtaaaagggatttggtgattaaaatatgtaagcataaaaaatttaagtccacttgtaattcaccttcctggttctgatacttcattcaagtgacatatcatttctttagaaactatttctacatgcacagatactctgatggatttgataacttaatgttagttagcagaaaaaaagtcaaacaaatggtgaagagagagaacagaaatgtgcacagtaagatcaaaaacatgatcacagtttttaaaaatgtaattatggtaaaaaccatcaaaatattgaaaatataactataatataaatatttttgagtatagatacaggaagagatgatgaaaaaaagtgaatttagaaaaagaatgtgggaaggaaggaagggaaatggagcgaagatgagtagaagaaagaaaaaaagaaagagaagaaaataaattagctccctaacattatgtatttaattcattctttaatttccagggtctttcgtgtacattagaccagatacagctccagaaaattagaaactgaaaataaagttttctccctctacacactcagattaaaaggtgcatcagagacagggtaactgcaattatcatttcccttcaaaaatgagaacaggggcacagcagaccagtcagcagaaagttcaaaatccacaccggcaaatgatggaaagctctctgtttcaggggtggaaagttatgtgaccgggccttaattacacatcctatgtgctttctggtatgttcctcaagatctaggactccaccttctggaaaatctttccttatttcttgtcttccacattcacttttcaaggagacactggaaatatgctaactgagcaaactatagcttttgcttagttttgttctgttagaacaccccttttctgggtactaatttgatatcaatgagctatttgctatgtaacaaaacacactgaattaaaatctctttatcatttcccttgagcctataggctgg

SEQ ID NO: 54267 - DNA, 1360 bp, Bovine  19866880864051
cagcctgccaggctccccaggcagacccctcccagcacccgaaacttttcctcttgctcctctcccacctcaatggttccctctcattccacagcagagcttcagggaaaagccaagcctaggaaatcagaatctttctcctggcattatgctctttgcagccaagtgactcatgcacagaaggaacaaggttcaagttcacgaatcagcaggctttccattcacttctgtgttaatggttccctccttgtccaaaagcaaggctggagctaatggatgtaccgctcccatttccttctagcttcttttctaactgtgagaaaagggagggaattggaactttgtgaacttgtaggaaagtattgtggccaggctctaggcataacagcttgtgtatatcatataatttgtccctccagggaagaaaaattatcttatattcaaaaaagatgaaattcagactcagaggaatttagcaacttgttaaggatcacagagattgtaagaaactgagtcaagatttaaaaccaagtcctctaggcaccagggcttccctggtggctcagttggtaaagaatctacctgcaatgcaggagacccctgttcaattcctgggttgggaagataggctacccattacagtattcatgggcttctctggtggctcagatggtaaagaatctgcctgcaaagcaggagacctgggttcggtccctgggttgggaagatcccgtggaggagggcatgccatcccatccattattcttgcctggagaattccatggacagaggagcctggcgggctacagtccttggggtcacaaagagtcaaacatgactgagtgactaagaacacacacacacacactctcagcgccaaagccggtttgtggatgaagactctgcacggtgaagccttttcctgggtaaccgcttcttctaagacacactgtgttttccttgccctcccttctggcctcaccaggaatacttgggttcattaggatgctggatctttatctcaggtgactcgttaggcatttgagtgctgtgcatttgtcagcagtccaggttaactcgctctttctagtaaaaccctttctagcaaaattcattccgcttgaaaaaattcaataaatactgagagatgggggagcaagattagaagattgaaaaggaaactagataactaaggaagaagagtcccaataagcccatatttctctctgatcggagagtatgtgaaagggctggattggcaggagtgaaaaagaaaatctccttttttattaagctcacctgtgtagtattatctcttcagaggtgtttatgaaaacattcacacagtaaacttgcctcc

SEQ ID NO: 54268 - DNA, 1032 bp, Bovine  19866880888931
tggaagtgagaaatagatttaagggaatagatctgatagacagagtgcctgatgaactatggacggcaggttcgtgacattatacgggagacagggatcaaggcccatcccccatggcaaagaactgcaaaacagcaaaatggctgtctgaggaggccttacaaatagctgtgaaaagaagagaagccaaaagcaaaggagaaaaggaaagatatacgcatctgaatgcagagttcaaaagaatagcaaggagagataagaaaaccttcctcagcaaccaatgcaaagaaatagaggaaaacaacagaatgggaaagactagagatctctgcaagaaattagagataccatttcaggttacctttgtttaacttgactctctgatacgtgctggcaaaagctctctggctaatgtagctgaataacagaagaatgtatctttgaaagttgaaatagagccttctgacaacaccattaatccacaaatgatctgtaatatcttggacaaagcagtcaaatatagtgagatttgacttctgtatgtacaaaatgatcccctatatctcactgagttatttaaaaatggtgactctacattttattaaatttctattacttgtgtttataccttaaatactttacagaactgtaattttttaacggtgtgagtttattcaacttttgatctctataatgcctactatctagcagacagtgtatgtagaatgaatcaaatcactgaaaatcaacctacgttagatttttaggaattttttcataggctctcttatttggtgagatggcaactgcctgaattaagccattttaccattttcccttttgtttcctgagtctttcatggccagacactaaaagtgatagctgtcctccactgcagcacaaaacatccctgcaacagctatttattatttggtcaaaatctattgtcagtgcagaaaacatcacataattctcaacatccctcccattcaaaattttaattcattcaattaattataaaaaagaattact

SEQ ID NO: 54269 - DNA, 736 bp, Bovine  19866880898051
ttttaaatatgagttaataaaatcactaggtcatcttgggaattatatcattttaaaaacagcattaaacttgtcatcttcaagcttttccccaagctcagctaacttcgtcagaagtctaaagtgttgtatgaattactagtaaattagccaaaaacaatctgtagcacacaaggagaatatactacaacttctcctgtgatctctggctgcaactacacttgccaaagaaaataaataatgaggaaattgtatggctgtaacaaaagcatgatgcaaatcccttcatagattaatcgacaggacagtgatccctagattacagaataaacttactctccttattctgccactcataaaaataatttttcctctttgcatctgaatctctcttccccaggggtagttataagttaggttagttcctagtattttccttatttaaaaattgtaagagtatatatttgtttctatgtttctatgtatatatgttatatatttgtttctatttgtttcagagtcagtgttctgacactgctatgtgccagtcaaagagctttaactagcagcttctgtagctttatgatgaacattttacctagatttgcttgataaatgcccaaaaccacattattaagtgtgacggacctagattgagaaccacttagctaaataatctgcaaagacatacatgacttggttattatcgctgtaaaacagggataagcatatgtca

SEQ ID NO: 54270 - DNA, 1147 bp, Bovine  19866880917184
gacgctgttttacagttagacggcggagatctagaaagagtattgtaatgaaacttacttaagatcaactaactctttcacccattctcaatccatccacaggattacagaaaacatgatccgacatgtgtgtgggaggggagaatttatataataattctttgttttcacttttatgggtataacttcattccagttgatgttcctcaaaattcaacccatgggtccttttatctgacaatgtgcactaaaagaaagacaataatcattacagtaatactaatccaaaaccttatcatcattattataaaagtaaggtgggtattaatatttattgttaaataacttgttacttttattactatcattttgtaaagcagtgctatttttctacccactttggattcactaatgtctagaacaaaaactggggaaaatagatgttaaaaatatttgtttacattcaactatagttatttttctcttaagatagttactgaaataagctgtggtggcaaatgccaggttttaacttcttttcagtcatgcgtctttaaaactccctttttattctgacagggagtgatggccacttctttctcacagtctcatttatactaaaaatgtattagaaaattaatttcgtaaaagagaaaatgattaagctccaataaatgtccagcacacctgggaaaatgtgaattattgaagatggagtctgcattgaatcttgaaaacctggaacaaactgcttattactgtggcctgtttcactgaattgctgtgattaaaagggagactggcttaatgtgaaggtttttccattaagaaaaaaatctctccctcgctcacatgcatgcacacacaccacacattcactgagacacacatgaggtcttgcctgaagcacaaaattattgctttcctttattgtgttggaattgcagtggtgcaaaaataagtctgtgccataaattgtgtgtcctgttaatttgggcagtgttctttcaccaaactggggctcttagacctagtagagcacactgaatatttaaattatatgtccaacttaaaaaagttgaagggagaggtatttagaacaacttgagaggaccacctaaaacaccaactaaacaagaaggtaaca

SEQ ID NO: 54271 - DNA, 1320 bp, Bovine  19866881255356
ctggatattgagaaaatctggaggtgttagactagtctcaccttcaagaggccctccacctaaagagcgagaccatcatataaaaataaatgctgacgccatttggtcaggcatttgttgatggtcagggcctttcaagatgatattccagtcaggagtaaagccctgcagaggagatgaacctgatccttaagccccttccaattcaatatcctctaacttcccttccagtcacctagttcactccctctgcctactttaggaaaattcacagcttaataatgcatgagggaacattaccttaaggtataattatgcttttccccaaatgacctatgcaattacaccagagtggtgaacagtgactgcagacaggagttggaacaagtgcccaggaatataatgttacaaaatgacccctgtttcaattttccttcttataactacataaaaattacatttgcttctatcacagagatgtgcagtaaaacatgaaaaagacccattagattatcaactctcatctcctcctaggaagttgttgttttttttttttttaactgtgatagtctttcgagggacttgaggctgttaaattattccaagataatagggataatgagggaggaaagacctcccagcacagtgtttatacttcgtaaatctgcacattggtacctggcggcaggtaaaccttcatggccagatcatgagtggatagagctcaaagaaaggtgggaagttgagccaggagatccaaggcgaggctgggattataaaattagagctagcattagagtcagaataaatagtcacagctggataaaagagaagggctagttagtggtcatgtgggcagttccagacctgggaaccagagatttgagacagcatgtttcatataaacactgatattaatatgacattaatgtagattattacacatatataaatattttatgaaacttccatcacactatgaagtattctgattctgttgaatattaaatccattccttaaccagaatcactaaaaacaccccgaaatgattacctaaacgccctaatcattcttttaaaacttattttactgaaatatagctcatttacaatactatattagctttaggtgtacaatacagtgcttcaataatttttatagattagactccattttaatttagtattaaatattggctgtatttcctgtgctgtaaaatatatccttgtgacttacacattttatattaatacctctcaatcctcttcccctaattacccccatccttgacaactcttgatatcatcaggctttttagg

SEQ ID NO: 54272 - DNA, 1020 bp, Bovine  19866881265456
aaaaattgctagtattaactatgactttgggaaagacacctaaatgattacagcctaagttactccctttagaaagcaggggattattgtatttattagaattaacactatgatagaaaaaggatgaaagatactgagcatagtgagtaatgcttttaaaaagctagttccctgtctttttttgcaaagagcactgtggggtccgagttttggagagaagggcaaagggaaacaaatagatgttctgctctgaatctgtgcacagactgaaaaatcaaagtaagacacacgcatgtgaccgcgtgagtgtgtgccggtgaagtcacaggtgctgcaaagaggtggcaaaaaggaccacaggagtttgtaagaaggaaggaatcagaagttaaaagcagaaatataatttggttctgagttattaaagttcaaattctgagagccctcctaaggtctgcctcattcagggcagttgtctctgcatttccggtctgctgaacccgtgatacacactgagcacagctgagaggcgccctgctcactgttcccacctttcccccagccagattcgctttttctcacactgggattgtccaaagtttcttccttgtttgtctgcctaaaactcaagcttgactccttccatccactctgcatatatggctagagatctgatgtgacacccttgcctaataataataatggcaattaagaaggacctgggagggaaaagatggaacagagaatttttttaaaagtctgtaaataagcccttgcacaagtatgatggtacactcaattgaattaggaatcacagtgagttatatgacctggttgcagtaattgcattaagcaaccgtattatttcaataataaaataaacccattgaaacagagtattttctaaggtaattatttaactaattcaaaagtggcaggaggattagatgttccaatctttgcattttattatctcctcactgtattcagcctgaaaaatagtctttggcaattgaactt

SEQ ID NO: 54273 - DNA, 1199 bp, Bovine  19866881272790
tttcagcttcagcatcattccttccaaagaaatcccagggctgatctccttcagaatggactggttggatctccttgcaatccaagtgactctcaagagtcttatccaacaccacagttcaaaagcatctattctttggctctcagccttcttcacagtccaactctcacatccatacaatgccactggctttagggatggattaatccatgagttcaaagagtggaattcagagattgtatcttcattattaggcaagctctttccaaattgatggcagatgaagccacagaggctctgggaataaaattcttcttacaataaaaattcagaggagcagaaaaagagtggtttgttttcatagtgccatcaaaatttccagagtgtctttctaaggtctgtggccaggaaaaaaaaaatcattttcttactgatttcgattatgtgtccaccctgagcatgaggttgaggagtcaatcaattagttgaaagtcttgttgttggaggggaagagttggtgcaatacccctaaggaaaaaaaatctgagattattataagcccctggttttaaaaacaaagaaacaaagaaaaagcaacaaccaaagcagtaagaacataacaagaaggtacctcacagatgttaaaaaaatgttagcctgaaagtaacacgaggccatttacatcaactctctgctgatgagcagagacgtaaatgggcttgttcaaactctcagctctggtcagtggctgaatatagaccacagtttatgtcttcagagtcatttaattacaccttgccatttccctaggcatcattatcattatttgtttaagtgatagatatcataggatatctgaaacttaaggaaatctcatgtttagcaagaagatcctggttttgcttccttaatatacttctgtgcttgcacacaccaattgtccaagctgaaaagagaacaaaattgtacaatttcccttcaagtttggccatttcacatttttatcataaaatagcctcatttctgtcactgctggggactgaatccagattaagtatatgcatgtgactttagtcactgaaatctcaaaagaaaatgttctactcacctttgagaaattcttccagtaaggagcaattatatttcttatttgtttgatttcatttcagagaaaagtgatggctcttatagactgttag

SEQ ID NO: 54274 - DNA, 1907 bp, Bovine  19866881375991
atactgtgaacaaataagtgattccatccaattatggtcacaagcaggtggaaggcaaacaactaagaaactgaagtaaacacgtccttcctcagaaccatcctttagattgaacagatgctgggtctggaatagaaatgtctttctgaccaagccctgctgggaataaactcggtctagaattaacctaatactgtctcagccttaatcacattgtcttcttttgatgtcattctctggttcttttagggaagcttagctgtactcaggcacatgtaattcctccttaactctttttatcttcagactttcatatctcaaattttgttaattgacagcagaattttttttaataaaatgaggggaaagatgtttttcccttatttccttcattaatgtttctggtaagcaccttaaaaacaagataacattctgtccaccgcttacctccccttcccttccctcttgctaagctgccaagttcttttccccttctgtatacttggcttcagacatagagattaacttctgggcttattttgggggggttgatatctcttaattattttctttgattcatatcttaaatgctgatgtcacaagaatatatgattttaaactaaaaactttggattcaaagtcaagcttaatttttatgattagtttacttgctaatctctgaatacctcttcatctggaaaaaagattctacaacaatacttaaattatataatgacgtcatttctgcccttcatactgaacatgaacgaggccagaagcccagtcttctttgtgtatctgctgttcagctgtgcttgctcagtcgtgactagtaatgcacatagctgttactgccattttgcaaatacaggtgttgccatgaatgtcatgaggacagaaattcatcaaacagggtttatgtcatttcacttgttctttaatagcactgagaatagttcacacataaaatctacataatcccttttatttgctttattgaaaaggctgtgttttttttttttttcaaactgcctcagttcactcatacacacatttacacatacatacaccttgcctgtaagtatcttataattatagattacaggctaattagggtgttatttatgcctgaagattatatactaattatatgttattatgggaaacctggcaaaagcaatgtgagcaatggctgtaaaattataagtggatgctgtttcattttatgattatttgtatcatatgaaataacaagtagccacatatcaaaccagaagggtgttgtgaatctgttacccatgtccttttaatattgccgagccctagtagtgccagaagcacagcttgctttggtttcaatgacagtggccttggaggcagagcagagtttagaattcatgcctatgataaagcaagtgcaagctgccttgtgatacgtcaggagatgccagatttggagtttggggataaatggtgaggaaggaactaagggtaatcatgagttactgggtaaaactgttagttttctaaccatggtcaacatcatcatcatactaacaaatactttcagaataaataataaaatagtagcagcagtttgtgcttcttctgtgccaagcactgttatgacactttcacatattacctcttcacacactcccatcagtcctgtaagtgtcattctatgaattataatctttttgttttagagatgagggaccaagagacagagagactttgaaccctagtcccacaaagcgtaggacaaagacaaggatgccagttgctcattctccctgggtttcttcccccttggcttgaagtatgtgacaacaaagcacatctctatttccttgcctccaacgtctagaaggggaaacacgtaacctgttcgcatccggaacttc

SEQ ID NO: 54275 - DNA, 1278 bp, Bovine  19866881540227
ttaatgaagtgaaagaaaaaacagtaaaacagagaagaaacaatcagagaggggaaatttttcaggaaggtggcaccaaattgcatctcctttcaatgatctgtaaatagtatctttgttgtcactaagttcttccaaataattctgatataaagcaaagtctgagaggtcctgaccaatccagatactctctgcaagtgtttacaaggtgatgacttaattacccgaaaggttgccttgcttgtctatgttattttattttatttttgtgtagacctgctctggactccagatttctaaaacgagcaccttggaggagttccatggcaatctccctggagacagagttgggattattaatatacttttggaaataacagctcttagacactgtaactcacattaatgtgcaatatccagaccgctcactctgcggatgggaatgcaatgtactcattctggtttattataaaagcattaaaatgtgctctgtgggttaatcatgatgacacttgcatctgttttggaggttttgagttgttttttgtgggatttaatcatactcttcttgaactttaccttctagaaataaatccaagactttgggggctggatccaagcaatccatgtcttcagcatatgctttttttggcatattagagcctgaatcaaaactcctttcagaagcatgaaactttatttaatcactgtgtacctattttttactagataccagggagatatgtgtagaccttgacagtgtaatctctcatgtaaacctcaaaaacaatagtgtgaggggaaggaaaattgtaattcaacaatttaaaacctgagaattttcagttcatcaatttaaaagataggaaaactgagccccaggtaggtttataaatcagttcaagtcattgaacagatttccatcatctttctactttactctcttgactcttaagacagttcatgagatgactggagtccacggttcttgaaaacttgggcttttcctctctatttctgtttattgatgcttatgtaatattgggttggtccaaaagttcattctgttctttgtgtgtttttttttttatagaaaacccaaacaaaccttttggccaacccaataattattaaatgaataattattttaaagtaaaaggccagagaaaagttcagttgtgaaacttaattctttggacattttcattgaactatgaagatatttgagaacatgtagcctgtcatatgtccctaatatcttcccaccactcccagtta

SEQ ID NO: 54276 - DNA, 2140 bp, Bovine  19866881573483
gtgttgtgtgcggtttatccattatggtacaagagatgcaggtgtcaaaggcccctacatccatcatgggtctcttttattttatttccaggtagataatgagcatcccatttatgctaggcacttctgttgatgacatactagttgccataaaatctggaaagtaagatcaattttatgagcaattaaatgggatctatcccagaggtaattaattttatgatggaggttgaacaaggtgagaggagagcctgttttagatgcattgatgatagggaggaataatggctcatcagctatgaaacagttccaaattacctggctttcgggtcattatttatatcagtattttaagtctgctgccctccctgtttgcatcaggaacagaaagagtattgttatccacagccttttagggagtgatccaaacttgctctcaggagcgtaatggaaaccggacagttacgaaactaactttgctttcctgtaagacagatgttctctgatccacagttgaagaaacaatgaggccatttatcagtgaaaggagctgcttctatctgaactcaggaaattgatagcaaatggctgagaaacaggttgttggcagttatgcccgagtagaattaattaatctatacattcactagacaaatatttattgataatattctgtctgtcagacaccatgctaagtactggggctataaaataaaattaatgcaatcattgggaagcttgtgagtctctgttaactgtgtttctccttgggatgattcaatttaaaaaaaaatggctcttgaataggtttgaacatctcaaaatccaagagtttcaaaacacatgagtaacgtggcttgcctcccatgttattgataatgcttgcctttgtcctcagaacggtgttcctgtcacagaaagagacaaatttaattgtgatcaccagggacagtgtagcattataaaaaatgccagaggacattctactcaccatagtttatcaaagctttactagtcctgcatgtcttctttatgaagctttctgtgttttcagagcatccaccccattctctgtgtcaccagggacatcagagccaaactaatctgaccctagttgccctaatgtgtgtgtgcttggtcgtgtctgactgtgtgaccccatgggccaggctcttctatccatggaattttccaggcaagaatactggagtgggtcgccatttcatcctccagagttgtcctaatacgagctttgatttaggcaagaaattgcaccttgatgaccctccccaccacaccctataacaagtctataattacaggtttttagtgagaagatacccaacccaatgtgctgcagggaagacaaagaaaggcttcactagactgcaggactgagacgtctggtggacaatggcaataagcacagctgtcttcatagtcacctatatgcagctgattccacgtcacccgttctccatcacctctttgctttcctttttctccagagggtttctcagatggtgacctctgatgtctccacatgtgcattatccttattgactctaattcctcaaggaaaaaaagtcctcactgtctgacttgctcaaaaagacatttataagattcactttgcctacaaagggccatctagtaaaatatatggtttttccagtagatgtgagagttggaccataaagaaagctgagcgctgaaaaattgatgccttttcattgtggtgttggagaagactcttgagagttcattggacggcaaggagatccaaccagtcagtcctaaaggaaatcagccctgaatattcatgggaaggactgatgctgaaactgaagctccaatactttggcccccctgatgtgaagaactgattcattggaaaagaccctgatgccaggaaagattgaaggcaagaggagaaggggacaacagaggatgggatggttggatggcatcaccaacttgatggacatgagtttgagcaaacttcaggagatggtaatggacagggaagcctggcatgctgcagtccacggggtcgcaaagagttgaacgcgactgactgaaatgaagattcactcttattagactaaattgggtctcatgtgtcacatcaaaccaacag

SEQ ID NO: 54277 - DNA, 772 bp, Bovine  19866882198225
tttagaagagataagtcctcatgtaatcgatcaggcatatgtatacaaagttcacattttaaaatcatatttggttctttaaaagtcaaagtgaaaagacaaattaatcggcttatgttctctgagctgtcaaaaagctttcagtatcattatcttcctgaataacagatctgtgctggagaactgacttcattgcagtcctaacactcatcatgcactccacttgatactaatttgaagtgtcatcaaatatttaaaatatatggatttttactctaattttaaaaacgagagagctgggatggcttcctaggtggcactagtagtaaagaacctgcctgccaatgcaggagacataagagacccaggttcgatccctgggtctggaagatcccctggagaaagaaatgacaacccagaggagactggtaggctacaggccacagggtcagacatgactgaattgattcagcatgcacgtagcatgcgtgagctgaaatacatcaaaaaacggcatcatttcccaagtttacatgactaggatgtacagatccatctgacctcaagatttttttttatttgatgtatgattgatttacaataatattgtgttaatttccagtgtacagctatatgattgagttaatcatgtacatatttttaagtctcttttccactgtaggttatacattgaatatagttccctgtgctgcacagtaaatccttcttgctctctattttatgggttttatctggtaatcctatactcata

SEQ ID NO: 54278 - DNA, 1170 bp, Bovine  19866880395976
atcgaacccaggtctcttcacctcctgcagtggcagtcaggttctttaccactagtgccacctgggaaacccataacgagtccaggtgtcccaaggaatgaacggctatgtaaactgccccagggtttccaaggcgactggggatggctgaagaagagaaaaagggaagtgagtgtacctgagatggagtcatggagccaaatggagtcaattcagcctcagctgagtaaaaggacatttggtcacgtcaggagaagagaaggaaattcacatctgttatcctcctgcagtgtgtcaggccgaacactcaatatccacagtcctgttgaatccttaggaaagcctggtgagggaaggagtattttcctcattttacagatagaaaactgaggtccagtgcagtaaactggcttgcccagggtcatcccaccagtagaagacagggctgctggacttaacatctgggttccttccatgatccccacttataaacgactgtaaaaacaaagggataagcagagttctaagacaagctaactaaagcaattccaaaaataactattacagaccaagcaagaagtttcgtttagttctccaagttctcaaattgaatttcagcaaggcttcccttattggacctgagttgtaagatcagtacattttctagagtgacatcttggagaaggggatgggaaagaacgcttgggacaattaataagaagaccctccccccaccatgccttgcccccattaccagcttacctttatcagaagatgagaattaaaagtgatgacacaccagaaagcttacaggatgggaaacctaactcaaagcatcagtttcgattctatgtgaaccatcggctctctctctttactctttccatctggctttctggtctttcatgattgggtctttcctgaaggaaataactcccaaaaggaagtagaaggctcacatcaagggaagatacaggactgaatgaaagctgcaggggaagaagatgagccctaaactgttggtgccaactgcttttctctcacgtcatcttgatgaagtagattgggttaaactactgttgagtcttgttgggggtatgtggtcatgggcaggagataagagaggagttaggggttaggagagaagagctccctcaagacaataggcag

SEQ ID NO: 54279 - DNA, 1081 bp, Bovine  19866880401139
ggagggtggtgatggtgtttataaaaattcccttgagtatatgaatatagaactagaatccatcaagtcatcagtaacacccattggctagctaaagaaaaaaatcatgggacttctctggtgatccagtgactgagactcccagctcccagggcaagggtcccaggtttgatccttggtcagggaactagatcgcaaacgccgtaactaaagattctgcaggctacagctaagacctagcacatcaaaaaaaaaaaaaaaaaatcatgtcagaaggggaaacagtctatttttattgggaatatgtttgctttacaatgctgtgttagtttctaatgtacagcaaagtgaatcagctatatatacacatggatcccctcttttttggatttccttccaatttaggtcaccacagagtactgacagagttccctgtgctgtacagtagctgctcattagttatcaataaaaggggaaacactctttacaggaaaaacgatgaggatctacaaaaatcagttcgtgctttaagagcgagcatcatacaggaacgtgcgggccacatccccaggtggaaggtattgctcctgtttatggaagctatacatccaaacttgaatgtcaacagactaggtgaatcaattagtggctgaatgaagcaattgaaatgcatccaacttcctacttggaaaaggcaataatgtttcataataatgaatgttaataacctgtgatggtatgtgatactggccagtgtcaaagagaagtgttttgtgtgtttttttttttttttaataaacacatagccacacatactgtctcacacacacccataagggtttgtgcaattcaattactttaacaggaagtccctccatggaaaaagtaacaggaccaaagacccatctgtgtccaaggcaaatcaatggtgatctcaatgggacctttggagagaaatgaaccatatcatggagttaattggctaaagccagttacagagaaacgctagtctaacttctctggggaaggaaatgttaccctgcccgagttttcattatacgtttatgaacacactaagaaa

SEQ ID NO: 54280 - DNA, 908 bp, Bovine  19866880455661
ggaagcccctgagcacatactaggaccctgctttaggcacagctgacaaaatagccttccaggagttcagcctcaagttccccagagaattgaatttatcagtaaccgtcacataaaatgtttgctcactctttcagcgcctggtgcttccgagcgccttgtctgttctgtctgatgggtacagtgcgccacaagactgttctacaaatgacatttggcctgaagttccaactggcggttagatagtaaaatataaacgagaaagagggttttccactgatcagttcaatttcagtggttttaattttcccgtcggaacagattaatagtagaatgaatgaacaaattgatcagagttttgtttctgggatattaaagtctcctttctttgattcccaagcaaattcttttagagagtgactcacttaaaatgactaatatttcaaaagctttctttaaaagaaattcttgcctctagttttataccagatttcagcaccagaaagaagatactaagtttgaaaaatctttcctaaagggaagttgatgggagttccctggtggcctaatggctaggattccaggctttcactgccatgacctgggttctatccgtgggatgaaatagatttctcacaaaccgcaccccatcaaaaacgtgaggttgtttaatatctcaagtatatatacagatagaatatatgccctttgttttagaggaagtttagggattttgctgcattaaataagttgtggatttaccttaggaaacagctaaattagatttttgcctcctgctttaaatagcaaggcttttttggtgaaaggacaggaactattaggttttacaaactcagatcaacgtgttcaggaataaagtgtaagagtttgcagggaagcaagaatag

SEQ ID NO: 54281 - DNA, 1441 bp, Bovine  19866880522905
ataaataaatattaaaaaataacaatcagtttcatcagattgcaataaaaatacattaaatgatttttttaaaagatttgtaaatgagaaataagaaagacttagctcatttatatgttgaatatttagaagctttcttggggggaaagcaactggttgaattgaagtgatctgagttttcaagcacagatttagatgcctcagtccatttaagctgctataacagaatcagttcagttcggttcagtcgctccgtcatgtccaactcgtccatgtgaccccatggactgcaacatgccaggcttccctgtctatcaccaactcccagagcttgctcaaactcatgtccatcaagtcagtgatgccatccagccatctcatcctctgtcatccccttctcctcctgccttcaatcattcccagcatcagggtctttgccaatgagtcagttctttgcatcaggtgaccaaagtataacagaataacatagcttaaaaatagcaaaaatgtattcctcccggactagtgcctaggaaatctaagatcagggtgctggcatcagggtgtctagtgcaggtcaacttcctggctcacagacggctgccttcttggattgtcacatggcagaagggaggaggagctcttcagaacttctctcagtagagccctaatcctattcttgagggctctgccctcataaccttttcacttccccaaatctccgcctcctaacattatgcatcaggggttagaaattcaacatatgagtttcagggggacatcagtgtacgatagtggataaatcacttcgtatgtgtgtgtgcgcatgttcgtgtacttgcacatgtgttattcacttcctctacaaaactctccttggaaatttcacttgcagctttgcttactatgaattttctatacacttgaggattaaaatgtccctgtttggttttgcttccctgttgctttcccaagtacctgggtgtttgccacttctgctatgaaagcattagaaagctggtgctaatgcagataattcaaatactggctgcatattttcaagtgtattgttttggagaagtttgaaggtcaagggtcagtatacgctaacatttgtgaccctgtggaccgtagccctccaggcccctctgtccatgggattctctaggcgagaatactggagtggattgccatgacctcctccaggagatcttccccacacaggaatcgaacccatgtcttagatgtttatatgttgctatttataatagagaagatcaagaagcaagcaaactgtagcaatcagagaattaatattaaatatactatggcacatcatttcattagaatttatatagcaactgaaaaggataaatatggaggctttgaaggctttaaaaagtattcatcagcccacaattaataaaaacagggaaaatgt

SEQ ID NO: 54282 - DNA, 917 bp, Bovine  19866880527165
ttctagaaaaactaaccgagagactttgtgacatcagatacatagggaggcagagtagggtgaaagtctgtactctaagtgagtccctctccctgccccctccccaacctagcctcagaataacagaccaggagatggaaagattcttttctgcagaaactgacacacaccaggaaaaagacctacacgtattgacatttggaggctcctggtgaaaaagcccattgtcgacccagtcttcctagaataaatcccattcatgtatactggacttctagtcagctttttagggtctcatccttgagtggcagtcaaggatcccaggtgaggaaagcatctgacatgacagagagtaaaataatcaaacaggaaaacaaaaggatctatgaagaaagcagaaacaaaagaatgagtagagacagtgaaagtaaattatatttggtatctttagagccataagagaagacatcataactgcaggatgtgaagaaaaagaaacaagcaaagtaaaaaagaattcttggaaataaaaaaactaacaagaaatttcaaaaattctgtagcagtgttggaagatatagttaaggaaatttccctgacagcaaagagagagaaagacaaaaggagaataaaagataagaaaattagaggtgtaattcaggagattcatcatccaataagtagttttagagaaaacagaggaaaataatgctaaggaaagtatcaaagaaataatatgaagatacccttgaaccaaaggataaaattcttgatgaaaatatccagcacaatagttgaaaatggacccagaccaagatacattactgagacattatagaactctaagagtaaaaaggagccctttagagttttcaaagagaaaactataaagtttacatacaaaggatcaagaatca

SEQ ID NO: 54283 - DNA, 625 bp, Bovine  19866880528365
gagagaggtagaaaaggtaatttatttaaggattaaaagaaaagtaagtggttgatactgggttattatgaaaaagaggatgtttgggggagtatattcttggtcatagaggctgattttaaggaaatcctttctttcccaatacaagtctgggggtttgggtcagactcaaaactgtttcagtctgatgtagtacttggaatcacagcattgcacaattcctgtacacacttttcccacaaaatgcagcatggatccttgaagctgtgtgacgtgctgatttatggatatgtctctatctgtatttttgagaagtctttagccattgttggggggggggggtcataaattcacataatcactgaagcaaagcagaagccatgatcttaaatactatttgttcattttatcacgtataaaatggggatactatttttggctcacagcgttaatgtcaagattaagtaaaagagttaatataaagatttctacactgctaggcaaatagtcactcagtcgtctctgactcttgctaccgcattactgtagtccacccagctcctctgtccacagaattctccagacaagaatactgggagtgggtagccattctcttctccagggg

SEQ ID NO: 54284 - DNA, 772 bp, Bovine  19866880651368
catttaatccctatactgtatcgggttgggttttttttttttcctttgccattacatgaggcttacaggatcttagttccttggtcagggattgaacccgggccctcagcagtgaaagggtgaatcctaaccaccggactgccagggaattccttatcaggttaaattttaacaggtgaagaggtctccagcagggaccattagatcaccctgaatgaaatctcagtgaatatataagtcttggtttgttccaaaatgcctttgggtaagactttcaattctgtcgatcttagctgaacctcttatgagttcaaaagaagcaaacactaaatctggctcaagaaaccaggctgtatgcgttaagcctaacctctgttgacaaaaccaggcagaatcagatgtcctggtttggtaaagaatgaaattttgctggaactctgctttttataatcagcattgtaagctgaatggaatgtttagagacaacttcaatatttaactggcaaatatcctgagtggtagcagaacacggaaaaccctttgtacaatagctatgttgtgtgatgcactgatatccatgagacttccaagctaaatttcgtgttttaaagcagttgttactttagcggaaatcttgaggttaaacctaacacttgtgatagttttcctgcttgaccagaagcctccttatttattgagcatttgctgtccagctagtagagagcagtgcttcatattgcaggctcctactagttctgtcacttcaggcggg

SEQ ID NO: 54285 - DNA, 1416 bp, Bovine  19866880651948
agcccaaagcccataatacacatagtgttttcatcatcatcaaggtcaggttggtttctgcctcccagctggggtggtcacagggcagcgagctgcatcagttgcctggtcggtcagaacaaatggacgggtccctctatccctctctccctcctgctcttccttcctccctccttccctccctctcttccttccttcctgttgagttggggaagggatggtttaccatctgccaaacattgggccaggtgtttgggaatcctgtgggaacagaggtcctgtaggcttctgagtcccattgtggggagaatgacatgacaaccagacacaacagctgtgaggaatgctgcaaaaaaaaggttcatgggggtgtcagggtgaagtgattgatctgggaggccgagatgagcattctggaggaagtgatgcttgagctggtattttggaggggtaaaaggtgaggaggtgggtgggggcagcctaggtggagagcagggattatgcaagggcccgatgggaaaacagcagagcatggaaaggtgagtgaggggacccagaaaggaggtggggctggaggggaaaggcagggcagagcacagacactttcagagccttgatgctcagagcccagggaagtcttcaaagggatggggctgggagtgacatttggggaacactggatgcatttgcgggcacccgcatgggcccagagcctctccaccctccccgtcaagcagcatcgatgcatagggacgtccccagacacagctgtcaagcaggaaaagtgaaccaggaaatggtggagctgggggcagggcagggcacagatggtcggagagtagcgttctcagcaccaccttctcaacctagtccgcgtgaagctcaggccccccaggtctgccttctctggattctgcacacacacccccccaacccccggagtcagctgaacatcttagcaggaggcttccgtggccgcctctgccctggttacacggcaggtgctgtgagtcacccacctgcgtggagagtcaggggaagaggtgagaacgtgagtgctgggaaggctggaaaagcaggtgggcgcttggcagaggcccagcttctcggagctggggctgcgggggtggggagcagcccctcccccgtggccctccccgcagaagcctctgcggagaaaccttgggtcccatcccccgcaggatgcctctccccggcttccctctcccctcgcccccaccctccttctccctgggctggctgtcagcagactgccaccatcaccatggctacgcctgctccagctcgcagctccagaatcagcaggagtcagggcagggggagggcggctgggctcattagtcgtcttattgaaccgaattcttctaaacctgtcttgtggctgacactgcacat

SEQ ID NO: 54286 - DNA, 930 bp, Bovine  19866880667150
ttttagaaggggattgcttctagaacagttctctaaataagtaattatcaaaggggcaccatcctcatccaaaccatgtggtctgagattggaaggggacccaaggaaagtcagggagttgctgcctaaggaaggggtactgggtgctcaaccggcagaaacaaaggatgtgtgagcattggctcatcagtctagatctccctttagagacaaaaaggaagggtatgtgggcccagaggagccgacaactccaatgtagaggtccttcatagctcttgcacctaggaagaaattttaaaagctgaaatatcgctggcagttactattaaaggatttacttgttaagttgctaaggaagttacagaaacagatggaccatactacttaggagatgaaatctcaagagttcctgggggttatggggccccatttccatccctccctcactccatctggactttgatgtgggctgtggcaaaaataccaccactcgccagcagaactgcagagtttaaaacacgataacttcacattgctgcactgatgacatatctcagctaccgtcttagatgtcagctctgtctgagactcttgccttttatccttttatggtgccgggcaagtagacacttgctaaatgaatagaagaaaacatgaacttgtaaacaagcaatggacatctattatgcatctgtatacaccaaactcagggctggttagtttcacgtgtaatttaatttaatctgcataatattcctgaactgattatcagagtggtatcttcaaggaatttaggctctagtttagaatataaatcataatggaaaaaagttacatgtaaaaataatagatagtggtattggtataaagataggtatatagatcaatggaacagactagagagttcagaaattgtcctacacatatacg

SEQ ID NO: 54287 - DNA, 975 bp, Bovine  19866880688438
ataaaagagaagttgcatataggttctgattaatttatcatgagtgtcaagtcttggctttcagggtgagagtaggggaggaatgacataggtgatgaaagtccacagatagcacgaacacccaaatttaaccagcaatttcaaatcctcctccactaaaatatttttttcatttttcattagaggtagcaaggctcagcccaccttttatggctggatctaacaatatgtgaactcatcagaaggcagtcaagtgggtgcaagaggaacagtgagaattgggcattgttggcctttctgaaattgcaagttgaccactcttcttcactctgttggtttcatttagaagcagcaccagattgaactgcaaggagatcaaaccagtccatcctaaaggaaatcaaccctgaatattcattggaaggactgatgctgaagctgaagctccaatactttggctacctgatgcatagagccgattcattggaaaagaccctggtgctggaaaagatagaaggcaggagaagaaggggacgacagaggatgagatggttggatggcatcaccaactgaatagatatgaatctgagcaagctctgggagattgtgaaggacagggaaagtctggcctgctacagtccatagggttacaaagagtcaaaaacgatggagtgactgaaccacagccacatcagcaatgttggtttaaactgggggctgtcaagcagaacttttagaaagacccactccctctttgttcatcactaaaaagcagctcacagatagaggaccctctgtgtaaaatgtgcttgcagtgactgcaggcaggatgatgtgacagagcagaagctgagctcccagagcagaacctccaggctaaactctaccagtttgagcttctgatatactcagactcaacccaacctgtaaccgtcaccatgcagactgccttaggcccagcccttcccaaaagcc

SEQ ID NO: 54288 - DNA, 1110 bp, Bovine  19866880709031
ccctgtttttagtgatgggaagagtgagacctggagaatttaagcaaacagcacaataattaaaatccagacagagtaaaactcctaaagacaccttcctattactcagtgttgcacttctcatgactctgttttaccacacgtgaaaaattaagtcatggaacacccacattggaacatctttcccttcctgtggcttgagttttgttctgagttttgtgtgtttctgaaacatttctgttggatgtgtgttttttaatattgtaagcccgcgcaaatccttgatggaaacaggcacaccataaagcacaattaaataaaaaggcagcagaacacacacagcgatcatggaaatgactccgatctccgtctggggtgggggctgtgggtgttgtctttgtggctggcagacagaaggttgtctgaacttggttatgagagccagcagagtgagcttgaagagaaagataaacatacaacaaccgttcaaagcttcaggtgttatgattgctatttgggaaagactctacatgatacccgctggtgcgtaggaatttcactcccagggataagtggctcagggaactctgggactctgctccttcagattttcccgtaatgagaattcagaacaattgtgtgctcgctcatcaggagcgggcgtgcctcagagttgaaacccagggcagctaaagctgctttatctctaaacaccttcaggtgggctcttcatacaagcaacctctctctctcactttttctctctctctctctcacacaaagtctcagacatctgacacacaacctacattctcacgtgcccccagacacatacacccttgaacacattctggctgatgacacgcttgctgcctatgtgcaaaaacacacaccagctcacgtaacactcacacatccacacattcacacgcactcatactttccctctctgtctctctctctcacacacacacactcagtctctctctcacctgcacgacatgcttctggcagagcacccgcagctgtactaacctgccccgcctttgttcccaggcctggcctcagcagcattttcccaggcccaggcttcctttaactgctgcttcc

SEQ ID NO: 54289 - DNA, 1977 bp, Bovine  19866880935848
atggacaaaagggcattccaggtgaacacagactgcaggagcaaaggcatattgaaaaaaaaaaaaatccaggcttttctctcttccattgcaccaacccttaacaaacatttttccagcgatcaaaccgctggagcctgtgcttgtaatcctctactgtgacatctctgtgaggcacggctctcctgcctccctcccttcatctcttcctatcctgcctcttcctgcctcgtgttctcacgctgtctctccagtgtcttttcaaccttctaaaatgaattccttgacaaacgcttgctttcagcccggaagaggcgttcctgcagggatctttaataacagcaaacacccggagactctcacaccttttttaacagaccttgttttgttgttcttttccctccttggataccagaagcttaagaagaaattaactcaagaaaaaaagaaaagaaattacctcatcacccacacaggcagatcttgactgtaaaagcagtctttctgacagacacttctggcgcccggtctccctgattaagggcagttttacacaccagcaccctgacgggggaggcgaggggaaaggcttggagggtgggttccagggagaatttttccatcttcagaaggattattaaacttggaacttatgtttctccatgttaatcattgagattgaaggcaagaattctgtttctgatgagaatgtgtgcatgtgtgggtgctaagtcacttcagtcacgtccgactctttgagaccccatggactgcagcccaccaggctcctccgtccatggggattctccaggcacgaatactggagtgggttccgtgccctcctccaggggatcttcccgacccagggaccgaacctgtggttcttatgactccagaatggcaggcgggttctttactactggcgccacctgggaagcccctgatgagaatggtggccaggcaaagggaagtcatttcaagctccaggaagaaagcctgccttgtgcctgcccgtgtggcgtcaggcccactgatctgggcggacaacgccaagctttcccgaatgtccccaaagggcacactcaggtagcagggatgttcaaaacgtgtctgttaagcaaatccactgaccttctgtgaagactctgctgtttcacgctgcgcagtgtgacttggagagactcctgggtctccagttagaaaactgcccagttttcagttatctgtctttttgtcttgtcctttacttttgattcttacctttagatttgagtgaggactcctatgctttttgggttgaatcatgccacgtcctggaagaccactggccctgatcatctccacaaagtctgtctctgctctggagaactgacactgtccctttcataatatcttcagctcagtctagacagttctcaaataatcaaatgctggagagaaggcagagctcagggtgaagtagggagtcagcctaacgatttctttgttggaatgatcccttgggagtcgatgggagtggaaatccaatttagggaccacagtccttccttggtgtctattcaattccattagaaattatcacagcaaaatcatggcatctcagcattaagaggatctggaggtgttatcttagccaagctcagcatcgcacaggaatcctccagaagcatcccagctggctactatcgctcaaataatcagacatgttctctgatggggtgaaattaattagagaagtcttccgcagactaggtgaaaactaaaaatctgcttatgttgtagcttatatgcatggatactaatgcctgacatacatatccataacatttgtgtggactgaccaactgactaattaaatgaattataaaatggagtaaattggcaaggaggcagaaaggggaaggaaggaaagtaattgcagtgatgagaggcagtgggaaagggtgggggaaacctttttctttaaggatttttttc

SEQ ID NO: 54290 - DNA, 1241 bp, Bovine  19866880955955
ttaaaaaagttacatgactttaagagtttagctgcatttcaatcccagaacaaaaccacttttattttcctgcacataaccatgaaaggatttgagggtactgctggggaaggatctgtttatggattttcgatctgaagttgaaattagatgtggttcttattgaactatcaagacatgattgcaaggcacgtaactggtgagtggcttatatgaactgggtagaaatgaaggtgtggtcacaaaccgcacgtatgtctcgcacagaactaagctctcgtaaccactgcttgaactacaatagaaaatttaaggagacggaatggattacggtaagggctggcaaacgccttccataaagggccagacagtaaatattttaggcttcgtgggctatacagtctctgtcacaattactcagctctgctgtagcagcaagggagcagccgtgggtgatatgtaaatagatgtggccgtgctccaataaaattttattgataaaaacaggcagcgggccagatctgtctcacaggcttaagtctgctgacctctggattgtagcctattaaactgaggtaaatatggatgcagtccttagatatcacgatgtctaaatacataggaatagatttgcttctccctggggaaacagacaaatgcaaaaccgtattaatatctatgttctcaaccatttctatctatttacttagccgaaagtgttaagacaattaggaaaatgaaagttctaccttgatcaattaaggaattaacctttttttttttttttccaaatctttcttcttttatcacacgactaacaaatgtgtactgagggttaaacaataaaactatagacaagttcacacaagaatataacaagagcttttaacattctcagcactatcttccaaactttgtttttacaaacatgagaccaaaatgtgtacagctttattttatattttctaactcaacagattgagcttttgttaaatgaaaaagcaacgtacgcagccataaaaaaggggtcatttgtcgtggtgtggatgaacctagagtctgtcatacaaaacgaaggaagtcagaaagagaaaggaaatatcgtatattaatgcatgcatgtggaatctagaaagatggtactgatgggacctatttgcagaggaagaatagagacagacgtgggagaatggtgtggacacagtgggggacagggagggagggccgagtcgagagagccg

SEQ ID NO: 54291 - DNA, 1157 bp, Bovine  19866880956796
aatgcacataaagcacaataaagtgaagtgcaataaaatggagtgtgccactgcagggttaggacctcagcctgtgaatttaggtggggggcacagttcagcccataacaccattccctcctcattccggcaggagacagaagtgtattctagacaaactgaaccaggaagactgcagacttgggtgtactgagggaatcatcaggactgaggcaccggacctataacagggagagtttgtgaaggccatatgctaatcagtgagataccatctcctggtttcctccacccagcccagtgagccaggaaccaagcttatcccaccagcagccacgcctcccctcaaagcaggagatcagaagatctttctttggattaattgtaaggtcttagagaaaagatctgcagatactgatgtgggtgtttcccaatcaggaagaaagagagagtggggggagaaagaagaaagagaagaaagaaaaaggagggcgaaaggaaggaaggaagaaatgaaagaaagcaaggaagaaagaaaaaagagggctattctctaatacatctcctttcaacaaagtccatcagtcaacaagtcctaccttcatacagagagtttctaaggagctctttctgccacactcttgaatatagataagaggttaggggtcagacatttgagaaaagcctccaaaatgaagacttgaccaacatgtaactaaaagagtgattttaagaaaaacagatggtacaaagatggaataaagattatataattaaaatatgagaaaacattgcctccatgaaataagaacagctactatttatttttaaaaaatttttaatggaatgcttcatgaatttgcttgtcatccttgcacacttaccatgctcatcttctctatattgttccaattttagtatatgtgctgccgaagtgagcaccagcatactatttaaaagcaatgaaacaaccatcagggagtcaaaaagggctcatagacattaaaatatcaatatgaaagcctaaaaagaggctaaaaagaaagcataaaaagagccttccacggtatatttgaagttagaatctaggaaatctcccatacagtagaaaaaaaacaacaaaatagagagtaaaagagaaaaaaaattaacaattgtaa

SEQ ID NO: 54292 - DNA, 950 bp, Bovine  19866880975425
cacctgtactattaagtcttccctgggtcctctctacatgcttccttgtggttctgtgggcaaaagccaaaatgaggacaggaataggagacagatagatgggagctgtacccagttactgcccccaggtcctctgctccccgggccttgacaacccaatgtgatgtgtgaacgtgccccaccgaggatgctggacagtgatgactcaaatgtacccagaaacaggaggcttgccagacatggtcagctggttcaccaagttcacaggtggctgggatcgcctgccgccaccgtggaagccacagacaggagaataaagtcaaagtccctcctgcttggagatgagtgttgccttgaagcttgttatataagtgagctggatttccagcctaagggaaagacatgcacgagaacccgcctcacagtgggtggggattgctgtggtcatcctggttgctgacagaccccttggtaaaagcaggcctgtttctaaatctactcccaccttaccaactgtcctagccctctctgagctcagggccttagctggcactgcaatctctggtttacacaagaagaaactgaagctgaggccttttccaaggtattcttccctgccttcacttccggcaattattataaagtacactcattatctttacaatggtttggagattaaagcttaatttggtctgatatttcttcagctttgccttaatagcatttgtagctataccagccccactaggctgtgaagccaacagattccttaaatcaccagaggctggagtttgcatcctcatcttggttcctattggtctggccagaggcacttttcatgagaacattttaatgggtggtcagggttttctgcagggacagctatctctgtaacaggaaaaatgagattctcttaagagaaaagctggcctgcaggaaaaatgatcagg

SEQ ID NO: 54293 - DNA, 1363 bp, Bovine  19866881102130
ttccttcagttcggttagtcctcagtcgtgtccgactctttgcgaccccatgaatcgcaacatgccaggcctccctgtccatcaccaactcccggagttcactcagactcacgtccatcgagtcagtgatgctatccagccatctcatcctctgtcgtccccttctcctcctgcccccaatccctcccagcatcagagtcttttccaatgagtcaactcttcgcatgaggtggccaaagtactggagtttccgttttagcatcattccttccaaagaaatcccagggctgatctccttcagaatggactagctgaatctccttgcagtccaagggaccctcagttccttaggtgtcaataaaagtgcttcacaatcatgatttagaaactgcaccaataaggtcttcccacatttacactaaaggatctgcttatatttgtattaagtatcatgaattgtatggagccttcacttcaccggaacaaaatgaaaccccaggtgacttataatgaagcttttccatcatcctcagactcttgaagcctgctggaaactggtgcagcacagaactgaagttacagatctctgctgcttctgtgatttcctggcagaacttccttgctctaatgtctctgactccagtcaccatctgaaagtcctccccagaggtctgagggcctcacctcctatgtctggtgctgctgctactgctaagtcgcttcagtcatgtccaactctgtgcgaccccatagacggcggcccaccaggctcctccgtccatgggattttccaggcaagagtactggagtggggtgccattgccttcggtacttaattaaaaactactcgttgtcagaagcaagtaggctctcaattcctgcttagttaacgtgagcctttcagttttgagatgtgttattctacccacatagcaggtgttccttaaatattttgtcaacggggagaaagaatgaatgaaacattcaaggagagatggggtttgccttttatgagattagagtgaaggagcgcatttgctggaaactgtccccagtgagtgaagggatctgcttttggttgcaggccactcattctttccatttcagccatcatgcattgtgtacaccatccatctctcatcttgggagataattcattccaggatttagaatgtcactgaagacatctcagcagggaccttttatttgtccacaacaaggatcatctgggggatgtgctgttccccatggcagagacccagactcaaagggcaatctatcacataccagcttctcagcatcaaaaggagtgaagcaagtcagaaagggatttgggtttgttgttaagagtgaaactgggcag

SEQ ID NO: 54294 - DNA, 1709 bp, Bovine  19866881103498
ccctccggcctctcccggcagagagaggtgtgttcgctctcccgcccttttcagtgctctttctgcggccggggccgagctgaactacctccaggcttcacgtactggaggtgcacgctttacagagagaagcccatctctgaaagcacagcatgcattagcatcctctccttcagagagagctatttttgtctttcgtcttccgaaactgttccaaagttggggatgcaagtatcaggaggagaagcaaaacgagccagcgtctcccgctcagaagagagggaatcactgtcgtttcctcaacaacataacaacaactgcagcagcagtaatggagaacaaactgagttgcagccgagctgcccttgggcacaggacaaccagcctgcccagatctctttctgtgggatttctttccgtacacttcacaggaatgaggttcgttgccatagttactagcaaatcacatggtatagcctcgctccctagaagtgccggagaacagcaggctcagactgtgatgggggggagaagatgccttcctccccagcatggttgcttttcctgagcaaacctgcgcagcggtttccccgttctgacctgcccacttaggggtcagggccagctgttctttggggcgccaattcaccgttttcctaatgagatcagcagcgcaagtttcctcatgcacttttccttctggtttcaggaacccctctccccctctccagtccctcccttttctagacacacacacacatacacacacacacacacacacacacacacacatgggtgatgtactgaattgctgagttgattgcggggtggagcgtgcagcctacaccacttgaataagctcttttaaaatccgaggatggcatgagtaagggaattttgaagctgtgatacaatcagtacactgatgcctcaagggggtggagggagggagtatggactcgcccagatcctaaagagacccggcagggtcgcctttcccaggcctagcctcgatggggatttgtgaccctcaagcctcagagttacggaattgggttcactctgaccaagtctggtggggtgggggtggggcgtggccccacaattgtcgccttccagggaagagaaagccgtgccctcagagaaagctctaaaaccacaaagctctttacctctgcgcttccccctccccccttccttccctacagaaccaggccagttagctcaagttccgtgtgcaggagcaggctagaagggcacgtctttttccctgacaattacagattgcctacttctttgtgttcagattgtatctgatcttgtcaattccatcagattttctggtctgctttccccattgcaaaagcaaactctggatgatagaaacacacacagaagagtcagcaggtagcaaaagcaggaccgagaagggactctgcccgagttaggcaaggtggtgcagaaggcttgctcagggcccctgcctcaaagagctcagtgtattcagggagaggaggcaaaggtccctctcaaaggtccctaaccccatgggcaccatgagactagggccagggccaaggggaccagagggttctaaaatgaaggggggcagggatgcaccctagaggtatgtgaaactctattcggtggggtacaagaaatattagaacgtccatttattttatctcttctgtgctatatgtattttg

SEQ ID NO: 54295 - DNA, 2891 bp, Bovine  19866881272825
atgtgtgtcttactgaacacatgcacacagagtgaatgtatgggtttgtgtgctgctcccaacttcctttactggcagccagatcaagtgacacctgagcttggccctctgatgagaaagcttaaggaagctgttcaaggacagcgctggagagggaggaggtcagctctgtgccaagaggactttgatgggagggagctgagcaaacccacgggggccaccacccacctgtcttcctggaccactcccatgagtgctgcccctccctggggtcgtgtggggtttccttctcttctagtccaagggaggtgaagagggaagtggtcaggcagagagagggagcagccttggagtcaaacagactggggctgaaattcctgctctgcctccagaccctaagagctgtgggtgagctccttaatggattcatccttggcttccccatctgatagaggaatgtgctatgatacctagcacagaagcttatggggaatatcaaaaggatcaatgcatcttgaaaaaaaaaaaaaaaacctatatatagcactctgcacaaagtatatgctcaatagatgatattattgttccactgaaagagtaggatcaccatttctttcttccaggttgccactttgggtcagattcacagctctcagagtggagacaaggcactactggaggtttgtagaagctctttggttcaacttgattagatattagggtacttcggaagccgttagcaagaggccccagggttgggaagagttaatgtaccagaacaatggcaactgttgtcaccgggaaatcagctctttggtttccaaaaggaaagcagaaaagtccctcttacccaacaaacccaactcaacactgaaaattctgactgcagtcaaatatgcctcttttaaaatgaaacactacacctgcaagcatgaactgattgcctggcttttcaagggccagaaagtgaaataaagaaacgaactctcaatagggagccccccgcccccccttccccgttactgaggagaactgagtcagaacaatgactgagcggctgggaggccacctgccttggaggcgggaattgagtcaacacaggccctaagcaaacagtcgggctttagtgttctaaatcagtttgaacagtggttaaagcctgtgggccgaggagccctgaaaccctgcacacatcctctattaagtccgagccaatctccccgggccgacgctgtgtttactcagcgtctttcattgcaaaatggccgcccctttagcggggtggggcgggggactgagcaaagctgaggagaggggcggtgccctgagtccgccgggcgctggctgccctgcctgctgagaaagcgtggactgcaggtccctcacagagaaggcttggggttctataaccccaataaagtggagacctgaggtgaagagaacgcaatgcaaagacaaaaggcataaaacacaccctgtcagcgagaggccttgtaaatagctttcaagattctcttccaaggtggggaaaggacttgagagaaagagagcgtgtgctcaggttcctggtcgctttggaaagcaggtctcacccttggccagcaatgcctctccgtctgccacttccgcaccaagaggtcttgagagtttgggcagatgagaactaaagaactttgggaatgtgtcctaaggtctcacacgtgaaaaaggacacgatgtcgtgtccatgcgtgaaccatatttatggcattcccaagaggtagctttgtcatcgagaaaagctggaaatattttcttcagggtgagggggcggggaagggtggatctcataaaccctagtcgcacaacatttcatgttttgcagcaggaaggaagtgaggaggagacaacaggccaccagaggaggcagagagcccatgcaggcgcaaggtgcttttccacacagacaggcttggtcttcagtgcatacctgtgtctcctggcgacctgactcccaccctgactcacacacagtgaggagggctttctggggctgagatataagtggacaatgagaagtaagagggtattaacacccacgcccaaacttccccaggcctggcctcctctaaaccttccggtgttgcaaaatatcttcttcctcccttcttccatcaaaatcccatttcttcagtacagtggttctcagctagaagggattttgcacccaaaggacatttgtcagtatctggagatgtttgtagtgattctaaccagggactggagtgctaccagcacagcatcccctgtaagtagaggtcagagatgttgctaaacacccgacaaggcacaggacagctccccgcatcaaagaattatccagcccaaaatgtcaccaggactgaaactgaaaaccttgctggcatgtactcacatcagagctgtaggactgaaaagcatctatttgaactgattcacaatgtggtttgaatggctgataatctacgtataaccttccagggtcagttggtttttaaaagaggttttcactttttggcaagcattcatatggtttaaatacaaatgcaaaaggaagagaagacttttgagaagctacggggagcaatgttttatacatatgtgttggggaggccctcctggctattccttcattcttatcatgaaggcatctacctacttgttccaggggtagaaagaccagtcttgtgcactcatcctggcaagagctgaaataagggccacgtcacaaaaatacaaagacaagtgttaacaattccactcaggtacctagagtagtcaaattcgtacatatcgaaagtagagcggtggttgccagggactgaggggaggggcagataaggagttatgtttaatgtgtatagaatttcagt

SEQ ID NO: 54296 - DNA, 1318 bp, Bovine  19866881273021
tcaggtctccttctttcccaactgggctataagggaagcccaatagaactgcttagtctggagaaacctgaactgattgcaaggagcagagttgcgaagatttctggggagattggtggccatcttcacatcttcacagatcttgagggttttgacagaacacttgtgaaattgcctcttaattagcatgtaccaatggggggggggggcgctgttgagtggcaagggcgtgggctgtggcaaggccatggccaaatgattggggcaaatcctctctgtaaagccctgtagcaggagcaaaggctctgcactcacacaggcctgggttctaagctcagctgttgggcgagttgctgagcctctctgtgccttggctccctcagatccaaaatgaagaagctaggctggaagactcaagaggtacagtctagatagaaaacttcttggtactaaaaatgtggcgtatgtgcatacaataaacaaatggaaactttaaggttatcttatttggattttgctcctgaacctgtactaatattggtgatgagaacagccagcctgcttctgttgcactccacgatgccatgtaatgatcggaaagagctgacatgttcacaaaagcacttttctctgtgggtaggagtggaaaatagtcccatttagctgatatcactaatttttaaagaaaaccatatgagctaaagagaactgaagatgaatgtgggagctatgagtcaaccagtgaatttcaaccacattaattttacattataaatgacacagttttaaattttcttagattttataaaacgtgatttttcttttaaaaagctcatcaagatacatgtcaatacatgttaaaaaaaaattactgaacatttactcccatcctaacacatcttcaaaacaatgactatgctcttagctatttttaatacaaaatccattttctagcagccttaaaaactgaaagcaatacgttttgtgaaaactgtcttttaataaaaaatagtctttgttatccttgtgtggtttttctccttttcaaattgtttcgtaagagataatgttgcttaaaaacatccagcatttccattagacaggatatattcaaaaagcttctagataagccacgtttatacatagttcctttaatcttagatatctaatttttaaatagcagaaataagaggttgctttcctttttgcagtagaatcaaagtggcattacaaattttcaggtagagaactacaatataaggcctagagattatgtaagaaacatccgtgcttccattctcacctcaaagcaaaacaa

SEQ ID NO: 54297 - DNA, 1851 bp, Bovine  19866881305979
tcacttgtcctgctgaacaaatgtagttcctttgctttctggattaggaaatgtccgcaggtgtcacgtcccgaagccagagctcccagagcatcttctgtttccatccctcagggatacaggcaaaaaggtctgtgccacctagagctcctccatttcacaccagccagcttgccacagcctttttggaagacgagaagaccatagcgccgggtccctgacacagcagaactcctgagctgcctgaggcccagggcagtgtctgggcgccgccttcggtcgctagtgagccatctgcttgagcctagatttgtttcaacacatccaaacacaccctacaggcccagcgggaagggtggagaagcctgtactgtacatgacacaccagggaagctctggttaccaggagcacaaacaatgcctcattcaggggctcaggtgagtgtcagggtaacttgtcactccacaggcatgcacctcacccttccctccctcttctgcttctcctcccaacctcatcttccaagtccctggggcggtttgaacacttggtgtccagaaacccaatcaagaataatgtgctgacagcatgacagtcaccttgtcatttgacccttcacttcctgaaatcccatccagctgtgtctaaacatcctacagtttccatcactgccctactttttcagagctccttatccctgcagacgatgtggctctttttgggtcaagcgtgactataaggctggtatgagtggatcaccctggctgttctggaagattcctttcaagttccccggaggagtctgtcccagcctactgcgtgtggctctgtgcatttattgggatgcaggaggttactacctacagaagttattccttaaataaagaacagttatttaagtgtaaggctatttctgtgtagtgtagtcatagaattttaaattttgagagctggaagagaacctaagaatcacagcttcatctttagggtgaaggaaacaataccagagaggttaagtaatttggccaaagtcattcatctcacagacatagatactacaaccttgtggagactattatcaagacttgacacctaagtcaatgaactgaggttgactttaaatggaattgggaactcactatggagttcgtgtgtgtgtgtgcatgctaagtcacttcagtcatgtctgactctttgtaatcccataagctgtattttgccaggttcctctatctacgggattctccaggcaagaatactggaatgggttgcctttcccttctccaggggatcttcccaacccagggatagaacccatgtttcttatgtctcctgcatgggcaggtgggttctttaccagtagcaccatctgggaagccctaactatggagtctctggggttgcaaagagttgaaaatgacttggtgacttagcaacaacaacctcacttagaagaaggggtatggatttcaaattattttaaataatttccccccattccccccaatatcagatactctaaattctatcttctattaatcatgatgataatgtgtcctctctcttactataaaatgttttgcttcctccccccacaccccttaaattgcacctactggatttatgtaatttgggattcacttgtttgaccgaatctgctcacaggggaagatctaagtgaaagtgtctgctgctgaaagggcaaggaaagctggcctggagccatcgttctgtctccagggctctggatggtgccgtttgtcaaaagatgctgagactcttgggaaagatgatctccaaggttgaattgcggtcaaggtttgctcttccctttcttcctgaaaacgtgc

SEQ ID NO: 54298 - DNA, 778 bp, Bovine  19866881317687
cccagtaacaacttgctaggtataaaattttaataagcatcatcgattaggaaacactctgtctcatcctcctttaatggagtctggagcaagcctatctgatgaagtagacatcactttcctagctcagggctgagtgagacagcccaagggctctggtagagaagagttgtggaaatcacaaaaatgcatactttgggaagtcctctcttttctagaatccccagtggccatgtgcttcattgccctcaagtccagctcatcctataaggaaagaagagctgggaaaagaggtttggaaattaggacaaacttgccaagtagaactaatcaatgataagatgcaaagaaagtcagggaggaggaagtagcaatgcacttagggagatgtgcctggtggacaagatccaggaacaattcccactcatcatgtaaaagccttcagtaagcccctagtgcagaaagtactgcttggagagcttgtctaggataaacgagagacaggaccagaggacttagagcaggggtactgagggaacatcttccagcccagtgcatttcaaacaagtccccaggcattacctctgacattttctggaaggggacatgggggtacctaaggatgagtcttgtcttttcactgcagtcaaaacacttgaaccacgagggttctgcctctcaaaaccaggcctggaaaccactaagggcatctcactctttcctgttatgtacagaataatggaagcccagagaggctgtgtgattgctcaaggtcaca

SEQ ID NO: 54299 - DNA, 1508 bp, Bovine  19866881386678
ttttgtttttttttttttggtttgtttggtgattttgggtaccttctcctctcgtaaatgacaatgaattaacatatatttagtttagcaagacagcttggaacttagaagtggaagtcatttgggattcttatttctacagatataattagtttcatgggctcatttaaaagtatatccacatatttaaggaaatcatatggttgactttgtatcttttggtctgtgatatatctgtattttatatcattgttcatcagtgtgagctcatcttttagtatttctctcagtaccatcactgatccagtcagaggcacttaattaggccagaaacacatatttgctcttttacaaaagcaccaaattctatgtttaaggatatgccatttcaaaaatggccttgtattcaatgtaagaaaaaaatcttttttggtattcccactcacctcacaaaatagtacatttgctggtaaattggttaatccaattgtgtgttagtcatggtaaagatgaggtagcatttttttttttttttttactctgtgctgttttcacttcccacttattttctaaaaagtaggcctattttgaaacaagataaaccctacaactgagcttatctaaagcaagaaaagcaaatttacagaaattaaggcaacacacctctggtaggattcccagaactggacactgtggagcaggaggggctgaatggaaaataagctgtgtggttctccctgccctgcagagcgtggtgatggtggtcttcagtgaggacaaaaaccgggatgagcagctgaaatactggaagtactggcactctcggcagcacactgcaaagcagagggtccttgacattggtaagttgaccttgacccttgacattcttgcatggtctttggtaaacctcccaatgttgccttgatagaaagaagagcccagaaatcacagctgagacctacatcactcctgttttgtgcctggcactagtttggaacgtttccaatatttcagtacatttagtacaaattggactgagaagtcaagattgggctaagcttagagcaaaacactttgtgtcccatagaagtcaactgtgtctcatataataatagatttagatttaccatggccaggccagtttctgaaacatatttccatgccctcttgtgtttgagcctaataactggcaggcaggccagaggaactcttattccttcctgtaacacaagtaacgtgggctcatttggatctaaggtactcgtgaaggtcacgggactagatagagcattctagttctctaattttctatcttgtgttccttctatccaaacacacgtctagtgcaaagagtactaggtgatcagactaatgcagagtttgagagagcgttcttggcagtagagaaggaataatctgcccagtgcatttccgggagtctgtatattcctaaacatcatgcttgttcttcagagattcggagcccccgggtgggactcaagagtcca

SEQ ID NO: 54300 - DNA, 1641 bp, Bovine  19866881523017
taggttatttgaatcaaaatttatacgtgagattggcctgttttctcttttatgctcgacttgtcaagttttggaattgagggtatgccagtctcacaaaatgttttggggaagctttccacatttttctggggtcagaaatactttgcatctaaaaattagacaggaataacccataaaaccaactgggggtctggaacctttgggcaggtgtgggagatacatatatatacacacatatgctgctaagtcacttcagtcatgtctgactctatgcgaccccatagatggcagcccaccaggctccctcatccctgggattctccaggcaagaacactggagtggagtgccatttccttctccagtgcatgaaagtgaaaagtgaaagtgaagtcgctcagtcatatccgactcttagcaaccccatggactgcagcccaccaggctcctccgttcatgggattttccaggcaagagtactggagtggggtgccatcaccttctccaacacacatatatgtaattacatatatatagctgtatactgggaacccagattaaaacttgatgaagtattttaatatttgcattaacacttggtattattttcagtttggatctgtatgtatttaaacctgtttcaatattttagttgttctttaatcactgccctatgacctaagtacacttagggaatcagtgacttttaccataaagggccagacagtaaaaattttagactttgcagggcatatggtctctgttcgaactacccaactctgctgctgtagcgagatagcagccactgacaatgtgtcagtgaatgagcatgactgttttggaacactgtttattggaacacagtcatgttccaataaaactttatttacaaaaataggtgaatcagagttttcagaacccttcctttatccatacgatctgtgacatcgttgtctttgttgtttagtcgctcagtcacattcaactctttgcgacaacatggactatagcctgccaggctcctctgtccatggggattctctaggcaagaatactggagtgggtagccattcccttctccggggatcttccgacccagggatcaacccaggtttcctgcactgcagtcagattcttcaacagctgagccaccagggacccatttcatcaagtccagacctcaaaatgtaacttaaacttgctgaaaacacaaaaaccagtggttcaatacaaaatatgattatgtcttaggaatgtgctcagtcctattacaatgtaatattttaatcaactgttggctgttttgagagtttaggattcaggaatcttttgaccaagaaaagggcctttgcatgtggcaatgcaagttatttttgttttttttagtttctttctactctgtagacctattaagccttctttttggccatattgccctgtcagtgaccaccagttgaacaagaatggtgattgtggactttcttgtctcattcctattttaggtggaaaagtttccacatcactttcatctataagtatgccttttagatgtttctagtttttagttcagtttagtcactcagttgtgtccaactctttgccaccctatgaatcacagcacgccaggcctccctgtccat

SEQ ID NO: 54301 - DNA, 1177 bp, Bovine  19866881587901
tttgatatgaagtgagagggagaaaaaaataagtatttattgtttattcttttttttttttttactgagcccctccgagtgtggatgaactttttattttttatttatttatttttttaatcctaataaaaacccttggtctccaaaccacaagcaagacactcctgctttagttcagcaagcttcagcttatgaagctccactgtctcagtcgccatcttgttacccctccactccgccaggcccccacccggatgaactttttaaacacttaaatcaaaaaattctgtgtgctccccaaacttgtctcttagatgaaacaaataaacttttatatatttgaaagtatataaacaagtgtaaatattgggagtaaacattttttaaaagtattaagcaaatttctttgggagggaaagacttgattcaattctttgctggcagtgttctttgtgaattttgtccatgatctctatatctagactcaaatgctgcttgttggaaatggtttctctttcaaattagtgttactgttattgcatgctttactatttacttttctgcaatcagaaatcagtgattgatccaataattctctgtgacaattaaaaaaaaaaaaaaacgtttgaaacatgctgtcttcagtcccagtgtgtagtggcacaaagaagaaaatgtgatcaaatttatggaaataatctctgatttatccacctataaatgcagtggtagctcaggagaagcacaactgttgatgtgtcttggaatcaaagttccctaaatgaatacagaggaagagttctagctgaagtgtagttgaagctgcagtcagctcttcaacacgaaggccatcctagtaaaaatttctcagttttcattgcctcagtctaaaaattggtcttttctgtaatggatgaaagcaaagtaactgaaaagaatctgttccagttttcaaatatcttgaaaatatattgaagtgaagccactttcccttaaataggggacagtttgctggtcgtttgctctaggaagatgagagttatgccctttctctccttagtctcagcacctcatctgttgccatgtatcagaaaggcagggcatcctaaatggaggtacttctgatggagggaacttgaggagggactggcttgcaaatgagatccgcgtggataca

SEQ ID NO: 54302 - DNA, 1131 bp, Bovine  19866881997706
tttgatataaagcacacacatgtaaattgatcagttgtaatgtaaatctcagttactctggatagagcctgcaggttcacctatcagaggttcttagaacaggacacagtcaaaatgaaatagggaatgctgacacttcccaagtaatctgaatgcaaaatcttacttgatttattggatattcaagaacaatataggagatattaatattattgtttagagtgacttatataagaattgcctcatttcccatgtcactcttaatttgcggaagatactgcctaattttcctccccaactaactaggtgcctttgcagttagctggctgctgtcatgtattattgcgtttccagccgtgtgtttagtcccagccatcctttctgttacatcagcaccatcaccctagcctaagaaaatcggagctatgacattatgtacaagctggtgtttaaactcaatccaaatccctaacatgtgaaatggatgcttagcaatgtttcttcatgtattctcaggggaattaaaaaaagaggattttcttaaacattccttattctttggactaggaaagaacacctgctttgggggctttgagtctctgtggcaatttgataaagaaacttggaaaaaagtcgaaaatctctgactccaggctgtactgtttgcttctttcatggctggtgtttgaaatttcaagtttagaaaggaatgtgccattatttttcatgaaatcaacccttattttaatggtgccctgtgttggaaacccaaccagaaatagcattccaaaatatagtattttttattgtttccagaagtgatgccatgaaagttaatgctcattaacacattgatataaaaattatatgataaatatttaaattcactggagccacatgctttaaacccaaagcagtctgtgcttattatttttgtagtgaggtttagggatttgggggacatatttttataaatccctttaattagagacatagcatccctttaaaatttagtgggcactaatagaaaacatagtatacttacattaaagttcaatatttaattttcaagaaaagaaggctgtagtctgcaagatatcccagctgctgcctgtcctaatgggagaattg

SEQ ID NO: 54303 - DNA, 937 bp, Bovine  19866880915743
cttatttatttgttgacttgcatcccagctctttcccgattttcctggaactgttcatcttaagtttctacaggcgtgatgggtactccaggctgtatgcttcagctgcctttgtcaaaataggcatttccattgtagtaggaaaatatattaaaagatcatacatgttggacagtttttgacacagtaataatttttttcaaaggtaactttacagcgttcctgttcagagaaaggagatttattccatttatgtctaaataacatcatctgagcccttgagtatatagggtatatcagttaggatgctcttggctataattcacagaatatctgactgcattgacttagactgtgtgggttgatgattttctcacataacaagtccagaggtgagtgatttttagtattttttagtgttttttattgttgttcggtggccaagttgtgtctgactgtttttcgtgtctggtctgttttaggcattcagtaatgtcatctaggacccggtttccttcggtctggacgctctgtcgtcccccgtaagtcaggctaaaggacaagggttcaaaggccagagtgggaagtcacatcaaggagggactcacaggcgtgccttttcctctctgcacagagggaagtctcttgggaaagccccctttcatcacgtcccgtacgttttgttgaccacactggatcatcgtctattgcttgctgaagacaagggcaggtattctcacctctggttctgaccctggcgctggggggcgcctgctctggctcctggcggcccgtctctcactgatggcgcgtcctcctccgcctggtgctttgcgcagtgagacccgggctgcggtccgccgtccagaggaaagaagggcattctttggagctactctgtttacgaaaagcaagagcatccacacaagactcatat

SEQ ID NO: 54304 - DNA, 1544 bp, Bovine  19866881203214
ttttttttttttagccagagtcagcatttgttgcttagaactaaaatacccttgactaacactcaagaacctatgatacaaaattgaatttgctttggtgatgacctttcttcattgtttagatccaacagacatacttaaaccaacataagttgccttatttaaattagttcttttactccacaaaccctgtttttctggtctctgtgttagggaggtcaatttaacaggaagcctattccagtgactagcttggaactgtttgggaagccaactctgttctctccagccctcaatgttcactctcactattagtctcttttatcactacagcgtggcaccctgacactttaagaagggatcattaagctgtagttatatatcatttggcaagaaagagtgaaaatcactctatggaattcatcagtactgaaaatgacttggggcataatcagcaatgtgaaaagcaaactgcaggtagtttaattttaaaatccctgttatctgctgcagaaagagacatggtagcagcagaaagtgataagcagttggtatatgagtcgtggtgagacaccattcaaattctagaaaataattctaaattaaaatgccacccattgtggctccccattattaacggggatcagttaatttaggcagaactaccaacctggctggagtgagggcacagctttaattaaaaacgcttcaatgtggctgaaaattcacttgcatagtcaagctgaataaatgattggaaattaaaaaaagctgatgggtcagtttctctttatctctgctctttgttgggatgaagatatttatgaacgttctctgtatccctaacactgtgcccgccattggtagggtttttcctgtggttgtgtatggatgtgagagttggactgtgaagaaggctgagcactgaagattaattgatgcttttgaactgtggtgttggagaagactcttgagagtcccttggactgcaaggaggtccaaccagtccattctgaagatcaaccctgggtgttcataggaaggacatgctaaagctgaaactccaatactttggccacctcctgtgaagagttgactcattggaaaaaaccctgatgctgggagggattgggggcaggaggagaaggggacgacagaggatgagatggctggatggcatcactgactcaatggacgtgagtctgagtgaattccgggagttggtgatggacagggaggcctggtgtgctgcgattcatggggtcgcagagtcggacacgactgagcgactgaactgaactgaactgacagatcactgtgatttattctttgtgaaatcatcataatgaaccatcttatcaatgaaatcccatgtgggcctgatcacttaataggcttgtgccaaagtactgattctgaatgtcagctcacaaggcagcagcttgaaaagtgcaagggtcatataaaggagaattctggactaattttaggaaaagtgccaaaggggcaaggatttcctggaaatttctctagggatgaaatca

SEQ ID NO: 54305 - DNA, 1004 bp, Bovine  19866881525230
taggaaagagcaaggcaagaaggtggaaaatccccaagcatgaaatgtttcttcttttttaattggaaacagaaaaggtttttctctgttccaaaaaacttacttaaaatgtacttttggaacctaatccatttataaactgggggcttcctgaatagattagaagaacaaattacactaaggcttcacagatgcactgcaagagagatttctgcttgagaatgaaaacaggaacagttattttcagttcctaattagcaatcagaaatgagctaggacattttaatcccataaaaagttatcattactaagcatcatttatagactggggcttcctcgatgtctcaggagtaaagaatccacctgcaatgcaggagatgcaggtttgattcctgtgttgggaagatcctctagaggatgaagtggcaaccactccagtattcttgcccaaagaattccacggacggaggaggctggtgggctacagtccaaagggtgacaaagagtcagagatgactgagcatgtacccaaagactgtttaactacaaatatcttgtttaattgactcacagtcacagcagatattgactttttattaatctacaaaattttaaaggcccttctaatgttaaaagtaacaaaaacataaatagaataagaaatgtcttcagttcagttcagtcgctcagtcgtgtccgaatctttgcgatcccacggaccgcagcatgccaggcctccctgtctatcaccaactcccggagcttgctcaagctaatgtccattggagtcagtgatgccatcctatcatctcatcctctgttgtccccttcttctcctgcttcaatcttttcagcataagggtcttttccaatgagtcagctctttgcatcaggtggccaaaatattggagtttcagcttcagcatcagtccatccaattaggactgatctcctttaggatggactggttggatttccttgcagtccaagggactctcaagact

SEQ ID NO: 54306 - DNA, 730 bp, Bovine  19866880739527
cactgccaacaataacaacaaaggccaattgcacttgctatccttgacgaggcagtaaaaaatatgattttattcaatcttagccattgcatacacaacttcttaatattctacatgatgaaatgacaagtacaactaaaacatttcagctgcagatcgacttacaagggtggtcacaagaaaaaccacctttgtttgagttgcaagctgagctagccagttttttaagtttttgtttttgtttttttttcccatagaacgccgcttttatttgaaagaatgactgacagacaaactaggattatcagactcgggtatctgacagatattttctaatgtctatcaagggagcctgttacttcaaggaaaacaatggaaagtgcttgttgccaatgataaagttcatgctttccagcacgaattctgaagttttggaaagcgcgtatctgccagtgataagagcttgacagcttcctggtacttatagacttttctgacgatattggtggaattattaaagaattatgttttatgaatatattgtataataaaatgtgttagcatttggaagatctgcatgaccaagtgaaccaatatttttcaaatgaccaatgcaagatgttacaaagtcatgttgtgggtgaaatctattcacagttcaagataaccaatgcgttttaatgtaacaaagtaagaatgtcttttgctatcacccaaatggatctgtaga

SEQ ID NO: 54307 - DNA, 1337 bp, Bovine  19866880953444
cccctctccccgtgttgtcccaaagctccctggaacgcgtgtcagcccaggaccccagtctccacccgttcctccccatccttggtttccctctgcttctctagctgtctgtctccatcgtgtcccctgctctcaccttgaagcccgtgggacaccagtccacaaactggatagtcctcttggtcttgatggcggcaatggcgacgttcacgtccttgggcaccacgtccccccggtagagcatgcagcaggccatgtacttgccgtggcgagggtcgcacttcaccatctggctgttgggctcaaagcaggagctggtgatctcggccacggacagctgctcgtggtaggccttctcggctgagatgatgggcgcgtaggtgaccagtgggaagtggatgcggggatagggcaccaggttggtctggaactcggtcaggtccacgttgagggcgccgtcaaagcgcagggaggccgtgatggaggacacgatctggctgatgagccggttgaggttggtgtacgtgggccgctcgatgtccaggttgcgccggcagatgtcgtagatggcttcgttgtccaccatgaaggcgcagtccgagtgctccagggtcgtgtgcgtggtcaggatggagttgtaaggctccaccacggccgtggaagacctggggggccgggtagatggcaaactccagcttggacttcttgccgtagtccagggaaagccgctccatgagcagagacgtgaagcccgagccggtgccgcccccgaagctgtggaagatgaggaagccctgcaggcccgagcaggcatctgtctgggagaggaggacacggacaaagctctgaggacacccttgcgtgggcaccggcagacggccttcgctgtccgcctgctccatcccacaacattttcaagtgggtgaaatcaaaccgtccttgcggaagtcagaaaacacacaggagctgcagcactcttgggaggaacggctgaaatacggggcagcaaacacgctctcgcctccaggtccacgaagcttccagcccagtggcctgtttgcaccaggaatgaggctccgaaaccatggtggttaaggactttgccccgtgtggaccccagctccttgcccctttccctgaccctgtcctttgattctgtggaaactgcaggcttatacagcccagcccaaccatgcaaggtggctcagggtaccaatttcagagggataaatgggtcagagaccctgagatttaacatcacctttgccatttcccagctgtaaatactcgagcaagttactaaccctccagactcacgtttcttcttaaagtgcgga

SEQ ID NO: 54308 - DNA, 1762 bp, Bovine  19866880996315
ggggatgtgatcctgtctatacatccaggcctgctgccctgtaccctccccactacatgaccagggtgccccagcttgagttatccgctgaccaccgcgtttcggtcctctgttcccaggtgggcatcaactaccagccccccacggtggtccccggaggagacctggccaaggtgcagcgggccgtgtgcatgctgagcaacaccacggccatcgccgaggcctgggcccgcctggaccacaagttcgacctcatgtacgccaagcgcgccttcgtgcactggtacgtcggcgaggggatggaagaaggcgagttttccgaggcccgggaggacctggctgccctggagaaggattatgaggaagtggggactgattcatttgaagaagagaatgaaggggaggaattttaaatacagatgttcctcctgcctgtgtctctttattcctgctacccctccaagcacgttaacccagcctggatcctgacaccagggcccgtgggtgacgagcccacacagacgctgagctctgccagaccctcatgaggggatggcggctttgtgtccccagaggagaccagagtcactgtctctgggtcagggtgggaggccgaggcaggatttaagattctagatgctgctggccccaccgcagacacagcctcctggctgggatgcaggcagttgagacctgggctttgggagggctctggaaaaagagtggctctgtggtcagggcttgaggagaagcaggagtgcttttctgcccctgtaacacacagaacagcagcggggtcaccgcaggcagttcggtgctatgactgaactgtgcagtttgggtggggagtcagaaatgacctcgtggagacacaggtgcagcccgtagccacactgaggttctggggtcagaggacaccggtaggatgtatgaaaagcaggagagaggccagggcacccagaggatcgaggggaggatgtgacgccaggtcaggggccatttgggccactcctagagaggaggtgaggaggtcagtttcctctaactgagcagcatttggaaggctttatgcagaatgtctcctgtgcacacatcccttatctctcacccccagcagtctcaagggctcctcctcttgttttatgcatgaagacactgaggtgcagagagtgtatgtgctggaagtgggacagcggagccggaggcgcgaccactgtcttctctgggtgctccaccccgtctccacccttgggattcgtgtcctgttccaatagccgcctcatgagatgaagggtggggagaagcaaagtccacttattacaaaagagaggacaagttaatgcatctttccctaaagttggcagctccagtaggattggggggaaaatcataagccgccctgattaaactcgtgatgagacccccagggtcgggcccacagcaggtcctgatgcatgaaacgtacagctcagtgactgcgcacttttcttgcttgtctctattctgtatcccttggaagccccaagaaaaatagaatgaaatgtcccaaggaaaggaagatcaggctccccactcatcgaggactgtttcagagagaccaccgtggcggtgctcctctgtgacggaggccgtgggctgaggaggccaggtctgcttgcgtccagacccccttgcctgaggtcatcccgcgtcagttcctggggggctgcagagacccaggtcaggagcaatggcccatctcaggaaggggcgttttctactg

SEQ ID NO: 54309 - DNA, 2133 bp, Bovine  19866880151772
cccataccatccctctgggtcatcccagtgcaccagccccaagcgtcctgtatcctgcatcgaacctggactggtgatttgtttcttatatgatattatacatgtttcaatgccattctcccaaatcatccccccctccctgtccccacagagtccaaaagactattctatacatctgtgtctcttttgctgtctcgcatacagggttatcgttaccatctttctaaattccatatatatgcgttagtatactgtactggtgtttttctttctggcttacttcactctgtataattggctcaagtttcatccacctcattagaactgattcatgttgatgtatggcaaaaccaatacaatactgtaaagtaattagcctctaattaaaataaataaatttaaataaaaaaatatgaaatggaatcaagcctaatgctttattgctgctttacactctggttattcccagatggctccctaacttcattagctccctcccttttggctcctgagttggcaaaatacgccgtgagccacactttgcctcagttgtttagaggatcacttccagaagttgccagggcagctggctttcagaaggtgtcaaaggttcccatccagtggattttgcctctgtgtctgggcccttggagtgagctctttggctgtttctttagcttttgtccctggatgctgtctctcagaactcctcttagaagccacagggccagttccacttcatcttcaagccccctacaggagacaattcaagctggattcagcatcttgggctcccctgtatccaggaggagagttgggacatttggctacaacccttttaggatagttgtgaatgccaaatggacaccagcccctttctgtagattgataagattaaaaataaaaaattttctatttgcaaaagccgtaaatgcacacacacacacacacacacacacaccccctataaacacagaaatgtatgaagtttaaaactaaaggcccttgtatcaacctcttagtaatatttctttattatatactattccagatttatttcagtgcatatctaaagtattgtacttaaaaaaaaaaaagagagagagaatggaatgcctacctattcttcagaaattcgcatgttttctttgacagtgtatcttggatgtgaagtcattcagtcgtgtccgactctttgtaaccccatggactgtagcccaccaggctcctccctccatggaattctccaggcaagagtactggagtggattgccatttccttctccaggggatcttcctgacccagagatcaaacccaggtctcctgcattgcaggcagacgctttaccctctgagccaccaggggaatcccaagaggcttttccatttcccttttccatttcttcctttggtttcctatgaagccgttgcattttttccctccgtactcaccagccagattgtccactgtctcttccctgatttttgccaagtgactgttcaccagcaagtggtctggtgtcctttccaaatgagggtctgacacttgttttgctcccacttcccaaagctttaaatttcctttatcaagcaacttcttacgctgggaagaccacagtcggtctctactgcttcctcacagtctcagcttcttcaaattacttgatagtgcctttggttaatgacttgcacacttgctttgtttaaatattttatgctccagatttcatttattctttcaactgattcttatgatttttttctttatctttccttcatctgtttggagcttacctcttttttttttttttttttctgattacctcctttctttgataaaataaaaggacaaaataatatccaaccagtaatatccagcataatatctttagacttccttcatggaaatataggtagaagattctttaaattcagaagaactttatttttagcagattatgatgaaagaatacagtttgttatagttgtacaaaatatcaggatggaaactggcccaagaaaggttcgctctcaagcacagggataatccatgatttttattaattgtttccttttcacttttctttctggtctgcttttgcatttccttgcctccagcactaggtcattttc

SEQ ID NO: 54310 - DNA, 2938 bp, Bovine  19866880400341
cccagttcaaaagcatcaattcttcggcgctcagctttcttcacagtccaactctcacatccatacatgaccacatagccttgactagacagacctttgttggcaaagtaatgtctctgcttttcaatatgctatctaggttggtcataactttccttccaaggagtaagcgtcttttcatttcatggctgcaatctccatctacagtgattttggagccgagaaaaataaagtctgacactgtttccccatctatttcccatgaagtgatgggaccagatgccatgattttaattttctgaatgttgagctttaagacaactttttcactctcctctttcactttctttcttttcttttttttttttagcacaggcccatgattctttatctcctgggtctgcgacccacatctaatctggtcgagtaaccgtaaacattgccaaaacgcccagagtacgcctagggaagccggcggtcactgagcaccagaggagccgggtagtgttgcctgcagggagttgtaggctgacggccacaggcgtttgcgcaacctccttgagaggactgtgggatgctgtgccatgtagattgagcctgcaacagctactgcaggaccgtggtcggaaaacacaaatctgaccttgctttcttgcttggaatcatttggcgaggatgagttctcatcactcaaaggataaattcatagtcctaaagtaacattgtgtctttttcatcatgatttagtacccgtggtagccttaacatttcctaattattcttcaagacgattctggatgcttcctccgagaaagggacttgctttggacttctcttttctgtgcttccacagcactatcttacaattctctaataccatatacaatcacggctaggtttcccgagcgcttacatggtcgttctagcctaaactatttaccctcaccagctcagtaattttcacacaacagtttgagacagttgctgtcagtcccattctgcagatgaggaaactctggcctagagacgttcgttcactactcagggacagtctcccactagactacgagttccaggctggcaccgaaagaccagatatttgcttttccgcgggccacgccctggggcagggtctggtgacgacactgcgtcccatggtgctttgcccgccagcgctgccattggcccggccagtcggctcccttcccaaagtgaggtgccctgtggttgcctggcccccggggcccggacggagaccaggtctgcgactagaaggctctggccagtgcggggaagacgctacggtcagtcacggttcctgggcgacagcgacctccgcaggcacgccagcacccgccaggtgaggagggcacccaggtccgcgtcagctgtcgagccgctccacgccccttggtgcccgagtccgcgacccggccctcccagggggatagtcatcgcgtcccagcagaacccatccgcgaagaagaaagaccaaaaggggaagaacatccaggtggtggtgagatgcaggtagggcgagcttgcagggttccgagccctgggctttgctgcagggctccttcctgtgctgtccgaggagagggattttgtctgcaattttctgaatgaaccagaccttcctgtttcatagtttcctgcgttctaaaattttcttcagaaatgtacactccatttttttcacgagttgcagcaagatcccgtttcagacactctatctcttatgtatattccttaatcagagctttcttggtgagtttctggttaattgagtatgagtttctggttaattgaggcttattgagtatgttctttgctctatgagagcaatgtactcagagtttccaatgtactcagagtttcctccagattgagagatgcaggagaaacttttgcaatgataaagatgttcttgtccgtcccccaagagagtcctggaggattctagtcaggttagattctcgataaggaacatgaggtgttctttctacaagagcagtaataacccttccccagagtcaacagggactgactgatatttccagcttcccgagctctcttgtcgactgctccagaacggccaatgtttttctcactgcctgcaagatcaaccaagttcaactttccaattttaacaagctcctctccatcaactgtggtttctttcttaggtattgtaacagagaaaactgagtgggatcgactagagcaggcgttcatcaaagttgctcggctgtctttttgctgcctccttctccaaaatttgatagacttcatccttgttgtgtactgtaatttcttctaaacctttgattatcactcccctcttgttatggggatcatcaaacatctgcagcctctcagaaacatcagaagacggattaaggagatcaaagagctcttcattatagatttccaatagcgacactttcactgaaaattcagtaccattatcagtaagtttctcaaagatgtgatgaggagtacgtggaattataccagccaaaggatcctcctcccaagtatactcttcattagggagctttcaccttccattgtaaaggttttgcctgtgccggtttggccatatgcaaaaatagtgcaattatagcccataataacttcatccagaactggacaaacaacacttctgtaaacgtcaatttgtttagtatttgctccaaaaatcatatcaaaagtgtgtgttttccttgagcttttgtccaccagtcctccagtgtcgaacactaacttctttccgaacactaacattctactaccgaaggggcattagctttccgctctgtcaaattaaatggtctgcatctcaccaccacctggacgctcctccccgcttcatccctacccccgcagatgaattcagctgagacgccatgaccgtcccccaagaaggccgggc

SEQ ID NO: 54311 - DNA, 1371 bp, Bovine  19866880444851
taagccaaattatcaaccccacttttcaggttcagaagtatccagaattgcagattttggaggccaccaggagtcttaacaatatagttctaaacttctttccttgcacactatttcccggaattactgcccctgctttgattaaatctgtgtgaaaatccaacttcccaatgaaaactaagctcacctgatagaagtggactgactgctctaccccgccctggtcatgtttcatgaagctgcctttacacactaccccacaagtgcacttacccctttgcttgtgcatagtgttagtactttatgttcttgttcaatgtttgttcagttgtctcagtatcctttatgtctgtccatgtcagcatcatcttagactgaaaactcccagggggcaggggccatgtctgtttaactcgttttgtacagtgcctaggatagaaccatgtacaggtaggtgcttaaaaaatgctctttaatgatgactggtagcactctcagggactccctaagctccagctatcttcagcacatggtacttggcagtacatcagggcactttggcctgttctacagggcattagaatgcaatggcacaggaggctagctgcagcagtctgtggcaagtatttgactctatccattgttaagaaacaacttaatatcacaaccaccaattcaactaagagttaaaatacgtgggaattttgatggaatagtaaagagctataactctttctctagtgttcatctgtttccaacactaacagaccagaggctaggtctaagagcctcagacaagcttatgtaagtttcatctttaattgctctgcttgtagggtgagctgttactatttttttaatgtaaaaacaaacatcctgcaaactcaggctgtaagttactttgcctaataataagaagttagtcattagattgtaaacagaagggttatgttttggacaattatttattgaaccaaactaataataattgaccccaaatccctcaaaataagcaacactgaataaaagattcagagtcaaaggagatgagtaccatgtctcagtgtgtgtgtgtgtataggtggtgtgtgaatatatatagtgtatgaccaagaaaagtaactaaagaccatcaaagtagttcaaagtacgtagtttgtgccaagggaaagcttcaatttttcctcattagaatagaatagcccatagaatatatgagggctataaagtcaactactaagtacttattaagcacctattgtacacatagaattttactatgcattaaaacgtaaacaaaatttaatacactagcctctgcctccaaggagctacaatctagttagggacaaacaataaatacacattaaa

SEQ ID NO: 54312 - DNA, 2954 bp, Bovine  19866880464339
caaagttctattgttgccaagaaaatggacatagaaagagacatttttatacttggtttaagcagtgctgcagtaaaccattataatatgggatttgagtctctcccagtgggctagaattgtctttacaatagccatatcatcatggctgaaatatgcatttgattgtaattttaatatcactcagcttttctgatgctagtatcaatgccttctgttaatgccttcagtttaaactatatgtttatagtggaaaaattaatgctgtcctatagcaaaaaaaagccacaaactaagctagactcagactattttaaggctataagtaatattaatatattaaatttaaaattttttatcatactaggaacactcatttctcttcttaacatttcttaaagacattaatttcactttctgcataaattcactctgtcaaggtcaagacccatctttaataaataagacccttttcaacaaaagataagcaatagattaaaataacatttacaaaattaacatgcaatgtcagtaactgtttgtacagtctattcgtttgggtgggtttttgttagtttttttttcttttttcttatttacagcaaagtccgggaaatagctacttccttcccctccccccaccacacacacaatagatcttcctttacatgcaatcacccaatctcaagtaacaaattcttagcagcagttacctttgagggtccagtgtttaaggatcgataaaattaaaaagtgtacagtatttattttcttctttcaggttgattatgtgaccgctctggcaaaagcactttgacaactgtaagaaaagagggcatgcgcacacagggaactgtgggggctgaagtccttcactaggtactctgcccgatttaagcacgctcagccacgaaaggaggaagcctttcaaataccgattccaagggaaagacgttgtgccggattacattttatcttcctaaccaatctaaatcacgagttgttacgagaaaaataaaccggtttgtcaactgatttaggaagccaggttaaaagagaaactggattacaggactcaaataaataaacccagaggagctaccttaaatggtattagaatggtaatgactgggtagccagcagaaggaacccagccacaccaaaagaggtggggtggggaagaataaagaagggaggaggtggactactaaggaaagataattaaaatctgaccatacttaaatacgtgtaatattataaaatgaaaagaatcttaatatgaaatatgatattaactcttgaaggtcaggttaaagataggtttcagtcataaattttggacattatctatccaccaagatttctatttgattttcaatgaaggtacaaatcacttatttcaagattctacttgatatgctctaaatcatacacctccttattttacttgtcaaaatgaaagtttactttgcattattcatacaatgatcaatcaaataaaattcagctctttaaaactaaaacagtgttttagttaaatattaaaaaaataatttgacatgtttattgtttcactgcataggacagtgacatctttattcaaggcagaaagtagctacagtttcttttaaaacttttttccccctgatgtacatttttcctatcttaacctcattaccccaaggctggaatctcacaacatcttaacatcaactggtattacctatagcttctgagagcaatacttcaactaccagtttgctcacataggcagaaggtattatctcttgtggggtttggttcaatgccattcatgcaaggggttcagaataaagtcacttcatgactgtgctgattgaactaagaattaaaaatgtcagacatcatttaaaactatcttaattctctatttcccctcttcaccaattagaactaaagtagtattatcagagactaccaatttgcagcagtcagtagtctttatttctacttatttccaagggaaaaaacaaaacaatttaagacaaaaaaaatcattttgaatcaatctactacaagctctttttaaaagaactaaataaatggtcctcttattcctactatgaacttactgtatattccccattttttttccttcctctatctttctaaagaaaatttttcctctgccaacgtgttatacttaacaatattcattcccgagtctaaggatgaactcagttaatcttactcctgaagacttcccctaatctaccaaacttctaacattttcaagtacttgaatatttaaaaaaacaaaagttcgctcataaaggtcatataaagacttgttttaagaaatagatttttaaagattatttaaaattaatatgccaaatttttattggtaaggtagaaaatcttattattcaggtgtacttgaaaatggtttaaattgggcatttagcaattcacttgaccccaagtacaggtctactaataatatacacagtgaaaaaaactaaactttggtctctgaccctttgataaatgacaaaactaaattaacactgcctatacttaacacgtatggatgtgagagttggactgtgaagaaagctgaacgccgaagaattgatgcctttgaactgtggtgttggagaagactcttgagagtctcttggactgcaaggagatccaaccagtccattctagacgagatcagccctgggtgttctttggaaggaatgatcctaaagttgaaactccagtactttggccacctcatgcgaagagttgactcattggaaaagactctgatgctgggagggattgggggcaggagaaggggacgacagaggatgagatggctggatggcatcactgactcgatggacgtgagtctgaataactccaggagttggtgaggacagggaggcatggcgtgctcgattcaggggtcgtaaagagtcgga

SEQ ID NO: 54313 - DNA, 1065 bp, Bovine  19866880537118
tacagaatataacacagaaggtgttgataaatattgcttattgtttcatgaacttttatatataagatatatatacacagacattgggtactaactaaaaagatattttttagtggtgggggcatgtcacagtcaaaacaaaattgagtctagatcccaagagtagttttttttggccatgccttgagtcacgtgggattatttccccaccagggattgaatcccctgcattggaagtgtggagtcttaaccactggaccaccagggaattccctaaagagtatttttttaaaaaaatactagttccctaatggacaaatgttgcttcccaaagaggattcagaggttgactatatctaaaaaaccatgtattatatccccattttggagattaacagtgtgcattagtaagttgtttaagaagtcttgtatttaaacagttgccaaatttatttgacttcagaacttttttttcccacctgtaatgccttttaacattctgtgaaactagtttttggagaaacacactttggaaaaccttgatctggttttgttgtcacgagggaaagttttatctatttagtctgaaagttcttatacatagggactgaggatcgattccctgtgctgtcattgggataagagggtggcaggtaccatattgtgggtttcgaggaaggtgaaggtcagaataaggaagtgcttttctctagaatcatgctgagagaaattgcctgtttcctaagtggagttcttttctgagaaaggagctatgagagtgaccaggaccctgattgctgaaattttttcttcttatttttacagatgtgggatctaggaaaaggcctgacgatttcccagctacaccagtctggagtggctgtcctggttcttacttttgttgtcctctgtagggctggcagccatgtgaaagcccgaagttcccagtgtcatcatcctacaaattatcacattgacctgtcttcctggttggtactcttgtctttggccagggcaaagttattctgatttgtttagacccttctttgcttgcagatccccttg

SEQ ID NO: 54314 - DNA, 3175 bp, Bovine  19866880611952
aaaatacattcattgtccggctgactttttctctttaagattcttgactcctctgcacgtggcttctgagaaagctcataacgatgttgttgaagtagtggtgaaacatgaagcaaaggtatacttcatttttggtaatttttggtaatccagtgagttgtttctgattttgtagataaaatgcctgatttcctaaactatttattctctcctaagtattagtttttccctcaaaatagttctgcagatacttttttcagtatctttttgctagaaaagctgtggatttactcaaagaaacattcctgtatatccttccttcacccttcctgttaaccacacctcactggtcaaattattctttttctaacagtacactctaaagagtatccctagccagacatatttattctggaattctcttccggtgtcttctgttccttgcttacatgataattcctattatttaccccagccacagtgtctcttaccctctgttatttctgccagagaacatggaacagaaggaaataagttacttaaataagttgactaaaaagatagctcttcagattgtgaagctgctgttccatagttggcacttggacaaaaagcgtttttttttaaaatgaatcacaaaagtcattcactccagagcattcaggagagaaatgttttgtttataagagttatactttttttaggagaatatggtttttctgtttgtagaaacagtatacttaagtttaaagtcaagctgatgtcactgtgttgggcaccgtaagcttagataatatatatcagctgtaccgccaaaaaagtcaagtagacttaaagaagataaagcattgtattcatggaatagttaggttttcatcaaggctaaaagtcatcatttcttacccaggaacttaaaaaaaaattctcaataaacaatacacatagcatcccagattggaagagataacagtcatttaattcaacggttttcacagttttcttagccacagatccttgtcttcttcaaacaaaatcttggtagaaatacattatataatagacgagctggctcttctctaagtgaacttggcagaacgattttctaagctgtcctttcttggatttccactcaaggaaccacttcaaattctgcagttttttttaatgttgcttctcagtgtcctaataatttctctcttatttgggggaattcttgataatgtataatttcaatctttcctattgtaaagtattaaaaaaataaagtttatttctgcttgactgcttggcatatctcattttgtctgtctgttctataactttttgttgatcgcttcttttcttacatgtggtgtgttacttgaagactatctggatgcatattgaatttgagttgtataactcagtgaaacaatcttggctagggtgaccaaccatcctaatccccaaactgagggatttctgggaacacaggactttaagtgctaaaaccagaaatatcccagccaaactaagacaagttggtcccctaatattgacacagaatggcacccaaataaagttttcaagtggatatagttcacgggtttccagtgaatgtgagttcatgaataaatagattagttgctctgagcattttaagttgatttttctgattctgtaagcatggagactagctttttgtaggttactttttagaattattgagaaaatcttactatataatcctattcagatgttctccagttccatgaatgtgaattggataatgtcttaaaacacactagtggtcacataattactgaggaattttatttttcagttacgttttgaagaattattttccagggtggcaggggtgggagttggtgggttgggaatgagaataaaggggtcttaccgaagatttttttaattattactatgaaatttttcaaaaatacagccaaagttgatagagttttacagagtgtaactatatactcgccatatgaattctaccactagctgttcaccatactgtttccttacatatccagcaatttttccctcttatcagtatcttacattttttgacacacttcaaaagtaatttgcaagttactatacacacctccctaaattcttttagtaggcatcaactagaggtcagtatttgtttgtagtttttgtttggatgtggaatttacgtacaatgaaatacacagctcttaaatgtacatttactgaattttgcctaatgcaaagacctgtgtaaccaaaactcttgaagatagagaacataaccacatggcagagacagtatcccatccaaggcagtctccttgcctagaggcaacaaccattttgattttttctacagtagattgatttgccactttggaccttcatgtccatgagatcgtacagtattcattgactcttttgtgtcagactttttttcactcagggttaatgttttggcgattcagcagtaacaataattctttttattgctgagaatattccattgtgtgaatatactgtagtgtctttgtacagattgtattttaaatgataagatagaagattaagccaatagaaataagtattttaatgctgatttagtgtctgactttgttatctgttatcttggggttagtctctacatttctgcacctcaagtgatccttaaaaatacatgcattagaccttaggccgtgtctataaatgcgatgaatctatgagtgctttaatgctaaacacaactattattcaacaccttaaacttttaatccaaaattgggtctcctgatgtctgccttcatgaattggtgaatttgtactctaaatttgagagaaaatagtttatttgccactggataatagtcttcataagagaatacttgagcatttttaagttaataacaagtgttgaacctgaacccataattagagcattttaaattttataccactggctaatttccattttttctgattgttaaggttaatgctctggataatcttggtcagacttctttgcacagagctgcacattgtggtcatctgcaaacctgccgcttacttctgagctatggatgtgatcctaacattatatcccttcagggctttactgccttacagatgggaaatgaaaatgtgcagcaacttcttcaaggtattgaatacttcg

SEQ ID NO: 54315 - DNA, 2369 bp, Bovine  19866880684671
taagtttttaatggtccctaatttaaactctaaaattttgaaatgcatagtagctttagttaaggcctagtcttaactagtctgattggttacctgacgcacaattaaaggttaaggcatcaagtagcctctttttaggaggaaaaggaaagaaacaaatagattgattttctgtccctgagaagaaagccaggaatttcttgagcttttatgtatcagtgtttactccagttctctgtctgaagctgtatctaaaatttgtattgaactctcaaagaaacagtgaattgttatatatattattgtgttcttaaaagtgattttattgttgtatgtagggaaaagcctgtccttttctttctttttttgcataaaacaaaaggtatttgtcttttaaatttttaaaggcttcttttaagagtttttttttaaacatctgctttaagatctattcaagactgaaatgtattttgtttaaaggtataatctctgtgaaacttaggacagtaacttctaatcaggctacagttctctgaaagggtcagtaaaagcatcatctatgcaactgatgaatctcacaggattccttcacagttttcctgattctttgactaatagtttcaacagtttagcctatagaatcatattctatatttgttattttcattcgtgttctgtacatttctaaatcaagcatagccattttttcagaaagtgatagttatatatggaggaaaataggaggcaagccaacccccacctccaaggaaaaaagtatttctaaataacaggtaacttatatctaattggattaatttttcattttaggacttgaatgctgttgcttttaggtttaaagataaagagagaccacggggctatacctctaagattgcaggaatattacatgtaagtttattgttattttactctatactttggcacatagagtgtttcagtgatcctgtatatgttactttcagtactatacaaatcataaaaattgaagctacagtgtaaaactttagacattgtagcaactagtaaagtctgatgtgaagacatatttaaaatcttaattttcatcatcctgaaaatcatcatctgtaatattttcattacatagacatcatgcttactggctttaaatatttttcagttctactatgtgtcatgtgctacttatgtgaaagctataaatcacccacttttctctgtttccattgctgtcaccctaatatgagctaccttcatttcttacctggattaccatcacagactcttagctgaattcgtgtttgccatctccctagctttagtgttttttccctgcctcaatgatcttttgaaaacccaaatcagattatttcactcctctgtgtcaagactttcagtggtttcccgtcagagttgaaatagatctaaatttttacctgacccataatgacatctgactccagcctctctctgacagaattccatatcactccccctcccacctctctcattcccattccactccagctatcctggctctttgtctaatctttaagcgtttagttttttcttccctctcagggccctgtcatttgctttttttttctgcctggaacacttacagtctttgcatggctaggttcttctcgtttgggtctccactcagatgtctctgctttagagacaccttccctgacctctcaatcatgaccctgccccttttaaattttctttatagcatcttatcagtataatgacagtatttgtttgtttattgtccacctccctcccagttagaggacttccctggtagctcagacagtaaagcgtctgcctacaatgcaggaaacctgggttcaatccctgggttaggaagatctcctggaaaaggaaatggcaacccgctccagtattcttgcctggaaaatcccatagacagaggagcctggtaggctgcagtccatggggttgcaaagagtcggacaagactgagcgacatcactttcctcccagttagaacatgagctctttatagaacagggacgtcatctgtcttacctaccattgtacccacagcagcacctagaacagtgcctggcacggagtagggtgttcattacatacttgttgaatgaatgaatcagtctgtctcagtaagttccccttactaaaaagcttcttccacattatttttctttagtaactaaaaatataagccatttttcctccataacaactttgtaaatgcttgtctgatttcattcataagaagttaaagaaaaaattctattaaaatatatatactttatattaagaatcctatagatgccagcatttaatcaccaaatttcttttaatcgacactcaatttt

SEQ ID NO: 54316 - DNA, 1696 bp, Bovine  19866880942809
aatgggtgagaccatgcagatgcagaggatctacaaaatgggttcaccaggcttgtctacagtgctgggtggatgaaaaacaaagaggaaacagtacagccagagtggcatgtcctcagtgcaatgctgaatacttaatagtttttccaaagttgggtccagttgtttacatcttggatcttgcagatagactgatctcaaaagcctgtccatttgctgcagcaggaataatggttggctccatctattggacagctgtgacttacggacaggtgacagtgatgcaggttgtaggccataaagaaggtctggatgttatggagagagttgatcctttattccttttaattggacttcctactattccggtcatgctgatactaggcaagatgattcgctgggaggactatgtgcttagactctggcgcaaatactcaaataaaccacaaattttgaacagtatattcccagggattggttgtcctgttcctcgaattccagctgaggctaatcctttagcagatcatgtctctgccacccgaattttgtgtggagcccttgtttttcctactattgtgacaatagttggtaaactaatgttcagtagtgttaactctaatttacaaaggacaatcttgggtggaattgcttttgttgccattaaaggagcattcaaggtttacttcaaacagcagcaatatttacgtcaggcacatcacaaaatcctaaattacccagagcaagaagaagcataaaactgcgacttcttgttgttctgcagtcctcccattcttaggagtctgttgtgtcgttctgattccatcattgatgcacagtaatggagacttgtaataagctgctgctctcatatttttaagaaatataataaagcacttagggcaggggaaaccccctcggtaatcacggaacctaaggatgtgatttgttttccttgttttgtatgtacttctttcatggcggtcatctgaacccattatcttagcatggtgaacctgagttttgttcatattttcctcaagacagaaatgtaaagatcaaactgtgcaaatatttaaaaatacacatgctgttttattcaaatgcctcttttgtacatgttcatgttcagtgttttcttagaattagcaactcaatgaaggtactgtgaggatttttctcactggcataatttgattacaagctaagcagaagtatatgttaatatgaggaaatgtaaattagttataaataattaacaaaccaaaaatgtatgtaaacattcaaatgattatctgaacaaatgcaattttgttgtgtttttcttaacccatgtgatgtcctccaaaatgtgtagggtaaaaattcacagggcttccagatcactttttcactattaaattttatttatataatgttgacatctcatagttcatgatgtaatttttttaattaattttattttatttttaaaccttacataattgtattagttttgccaaataacaaaatgaatccaccacaggtatacatgtgttccccatcttgaaccctcctccctcctccctccccataccatccctctgggttgtcccagtgcactagccccaagcatccagcatcgtgcattgaacctggactggcatctcgtttcatacatgacatttcacatgtttcaatgccattctcccaaatcttc

SEQ ID NO: 54317 - DNA, 2490 bp, Bovine  19866881057276
cttaaaaaaaaaaacaacactacttagaatccactcatggtgagcagaaatacaatgtactctttaaattttggaaaattccatctgaaattctagcaaacctggctttattcccactttagcatcaaagcatcacgtgttctgctccctctctgccacttcctctcagctgagctgctccccaaggagatcactcccaacagagaacgaaagggagggggaagaggagtctgcctggcaaaaagttcataccaaaacccttttacattgcccttctgattcaacaaatgcgctggcagccctcagttcaagtagaaatagaggcagagtcttcaaaaatattttcaaggcattactaacgaggacaaagtggaaggcagcataatcttaagctccaggtttcctggtgcgtcagctgtgtaacgtattagctataaatgacctcagagtttctcaagcagatcaatgttttgttttttttgtaaatatattaatttagttcttcaaacatccaaggttttattatgggatgcctcaatttatcagtgttttcaaaagtttgataaggaagagtgatggcaaacaatgatttctccctgtcagaagggaagcgacacttcaaatgtcttattcacctcttaaaaccgggaacagactctagtcacgaggtgagaaacatcaaacaatgaatggcatgaaaaattttaatttagataaaactgaacctatgttacattacagagctattgtcttaaaaaaaaaagccctctactctaaataaaactatgccctctactttccaaacgaagcaatattaaaaccttatttgtacatgtgcctaacgtcatctaaatctcacaaaaatactgaggtactcggagtatcataactgtcttcttgttggtttaactaaagagataacgtaggagattcatagacttgccaaccaggagccatccctattatatgactcctctaagatctaagtcctcagttttgttctctgaaaaaagggggatgatattacttcaaaatattcttaaagctgctgtattttctctcaccatagattagtgttcacgttctagaatgtaacattattctagtttttaaaattcagcctattctgagtcattcatgttgctgaatgaatcaataatttgttcctctttattgctaaataaaactctactgtgtgaatataccacaatttgtttatccattctccagttgagggacatatgcattatttttaattttggctattaagaataatcctactttaaacattcacatacatgcctttctgtggacatcagtcaattctaagatagaactgctgcattctatggtaggtgtgttatgtttaactttttaagaaactgccaaactgctgtctaaaatagctatcccattttacatgccaaatatcactgtatagcacctttgaaagtgccaaacatcatgaaagatacagcaactctaagccccaaggaaggtgcatgtttcggtcaagggacagaggcaggtagcatttcatgcagaaaaaaagattcacacaaaaagagatgtagtgcaccccaggacagccactctagcctgtgagtgacttgtaggtgtgctgccttaaattccattaggaaaacatctaagtacaaccaatgtaagatatgttctgggaagtctaacatgcaaagaaaaggaaatcctaaggggcagccataaagctgatgcaagcaatcacaacagcagttcaccagagcattacctacaaggcggctatgctaaactttaaaagatttatatacagccactctagtgatcaagatctccattttacaggtgaagaaaccagaggccagaaggtaagaagctatgtggccccaaagtcacatagcttatagaaggtgggaccagatctgtctgattctagacaatgtttttcttgactatgctaatttattgttccatctccatgtttcacaaccctcctaccctgcttggaaggtacctccttgaagctaagtgatactgtcccttaagccatactatagagaaggaaggggcaatgcattccagtattcttgcctggagaatgccatggacagaggagcctggcaggctacagtccattgggtctcaagagtcaaacatgactgactgactaaaccaccaccaagccatactatttcccgtttctaatgtactcatctggcatctttctggtatttcactgtttttccaagctggttctctacctgaaagaagaggagctgaccagtcaaaaggaacaaagtggatatacttggcagtgatctgcagtgattttcctagagtaaatcacagcacctggcattctggttttgaaccttaatttgaacataactttgattcatttgactgatgatgaaggcaccaatatccttttctgaggatcatcataacacaggaaaaagcatcaaggcaggtatcaatcccctataaatccat

SEQ ID NO: 54318 - DNA, 1563 bp, Bovine  19866881076007
acgcctgcctgaggaagatgggaaactgtacctgtgtgtgtcaagccccaccatcaaggataaaccagtaagtaacttgcagccagctgttgcttttccagagcatgtatgcaatcagaatagctggtcaccttccccttgtcatgagaatactgggagctaggatcctcttacccagggtgacctcgctatgctgtagtgctggactgctgctgacggggaactaataacaaatttctcagtttttggttttatacctttgagactacatgtaaacaaatgtgcccttgtctttcactttacagttcttttaagctaattcctattgagaaactctgaattgaggtaaataatgcccttagtggttttggcagctggtttctgtcattatttcagatcaagggcaggagtgatttatttattttttaaaaataaaagatcaaaatcttcgatgtttatgtgcctttgaatgcaaagctttgtgctgggtggtacccacagctggctaaatagagccttctgggccaggggcttacactctagagtggatagcttcaaacagagaaggggaggggaaagatggagaacatggacccaaagccgtaaataatgcacacttctacagaatttgtgattgagtctgtggtttctgagccaaagagtgtgagtgaataagtcactgggtgagaaaggaagactacttcctttctcctgacagaggggatatcagtggaaaagaggcaagactgttcagggcagaataaaaaacttgaataatacagcagaagtagactccaggaggtgaggagggatagggaggtctggcgtgctgcagtccactgggtcgcaaggagtcggtcacgacttggtgactaaacaacaatacagtgatccctgaggcggttgggagaggggtgagacttgtgtgtcaaggcctgatgctcggagtgggaaatagagtaaaaacagtagcgtggactaaggggcaaggcacacgtttaccacgggccctgcagcatcccctgtaaggcttaaccagaggtgtgggcttggttaacagcaaggtttactctcagaaacatgtaggggaaggagttgtggtcagatgtaaagctcccagtttgagtcttgattctagcatttaaatatctgcttgactgcataaagtcacctaatccttgctgtgacttggtttcctcactgataaaatgagaagaccaagagttcctctctgggatgttgagaggctcagataagaggaaaaagtatgtaaaagcctctgatgaggttgggtacttgcccaaacagtgctgctagtcctacatggtgctagaggactggggagagcgagatcagagcttatctactgacaacatcttttgaaaaaaacagtgactctagaacagggtttataattgtttgcagaagaatgatgccaggactggccatctgtaagtgggagaaggcagcatgtaaagccaaagagcgagttactaaggaaagggaaccctgggtcatgtcacaatgattgatgcagaagaggaggcaaggattttagcaagt

SEQ ID NO: 54319 - DNA, 1691 bp, Bovine  19866881132235
tagccagtcatcacagactgggtaatggctcattttgaacttaagcttcttcctcagtcactacagcatggcagagaggaagagtcagaaactgctgttcaaaaaccattgaatgtggtaatcaggcaattactaaacactatttgcttagtcacatttactgctcatgaaatagttatcagatcataaagcatggccatctgtttataactttgatgaagtacttgatcagcatatctcagctctccatcatccaactgtatgtccttggataagttgctcacttctcagggtctcagtttcttcatctctgaagtgagatgtcagactggggcatctctacgcattgtacacatatgtataaatttgtgaattgaccttcagcgtgggtgttggtaaacaatattgaattgaatgctaaatagataatggcacaactaatggtttaaacaattgttttgcatggttattaaaacataggttgtatttctattgagtttcttatagatattagctagttgtaatttagtctgtacactgcattgtgaatttcattaactatgatctcaattagcattaaaatttacttagtcataaaatgggtcttttacaagtgttttgccctttaaagtctttgaatgtttataagggcctcccaagtacagatcactgtattaggattcccttgggtaagttgagtttcacattcttaaatgaattaattgcagtttggaactgccaaaagacaccaactaaactgaacaacttcatacagacaaacaaaacagtaagtttgtttaaaccctaaagaagtttttgaacatgtcgctctcttattgaaacttcctagggggatggtttgtgtatcagcagaggaatgaagtccacaataactgtggcattgagatatactaccaaaccgacatgcagagcacgtcagagaacatgtttctggagctcttctgtcagatcatctccgagccttgcttcaacaccctgcgcaccaaggagcaactgggtgagtgggcagcggggcgcggcagggcacctcactccttgaggagcactgtcgtcctcgagaacattcgccacatgtgcagccccctgtcatgatgcctgtggggactccacctctagaagataagccgttactatctcatggacagtagagcagttcttaaggagatgacgtgtgtttacatcacatacatgtctatatagaggtcattttgggtgggggaaaaggatgctaagggcaggctgttgagggtgacaaggtgggaagcaagccaccagagaagcttgctgctgctaagtcacttcagtcacgtccgactctgtgcgaccccgtagacggcagcccactaggctcccccgtccctgggattctccaggcaagaacactggagtgggttgccatttccttctccagtacatgaaagtgaaaagtgaaagtgaagttgctctgtcgtgcccaactcttagcgaccccatggacttcagcctaccaggctcctccgtccatgggattttccaggcaagagtactggagtggggtgccattgccttctccaccagagaagcttagattaaaaaaagattgttactttaagagactcaccgaaatcctttttcatggtgttcaaagcacattactggggctgctcttttgatcaaattttccaggatct

SEQ ID NO: 54320 - DNA, 1169 bp, Bovine  19866881175675
atattaggacctagtggaatgatggatacaaacacctactgtaaactgaagaacactaaacaaacattaggtcaagtaatacattcgggctgatacttgaaaatgcagtatgaataaactgcaccttccgtagcattattgggcacctgctgacctggggagttcatctttcagtgtcctatctttttgccttttcatactgttcacggggctctcgaggtaagaatactcaagtggtttgccattcccttctccagtggaccacattttgtcagagctctccaccatgacttgtccatcttgggtggccctacacagcatggctcgtagtttcattgagttagacaaggctgcgatccatgggatcaactcctagagttggtgatggagagggaagcctggtgtgctgcactccatggggtcgcaaagagtcagacatgactgagcaactgaactgaactgaactgcacctttctgtgtattcaggcttccagctgagcttggcaccagtattcttcaccacatgggggtttgagggatccagtaaacacaatactcaaagatgtgtcagaaagccctatcagtccagaggcaccaggcacaggcacatactgatgccttatttaatcaacttctttaaggaataacagatttctcataagttacttttccatgaagcagacatttttccttttcggtgctagacatcttgaattttgatattttttgccagaaatcttcctaaaatgtactgtctattctttcccctctcaagcaaagggtactaccaacgtcctttacagtacggtaaaaggtgtcttgcaggtaagacaatgcagtggacagtttttctgtcacctccttcaaaatgtgtctgcctgctaccactgttaataatgcctttcaaagaccctttataattttgcaacttcaaataatttttaaactggattaaaagctagataatcatattctctgagactagtacattaaataagactctgaataaagctgaaaagtaaaggatgtgacttttggaccacgataacctctcaaagggtaccagtcacatggtatctctgacaatatgtatcaacaaagagaagtagctgcatgaaggacattggtagttaggtggtccttaagttaaagaagagtaatattttcac

SEQ ID NO: 54321 - DNA, 1551 bp, Bovine  19866881183782
tggaccctctaggaatccagtgaggcacagttcaggttgctttggtcctctcactgattctaatagtagctgatgttttttaaatggtctgtaagagccaagcacagttacaagcatttgatctgttcacatcattcaatcattggaacacacagtgctttcagaatatggagtagaaaatattgctgggcacgaaagagttttattgtggactgtttaaaaatctattcaaatgctattaataaaatggcattatttgctgcacctaatcatttcatggtaatggatgagagaatctctcctccactgtggtatgattttaattgtcaatttgtgatactactactcagaaaaaaattataataaagcatatcagcatgtcagtccttttagaaagcacattatcaaagaattactttgtacttctttttttcctacttttagttaccctagtggagcttagtttttaaaatcattcaaatgacttggccctagttgataaaatccttgtaggtaaataatcttcaccatttgaaaaatcaagtaagattaattactgaaatttattctgtggttatagcactgcttataaagacctagaacagtagctatcaaacattagcaagttcagaatcacctagagggcttattaaaacacaaactcctatgccacgcctcttgaattattgatttactaggtctggggctagggcagtagaacttgcatttctaccgagttcctaggggatgctgaagcttctgatcacagatctaaaaaccctagagcagtagttctcagctttggcagcacagtggaattacctgaggggctttaaaagctactaatgactgtgtcctaccctcaagagattctcacttgggggtctggtctgggcatgggatttttaaaagcttcccagctgattttgaagggctgccaaagtgaaggcctgaagtcctaaagggagacaaagactgtctgtttatgttttgttcttactgttttccctctaaacttagactcatgtaggtgtctaaagccagacctcctgggtatgacctcccacccgcttctattttagatcataggttggaatggctaggaggcttgtaatttcttgagagtctgtaaattgaacactgctatctttacttgtcatgtatcatctggaggctaaatagttctgactattaatagtaagcagtgttctagtacctcttctcagttgtctttgaagtacaatgcttgtatgtctggaagtaaatttattaattaagatttctgtatgctgaattatcatggattgattgtgactataatagaaaatctattagaaatgctaagaaaatttgcaaagagcatatttagaataaaaaatatagcctatcttctttgaagacagaatcatcaggccaccaaatctccttttcctctgtagaaagaaaagtagattagagagagaagcagtgaaataacaaaaaagttcgttggacctaaggaaggccaatcatatgccctggggaggagaaagtaatacaacctaaacttcg

SEQ ID NO: 54322 - DNA, 944 bp, Bovine  19866881274599
ggacactttagatggatctcctaccacttttggaaaaacaaattagaccacctgtcctaatgttatgcatcatacatcatcacagtggcagagagtcagcgttattaatattatgggaggtggtgtgtagaaaagtcatgcagtatgaaatccaattatctaaatttagagactagcattgccatttattagctgcctggccctgggagataacaattacaaatattcactgagcacatactatttgcctgtactttgtttacataatgactaacttcatacaatcctaagaggtatataacttcattacttccacttcacaggcaaagatactgaggctctggggaaattcaggtaactcaccctaggttacactgttgggaagtggaagaaccaggaataaaaccctagcaatatgactctaaaacacatgttcttaatttctcagtctttgattcctctagaataaaacagagataataacagctgcccaacctaactaatcagaattatattagcaagtacaagggcatttttaataaactgtaaagtaatagaggtcaatgtatgaaatccaaagctaacactgacaagcagatgggtttatctggaagatctacacacatacagatttccttgtctcctttccacttaatactgagagtcaaacaagttgtgttaagcccatgctgtttctaacaacaatgatcttgctatccagacatttcttaccttacctctttctatatcttgagttcctacttatggaagcagaaatcaatgttatatatccttaaactgctagagagtacagattttttaaattattattagtttcaacacctatagtttcagagaattttttcaccatctggggatgatgatgtttatactatctgatcacttatttacatggatgtgcttagtcactcagtcatgtctga

SEQ ID NO: 54323 - DNA, 1381 bp, Bovine  19866881501393
ccaaacatgccacctatgtaggcatgcctttcatcaaagcctttatggataattgcattcacaaaggagaccctacaaatacatataaataggtaacatttttaaatcacaagtaaaggaataaaagctaaagcgtcttagaagttaaattctttcttttttcttcaattgtttgattccacaaaaatcagaaggcactacagccaacccattcccatggtgccctgtgtgaaaacaagtcagcttagatatatgatggactaaaatcccactacataaggctccaagcagtgagaggaacagacatgagaagaagttcaattctgaattaacatacatgtatcaccaccatgataagcaaaaccgaaacacaactgtcagctggctcgctactttagaatagttattttagaagaattgctaatatgaatgaatgtttctaacagggtggtggttcggatgccaaagtgaggacacatacagattcaactaggaaaaacgtacagatcaccagaaagaaacatcaatgctagagttatcaaattcccggctccaaattcacaccaacccagaatcaagagtctcataattgacctcctatggccaggctgaacacaactaggtcatgcaatgacacccacattcgtgtacttttcctagataccctaagcggctaaagtgatcttttcaagttcatgcttttcttcatatttctctcctattcttccgcttctctgcctttatcacttgctagtaccagattccatatgcaaatgtggtgtgttccttcattccctacatattgacttctttctcctccttccttgcatgcatgccaaaaaggagctcagccaaagaccaggaggtactaagcatggagatcaggtcagggagggcagtgaggctggggcttgggaaaagccaatatgacacagctaactgattcatcaagattagtgtcccttttcataaagggacaagggaaatacactgaattctgctttacagaaatactaaagaacagaataactcacttgaattaacttggaaaaaccatttctattataaaatagaaaaagtcatacattacaacccttaagtcaatacataaataaatatcatgttctgtgccaagattttatcatgacaatttttagggtgttgaaatgagaagtaccatttagatattatatactaattcagtctgctatagccattcttccaggggattgtgatatttaaatactgtattttatagaactttaccaagtctctaaaaattttttgcaatcaaagccaattaaggaacagattggaactatcatgggtaatgtgcttaaagacttgataaacactacactaatatctatattcatctttt

SEQ ID NO: 54324 - DNA, 743 bp, Bovine  19866881733641
gctttctgatattttcagaactttgaactgcacttttagctacaaattaaaagaaccacttagtctgacattcacaaaacaggaaagctattttatataaagacttgcagtgttttaaaagtctcaaagcagtcaaatgacctatcaataatccacattttataatgattataaatacttcttctatatctaccaagcactaaaaacacaaagaaaaacatataaaaatacacactgtaagaaaagtatgtaagaactaaccttgaccagaagttcagttacttcataatgaccataggaacaggcgttgtgcaggggtaccagatcactacaataagacaaggggaaaaccctgcgttattacagattccctatgctttagcttatgtacttaaatttaaatagcaaatgggttatgtcaccttctgggcttcccttgtggctcagctggtaaagaatctgcctgcaatgcaggagacctgggttcaatccctgggctgggaagattccctggagaagggaaaggccaccgacaccagaattctggcttacagaattccaaggactatatgtatagtccatggggtcgcaaagagtaggacatgaccgagggactttcactgacttctgtatcttttccaaactcagaactcaaacacttggtcttctttgaaactttttcttttaaagattctgtaaggtaaactgctatattccttaacgtaaacccaattccttcatga

SEQ ID NO: 54325 - DNA, 867 bp, Bovine  19866882067397
cactcttgtgaaactacccattctcctttattattccagagtaattccagtttaacacaagtttcctattcatgtatagtaatatatacctgaattaggtggctatttctcaccactatctctacttcagttatagacagaaaagcacagaattgtccagataccaaagaatattagatggcacattctggggactatgtttacaagacagaaatcctacaagtaacacctaaaaacttcatgacagataactagaaagtcacatcaaagataggaacaaaactcaaattctttctttccaaaagcctaccatctgtaacacaaaaagcatttgccttgaaaaaagcaaatacaaatatacttcctttcatagcatcttaagagtaagtgattaaatatgctaggaagaacaacgatacatacccatggctaaggaaaatagcctatgatttaaaaattcctcctccccgaaaaaacccaagaaataaaaagtttgaggttacttggtgtaagagtttagctgaacattcatcattttatacttacatgctaacctttcttttaactgtggtgtgggagccaagtctatagcacttttattgtgacagttcagcagtgttggatctgcgccataactcaggagaagagaacacacttcaaccctgttcttggaagcagcctcatggagaggagtgaactgccacaagtccattgcatttacgcaggcaccatgctggtggtgggggcgggtaaagcatatatttagtgctcaacttttaagagaacttagaatattagtactggggtaatttacatcatgccagcttaaaagggttatgtccccaaagggttacttttcaaaccagt

SEQ ID NO: 54326 - DNA, 754 bp, Bovine  19866881131881
acaacccctttgaggaggtgctggtaggtgcattcttctgggtgaagggcagcagtaggtatttagaagacagaaaaacgagatggcttcctgttgcccgcaggaagcctatggcatggaaattctctagtttctgtctttaaggccagccaacagtcaatgaattttttcattcaacttatttttatctgatgtattatattaaaatctgtatgttagaaatgaaaaattcttgcacaggacccaagcattgctttttctgcagatacctcattcactacttacatcctctaactgcagtcctcagttctcctgtggttattacatgagtgagtagatgtcctctcaccatcactttatccccacttttttcagatttttttcagtggtgtctgtgcttttcttgcttttctaaccttgcatttatttccctgcagatctcaccatctgctgcaatttgactactcaggttagtgaaaatttgcccatttaccagttttgtgccttaggcagtattcaccagcattctcctacttgagatgaataaggatctttacttctctggccacttgtgactcattaatggtgaagttccatatctttagaacagtttcatccaaaaaaagctagctggttttttgagtatttttttcttctgaattgtagtacactagtataggaaccggagaaggcaatggcaccccactccagtactcttgcctggaaaatcccatgggccgaggagcctggtagg

SEQ ID NO: 54327 - DNA, 778 bp, Bovine  19866880514128
tggagttggctcatttcaagccctcaagagatgagaataaagtagcttgctgaaacattgattaacacaggagactctatctttttatcttcacaagcttattaattgcaagataaacttggagcagctctggacttcttggccacctgcattatttaggaagggaaatgaatgaatggttactttaacttttggtaaatgagagaaatgaagacacatttcctcttcaataataacgtaagaggaaaaaggagatggcaaacttccaactggtacagagaaagattaaaccctgtttcacttggaagaactacagattccagctgaactcagatattcattggtattaattcaaagccacatcttctttaaaacaccactgttttgatgatgtactcaggttctgttttctttgccttttcctcattaggaattggggtgaatattctgtttgcctttccagaactttttcccctccgcgccccccaccttattctccactcctggaggctgagtaggcatggattgcatcgacaagttccctttcctgagagtcctggttggatttggactgtgggatgcactcgatagacaggagcacagaagagagagtccaggcatggtttggcaggagctgtgtttctctctccaaggtcacatctcctgcccatcaccctcagtgacatctagaactcttgccagcctgtggtagctgctccttcccttgtcctcagaaactgaggaatggtaaggattcatctcgttgctgggccctggg

SEQ ID NO: 54328 - DNA, 1549 bp, Bovine  19866880533443
ggagaacttttgaatcaaagcaccaactcacatgggaaatatttaacttcataattaaacatattttctcctcttccattgattccctcagagtaaagaagagaggagagatttccctttcttttcagttaccagctgttacatctttatcatctctgatgaccagctccaattcgtttcacagccctgacctctatgtttagcaggggtccatccaggcattggttcctggacaattatctacaaataagatagctagatagatatcaacggagatatgagtacagctgtggcctgctaaaaatgtaagatcagaacgcagaccccttcctgtggggtaaccacagagctcctgtaacagccccctcccgggatcttagaaaggatccacgtctatttcagaatgcaagagtgggctgcatgcacagtatacccacatagctcctgcgatgggtgctgacagatggaacagatgataatgggcagagccgtagcccagccaggataagagaagagaaaggattacattccaagtaagcacttctaattatctgcttctttttaatatgggtaatgtatctgtcttctaaatattgaatataaagcataccgtatttccatctaggacttcaagatgctatccatcctgtgccaaaagacacccaccatctcaatttctactattattagagtattaatatcattagaatgtgcttggttctagaaagtttggttaaaacttatccattccaatcatttcttcttcaactcctgctccatggataaaacagaaatacaattttgattgtaaatcatacttgagtaaactacattttaaaaatagggaaaaagaaatggaacttggaaagaagctgttatttttccaggtgaatttcattattagcttgtacttcacagcattattcctaatgcaaagtagaatagtgggaaaaaatccaaaaacaatggattttttaaactttttattttatattggactatagacaattaacagtataataatttcagatgcacaacaaagcgactcagccatacaaatacatgtatcctttctcccccaaactcccctcccatccagcctgccacataccatttagcagagttccctgggctgtacagtaggtccttactggttatccattttaaatacagcagtgtgtacatgtcgatgccaaactccctaactatctcttcccccacccttctcccctggcaaccataagagaaaacaatgaattttaagcatagccctgtatgtaatattgaaaagcatttatttaacttctctgagatgcactttaagaaaaaaaccaaggaatggcattagttctcttacaaacttattttgaggattaaatacaatcatgattaatgttaaccttccaacagtaagacagttaacaagtattaagtatttgtcaaatgtaatatatttgtcaaatataagaatcgatcatcttattaccattataatgtttatcatctctacttctattaagagtgctttaggcaatggatgtggctcttt

SEQ ID NO: 54329 - DNA, 1883 bp, Bovine  19866880590166
tttctggaatgagatgtgtctctcctaaagtaaggagcccaggctctttccccaaatcattaaggatcattgggaggctcgaatttttcccagtcagtttgaattttctatggaattttccaaggagatcgaacctggaatcctaaaagaaataaaccttgaatattcattggaaggaatactttggccacctgatgggaacagtcaactcactgaaaaaaaccctgatgctgggaaagattgaggacaggaggagaaggcggtgacagaggatgagatggttggatggcatcactgattcagtggacgtgtttgttaagtttgagcaaactctgggagatggtgaaggacagggcagcctggcaagctgcagtacatggagtcacaaagagtcggatacaacttagcgaatgaacaacaatggaattttcctcctctgctctgcagctttgcttctgtgagtattgaattctacccacttgaactcaactaaagaggtgattacagtgtctctttctcttcccttccagcaaaatgcgactaagagaaggcattgtgtagagagattttgctgaagttagggtgaaaatggagctgctttggggatgttgcaacgtaagagccaacaccacacaacttagcattggctccatcacttctagaggtcagtagatattcctgttgccaagaacgtctcccttgctgtattttgtctcaagcccaatcaccagagatggagcctgtttttcctcatcattttttgaacatatacacacagacacacacatacaaacacacacacacacacacttcagaaataaaaaaccataaggaaaaaaataataaagtaccactgttacctatcagagtagtacaaatgtggatttctgtcattctttgagcatctcagtgctttataattcttctgtaatgaatatttattgctttcattgcataaaaaagagaaaagggaagcattacttttagtgtaaaaagaagtcatgtaaaagagttcttgttccgaggcacgtgagctgggaagaatctttcttacctcgctattcatcgctgcctcttctgacctcaaagcatttcgtgtttcaatcttttttcttttaaggcttgaggagagtaatctagcagggggtctgataaaagaatttgaaaaacgagcttttctatgtgaagccttacatcctcctagaatgaatcgtgctcgttcggctagtaattgctccagactccaggaaagacaagactttcccgtccaggaagataaagggctgtgcgactgtagaacccaattcaattacccattagtgtttgtaactgctggttctttcctgcttcgcttcaacccactcctgggaggattcgagtcccctggaagcatgctcagtagcacacgactctgaggactcaaaagtttttggttttaagatctgatgcacaaatcgcacattttggccatccaatgtggattctgagtgaggccaaaagatttcctgggctggggcctgaagtttagaatggcctgaagcaggtaacacaggatccttggcgacagacagcctgagcctttcttagctatttcctctgaacagctatgtcctgtgagcatcctctgcttagtcctgtctctctttgcaaacctgctcttccccttcctgtttggagtttgtgtttggcctcttcacctctggatgagagaagtgacatttgcaaactagaaagatccccagagtggccgagaggctgagattgttcggccgtggctcaattatcgtacaactagtgggttccaaccactcagagactcaatgtccacatattaagataattttatggttattatgaagacagtacactgcattggttacaca

SEQ ID NO: 54330 - DNA, 746 bp, Bovine  19866880595960
ctcagaggacaccacagaggactcaggtgtgatgagctccccctcggacatcgtgtccctggattcccagcacgacagcatgaaatccaaagacaggtggagcacagaccaggaggactgcagcgaccaggacctggctgggacgccagagccgggccccccgaagagccccttgtgggagaggagcagctctgagaaccggcatctgaggtgaggcatgggccggctgggaaggggggtcccctccagcctccaaggatggaggcctttgtcccagtgagccagccagggctccatagtgaggagcctgactggggatgtgttgcacgtggttctgtcttcatgctgtgtctagctattcaggtatttataaataatgcatagtgtcagcttgttcacatttacctttcatacaaacagcaccataacctgtttccgcaatatcacgtgtttacgatttgtccctggtgacgtgtgtgttcatgagttcactccctcatccagttctttatgacacttgagccgttctggtttttcacccctggagtcaatgagcaagttgtatgtatatgtccatttatggatagagttttttagaagaggatgattaggccttcagagaaaattcagctttttggaatattggcaaattgctgtccgaaatgatgacctgctgaccacgccctccagctgtctgtagagccctgcccgtcaaccttcacaccagtatgcggacgagcgggcgt

SEQ ID NO: 54331 - DNA, 1450 bp, Bovine  19866880855979
gctgggggagactgaggtctgaaggctgacagaagtcaggtgtacgcctggctctcccacccagtgtgcgcccccgggcggtggcccctcctcgctgccaggggccccgctctccacccagtccttcctcccactggctccccagggaggacaatcccatggaggtaaggatggcagccacaagagcagccactgaaagcttgggccctggcatgcggagcttcaaacccaccctcttcaggtatgaaacagccctggagctgtccaagcctcggttgtcatctttctgactcatctgtctaatcctccatttttgaatcccctacaaacttcatttgcatttggaagtaggtccaatgtcaagatgatcaaacgtattttgaggatgaaaaagaagtcttttttgaaaagagataaaatgaatcaggattattttgcctagagaaagttggtaagtaattcaacaattatcttctctacccagaagctggcagggagctagctgtcatttccaaggaagatagaaaaagatcaagtggttggatggtggaaaaggatgaacttcctaagctgagggctgcagagctcatgtgggacataggcatcagctgctccccgggtggaatgcacagaagcattatgctgttgggaaaatgcaaccctggagggtacctggtttataaatacgcatcctgtatagctcaggagcccctgaagtagggacacacacaggctcaatatatggacgatgccctctgtgtgtgtgtgtgtgtgttactgatgcttagtcactaagtcacacctgactctttgcaaccccatggactgcagcccaacaggctcctctggccatgggatttcccaggcaagaacactggagtgggttgccatctccttctccaggggatcttcctgacccagggatcaaacctgcgtctcctgcattggcaggtggattctttaccactgagccaccaggaaatcctgtacgtatgtgtaggtatatataaagaacttaggcctgtctggaagcagggatgctctacatggtgtttgttaaaattcaaaagaaatcccaggaaacaagaaaggatgatctcagacgaggtgtgacaggaagcagaaacaaaaccagccttcgattctggctgttgctagactcaaatcaagctggtcccctcctggggcctcagcctccccttctttaggactaatgtttggcccctgggttcacagactctaatgggtaagtccccgtccatctctggagcacagccccctgcccaccggcattcacagccggccgcagcgggctcaccaccacgacctatgtgaccgcatcatcgctgtgctacgctgacctggccactggcgagcattctgaggccggttccaactcgaggaacatttctctgctcccggctggctgcctcggcccataggatacagt

SEQ ID NO: 54332 - DNA, 1123 bp, Bovine  19866881277377
agtgtgggggaggatgtagtctcctgggggctcaggatatggaaaggctgggtttgctgtgggatctgcctccagtcttagacttgacatccatctgggtggtttccttcaagcagccaaccccatgtgtggggacaggatgctgacttcagctgtgggtgccaagggctctctcactgttttggctcttttattctcatctcatcattaaattgagctcaagctctcttctttcaaacagcagtactcatctcgctccaggtgttgttccttggttcactgcttctagaggctttggatgagccatttaaagtcccagagacacagcatgcccatctgggtaatgggggcaaaggttccacgagcttcacacactgagacatgcgcatgcctgggagtttaaaacctctgctccatggtaccctggggaggtctaacctcccgtacagtgctagcgttagaagcaattgcccttacatcacagctctgccttctccttgatgatacaaagacgatatgtacagctctagtggtgagaaaaagatggaaattggaatgctttgtatgccagaggaggctgcagctatgagtttctaaaccagtttcttaagacggattgaaggaaatggatgtgaatcttacagctatatctcaacttaaattcagccatcaagggcctgatttctaaaagcttatttgcacttttccaacagaatactacttgcaaaggcagaggggtggagcgaatctatttcctatgaggtgaaacctcctattcggggttttaagtgggctcatgtattatcccaatggctgaccattctcctggagctgagggcacagtaagtccaataaaatcaccccagcagtttgatatatcatttcatccgtttctgacttggagaagtcataaactcatgtattcagagggacctgtgctaacaattctagcttggtcattcagagtatttacggcatcttatatcgtggcacctgcactggccatcccattgccagacatatttatccattgactttgttttgggcctcgcacatgccaaaaaaatatgagtcatcttggtggggggagaccacagtgtactctgcaaagagaccttttaca

SEQ ID NO: 54333 - DNA, 1149 bp, Bovine  19866881351903
tgccccgcttttggcagagtttggtcactggcctcagcactggccctccttccttccttggtagcagggcctctggtgacataaccagtcaccctatggtgagccagcaaccctgtgagtattaaccacgtcttttttttttttttcttttcctgtattttgttgctttgacctctggggctttgcctaccctgaagggactggatcaaccactccagagcccaacctccagcacctgcttctggggctctcacactctgggtcaccacccccataacctggggaataggtgccagacaaggaaggacagtctctatggcttagaacctgcttaaatgatctgaattagacagtcatgccagctcaccctgccacgcctcattcttttctggagaaatcatagttgtccccagggttctcactccctcggtgttctgactgaccctcttgcttccccaggccccctcccccactctttgtggcatggcatgccccttcctctcggggactgtgagtaacagactaagtttccaatagatatcatttcatgattttctggcttcacccattctaaataattacaaaacccatattaagacaatgagtgtggcctgcagtgtatcagcaggaggctggactcaggcatctcagatttatagatgctcaaggatgcccttttctatcaactctcacccggtagaaccaggtatgcggcttccttgtcctgattactttccacttgacaatgatgtacaatctctgtgctaggcccttagtacaatccttaaatctatatttcttactgagccagattatttgtctttctgacaatattagaccctggaaatgtaattttttaaattaaagaactttataacgtgcttcctcagaagagctccatccagtccagatgaggacatttatctctagttctgtccccttggtgatattttaatactgcataattcacttaacaatgtgcctattaattatagcaaattcttacaatcatttgcttgtgctgctaaaaattggatagtttgagaaaagttttcctctgttaaaatccttgccagatttcagaaataatatgcttggcattattaccaaattaagttatttttcaaaagattttcacaatgaactaca

SEQ ID NO: 54334 - DNA, 723 bp, Bovine  19866881423042
ttcttgcctaggaaatcccatggacagagcagcctgatgggctacagtccatggggtcacaaagagtttggatacaactgagtacgcatgcatgcaatcttaggttagcactttctgctttacacccaagcttgagaattttccaaagcttgcagttagctgtaatggcatttgagctatgggattatataattcaggtggaggacaatggaagcattaaatttcctgacttgggctctgtggctatttatttggaagatgatttaattatgaatttgtatttggtatctgctaaaaatagattgtgcttttccacatttgcaaaaattctgcagtaataactttttagttcaaaaaaaggttcatttctttagttcaaaaaaaaagctccccccaaaatggttcacaggagtcttgagcctttgcaagagctgtttctctttctgactggaagacccaccctgtgctctgagcatcttcccatcctcgctctcccccctctcactggtgcttatgacacttgcaggctggagatgctctcacccctgttccttcccccttgggcgtttaggcagctagctgcccttctgaccctgtgtgaccatccccaccatacactgcaggctccctgagagcaggtcccctcgcctgccgcccagcgcaggctctgtgtcctggagcaggcatatggggtgggccctcaccgacacctgtccgtcaggt

SEQ ID NO: 54335 - DNA, 954 bp, Bovine  19866881774715
atctcctccaaagatgcacattcttggtcagagtcctgaatttcctcaatatgctcattcattcacacatttatgatgcacctactatgtgccagcaccattctctggagtctctccaggaagagagggtcagggaacgcagggcgcattttggcaacagacagaaacatctggcttgcttgcacttaacagacaatgtttgttgttggataaatagagataatgcaaacccaaatcttctggggagaaataacgtactgatggtaagttaataactgttgttggatcctgttgtgagattagagtttactgggagagtatttctagagaaaataggatgctgaaaaaatagagaaaagaaagatacataaacacaaatctgagactctgtttaaagggatggactacagtgaagatgcccaggaccaggtgcagtgacactaggcaagaagactggacttaaatcgacttcctccggttcaaactctggctgcagacagcagggccgtcccatcttgggggctggcaaattcctgtcccctgtgttttcctatagtaagcaagctgagattgttttctacagtttttaaatggttgagggaaaaaactcaaaataggaataatatttcattgcatgtgaaattacttgaaattaaaatttcagtgtccatttttgttgttgttcagtcattaagtcatgtctgactctgcaaccccatggactgcagcatgccaggcttccctgtctaccaacagctcctggagtttgcccaaacccatgttcactgagtcggttcactgatgccatctaaccatctcctcctctgtcgcccccttctccttttgcattcagtctttcccagcatccaggtcttttccaatgagttcttcatatcaggggccaaagtactggagcttcagtttcagcatcagtccttccaataatattcgggg

SEQ ID NO: 54336 - DNA, 672 bp, Bovine  19866881873875
taaattgcgattttgttcctggcagggggcacagtgggaatatctcagccgcgggtgcaacactgcaggcttgttcggtaggaagccctgcatcgggtggcatctttattaagtcacaggctggtcgggtcagaaacctgtgcgtgttctcacagttcagcttccccgccaagctcccatccagggaaattccagggacgggctcgccttgagcagctaggcctgcgccttgtaaagaggcaaagcaaggcctccaggtgagggcagcacagcttgggatgtgtgcagacattgccaggtgctttgggaacccgtaagtttttgcctctgatctgtttcccgtcatttgataagaatgttcaaactgcattgagttagtgcagcctattttttggaaggagagatcctttttctataaacattcagaatgcagtaactctttatctgatccttggagcaggagctgctctgctcagcttcatccaggagcctttgccgacagctaagcgatccacacccatgggctctttcttaacttactggaagttgggtaatagctgtgggactcggctctcaaatgttcctctttgaatatgaacttgatgtgtgctgagatagccacattcccatgctcacggcccacggggtgagtttgctgtgtgttatggatag

SEQ ID NO: 54337 - DNA, 1421 bp, Bovine  19866881893443
ctggaagtgatttgcaatcctcagttcgctgcattagaatgggggtgggaaagcatatttattcagcacatggcatgtgtcaaatttgttacatgctttaccaaccttatctaaaccatgtctcacagtaattctgcaactttggcactaaccaccattttacaaatgcaggggaaatgggattcagtgtgggtggggtcagaggactgataagcagccctttaaggacttgaaagtttctcttagtgtcaggttcattatattttaatccgttcctcttcctcttccaaactttactgtttgattgtcacagaactcaggtctccactccagagacttttcaaatgcaaatcccaagtctcggcatttccgcatcacgtacctgctcttgttaattcaataaatcaaatcaattcgccaaggaccatccaggaggatgaatcagaaagagatgaatcagaaatgcactctgcacttaagggaatttataaactattagagggagtaaaaccacatcataattaaaataaatacatcagtgcatccctatccaagacaaggagaagctgagatgttctctgtccaccaacgacagtgaagggtggagggaagataaccaggatctggagccaaggagagaggaagagagcaggggcccagacagacagacaggactgtgaggtgcacagactccctggggatctccttaaagactggctatgggcccgggggcctgcattctcataagcacagaggtgagcctccgccacattttaagcagcaagggtccagtgaggatcaacgtgtaaagtgcacagtggcatgggttgcctagaacaggaggagagtctaaaggtcagggagaaggactagcaaacgaaccaagacaagggcgaagcggggagggcaggatggtgccctgttcatggcgagtgaactgtcatgctacagattcactgctgttcctctctgcaggctgagaagtgggcaagtcagccaacttaaagcattgtaaggatggagtggacagtcactcaatgctctcagttaaagcaatcaaccaacgaaaactggagagggagccattcctggaaagacgattcaggcctcatcaggaaacccaaacgagcactacctgtcagtcaggtggtactacctgtcagtctgtctgccctgcagcctgtcggtcacctgtctccatggctgtcgccgtgcaggtttgttcatggtcctccacaggggtctttggacgcgtcactgcactgaggttgatgttatataatggctaatagaaatctgtctcgagtgaaatagtcaatacaaaagtgtgtgtaaacacaagtcgtttggagttttcagaatatagagcattacacggttactcacgggaagagaaaaatcaaccttccaccagcactcaa

SEQ ID NO: 54338 - DNA, 929 bp, Bovine  19866881920989
tgtctcctgcacagataaagcccttttctgaggaaagaatttaacttaaagaaggtactttactgcattcaaataagccccttaaacattctgcactttaagcttttattctagattccattgtgaggtgataatgaggtgctgaaaactaattagctcatcagacagaactgtctggtctgccatctgctgagtctggagagtgatagtccctggtcaaactgagaaatgggactaaaaatatcacactctcctgttcttcaccctgttcttgcctttgtgcctgaggcagaagccattacgtgggatttcaggctgctcgcctggccatccaggctcagggtcacacactgatcatccacgcccacgtggattttcaaatccaagtggtgtccttgaggttctctggacttgggtcctcctccaatacacacaccctgttacactgtatacttgagaggagtgaatggtttgagactgcaagaaggttattctcattaaccaaattgccaggaccccaaagtatccatcagcagagtgtcccccacatagattttgcaatgaattcttggaccttttctgtaggcaacttctattatcatgggttcagatagcttgtgactctggaacaaggcaagttttctttgttcttttgttacttagagcttccctgggtggcaccagtggtaaagaacttgcctgccaatgcaggagacacaggttcgatttctgcgccaggaagatcacttggagtaggaaaaggcaacctactccagtattcttgcctggaaaatcgcatggacagaggagcattgtgggctacagtccatgggtccccagagaatcagtcaaagctgagtgactgaacacacacagcgtgaaggactaagacttgataagcaagttgcttccccagagttactaatgtt

SEQ ID NO: 54339 - DNA, 1650 bp, Bovine  19866880458349
gaaaagagataaaggcataaatgaaataatactgacctgaatagataactcctgaagctgaatgatgggtacaacatggttcattaacctactctgtctactttgcatatgtttgaaattttccatattaaaaataaagaagatttggtagcactgtggctgtgggcttatttcttaacctactgatgtctcagtttcttatctatatgataaggaacaatagtacctacttctagagttgagatgagaatgattttttatatttagacatattacatctaaaatttatataaatatattaaaatcttatatgtaaatatattatatacatgaattctctaaggttatatataaatgtatattagctagataacacacacacaaagggcccagcacatagtaaccttcagtaagtatcagctctattagtatgaacacaaggtactaatatggtgtctcaatacaatgggcacccaaatcatggcagctgttgttaatataaatggcagagttaggtctagaacccaggccagatttttaatcaagtatttgacacatctccttgatagaccaggtcaatgacccactggcaactctaacatccccggtgtctcctgacaaataccagagaacctaatacaggatcaggagctgactaatgtttaacatgcttctctggaagcaggcagggccaccttgtttgccaaaaccaggtaatttatggtacatttcctaatatctgctgacagaacaaataagaaaggctctaggacatgatcaatgttcacaccagccttcaaagtgatttggtaaaaccatagaaaataacacccagctaaggtgcaccacacagggtaagagctgacaaagaaatggcaatttttccctgagcaaatatacaagtaacagatgagtgctgagagactagctctttaggtcttcacactctccttcctaccccctatattttaagagaagacaaactctttttcaacatacttcaagtatgactgtttgctggattaactgcttccttgaaacgataaaattatagacaaagagctcattctaatccttttatcaatttaagtacaaattggcttaggaatattattaccttttctacctcctctaggagactatgagagggtatcacccactccaaattatgggacatgtcctccccactccgatcaacagcaggaatatggatgccacttgatctatgagtagtcacacatctccatttctgctcaagtcgctcccattgcacacagtagcctctctccatctccagagcctaaatcacctgtgaccatactttctggaaacaaaggggaagaggagagaagtaccgcgtgagaaaaggtatctgggtgctgcttctgggtaatctgggagatctggtccaaacacagaaacattggtgtttcgtattataagcacaaccagaaggaatattagaacttaagatggtcctggataatacacggtcactttgtcctacaaggcccagtataaatgctcgcttctccaaaaatgttccctaggcaccacaaatgaagcaatccctccctcctctgaacttccctatcactttacccctttatgggactgctaagagttcatactgggggttcttacaactca

SEQ ID NO: 54340 - DNA, 2217 bp, Bovine  19866880472920
tagtaacacaggagcagatggggagaagatgggtgggtttactagcaggcgctgactgaaacagttttagagacgaaactagggaagaaagctgaagagcagcagcctctgccctctgggccaaacctgcagagatgctgggggttcttggcaatggtttgaaagctcgtccacccaggcacagggctttacttctctgatgccaaaatcctctgcatgcctgcccctccttcctgtgttcttttaaaaaaagaaattaatggaatctgttcagaatacccctgaaatgaaattacatttttaactctaattaccctaattaaaacttgacagctgtaatcctggaatggcagatatgctaagtaccccatgcctgtgacaagcttacttacccagatggaatgttctgttctgggcttaggagaaaaattcttctgtgtatttgttttgtttttccctatcggccattagtctttgacctcacagcttcctcaagctaggatagtctgtcttgtgggctacaggacccctgaatttccacagcggtccgtttgctttcagaggtgttgctcctgatgattcttaccacatacctttgagttctcacttctgttgaggttggtctgcatgccctgagcctgtccctgggtgaaatcccctgcctgtgggggacctgcactttttagagggctgtctgctgatctagggctacatctgtgtctgggatcagttgatggctggtattaaggttacagtttgaggtcagggacaatgagctctgaaaataggattcctcttctcttcacatgtatcagcataggctagaagcaacttggtgaaatgcctggtcttgacccctgtcttgactagttacctggacagacaaggaacatattggggagggagggagacagtccttgaaacagcctgaaggctctgttgatgctgtgagtaatctcacagttctattaggaccaaatatccccatgttctgttactttcttgtagcctgaaagcctgtttagtcagtggacactgggtgttaagtactgcaaaggatacagagttgaataagacacactctgtgccccctgagaagcttagaattgtggggggagtaggggaggcagtagtggatgaaggacagccatataatgactagttacataagacagaacaaggtaaaatttcccacaggtgttagcatttgaacttgacccgaataggtaatactggcagaggaatggagaggggcattgcaggttttagggaatagtgtgatggaaggtgggaagttgttagatgacagtctgctgtgattggaatacagtgaacagggaagggtacgaaagaggatgagattacggtttaaactatcctgtaggtaaagggagtccgttggggctgtaggactgtaataggagtatgtgtggtggattgagagggtgattggagacagtagattagaacagatgtcaagtaaactatggcctatgggctgaatcagtctgttgcctctttccatgaagtaatactggaacacagccacactcatttgttcatctatgactgctttcatattaccttgtggcagagtcaaatactacagagactgctggccctatacagaaagtttgctgatctttgagttagaaagtaattatgaaagttccgtaagaggagataaatgtcaggagtaagcctgaaatgaattggaggtgtcaaatgagactgcagaagctgagacagtatgatttaacagagaacacctgccctacctacctctcacaactttgtaagagtcaaattttctgaaggtcacgatgtcacaaaggacacaggacatgagtaagtcctggtttgcccttattagctgtgaccttgggcaaatcacttaactttcccaaaagtttaggtgaatgtgttgaatgaaacaaaagaaccaatcaggtttttcctcatgacacagaactcttactctgctgcttatctatgcttcaccccctaggttatgtctgggaaagacagatatcctagaaaacttggaacatagtttatagtttgagttgtgaagctggggacaggtgggcggaaggtgtgggagaggggctcatgatagtttgagggcatactgtgcccttcgccttccctaactgctggcacttgttctggccagatatttctacccttcaacttccagagcatattaggtccctg

SEQ ID NO: 54341 - DNA, 4665 bp, Bovine  19866880540002
aatatcctgaagtctatttttaaaaattaaaatgtatttaaggacttccctggtaatccagtggttaagactccatgtttccactgcagaaggtgcaggttctgtgcctaatcaggaaactagggtcccatatgccacatggtgaagtcagaaaataaaaaaagttttcaattaaaatgtatcttaaatgatgcagcaatttatataaagtattatataaaacacaagcagactttgtaatttttttaaaagtataaaaaacaaaaacaaaataaagtcagggctacccttgaccgcccctcgtcccatcccagatagcttccgctactgctcctgatttggagttttccttgtttctacacaacacatgtatgtacacacaggaagtgcattgtgtcaaagggcctgttttgcttctagttttagaagaactatgctttaaaaaactttatgaactgacaattacagggacagagatcaaaattccaaaggttcaatagggaaaacagtgaaaagtgggtgtccctctcttctctgttcccaattgtctctttactccctaaaggcaaccagcaattctagcttcttgtaattccttccagagatagtctagcatttaaaactcaatgtgtaaatacatatatgtattttccaaataaagaaagactcttctgcaccttgtttttcttcattttatagtatatttttcaggctttttttttttatcagtatggaaaatagcctccttctttttcacacatacatggtatcccattatatttatgcacaatatttatccagtcccctatggaaagaaaagttgtttctaatattttattacaaacaatgctgcaattaaatattttatacattattttgcatatttatttgtaagatgaatgcctattagtggggattagtcagctgaggttattttaaaattttaaatagtattttaaaagttgatagaaactgccaaatagccttcaggacataccaatttatactgcttatgagtttgtttgttcctttgttagtatgtcatatgatatactctgtcctgcagactcacatttttcactcagtaatatgacactggagttctacttatgtcaatatgcatagatgttcctcattaaaaacaaagaccatcttacagtttcccactgctatggctgtggaaagttgatttagttgaacacatattgatggacatttggttgggtttcaattttttgcttccacgaacaatgctgcagtaactcctcttgtattaatatgaatagaatagattcagagaagtaaattgcaagattgatagttatacatacttaaaatttcagtagatgcttttaagttgctcttccaaaatgttgcggcagtttagacttcctctaacagtgcatgagaactttgtgtgtgctccctcagttgtgtccgactctttgtgaccccttggactgtagcccaccaggctcctctgaccgtggaattttccaagcaaaaatactggagtgggttgccatttcttactccaggggatcttcctgacccagggatcgaacccatgtctctggcatctcctgaactggtaggcagattgtttaccactgcgccacctgctcttgaacctgcccatgtactttctcctggaacaaagctcaaagtatgggttatcactgggatcatccagaccctgagccctattctgcagaatctgaatgggtaagccaagtgttgggaagaataaacacagaaaaggggcagagctgtcccccactagccagatagtcacccaggtaacacaactctctccaaaggaaagattactttggaagtgggagaaactgagctccccatcaataggggtgtttgaacggaagtttcaacaaatgccctgagcttctactctgtgtgaagtctcttagatgggtgtcttgagccggagatgagtcagaccgtccctgccctctcagggcttgatactcatggagaaaatagacaagtaaacagacagtgacatttctgtctactaactattgagttggatttccttttttgataatatctggaacttcctgctacacagcacatgggactgctggagataaaaacaataaacatccttttaaatgcacaaatggatctgcagccatttgggttttaacagacatttgggggagatgaaggctttgacttacatgaagttaagggttgtaactgagatccctgataaatctaggacactgaaagggctgtaccaacagtgaaaatgcagactaggggaaaacaagcaaatgtctgagtacagaagacaaaagaagacaaaaaggatacatgtccttagcaaagaagacaaaagggatataggtcccaacaaactggtctttggatgaggcaaagacactatctttaagaatttgaaattgcatgcttatccttgatgaaaatgaggtgacgcatgtggggttcatatttacatacctgcatatctagggaactccaaggctaagaaattaacatttaaggagatctactgaactgaacttcaaaagtacctctcagattcctagcagaaactaatgcaaatcttctccagatctcctccatggacccccttcctgccccaaccattgcaggttacacagaattcctatatatagagcccttccaaacagctaataatccacaaggaaacaactgctaaaatatacaaggaaacaatccatcatgagtaaggttcagtagacatagcaacatcagtgcaggaagatggcggccaccttagcagctgctcggggagaggggccagcaccagtctgggggcccaaggccattgcctctgactgggaaaaccaggaagtctccacagggatccctatcatggctgtgcaatttgatggggacatgattctagaagccaactccagaacaaccacggagtcatacaccaccaaccaagtgactgacaagctgacccttattcatggtggtattttctgttgccactcaggctcagcagctgatcctcaggcagaagccgatgcagtcacttatcagcttggtttgcacagtgttgagctgactgagcctccactggacacacggcagccagcctccttaaggagatgtgttaccaataccgagaagatctgatggcaggaatcatcactgagggctgggactcccaagaagggggacaggtgtcctcggtacccatggagggtatgatggtaaggtaggccttcaccatcggggactccgggagctcttatatctatggctatgttgaggctacctaccgggaaggcatgacaaagaatgtctgcaatccactgccagtactctgtctttggccatgaaacaggatggttccagcagcagagtgatccgcctggcagctattgcagaatcaggggtagaatggcaggttcttctgggagacgagattgtccaattcactattgccactttataagctttctgaatcctggggttctaatatacaataggagataccccatactgctgcaaaattcaataaacagcttgtcactgaggaaaaagaaagattcagtagacaaaatgcacagaagaagactcctacatacttcagataacagaattatcagatagtgatcattgagtgcaggttagaggcagctgctaagtgctttggaagcatattgaaagaacagattccttgatgaaatcaaagtcttcacagagaaggagactaagaataagccttgaaggataagtgggactttgccaaacaaggacagatgctgttgggatgtagaaagtataaggtaccaagggcatgatcattgataattaattttttctgatgcaaatagggcagaaaagtgagggatgaggcaagggaggtaggtagggggacagatcatgttggcccttgtaagcagtcttacaaggagactttggtttctttttaatatttatttatttttatttggctgtgctgggtcttagttgtggcatgtgggatctagttccttgaaagaaagttagtcactcagtcgtgtctgactctttgcaaccccatggactatataacccaccagcctcctctgtgcatggaattttccaggcaagaatactggagtgggttgccatttccttctccagggatcttcctgacccagagactgaatccaggtctcctgagttgcaggcagattctttactgttcaaatcaccagggaaaccctagttccttgaccagggatcaaacccggggccccctgaattggaagaacagagtcttagccactagaccatgagggaagtcccatggctttggttctagattgaagtgtagaatagatttaagtgtaaaatagatttaagtgtaaaagaaaaccagtgaagggttttaagtgaggggttagtgatattcacttgtcccttcattcattcagttaataaatgtcaggcatgaagaatggctggaggatggagggtggcagcaggtgaccagtcaagagagaacagcagctacttgtgtaggtgagaaatactggtggcttagattagagtggtggtaatgaagatagagaggagtaggtagatttgactgatatttaggtcaaagtcttcaaagtacataagggatggaaagtgcgaggtatcgaggcttat

SEQ ID NO: 54342 - DNA, 768 bp, Bovine  19866880570952
ctgagagccctggtcatgtgcatcacgaggtacttgcgtggccatgggcgccttctgttctgtaagtacatataagccccacctggaaagccagtgtgttatgtgatgttatggctgctgctgagtctgctgcaccagccagaagagaataaatgtgtctgcagttcctatggctcctcgcgtcttcttccaccctcttagcttgcgccttgcctatcctgggttcaactaatagttcgcacagtgagatacagcgagacaactggtgccgtgagcaggatcagcaatataccaagccttccccgaacttggttcctggctcctccaatgaccttgggcaatcgacaatctctgtgagccttggttcccatttgtaaaacagggatcactgtctcacaggcttgctgtgagaattcaatgcaataaacgttagccaagttcagcttcccccactgctcttactgccctaccttctctacagaacctcgagctacttgaggggaagaactgcccctcgttcacgtccaaacacctgttggcagaacccagggcccaggtggaatgtttgaggctgcaaaatgaatccctgttgctgggctgtccttaactcttacctgcccaatgttgaaggtcagtgtgatggcataaaagaagttggagttggcacttcctgcgtaaatccagagatgccacaggacagggaagagcagggagcagatgatgatgatacaggcgaggacaaatattttcgcagaactgcaaagaaga

SEQ ID NO: 54343 - DNA, 744 bp, Bovine  19866880609777
gctttttttttttctctctacagtgaaggcagcatagtgtcagtattgtttgtgaagtttagtatttgcgaggcaattaaaacaatcaacttgctaaatgaagtcatttgcagactgggaccaacttctccacaaaactactttgtggagagatacaagagtctagcatctcttttctagggataacatcaaatgatgcatggatttcatgctccggaaaggaaaaacaacagtcaggccaggctgaaagaagagggagagcacaagccagaagtttgctcacaaccccagaagctgggctgttttaaacaaatacctctttccacgaggcttaattggtagatcctacatattttagttaccatggaaattccctgcatattttcagaatctctaaaagaaaaaaaacctaagtgagacttctgagacacaaattttttgttaaggaaacaatctagtggaataagacaaggcagatttcattgctgtgttaatctcatggtaagtaaggtttatgactaagtcatttgcagatctgatttctgaaaacactgagaagaaacccagaatcactgggagataaatctcaatgataacattaatttacttacactcaagataactctctaaacagtcacagtccaattttacaagtgtgcaataggcaaagaaggaaaaggacaaacgttgcaaataaattcttgtcctttggtggtgcaggctctcagaattcactcttgtcca

SEQ ID NO: 54344 - DNA, 1262 bp, Bovine  19866880633710
agaaggctacaggtttgtgcccttcccagtatcaaagtgtggcgctctattgagatacgtgtaggagaagaacattccgggagggagcagccatgttgcagtgaaccgacaacacccaataatataaagaacaaatccaggaagaaatggaaccataccctagaagcttgaagttacagtggttcatttggtcaacctgctctgaaaataaaggaaaagattctcatgttgaaggtagggcatgtgcctgcattttctctgcttaagccacagggatctcattaaggatcgggacactaacactgatggcttcattttgggcacaactctcagcaggaaagccccatacaaaggtaattacaaggaattggggggtgggtgggcattatagccttttaatttggtctctcaaatatcctgtcagacagatgtagaaaggagatcaatctttacctcaaaagaagtaaattgtaggttgaagtgtttggtttcagtctctatcaggttgaggctttgaaaaacagatctgtgggtctaggaaaccacatacaggattcagttgctttggagtccggtgagtattcaaggatataaggaaatgtataactcaatttgagacaattgtttttaattggcagttttactctcgagtacggtaaacccattttgtgtaagtggctcggggttgaaatacagtctgggaaaagggctgtttctggttcttcaagacagtctgaaggcatctcaaaagttaaaataacatgaaacttgccatctttctgttacaccgcaaatgtttttctcttccaagcacttctgcatatgggtaagcattccagcaaagatgcagttacagtccagcatgggaaagcaaaggagcctagtgttcagagttcgatgaaacagccaggatgctagtcaaaaagagagaagagttcttatagaagcaaaacagaaaatagaaatcaaaaagatcacatatcaatgtgtgtgttggggttgggaggaaggtggatggtagcagagtgtaatctttgattgagataagaaagaatatggctcagggaaaatgtacacaaagaaatagactgtggcttgagagaaaactgacttcagttgggtagggaagatttattcaggttttggtgaggaaattggaaagaactgtaaagctaaagtctgtatccaatttaaatacctgtgcagctgggtctgagggccaaagtagtccctagagccccaagaggtctgcattttgctca

SEQ ID NO: 54345 - DNA, 1433 bp, Bovine  19866880647140
tatggacttgagttatgtggttggagaacactcactgtttccccttaacagttctgcccacagtcctttgctccatcactgcctctgtctaaaatgcttccagcattctttctcccaacccaaggctgatccagaccactcttcctggtcactccagcccaaagagatctcctcttctatagaaaactctgctatttacctattaactctgacaaatgacttgggttcttcatatataaactgtattatctgtttttataatgtagttttagtaacatctaacctgctcctcacaatacattgtgaggaaagcaagatatagattattaaccctattttatagatgcttctgaattgtggtgctagaaaaggctcctgggagtccctcagacagcaaaaagatcaaagcagttaatcctaaaagaaatcaaccctaaatattcatcaattgatgctgaatactttagccacctgatgcaaagagctgactcattggaaaagaccttgatactaaaagattgagggcaggaagagaagggggcaacagagaatgagatggttggacagcatcaccgactcaatggatgtgagtttgagcaagctccaggagacagtgaaggacaggggaagcctggcatgaagcagtctatggggtcacaaagagttggacacgccttggcgactgaacaacaacagatgagaaaatgaagttccacagaggagacaatgacttattccagtttttatgaccaaattagttccaggaaacaaaagatgttagtcttctaaaccaaactgtcttatcagctacaacttcatgattaccttatctccccagagaccacaggttccctgaagacaagagactgttttacacattcacctccctcacagcaccaggggaggcactcagtgagagccatacagtttggccgactgatttcaatactgtccccaaactgtgagactgaacaaaggcatatttccttttcttccagacctcacggacaatgctaaattgttggaagaaatcatgaacaaaacacagcatcccaaataacatttcttttttgagggaagggacaagagacgaggaagagcccttcaagacagggtaagctccatttcgtagggttccatgctgctaagtgttcaaagaaggctggcagaggcagtagcaatgggtttcaaaaaccaccgattagtcataattaacaagtcaaacatcgatcaaatgggaattccctgacagtctggtggtgaggactccgcactgtccctgctgaaggcctgggttcaatacctggttagggaactaagatcccacaagctgcacgatgcagccaaaatcaacacaaaaaacaactaatgccggaaaccacacctcaattctacttgcaagcaaaacagagagctatcttattttaaaactg

SEQ ID NO: 54346 - DNA, 1979 bp, Bovine  19866880681198
gcaattgctcattttactttgtttttatttcaacataacatgcagtaaaaaaattaacaggatttattagcatttacaatgcttacaaagaaaaaggactctaaaagcaatttagttcagatttaagaaatcactctaattaaacacttacaataaatctatttccaaatgatcagtttggaccaaaatttaagatagcatttggtagatatttatgtctgctgtctatctgcagtatttttatataacctctgattcttgggatatccagcccccattttcctaacacagcagggaaagacatatacatgtggccatttaaattaaaggaagaaatggagtaagggagatcccaggctgcaaaaatatatacaagcatttaccttttccagaactaaacatttcttccataaaaatattaatagccaagccctatagaactagggccgggactacttcatatataactattctgtattttaaaaatatagggcagaaagccttttggatgatatttatacattttcgcacaatatttctaggtccctaaatgaatcatcaagcatgtagaacaaaaaagtctactttcttacattatctcttaatttaatctcataaatctctagtaaatattgtaggtaactacatttcaatatgagcattcacctcaataggaagtctttatagaaggtttaatctccatagccatatattaccaaagttcagacatataacgaatgggtagttggcagacattcgctctgtaagacaaagcaatagtgttttttgccccctaccaacaaaaaggcagagtcactttgaaaactagggcttttagagaccatagtacatttcctagactatgtagaataaaatcaaaataaagataggactggggggagcccaatctctcccttcacactaacgacttctggatgaggcaaccctttcactcacatgtctgctttatgatggcagtgttttagaatacagatatacaagttaaaaaatgtttttgtcgttgtttcaagataagagtagttagggacaaaaccccccatttcctttccaaatagaacaggggtttgctatttgcttatttttggctcaatgttactttttcatgctatgctactgaaacctgccgaagtccctatttcatgagatattaggttatgagttcagttatgataggcactcagctggcttaggctttctccactgtcctctgacagcagtcatcttgctaagtctaagcaggctaagttaaaaaaaattaccacagagaaagtcaaagtgcattaatcagttactaacagagcaatctaatgttaaatagtcatgggaaaaacctgttaaaattgttagaagtgaacagaaaattcaaatcaggacaagacagaatggaagtaactattataacatttgtcagataaattgtcaatctgtgaagttttaattcacacagacaatacatttctgtggttactagaaatgtattgctgtaaatgcatttactcacttctttaaccagtaccacagctcttcttccctaatgaaaatgaaaatgattttatagatattttcattgacctctagacaaacatttttattttcttttttctcttattctcttatgtaacataaatacaataaagtcaattgtttcctatattgttataaacatgtaaagtcattaagttatgttgattttctgccatactatttaaacattgttaattttacacgataattggtaagttagagaatatcagtgagaagattacctactcaaggactttgcctcctcttcaagccaagaggttaatgcattttcagttgtacacagaataggtatttcatgttagatgaattttgaccttattgtctttttggagatatatgatttgaggagatgtgtatgagcaccataatgacaaggggtgaacttgcgatggttgattttatgtgccatgttg

SEQ ID NO: 54347 - DNA, 1584 bp, Bovine  19866880740583
atattctgctgaattttaatataattaaaaattatatttttctgaattaaaaaatctccagggtggagttttccttccctttcacccactactccatgcagccatttccttgtcccttggaaaattggttttttcaaggacataattcccctactccaaataaagagctttttctaatcactgaagctgtgtctacacacgtttgcatccccaaaacctagggtggagggtagggaatgaatcatccacactcactacaccttcaactgttagcctcaacacctttcaaattcaggaagctaccctccaaattcacaaccctctaagcatatcagaggatggaggtttttatcactccctatcaaaccacctgcagctttctaacatgaattctgaattccaaatgagcacaatctcagcagaggacaggctagaccaattttgcttttgtcaagcaaagcagacgtaaaatatcatgtgaatcaactggtcacaatcaatcagcacccatatttcacatgctgaagctggagatgggggtggggatgcagtcttccctctctaccgtagttttccaggatgcatttgggtgcagatgggcttccctggtggctcagacgttacagaatctgccagcaatgcaggagatctgggttcaagccctgggtcttcctgagaagacttctccctggagaagggaatggctaccactctagaggagcctggtgggttacagtccacggggtggcaaagagttggacccaactgagcaactaacactactactactactactactactactactactactactacagcttcattaccagggataaaaagtctcaaattccagcaagactgaattgaaattattggccctctaaattaaaagtatctcttttactgacactaaagcatgacttgttaggaaactcactgaaatctagtttatttccctataagcttctcctcccattaaaaattattttaactggagtatatgacaattgatcagggggaaaaaaaaggaatacatatgatgttagtatctctaatcagctttcattaaaacacaagaacacagatgaacatctgtttcatctaagaacacagatatgggttgattgtgttcttagatgaaagctaccaaccctcccttagatatttacatatatcccatatacatacaaacacacacacacacgtggtgagtatagacatggatctattttctattttttcctccagtgttttatcttaaaaactttcaaactatagaaaagttgaaagaacaattcaataaaacacctagatccaccaactgttaacacttccacattttatctctacacacacagacaaaaacacacaccagatgcatttttttccaaaaccattttaaattaagtcacagatatcatggcccttcacccctaaatattttagcatgtaacttcaaagaacaaagattggagtttacatacacaatctatcttgggagaagaaaataactactgctattttatctttgaattcctctgcttagaaatctcacacccagtcatttcaccactggccttc

SEQ ID NO: 54348 - DNA, 1761 bp, Bovine  19866880753953
agcctgaattgaaaccagtttgtctgactccaagttcttattactatcttattccttcaattttatagataaggacacagatactcagagagcttctcttaatggcagacatcaaatttgagcacctttctgttgaatggttaatcctggccaaccaaaatttgaaaagtaaaaacagacctgccgcaacaaagtcaatgtacttaatgccacaaatcagtacacttgaaaatggtctacatggtaaattttatgttacgtataatttaccaccaaaaaaggttcctgggtttgctatctggtcttctctcttcaacactgtagcttgtaaccacacatatgactgagaataacaaaactggaggatctactctaaagtgcacagaattagcagaacctgaagatcatttctattccctgaaaaatatatgacagttctagattatagtctgattatttagaaaagaatgcaaagaaaggaatgtcaaaaagcaagcttcctgtcaaggaaagcaatatgtacctcaagtgtccccaagtagtcactcagaaaacaaaaaggtaagaaggagaaacactagagattctccagccaattaatatccttaatcacgaccaccatagccccaagtccccatgctatggggctcctgggccccccccagagatggctggctgcctcttcactcttacctcccatcggcctcggcactttggttctctgactccaaacgtggggaaccacccaatgctcctgccactctgttcactgcatcactgccaccctctttcagccaagctttctttcaagtcctgctgaacactcactcctcgagaacatcttcgtatgccaccagatatgaaacctggctctggttccagctctggtcaaattagtttctccatctttaaaatgagggtgcggaaaagacacagatgatctaagtcaaaggttcctaacctttttggcaccaggaactggtttcacggaaggcaatttttccatggacagtagggtggggtggttttgggatgattcaaatacagtagggtttgtgcttcgatgagaatccaatgcccacgacactgatctgaccagaggcagagctcaggtggtaatgcaagcaatggggagtggctgtatacacagatggagcttcatttgcttgctctcctctcgctgtgtggcctagttcctaacagacctcggactggtaccaggtccgtggcctgggggctggggacccctgatccaagtctcttatatttccaagacacagtaattcatcagaacctgaacaagtttcagtcagactaaggcttctgccctccttcttccctactgtttacacatggaccaagatacagccccgtcacatgcagatgtcctaacgtgttatctcgtcatgatgaccatgtctcaggtgttggtcttcactgcttcaagaactctttaaagaaaagaaccaccttgtgtctactttggaatgaccttctgccctcctgtcaaccagagccatacgcctttactaataattaagacagaacaaaaacttgttcctcacacatgaaaaaagatcagaaaagtctgtttaagagacagaaaatgtctatgttttaactattcaaccaaagtgggcagagaaattcaggtcaaaatcaacattaactcacgtaagacttgtggccttacgagtcttaaaaccgaagagagaagggaagtcagctcctaaagagcctaaggccaaagaagtcagcggg

SEQ ID NO: 54349 - DNA, 1372 bp, Bovine  19866880779325
tgtgctgttaagaatgttcctattttttttaatattaaatttttttaatggaagtatagttgacttgcatgcatgctaattcacatcagtcaagtgtgctgaatttaatttcagacattgcagaattccatattcaatgattttacttttatttttaatatactgatgttttatagtgtttacataagaagaattatgacttcctgggagcccacaacctaaaactatgaatagtccctaggtaagaatgaataaattttcaattgctttctttaaaaatgcagaaaacctctacatgttagacaacagttgaattttttttgaaagacctatttggttgtctgcaggaaagtttaatagttgaactaaatttttagtgacttaactgaacataacagtctaatttcagcccccgatgatttttgccatttttctttaggcagtcaaatgtttctatattgattgtcaatgagtccacttaggactttgtgccctgatttgtattgcttataaggaattgagcttgctaacaattcctgcagaaaaattaaatttctctagatcatatatagctaccaagttagcaatgatgccaaagtaatttaccagagacctggtggatttacttattttaaaaatggaaattaaaagagtcgagagttgttcagtatacttatacttacctatgtcctgttatttgtacatattatatgtgtgcatatgttatatatacatatatgtgtgtgtgcatgtattcaatataccttctactctaaaggaagacatttaatttttttttaggcaccaaagttttactaactctacttcttactctttctttataaaacaatttaatattttttggatccacagttgtgatgggaaccaagttacaatgtacttttatttctttctggcccctctcaacccctggttgtcacttctctcatcctttctcacttaccaatatattccaatccctgtaaaatacagactaaaggtaacaacatcattgatttgagattttagagaatgcccagcactaagccaggctctcaggagcattcaaactctgagagttcccatacactctttgacataattccttctcatctctcatgggttgaggaaccaatgagcctataaagcaagaacatggtctaaagtccatagaccaagcaaaggcctggctggtaaagtgcatggctttgtgactgctactgccaacttccagcctaaggaaagactgagtttttgttgttgttcagtcactcagtcgtgtttgactctttgtgaccccatgccctgcagcacgccaggcttccctgtctttcaacatctcccggagctgctcaaactcgtgtccattttg

SEQ ID NO: 54350 - DNA, 858 bp, Bovine  19866880807998
agaaagagctaaagccctcaactgtaccacaccctttcagggcccctgacagcttcaggagaaagtcacaggaactgattctaatcccagttctattcaagtttccccatagcccagggcaagtcacctcccctccctgggacaaacttctccacctagatgatcagaggcctgggtaagagaaccttctaagaagccaaagctttccagcttaaaactctacattcattccaataaccctgaattactcagaaaacagtttcattccatcagatctgcttctaggggtagcagggcaccataatccatttcagaagagttccagaaaagatgaaaattagaacaaacttgggtgcctgaatggataagtggaggggtctgggactgaggccttgcacagccagcatgcccttgcgcatgtgtgccccctccaccagcgggtgccacgtacatgttgtcgtgggcagccttcatggccttggcggcatagcccatgttcttgagcacctcggtgttggtgttggcattctccagggcctctcgctggaactcgattgttgacagcgtgccgtcgatctgcgccagctgcttttcatacctcttcttgcgcttcagggcctggagtgccgctgcattgggggaagaaaacagggtttcagagagcccggacacagggcagcgtcctagagttcactgagttgtcttcctaattgggatggatgcacttcagtttctgcttcactacaacagagggctaatactctcttcttcacaaacagcatattcaatattctgggaaaactatacaaaattcacattcttcaaaatgcagccaggcactaagccaaagttcactct

SEQ ID NO: 54351 - DNA, 1618 bp, Bovine  19866880856394
acattaaagccattaaaacattttaaaaaaccaaaagaatgggttgctcttcaggtctctggaagcacagagggacagagcagggaccagggggccacgactgtgaggaataaactagagttatcattcattgtacggacgtggacagtgctgcacagggagggagggggcagtggctcacacaggttcacacagccgccgacttggccaggctcctctcccgacttgccctgctcagatggggcaaaggggcgctgggtctgcaggtacgatgtcagctgaatcccagggcctcagggaaatcccttctcctcagcccacatggaaagccttgaggtcaaacgaggctttctcagccagcctgtgacgtctgggggcttccctcagagagtgcagagcctctaggccagtgtgtccccgacatgccctctccctgggggcagaggcagggcacccactcaggacttcgatcccagaaaaccaagccaacacgcaggactctgtccctcacaccacactcccctgttgctttattatgaaaagtttcacacatacaaacaaagttgaaagatttaaccttgaacacctgtatatctaccacctggacctcagcattaccattttcttatacttgggtgatcacaaatgatccatttctcaatccatcttatttctgtaatgtattcaaagtgaaatacagacatcagtacatttcctgccaaatatttcagcatgtgtattgttaaccagagctcaaaacttatatttttcttatgtgaaatttacatacagtgaaaaacacaaatctttaaaaaaaactttatattgacatatagttgatttataatattgtgttaatttctgctgtacagcaaagtgattcagttatacatatatacatttttttttctcggctgctctgtggcatgcggaatcttagttccctgaccaggggttgaacccgtgcccctgcaatggaagtgtgaggtctcagctgctggaccaccaaagaagtccctgtctgtcttaatgttcttttccactgggcttatcacaggatatcgagtgcagctccctgtgctgtgtagtagaaccttgtcattccattctgtatggaacagtttgcctctgctggccgcaaactcccaacccagcccctccccgccaccctcttgccagcgcaagtctgctctctgtgtgtttctgttttgtagataagtccatattatcatattttagattccacatataaatgatacatgatacttgtcttctgacttacttcatttagtataatgacctctagttccatccgtgttgctacaaacgggcatcatttagttctttttgtttcggccaagtagcgctctgttgactgtgtgtgttctgtacctgttcatctaccgatggcatttaggtttccacgtctcggctgttgggaacggtgctgctgtggacgtgtacagtttttgaattatggtttttatttctggatatgtgcccaggagcacaactgctggatcatatggcagctctgtttttaagttttctgaggaagctccatagtgttttccatagtggctgcaccaacttccgtttccaccagcagtataggagg

SEQ ID NO: 54352 - DNA, 814 bp, Bovine  19866880886479
aacttacagtctgctgaaggagaaagatgttagtcacataaataaataaaaaagttctaaccgtaaacactgttaggagatttttacagttagggcggtggagagtgtgccttcctgaggaagtgatgatttaactgggagctcaaagactgtgtgggagttaactgggaagagagaagaggtcgttcaggttaaatacagaggcctgggaacaggagaagggtggcatgttcatggtgcttgaacccagaaagtgagaggtgtggggagtgggtgtgagctgagcctggagaagtagggccaggcaaggcaggccacatgggggaaggacttttgtcttcaatctaaaatcagtgggaagttactacttatttcatgttttgtctttttttttttcagtttaaaaagcagaaactccttctagaactagaccagtatgcccccgatgtggccgaactcatccgaacccctatggaaatgcgttacatccctctgaaagtggccatgttgtaagtatcctctgaccaaacggggctcagagccaacaaacgcaaggaaaatctgatgagactttctcatgttgtttgttgtatttttggagatttggagtcttagtcatcaagtgtttgctatagttctgttgcacagcttggggttctggccaggaaaagagacagagccattctgtctcttttgggacaaagcctcacacaggcacacgcacaatcaacccttcacagatgctttttcactcgatgctgatctgggttccagcctccatgtaaccagtatttctaaaaacaataacaacaaa

SEQ ID NO: 54353 - DNA, 1894 bp, Bovine  19866880912080
ggcttctgccttacgttctctctgttaagaatctggggtcatccctgactcttctttttgtctcttactccaacaaactaaccctcccaacaaatccttcagaataatacttatcccctccactgctatagttgcatatcttgttttaacgctaacaacagcttcttcacttgtctccttgcttccttgtggagccctttcccctccatatggcagagccttgttttcacatatgttaggccttgtcactgctctggctcccatccactcaccagggtccccagcctatggttgcagagccagttgggtgtagatcccaggcctctcatccctagattcagggccttttcttagccctgcctagtgaccctggtcttctgacctggctgtgaccagccctgtcttgctggctctttcaggtgcggtggtccagctgcaatatcttctccacccaggaccatgcagcagctgccattgccaaggctggcattccaggtgagtccttgctgggggatacaggaatacaggaaggggctctgattttctctgtttgcatcacttcacttttactgctgcagacctccctacagtagggaagagtcatggccacagaatcctcgcctagaggcccatcggaaagagccgttttgtccagctgtcatctcagatcctactgaaggcacttacttgccctattcaagtcagtgattgggaatcacatggtgttgaagagggggaagttccttaaaaagaggatgttccttaaaaagttccttaaaaaaagaagttccttaaaaagaatcagggaggggtactggacagaaaaagagtcccagagatccactgcatagtatctgatggtctaggtaccggggaaggaccacaaccaaagaggaaggactttctcacaggctgctggagaaacagaaacaagtctgcttgggcttggggagggaagtggttcggtctgacgatgataaaataggacattcattcacagttccttctaaccagctgcggggggaaggtaaagagttggggaagacctctccatcgactgaccaagggtcggcgtgtccccagctcctcagcctagtttggactccatggccgctttctggaaaggccttgttttcaagaccattatctgccccagtttgagggaggggaagctggccttgcttggcaggtgtcctttgctcacaggaggttcctgggagccccgcacctgtgtcgcagttgtaccacatgatgggaggagcctgagctgacagtcaggagcacgggactctgttgcttgctcagcagtgccatgctgggacttctctggtggcccagtggttaagactcggggcttctggtgcagggggcatggatttgatccctggttggggaactaggatcccacatgctgtgcggccaaaaacagcaacagcagagtgtcatgatgagtgacctgggcacatctcagccgcttctctgggcatctgtaggcgatgatgatggtaatgccagcctcacagggtttctgtgaggacagatgagatgggggcaagaagcagttagagtattgcctgacacagagaaagtgctccatacacggtagctgctgttagtagatgctggccagacgtcgcctaggataacgtattacagagactgtgggcccatcaggtcctttcagtgcagaatggaccctggagcttgtctcttgagtccacctaatgtgtccctcctcccgtcacacctccctcccagcaggaggcacagtgggtaggaaccctggtcactgtgagctgggggcccagacagacgagggtaggaaaagaaagagtgagaaaggaaagaattctttccagatacttatatatagggggtctgtgttggctcccgt

SEQ ID NO: 54354 - DNA, 844 bp, Bovine  19866880998384
gaaaagtgaaagtgaagtcactcagtcgtgtccgactcttagtgaccccatagagtgcagcctaccaggctcctccgtccatgggattttccaggcaagagtactggagtggggtgccaacactgttacccacctacaaaatagtaagtcctaaaggagatcagtcctgggtgttcattggagggactgatgttgaagctgaaatcccaatactttggccacctgatgcggagagctgattcatttgaaaagaccctgatgctgggaaagattgagggcaggagaagggtacgacagaggatgagacggttggatggcatcaccgacacaatggacatgggtttgggtggcctccgggagttggtgatggacagggaggcctggtgtgctgcccttcatggggtcgcaaagagactaagcgactgaactgaactgaactaaaaatagtaagagtattatctcacacaagcttgtgataattaaatgtgataatccaagtaaagcacttcacaatgcttggatcatagaaagtgcataacgttaattactgttttataaaatattcttacttctcctcctgtttttctaccccctcccaacaaaattagtttcaaggagactacatttcccagcatgccaccccgccctttgatcctagctagaccaaaaagacgcgccgccgagtgtcttcagccggaagactatagcctcccggcatgcagcgcgcctccttccattagctttgaagcacggccggcgcgttgcccaccgggagttgtagtcagcggcgtgtttccctgacgcctgccgggccgggcgtgggggcctgtgggaggtggcgcgg

SEQ ID NO: 54355 - DNA, 846 bp, Bovine  19866881051714
caggggacccaggggatcaaattctttattttgtgatgtagcaaacaaattcttgattcccataaatgaacctctgggtaaactgctggcatagctccatgaagttgactacgctggagctgccattgttcatagttctggactgattccagggttggcctctgccacgttgttgttcttgtgaatggtcaacataataaatacgtcccatgttgtcaacccgccactcccagccaggaggtagaggttctggtctatcccacattgttcttttttcaatatgatctacatagtaaactcgcccatgctggtccactctctgctcccaacaaggtgggaggggagcttgaggtacaggatttaatggtctagggcctgcacctccagatatagtaagaggaattattaatccagatgttgctccttcagatgtacttgaatttgtatttgttggtggcagagagcctgtactggagccatcactttcagaagtggtagatggtgagccattgacagatgctggtctacgtggggtaggtggaggtggttgtgaaggtcttggaggcctagaaggtttaaaaccgccatttgagagtgatggagaattattcccattgatcctcctgttttcaccagaccctgcatcctcagggtcatctgatccacttgcgtttgctctcgtttcatccttgggcctggagccatcatcattctgtgaagcactttctgaacatgcagtttcaccatgggcaacaacttcagactctaattgcagcccatcaagacagactgacaaatctcctattgtttctgctggttctttgtcacctacaagctgtaaagtca

SEQ ID NO: 54356 - DNA, 1995 bp, Bovine  19866881063292
taacctgtttcatctgctgcatgtttgtgactataaaagcagcactttactgaatctaagggtgctcctgggctgtcaccataggggagaagatattgttcagaaaaatctgaagcctataaaacttttgctgggaatgttaatttgcaaatgccaccaccatagaatgagaaagctttaggagggaaaacagtgtcataaaaaatgcccaagattaaggggaaacagctgcactaaagagcagcatggcacaaactatttggttttaattgcatggaagataattggctccagttggtttgggaaagattcagaaacaaaagaacagcaaggaaaaacaatggttcaagaactgttttaaggcaagacaatgaggttcatttcaacctaaattattccttaaggcacattttccacaaagtgggaaaatatttcaattaaagttttctaaacctgccatggagctttagttaagaagctgtaaatatattagacttttaaaaaatggtctccaatacaatctaaaacctcttctttttcagaggattttgtatttctctgttcttcaacctaagattctcatcatctaggtatgaaatcttttgaaaatgccttaagtcttggatcagtcttggcatacagtcttaaactggtacagtctttccttaaaatcccactttcatcaagtttttgtgattgacctcagggactgactttttataaaggttttgtaggccataaggtttctgtaacagaaagaagagattaagaagaggtgacaagaaggcacagaagaactatacaaaaaaggtcttaatgacctggataaccacaatggtggggtcactcatctagagccagacatcctggaatgtgaagtcaagtcggccttaggaagcattacttcgaacaaagctagtggaggtaatggaattccagcttagctatttcatatcctaaaagacagtgctgttgaagtgctgcacttagtatgccagaaaatttggaaaactcagcagtggccacaggactggaaaagtcagtttttattccaatccccaaaaaaggtaatgccaaacaatgttcagattactgtacaattgcattcatttcacatgctagcaagattttactcaaaatcattcaagcgaggcttcagcagcacgtgaacccaagaagttctagatgttcaagctggatttagaaaaggcagaggaaccagagatcaaattgccaacatcctctggatcacagtaaaagcaaggggagtccaaaaaaacccatctacttctgctttgttgtctacctaaagacttcgaccgtgtggatcacaacaaactgtggaaaattctgaaagagatgggaataccagaccgccttacccgcctcctgagaaacctgtattcaggacaagaagcaacagttagaattgaacatgtaacaatgaactggttcagaattgggaaaggagtacgtcaaggctatatattgtcaccctgattatttaacttatatgcagagtatattatgcgaaatgccaggctggatgactcacaggctggaatcaagattgctgggagaaatatcaacaacctcagatatgcaaatgatgccactttaatggcagaaagtgaagaggaactaaagagcttcttgatgaaggtggtgctttcaaactagggtgttgaagactcttgagagtcccttggacagcaaggagatcaaaccactcaatcctaaaggaaatcaaccctgaatattccttagaaggactgatgctgaagctgaagctccagtactctggccacctgatgtgaagagccgactcattggagaggaccctgatgctgggaaagattgaaaccgggaggagaaggggatgacagaggatgaggtggttggatggcatcactaactcaatggacatgggttcaagaaaacttgaggagatagtgaagaacaaggaagcctggcatactgcagttcatggggcca

SEQ ID NO: 54357 - DNA, 823 bp, Bovine  19866881200128
atagatgtttttctgaaattctcttgctttttctatgatccagcggatgttggcaatttgatctctgcttcctctgccttttctaaaaccagtttgaacatctggaagttcacggttcatgtattgctgaagcctggcttggagaattttgagcattactttactagcgtgtgagatgagtgcaattgcgcggtagtttgagcattctttggcattgcctttcttagggattggaatgaaaactgaccttttccagtcctgtggccactgctgagttttccaaatttgctggcatattgagtgcagcattttcacagcatcatctttcaggatttgaaagagctcaacgggaattccatcacctccactacctttgctcgtagtctgggaaaacattaattaacaagataggcgtggatcctcccttcgtggagctcatggcccagtggtatataatgggatgaacccatatagaataggaggcacaaagaaacactacactgaggatctcaagtatattccacaaccgagggaccccttaaggcaagttgtttaacttctctagacctgtttctttgtctataaatgggaaaggtttaattaggcagttgctgctcaaagttctttccagctccaaattctactagaatcataaaaacttagcccaatacccttttcaagttcctaacacttattagcttcctccctttatctgggaaatcatgatcagttgtcatggaaattaccatactgctccacatattggactatgatgttacagtaattacaaggaaccaaagggaacaggcagcaagaacaagca

SEQ ID NO: 54358 - DNA, 1253 bp, Bovine  19866881278457
cttcttttacatcctcagggcgctatcctttctaaggcttgttgtttggcttttcctttgattctttgaagaatccagacctctccagtagagtactgccccactttgtttcttaggctagccagaatcagttctgttgtttgcaaccaaaacattctgactgactgactccaaattttgtaaacggaaaacggtagtagcatcaagaggtcagtgacttgttcaagcccacgttcttagaactttgggcacaagtataaggccacgctctccaggaagaaattatcctagatcaatatttacaacaggagaacacacacatctaggacagaactcacctttgttctgtgcatatgagggagacacaggaagagaaatgtgaataatggctgggaaatagggagcacgtatcccagatcttcacaactttcaattcactcaggcagggttttgcagagacccagaaccattctctctggaccctaaggcttgaggaggaatttctgaaaaggtggaagaatcttaggatctcaactgaagaggaacttgggcagataaatatctaaccagggatatgattcaacagaagcaaaactgagggtctgtgggaacagaccacatatgctaacaatagtagtggtagtgttagtcgctcagtcgtgtccgactctttgtgaccccatggactgtggcttgccacgctcctctgtccgtgtgattctccaggcaagaatactggagtggattgtcattcccttctccaatgctaacaatggttctgacttttaacaagggctggtgatcttggtccactaaaccataagctctgtaagaagaggactggacttgttcaccacaatattcacaacacctggcacagggccttgtgcctggtcggtgctcaatacacatgtgctgaaggactgaacgggttgggcttccatgtggttgtctggacccagcagcctagtgattttgtcactaatgaactgggtctttggctttgcatttctggcctcaactggggggagaatggtgcctggctggtgacaaatgtctggaaaacacaggagcagtggctacaatatattcccaatattctaattactgatgacatttactcagcagcagttgtggtacagggaacaaaaggttctgtgggcttgcagcctaaatgacagaacacaaaagagtaactgggagcttctctctctatgggcttgctttgttaaggtataagaagcaatactatt

SEQ ID NO: 54359 - DNA, 796 bp, Bovine  19866881385919
tcgcagtgttcctgctgagcgattagcctctgattgaacctctctgccgacaggatttgtattaggtgccctgtcctctcacgctactgcatagtctgcctttggatggctctgactagaaaaccacctttcttatttgaaactgagatctgtcttcctctagtgccgacctccggtacaggccggggtggtggctccacagggaagcagcttgggctggcggaaagaatgtgggatctgaagttagaaggtttaggggcgaatgccacccctgacgcttgtcagcggtgaactgtttgcttcagctggaagaacaggtggtgaattctgcctcagaaaacaggtctcatccccctttgggaagatagatcaaggcaaatggggcttacgtctcaacctgcacctctcttggacaggtcttctgtgttccattgactgttcctggcctggtgtttttgttctttccttgttaccctcctgtaggtgggctcctgttcatcagtgtcgctcttaaggtgtgaagtgggcagagctgaccactcagtgactttgccagctgaggtctgagcactgcagcccagaacacggaggactggctgtctgttaggaattaatttagttctgtgtgctgtatggccctgataattcccatatcactgagaatttttcttgtttttttttttttacacttgattgattacactttcccgtggtctttcattagtgaaggagcaagcatctaggagcccctaaaatttgttccaggtggcacagtggtaaagaatcccaagagaca

SEQ ID NO: 54360 - DNA, 969 bp, Bovine  19866881404283
tccccattttacagacgaggaaactgatctcagagagggaaagtatcatgcccacgatcattaagttgtggcactgagagttataccttcctaattccagaggaaagcttttaaccactcaaatcctctccccttatacaaccaaattactgcattgtcaatatattgtttatttttctgcttcccctgttaggggagggtcgtgcctttgtcatcctgcctttgctgcaccatgtgtggcccagggcctggcacagagctggagttcatttcgtgggcgtttcgtcacacaccctccggtaagtcagtgtcaatgctgctgctgctgctgctgctgtgtcgcttcagccgtgtccgactctgtgcgtggttcccccaattccaccacttctatttcccctccaggaattggcagatcggtgatggcaaaagaaacatcccccactaatcaataaataataatgttggagaatttgaaataagaatctggattattaaagttacaaatctttggtccttatacctttaataaaacatgcatctattaataatggatactgattctggcctgcttatgctgaaaaggggaaaaaaatgaccagtcgaaagatgctaatattttttctccttacccggcttggctgccaagcacttccctgacaaactgctcatcatttaaaaaggtttaaaatttttaacagcacgaaagggtaattgaagaggggatgctcagccctgtggccccttcgtgagagatcactcctcttggagacatctgtctcgtgggctgtggtggacccatctctgctggctcctagcttagtcctctggctgcggcttctcagactcactgtttttcttcaacctcttccctgagtcccttcctttcctcctccattcttcctcttcctctcccctcccttcccctcttcatttatgtttttagttgcacgggtctccattgctgtg

SEQ ID NO: 54361 - DNA, 901 bp, Bovine  19866880264349
tgttggcaaagtaatgtctctgcttttgaatatgctatctaggttggtcataactttgcttccaaggagtaagtgtcttttaatttcatggctgcagtcacaatctgcagtgattttggagcccagaaaaataaagtctgacactgtttccactgtttccccatctatttgccatgaagtgatgggaccagatgccatgatcctagttttctgaatgttgagctttaagccaactttttctctctcctctttcactttcatcaagaggctttttagttcctcttcactttttgccataagggtggtctcatctgcatgcttaggtacaatcaaactgttgattcattttggtaaagatgtataatttgatgcaggttttccaagctcacatgtccctgggtcttaccttctgtgtaattctttctcctcaggactgcttctatggcagaagttttgggggctataactctgggagtgtatttttgttccacattttgagatcaccattcaaacatgaagggaaagagttacaacgctgtttctaaagatatggatggcttttccattgaagaatatgttctttcaaaaaaagtaaagaaacggttttattccaactccaaaagcctgtggttcttagttattttatcaatggctttctgttttcccatacaccataaaaacaagttagcatacgagtccaaggagcatagaaactcccagagttacttgaaatatgccgaggagggtttaacatacataatgataagactacacattcatgttctcagagctcctttaagggaagtttgtgggatgattattatcctgtaaatatcctccagcactgcttgccgccttctctagtccagatttcccatgggtgtgtgacccatctggtaga

SEQ ID NO: 54362 - DNA, 1760 bp, Bovine  19866880372596
ctgtaggtagtaacacatcctttgtctctttacagcaaaaatagattaaaaaataaaagttgtattgtacatataaccaacaagaccatatactacaattaattggttttgtttcaaattcattgtgtaggaaatggtgtaattacactgctccagttgcattcctttctctcagcattgttgctgttctccagtggattgtggtcaataatatttcattttaaaatcctgtgctaaaggtggacaggtcttgaattacatgttgttctttaaaccagctcataactgtgctccgtcacaccaagtatactgatgcaacatttatttactttcattaatttggaaactgcatgatttactaaattacacactgggtcattcagagtcatcatatcaggtgtagtcaaaggccagattgaatggcatttttctgctctcagtttccagtctttgttgaaatagagcatgcagagttgtttttgatcttcataatgaaggccgtctccaggaggcattcctcgagcccagtctgaccagagtgcacctcttgcaagaagaattcccttccttccagcccattttgactctgccacttgtagatttatgtacatattaccaactttcaccatcactcagaataggaatgtagctaccttgttacagggaggtggtaaaaaatgcattctgagccagtgttgcaaaaatgtcctattagatttcattttagtatttttattatgtaattttgaagattcaactgtttttttttttttttttaagataaacaccaatggcatactcaggtttttactctgtgcaacaccatattccataatataacatacacgttagtggaagacagtctccaaaaggtgaactgacagtagtcactgtttgctgccacattttaatagagatatctaaggagatagacagaatattttaagctgagagaggtgaagatgattaattttctttttaaatggagaggtttgtacattattaggttattttataaattctactctgcagcctatacatatttgcattgatttttgtaggacaaaagtgaaattgattcctaacccatcacattaatgtaatttataacattttttttttgcacattaaagtttttctaaatgatgagctcacacttttttcacaagtttgcctaaatttaatttaatatgtggggcgaagagtagaaagaatggcatctcggtgattctctgttctttaaaatatatcataaattttttttcctcttttgttctggagttcaagcatcatgctagtgatattaatagctaatagtttgtaagttctgccatctcttcaggtatttatttcacttgagatgttttaaccaagcactgttttatttacttgtttttttttttttttatcttcttcttccactaaaacagtaaactccatatgggtagggacttacagtgatcataaaggatctggcagatcacaagataatgtaaaccattatcttgtggggagtaggcggggcaaggattgaagtggggcaataacctgatcctatttgcatcttaaagacagccaaagttcagagcaggatcatgatggtcttggtggtgggggcacatttggggtcagggagaggacttaaaaagctggtccaataagaaataatgatagaccaacttaagatattggtagtagatttgaaagtcatggactactttaagcgatattaagcaggtagaatctatgggactgcgtgg

SEQ ID NO: 54363 - DNA, 1129 bp, Bovine  19866880392017
agaaagcaagggggataaatctatttgacaattattgaaccagcatttattggggtcttattgtttgagtgtggtcttcaaacttacccagtaaataaatgcttatccccagctttcagagtagttcattaaaaaaaaaaaaaatccccgcaaaaattaattcctgatcatctaataacaggttgtgccttctgactgtttccaccctttaaaagacctttcccatgtagcaagggggagaagaaaaacaggtaaatgaagagccatcttttcagtattcaggtccaaatgtctatttctctcaggaaaacattcttttccttgaagaataatttcattcattaagagaaaagtagaagttttcatagtgttgccaaacaaagtggttctctacttttattttcagcaaagctaaatctactgcatattgaaattgtatcttgatatgcagagaccctaaaaatgaaatgctgacacacttaactgatttttttcatttcactttcttactgttggctgtgcacataggcagacagtcatgtgagatagttaatgattatatggatgaaagaaaatatgatattttgcataatatgatgagaaaatattaactggaaaacttaaggaaaacagaaattcaatcctagtcttattttcttctctttagtatggtaatctgtgtacaattcatacctgtccaatgtgatacaatgaaatgcttttaagttgtgtggtatttggaaaataaccctactttaatttcttgccgttagaatacctctacttaaaattcttactaaaatgatatattaagaacagaagtaacatatttattatttgctttaatcaatgaaacgcataataaaatggtaaatactcaatattaacaagaatttaaatgaaaatactaaaaaaagtttggataaacatgtagaaaaggcataacacattcaaaaattataattttaaattataatttacaaaaaataacttattttatagatgagaaagctgagttggaagaaggaaatttatttgactaaggtaccttgacaagtaaatagccttgagattgcataaggccaatttcatgaagtcgcgctgttccttttttcttaaggtgttatca

SEQ ID NO: 54364 - DNA, 1884 bp, Bovine  19866880488691
aggctccttaatactgtgggtgaatggttgtcattaagaaagtgtttgaatatagcatcacatttcaataggtgtgtcatgaaaaatacccctgctgctgttgcctgcttcactgatattaaatggctcagacagattctgcatctcataatctccttgacttaaaagcaggtgcatcttatgtgagagccagaaaatttgcagagcaatatagtacttaaccacaggcttaaacattttctaccttgcacataggaggtatacttctgaagaaaagaaaataaagttctcttttttactgactcacttgattttcagattgaaaaaaaatttttttttgcagtttaaattgtatcaatctacagtaagtaacatgagtaggatgctagactatgggagtcttttccctagtaagttaaaaaaaaaaatcatcatgatgaattctaatctggctttgttgtgctctgtacccaccagcagttaaatgtctgtagccaagacttgcagatctatttatgtcattgagtggcttaatattcctcacaaacttcaacatccattgataatttacaaactcctgatcacgcctatgaagcccactcattctagcgccttccaactttctgattcttcaccccagttgatccaaggtcatggctgtgtctttgaacttgacccaggccctccttgaaggctgtggcagagaccactgaagaacagtgctgttgaccatgctgaccaaaatatattgcctgtctgttgcattgcatttcatgaaaggagtatagaatatttgaatcactattttttttttttttttctcatgactagactgacgttataggttttggtgaggaagactgcagattggcaagagctggaataaatcatgtttacttaatataaataaaggtggtaacctacaaaaatgtttatagatttgtgtatattcctgggttagtatatacatgcaattttctgtgttctggtagctgagaggtcttagaaacagtgagcacacctagcactcagaacttggtttctaatacattctccagtgaaaggaaccacaactgcttggagaaatggttgattgcaggtttgagccagaaatcttcaatatgagcctagagcatcttaaagtgctaggaaataaggaaaatatcaaacaaaaacacaatgaatggggacatgtaaaagggccccagggactgaacccacatctcttgcattggcaggcagattctttaccactagcagttcttgggagccccaggaaaggcatgcaggggcaattggaactacaaaataaagtagtattgtattataacaggaagtataaaatattcacaaattcatctgatgtaaatacatgattgaataaataaatgaaggagaatagacatatccaatgtaaaaacattgctaataatttatgtagcttaactctctactccttaagcgtgggctgtgcgtaattagttccttctatagactgcagtattgaaggagagtaattttacagcggataaacttaccaaatactgtcacccaggtgatcaagtttaacgtaaatagtgatgtcatattgatagcttctggagtaagaaatggcaatccactccagtattcttgcctggaaaatttcatggacagaggagcctggcaggatacagttcaggggttcacaaagagctggacacaactaagcaactgagcacattaatagcttatgtgatgaaaatggctctttttacattcatggtcatcttctccaaaacccatagccctagcctaattatgagaaaatatcagacaaatcttaagtgagggtctttctacaaaatacccaaccaatacatctcaaaactgtcaaaatcatcg

SEQ ID NO: 54365 - DNA, 1193 bp, Bovine  19866880530784
tacctgtgtatatttctattgcgattatatcatgactttctgaagaaccgtgaaaaatccttaagcatgagtgaatcatgccacattgctgattacttaatatgtattcctgccccaactgtggacagtttttttcttttcttctcaataagatttggagtgctttttacaaaagttttcatgtgatttttgaaattaagttgatgagataattaaagaagggactttgatgaaggggccctcatttgcagtaatggcttcaaagtctaaataaatcatgcctagcttgctttcagatgctaatgcagttaggaagaactctactgactatttaagagcgaagtatatttattgaattactttgtctttagtttaaaagggaaaattcatcatgttgaaattccacatgaggaccgtgaacagaaaaacatcttctggatttttaaattttaaaaattaatttttgtgtgtcttgtgaagcatattatttgctatatttcagaaagaatttccgaaagttaaaattcaagattttatgggtatatttgtagagaaatgccatgacaaattaagtagagaccatttatatgggtagagatcacttatattggttttctgtagcttctatagcaaattactgtaaacttggtggtgtaaagcatcccaagtttattatcttatggttctagaagtcagagatcctaatgttaggatattggtaaagaagcattccttctggaggctcgagtagaaaatctgtttctttgccttttccctgttctagaggccattcccttctttggccccttcctccatattcaaagccagcagtacggcatcttcaaatctctctctgactgacctctgctcatgtcctcatatctaatcctgtctcactcttagaaggacccttatgattacattgggcccacacagatactctagaataatgtcctcatctcaagatctttgagcaaatcacatctgaaaagtctctcttgccatttttaggtagtatattcagactttcaaggagttagaatatggacaaaatctcatctaaaattcatcagctaaaaatttccaaatctcatcatctaaatcttctaaattaggtatgagtaaggtttagatagggacttccccgggtggggaaatagtaaagaatctacctgttagtacaggaaacacaa

SEQ ID NO: 54366 - DNA, 1797 bp, Bovine  19866880549089
ctttctacttctttcctcactgtgtaatttgtgatgagattccagacactgtgcattctactttgttgggtgctggttagttttgtatttctatatgtgtttttaagctttgtactgggacacaggtaagttggttgcaaaaaaattaagccttttggatcttgctctcaaaacttattaggcaatatcaaagtgttgacaaatctagagttaattaccccttaatactgaggtaaatccctcaagtcctgaaaccagtgtctcataattcatgagatttttccaatctcactagcataaactggtattatcactgaatgtgtgtgagtaccaaacacacttccttctaattcttttagtgattctttaccagcctcaggtctcttccttacatgtatatactcatcagcactcggctgattacaagtggggaactctctgaagatctctagaattccctctctgtcctacactctcttctccagtattctgtcctgcacatgttaggtacctcagtttgcccattatcacatcttggtttcctcaactcagcaagtccaccagtgtatgatgacaatcatgtgtctccactgtgccccgaaaactctgccaatgtagaaatatgggcaatattatggctcatctcttttactgcccacctctcaaggatcactgtacattgatgtctaactgctattgtcttataaactgctgtcgcacataatttaacacaggagctaaatttggtctcccttactgcatcttaaacaggagtagtaatccccactgggtaagcctcttcttcctccaaatgagaacatggttagttttcactataaaaaatggtgttgcaatcaacatgcctatatggctcttgtctccagggtatataactaggaattgaattttagtatcacatgtactaaagatgtatacaggtacatctttactgaaaaattattctcaaactcagctgctccaatctgtattattaccaataacttatggtaattagagtttccacataatgttcattaacattccacctatagtaagttttattagtttatactaatctgtaatttgcattgcccagattatcagttagtttaatatatattggaatttgtttcttagattgcctgttcaaaagcttagcccattttttaattgaagtatagttaatttacttagtttcaggtgtacaacaaagtgattcagtttatattatatatataattatataaggagcctatatatatatatatatatatatatatatataggcgtttctggatgcctcagacagtatatacatataaataaatactcttttccagattatttttcattatcaccatacttgtgcacagtcactaagttatatctgtcagtatgtgaccctacagacagctgccctctaggctcctctgccctgagacttcccaagcaagaatactggagtgggttatcatttccttctctaagggatcttccagacccagggattaaacctgtctcttctgaattggcaggtatgttctttatcactgagccaccagggaagcccatttttcattacaggttgttacaaaatattgaatataattcactgtgctttataatatgttcttgttggttatctattttatatatagtagtgtgtatatgttaatcccaaactcctaacttgtctctccctcccccacccctgctattcatacatttattttctatgtctgagtctatttatgttttataaataagtctctggataattcttttagattctacata

SEQ ID NO: 54367 - DNA, 1371 bp, Bovine  19866880611340
ctgattatctaggggcctattgaagacgttccttaaggactaccaagtaatctttgttaaccaaatttaaatgctgccttccatacactggtattatggacctcacagcaggaagtatgactttacatcagctcatcaacactacagagagattacctgtaatcaataggtagacttttggtccaggttcccctctcttctctgaccaaaatacaggcatgcatgaatgctccctctaacaggtgaaaaaagggaaacaaatggcctcgaaaggcactgaatactgattatgtgtacaaatacagattatgtgtaaccaacatggaaaatactacatctcacagacaacttcctccagtaacctctcaaagcctgctgctctttctctcaaacacaatttcaattcattcaagtattatgtatctacagggcttgatctttctccagcccaaggaagaatcttagcttttacccatggcagttatgcagaattccacataattgaaattttttaccctcacccaaaataccaaccgtgatcttattaagaaacctaccactacaaatgtggtaagtttatcagcaccagtaaatagcaaattagaaatacagtatggaacacactattgatcctcattaggtttttgctgcttgattagaggaaatatatgtatagttattttaggagatatttataaaactaaagttttctgttttattttattttatttttttaaaaacctttgttttagaggctcatttagatgtaaacagaacatcccaagttctcttctaagatacaagttggctctccacagaaattttattgaagcatattttactttacattcatgaatttttaagtgctttctactttcagttttacagagtgattataatttctttggagttccttttatattaagcagtattttataaatagtgataattattttaattcctgctttaataaaaagaccttgaaatattttattggaagaaactaaattagcctcaggatagagatctgaatttgaaaaaaagcatatgcactttaaaccactgcaactgcttcacaatttagaaatatacaccattaactacatagtcagctgaacatgaaaattaaaagggtttacaaagctgtgaactgaattcatagaagcaattcaagggatataaaacaaatccatcttcagtggaatataccatagatcctaaaaatgttaactcacctacaattgctatttcaatcaagacactgaaaaactaaagattaggaaaatcaagcaaagggactgcttcagtgagactggaaggatagtttggacatttagaaaataaatggagagcacttcaacttttcagatg

SEQ ID NO: 54368 - DNA, 1111 bp, Bovine  19866880630356
gtctctgggttttgagggccagtgggaggaaggagggtaagagatggcacaaccagctgggaggctcttctgtggccaaagctttaggatttcagcggtcatacagtctggtctcagggacctctgaactcggctggccatgagaagaggcagtgagaagtggccagatgagcagccaatgatgcgtggtctgcttctgaggctgcagtggtgttagatttggtctccctttatcctgatttctgatatttaagccagcagaattttccttctagttacattcttcttccttatactcactgatcaattattggcaccagtaactttttaaaaatgtagcttgctaaatgaaactgtaactcttatgagtttagtgttttgtgcgaaatatgctttcagtaaaagagggaaaagcagtatctcttgttaatagtgtgtgtcacgtctctagcaaaaagtagagatatttttctaatagtgtctatataacgagcagaaatagttttatcagtaaaaagggaacttctctatgtatctggcccctgccaaattgttttcacaccgttgttctgtgcacaggcagagcaatcacttgattttattgtaggaggcagggtggaggtgagccctccattagttggttttcctcaactttttccttggatgagaagagtttcccaagtgtgcagtgtttccagggatgaaaggcaatcaccaaatgctgtccagagatcaggcagggtcaagactaaacagaggccactgtatttgttcagtaagaagttgatctcatgttgatctttgccagaatagcttcaggaaaatggtcagctcagaaatctgaagtagtattgaattgagaagtgaataaaaagaaaatgaaagaacgctagaatacccgaagtgggtagcctttacctttctccaggggatcttcccaacgcaggtatcaaacccagctctcctgtattgcaggccagttctttactaatagagctatcaggaaagctgggaatgcaagggaaggggggaagcagaaaggggaaaggttagtttgcttcattttcagagaagcagctcaagcatgagaaaccatcacaagtagggagtt

SEQ ID NO: 54369 - DNA, 1081 bp, Bovine  19866880697938
agaaataaatattgtaatgcatattgcaaaaaaataagatgtggtatgtaatgtgtattgaaaaaaaagatgtggtgtgtatacatgcacaatgaaatattactcagccataaaaagaatgaaatagtgctatttgcagtactatgtaaagtaagccagacagagaaagataaatatcatatgatagtgcttacttacatgtgggatctaaaacttgatacaaatgaacttatttataaaacagaaatagacttgcagatatagaaaacaaacttatggtttccaaaggagatagatgaggtggaagaaataaattcagagtttgaataactctactcatatacacactattatatatcaaataagtaaacaacagggacccgtgaatagcacagggaactgtactcagtaacttgtaataacatataccgaaaagaatctgaagaagattttatatatatatatgtgtatgtatatgtataagtgaattactttgctgtatgcttgaaaccagcacattatatattaacttcaatttaataaagataaataattttcaaagtgtaatttaaagattaatgagcctatgagaatatcatttctaccgtcagtcttcttattggtgattttgtgctttattatcctaagagtataggtaatttttgccatattattttcttggctttgaaaaataaagggaaagtaaaaagtatgcttgatttttttaagatctcctgcagcgtggtagttaacttttaaaaatgaaaaaaaatgtataaatgacttgaatatgatgttattataaaacatagccattgtaaatgtactatgggaaccctgtggtaatagctaagatggtaatttcattctaaactgcagttttcaatggctaatttaacacaaactctcaatttacactgttgactgaaactttccaagcttgtttgcatccccaaggggaatttcatgaagagatgagacaaaattcctttaagctgagttattcaagcatggtaaaaatgattttcaccagtattaaaatttttagaatatttttgtgactcatgtgggcttcctggaa

SEQ ID NO: 54370 - DNA, 1527 bp, Bovine  19866880740747
tggatgaaactgagagcaagggtgattggcctaggccaggggtgatgagatgctgctcagttcattcttgagacctcatgcccctccctggggtctagtatcagctgtgatttctgaatctagttgagaacagcaagtctgggattttgatttgagggagcaaataggtctcagggtggctggacacagcctaggggaataggatatatccagaatcaggggaaaagttgcagtgcttcccctccaccactaaatattctgtccagatgccagtgtgggtctctgccccaagaacagatacagcatgcagttcaaaagaggatttagctataaatatgagcatataatcaagacttagcagatgtttgaggaaaagctacactataaaatacaaataaatagcaattataagctataaaacagaaaactcaaagccactatatggtggaaaggattcattctgagatgcaaggaattctgaaaagccttataaatacatcagctacctagactcactgattcttaaggattttttttgtccctatggctttgctgaaaaaagagcacaggttctttctgccttttgtgggacgttctattaccttctcatcctcagaggtagggtaatcctctgtggggttttcccagtatagtctgagtttacacctgtttttaggtaattatctatagtgtcgctttggtaataaagtatatgattatttattcaaggattatctgaggcatggggtcgaggtccagcgtctctttcctcaggggcctatgattgcctaaatatcttctacttccttttcagacagtccaccttcttccagattgtagaatcctgtgtaggggatggttaaacttgtaatgggcttccctggtatctcagtcagtaaagaatctgccttaggataggtaacctagttcttcttcaggtaatctgccaaatctgctatctgtttgctgagtgagtcctctcctggggctctttccccccgcctttttttttccactaaagcttccctaatcttaagcaataagtccaaatggcttaggtgttccaaatggggaagaggaaataggtaaaataaagagtggtaataatgcacacacacatatacatgttaatattctaaatactgtcctacaacatcactaagtgccctgtggtctttgggaacattatttaaatactctcagcctttttgtcctaatgtgtaagctctctgaactttgagattcctcctgaaagctcatgataaaatcatccagcttagggtttgtaggaactttgtgcatcactcagccaaacccttcaccctatatagatcttctttccaaatatttgtgccatgtgattatctaaccaccgtaataatactttaaagaatggactagaggagataagaataacattaatttctaaaaattaaatataaagagtgtggtttgtgccagtatcatactgtcttgatgactgtagctttgtagtacagtctgaagtcaggaacattgattactcca

SEQ ID NO: 54371 - DNA, 1314 bp, Bovine  19866880746244
aactgactagacattgattgtgacttgccaaatcactttgcttgctctgtaatttggagtaaagagcagagactaaagcatttaaaacttttctatagactagctttcttgataacttccaataaaagctttagtttgctaagcaggatagacacctcagtgcaaataaactacaacacccacattcctatgaatctgataaaaataatgcagaggtgtagatgactagctaaagagaatatgaaacagttgcattcatttccctcccagacttctcactgacagaaaatattcagaagtcgataggagataaggtttaaaagatattaaaagctttgttagcagattaaattgctctagatgtagcactaaaagaagtttggcaattgaaatatgtatccaaattatgatacctagaaaaggagtgataatgcaaatctagtttctattctggaaattttcgcaggttaaccaaatgttgagactgagtcattcaggctcctcggatcaaatttaccacattgtttttataagatgaaatcggaaatagcaataatcttcatttaaagcctttggaaagtgacatgtaaatcatgcattttgatggtccaccatttattaactactatttcatctctgtcctcatttctgagctcacttgggtactggttttcctgactgaaagctcaaaggcatttccaccgtttattctattttctttcctccctgaagctaggtactctaaccagcactgtatttgtcaatctgtgaaagcagaacctccagtggattgaaaaatttgagctacttacaagtctgcccttcctcctttattcacatcctttttttttttcccctgcaggagataaatagctattaatttatatgctaatccatataattccacattttccttaagatgaggctatgtgatatgtattcatgatttaatatacaaaggatattttaaaattatgagataataatacactatttctggacagttatgcagaggaattttacaatttttttttttgtactcaaggtgacaacacttgtcaacacaagcaacaaaggcccatccggtaaaaagaaaggaaggtcaaagaaagcccatgtactggctgcatctgtagaacaagccactcagaactttctggaaaaaggtgaacagattgctaaggagagtcaagatctcaaagaagaactggttgctgctgttgaggatgtacgcaaacaaggtaggaagaataatattattttagagggatgtatatgatgtttaaacagtggatttttctaggaaaataagac

SEQ ID NO: 54372 - DNA, 1113 bp, Bovine  19866880837170
tgagaaatttataaaatgaaaagtcagtatagcctgggtccaaaagagaccttgaagaagaataaagaaagaagaagagagtctgggggcaactgtactgtgatgaataagactttgagaaaagtatttttagaaagattggctgaataagggtgtcttttcctgaataactggaaaatattaattgttcatcatttccttctggttcttacacttgtgtatttctttagagtggccatctgtgctaagaccaggccacaaggtagctcacctggaggtaactcacatctcagtttagatatactcaactttcatacacgtgcaatttggggattatacttggatattggattaactgaaaaagcactgcagtcaggggctctagttatcaactacttatgtctgcatattgttgttgtttagtcactaaattgtgtccaactcttttgtgcccccatggactgtagcccaccaggcttctctgtccttgggatttcccaggtaagaatactggagtgggttgccatttccttctccacttatttatgacttactccaggtacttaatgtggctgtaaaatgaagagattagtttaaattatttctaaggacttggagctgaaattttgtaatcattcctcactagtcttcagaaagtaaaacagtgatccaagatgcagactcactgtattccaacgatatggccttattaaaaagtcagcaaccttcctccaagttcttaatctccaattcagagtcagtcactttatcttcaggattttgttgccctgcagctgctacaagccccgcctcagttctcaccgcataagtctgctcacctagacttccactgtgggcattgtaccatccctccaccagcaaacctggtatattagccacctcatttacagaagtagtcctgagctccttggcatgtagaataaatcttcaatctttttcccatagaagtatttacacctgaactatattcatatattgtttcccaagggcagtatattttaaccacaccaaaggtttttgccaaattttaaaacttcagtcaatgggaagaagtattagtagaaataaatacttgagcaaccattttttcta

SEQ ID NO: 54373 - DNA, 1298 bp, Bovine  19866880894751
gatactagtactcttgtaaagtcccacccttatgagttattaaccgtaactgccttgtaggtccttgctctgaatgcaattaaggcttcaacatacaaatttagggaagacacaattcaatctatagcaagtacttagcacagctctgaaaagagaacaaatactcaaagctagttctctgctctttagggtatcaactccctatgctggcctttctttccatagtactaaactaggaacaggataccaaatagagacttctaattagacagataagtgataagacttattaaatagactactggaaggattaaacttggtaatgcatttcaaatttggataaaatttcacttaatattcacacatttttttacaacctggaatttttttcaacaacatattatgaataattttctatttcactaaatgtaagacagcaactttagttggtgaatatcattttaatccaaattcaggattattctatatttattctcctcttcaatggcatgtgacttatctatttgtttttatatatgatgccatgatgaacatcctcatatctttgcacttggatagctagctttctcacattcatcttcaagtttaaagcaaaattctaaacagccattcattgtactcaatattttgaccattcttgacttattttgtttcatattctttgctgtccaattattcaactatgagggccattgcttccttcttgaggcagagtccacatttgttctgctatttgttattttagtcactcagccgtgcctgactctttgtgaccccatagaatgtcacccaccagcgtcctctatccatgggatttttcaggcaagaatactggagtgggttgccatttcctcctccagaggaactttccaatccagggatcaaacctatgtctcctgtgtctcctgcattacaggcagattcttttctgctgaaccaccagggaaaccctacatttattctatcccccaggatttacttctgcagataaccttggcacttactttgctgaaaagaaatactgttgtattctgaaagccacttattcagcttgtaagctttcctcttttttaaaattaagcaccctgaattgggagaatctggttgctgcattagatttcctgtgctaataaaattcaaattaaatgccagctctaggccagaagtaaaaggcaatggacatgagaaatgatgccaattctttctcccaatcagtggaaaatgtgcttttctccacttggcggctttcttgtgtttggttctagcctaccccaaca

SEQ ID NO: 54374 - DNA, 1426 bp, Bovine  19866880901427
agatttagggattatttgttacctcagcatcacctagtctagatgagtcatatagcaactgacctagttccatgatggtgggagaaaacacatgagtctcagtttctccatctgcagaataaggaagccacagatgaaaggttatcactaaagtctctttgagttctataataataatagtaataataatagcaatgaggatcagacattttataaatcaaggaagaatgaaaataatctcattgataagctctgagaatcaaagaatagcagagggaggcaaaatctaaggtcagctcttcccaaagctggttttttagaactctagtcacaagagatggtttgtatcagacagttccctgaccaagtaagtatgggaaatactgcatatgacagctatctgttaagtaattttcatgcatattatcatagtctaaggactcatgaaggaaacctttttaaaaaaaattattgattgacttggctgcatcaggtctttgctgcagtacgccagatgtttccttgtggtgtgtgggcttgtctctagctgtggcacatgggcttagtagttgtggcacacatgagcttagccccagggcatgcgggatcttagttccctgacgagggatcaaacccatgtcctctgcattgaaaggtgggttcttaacactggactaccagggtagttccaaggaaatctttaaaatgcatttcacctagaatttaccaataaaaaatcatggtggcaatcactttcacaatgaactgggttgctgtacttttcatttgtacagtaggctttctcatgcggtacttcaaagtcttttagattccttctgcatgtagtcacaagagtgggcatatggacaagagcatctcatttctctgatcatagtaatgggtttgtatatgaacacaaggcctctgcgtagccaatcagagccttcaccatgattaatagttttgatgacatcttggatttagctgaacctcactgagatacactttagacttctcaggtatttgagccaaaatgttccttttactcaaactaatttaaattggattgcagtcatttgctattgaaagaattcaggttggaactcttcctccttagaacagagtttagaagaatgctcttccaggataacagagtaaaatgatacaattttgaaacttattaagcaattgccccatcttcctctaagggaacttgggtctactggggagcatgaagatgggagtgacatatttagcttgagaagacatattacagctgttttttcttttttttaaaaaaatttagaaataaaaaatgatggaaacagacacaaagtagtcaaaatatattgatagcaagtaacaatcttaatgtctcattcatttcctcattcatagaaaaatattagttaaagagcacatctat

SEQ ID NO: 54375 - DNA, 700 bp, Bovine  19866880940929
gcttggtttgcactctgcctgctttggctgcctctcaccccacccatcctctgttttgtaggggcaacaggtccagacttgcctctggagtcagtcctcattctaccctcctctcagcctatgttctggttttcttcccctcaaagagactcagaaaatacattatataaatgcacttgtgactaaaactctttgaaaaacaaacccctggtttttggaggaatacaaatccttggagggagatggaactcctgaagtggtcgctggcccattgggcatccggtgcccccactttctcgcttgctgttggtgtgggtgctgagggcattgtcggtctctgcacacccctgcctgtcctcttctctgctgtgtagtaaatcttcagatattaccaaactgtcaagagtgtagcattcttttgatcattttctgtcaagagtgtcatctcctaaaaccaaggcctcccttcttatttattattgtcagtgctgtcagccttgtggtcagatgtgttctattttggagtctgaccccctgcttcttcagcctttggcgggtccctatttttttttaacgcgtgacacagaagtgttttatcccttgttttcaatgtttatagtttttattttccataaagcctttctctttttagtttagggttttttgttttcctcccagtgcttttattttttgttgttat

SEQ ID NO: 54376 - DNA, 1359 bp, Bovine  19866881238607
ggctgaatgggaactatggctgcagttgcctagcatcaggagagagcactgaaccacatactgctcacctgagaaaagatcaaatttcaaaatttgaagtacagtttctactgaatgtatgtcacttttacaccattatgataagttgaaccatcataagtcaaggactatctgtaatattcaaacgaatacaacactttgacttccaacatagttgttagaaatgtcaatgctctgtttggagaaagcttcttgaaggaagtaaatattaagcaggtttggagaatttagtttgttggagatgcaacagttaattttaaggagaaacacagactgtactccagagccctctcatcctctgtcttcactgcttggtgccatctctgcaactttaatttatgtgcatcatgttatctgccttgtctgctgttgtctagtccaagaatgtgccattcttcaaatatatactcacaggatagaaaagaatggataataaattgctaagtgtcatgatgaccccatgtaaatcatcataacagtgaaaacagcatactagataaacagagaacttgtttatctagaaatgttctctggattctccagcttctgattttctgcatttctgacttaatcatgatctcatggtctcctatttacttttaataggacatatgaaatatatatttgaaatatacataatatgtatcaaacatataaatatatataacagatgactatttaaaattatatatatataggaaatagtgagagaagacttgaagttggttaatgccaacaaaatacttgttaagtacactaaactgtttttactttactttttattattggcaacctcaactgatgttcaagaaaaaaactttagtctctaaaagtgcttggttttgagatttgttttctaaagtttctatatgttattttcagttggatttaagttccatctagaattaccacaggaaagatttattagataatttttttactaatgctatattggataattctacttgttaacagaatatattgacattagctttcttaattttaattatcttggtagcatctatagttgtatatttaaacaataacaagctgagatagaatattattagtgaattgtttctagttgtatatcttttggtttagccgcaataatgagcacatattctgtgatgtaaaatgtgggaatacaataaatatcatgaatataagtatccaaaatggaattgatttcttcacaatttacttttagctgaagaaaatgggagaaatagttatctagtacttgaatagaagccactatactagagaagagaccagacccgcaggtgtataattggt

SEQ ID NO: 54377 - DNA, 977 bp, Bovine  19866881279128
cagatgctaaccctcacctgttccctctgcccttttgagagactgaagggaaggctgccatcacagcttcttctcccctctgaatgcatacacacttccttgactgcctcagatccctggctcccaatgccacagtgaatggaccagggttcagccaaacccaggtcatgctcagggctggtcagcttttctgtgccctgctttcaccactcagagaagcttccttccactctgccgagccacactcccactgagggcctgggctggagaggaagggttggaacgggcttcagatgatgctgccgagaggcctgtggagggttgaagtggtggttctggaatgaaagatgtgatgaaaggagcatttctctcagcagccatacatcatggaacttctccaggcagaaaaaagtgagaaacagatggcaatgaacaggcaaatgcaccacagggacaaagctggagtgggagggtgtgaggaggcagcagcccatcggcagcagcagaaagaggggaaaagcccaccctgtggtactaacataaggcaagtcagagttggagacaggagacaggaccatgtgaccagagactagtgctcacgacacttggagccaaggatagggccagctgtttcccaggcagataggagaactcttcctcagaggtcccattgaagactcatttctgcacctgggaaaataagctgctctaaaacaattagggcagtagatttcaaccacactgcataataatcacatgataccaggatcttccctcagagattaccatactgtactttgcttagtcaatcagtcattgtctgactctttgtgacaccacagactgttccttgccaggcttcctctgtccacagggattctccaggcaagaatccttggagtgggttgccatgcccttctccaggggatcttcccaacccagggatcgaacccagatctcccacattgcaagcagat

SEQ ID NO: 54378 - DNA, 1151 bp, Bovine  19866881735397
gaaggtgtgctgcctaacagcagaattctgggcatgttagagctgctatgtagcagttggtagtgtgaatgggaaatgtgtaaagtttttttggtttttggaggacaggcaacatatccttgccaaatattgttgttgtgaaggaacccaagtctaaattggtctatatggttggattgctatgcttagtttatttaaaacatggcatttggagagaggtaaaataccagcatactgcatcttcgccttttttttttttttcttgaagcaaatttgttaggtctgtttgcaaaaggactagctgtagcagggcagtaaagagacatgtgcctcttgcgatagaccttttttgtagtgttaattctaatagaaataatcatctacattgatcaataagagtggaatggagcggggacattgattcaaaagagaacagctgtgaacagtttgatttatgatgatattaaagcaaatgattcagattcaccttgcacagtctaaggttgcttgtccagtggttagttgtcaaaatatattcatcagagaacagtcaacttctcagtgagaagcacacccctaacagaatgtctgatttactcttttgaggctgggatgatatcgtgtgctcgatatgtgcaaggttgctacgtgcacacccgtggttcttaggtagaaagggattgttgtagaatgaaataaataaccttatcagacactcattttatgggataagaatgtaaatgcagtgagtaatcagagcgtatgtaaatagcagcaagctaattttcagaatcattgcgactcattttgtaatatctctcctatttaagagaataaaactcagcttttccaggaagcataatatcctcagtggtcagttatggtgtgacaaaaacaaagaagccttttgttaggacctggggtctttcatctgattgtcatgatgagtttattgtacttctttaaagtctttgctgatctcctttggtgactgactttgatgtcctttcttcagttcttctgtggctttctctgtattccttgatcacagcacaggccacattgaggcataactatggccaacctctgctatttgaaaccacaggtactggagggcagtgaccaaggctttcccagcaaatgtgtgtgtg

SEQ ID NO: 54379 - DNA, 625 bp, Bovine  19866882155101
tttatttcctgatttctgggggaggatagacagttttaaacagaaacaaggaagagattaggaattccgctggatatgaaaaatctatattcattaagtagagctatgcaaacagctgtaaatttggataataggcaagggaagatatctgaatttcattagtcttttttcctttacagttagcagatatctcaccttctaaaattactttgattgtggttcaccacaataagcatgtaattagaattgaaggatgtttaccaggtgaggaaatttgatgaaatggagccaggagaagggattggaaaatgtgcaaagaataactcaagaaacacactgcaattgggaagttattttagcaaaggtactgtgggcaaggatttcaatcaagtagaggatgctgggttaaaactagtatgtagaaactaagtcacgcaggatgtttttggtgttgagcattaattaagtcaatattcactgatagcctattatgctttgatttctatatcatatcctgggagaatcattggtgagaacagtttctgtaatcaaagagtatgtattctagttatggtgagaagtttgcattactgtggagtgttactgtgtggtgtgtgcatatgga

SEQ ID NO: 54380 - DNA, 5745 bp, Bovine  19866880485390
gagcttctctgtgggctagcgacaggtggctgggcatctgggcgggcagggagctggggtgggggagctgggctcggctgtcccctgacacccccatccctccagattccggtattcagaggatgatgtggccacctatgtggtgcagctgctacaaggcctggattacctccatggccgccacgtgctgcacctggacatcaagccagacaacctgctgctggcccctgacaacgccctcaagatcgtggactttggcagtgcccagccctacaacccccaggctctgcggcccctgggtcaccgcacgggcacactggagttcatgggtgagggcaccatgctatctaaggggggaatggggtactcgcaaaggggcagcagccagggctcaccccacttcacccacacacgtggcatttattgagtgcttactgtatgtgagccgcgaattaagtcctttccgtggatttttttcaatttttcttcacagtagccctggagattggcataatattacctctattttacggatgaggaaacagaggtgcagggaggtgtttgttcagtatcagtgtacatggtagacccaggatgtgataaacacaggagaattgattattaatttatataaataagggaaactagctaccatttagctacctgctaaatactctgttcatcatctccattccctagaataactgtgcaagccacactttacagaggaggaaatggaaagccagatgggtttagtacagtgctcagggtcctgtcactacaaggggcaggctgggattagagccagcccagctgatttcagaggctcttaatctcggtgttggccatactcttcgtgaatgagcgcctacctttggagctgatctgagacagcttgtgatcatctgcttcttagctcctctgtagttctggggacccccacacatacacattcagtgcctgggatgattcctcaggtgccccaagtctcgcctgggggccatgcagcccaccagtatccggggcctgctgctctgcttgtacccattgtctggtgacctgggcaccgtcctgcttcccaagcccccagtggcgtactctgcctctctctggtcccttgccacctggaagctggctcaccatgggctcttgtctcctgtcagctcctgagatggtaaagggagaccccatcggctctgccacggacatctggggagcgggtgtgctcacttacatcatgtgagtgcccccaggccccaccctctgcctgcaccccacgtccccacccacacatgcatgtgcactagtcatgcacacatacacacatgcatgtacacacacaaatatccaggtatccttgtccccgagtgctgtgcccctagaaatccccacactactgtccccctggacctgtgagttgaccctcagtctgcatctcttaactgaactgtctcctctgcaggctcagtggacgctccccattctatgagccagacccccaggaaacagaggctcgcattgtggggggccgctttgatgccttccagctgtatcccaacacatcccagagtgccaccctcttcttgcgaaaggtcctctcagtacatccctggtgagtgggtctcacacctgccagcctcccagcatgaccttctcccagcctcacactgccctggcccagcccacacctaagccccccaactcctaccccacaccaataatacactgctgctgctattactacggttactacgcctacttctcctaagtggctgttctgccaccatttaaagcccgtaacagccctatgacacaggcagaatcattgtccccatttcagagactgggaaactgagtcccagagatgtccaggctcattccctagggatgaatccaggattgggagtcctgtctctgggagggtggagtctgtcctcctctgggagccatgcctccagcctcactgtccctggcttggcctggcaggagccggccctccgtgcaggactgcctggctcacccgtggctgcaggatgcctacctgatgaaactgcgccgccagacactcaccttcaccaccaaccggctcaaggagttcctgggcgagcagcggcgccgcagggccgaggccgccacccgccacaaggtgctgctccgctcttacccaggcagcccctagcgcctcggaccacagcccggccttgcgggcttcgacttggggttcccgctgacgccccgggacattccagggcccccgtggagccgggtgggcccaggggggcttcggacaccaccagcaccaacatccggccgggctattacctcatggacctgtggggacagagaccctgggcttcggccaatgccacccagctggagtcagagccggagacccatgggccaggctgggtggggtcaggatcaggtcaagagggacaaggagggaatgggcaagtgaggaaaagaagccgaggcatagggagggggagactctatggaggttccgggggagggagactgagcatctgggggagaacccaacccaagagggtgtgaatgaatggagaggaggaaatgggggaagcccggggtgtctacaggccaggggctgggagtgtcactgaagcaggaacaggacgtggagacagtgccagagagccagaggcagtatgtgagagagggcagcgaggtgggagagggagaggagagaggactcaggtgggggcgcgcggccagctgccagcctccccagaaggagaagcgtggagggctgaaggctggaggcggggtctcaagccagcagcgctttcctcctatcccggtgaacgcagtgctgggccctctgcgctggcccgaggatgtccccaccgcctctctgtggccttcaccctccttctcattcatatttatttatttattgacttttatgaagtctccctgccatccaatccctcttgcctatgttgtcctgaccatccccaccccacccccagccatccagctgtctgtgcagctgtctgtctatctgtcacaaggaaaataaaaacagcaagcagcaggacctatgtgtgtggtctatggggagggatgactggggggtacagcgcgtacacaatgccagggtactgggacggggcattccagccttttctggaccagtgagaaccgaggtataccacctagcaccttaggactttcctcccctgccctctgaccctcctggcccctcacctgtcccttatttcttgagaaaggaaagatgtgggtgtgtttctccctctaaagtttctgaaatcctggcaggaccactgaatccccacccccagcctctaactatatgggtggccccgacttcttctcacatgttccatcatcgcaatgggaggatgctgggctctggaagggaccagcccacacccccatcctggctcagccttcttcactctgttcaggggacagggcagctctgtcctgacccctggagcagagggggtttcatcatgatgattggtgagagcagatggtgaaagagctgtagaggaaagcagggcaggctcacgcgcccacgctctgtgtcagagcaccaatcagcacactcacaccaatcagctgtgagtgccgtcagtgcgcctgctgcgatggggccatagataaggattttcttggggcccagggacactaagtctggcccttcttattcccacggcaagccagggatccactgggtgctaaggtaccttgactctagctgccctcctgcagtgccacagaaggatcactgggtcctgtaactgggctgccctgccctgaggtggatggagggggagccagttcttgtgtccagagggactgtgccccactgtccctccccagactgaaaactctgttcttggccatgtaaaaggaataaagcctttcaccgtgagcacattgagctggtgctggtgtgttgctgatcaagtttgaggctcccttggctgtagtccaaaccaccttttgcccagcccagcctctctggcttctcaggacacaagggaagagccaaaccccatcatcataaaataacagaatattagggccagctggaaggggccagagagccacctttaccacctgccattttagcgatgaagatatacagtttgcctgtgagagtctctaatcccctacacactgcaagtgttttcatataaaaatgaggtgcctgaactcatatcttgataaatggtaaaattcttctcccgtcccccctctgatcttgagcttccctctcatctccattggaaatggcatgtgaactgcttgttccaaacctggaggagcaaaggtaatttatgtcaacagagccgtgtcaaaactgctctgatcaaaagctgacagcgctccacacctgggcaggcagttacagtgaagggaagcaaggcttatctagtgccctggcctgggtggactggactccaggcaaatcttagaggagttagccccctcacccccggtggtctgatgcccctatacaccagcttatgcccagggagggagcttgggcagacctagagggtcagagtcagtgccaatctccagggacagtgtagcgcagccagaccctacgatgtcccatggaggggagtgtgggaatggggcagcaggaggggtggctgttctcaaaaatccttaaggtcccttctaggtttatctgtttaccaccaggaggcacagcgtggaaatgacaaccctagactcctggggttggggggagtaaggtgtttccagattggtcctgactgccacgtgggcctctcataattggctagctggacagtgaagcccatcaccactctggctttattcaagggcacctccaacaaacactcacaccccttaactgactgtgtccaggacccacatgttgtctctctctccagggactgacctgagtgtaaacttccccagcagggagctgagtctcctgtcgacctgaagctgtgcctagttctcctggaagtgagatggatagcccctgctctgggaaggggatggggccatgcccagctgcccagctctctgggtgctgacgtgtggtgcaccccagagccgcccaggtttcccctgagggctgccccagtggctgagctagcatcccaggcatcctcaggctaaataaggagactgtgtgggtcagggaatggaggctgggtccccgggggcttggggcagcctcgccaaagaaggcaaggaggggagccatgtataaaacctgggcctggggctgagcaactacccgtgccctggccctgccgtttggaaggccatgccgcctgccacccagcagggtgaagctgagccctcacagcgagtctagatcttcaggtcagcctagacactctcacatagggggatgttctgaacctacagggaaaaggctgaaattcggaatctctgtgtcaacctagacctctttgtttcctgctccccagctcctgccagaaaaccagctgctgtgttctgctccgctgcggcccctccccctggatgtatgctggatatcaatgacccccaggttcagaaagcagccattcgcatccaggcctcttaccaggaccacaggtaagggggagctctggagaattgctggaggaagggagctggagctgcagaacgctcacgactgcatttgggggatgggggtagactgtatttggggggttggggagactgatgctgcagctgaaaccccaatactttggt

SEQ ID NO: 54381 - DNA, 1198 bp, Bovine  19866880529619
gaagaagaaacattcctgaccataggaagtgaccccccccccaataaaacaagagatgttatttgcacaacagaagcttcttgtctctaaatgagctctggataacaaattttcagcattagatgagcacacaatactttctcattttaagctttaaaaattggtcctgcttggggttaaagaaaaaaatcaaatgaaaatacagaattttatcaaagtttatggtgtgtaacacagacactgtgctagtctttgcacaaaagaggaaggagacactgatttcaggaagcacacaggacttcccggagggtccaatggttaagaatccgagctgccactgcagggggcacaggttcgatccgtagtcggggagctatggtcccgctatgcggccaaaaagactagttgtgtctaggtggaaaagcctccagttgtcctgagcagtccataagtcctagacacagatggctagggttcttggggacagctgagtgagcttcctgactggcctgggaggccgggaggatttggagaggccctgccgcgctcaggcctgcgcgcccaccctcgcaggtgaacctggtgtcggagcacatctggtgcgaggacttcctggtgcggagcttctacctgaagaacgtgcagacccaggagacgcgcacgctcacgcagttccacttcctcagctggccggcagagggcaccccggcctccacccggcccctcctggacttccgcaggtgagccggcatccctgggaagtggggcagcccgaggaaggctcccagaagcccgggagagagcagcctaggagcaagggggcccgggagccgggctctggcgcctccccgcagcctatcagctcctcctggggccccaggtcaggagaggcaggccctctcgcccgacctggagcctcagcttctggtctgctggtgtccccttctagacacccccaaaccaggactgactctgacctcctggcgtccccttctgaacaccaccccccaaaccaggactgacgctctgtctcgctgtgcccatccgtccattgctgtggtccagctcctgactgctcgctctctctgctggctggctgcctcttccctctctcttgccctctttttctatctcccactctttctccataaccttcttctccctccgccccgctataccctgaaaggctcatcttgtt

SEQ ID NO: 54382 - DNA, 1653 bp, Bovine  19866880981518
ccctgcactgggccccacttaatttgtttctgagctgccgtgtccagagttaaacttgggccttagctgcagggcttcgtctcaggtgccatttgatgactcatttggcttaggtttctattggtttgggttctctttttcacttttaaatgattatctagtccccagtgtagttttttaacactaaattatttcctattccttttgggaagtgagaaagctatctctccattaacataagttaaaacaagacaaaaatctaaggattatcaagagctgaatagcttggtgttactcttaactgcaattgcccggaaaatcccacggacagaggagccctggcgggctacagtccacagggccacaaagagttggatgcccctaaacgcacacacacacacacacacacacacacacacacacacacacacacacatgcagttaggttccaagaagggagtgacccaggtgggcagagggtgtctggaagttcctggggggcagggggcagtggtgggattgcgagtcaaggtgaaaagcaagccctgtaacccaggggtacccatgcccagtgagacatatctggggagcggacgaatgatgttggggtgggaggcctgcttggctttgcagccccatgctcgcagggcccggggactgagttctcacccttctgacaggctgagaaaccgtcagcctgtgcgcccagaccagcggcgctttgctgaggaggcagaggatgggctctgccggcttcggatcctggctgccgagcggggcgacgctggcttctacacctgcaaggcggttaacgagtatggcgctcgacagtgtgaggcgcgcctggaggtcagaggtgagtacctcacactctctacaaacccctcaccctggccctagcctcatccctgcccggttgccaattttcacacaagcttagttaatggctttccacaactgaaagggccttcgaggtccccaggttcagctgctcatgctgtagtgagtaaactgagacccagagaggggaggcaatttgccctaggtcacacagcaaattattgagcgctcagcttactacacagtactgctttccctaccctccatcacgcctgctccggtgccagctcgagagaccctgcttcctgtcgccggcggtcctcatctcacactcttctaagccttggtcaccttgccaggccccttcctcacacccactccctgctcctctcttgcttcttccacccatcccattgctgtgtggacgataccgtggttgggggtggcagtgggggagtgtttgatagtcggacccgtccggaggggcccttggagtgacttgggcatggagcgttgcagggacccgggggtcgccagggtgagcagagctgggaagacacggagaggactgggcccccggagttggggcgtaaggacaggtggcctctaggcctcaggacagcaggcggccccttggggctgatgcttttcctccccagggcaggccctctgcctcaccttctactccccaccttccctgtgggcagttcagggccaggaacccctctccccagctccacactcagccaccaccccctcctcctggcagaggccagctctgaggagccccccagctccctattggagcatgga

SEQ ID NO: 54383 - DNA, 1604 bp, Bovine  19866880988626
acggcctaaaactctgagaaatgaagtgacttgtccagttacgcagctgccatatggccaggcaagaactggaaccccagtccaggtgtggttgctacacgctggcagtgggctccccaacaggaatgacagtgaacactgacaccgtgtcaaacacctgctttgtgccaggtgtgactgccggtgctgccttgaaggaggcaggtgtactgcactctctcaccccactgctcttctccccagagatggaggcccgttttctggtcgtcttattcagcaccagcaccatcggggctcctacacttccactcccctccctccagctcttgggagccggcagcagccctagggcccaagtgggcagttacctttggccgtgctgagcttgcaggtgtagacgccgctgtcgtcctcatgcacagaggtgagcagcagcttgcatttgcggccatcgaaatgcatcttgcatttgagtagtgcaggctgcagcaggcggcctcggcacagccagtctacctccacgtcggtgggacccgccaccaggcactcaaacagcgccatctccccggcccccacgtccacgtcctgcagaggggccagcacggccagggaccggctttcagggtgtgctgggtgggggaagcagccacagggggcacacacggagcagagaaacacgtgccgagggagacacacacgcacacacacagagagacagacagacagacacagagagagagatgcattttgttcctttggagacagggaaagcccgcccgcccagcaggccaagatagcaaggggctcccaggcctggcttccgcatggccatcccacctgggccagagagggggaactcgggggaagcgggagggaatcaagggcatgaaaaccgagagggccacatggggacagagacggcggcggaaaaagaagacacagcacaccagctgggtacaaactggactttatttgaactaagaaacaggtatttctgaatatgtccacacccactacagcaggcccctactcctgcgccaagcctggctaactctcatcctcaaatagagcatccctggccctgatagtgaacaagggagccccgaagggccctaagcctgccgcccacggccaggcttcagccaggcctcctcatcagcacagggccaagggcctctggcttttggtctcttgtgaaatagaaaggattgtgccatttgaaacccatttctggaatggtcagtgccccctgagccccttgcccacagccccctgcccctctggttccctctatcctacggacgccaggccatgtcctctccccctttgcctgaccccacgccagctggagggcatccttccctgactgtcacagacacacagtacagacaaacagaaagacagacagggcctatagcagaggcagcacatgcactcgctgggtgctccccttcggggagagactggggggtggtcttgatacccctcacagccgccctcccctcctggcacccagtccgtgggggagctcccagcctgcccgaccatgtgtccgcttggggagagggggtccataaaggctcatgggctgtcccaggacgctg

SEQ ID NO: 54384 - DNA, 1324 bp, Bovine  19866881082570
tgccctggacttgccttttccttccctgcctttctttgccaggccccagccagagcctggagttgctatggcaacttccgaggaacccatttccttagtgatgtctgtggtacacaggctggcctggagcttgaaactgccagcaagagatctcctctgctgtccccaatttctctccctgcctcacccagttcccagaggccgttcctcagggactctgctgtccctcccccagagtagactctgcctccctgcaggtggctggttgaggtttttctccctagggcactctagattgcatgccccccccccccaccccataccctgttggaggtgaggtttgctgtgtaggtggctgacccaggtagcctgacactaaggcgctggagaatttatgcttatggccaataccatactttttttttttttcaataccatactatttctcccgtctctgtgcccccagaattccagacatattggagggaataagggcttagaaaccagactactgggctttcaatctagcaccaactatttcctagctatgttaccttggtaaggcacctcacctctctaaacctcactttcttcatctgtaaatggagataataacagtccttgtcgcaaaggattgttgtgaggattaaatgactcaatgcattttaagcattcagtacatgcttgacacacaataagtactcaatgagccatttcataagtttttattaagctctctctaatgtgttaggtaggatgctaatatctccaattccttttctcgctaatctctatgtttggtgtgcccccaagagtccagatgggggaaactgaggcccagctcttgggcatcaaagttctggaggtgagaggggcagtctggggctgcccagctcctttcttcctcctcttctcccacacccactgttcaggcccacacagtagttattttggagctgagttattcctgagcatacccctttggggagcttctgtgtttctcagggggtggtttccaaggactcaaggtaactttcccaggggcaggacaaagtcagaggccttgtaccgggggcagattaatcaaaggcacgggaacctgggtaccctcgtctcccactccagggacctcagctgtcacctgctgtcagcactggtgggggcacaggtctgaggagctgttaggcaatcccagggatgagggtattgctcctggaaggcgtgtgcctgttcttcctggggcacagtgaaggggtatgccctgctgaggaagggcagggctgtgggggccagctgggggcaggaatgagtgggaggctgaatt

SEQ ID NO: 54385 - DNA, 1772 bp, Bovine  19866881219128
cctgtgatagagagctttggagttggcagtcttggctatgaatcttggcctctacctgctgtcctaaagcaagaactcaagccagactggacctccaggaatcaatttcctgtcggtccaaacaggataaaatattagtaatggctggcacttacttcacactcactgtgtgctaggctgagtgctaagtgctttacagtccatttctcattcagtcttccccaaaccctatgctattataatcattttacagatgaggaaactgaggctcagaggggtgaagcaactcacccaagagtggtagatccaatctgaacccaggcagtggcccaggagctgctccccaaattcctccctttgtcccatacccctgcaaagtcgaatggaacttgggccattggctggctgtctggacaggtgtgagaagagttctgtctggggctataaaaacactgaaggttcaagaatgggtatcttctgggacttctctggtggtccagtggttaaggctctgcatttccactcaagaggctcaggtttgatgcctgggcggggaactaatcctgcgtgcctcgtgcagtgcacccctcccccaattaattagttaattttttttaatggccattttctggaacccaagactcactttcattgtgtatttggaaaatctgaagaataagcatctgaccccagcagtgaaaacagctcaggatgctgtaatgggctgtggtctggagtggcagagaagaccgtggggtctgagtggaccccaagctgactgtgactcagctggctggaggaagaggaggatgatcctataaggctatagatagcaactgtgcatagtggccccgtgaggtcattgccagcctgctcaggctctgtttaaagcactccacagcctcagagggatgtaggaaacctggaaagcgcccaggacggcagggatatgaccaaactggaggggttgaaaccaaaaacagcctatgaagaaagataaaaggaatggggataaatcaggcagaagagaggggtgagtgatggcactaagaatggcaggagaatcctggggaagaagggaagctctatttctctatctgggttaaggtctaagaaagaaggaacttacatttcagcagacaggttagagttaggccctgagtgactctctagagtgtgagtccataggtaggcagagaaacccatgaaatctcctttcacagaggttggagcagggctgggtgccaccctacaccaagctcagctgctcccaactcaccctgacaccttcccaccccagttctcacacccctgcccctccttcaccctgataaaccctggtctgatcaaggacagttttctcttattctccttgggtttcagctgaggggacggtgcatatttgtgttggaaagagagggctcccctgcctcttcaggaaatggctcaggactgaggggacttggagaattcaggggtatccccccagatggctgggaactgtggggaggtggctggatgtggtgggggcagcagtgtaccaggacagctgagacgccaggaacccatgaggaggtgggggctgtgtctgttctgtggggcaggaacaggtgctcacacagtgaggacggagccaacagagacaggggaggcaggaggaacctgcggggagggagaatgtgtctctacggaggaggctgagtccatttctgctggcaggtgtagctgcctctcatcaacacacggtggggttgggtgtttctaggtacgcg

SEQ ID NO: 54386 - DNA, 1078 bp, Bovine  19866881342899
taaaacttgcaagtgcttgaagactggggtggtaaatcctgggaggggccagagctgccccactcccacttggctctgaccatctgagggcaaaaaagtggtgtgagaaaggatcttgactagaagccttccaaattccagttgaaataaagcagattccttccactatctcccctgggttcaatggtccctgtccccctcacctgaccccctcctcccttcaggtcttcctttttattcttccctccccccatcaccaccttccctgtttgttaacccctgccacctcattcacttttggtagcaacttccagataagagccaagcttacaggcaaagagcagcccatggagggtgaggtaagcagatactcaaaaagccacacacataaatggataatcaggtgaacaggttgggcatggaaagtaggggaattgcatttagggaaggctttaaagcctggaggggattgaaggggactggagtgtggctcagtggtaaagaatcattccatccttgggtcaggaagaccccttggaggaggaaatggcaacccactcctgtattcttgcctgcataattccatggacagaggagcctggtgggctataatccatggggtcgcaaagagctggacacaactgagtatgtgagtacgcatgagcacacacgcatgacaattggagaggagtcctgaaatctttagaggaagaaagtattggtatgcataggttttgagtgtctggagccttgtcctgaaggctaaaatttgccactgggcatatggaaaggctagggggatggagataatccctaatgctatacacttttctcattccaagtagatggggtagggttggagtctggttttttttttgtttgcttatttcttttttcttttttttttttttgagggggtggtggtgtttgtttccgacggtggaattaccatgagtcattatggaaaggaaattctcctcccgatttaaatggattctattatttccctggctttgagaaggaggaaaacgtcatactaagaaggaatataagttcggaaggagatatcgttctctgg

SEQ ID NO: 54387 - DNA, 2898 bp, Bovine  19866880245897
tgagttttccaatttgctggcatattgagtgccgcactttcacagcatcatctttcaggatttgaaatagctcaactggaattccatcacctccactagctttgtagtggtgctttctaaggcccacttgacttcacattccaggatgtcttgctctaggtcagtgatcacaccatcatgattatctgggtcatgaagatcctttttgtacagttcttctgtgtattcttgccatctcttcttaatatcttctgcttctgttaggtccataccatttctgtcctttatcaagctcatctttgcatgaaatgttcctttggtatctctgattttcttgaagagatccctagtctttcccattctgttgttttcctctatttctttgcattgatcgctgaagaaggcttttttatctcttcttgctattctttggaactctgcattcagatgtttatatctttccttttctcctttgcttttcgcttctcttcttttcacaactatttgtaaggcctccccaagacagccattttgcttttctgcatttcttttctatgggaatggtcttatagacttataaagagacttatagatacatccaattcttttgagacctatcaggacacacacaacctttgaagacgggacaattctatattacactatgtgatgtagtcctttgttgggaaagactgctgacaaggccagaggttggaatttaggatcactgataatctgggaactgcctctgtagtctcacaactaacctagaattgggaaggctttttgttctttggatgtaccaaagatggatccccgtttgcagattccaaattctctattctgtttctataagattcttattgtcttataactgtatttttaaaagaagaatttaaaaaataatatcccctttgccttagactataaaggatcaaacttttaactactttgtgtcataaaatcctcttaaggagctacaaatatatgtaagtaacataatttcaagaagcttctaaaaccatgtttatccacacttagaaaagtgtggatctctactatataaaattaccatcaaataactgttattaaatggtgctcttctctctacagtgtatttaaactgctagatatgtccttcataatattaaaggcatcttaaactggcttgtctagagacttaacattatttgagaaaccccattaggggaaaaagttctacatacataaagataaattggagctctgaaacatgctttctgggagacaataggcttttttaatttgccttttttgaatatcagtttctctctctctccttctctctccctctccctctctctcatttcttccctttcccgtttgtttggcctctatgcctgtctttctattgttgcctattttgagctctctgtttagaaatgaaaacatctttgtcactgcagatgtgtgacctttagaactggtatactaggctttttttttttaaacattgactctacctgcatttttcaatattcttctccattgtctcaatttctgttgaaaacacacacttacacacccacacacatacctgaaaatgctatattcatttcagggaatattgatttaaatatagactagatgattcttcaaggcaaaacaataaaatcatgtgtaagaggaaaagttagcaaaaaccttataaagcacaattacacagctctctacaatgataaagtgatttttattttaggcttgcaaaatattcctgcacttcattatcaagtccatatcagtgtcccagaaatatggaagagcacaaaagttttggaaaggattcagaagagattattaagatgagctgaattttcagaaaagaagccagatggctaatctaatattggcaatgggtaggtagagtgtggcaagtgatggggaacaggggtcacctcagttccagtttcactattgacaaagtggagacaatttcaggaaaagaggaagaaaatgatgtcctgatattggtaattctaactctttaaatccgatttcagagaaggcaatggcaccccactccagtactcttgcctggaaaatcccatgaacagaggagcctggtaggctgcagtccatgctaagggtcggacacgactgaacgacttcactttcacttttcactttcatgcattggagaaggaaatggcaacccactccagtgttcttgcctggagaatcccagggacggagagcctggtgggctgccgtttatggggtcgcacagagtcggacacgactgaagtgacttagcagcaaatccgatttagtattttttttccttaaatatttaagtttactagaaaattggattaggcccgctgaaaggcagagggacagattagttaacaccttggcaaaatacctggttctgtgaatcttaaaactttgagattgtatgaacaccagtagaaacaggtaggaaatgtccagggcagtgacagggcctgagatacgctattagtcagttcagttcagttcagtcactcagtcgtgtctgactctttgtgaccccatggactgtagcacatcagctttccttgtacatccccaaattccagagtttactcaaactcatgtccctaagttgctgatgccatccaaccatctcatcttctgtcatccccttctcttcctgctttcaatctttcccagcatcagggtcttttccaaggagtcagttttcttgcatcaggtggccaaagtactggagtttcagtttcagcatcagtccttccaatgaatattcaggactggtctcctttaggatgaactggttggatctccttgcagtccaagggactctcaagagtcttctccaacaccacagttcaaaagcatcagttcttcagcactcag

SEQ ID NO: 54388 - DNA, 2516 bp, Bovine  19866880388641
gattcaggttttacaggggaataggagtttgccaggaaagaacaggatgcacaaaagcatgacattttgagtcatgtgagtacttaaggaaatgtaaattgagattcaaagataagaaggagctaaagtggcccagactcctttcatggagtgcttcaaaatcccatgaaatcagagcactgcaaaatcttatcttggcatgaattacactgtagctttttcactggctctagattaaagccccaaatgaattaaaaaggtatctactctccttctgtgtccactctggcttcagaagcagcagatagtaaatgacatacattatgagagtgggagggaccagaacttctctttcctgaggattacctcccacccccatgactaccttggggtcctgcacacggggatgaagtcattgccagattcctgaaagcaggcactgctgatacatagcaaggaaggaaaaggaccgccgaatacatcagcagatcccacccaccttcctgtgaggcattcctggagaaactgctccccacatgtcctctgatcactgccagtacatctttatgtcctggggaaaaaacattatttatcttatcccactcctgtgatatttatctcatcacattaaaatttgcaccattccaacagctttgtttatggtagcatgcaggataaatattttatttcctgatgggtgcttgggttttctttgccagcattaaaatcagggtactggagataggaatctggatatttaccagtacaaggagatgctacacagatgctaatgaaagctctgagggtagttttcccgggctgttgaatgtaatttctcacatctccaaatggttataatagggaaacaccctgaaaagaattctctaatggctgtgcatatatagcaggggatcgttggaaagttaattagccatgaaaagcagatctttcctcattcattcatacggtggactgtgtcagactgaacactgaccctctgtgcctctctctctctgcccactttgtctccttgcctcaaaccctcacctctgccgagttagctttcctttaaaaaccaagattaaaactcttatcttgctttctcttagcagctccccaaacctctcagactgaggtatctcttcctctctgtgtgtaacagcaccacaggtacacctccagtgtaataatacattttaaattaatgttgtgtctacctcactgcatagttcactggactatgattctttaaaaatggagagcatactttatttttcactgtatttacttcaaacctttgaaatgtgcgctgaatatggcaaagatctcagcatctattaatcaatcttttcattctttctggcacctaatacatgtttggttaatgaacaaatgaatcaacaaggcaggagaccttggttgactctaagaaaatcactttattttttttcctgtattctcaatgagggaattcagtaagtattgtgtttgacctagaaggcattcatgtattcattaaatcatttcacaagaatttaatatgtcgctaatagcaagcaggacacagggacgatgcaagcacctaatctcaaacttcatagaatcctaggaggaaaactgggagaagccaggactaagtaccataaaagaatgttgccaaaacggttgatagaaaattcagagaaaacgtaaagtaagggcaggatcaagacactataattttgctcttaacttcctaggactacccactgacaccaggaaatggttggctacaaaattttgcagactcaagactcagaaatgtgctgctattgatctttcttaattcccaatatgaaatctggcaccaagataattgttttgtatggagtcagcctagtacagtgaaatctcagttgttcagcctagattgaggcaaaggctccagtcagagatctagtcctaactgtaccgggctgagatctccaagcatcatgcctgtgtatacacagtgtaaagtgcgggcaattccttcaggctagatcacactgctttcacccaacatactttaggtgggttcactgttcttgaacgaagttcctctgtctgaaaatgcagatctctgatactgaggatctctgctctagtctccatgaaaagtctgacatactatgccagatccacttcattcctagagaccattcactacatataccacacagtcccttggcacaaacactgaggctgttagctacaaaggaagacagaactgagcgactgacaacgcagtcctaagaacaattaatcgctccacatctggtttccacttagagcagagcatgcagcaacctcgctgtctatcgtctgccccaaccttcaagcagtaacgcaccctaccatttccatactaacaagcaattagcggaacgatatactgcaagctgagcaaatcttgccatgataaaagaacgggtttcatgttatcttttcctttgtatgccaaagattagaaaatacaaattcaagggactgaagta

SEQ ID NO: 54389 - DNA, 1722 bp, Bovine  19866880625976
ttcatatatattaattttataataattgttatgaattttcaaaatcttagaataacttgtgtcttttcttaaccctcatgttcacaattttgccatgatttcttactccttgtttccttgttatttatcacattttgcttatttttctagtagtacttcctggagagacattttttttaactttttattttgtattggatcacagccgattaacaatgttgtggtagttttaggtggacagcaaagggactcaaccatacatatacatgcatttatttgagagacatttttacaactccacatttcttaacactttgttagtgatatgatgtatactcaggatctacctgttgattgatcgccaattttctagctttactgaatttgtatgtagactgtttgaaaagaaatttaacacatcaaatagcttaaaatcaccaaggtgtctgatattattatacaggtttttattaaatactgaagtttccatcccacataagggtatagttctgtggtttagtacatgccaagagaaaatagatggcaagatatccatgaaaacccatgtagaaaaatttagtggctaatactcataacctcaactcttaactcacttgtctgcacacatagaaatgactgtaattctgaccagtctagggtattgatgggctgacactgagtagattctaggatgaaaaattaaatggtgttcccactccagagaagatgctagtgaaaagattgaaattacatggggtagttgcaaatgacattaaatatcatttcctttgtttctgccaagttctgccaattcgtttagcttgatttaaagaacatatgatgaaaatggagaacagtttctaatcacagcgattaattacctaggactaaattcaaagagattttctaattaaaatttcaaagtatcttaaatctaatgtcatgctcaaatgatgaggcaacacaggcattttttagaacagcctacaagacatcaaggaagaacagatattcccaagtatacagaaaagtagattcttgtttaaaatgttctgagtctcaatccattgggagaagccattcttattccagttgtaagtacaaaatcagacatggagctgctgggagtgatctgtgagactcatcaagaaccatgtgttgtgcagaaaacaaatgtaaactgtcaggacatgatgagattcaagaataaccaacggggataagcagtaaataagttgcacttgcatattcattcaacaaatatttactagctgcattttacatgtcatgtactcttctaggtactggcatatatcagtaaattaaatggacatatccctacttttgtggagtttatacaagcagatacagaaatataggaaatgatgtaacaaataagtagttttactatatttttgtatgtgagaaaataagtgatacagataaaaggaaagtaggaagatgagagtactggttatgggatggaagtgaggagggttgcaattttaagtaaagctctcagggtaatcctcattgttgtttagttgctaagttgtgtctgactctttgtgtacagactccatgtactgtagtccaccagcttcctctttaagaaagagtattatttgaaaaagactcagaaaaagtgagtgaatgagtcatgtggctctttggtggaagaactgcctcttccctagtgcaaatccctaagcctagagtatg

SEQ ID NO: 54390 - DNA, 2644 bp, Bovine  19866880657616
aatatatctacttaaaaaggcaaaagacctgcaatccacacactgtaagacactgaagaaatacattaaaggtaatacagacaggaagatacacagtgttcttggattggaaggatcaatattcttaaaacgaccatattacccaaggcaatgtacagattcagtgcaagccccatcagaacactggtggaatttctcctagaactagatcatttttaaaaaatttgtatggaaacacaaaagattcagaatagtcaaaaccatcttgataaagaacagcagagctggaggaataactttaaatggaatttaatttctaagaaatattgaatcattatgttgtacatctgaaactaatattgtaaattagctataccttaatttttaaagaacaaaaaataggataatagaggtaagaatttatcaaaagaagtgtaagatttttacactaaatattacaacactttcctgaggagaagttaaaaatctaaagaagagatattctaaaaaattaaaaataaataaaagtttcgggcaaggtgattcagttacacatatagattattcccctttaggttattagagaatattgtaactttgctgtacacctgaaactaacacaacactgttaatcaactcccacaataatataaagtaaaattaaaatataaataaatgttgcatgaaagcagaaattgttttactcatagattttagaaccttctttggcaaatggctatgaagtaatgagaaggaatctgtttctatttatagtactttttgtataacattttcttaagaaaaaaacatcactttctctacctcactgacacacactgaataaatatttaagaaatatttattttggagaaggggctcatttatcagcttgcttggggctgctgtgtatttttggccagctttctttatataggctgtgttgctgcgacactcaacattttgcctatgttaagtgatactatctttcccaggatgcctattctaagcacaaggtatttttccaattgtgtggctggtgactatcaggatgcctgttagagcaattatttctgtatctgtctggattcttgagctcaaggaacagccactagagaaatggagaccaacctcatgcctgcctgcaatctccatagaatgcagcactctcctttccacattgtggggctaaatgaatacttgacacatgcacagttctctccaaggagtaaacagtgatgagaaattaggtggaaccccaaagtgctttttagacaactttaccgtgcacacccttttatggatgcaaaggcatcagaattgttttttcttcattgagcccatagaatctggagacatttcctgcatttcacagtagtaattctaacttatgaatacaaatgtagatttctggatggtgacagagttatctgaattgtacaaaaacttgaattccaaaagactttttttcccccctgaactatactgaacagggaccttgaaaggattttcacttttctatgagcattaagccaagagaacatcttccatgagttagtttattctgccgattgcttgtgtgtattgctaagaagcaagctgagatgttggtggagtatttcttttagccgtgtttctgttgttctattttacctttctgtttattatacttagcaatgtgattcctactcatggtattcagttcagttcagttgctcagtcatgtggtcccgactctttgcgaccccatggacttcagcacgccagacttccctctccatcaccaattcccagaacttattcaaactcctgtccatcgagtcagtgatgccatccaatgatctcatcctctgtcgtcccctcttctcctgccttcaatctttcccagcatcagcgtcttaaatgagtcaatttttcgcatcaagtggccaaagtattggagcttcagcttcaggccttccagtgaatattcaggactgatttcctttaggatggactggttggatctccttgcagtccaagggactctcaagagccttctctgacatcacagttcaaaagcatcaattcttcggtgctcagctttctttatagtccaactctcacatccatacgtgactactgaaaaaaccacagctttgactagatggaccctatgttggcaaagtaatgtctctgtattttaatatgctgtctaggttggtcatagcttttcttccaattagcaagcaccatggtattacaggatgcaaatcagctttgattgaaaactcttgcagacacatctttacctaaatagtcagttgtaagctccttcctcaagacaggagagaagggaggagaaaaaggaggaatgatttttttggttaacccgaacccatagtaccttcctgcttaacagcaagttaatgattgctgtaggaggagaactggggtggcaggtgtcctatttttagcatcttcaaaatgcacaacataatgacctgctttaccatgtccctaggctttggatgtgcccacctccccgagcacacagggccattccctgcaccatattcctcaaaaactgcacacagagcacaggctggtcttagtatcctattagcagttgttttggccaagccagtttttcttcgcagcctacaca

SEQ ID NO: 54391 - DNA, 1110 bp, Bovine  19866880713269
tcttgacttatttcttccgaatgtgttaataattgtggccacatttattttcctccagatgtgaattaaaaatgccacaagggccaatttcaatgcaaacctggaaatggttcaagctgatttctttccttccctctctccaacttttgaaagattttgccatctttcaagtgtaacatagagtatacccatcaatcagagagctgctgggagtcccagaagcaaactgcaggtggcaagtttcactacacataccttaaatggcatcctcatgccaataaatactcaactatttaaacagcaaccactcccacatgcaaatataacaatatcagtgcgacttaattcgtccctgaagtgtgtgtcacaaaataaccaggcaggactggaatccactctgccatttttatccttaagaaacaaatttttaatcaacattttcagccttgccaacatttctctttctcttggttaatatttaagagagctagtcaatttgtgaggcattggagctgtcgttaaaataagttactctctgggttttcaaaatctctttgatgcagcctacccctaaccactggggctggctctatattaaacatttcttttacaggtatttttcatttcttagaagcagctttgcacttttctgttcacatgagatcagatctccttttgcaggttagctcacagcctgagcctctattgattttgaaagctcataagggaagatattcagagaagcatcttggtggttaaaccaagacacttctttcctggttgtgttgttcaaccagtttcaagagttgcctttcatcgtcattcatctatttacttatattaactcacatgcacatgtcatgtagctcccctaactacacacacacacacacacacacacacaagttgctctaaatattataaagcaatgcatagccacatgaactgaatgctcagccatataatagcaggagtccaggaggagccggattcattttgatatttggcaaaactaatacaattatgtaaagtttaaaaataaaataaaatttaaaaaaaagagcaaaaaataaataaataaaagcagcagtaataagggattaagaagag

SEQ ID NO: 54392 - DNA, 1715 bp, Bovine  19866880760746
gagaaagatatcagaaaatatatcttagtcattttcactaagtaaaataattaacaagtaaataagcagaaaaatatatacacaccccatatatatacatacatacatataagccaaaattgccatgggcagagaaaacaaaatagccctcacattttatagagcacagtgagcaaaacaggtctctttaaagtgtgtgtgtttcctttaccttcatatctttaattccctacaggagataagagatagggaaatgcagtgggagaatgactcccagatttatcatagcaatcacttgatgcttcccaatatggcagccaaaatataagcacagaataatttcaaagactcttaatttgggaaagcatgtatttactcttttaaaaagttctctaaaggtattagatatttttttcttccttctcctccctcaggaactgtcaagaagttctaattagtccacttagttctatcattggacagtgtagacttcgactgaagtatactgaaatatggattggacttttcacagtgaaaattccaataagaagctaatacagttcctgtggatatttttttgacaatgtccctttagaaactcctcgaagaaggctgtttctggacaaaaagacatgatgaatcattccaaactgcaaaaacttcagcttacagagaaatgtgggctaataagcttataattcaatgaaaatagtatttttttatttcaatgacagaaatattagattatgtctccaaaaagttatctaaaatgaatattattatcagtaatatcttagaattttactaacttcacactaaaagagcaaagatttataacaaagctgtcatcttacagaaatacaataaagttaacacacaaatgaacagtttattaaagaaagaataccaaattgtagaaacatttcaaacataaaaagttaattgagagacttacctaagtctcaacactgctcaactctttccgcaacatcaaacaatcttgaccgctgctctgcacaattgcctagaagtccaggctacttgggggtattcacaagtccctttacaatctggctcccatctttccatttggccttgtctccaaaacttgcatgctttaccaggggttctcaaacttcatcgtgggtctgaattacctgcactgtttgtaaaaacacagattccttcttgatggtactctttctgacaggtgtgaggtgatatctcattgtggttttgattccatttcccctgatgattaacaatactgagcatctttttatgtgtctgttgaccatgtggattttccctttgaaaaaatgtctagttaagtcttctgcccatttttatttctttttatgttgtaagagtttgaagtttgtagaggtatacctgccaaatgttttaatgtttacaaaggaaagaatccagggtgttgcttggcagaactaacttcagatgactgatgaaacagcagaacactctaatatgctaaaaatatgaattctcttcagccacttttgtaagtaaaatatctgcatgacagataacactgattggggaaatgtgaagtatgtctgagaacaagcaagctttctaagctttctcctcccctgacttagatcattagcctcacacgtcccccaatctagttgtaggacagcccacatgagaaaatgtgagttctctagagaggttcgaatcactatacttaa

SEQ ID NO: 54393 - DNA, 1017 bp, Bovine  19866880770297
catttgctgaagacactgccttttccccactgtatattcttgtctcctttgtcaaatagtaattgatcttataaccctcaatctgaagacaactcaagtgtcaaaaaaaataaaatagaatggataaattgtgatatgttcatttaataaaaaatgggttgaattgaaaataaatatattaaagcaacaatatacatgaatctcactgtgtcgaacaaaataagtcagatgcaagacaggacatgctgcgtgattccatttatatacaatttcaaaaacagggaaagttaatctatggcattagaaggtcaggattctgattatccagggggaggagtaacagtaactagaaggagaaatgaggggggagcttctggagggctaataatttttgtttcatgatctgtgtatatcatggaagagtgtgtttccttttttgaaaatatatctggctgtaaacttgtgtatctattttgtagaaatatagattttatttgaaaggaatgcatacttggccaaataaaacatccccaagaaatttcttgttaaaaagagttccacaaaaataactcttctgtggttggagcccctgtctgcttcacatagcactgcttacgtttacatactctaagattggtaagcgctgggcacatgaattgattttgagaggacagatgctttatttgcaaacgcttaccctcttgtgctacaattaatgagcctgctcaacaagcagcatgcagaatagcctgagatttacagctgagctgtacacattcacagaaggctggaaaatacgggaatagccaactattgcatggtgatgaagtgacaagacatcctgaagtcattcagtgttcaagaaaaacataaaaataatttgggagtccttggcattggacccacaggaaagatgggctcttccatggcatttgtatgcctataagtaggacttaaagattgaggcatatttccaaatcctccccttaaagagaaatattaaattccttttatgtg

SEQ ID NO: 54394 - DNA, 1428 bp, Bovine  19866880817985
ttaagaaattttctttacaagggcacttgtgtctcccctagcattagattttctatgttggaagcttaatccaatggagaaacattgaggaattccatgaccagtccaatgcttggcaaattgagacctccatcaacaatttttattttactcaatctaaaggcctgtcatggtttttgtctgttttcaagctatataaggaaggattagtatctataaaagaaaaatgggtgtttgtttttttttttttttctttttacaacatgaccttccaagagatgagacattgactaattttgaaggtcttttatcacactgaggcttcaacagaggccagtcctgtcttgctggaaaagatgagagagagaatgttggcataaagtggtctcaaatctagggaaggctccacaccctcatgacattgaacttcaatctcgagtggtatggaccactaagccaccactggtgtaattcacagctactctgcttcacatgctgacaagacagggaagtaatgcgccaaatagaatttctaatcactacttgctctgttttgagatgcctttggtctattatcaaacctttatctccctctgttcctgctagttgtgtgaactacaacctgctgattctaatactaacatgatgttatttgtcattcttcattgcaagtgtttacatagaatatactatccaactttcacggaagaggacttgaagttcgtctcttcctttacttcattaccctgagcctaagctcagtttcaatatcaaacacagaggatgatttgattctaatagaatagagattggtcacggagaagaattagccaggcccctatgtgcaaacatgatttctcaaagcaatatcctgctgacagcttcttcctcctgacagcttctccttgctgttttattaaaatagcattataacttataataggtctagattttttccatcagcacccaatatgttattctaggactttgtagaggaagattatattaggttgtttcatagagttggcattgaatatatagttatttttccccacttgtgcataataggctactttagttcatcggattcttagcacacaaataacttatcagttcactgaacagctctaatgaaaccagtctctataagtttaagtgctacctgaagtctattccattccacttatcctgagttgcctatgcatgtagaacctggtccatattttacattaagttttatttgattaaagagaagctacttgtgttttctgttcccaaacacaaatagcaaagcaaatatactaagaacatccctcacctttaacaggagagaacaatggcagtgatgtctgttcaatgcaaaagagttggtgagacagttgggcagcggaaaaagaagtatgaagcaggaaaaaataaaacccttaa

SEQ ID NO: 54395 - DNA, 1459 bp, Bovine  19866880997772
ttccgtttatcctcacagatcgcaccaggaaggagtcagatggatgaagcacagacagggaattgtctacagaggagcctggaacaatggatctttaatggactcatagccagaaagggtgggggctagaaatggaacattctgagtccaggtggagaaaaatgtctcagctgaggctgctaataaagtgatcttggcagaggtgcctgagaagtacctccactgaagggaaggctgagtttttaaaaggaactccctccaggaaacgtgcatgcaatggctgttcaccaggcttgatgtggcggaggcggcttctcccacaagtcttgccaggcaaatccttgtaattgcctatgatccaagtctgaaagatcacacagaggcctatctgaattcctccgtaaggatagcgttcagtctacacagagtccccagttccctctattcttactttccattatttttgtgctactgttcttatgtagttcagtgcagcctactcaactaaatacacaccatttccttctgattctttagtcctgtctccctatgcagaaaatcccacacattggtaacagagactctgttcacgtcatccaaaaccgatttttaatggacattaaatttcaagtttcttatatgtgttttatacattttatatacacacatttgtatatataacacttatatattagcaagtttgatagattattctctcagagaaattctacacatagacaagtttagtcagtctgtctagtgggaatgttagagaaataaagtttataaacttctaagtctataagactttattattgagttttttttctttaccggttcctcttagaggacaaagtcccagaatcagttgattttgaatgacactgttggaggtttttcagttcaaaagtatgagtatttcctcttaacttctgttcaccccttaggggatttagtcagcccaggaatccgagttagtgtgtgtcttctacagtttaatgcagcctccattggtggtgtgggaaagctcattttccagtcattccataagaaaaaataccatttaaattttgtagaataaatactacatagcagaaatatagtatatcattttatgcaatgaaaacaatcacatctgctactctgtacaagaggaggacccctccccccaatctgctttcatttctgttagtgaatcatcattgcttctgtatcagatttctcatatgtatacaatttgaggaaattatgagatttggagtttttattcatcgtgtaaccttcagctaaacctccatgacctagcaactctcaatttcttcctgtattttaacatgtcaataaaataaaaatggcactcacttgacccccagcttccaccgtgagcccactgtccggtttaattgtcagctgggattgttccacagcattcatcaaaaaggagcaggaagggtacagt

SEQ ID NO: 54396 - DNA, 1102 bp, Bovine  19866881010704
tacaataatctctaggtccatctgtgttgtttcctggccccaagtctattggcactcccaatttcctggcatagtgcagcctttccaaagaataaaggctcagctgcctcaaccgcatcagtgtgtagactttccctgaagatctataaagtcagacttgatagtctcaggcaagtggagagggcttcatgtggatagagacttgtgttgtttccatctacaattacagcttggctttattttttaataacctctcaaaacctatcatcaactgtctaatctttaacagtgcacttcccttctctctccctcattccaactctgctgcaaaggttggaactcactggattaaacaggatgggataaaaacagtgacttgatgatgactatttagaaactgcattgtattcctcttagaaaactggcccagtttcctaacccttggaaacccaggatttcctagaagtatgatgtgaggaaaaggtttttctgatgaagggcaaaatcaagactcagatttgcttattcacttgaggggggtcttaaagaccccattgtcctctacaacacataaaatgttcttttaattgagccccacattcactatcaagaagagtgagtgaaagatgagaaataaaatgcttccattcttttccactggctattacctcggtaatggcactaataaaagtggcattagaaagaactgggagaaaaatcatcgttactcttggacccataagaaacgaagattcaaaaggttattacaggtaatagattcacattttagcatgtgaaatgatggtgggcttagatcacgtgcttttggcttagagatgattttctaaggtaggagtctcagggttggtgaatagaagaggaacctctgggtcaaggagggaaactgggggctttgttccaatcctgggccttggagcagggtcacactataaacaacaattcctcctcaaatgtgttctgaaaagcccagggaaaatcagtttctctgcttgcagaatctcagaggacagggaagaaagatagtgcaagatgaagacaaggtgaactaatgaaatccgtctagcctgagtgaacacgctgt

SEQ ID NO: 54397 - DNA, 1572 bp, Bovine  19866881082375
agctagctcagtttaaaacagctcatagggaaattatgaattcactaaggttttctttgagctctgctgacctctactttctgtggcctttcagttctcttgtccctgttctttctcttgttttcctgggtccttatatgttcttttactttctcttcttcatattaaaatttaattgtaggaaataaggaatgatttcttagtattcaaatgtcatttctttctcaatttaggaaaattttggctacaagtatgagaaacaccttctctaactgccttaaaggttatagaaatgaatttttaaatatactaagtcctgtatcagagcaggattcagctatgtcaattccactgctcagtagcattattagaggtcagtttccttgttctgccagtaacagcattggcttaatcctcaggctggttgcacttatcaaaagatgacttcttataataactcagtctatctgtttcttctttcacatcaatcagccaaatataagaaatgaaaaactgtcttttttttcataattatagagtaaatgatcttcccttcagccctcttggaccaagttaaatgcccagtactagattaaacacggtttttagagtgtcacctctccctgccaatcagccctacctttggaactctgaatgagagtatcttcctctaggcacaaaggctacctagagggctttgtttaggaaagaaaaatggagctgtgatactacctagactattcacacctaatacacatccctttcttcctctaaaaatgacctgtctcatcaaagagccttcatgatccagtgagcaggtaataggattcattgggatgaggatattctctgtaagatgtgcaaacatctgcctaaagtcccactcagaagagaaccaggggcttttgtgtccctcatcatgaatccccattttctgcgggcttgaatggctggaacacagaaagacagtgtgtgtgtgtgtgtgtgtgtgtgtgtgtgtgtgtgtttatatatatcttctgctagccttctagcctgaatcaccctcaattttgtcccttatcaaccagttaagtcaccctgcacctccttccctctccctactctctgagtcccttagaaaagataacaaatgaaagcaagcatgttgatgcatttttaggaaaatgttttacaaaaacaattctgaaaacagtggcatctaaatcctctaaatataagaataaaatctcctccttccctgctattcttttcaaataggactgaggcttggagataggatttgctaataatacagatgtgtggatacccattccatttggtttcctcatagccttgaggacagttatttggttccatcagtttactactgtcagtgactacttttgattctttcttgagctaatttctctctctccctccttccctccctccctccttctttatctccctctctctcattttttttttttttttttgtacagaggaatgtgaaagatggattctttattgacatgcttgttaacacagttctattccccccaaattatatattaataaaaaagggaagat

SEQ ID NO: 54398 - DNA, 2036 bp, Bovine  19866881152820
cagtccttccaatgaatattcaggattggtctcctttaggatgaactggttggatctccttgcagtccaagggactctcaagagtcttctccaacaccacagttcaaaagtatcagttcttcagcactcagttttctttatattccaactctcacatccatacatgattactggaagaactatcgctttgactagacggacctttgttgtcaaagaaatgcctctgctttttaatatgctgtctaggttggtcatagcttttcttccaaggagcaagggttttttttaaatttcatggctgcagtcaccatctgcagggattttggagcccaagaaaatagtctcttactgtttccattgtttccccatctatttgccctgaagtgatggaaaagactctgatgctgggagggattgggggcaagaggagaaggggacgacagaggatgagatggctggatggtatcaccaactctatggacgtgagtttgagtgaactccgggagttggtgatagacagggaggcctggtgtgctgcaattcatggggtcacaaagagttggacatgactgaacaactgaactgactgactgatgagagcagatgccatgatctaagttttctgaatgttgaattttaagccaaatttttgactctcctctttcactttcatcaaaagactctttagttcttgactttctgccataaggttggtgtcctctgcatatctgaggttattgatatttctcccagcaatcttgagtccagcttgtgctttatccagcccagcatttcgcatgatgtactctccatataatttccttattgccaaattcagactcaaattgaagaaagtagggaaaaccagtagaccattcaggtatgacctaaatcaaattccttacaattatacagtagaactgacaaatagattcaaaggattagaactatggaccaaggttcatgacattgtacaggagacagggatcaagatcatccccaaggaaaagaaatgcaaaatgtcaaaatcgttgtctgaggaggccttacaaatagctgagaaaagaaaagacacaaaaagcaaaggagaaaagtaaagatatacacatttgaatgcagagttccaaagaataataaggagagataagaaagccttcttcagtgatcaatgctattaatagcctttgccctattcctgaagaagtatatgtttttcctctttcagtgcagtgcagttcagtcactcagttgtgtccaactcttttgtgacctcatggactgcagcgcaccaggcctccctgtacatcaacaactccccggagtttactcaaactcatgtccattggagtcagtgatgccatccaaccatctcatcctctggcgtccccttctcctcttgcccctaatccctcccagcatcagagtcttttccatcacttcatggcaaatagatggggaaacaatggaaacagtaagagactattttcttgggctccaaaatccctgcagatggtgactgcagccatgaaattaaaaaacccttgctccttagaagggttcaatctttcccagcatcagggtcttttcaaatgagtcagctcttacatcaggtggccaaagtattggagtttcagcttcaacatcagtccttccaatgaatattcaggatatctttttacatcctgagcctctagaaagccacacctatattagatcaacttacaggaaaaatgtaattagtgaatttcatagtatttaatgtagtttgaatgtagcacttgaaaatgtctatgtccatgggaccttgctaaaaacagagccttgtggtctgaaagttatactgcagattggtctagactgaatttgccttcatttgtgactgagacaaattaaatagcaactctatgagacagtcttttgtcctcatggagaattgagatgtcttttatacatgaactgctattttattatcttatgatcttcactttaaattaatggcctagttaattagggtgaattcaagtcacatttctata

SEQ ID NO: 54399 - DNA, 671 bp, Bovine  19866881175442
actgtgtatatgctggcaaaacactctaatgatcttaaactaggtctgtcttgagagtggatggaatttatgaagcccctcactggatgctataaagacatctctccctattatcaggttctacagaattggagagtaccagagggaagcaggtagggccatggggtagggggttcatgaatgattaaataatcaaaggaaataaaataaagatgaactgtcctcaaacccaggaggatcatattataggcataataaaagcgacttgatataaaatccttaggactagtagcatttgggtttgcagataagcaagggaagaaataatgcaattcttttagtaactggctttatctagattttgcatatgggcagtctctcaggaccattctctcttcctgtgtatgtagtcaattcagaatggaactctcttgttcatggtactctgaggctttaaaaaatgactgagatttcagatttcactggtaaatggaatatttccagtttcattttaaggaaatcctaaatgctaggctgattttaaaccataggaagaaggccaaagggaaatttgttgttactaagaagctatgttttcattttatgtttgccatccatgacctgtatctatcttccctgacctcaaagtaacatacctattctatttacag

SEQ ID NO: 54400 - DNA, 1118 bp, Bovine  19866881277229
tcaagtctgttctctcttttattttttaattgacaagagatttcgatgcagcatatacagggtgaggagcttaccttgatgcttctaagatattccatctgtgctttgggggatcactacctagtaaagagcactaattaaaccagtctcactatgctcagagcctgctgctgctgctaagtcgcttcagtcgtgtccgactctgtgcgaccccatagatggcagcccaccaggctcccccatccctgggattctccaggcaagaacactggagtgggttgccatttccttctccaatgcatgaaattgaaaagtgaaagtgaagtcactcagtcctgtccgactcctagcgaccccatggacttcagcctaccaggctcctctgtccatgggatttgccaggcaagagtactggagtaggttgccattgccttctccgatgctcagaacctaggtctacattttagtagaattctaccacacggcacaggaaaagtctggctgacaagcaggataatacagataacattattgtttgtggcaaagggaaaagagaaccagaaggagcctgtgaaaccctggaagcagtccttttgagtttcaaacagtgacatattgttaaacattcaatatatctaaaattgagtaggtttcccaatgtgaactgatgcaggcttctgggaacattttgcccaagccatcttacactgttacttgaaatctgcagtgaaattggatggaagactttgtttcaatccgttccaatattccctgacatgcacctgaatccccatgtaggataaattagccagagagaataggagctgagtgagcaggactggcaggcagtctttttgaatcatgtaccagatccacatttacacttcctatttgttgcttctctcatagaaacggactcatgtgtgaaatgggagaaatgtgagcctatcactaaactacatcagatagcatgacaagagatgccattgatggatgggtagctcacaagcctgcacaggctccattaccaaaccaatgagcatccttttaggcagtgagtctctctaataatttgtgttgatgatgatttggtggcaaattagaatcaattagtgaaa

SEQ ID NO: 54401 - DNA, 2076 bp, Bovine  19866881279156
atctgctagacatcacctctgcctcaactacatcccttctgggcatgacatcacttggctactgtaagtcactgcctccctcattctagtttcccatctctgagcagcaatatacaaccatccactctcagttcatatgcttagatcctggctgaaaggaattgaggagggggaaaatctctcagtttccatttctatattgaggagaaataatgttcactccctcctactgactttccccaaattaggcacatgggaacatccctacccaaagaagaagagttctttatcattctgcaggaaggaaaaaaaaaaaaacacaacaacaacaacaaaaatcaatgcctactacaatgtgtctagtaactgggaatttttatgtagaagttggatgggtaactagacataatactgtgcattgtgttgctgtatcaagagaacagttagaagatagtttcctacaagcccctggtctaatttgaggcatctacgagataagggaatttttgagttatgctggtgtgactgctgagtcgtgagataaagcaacacaccgtgtgtgccctttccctggaagcttcacgttgctttataagggaatccatttctaccccctcgagttcaaagctggtcttaattaaatactgtaggtttggcctattaccgctaggggtcattcttttacatgtgtcattcaagaccatctaagaggaggtactgattctaagacaactttagaggtttgttctttccaaatattttaactacagagacaaattgcatttggtaaatctgtggttccagtgactaggtatagaattgattgcgatggggcttgtgctgccattcaaaaataaataaaggtctggtgaatgacactggcgattcttaacattctgtgtgatttaattttcaacctagaattccttgcactttcagcccttccctctctgctcagtatcaatacatatatggggcatttcaattgagttcagcttgggctaattaaaatcttaaggttttattaaaatgtgagacagtgaagacagagaattaagatattaaaaatgttaaatgaaacatcccgtaaattaagattaaaatgatgattccatacatcaagctctttgagtataagggtacatgtctaggtttctttgttaatacaggatgagacacttgtgccctgcaccctattgttcccatccaggatgggtcctgcatgctgggacatcggatataccccccatgcacgttcactccagggtactgggctttatctcagaccttgaaggactcggtctttggctgctccctttgtgaggatcaataatagtgaacacgcagtctccattttacagtgaaagttacctttctgtccttaatgaacattattgatagtcatcataatcagagaagaggtagagtcagttaagtgcatcacggcatggcaggcacttcacgtggtactctcacacaccctgaactctgccaacgcttgcctacatgctgatattttggtttttgttgcattgcctgtttagattcagtttgcaagtttgattataaaatggatcactgagttcaatcacaaaagaagggagagctgtcctgatgttgccactccagaccacaagtgctcagagtcctgtgtctgaggaataaagcctgatctgaacacgtgggtttgttagggcttccatgctgccctgccactctcatgcctccctttcatctttcccccgaaactctgcattaaccccctacttgtccactcccctcgccttcaacatccttcttcttcatctttcatttgtccttctgctgtcctgtctcctaatcagggcgttggtgggggacgatggcagagcaagaccagacaacagcactggatttgaaagaatacacatgaagacattcttctgagcactttaatgagctctgttttcctggaatggcagagagagagagagaaaaagatagtacacagagttcttgctttttttcttattgctgctatttggataaagatcaaagtctttacctgtgattatccataagacatgcaataaaatg

SEQ ID NO: 54402 - DNA, 1045 bp, Bovine  19866881364288
aaaaagaatcatgtggctagaaaagaatttatggcttatcatagcaataggaaccctactatagtgactccaagcaagaagccatattatatacatgtgttgtataatgtaagaaaactcatgaagtaagggattgtttaggcttgcatcctttacagatataccactttatatttatctaattatctttgtatttcttcgacatcaaattctttcagctccacaccttaaaacaaaaaaataaaacatttaaaaatagaaatcctttttactaaggataaaagtataactttgtatgtggctgttgttgggaaaataaaattagaaacaaaatcccctgctaaccaaaaatcctttccacaaaaacagtaggtaaagaaaacttccattatttaataaacattaagacaagatctaatgtgtatcatagacaattcatgaaagagacttcagatacagaaagatgttttatgctttcatatagtcagtcagatttaatctgttcatacatgttctaaagataaatgataaatagtccttaggtaaatcaactggacagtaccatttaccacacataatttttcataaattcacctaaagacagctttactcaaaatataattggagtgactgtgttagctaattggctttattcaaaggaaaaataaagctctcatatcattatgacagggagtagttttgcaacttgaagtgagatcctcactgaaatttggtttccacttccccacagaaaagaagatagggtgctgtcttccctgattgtgcttcccaattcaggaaatacaaagagatgcagtttagattcctgggtgggaaagatcccctgtttgtagaaaatgacaacctactccagtatttcttgcctggaaaatcccatggacagaggggcctgatggactgcagtccatgggttgcaaagagtcagacaggactgagccactgggcacacacagcacttcttgattattgcatctcaaaagagatggcttataggttcttgaggaaacacccctaaactttgaga

SEQ ID NO: 54403 - DNA, 1473 bp, Bovine  19866881423403
atcacccaatgtagtaaagttaaattataaggccagcattcagagatattttcctatttgcagagcccacaaactttgaaacagacctaacctactagaatcccctttcttctttgatggcctcttataagttgtggactgttcacagagaggcatataagcgtgtacatgtacaagaaagtttaaagcacagttaaaacttttattggtggacatgaagaatcagtgaatcaaagagacatgaatctgcatgttccatccatgtaatatggaaacatatatggattatctttcatttcactcatcattagaatagttgcaaatacctagcactgggaaccatatacagtgcaattctctcagttagatttttgcttttgcgtctgttcttcaaaaggagaccccgggggctcttgaaatgtttacacctgcagcttgaagaaagtgcctcagcctggataagttcctctgagagattatgctcacccatctgttttcataaaaatttaatgccaggcagcaaactcatagattgttttgttttaatttaatttttatttaatctgttagaaatcagacttctgcaatctggtggcaggtgtgtagtaacaaacacagaatgtgttctacccgcacttccgcaaagaaccatttgtgattgcactgactccatacacggcagtaattgggactcttactaggatgtagtcatgattcccggagcttcacctctattctataaggaatctagaggcgaaatatgctctacttaaagagtacagttctcatcacttaacccagcccaaataccagcatttctgccacctctgactttctaaaatctagagcctgggaagatatgccctcctatcaccacttcactgacccccagccaatagcgggaagcatatgtcttcttgtccttgcagttaaaaaccctcccggtgagtctcaaggctttgtccagtgtcagcagcctcaggcattattttaataatcctcaatgagtataaaaggagatatttttactcagtttttattttatggagttctacttttcaggggaagttccctcaatgtccaaatctcagactattttccttccactcagccacaacacatggtgatatgggcaatctgtcttttaattttttttaatttttattttttttaatctgtggatcaagaagagtagggtagctataacttccaggcctggcattgacccttagtaaatagcaaatagtcatctttctatctgaaagaattttgtctccttccaattaactccccttaagggaaaagtggagggatgaagttgatgagacccgttgtatacggttgggatgaagctttctcttgaaagtgatgatccactgcaatgaatatttattaactatccattatcattactatttattttaagctggatatagggatattattggctcaaatatgatatcagaattaaca

SEQ ID NO: 54404 - DNA, 750 bp, Bovine  19866881572105
tggcagaagctctattctaagtacagtagggcaagaaaactggaacccaacactcctgcctagcttgcttatagtatagaagttccatgtcaaataggaaaagtccagaaggtcaggggcagcttccctgtccacagtcccacttgctgagcaggatgtcactctatgaaagtggaccatcttctccaccctcaaccccaatgcaatggcacagaagctcaacaaaagaggaaacaaaaaacagagttcccagcactgcctaattaagattaacttactttggaagaaattgtgggaaagttcatgtctaagagcattattgaacacaatgaagatcatcaaatgaacaattaagaagagactggcagctctctgacactaataactgaaagtaaaactgttaacaaaagagaagtttaacagaaagagccaggaaaagaatcaactaaggagagctttcagggagtcagagcagccccaaagactggcaagcctttgcccaggtagaggagccttactttattggatcagtctgtggaacagtttatgccataagatattgctgccaacaacactgtcattagctaacactggagactaacaattgggtgtggtattcatagaggtagactattctaagtgttcagagagactgtgcacacccaaggatgcattctgtgagaagaaacataaaatacttcacatactgggaaaagtcaaattcactaaactagggcttccttagtggct

SEQ ID NO: 54405 - DNA, 1004 bp, Bovine  19866881945065
tccaatttggaaaatgaatcacgctttccagttactcaagcttttcattttgcttcaagtgtcttcctatctgcttaccaaattcgatctccttcaagtcccaccttgagtgataaatcctacatgaattatcctcagaaacccactaaatcatgacttctacctcctttgaatctcacaagccttcatttctaagtatgacatcctgacagacatcttcagtcctgcataatagttatttgtgttcttgtcttcacatgatcaccatatctatctcaccgtgtcctttcttgaaggaaaagatgtggattacagtcgtctttgccgaccagaaagcagttggcaacgtaccttgttgacgccagtttttagcactgtacaattttgtttgcttgtttttgctcttggtcatggtgcaatgtgtactgtgctgacactaaggatatattacaggatctaacactatatcctccacagagcccacagtccagagagagcttgtcatgtgtacacagaaaaaaaaataaggtgaaaaaatgaactgaggacactggtggaattgctcagtgagagttcattatggaagtagcaagattctatcatccaaattgaaataatgtggcataggccctgaaccttatctcacaggtccagtcagtggattacaatgattttctaggaagtcacatgtgaaggtatacatttgacaaaggggatgagggccaccttataagttcagggctgggtgggtccagtgacaatactttccagcatccataggctggaaaaagggtcaatggaatcccctttcacaagagagtagtaactgattttctttatgtttataaagtacatacttcttgtagaaagtttggacagcagagaaatgtatcaacacagaattttaaatcattgtaattgtattatttgatattatactacgtgatgttatctgaatcctgtcttttcagctaatgatatgttggcaagatttctccatgtca

SEQ ID NO: 54406 - DNA, 2342 bp, Bovine  19866880508883
tcccctggagaaggaaatggcaaccccctccagtatccttgcctggaaaatctcatggacagaggagcctggtgggctgcagtccatgagtcacaatgagtcaggcatgactgagcgactaacacttatttacttacacttaactctgattaaaacatgaatttctacatcccaagtctgtaagactgaagtaaaaagcattgccatctgctgatttgaagggttcttaaagttcacccacccttcttaaaagaaagatgttaaaatcatgaagcagcatataggagactgacttccagaatgaggagttccactgacccacttcccaatgcaactggtcaatactatataataaactcccaaccactggaagcctctagaaacggtcttcaaaacaaaaataaaaaagaattgaagtatgaaaattcagtaagagaggcaggagtctgtgggaaataactcgttcctttccccctctccactcagcaaggcagagactccacactggactgctgcagtcagaacacagggctccctccctccccagctccggcacagaggactcgttctgggaagggctgggtggacctgtatatttcacttccggcccccagatccccagtgctgaggctcaggcacaggaaagtggatcagaagctctaccctgggcctggctcccttagaataaatactgggaccttgaaaactcttttcctagtcctcaaggcatggtggttccaaacaggaaaggcattctgagaaggccttaggctacttcactaaaagaatccagccagttactaaacaaataaacaaacaacaataacaagccttcatcatcagtgaaagggtggcggaccagagctgctataatatataatctaatatattcagcttctaacaaagtatttcaaggcatgtgaaggagcaggcaagtacggcagtacgacccatgtatacatcatgaaaaaagccatgaaactacctgtgagagtgaccaaacgttggatttatgggaaacgattccaaagtagccattatacattcacagaactaaaattttacgttatacattcacagaaccatacattcacagaactaaaagtttttaaaaagttactagaagggctcaagagaagatctgaactggcataagacagaactagtgaacttgaagatacagtgattgatagtatgtaagctgacatcagagagaaaagggaatgaaggggaaaaaaccataacctcagagaaatgtaggacatcgtgaaatccataaatcacatgaaatgggagtaccaggagaggaaaggagggggaaaagtctttaaagaaatagtagctaaaaactttccaaggttattgaaaaacaataacctacatacccaagaatctcaaactctaagtaggattaatctaataagacctaaaacacacaccataaaaaaatgctaaaagtcaaagacaaggagaaaatatggaaggtatcattaaattaaataaacagaaaggccattagattgaggtggctttagtgccttaggagactatataatcaaactaaaccctaagccaataagtctctcaacattaagagattaaaacccaagcacaactaatcacacagagccaactaggactttccaagtaaagcaaattcttatgctatagccaatcaagtaattccttgtttgctctgcctcttccatggaagtctttcctctagagggctcctcaccacttccagtttggtgctgccaaattcaagtcaatttttgctcaaatagactcttaaaatttttaatatgcctcggtttaccttttaatagtagcaaaagaaagacaatgtgtcacttataatggaagcccaatatgataaaaggctaatttagcagaaaccatggagaacaggaaggccatggaataacataatcacagtccttaaagaaaaagctgtggaccaagacccgttattcaataaagctgttattcagagacaaaggtgaaacagcatcctagataagcaaaaactgaaagaattcactgttaacagatccactttagaataaataaaggaaattctttaggttaaaagaaagtgacctcagatggtaatttaaattgatatctacaaagagtactagtaatataactgtgtaattataaaagacaatataaatgcctaattttgttttttctcttagctgatggaaaaagtaatggtataaaataatatgcataaaacatattattgggcctataacatacagaaatgtaatacatgcatattatatgtgctattaatagcacaaaggagatctgtaagagcaaaggtgttacag

SEQ ID NO: 54407 - DNA, 1601 bp, Bovine  19866880844985
ttggattttactttcagcaccagacacatcccccaaatgagtgtcatttccactttggccagctgcttcattctttctggaatattagtagatgtcctcctctcttccccagtagcacactggccaccttctgacctggagggctcatcttctggtgtaataccttttttcctttttatacagttcatggggatctcacagctagtttactgtaatggtttaccattccctcctccagtggatcacactttgtcagaactctgtactgtgacccatccatcttgggtggccctacacagcatggctcatagcttcattgagttatgcaagcccctttgccactaggcagtaatccatgagggggatcatcatgcaaaatgctgggatgagtgaatcacaagctagaatcaagattgctgggataattatcaacaacctctgatttgtagataatacttctctaatggcagaaagtgaagaggaactaaagggcctcttgatgagggtgaaagaggagagtgaaaatgctggcttaaaactcaacattcaagaaactaagatcaaggcatctgttcccattacttcatggcaagcagaaggggaaagagtagaaggagtgacagacttcattttcttgggctccaaaatcactgtggatggtgactgcagccttgatattaaaagacactagctccttggaaggaaaactaagacaagcctagacaccatattaaaaagtagagacatcactttgctgacaaagttatgtattcaaattgtggtgttggagaacactcttgagagtcacttgaactgctagaagatgtagtcagttaatcctaaaggaactcaacctcgaatatttattggaagggttgatgctgaagctgaagctccaattttttgcccaccttatgtgaagagctgactcttcagaaaagactctgatgctgggaaagattagggcaaaaagagaagggggtggcaaaggatgagatggttagatagcatcaccaactcaatggacatgagtttgagcaaactaggagacagtgaaggacaggaaaccctgctgtgcagaaatccatgggggtcacaaagagtcagacacaacttagtgactgaacaacaagaaagctatctctcctctggcccagtcctatagctgctgctgcttcacaatctgtgctgaataagccttgagcccagcctcctcctttcaggtgtctctcatgttgtatgtatattgcattttcatatgatcaaaagtgaccttaacacctttcctccttgtgtggaatttaatttcttaactgcagttttatacagtgcaaaatgaagatgttgtgtctctgatcttgcaagaaaaaaccagttcctcacctgtgtgggtagtgtgggattgattgatatgttaatgtaggaggatgcagtcctgaaaggatgtcaggtacttctaaatatacactgtgtgcggcccagttctgcctgctgcaggctttgatgtcgaataaaatgggataagggtaggagagtgacgccatatcacagatcttcttccttctaacagaagggcaaaggtcagcaaaatcctagtcagc

SEQ ID NO: 54408 - DNA, 802 bp, Bovine  19866880946592
tgaagatattcagaaccttttttccaagtgcaagataaagcagcagctaccagtgcagattccagcaatggaatgatttgctggctgtgtgatcaaggtgcatctcgttactgatcttaatctgttttttacctggaatatctggatgctgatggcacctatgctctggggttgtgggaacaattagacaggacaagatgcagtctattacagcaaagagcctggtgtattagtgcccagtaaagattaactatgatagtgttactacctgtgggtatgacacagtgaagttttccacactgaatctaagtgacttgctgctctaccataccagagatgccatggttcctccaaggggtgtctctgtttaaggcccaaaggtcaatgtaaaaataaaagacaggacacagagtctgacctccttgtttagcattctgaagcaaccaaaagctcccctccaacccaagcatatttgcatcagcattcttaaattgcatgctgttttctgaggatcatcatgattcaaattttaataatcttgttgaaaaacaaatcaagaaatgaaaagaaaaatgagctggagatattgcatttctctggaaggctaccactaattaagacattgaaagcaattttaacaccatttctcaccaccgtgacaaatctgacagatttacaaattagcattctgggactctcgcactgaatgtccatgttttgtcagattctgtgatggatcacaaatgggcttggtaattgccccaagttatacaatacctgcaaaaagtaagcacattctcag

SEQ ID NO: 54409 - DNA, 1895 bp, Bovine  19866881279230
tatctttgtctagttgtttctcacagagaagtttggaggcaaaagtcctgggtttgggaatctattcaacctgcctcttattaacctcgtggtctcaggtaaatcactcaagctcacggtacctcaattttctcccttgtggggaggaacactaacacatgttttgtcaacattacaaagtgttggcaaggctcaaatctgctaattcaggtgcaatctgttaataaattattaaataaaacatcatagtaatttatcattgttctcccttaacagccatttgcaacatcattgtcttgttctctagtttcctaggatggaaaggaaagattgacaatttgagttctgagtcctgggttgctatctgatctggtattaatgaaaatactactatgtcattataaaagtagagtggggacaatttgaggtgcttccatgaatgaatcttttagtataaatgaagaaggagaaaataaatgaaagtgagacatttccaaacatgttttttcaaaggaagaaatcataaagcctggttgacagctgttgatcttcttatcagaccagtagatcttctctgctaaatcccattatgaatgttatgaatttagcccaaatagagacataccggtgacggctcagcacaaaaattgttctttcactctctgtgactctctgtcactgaggcagtaaggagtattatatcacctgcagtggtcctgcactgcttggtaagtataaacttaaggcgagtccgacaactgcgtacatcattccacaaagagcaggctgtctcggcagtaatctgggaaagcagcttgtgtggctctgctgtgtcctgcagggaaaccagtggctgcttcagggagcttggacaatgaatcatgattttctctggcacctattttactgtcctttggaacaggctctcagtcaccctgcaccatcatttatagagtcctttacagctcattagatagctctgagagcaaatcctatgcaatgctgccttatgacccaggtgccttctaacttgggatgcaatgaagggcaaagataaataggctataggaaggcccagcttctgccatacaaagaactatggtgtgggggtgggtaagaggggctagggggacgttaggcccaagtcccacaggcaaggctttgggtagaaccaaagtagtctacaagtgaagtgtggtcagcacaagaaatgacacccaggatccctgagaacagctcttctctttatccatcaccctttgtcctcctctttaggcatctcattctaccatcctgacagcttctcaggtgcctaccatgtgctcagcctcacactcagaggatctgaaggcactgctcagtccattcaatgttcatgagttattttcataaagttagttgtcagttaggagataaccagctttatgtactgtttctccaccttatacacctatactacagacatcttattgcacatatgacaagatgaactgacttctgtggattgtgcagattttggcctccccccaatcctctgtgaaaatattgaaattgttagtctaattttccctgcctatttccctccactacctctgcctttcaaaggactcttgttctttagcacctgttgtgtgactttgatcccccaggcttataggatggagaggttcaccaagagtgttcagacaggaagttaacactgctgaaaaggtccatgctcccagcacagagacaggaaatggaagaacacccagaaagcaaggcgccctggctgtggacaccaaggagatgacttttacattttatgtgggagtgagtttggtgagtggaatggcactggagacagtaaggtataacaaatgaagaatttttaaaaggaaggaaacaggaaaata

SEQ ID NO: 54410 - DNA, 1247 bp, Bovine  19866881414396
acacttggaccagattcatatgtagctccataaataatggcaccagattttctgtaggacacctttcatcatcaaaagcggcttccaggccatttccataggatccaactgctttttgcaggtttccatttgtctttgctttcttctactgcatgcccatcttcccttacctactacctgctgaagccctgctgaccacacataaaacatcagatgcagaataaatagccacacataagctgctaacttgctttcacaaaggcataggatcaagtccctgtaatcaatcccttactcttcatcactcctagtgtttctactccttatattgaactctgactgatattgtcaccatgcacccctgcagagaatcagatgggcaccaataatgaaagtcattcatagttactataaagattttaaaatataaaatgcaaataatgacctaatctaatgtctagcatatagtaggtcctcaatgatggtagctatcactgtgtcattagggaactggactatttccttagtgccaggagctatttccacatggatagaaatacatcatagtttttggaacctgaatatgagatcaaagactctgcactacagttcccatgatgaggagtttaattatgaacaatgagaaggataatgcatctggattgtttgcagatagctaatgacctgacattctaaatatagctgcagtttcccaactgaaagtcaatctgctctgtggtagcagacagaaagccccactgctgggcaacattggtgagaacagctagaacaaacattttcctcctctccactaaatgataaatcacagctgtcaatgaataaaacattcagtctcagcaatcaagcaatggatttttaaggagccctcccatttatcaggttggctattgattgcttgtgaaaagtcattgcatcagagggataatgaatgggagagtagagctccaccacacaagatgaactggttgataagcttgccttcaagaacttgataatatttaaatgtgtcccctttatttaaagaatttatcataaatataaccacatgccattggatttacaatagttaataacaggtgtgtaaagcaagaaacaaatgctgattaaaggaatccaagccagtcgcccaaaaagcaccccttacccagagccctaggcctctgatggaaacatgataccgctttcatatcaataatgtggtccagtccagcagttgggattgcaca

SEQ ID NO: 54411 - DNA, 1677 bp, Bovine  19866881514256
tgagaaaagttaaatgactggcttacagtcaacaactgagacaagattttaaacgcttttatcagattgcagtgctagagtcaaataagcttccaaggatgcagggggaaatgcatatttgatccacgttcaagtacaattcttaaatctttattcaaaggatgtctccaggaggtaccttggtaaatccacctggttttacattgtttctctgacagaatataatgatgggagggaaggttgtgtgttgctgtttttaaattatttccctttaccttccctttaccttttaaattatttcctttacctttcaataatgaaactcttttctaatggggaaaaaattgaaacacatccatattctatcaagctggacagcattacctcagaatacaaattgttctgttacttttcagtaatttttaaagatctctttcttattataaaattaatacaagcatcaaaatggaagtaatatatattactttagaggaagtttgaaaatgcagaaaagtataaaaaggaaaaacataaattccacaaaattcctttatttaaaaaaaacaacaaccactattactgttctggtgcattttcttgcttttctccagttttctgtatatcagatgtacacatgagcatgattacagggccctccaggcactgggggaataagccagtgacaggagaggaagagggagcagggtgagacatgttcctaccctggaagaaattgatggccaagctaatggccccaaaggaatggacttaaatgatattaggagagacacagtcagcaaagttacaattcaaaagcaaggggaaaaacaaactcagaagaaaagataaaatgtcctagtccatcatcagctccaatgtgggggctctcaggcgcacgggtgcaggttctaaggcagtctgctctgagctgagttttttggcatcaactatgccaggaggggtttagggtggtgactggcaggaaggactgcagaggagaggactggtgtgagcagccctgtggacaccctgtcatctaattctgcagcctccagaggggaacactgagctgttgagactcacccaggtcaccagctggcctgccagtgccagcactctgagaaccagcactgtgagccctggagttcgtgctttttctgattctgggctcagaccctttggtgcttagcagctgacttactaatccaagaaatctctgaggcactgaacccaggacagcccatcaactggacccagacctggccagggatggacagagtccactctccagggacatggggaacccagttccacctcaggggacccttttttggacccacacaaggaaggctaagtattctcataatggcaggcatggacgtgctaaattgcttcagtgatgtccaactctttgcaacgctatggactgtagcttgccaggctcctctgtccttgggattctccaggcaagaatactggagtggatcgccatgcccttctgcaggggatcttcccaacccagggactgaacccgtgtctgttctggctcctgcattggcaggcaggttcttgacctctagcgccaactgggaagccctaggcatggacacagtgcacaaaattgtagcttgatttctctgcttgacaagacaaatatgagaacaaagcagcccaggc

SEQ ID NO: 54412 - DNA, 1417 bp, Bovine  19866881561052
aactcgattctggaaagcaggtttaagtgactctatcactaagcctcgatttccccttcttgacatgaaagacttgcattctttccgcgctgaccgcttgtgcatctgtgatgcccgtgaaaaagaaaaggcaacccttttcttgacccctgctgccgaagcgcccacggtccccgccgcagttctgctcccagtgccccgccccccgccccagttcggcccttcgatctctttctgactgtccactgtctcagtttctctctccggctttcattctctgtctctccatctctcttcctgtttcactccctcgttctccccgcccagcccccggcctgcgggtggacgcacgtgagtcctagattgccgactcagacttttctaactgccccctccccgggattcaatttctccaaactcatcctgccctcatccgggttcatgagcttcgtgtctctttgagcctctgactaggtggaaaggttgaaggtctgcaggacctagctgtcacctgtcgggaccagctaaggactggggatccctggtgggaccaagaaggatccgtttttctgcgaagggaggggcctacctcctcactgaatccctgaatacctcatcctttggggaagctcaaggagggcaggcttctcacttaaggagagggagggaatatggttaatacccaggctgcaaggagtggggtccatatggaccagacttgtgattctgggaggtctggaaagtacatggtggacaaggaacatgtgaataacatacatgtggaaaaaccctgtgtcactcacagacacaccagtggcatgacatctcccctccttcaccccacgctcacccttggggattaaggagcccacccccaataccagctgtacaagtgcattaagtgtgcatacacacacataccatgctcttgcactcacacacacatccgactagctagaagagcaggacggaggagctgggctgaatgaggggaggggaggggagggacaggaaggcagggtagccccacccccgccccatgccccatgcccaccgtccgcctcctgcctcccggtaactggcgaggtctctgcccccttgacttttcccagcttcgaggaaatacctccctttaggggaaagcgagatcgtgaggggaagcaggggaagcactgactcgggcagaggcatgagcctgattttccagtctggggcggggcggagcgaggtggcacaggggacgcccgggtgatggggcctgactcagagccagaaccacagatctcgtccgctatattgtcgtcggggaacaagaagccaccaggtttataagaaactgcgattcatctctgcccccttccacccctctgcaagggatcacagtagactcgaggaagaacttcaggtaggggaggaa

SEQ ID NO: 54413 - DNA, 1005 bp, Bovine  19866880445549
gagaactaggatataaaagtctcaaaaaggtcttcccaagggcacccaagctgcctggggccaaacccaggtctcttgagtttaaagttcattactttatgcttataatttttataaatatttgagtgcttcccaggtgatgcagtggtaaagaattagcctgcccatgcaagagactcaggagacccggattcaatctcgaggtcaggagcatcccctggagagggaagtcacaactcactccagtattcttgcctggaaaatccttggacagaggagtctggtaggctacaattcatggggtcacaagagttggacatgacttaacgactaaacaacaacaaaaatcattgactacagagccaaatatagcagatgtgtaaagtctcgatccttttacatatatataaatatgtaaatgaaatttaggcaaacaagaatagtaggaacggttttagaaggctggactttaggtcctaaaaaaatgcaaagcacgatagatgaagaattctggtatgagtggatttctaacaaggctctctgatatgtatcatacggtttgtcacacatatttttcctctgatcagttcatttccacatctattgttcatatctgtcaggtttgccacaaataacttcctcctgcagtttttcataatcagtcttctacatgttccagtgaataaagtgctctgagccaggtgatagatgattgtctggactggcaagcttgcaagattagtacttggagttaggaaagctgtaattgtggttcttgttcctgtgtgtgaccagtcagctttgctctaagaaaaaaatgcttccttgctcataaattgcatttgtcacaaggcaagtattcttgtatgggaaatcccatggacagaggagcctggtgggctatatagtccatggggtcacaaaagagtcagacacgacttagcagctaaacaacagcaacaacaaagtctttctgaagatgttcagtgtggccatgcagcacca

SEQ ID NO: 54414 - DNA, 1267 bp, Bovine  19866880496380
actctctttatggttaaaaattcttgagtatataattttatctgtattaagacatttcattttcggcaggagactcataaaagcagaatacatttcggttctagagtagagtagtagtttctggtatcagccatcagtgtgcagagaaaaatgccatctgaattacgcttttcactttatagattcagattggcaagtttatttctcaagttgtttatttctatgtactctcctaataatcagagtaagatgccaccatataagaaacagtatttgggttatagccagcttataaaaaccctagctttataccatagaagtggctatctaagagaaaaatcagtgtcttttatacagttttatccattttaaaataaaaatagaattctttactgtgacagctaggaatgtttagtacttctaaacttaaaaaaaaaaaagtgatacctaggcataaaaacaagcactggcatgcagttggtaccagtttcaccaagttctaacttgcccagtgtgtgctttagatttttgctcatccgtttacccttagttcagtacggaagttgcacctcaaattaaaattcctttccccaaatcttccttcatagttttatctgtcactttcgtaattaaaaaaatatcttcgtactatagattaaaaattgctttttgttgatgtatgatttgtatttatttgattacgagggaagtagaaatcactttatgtgctttttggctatttctttgtacttcttttgtggaatatcctttgccaattttaatactggtgtgtctgtattttctagtttaggagtgaaattagagtgggcagagagcttttattggcaatatactttttctttacatggtgaatggaaccacttttcttttacaaaattcaaatctatatgtccaattaaaatttttttatgaacgttagtagtgtatcaaattttgccaaaattaatttcctctaaaatatgcaatgaaataaatgaaccaattgcttcaaaacttaatgcattctgataagacagagatcacctattttttttagtttgtcttaaattgtattttagaaatatagtaattatttacctcttatatgctttaagtgtgttttctttcttgagcaggaatttgaagtaatttatacaacatgtgttagctgaagtttttttgtgtgagagatgggttgagtcctttttgacatttatttttatgaattatatatctattatacacacggacatattttatcacttta

SEQ ID NO: 54415 - DNA, 1329 bp, Bovine  19866880583545
cacatgtgctcaagctcctgtaagcagttctctgtgcactgatctcagagagtcagaaagccataatggatgtactctgcctgtatctcatcataataatgagacaatgccccccctccaaacttgcaggaggaagagaaggaggaggggagacaagccctcctttgtccccagagcacagcccgcaagctgtgggagatgagtgtccatccaaggtcctagtccaggtcaggtccttcatgctccctgtggagagcatggagggggtctgctcccagatcatcacagaaagctctgaagttagagaagcacagttgccaagctgtcacaataatgaactccaagtggtttccgttgcaagtggtgctccccagaaagaggaagtacagggcaataagggcacatcacccaaacacattcactgcaaagaggaacatatagtaaaatctggcgcacaagtcatgccgcctgaatcagaagcaactctgcctgtccaggctcaaagtgaggacaacgaaaaacccctgaaggctgaatccaccgccaccagcctccctgacaacagaagtcatttagaaaccccccaaagacccagtcagagtgctgtgaatggccagggcagtcctgccagtcttttgaacatctctgctggtagtgatgatagtgtattcgattcttcttctgacatggaaaaattcactgagattataaaaaagatggacagcactgtgtgtatgccccagaagaaaaagaagaccaggctaccaaactcccctgcccctcactttgccatgccacctattcacgaggacaatttagaaaaggtgtttgatcccaacgtgtttacctttggtttggggaagaaaaaggaaggccagttggaaatgtcaccagctttacatttgatgcagaatcttgacaccaaatccaaactgaggcccaaacgatcatccactgaacagagtgtcctcttcaagtccttgcagactcatactaatgggaaagatgagcccctggcagctccagaagtcaatgacaaagagaacaaggatgtccaaaatggtggagtcaagagatcgaggctagaaaaaagcgcacttttctcaagcttgttatcttctctaccacaagacaaaatcttttctccctctgtaacatcagtcaataccatgaccacatctttcggtactgctcatagcagttctctttctcgaccttccgtgttgcagcctgtggctgagagtgccccaccctgtagtacagagaaagaacaaccaagtctgccagccagtaacttaaagggtcttcaatttcaactcgtcagatacg

SEQ ID NO: 54416 - DNA, 1602 bp, Bovine  19866880669314
gaatttatcctaaggaaagaattatcaatatatacacaatagaccatttatccagcaatgtaatcagaatgatgtttgtaaaaatgaaatctgaaaatatcctatctatcctttgtgggctttataaaataaagaatatggttctattttggtagagcacctatgatcatgggagcagaacacacaaactattgagagtgttacagctgtgtcaaggctaccttttatagttttgttttgttttctctctcttgttttttttaacaattttattaaacatgttctatgttactgtttgtaacaagaacaacaaagtatgttgtatgttgtttttaaaaaagataaaagtagttttctctgactcaaaggagctatcagacctcatctctgatcttttcttgttatctgagctcttgcctggaaactcccatggacggaggagcctggtaggctgcagtccatggggtcgctaagagtcggacacgactgagcggcttcactttcacgcattggagaaggaaatggcaacccactccagtgttcttgcctggagaatcccagggacgggggagcctggtgggctgccgtgtatggggtcgcatagagtcggacacgactgaagtgacttagcagcagcaggagcagcagagctttatcttatctgaatttgcccctttattctgttccccttcccctgtctcaggtagtcaaaaaatcttagattcttaattctccacgcctaacactttgtagagccctaactagtgtatctttcaaacatgaatttctttcatttcctactctctgcattcattgtagtcactgcctgagtttagattctcatgatttctccttttcttcagtgatcttcctccctttgtgtcctcaaccatctgctgattaaatggctaaaacacaaatctgttctcattactactgcttaaaatatttcactgaatccccactacctaatcagctgttggcaaaccttgtcggtaaagggccagatagtaatattttaggcttttcaggttactgtcaactacttgaaagcatctaaagacaataggtaaatgaacaagtgtgtctctgtgccaataaaactttattagaaaaataaataggtggtgggccagatgtagccaccaaccacagtttactgaccccagctcaaaagaataaagtccaatcttgattgtatttactttttcatatcacattctagtctctagtccccagtgtctccactttagactcttaggtcctcattcatttacattgacttacacttctatgcaatggaaaataaaagcaaaaaaacagtattatttcctcttcttgaaagaactcttctttcctgaccccttgacagaggcttatttttctttcaatactaagatttgacggcgacttagctgagaaaaatttccctgatcacttacattcttcttgaccattttaccgtataaactttagttattgtgcttatcacacagtccattcagaaggagatcagccctgggatttcttggaaggaatgatgctaaagctgaaactccagtactttggctacctcatgcaaagagtgactcatggaaaaga

SEQ ID NO: 54417 - DNA, 841 bp, Bovine  19866880731188
cctctaccccacaagtcaaactatctgcagacattaccacatgttccctggttgagaggaagaggataaaattgcccccagttgagagcactgctgtagagagatactgtaaaatcttttaaattttcaattaagataatagacgtgcctatatttaaggatttagagcgaaacagacctagttgggaatcctggatcctctgcttgcctactgtgtaacattaggaaagttacttaacttcttagtctcaatacttttcattaataacatgaaggatgataatacctacatcataggactgttaaaagtgttcagtgagagaacctttggaaagcatctagcagaatgcctgatacataatgaacatttaataaatatagattctccaaccagatctccagtctttaatattattgtatccagttcacaatatctagtattgtgcttgtcatgccataaatgctcttaaattagttcagtctttttagctacctactaacaatttaatcattttctaatatattgccagaagttctggggtacacatttttttaaaaccatctatttggatgttctgatctctgttttgactttttccaattaggagtatcttacgccagaattgtcaagtgaagtacaatctctttggtccaaagctgctaatctctttgagtctgagggggccaaagtaactgaagtctccctgccccataccagctactcaattgtgtgctaccacgtattgtgcacgtcggaagtggcatcgaatatggccagatttgatgggctagaatatggtaaagtgcctgtgttttggacttgaggaagttttctcaaaca

SEQ ID NO: 54418 - DNA, 2828 bp, Bovine  19866880791558
aagcatcactttggcttctgcagatgacagcttccccggcacaccgttctggtgactatttggcatcaccttcttttcaggcagctccatttccttggcttttttggctaaattcagctttgccctctcgacaaatgttttattagacgcaggagtgttcttcaaacctcgaatgtcagtgtgtcttgggctgctgtttgcccgcttgttttcaaataaggagattttggtggcagtgtttcctttgtgaactggctggctaaatggattatgctcacttcccaaactgtcaagattcttagagtttttaagatttagttccacgtgtttgggcctggcagggctgcaagaataaaacagtatcaagataaatttattgacctaggttttaaagcaaacacagcaatttactacaaaactgaaaagccaacatctgataggtaacattttatgaaattatttttaaaccatcctatatatactgtcaattatctttaatggatgtttcgctttcttatgagggatgagaaaattatacagctaagaaactctagaggtgagaggttaacaagtttatcataagcacagtgcttggcactagagttggcccaaagaacattagaacaaatttgaatacttcgtgcactcccatactttaaatatgtatgattttccccagaaccaactgtactacttatcataactttttaattttcattatctcaaagagctggattataaaaaatatttattatttacctcttcgaacagtttattcccttcatccttcctccataaaatttttctgattacataaagtgtgttcactagagaccatttggaaaatataaagacaaaaaatcattcataatcctaaccactcaaacaatatccctgtcaacattctagtacacttcctgtcttttttgtatgcatagggaaatattttcaacaaaattgagattagtctgtttatagagtttggcacctccccttgaatttaacatttttcaagttactaaaaacttatttgaaaagtctttataacgtctgcacgtaaaagtccagcgtatagatgtgccataacttactcatcattactcaactgttggttctgccaccatttgttctcctccctttctcacatttcttgggtgtaattgtgttgtgcagcgctaagtctcctcagtcatgtctgactctttgtgacctcttggaccatggcccgctaagctcccccgtccacaggattctccaggcaagaatgctggagtgggtcttcccgacccagggatcaacccatgtcccttacatctcctgcattggcaggtgggttcttatcactagggccacctgggaagcccatgaaattaaaagtctttgaatgtatacagttttctttctgaggaaaaaaaatgtgctctggctcttacgctaattatctgggtgaacttggtcaagttactttagctctctggactctaccttcatctataaaaactaacaaacgaaaaactagatagtttagaacagaattggttcacacacacacacatattatggttgaagacatccttgtagttctcttcaagggttgccgttagggacagtagagactgggggatggaactgctggccagcaaccctccttgcaactagaatcactctgacttatctattacatatgtcacttttacataagctttccaagaagaacagactctaaaacaaaaacaaaaatatgtctaaatcattggtctagtggtttataaaaggtaagagataacagccactaacattcactaatggccaagcacttgctatggcctgcctcatgtgcaattttacacattctctcttaagatgaggaaattgaggtctagaaaaggtaagtaatttgcctgaagtcacacagctattaagtgacagaagccaggtgttcttgtttcagatgccatgttcctaacaacgcttctatcctgttttcccaggaaaacagtaaccttctctagttctctccagtcttatgagccaaggagccagtaaattatcatgagatctataagataatcatactttagaggccatcttgataaagaaaatacaaagtagagaaatatttaagatctcacactgtctcctgcatggactcactggccttcaagaaggtggccctgatgagccctttgaaggaacaggcaggatgactttggatgatgacaccttatccttctagataaaatgagaagaatgagaagacttgagaagtccttcctaaatacatcatttagaattagattttaattttttagttaaatactaaatttgctatattctcatgaatttctcccaggcattgctttctcctgtatcttgagatatctaggctcccccatggtggacccatatctgaaatttaaaagaaaaattaacttataagcacttccttaaattctaaagccagtgagataagtaagagaacttacaaatgttatcagttaataagggatgttcacatatcagggaatatatattttaaaaattctcactgatcacctcaaggaacttagtcaaacatcaaagcagaccttatgatgtaaatggaaaacactctaagttagccagtaagctacattaaggacaggacacacatatctgcacattaaagatttacatgaagatcaaaatacattttacaaccaaactttctgtgctattaacttctgctaccaagagtcactacaattaacctggttcaaactgattaaaaggaaggctcctataattcatgttgtaatgccttcattaagatgtgagaagggaaaata

SEQ ID NO: 54419 - DNA, 4170 bp, Bovine  19866880877764
acattctacctatcaaatgacatgatacacagctataaacaattttgttgttcagttgctaagtcgtgtctgactctttgcaaccccatggagtgcaggacaccgggtttccctattcttcactatctccctgagtttgctcacactcatgtccattgagttggtgatgccatccaaccatctcatcttctgttgttccccctctcctcctgccttctattttttctggcatctttccctttgcatcagctggccaaagtattggagcttcagcttcagcatcagtccttccaatgaatattcagggttgatttcctttaggattgattggtttgctctccttgctgtccaagggactctcaagagtgttctccaacaccacaattcaaaagcataaattctttggtgctcagccttctttatggtccaactctcacatccgtacatgactactggaaaaaccatagctttgactatatggatctttgtcggcaaagtgttgttaaataaacaacttattcaaatccaaatgcattttagactaaaacttaggagtttttatttctctccttgagcttcttgtattttagttcggtcttaaagcactctattctttcctttagaattatgatgaactttgtactaacaaatgtcctgagaactaaacttactggtctgtctctgggatgtttttctagttatatcatctttatacatattttgtttactcctgagagggtgtaccggttactagtaaagagagcagctaaagcacacttagatttctggcccatctttggtcagtctcactctcttgagcaatcttccctgtttgttcatttctgtccaggatttggaggtgtgggcctcagctggaatgtgcagcactcactgggacctttgtttctatataaggatgggacagtcaggtggccacacttatctgctgggcattcaccattaattttgtgggcttttagagcaaatgaaaatgaatttatgtcctgtatatatgaccttggacaagttacttcacctttctgagtctccatttcttcagatggaaaatggagaacatagtaatactaattctgtaggactgtagtgaatatcatatgctagtttatgtcattaaatgtaaaacttttatcatacctctggatgcaaagtagaaactcagtaaatgtgaaaccatcaccaccaccatcacaattatcattattataaatgttaagctctaatggaaggaacgggaaaaaatagggttggaggggaaaaaatgcttcccctcttaagaacttagcagtccacatgttcccactgggtcatcccagtgcaccagccccaagcttcctgtatcctgccgtggtagattcatattgatgtatggcaaaaccaatacaatattgtaaagtaattagcctctaattaaaataaataaatttaatttaaaaaagaacttaacagtccaatgatggtttaaagtttactgatgtctgtattctgcaaatatttgcaacctttagtgcagatgttctaaaactcagtgaccattgcttgcttcctttacataaaataatttgaacatggctgtctctttccctaaaatgcacccaaagagtttttttttttttcaagcttggttttggtaagcatattagtatgttattttccatagaaacagagccgtcgccgtcctgagtcagcttcatctgctgtcttgtccattctcttgccatctgagggaccacactggtgtgtgtggagagggcatggtgagttttggctagagtttccttagcagccttcagtggcaccatcatttatcaggttttgaattatacttcatttgtaagcattttattcagagtgtgaattctctgtgttgtgcttagccgctcagtcatgtctgactctttgcagacccatgtagaccctttgtagccccctacagccactttgtagacagccagtctcctctatccatgggattctccaggccagaatactggagtgggtagtctttcccttctccagggaatcttcccaacccaggaatcgaacccacatctcccacattgcaggcagattctttactgtccaagccaccagggaagcccatgaatactggaatgaatagcttatcccttttccaggagatcttcctgacacaggaatcaaaccaggggaattctatatctgggtttaaattcctgttctacttactgtgacacttagctgtgtcatcctgggcaagttattatcctttttgtgcttcagtcttctcatccataaaaggggcataataagagttgttataaaaataagttagtggctgtcaagcactcagaacagtgactggcacattgtgagtgctcagtaaatgggagctatttctcctttttcttattaatatcttgcctatacttttgagtagttattttatgatttattttctgctatatgatgaaaatagtgcttcgtttttattttccctaatcagttattttaattagaaatgggttctgagctaaaggtcaattgagtgaattaaaaatgatcactctccatctgaactccaaacctagaagcaagcattaatgctctctgcaggaagccagactcaggtgatggccgtaatcctctgaaaatcagcagacttgatttcatttggaggaaaaatgcagccaacatcagagagcagagcatcctcgtttcaggatgcataggttcaagttttgagattgccaaacgtcgcctagtttttctgtctttgcatggacattttccttctataacaggaaaacaactcactccttagactctataaataactagagggttttgaggataaactgttattttatttcatgagaaaaagaaccgtcattggaaacattctgaaattgtagagtgttcatcttcatgacttgattgattccatttttccatcttttgtgactggtttagtgtttagaactctaaacaggtttaattattttctaacaaaaaggacatagctagataagtctgctgctgctgctaagtcgcttcagttgtgtccaactctgtgcgaccccatagacggcagcccaccaggcttccccatccctgggattctccaggcaagaacactggagtgggttgccatttccttctccaatgcatgaaagtgaaaagtgaaagtgaagtcgctcagtcctgtccaactcttcgcgaccccatggattgcagcctaccaggctcctctgtccatgggattttccaggcaagagaactggagtggggtgccctcaccttctccgagataagcctagatttgttttatctaatagtgcatctaaactggttaatagataccggttacttcccttatttagtttatgccaaaggcaagtctttgaatttttcggtttatattctttcaccattgataaagcaggtatttaatttttagccctgttacttactagctgtgagctcctggaggagtttctttcctgctctagcttcaattccatgagctgctacctacctcttagcattgttttggagacttctaaaatatatatttaaaattagtagcacggtgcctggaagataacagaggcttagaaatacctctgagagcaagttgcagtgacaaagccctaggttgtggtattggaaagactcagcttcaaatttgcctctgctgttaggataagttttgtacgcctcagtctttaagcctcagctttctcacctgtaaaatggagacaacaacatcccttctggggctttctgagggttaaatgctatctatataaaacacctgggccagggcccagggcaaagcaggtgctggacagatgaaaggtagagcgggagcgatcatggcagtggtgttgtaattgctgtctgcgtagtgatggtggtagcgttcataagcccacttgaccttgtaagtggagttaaacaacttcagaagtccaggaggagtttataaccaggtatatcaagacctgaagtacctctgggtgtctggaaatacctttgtagttgtaaaagggtggcctttgtgcattcaaaacttaacagtcttaatatatctgaattacgaagtcaaaggtaaagtttatatttgaggttggtggtatttctcctgaagcagtttggagtcagtttagt

SEQ ID NO: 54420 - DNA, 1262 bp, Bovine  19866881089441
cacacacacatacacacacacaaatagaatggctgctcaggtatccaatggcccgacacatctccagcctcattgctgttagatcatagcttccccccatctctcttaatccaaaacagtctccatttaaaaaagtcctccatataaaaaagcaacactgtgtttctcagcagtgcttggtggaagagggtgtggttctgtgttggcagcttcagttcctgatgctgccacttgatggcgcccgtgagtgcagaacaggcaaagaacaagcccaatgagtgctacagaccaatggtctgtgtgtgaagcagcctggggacacgccattctctggtcctgcaagctccatgttttgtgcaggcttgaccagggcctgtacttttctttaaagaaggaaaagtccccagattggacagcaggcaaatatattttcaagccaacagtatgtcagctagtactccatggtttgaagccctatgactgaacaaactcttgtactcttcaaagcactttcaataaaaagagaaaatcctgctgtcccttacccctagcggcccttcatttcagtgctatagagtgggagtactttctacccagctgcagtaatagtcacaagatacactgagactccagctgcagtaatagtcacaagatacattcagacttcactgaagcagaagcctatttgtcacagtgaagaaaagtgtgctgtattgcttggtttataaacagcaagtacccaggaaatactctttgcaaaaagcactataattcaaaatcgccaataattttaatcacattcttctcttactaagtccatatgcccagcttcttttgaagtcagtgggaactgaactgtggcagataaaaaatatgggggaagaaaatatgaataattattaagctgctaatgcattttaaaccctagattctcattttcctctgtcatttctgcccgtctttgcactctccctaaacatacgttaaggcactaaggcaatgctgacttctttactgtgaccgagtcactctgtattcagcatctgggcacctaagggctatacagtcacattttcagtatcacaatctcacgagacatggcatcaacacactaatcaccttacaaataaaaaatatatgaaacacactacaaaacagcaggcgatccagaagtagggaactgcctttcaaatttctatattctggctaagccccagaagtcttcaaatgccagggcggggtatctggagacgcggggtcaa

SEQ ID NO: 54421 - DNA, 2351 bp, Bovine  19866881103759
atcggattcctctttaccattttcagtggccgcatggatccaatgtatgcctcctctgtatcccagaaggataagtcagggtattcaccaggttccaggataaaagggacaccctgaaatccaggctcttcataaatcagccatctaaataagtaccaaggaagaagcagacagttcatcatttctgtcagtggaacactgcaccccacagatgagagaggaccagaacaggggaggatgtgggtctggacacacaagtgtgggtgcacttagtggagcaatgttggactccaggaggaataagccattatatgcacctcttgagcttctgtttgtttccttggcttggctagctttgtccactgattttactttctattatgaactgtttcaaagtttaaatgtctgttacttccaagtaataaaagtagttatcttttgccctgtgtatgtatttacagaggctccagccaggagatttcacactttaaaaggttatatctcatttgtaaccaaaaataggatgttccacctaatcatctgtcatagtgtcaaaaattaggaacagctaacaaatatctagagcttacaaggaattccatctgatccttacaataatgctacaaggaaaagatacagtccccattttacaggtgaagttaaattgcccagggccgcacagctacaagtactaaatgcagggctgatccaagctgaccccaaaaccaaggtcctagtcattcttgaacagcagtctttctcattccagcgtgcactgaacataatttctgctttcacagtcactcaggatcagcactgggagcatgacttaatgcacagtgatgtctgtgggggctctcaaagtctaaagactgcttgttcccaggcccagtgctttttgagtccttggacttgatttttatggtttttcaataccacacccttctatcatacttgtcagctgtcacttctgctgtggtcaggcaaccagaagcatcaccctcctctaatgtgctagaaaccaggaaaccagaaaaccatgcctcacatgaactgtccctaaagactgcagtcttatcaatttcttggttccttggaggattctggtgaagtcgctgttgctggagaagtgacttctttataagagagatggtaatataccctcttgacaagcaaatgtgacatcttggtgatcacttatacccaccaattctttattagtcttgctaaagcatcctagctgggctaactgtgccaagttccccagagcacaggccacaagaggaagctggctgtaaaggtaatcttttacctacaaaatgaatctgattctcccctctttgcttttctcttgttcacagttttggcccaagggcacgtttttggtgagtttctgttacagactgtcctggataaatcagtaacttctttagacttactaattatacagggatttatagtcaaaatcctactggagacctgccaacatacacatacacacacacacacacacacaatgttgagaggccgtgtgtggtgtgggtgggggaatcaaaactaatccacagtgttagaagtcagggcaatacttacagggacaactgggaggtggtgggaaggcaggaacagagatgcagagaacagacttgtgggcacagtgggggaaggagggggcaggacaaattaagagcgtagcgtggacacattctttaccgcatgtaaagtaggtaggtgggaaattgctgtacaacacagggagctcaacccagtacaacaacctagaggggtgggatggggtgcggggctgagaaggaggttcaagagggaggggacacatgtattcttccggctgattcacgctgttttagggcagaaaccaacacgtcattgtaaagaattattctccaattaaaaataaattaaaaaaagagaatgcactacgtctttttttggagcccaaagctcttaaaggcacatcacacactgatttcatgccctagctaaataacagcagtttattataaagtgtgcttttcggccaataacaagccaagggccttgaggtctgactcttcacaaatgaacagtctgaattttttataaacacagacgatggctcatcaacaagtgattctgagattctgacatggtgcttactgaagtactctttcattaagtgttttcttctacagtttgagttctaagggtacgtattcatctgctactaaacatctcattttccttgaagcatacagcttagtcatgttaacacttatagaaggaaggtaatctgggataaagagggttttgtccaaaagcctgaacacataaactggcacacctgaagactg

SEQ ID NO: 54422 - DNA, 823 bp, Bovine  19866881194153
cagaatttagaaaaaggatttgtttggctcttaacagatgttctccgaaggggaaaaaatgaggttgatgagaaaggcggttactggttgataaggaggcattgagaactgcctgcctgccacgtttgattttgaaatctcaggctcttcgaagcttctataaggggacaagtagtcacaatgctatagcttgtagcggattgcaaagatgcttgtaaaacactcaaagcctattaaaaattcccagcagatctcttctcccagatccttcgccactccccaccaatgagctggtatacattcaagggaaacaaagaagcaattctaaagcacaaaggagctgcccaactattccaggagtttccccaggcaggggaaatgtgcgtcctgacatgcttggctggaactgattgggaaccagactgtgttcactgagcaagttgagaaagatttgcctcaagcttcggcacattatgatgtcatcttttggcattttaaatattcaagtgtgtatcctgaaaagcctcttgctttcatttcttgtttaggttgaataaaataggcctgcttccagcttgtgctaatttaaactcttaaggcgagcttagttgctcagtcgtgcccgactctttggaaccctttggactgtagcaagccaggttcctctgtccatgggatttttagggaaagaatactggagtgggttgctatttcctttctccaagggatcttcctgacccagagatcgaacccacgtctcctgtgtctcctgtgattgcaggcagattctttacctgctgagccactggggaaacccaaagct

SEQ ID NO: 54423 - DNA, 866 bp, Bovine  19866881279286
ttcctcttcactttctgccattagagagggattatctgcatatctgaggttgttgatattctccaggcaaacctgattccagttagtgattcatccaacccagcacttcacatgatgtactctgtatagaagtttaataagctgggtgacaatatacaagcttgtcacactcctttcccaattttgaaccagtcagttgttccatatctagttgtaactgtcactttttgacctgcatacatgtgtgaagcatgccaatattttctaatttttttccctgaaaaatgctagtcaggacccacaaaactgatttgatgacccaccaataagttgattgaattttgaataaggtgtgatttaccactaataaatcattagactaaacaacaacccctaagaagattcttctttttaaaagtatcctgtggctaatactaggattttcctaatcttttcaattatcaggaacgataaagtagtatttactcggtatgcatagtgtaataatttgatggaatgtgtaattaaaagactaacgttaaatgtctggtaaggcttctagatagatccagtgccaacagcttttaagagtaagtttactaattgcttgttattttaaccaacaggaagacaaaggcatatacaattggatggatgggagggcttcaaatgcctgttaattcatgctgtggctctgacaaagtgaagatgagaaaataggaaaacactttgaagatcaacgttttattaattttactgtgggaagccaggagagagacgccgcgatcaagctccagtgaggcagtgtctccgtatttgtaaaagtctctgctctcacagaactgttataaccttcttaaatatca

SEQ ID NO: 54424 - DNA, 1071 bp, Bovine  19866881463317
ataatcctaaatcctttgtggtatccccagtttctctctctacaagttatagacaagacaaagacaggttgaacctgtcactgacacagaaaaatgaaacacagaattaacaagtgccttttgttttttaaccttcccatgtatggaagtgaaatgagtaaaaataagttactggtaagcttggcaaaatattctgtggtgaagaagttggctgctgactgtatttcttaatgttctacaccatttcaagtcagcccccctgactgagtgtcatcttttagaagccagggttatgacaatctgaagataatagttcaaataagagatttagccaacagttgcataaagataccatgcttaatacatattttaatttttccaaatcagttaataagcaatagcataaattcctgatagtcctttggattttctagttggatagttctttatcttaaaattgggttcaagaggcaaaataatatgtgctatgaataaagcaagaaaatacagggagcattcgatttataataactttagatcatgtctatgaaaacactgttttccatcaagattttattgaaagatgcagcttatttaacatacattgtgtcagacactgttccaagcactttacaaatattaactcaccacagttaattcataacatcctggagaggcaggtactattattcctattttgagaaagaatgaggcacagaaagtgaaagtgagtaaaagttaagtcgctcagtcgtgtacgactcttagcgaccccatggactacagcccaccaggccctccgtccgtgggattttccaggcaagagtactggagctcatgaggattggggctgtggttctccagctgatggtcttgagtcctgcagttaatcactacaaattaaaagcactggctagtgctaccttctttgtattcccacagtaagtatagttaagctgtaaatttggcaagcagaaattataatgtacataggaaaacaagttaacttttgatactaaacaatttctatattaagtaggaagaaaaaaatatacataaatacattaaaat

SEQ ID NO: 54425 - DNA, 1393 bp, Bovine  19866880120670
atggcatctggtcccatcacatcatgggaaatagatggggaaacagtggaaacagtgtcagactttattttggggggctccaaaatcactgcagatggtgactgcagccatgaaattaaaagacgcttactccttggaagaaaaattatgaccaacctagatagcatattcaaaagcagagacattactttgccaacaaaggtctgtctagtcaaggctatggtttttcctgtggtcatgtatggatgtgagagttggactgtgaagaaagctgagcactgaagaattgatgcttttgaactgtggtgttggagaagactcttgagagtcccttggactgcaaggagatccaaccagcccattctgaagaagatcagccctgggatttctttggaaggaataatgctaaagctgaaactgcagtacattggccacctcatgtgaagagttgactcattggaaaagactctgatggtgggagggattgggagcaggaggagaaggggatgacagaggatgagatggctggatggcatcactgactcgatggatgtgagtctgagtgaactctgggagttggtgatggaaaaggaggcctggagtgctgtgattcatggggtcgcaaagagtcagcgactgaactgaactgaactgaactattacatctccatttctgcatatgaagtgacttgttccaagtaatttctaggtagtaaaacacctagaatttgaactctaaagccatgctttggtgactgtaagattttctagaacaaatctgattgtaaaccattttgtgtttatgtttcactagatcctcaggggaaaaaggggtgcttaccttgacttttcagattttagaaacatttccggaggatcaacttgtctagtgaatgtagagcttaatttaactaaagtcttgattccaaaccctttaaatctgacctaaaattttttatccctttttatctttcaatatacgcatataattgtcctgtattctatcttgttggctccttttcagttcatctcaaattgcaactgcctggggacagaatttgaaacttaaaactaaatgtttataaatttataaagcattgctaccttttttactaagcaaaaaaaaaaaaaaaaaagttaggagtacatttaattctatggaacccaggaaagggacttgaaaactgaataagaaactttctgaaaagtcaagaactgacttttgttctcttctttgaaaagaaactattaatatttttaccataatttctaatgccaactatggcttcctttaacatttctcctgttttaaggagaactatattagcttcctaaacaacaaaaaaatccaatgagatatacacctgatataaaagtacccatagtttcttat

SEQ ID NO: 54426 - DNA, 1306 bp, Bovine  19866880354916
ttggaaaatcctatagatagaggagcctggcaggctatagtccatggggttgcaaaagagtcaggcaccaattgagcacacatagacacacacaactttacatgtatgaggcccatatctttatcttcagtgtctctatcctaaccttgttgctggtagccacgttgattttgcaggttataggggctttttaaaacaaacaaacaaacaaacaaaaacattgcaggcatgttggtttggggagagattcagggtgcacttgcaaatataggtctggagttcaagaaggttttctgtgttggatatttagggagacttttctatgtcttgagaatactaaattgaccactttggagatcttgaattcattattcctcatattaaataatggtggtggtttagccgttaagttgtgtctaactcttgccaccccatggactgtagcctgccagaatcctctgtctatgggattctccaggcaagaatactggagttggttgccatttccttctccaggggatcttcccgacccaggaaacaaacctgagtctcctgcattgcaggcacattctttactgactgcactatgagggaaaaccaaacatattaaataatagtcatctacaaagtgtagtaggaagtcaagaaacacctggagtaacaggcaaatttggccttggaatatggaatgaagcagggcaaagactaatagagttttgccaagaaagtgcactggtcatagcaaacaccctcttccaacaacacaagagaagactctacacacagacatcaccagatggtcaacaccgaaatcagattgataatatactttgcagccaaagatggagaagttctagacagtcaacaaaaacaagaccaggagctgactgtggctcagatcatgaactccttattgtcaaattcagactaaagttgaagaaagtagggaaagccactataccattcaggtatgacctaaatcaaacccttatgattatacagtggaagtgagaaatagatttaagggcctagatctgatagatagagtgcctgatgaactatggactgaggttcgtgacattgtacaggagacagggatcaagaccatccccatggaaaagaaatgcaaaaaaacaaaatagctgtctggggaggccttacaaagagctgtgaaaagaagagaagcaaaaagcaaaggagaaaaggaaagatataagcatctgaatgcagagtttcaaagaatagcaagaagagataagaaagccttcctcaggatcaatgcaaagaaatagaagaaaacaacaga

SEQ ID NO: 54427 - DNA, 1785 bp, Bovine  19866880378113
tttacaaaaacctcagtactttactgtctatgaacacatctgagggaggtctgtatgcagctgaacatctctttgatcacagggctacatacacaaagcttttctttcctgtgtgtccgagactgtgtccatgtcatcaaagggactgagctggacctctgcatttatttctgctaaaagatctaaaggccttgctgctgtgtcaagaattcttcatgattttctggaataggggaggttgctgccctggatttctattaaatggaaacattgtttatatgatggaaataaccaaagggttatctgacaggataaagaggggattaatgtgtcaaatgggaaaattaagcaacatgagtagataaaccataaaccaatctaatcaccctataaagaagcaattctttggaataaagaaggaaatggaggggagatatatataaaaacatgtatatacaatttacatactatagttacaaatgaaatttcctctaaataaagcacacggagtgaggacttcaaatatgtatatactttgaaaaaaattgcagaagaagcctcacatcacaaaatctgaggattgggagggaatttagaggacatctggtcaagtcctctttagaatatcttcttgtatcagaaaagattcagtttttattaagaggacagagaagaaaaatgtgcaatcattcattcagttaatgcccaacatgaccctataactggcccatcttaagattcagtaacttacattttaaagtatttgttataggaatgaaaatacattaaaaaggaaacaaacttttcaaaataaaattctactttaatgttttatttatagtaatactgacagtttcatctcttaagaaataaacttcaaccctttaaggactatgagtaaaaggaaaacttttttatggtctattcaggagagaaaaatcaaaataccacacattggcatgagagttgtttaaaatttgttaagggggaagcattcagagtcatgaagacagttttaaaaaaccagcaatattcagcctggaagaagagtgtcatgttatctgtctttaaatatctgaaagaccactgtgtagaagatgacatggtcttcctctgacagagtagaggacagactagggtcagtagggggaggcttgtatgactatctttgactgaacaagaatggacatatgttgagcacttctcacagcctcctcataaaaaaactatatacttttttcttttctttttacattttacatgtgaaataaccggaagcagagaaaggttacgttacattccaaagcgacttagttggaaaatgcagaggggccatgtgaatccaggtgagatggcttctctctgggggttccctgggagccaagaatgcaagactctgtcttcactctggggaaatgtgggggctctctttggtttgtctcttggccagttaagaggactgatcctaggaccagcgagcttgaactcaaattgcaattgctgcacttgctgggagggtaagggttaggcttagttggggtaaggtccttactctctctgagcctcagctttccttctctgttatactttgcttccctgttatacatgaatgataggggtagttacctcatgggatcgctttaaggattgaatattttcataattataaagcacttaatgcctgacagtatctacacaataaacactgactaaattatttggagtttcctgtgtggatgggcctttggtttccttttttaatctacttatttgaatttctctttt

SEQ ID NO: 54428 - DNA, 1915 bp, Bovine  19866880500775
atgcaaagagttgactcattggaaaagactctgatgctgggaaggattgggggcaggaggagaaggggacgacagaggatgagatggctggatggcatcactgactcgatggacatgagtctgagtgaactccgggagttggtgatggacagggaggcctggcgtgctgcgattcatggggttgcaaagagtcagacacgactgagtgattgatctgatcttatctctaatatcaactttccttctaaataaatcaaaggggaaaaattatttacctcatgaaatctaatgacactggaaatatgggctcttattataataagctatcctatatgtaagaaatggagaaaataacaatatataataattttttcctatttctgataaggtaataacagtggaaacctatagaaatggttatctgtgaaagagcaaagggttggtggaggggaaccagtggggagccagatttctcagtaggtgaatacctttttattttgtgttcctatttcaaccacagaaatatagcatctatccaaaaatgaaaaaaataaaatagctcaaacttgccacaatgaagccagaaattaaaattaacatgaattctagagaattgttctaaagcaggctctgtcagtaaaaatattttaaatgcatgggtttttgtgcaaattttcattctggcacatacttaccaactctgagactttgcaaagttacttcacatctacaaggctcaattgtctcatttttaaagagtataaaactgtctacctggtaaggttattgcaaaaattaagttagacaacacacatgacatcttccaaacagtatctagcctttggttttattggaaataataataatatttccaacagaacagtacctaggctactggagtcccatatggatgaaatccattcattcacttatacatacgttaattcagcaaatatctattgagagtctatcatatcagatactgctccaggagcgtcagatacagtagagaacaaaacaaagaaggttcatgcctttttgaagtttgtatcatctatgtggcattgatgagggagataaataagtcccagcaaacataatattaataagtatggaaataccaaagtgtgtcagtgagactgttatggaaaaataaaaaagtagaacagggaaaagcgattgtgctgggttggagtgggtaaaaagtcaaatagattagaatattaaatggtgtggtcaggccttattaaaaagaagagtaaataagataaaaatcatcctgtttataccctgattgcttcacttttaaaaattattaaattacataggtttaaaataactcataaagttgtttttcagtatatagtcagagattaagctattctttcttccagtgcgtaatcccaactctatcctccttgcatgacactttcatccaaattttctgtaaaatcaagggcatcttgtaaaatacattctctcaaactttcttcctagtacaaaggtaagagagataatactgtcttactaagatttgcatttgcctgttgctgagtgttaccattttacttagatttggatagatccagaattcaagcatggctattttagtagaattgacagaaagtaatacgcatttaaactcagccttctgtcatgaatagttgtcctaattctgggttactttattagaaaataaaggccacattactaaatatatttatgtaatatggaaaggacctcatcaaattacatgcctagataagtatgcatacttaacaaatatcaaagatgaaaataaaatccaactgatgaaaataactacttattaaaagtgttcattacctcatgtgaagtattctttaatgtcacttcttgccagcagatgcaaaaggaaagcagacctgtatacaag

SEQ ID NO: 54429 - DNA, 1279 bp, Bovine  19866880625201
tgattaacagaaggatatctgagaagaaaattagcttcacagttttctgaaaatagattttatttaccaaaagtaagacttgttagttagaagtcttagaatgtttattttattatattaagttgttagttacttggattgatggagaaagctaatctgaatgataagtcttttatttttgtcttctgaaaatcacataactcacattaggttgacaaatcactagctgttaaaagttcattctttagctgatcagttatgttacttatctactccaagaaagactgtgttctgaaataatcaaagagcagtctgtttgctgatgtactataatcacctgctaagctagttagaaatgcatacattatatttctgcaaaaagattttgcagaaaaagttcaaattagaacaaaaactttcaattatttttaattgcagaatttcttcttactaattgcttagactatgtatctttccctatatgttatataggtaatagttaagccaaattaattacaaattctggatttaaagtcttgaattaatgagcttttactgaaatttacattcaaaggcttgaatctaagcactacttgttctaaagtcaatatattctctattacaacaaaacttgcttgtataactcggaaatatcaaaattcatgatgcttttatagaagacattgcaaatacactaaatgtctgtgatggaaagtagaaaataagataggcttgatttaaattcattcaagagaacatcactgaagagagaggaccttttcataaactggtcttggttccagagtaacttattaattactgttttttaatagggagtatatctgattagttgagtagctgttgttcagattatcatactcagtaaaagtctttcaaatataacaaatatttccattttcttagctttggcaaattttcattttttttaagtctttgtttttccattttgcagcttgattagctcaatgattcccttttgtagaaactcaggagtcttaaaggatgaattcctttatgcgcttttcatttttttcaatagccatgataaaggataattttagacaaagttgtacaaatttagacaactattttaatctcgccagcagaccctaagttaaacagatgtatgctgccctcttatgttacatttgagtaaaggcaataaacaaatacgaacacttgggagtctagcttgctttttcctattgccagctcttcatctgtggaatggcaagcctcagaattagagtttttaaat

SEQ ID NO: 54430 - DNA, 1841 bp, Bovine  19866880708521
gtttgaattgcagctctgccgtatagtttcatcacctatacagtagggctaattaatgcctttttgttagggttgttacgagaagggtgcaaaataacacacaggtgtaattactaatataacattaattttatcaagacatggaatggaatgattgtgctgttgctgctgcagctaagtcacttcagttgtgtctgactctgtgcgaccccatagacggcagcccaccaggctcccccgtccctgggattctccaggcaaggacactggagtgggttgccatttccttctccaatgattgtggtgttaagagcagataaatagctttgcccttttttttttaatgaacatttatttttagccacataataatgtttttttcttttttgagaggattactaattttagctttataatagattggttgatactatgattcttaaagctgttctcaatttattgtatgaatgaattaatttaaattacttgatttaaagtcaagaggtataaatctgtttttataaaaactagcagatcaaagtgtaaacagaaaactaaggggaaagaaagcacatatgtatgaaattttatttcagtgcaatccctgaaacagatttctagagctatattcatataatatctgaataaacagtgagaaagtttagctaattataaagatattaaaaatctacaatgtacaatgtcaaataatcagaaaatattccatatgaattttctttttctttgcctgccaaactgctaaaacattgaaaaagaagatgtccagaaccagagccaacatgcatatttgggtacttccagccctggtacactgtagcagggcagaacaggtccagtttcagcccagtggttcactggcatgtggtcagtgtgaagtttcctgctgtactcttctgagctagagagaaggaaccaaaaatgctgacatcctcatttggcttcatcagttatgcccgagcacatagagcaacacttcctgtgcaaaacctacactgactctgcagaggacactctcaaccttcagctgatctgggcggggatgctggcataggttggtgaaatttggaaagtgttagccattggatacttcttcacatcacatgaacgtggcatgtctcattattatacctttcatttcatagaaataagctttcaaagcttgcaatgaaagcttgcaataacaacattgattgacaggaagagcttgttgtaggccagttattagctctcaaaactaccaccccgcgaaagcatgtttaagaaagacctaatttagaaataaaatgccatggaaattgaactgaagaaagcctatgagaatgtctgaaatgtatatatcttgtctctttaatatcaatacgtctatatctagccttccttaacactcttgatctcagttttcttatccatacaaagggaggatttctaaatttctaagggtttgtaattttagtgtgtgtttctccgagtagttttctccatgttttgttttattctacctatcaaaatatcctcaagtactttaagttagtacatgactttcaattctttcagaaacacaataatttggaagaagtgatgttataaagttattctgagtctagattattatagtttgattctgactataccatctaaacatcacatgaaagggaaattagtgtcactacgtaaatgttaaatccatgtgatgataaacctttagatgtttggacaagtctgtgttatatatcatctaaaacattaaccttgattagtaatttatcttataagcatgacaaggatgggaaatttgctcattggtgcctcttctttaaatt

SEQ ID NO: 54431 - DNA, 911 bp, Bovine  19866880833968
atgaatactggagtgggttgccatttccttctccggggatcttcccaaaccagggatcaaacccaggtctcccgctttgtaggcacacactttaccgtctgagctaaactgatgcaaaacacattgtagctaaccaaatccaatatttttattttaaaatactaaataaactatctttatccagtaattgaaaacaataagaatttgaagctagctttttaaacatatttacatcttatattatataaacatcttatatattataatctctagtaatctatagaaacttagaaattttaccccgaaatgaaatacagtagtatttataggacatgtctcacaaaacagatgccaacatcagtagctcagacagttgtccagaaggaaaatggccttcagcacacacgaaagatgctgcatgttggtgatccaagtgtgaaaaagactgccgtctctctgctgaggaatttgtctcggaatctttctctgcagaatgaaattggtaagtgagtatgtgtctctatatgtaatgtgtctgtattgaaaatacaaatgcactaaaacaaaaacattgtccttatcccattctttttacaatgatgagttttgtgaataaaaagcaaaatgtgataaatagaactgggttttgtgtaccgagacatcaagagtatactttcacactggtttcaaatatgatttttcttagtatccaacttcatttttgttccaattactactgaagagaaattttaaaccatactaaaaatgaacaagataggtaatatatatgatatttcttggccctcagctctgccatccgatgacatcttttttaaaccatgtctttcagaatgttctgtgtaatctgcttaagcaccacccttctaaaacattaaataaacacacacaca

SEQ ID NO: 54432 - DNA, 691 bp, Bovine  19866880938050
taagtatgggaactggaccacagttacccaaatgttaacaagctctaacgttataattgttgttgtggttttttagtcatcaagtggtgtccacttctttgtgatgccatggactgtagcccaccaggctcctctgtccatgggatttcccagacaagaatactggaatgggttgccatttccttctccaggggatcttcctgacccaggaatagaacccgtatctcctgcactggcaggtggattctttaccactgagttgtcagggaagcccagcattataataccttttaagttcactgtcttactgaatcacccaaatgtccctaggagacaaggattgttatgctcattttatagattatcaaactgaagcttatccagatttacttgtgtataaggcataagaatttggataggtaaatatacagagcataattcttttggaatgatgtaccttttgattgattgacctaccagaactgaaataaaaaaacacactccaattcaatttgtagtaacaggagtatcgtctcttctgcatttttaaaatgtatatgtgtccaaatgtgaatgggtcaagttcatcactggcattgccttgaagtcactcaaagactttcttttaccattgcaggtagaacgggaaaaggccattcttctggccaatctccaggagtcacagacacag

SEQ ID NO: 54433 - DNA, 1542 bp, Bovine  19866881076296
ataatagtgttataatatcataacaatagtgttataatatcaataatagtgttatcatataatatcataacatttatagtactaatttgtggtttgttgccttgattatttaggtcaagttctgcaaaccttttctgtaaagggccagataataaatattttgggctgtgcaggccatatggtttctgttatagatacttaactctgtcaacctagcaaaaagcatcatagacagtatacacaagaaggagtgtggctgtattccaataaaactttattaactcttaacttttacttccaacccacagttttaatcagtcttcaggtagggaaaaatgttggcctgtattccatttatgaagaagaaatacactttaggcctttgaagtctgtagcaagttgtgattgctggatttagtagaatttttgaatggaatagagacctgattccctgaggtcatttattattatcttaatttcttagagtagatagcaagactttatttaaaaactcaaaatatttcttaaacttggtcttgtgacaaatagggggtcattaatgatttaaagggtatgtttagtttctcagatcaatatttcacttcatttggatttaagatcactgtagtgcttgtatgtcgttaatggaatctttggctaagcagattgaatactaatgagtcctcatagccccggaaatactggaaatacagctccaaatcatgagcttatttccagtgcaaaatacaaacaagcctgacagcagggccatgagttgtagaggaaagaacactgacctcggaatcaaaaacctttttgtgactcttgtatttatcactgtttactaaccttactttcttcaaccataatatgcagatatctgtcctacatacgttttatggatgctgaaggtgaagactgctgttacttttcacatgatatgacatatgtggaagtgccttattgccttactttcttcaaccataatatgcagatatctgtcctacatacattttatggatgctgaaggtgaagactgctgttacttttcacatggtatgacatatgtggaagcgccttattggagaggcctgggtcaggtttagcagaagcgacagctgtgtagctgaaagctaagcaagactagactagcatggagtgagcctaagggactctacctattggtttccagagggaatatctaagagtctactaaagagacttatcctagagcaaagataacggaaatcaaaagactgaagaacaagtaaggaggtggttcaaagctgggaaaagggaagtctgggagtctgtctatgttcagtgactccaactaagattctcactcttgcatttttcttaatctagtatgtttttttttttttttttttttttaatggcttgggtatttggaagctcctggctgcacagtattcgttgaaatagaggcacagagtcagggctaatagctatactataacagatgtaatcactttgttacttgctgagtgaaaaccaaaagataatcagctagagtccctg

SEQ ID NO: 54434 - DNA, 1502 bp, Bovine  19866881279341
cttcggctatgatgaaaaacccttctggtgttgaaacatcctcattcattatcaagatatacaaacttatatcttcacttatgcaactcaaagactggagtatattctaggcctcagtgtgagtaatttcattgttcatacaggttcatacattgttcatacaggttggttaagttcgtggaatattttatttcctaatccttaaagactaacacagaaaagcatgatttctaggtttaatctcttttaataattatgcttcatgaaaaactaaatgctaagtttcctatcctgtccttgctcttatatcaggtaaatatatcattggattttttttgttgttgttcaggaagcaaattctataaaaaaggagaaaagttagaggaagccatagacagcattagaattacactacaaatcatttctttttgaagaaaaatcagtacgtgacttttcagaaagtttataattcagtgtttaaaattttaaaagtttaaaattcatgtgtttccatgaaattaaatttactcattagccttgttttaactcagtaaaaaaggtagcaatgtcttataaatttatcaacttttaaattagtctttaagtttcaacttctgtccccaagcagattacagcttgagatgaaccaaaaaagttaagtaaccaacaagataaaatagaggcaacaagataaaatagtggatacactaaaatatccaaacatatgagaatatcaaaagatattccaggaaggcaagttttcaggtcaaatttaaaggatctggaatcaagatttagtcaaattaagctctacattctttaggcaagttgattctccagaactgtttgcaacatctaaaaaatcagatcattgatttttcttgatttccttaatttcatttgatcacttgaagatcaagtaaaacacacacatacacacaaaatggttaacaatcagatttgttctagaaaatcttacaggcagcaaagcatggctttagagttcaaattctagctatttactacctggactatttggagcaagtcatcttcatatgcaaaaaactggagatgtattataataaaacctcagtcaattataaaaatctaaatagaaaaaagtcattaaacttttatatagtataagctgtattgctatgttccaaagtagatttgcatgtactcttctgggagtacagttaggaagaattcacttattgacaagctttttaatgtcacttcatactagcaactttatttacaaagtaagaacatacaggtatccattgtaagtcagagatcatctctacatttcagaacttcactcggtttaagggccaacaaaaggaggtttcctctttctgtacctatcttgcctgtttttctttgtacatggtgtgtagtactaacaagtgcattaccatagcaggtaatgttttcaatttcaagtttgctggtaaaaaggtgcattgtaaggttctgtcccctttacaaattaacaa

SEQ ID NO: 54435 - DNA, 977 bp, Bovine  19866881749137
tcgtctccgactctgtgagaccccatacacggcagcccacctggttcctctgtccctgggattctccaggcaagaatactggagtgggttgcccatttccttctccaaagcatgaaagtgaaaagtcaaagtaaagtcgttcagtcgtgcccgactcttagcgaccccatggactgcagcctaccaggctcctccatccatgggattttccaggcaagagtactggagtggggtgccattgccttcactatgtgctagtactgctttatatctgctctgtaagttttcttgagctgaactttctctaaaataaattctctcaccttcgtggggtctaggattcatgaatcttgtgctgtcagctttgcattctcatgaagagatttgcactgcataaattacttagaaaaatttcttttccaagtttataagtatatagcttctcaaagactttggttaagtaaactaggtaattgctttctttaagtacatacgctgtatgtaatggaaacagcattagcctgagagtgaaaaaacttggatccttgttttagaaaagacactactctatgtatcattagacaatatcttacacatagcaggcactcagttaatgcctggggaattgtagttgctaagccattattgtgaaggattttgatgttgtaacactaccaccttgtgggaaatttgagcatgtgagtcaaatatttgagaactattttcaaacagccaaacaataaggcagaatttcttgataattagagtcacaatatatgaacagatgatatatgaaaaaaacatttatggtcaggtcattttagaaaactcaggataaaacaaataagtatttttttttaatgtgaggcttctcaaagcatttttcacctcataatgtccatcttgtaatatttttagaattgtgaacttcacctataatcgatgagtatatttcacaagctatagaattttctcca

SEQ ID NO: 54436 - DNA, 749 bp, Bovine  19866881852001
acagaggagtctgatgggctgcagttcatgggttcacaaagagtcaaacacaacttagcaactaaacaacaacaacaacaacaaatgtgtataggagtcattaccagctgtccaagttacaggcaatacacagaatgtcatcagcttcttgcacttgatatgacttatattcatttaattgataaaattggtaaaaatagctaaaatctatttttaaatgtgaggtaggtgccaaacactagggaggcacattctccagtgagcaaagctgtagctggatttcagcatttatccaagtatggtgtgtctgaagtttcttctttctagactggagcaagtgctgaaagccaaggggataaaggtgacagggtaatggaatgggccagagggatgtgagcagaagccagccattcatgccacccggacaaggcagtggaggtttccactagccacttctgacccatgctatcatcacaggtagaaatgaaattgggccagtaagccatttcacatcatattttgaagaaggcaacttgtaagttataaattaagaaatgaaatatctccatagttaatctaccgtttaaggagtttatagaataggaattcagccatcataaaaactattgacagaattagggaaacacaagagttatcggctgttttcaagtaagttttgcctttctgcttttgaaatagatgatcaaatagatgatctgctggtccagatctaattgatagctatcatt

SEQ ID NO: 54437 - DNA, 1307 bp, Bovine  19866880374327
ataggattttccaggcaagagtactggagtgggtcgccattgccttcatacaacaaaagttgaaaaacttgtttcaattaacaccaaccaaaaaaatttttaaagactaaaatatgaaatctgataaatttagaatagtttcacaaagaaagtttacatttagttctataaaattactgtaagtgtacttcaaaactatatttttcctcaaaagcttcagttcagttcagttcagttcagtcgctcagtcatgtctgactctttgccaccccacagactgcagctcaccaggcctccctgtccatcaacaactcccagagtttactcaaactcatgtacattgagttggtgatgccatccaaccacctcatcctatgtcattcccttctcctgccctcaatctttcccagcatcagtgtcttttccaatgagtcagctcttcgcatcaggtggccaaagtattggagttttagcttcaacatcagtccttccaatgaatattcaggattgatttcctttaggatggactggttggatctccttgaagtccaagggactctcaagagtcttctcccaacaccacagttcaaaaacaaagggctttttaagaagccctcaaagcttagagctttttaaaagtgtgattgaaattattaatattgtttgcaaacatttaacagcgtatcaatgctcctttacattatttacttgtttataacctaattcatctttactaaagagtacgttatagactttatatgaaaattattataccaatatcccataaaatatgagaacattcagtatgttagctttttaaaccaacttgtatagttaattaagacaagcaagtccaattatacatagcaagagacatgagtcactttatctcaacagaggataatcttgcctcccaagggccatatggatggaggcaattgtgtctactaccggaatcgagtaggtagaagctacaaatacagctaatacagcacaagacaggcctcccaccacagagaattatctagtccgaaatgtcaatagtgctgagaatgagaaatccttaaataaggtagtgaagattgctacatatacacaagtcatcactaaaattaagatttattataccagtaatcactcaaagtttgcctttagtgcaaagaagaatgatcaaatacctaaatatacaaattcacaaagaagaaataaacattttctgtgttatttctgtttggagtacatttgagtttaaacacatttttcattaaagattcattaaatttcttttaaatgctaggcttctttta

SEQ ID NO: 54438 - DNA, 4190 bp, Bovine  19866880517809
cttctttaagaattccatggactgtatagtccacggagtcacaaagagtcggacacggctgagcgactttcactttcactcgtgtcttaatctaaaggttggcaaattacctctggtgggtcaaggccaaagtgcctcagagtgttgcttacatttttaaaaaggttggggacaaaagaaacacctgtgacctgtaaagcctaaaatgttttctcctttacagaatgagtttacctacttactcctgtcttcagccaaagtaggattgaaaagaaataggttcaagtgcaatatctaggggttttttgttgttgttgttgttgttctcatagttcgtagtgcagatcaataaaatgtttggaaacaattttttattgacacttttcttatgtataaaatcaatttttcacccaatgtcagagctgttaaatagaatataagacaaagttctcagtatctgatcaggtcctaaaccagtgctgttcaagagaatgtttgtgatgatggagatactctgtatctgctttatccagtgtgggagccagtagccacgtttggccattgagcacttgaaatgtagatagtgtgactgagggactgaatttttaaattgtatctgtgtttgggtgcatacatagttgtgtccaactctttgcagccccatggactgtagcccacgaggctcctctatccctggaattttccaggcaagaatattgggttgccatttctttctccaggggatcttcctgacccagggatagaactcacatctctggtgtctcctgccttggcaggtggattctttaccactagcaccacctgggaattattttaaagagccatatgtgactcaaggtgactgtgttggactttgcagacctaaactgtagatttcaaaaaatttctttgtaatactctcagataatgtcaatgttgatatcttacatttttattaataacactgaaatgaaatagtagtgtatttgtggttatacataatggtttatgtttatttctttattcttatatgcagacaacagaagatattcctacttggtgtaagcagtttgcaactttttgttcagagtaactggacgggccctcttgttgatttacaccctcaggattttttgccatctgttttgtttcagcagttcagtgaggtacgcttcttggaaatgtcatatgtaggtattattgtgtttattctttagaaatggatctttataagccagagttaatagtaggtaagagagaaacatgacttcgtggcttgtacagaacctactaagaatacttgttcattgatcagagtttcatgtaattcagaagttccggtgtcagtctcaaactcctcttcaaacgctcctcattttatggagctctgttagctgctctgtttattaaagaatggacagctgcaccagtcctccagctgcatattttaccacagctacacaaagatactttctgaagaagtagaaagtctggagatctgtttaattttgttgcagaaaagttttgcagctgtgcttagaacagttcctggggaggtttcctttgtgtcacagatacacttatttgtatgtacttagagtgtgtgcctcggagatgccccatggtgataatgagtcttaatatccgtgtatggagataatgttactcacctgcatccataggtcatcagtacggcttgcagtttgaacacctcagttgtgtttgagcacatgtacccagggcttgggggaatgtaacctgccctaagaagaagaatggtaactgagttatccagccacctcagaggactggagcataactgttaataactcagcctggaaaaagggcaccttaacatccagaacttacgcagtcaaaaagacctgtttactgtttcctgttttctcagaattagaaatagctgatgaaaggggaatggagttgttagaaatcagtgttaataatttgatgagaatcacaaagcagtcataatctgaagccatggcagttgtagctgtacagtcagtttactgagtcataatgttatattgtgatagaataactaagattcatagtgctggctcgaaatcattactgaaacgttaaaagcccttgcatattttatgtctaagaagggaatttaatctataccttacaaaagttttcatccaagatgattacaagtaaaatccccaagattttgacacttaaagagatgctttgattatccaggagtttatgtatatggaacatctcacttcctctttgtgtatgaaacactttctggcctctgttgctgcccagtgcagggtagaaacctaccagacaaggttgcagatacttactgagcactgatgtgtggttggagtggtgcttcattcccatgtgttgtatcagtttgacattttctgttgatgagaagacggaagctgacagtggtaagagaaacttgcagaggctttatagctgggggattggaacccatgttttctgggtccaaatccagtactctttctgctgtgctagtgtggaagcacctgtggagtcagatagcaattcagacagtgcagaaatgggttacatgagagagtcaaactgtaagaagcattgaaatgaataagacatgtgaggaaagtgatttttgtctgagaagaccttttagtcaagagtggaccttgaggtagaacctgaagggtgatgagggcaatggatcagtagagaagaggaggaaatacgttctagatgcagtcacatgagcacaaatttagaggacagagcagtaggtgtttgtgagggctgtttgaggggctgctttgagcctgttggggcagcagtaaaagatggggctcaggccacatcgtaggaaattttcattaagaccttgattttaatctttttagtataagtacatcttactctcaataaacataccagatgtgtgcagtttaaataataaaacatctttgtttccaccacctggcttgagagagggaacatcaccagccttggagaatggaactttctgactgctcttgcttaggtgttgagcccctttgccattggggtggctctgtgggcccagggctgggagagccttggaactggtctcgtctggcttagcagcctctctagctacctggtgtgcaaatcatagcatcttctgcatgtgctctgacttggaaaagcattagaaggtctcctgtgtgtgcttcttggtgacatcccccagccccctttctcatgaaacactcatgaatttgatgttaacattccattgctttcttcatagttttagcacttacatatatatgtattctcagaaaacatattgtttagttttgccactttctgaactttatataagttaaataagcagggtgacaatatacagccttgacgtactcctttcctgatttggaaccagtctgttgttccatgtccagttctaactgttccttcttgacctgcatacagatttctcaggaggcaggtcaggtggtctggtattcccatctcttgaggaattttccgcagcttgttgtgatccacacagtcaaaggctttggcatagtcaataaataagtaaataaagcttatttaacttatatgcagagtacatcaggagaaatgctggactggatgaggcacaaactagaatctcgattgccaggagaaataccaataacctcagatatgcagatgacaccacccttatggcagaaagtgaagaggaactaaaaagccttttgatgaaaatgaaagaggagagtgaaaaagttggcttaaaactcaacattcagaaaactaagatcatggcatctggttccattacttcatggcagatagatggggaaacagtggaaacagtgacagactttatctttttgggctccaaaatcactgtagatggtgactgtagctatgaaattaaaagatgcttgctccttggaaggaaagttatgaccaacctagacagtttattaaaaagcagagacattactttgccaacaaaggtccatctagtcaaggctatagtttttccagtggtcaggtatggatgtgagagttgaactataaagaaagctgagcaccaaagaattgatgcttttgaactgtggtgttggagaagacttttgagagtcccttggactgcaaggagatccaaccagtctattctaaaggaaatcagt

SEQ ID NO: 54439 - DNA, 1008 bp, Bovine  19866880608281
ttctcgaatttttttaggtttatatattgtgataataacttggttgatgaattttttgggaagttttagaaactgtaacccttcagttttttaaaacaggttgtgcttattcctttgaatattagagtatgaatcctcaaacttgagtggacccaaagaagtttatcggtgttgtacaagtaagaatgattttccttttcacagtcctggaagatactgctctttggtgcaataaacttaacatgtactggcttcctgctaatgtggtgcagttccactaatagtataggtatgtcactgttcttatttttatagttaattattaatttcacttttattgttctcatcttaaataaaggtatgtcttccttaacatggaatatattattctgaaatacaacttgaaagatttaaatgagggaatctattccaaaagtaccttgttatattctgttttggccctgtcgcttggcatgtgggatattaattctccaaccagggattgatcccctgctccctgcagtggcagtgcagagtcttaaccactagactgccagggaagtccctcaaaagtaccttgtaaactataaaatttggttcaattgttaggcattatttaaaatgagctttttcaaaagatttaaatctatttgaaaaacggaggtttctttttattttttaattgaggtatagttgatttatgttaatagtttcaggtgtacagcatagtgattcagtatttttatagattatactccactcaaaattactatagggacttcccttggtgaggaagctatagattaatacatttgtttgttttattttttagatttcatatataagtgataccatatagtatttgtctttctctggcttatttccccaagcagaatatactctaggggttatctgtgttgctgcaaatggcagatgcactcctttttatggatgaggaatcctccttcctgcctgtgtgtctgttgatggccccttgggttgcgtcca

SEQ ID NO: 54440 - DNA, 1619 bp, Bovine  19866880789221
ggaggcttggcatgctgcagtccatggggttgcaaaaagttggacatggctgagtgactgaattgaaccgaactgaaataagtcaaagaaaaataccatattatttctcttatttgtggaacctaggaaacaaatcaaacaagtcagaaacatactcatggagacaaggaacaaataggtgattgccagagggaagggtgttagggtttgggaaaaatgggtgaagggaattaagaggtgcaaacttctagttataatgtcacggggattaataactttttatggtaacagatgtttgctagacttattatgggcatcattatgcaaggagatcaaaccagtcaatcctaagggaaaaagccatgaatattcatcggaaggactgatgccaaagctgaagctccaatactttggacacctgatgcaaagaaatgagtcattgaaaaagactctgatgctggcaaagattgaaggcaggaggagaaggggacaacagaggatgagatggttggatggcatcaccgactcaatggacatgagtttgagcaaactccaggagatggtggaggacagggaagcctggcaatgctgcagtccatggggttgcaaggagtcagacacaactgaacgactgaacaacaactcacattctaccatatacttgaaataatctctaggtcaccgacaacacctaatacaatgtaattactatgcaaatagtggcaggccatgtggcaaattcaaattttgctttctggaactttctgggttttcaaatattttccacctgctattggttgaatttggatgcagaacaatggatatatcatatattacatgataaatgtataaatcaattttcacacaacaacagaatcataccacagggttcaaaagagagacttcaggaattgaattaatcagatgtgaaagagagagggcatttcagaatgaggaactggcagagaacagaggcaggaaaaggggtggggagtagtaagagggaaacagggagtaggtcatttttgcaatagtctatatttgtaagagtgtagtggtgcacaaaagttaggtaaagatgtggccagaatgtggagtttcttggaagcatttgtaaaccttacactgtaaacgatgaagtctttatatccactaggattccttagtttgaggcaacaagaaacaattgcggctaacccaagtaaaaagagaaagagaccaaaaagaaaaaacaaaatagagtgatagatggagagagaaaaagagagaccggggaaggagaaagggagtgtgagaaacagaagagaaaaacagagaaaacaaattcaatagttttgagataggttatcaagtaagtgaccagcccaggaacctcgttagttctgagcatctcaatgatatgaactgatagagcagctctttagagcactcagttcttaacttacctcctatttcagtgtgtctccatgcaagattccagtttctaggacagtatgggtaacctagggcttccctagtgtttcccgtttcccctctgtgactcgggaggcgagattctgcgcttgcagctcaggataatacggcagcagaggtagttttccaaaggaagagacgtcgag

SEQ ID NO: 54441 - DNA, 2920 bp, Bovine  19866880793756
actcacaaaagacttgagagaaagttaataactgtacattcctaaaaattaaaatacacacattttatagagtgatttaaaacacaggaaatttatcattactctaagacatttcttacaaggtttacatgcatgtttaaaaaataataatactgctactaatttgagggacttagtcaaatacattctctgaaaggaatggactaatattttttattctctagtaagagtatctctactttccatactcactaaaaataactaaataaatttaatatagcaaagtgtgctttgggtatttgggattcaccaacttgcttaattacttcaaaaatttccatatttttatatatagttattacttatttgttcactgaccaatgggaagaatgatgcaatggtaactacatcaatggtatcctgggagccaagaaataattcacctccttgttaaacaaatatccgaatactacttgtacaccaaagggcactaaataaacacttaagtctgcgaagaaacatgatactgtatctcatcaaatttgagatgccatcaattttaagactaactcttaactaataaagaaaaaatgttttcaattacattatgacataatgccttggatgaatcacatcaacttctcattgcttgatattttttaaatctactcagaaaaattgggcaatttttcctgcctccagtacactgcttgatattataaacagcaattttttttttcttttacgaatcttggtatgaaacacggcttcatctacattgcggtgtcttcccttcttggctcccataaagcctttagttattgtttttaaaaagtaagtggaattgtgattattttaccaacggcacatgtttacttcactaatgttaaattcacatctctccactctgttttggtcctttaccatttctgtttcattgccaaatcataatgaaatctttttaaatatattttaaatggcaattaaatccaatgtatgtagagctgacactgtacataactcaattgaaatgatgatactaaatatagctacaactaaaacttgtacaagcacaagcagtttgaacctggccaaatggccacctgacagccactgacagatgccatcaagtggcagatacaacccaaattcaaagatattaaaatgtggggaaaaaaatatgagtctcagaatcagtaatagcagtaaatactcacagagcaaatactcacagcaaacactcacgaggaaagagcaccattctatgtacttttcatatgttatgcacgaaaatctgtcgggtacgtagattatgtgcctccagatgaggaagctgaggcttggggttggggcgctaagaagcttgccccaatatcacaaagttaacatgtgccgaggctagcttttgaatccacaatctgggctatgcttttaaccactatgtcatgtggtcacttaagttattaatcaataactagctctgtgacttaacctgagtcattagagactcctttccttatctggaaaaggaaggaactggaatggatgattatggagtcccttcccagaaaatactataattctataatcttttataataaaatgttatcctcatggtagcctctccttaaccctataaaattcaaagactttcaccaccattactgactagtgaaaataacctaacttttactattattctaaaattcacacacttaggaaaggtattaagaaacagacatacatgtaccactatttctctttttcaggatgatggcaaaggctgactatagatacaaatgatccaatttctgggttttactctgcctgtgtaccatacttgtgatacaaatttaccacttaaaattttagtccaaaattaacaaatgatttcaatgtgtccattttaacagatatacagggtgcacagtcctttaaaaattctgttcatttatgagggaaaaaacaacagattaataacagatgcaaatattacaacattttctctcttgacccaatttaaaggatggaattaaatgtgcattacacacttgtcaactcttttgccccaaggtgggggggtggccgagggggctgtcctaacctgtggatcttctacaggtcgagctgccctccctcctaggtaaccttgcttctgacccacagcctctgatcatcaggcaacctagtgatgcttaaaatatttcctaatagttcactttgaagttgtctacagaaggagagttaataaaggaaagagacgaaaatgtgcaatgtctttaaagctttcattatttattcataaacatcaaacactgtattagttttgggccttgcttttttcctttatagtacacatgcagacataaaataatctgccccaatggaagtcagagaaaacattaaaaagatttctgatgaaaaaagtgaaaaaaggaatataagcgaactgttggcaaaagtaggtttaaaaaacaaaacaggtaggatgatggctcaaagatgaaagggtctggccagagcataaaatttcactattacataccttcccatgctgcccagctctttcatagcaaatgacaacatcttcccacatttctagcttctcaaatatctgaagggctgaattggtacatcccaactcaaagagtaaacctgcaagttggcgctagaaaaatcaaataaaaataatgaacaatccttcacacattcacacacagatttctgttccatttgtaggtatatctaatctgccattttaagcatctgcttattgcaaaaaatgcctaatatctataattcaacctctgctgaaaaaacatatatgtttcctacatgttgaaaaacatacaggaactgttcaaaatacacaatatatcaattttccccagaattcaggacttaaaaggcaaaatctgca

SEQ ID NO: 54442 - DNA, 1013 bp, Bovine  19866880795623
tgtgggtccagttttcataactgtttttgaacgaggcagtgaattactagcatgtgttaacggatcttttctttttggaacagctccactttctatcaaggaaaaaataaagtcatcatggtcagaaaattgtggctaaacattataaaagttaatataagaaccagtacaaatttgaaagctagtaatattatttttatttcagcagtatctcaaaataagacttcagtcagaatatatactaaagtgttcataatgattgttactgggtgtggacaagattatgagtatttagccttttccttttcctggtgtataattttaagaaatacatatttgtcataaaaagaaataactatttgtgggggcaggaggaggatacaaaaaaggtaccaaaaaaataaggctgccaaattttttttcttttttgttttgttttatttaaaagctgcaaaaaattaaagaaacaaaatgtagtaaaggcactaggggtaggctgtatgggggtgggggcgggaacaaaccagcacatcattccaaacttttcagactacaaaacagtaggaaaatccaatctgtgccaccagaagagttttaaaaggtaattttaatttaaagagtataaagatgtggttaatatgccaagtatttcgtgctgtatctatgttaccaggtggctcagtggtaaagaatccacctgccaatgcaaggagacacaggagatgggggttcgatccctgggtcgggaagactactcattcagtattcctgcctagagaatcctatggtcaacggaccctagcaagctaaagtccaagggtggcaaagagtcagacatgactgggcatgcatgcacgcacatataaataaacaagtataagatattttctaataagtctaaaaggtcacatgacctacctactctgctcttctacataaattatacactttaaatgttcaaatctcactgcttctaaataatattttcatatactatataacaaacatcagag

SEQ ID NO: 54443 - DNA, 2497 bp, Bovine  19866880841618
agtttcttcatgtttctgttccctgtaatcaaaaatcagcctcaggattgagagaggaagaacctgacggcagaaacacaatggtgttacttaccaaaccactcacagttttcaggagttactgtgagggactgacttactcagcacagccttggtcagttgagtgctgtctccactcagaaaacagtagtgccaggcatctgtctttgccactcacctttctttacttgctgtatcgttggttccaggtaccttttcactagtgcctaaagatactatccatgttttctgatacataccattaagtctgatttgtgttaaaattttttatgttttcttataaatagaaaaattgattcctatccctgccccccaaaaatgcataataaaaatataaatgaggtataataaaaatcatttcatatgacaataaaccttaaaaatgagatttaaaagaacaatcacttgtcaaaggaactttgatttgatgaaatttcggtagtaaattctatactgagtgtattcaatgtttcaaaattactcaaaggtcagaagaaacttctcaacttcacaagcagacaacgtctttgctgctgtgagaacagcagatgtgtgaagttgatccggtttattagagatggcccaagttttcccctggttttgccttcctgtttttaaaaggtgcagcttatctcagatctgtgcttacaagttatcattttgtattcaccatatgctcaaatcacaaagttgggattcattttctggttttattatagtatacttaaccagaggtcgactttactttgagaaagcaaagaacaagtctattataactgagcaaagtagatgaaatagcaatgttgactttattcaaggggagagattggaacttaataaagtttaaatgtaagaattagttaagaaattattagtacttccttaagaattactagtataggtaacaggttaaggacttaagattccaggtggcgtgatatgtctgatggtgctttaaatgataattcacaaagctgttcatatgcacatcctttaaaattattagtgaatttactaaatgaattaatgtattttgcattgttattctcacagagcattgagagaataccaaggaaataccaataaaagctgcttttttaaagactgctttaaatgggcaaatttgttgcccattacataaaattgttagtttacaagtacatataatgtgtcccaggttctctttctcctcgagtaaatgttggcctgtgtttggcggatgctttgagttcattcttgctctatgagtgaacaagtgactagtgtcttcaagtttgttctgaggcactctggggatcctcaagatcatgtcaaggcatctgcagggtcctcccttttcctacttcatgcttgtgtgagaccagattttagtcatgcatttcaaccaaaacaatatattacaacaaatggaatgtagaggcagatttaagtcaatatcttttttattaagctatatcccatttcaaaaattttagagattttcttaaatataaaataataccacttttcctcaccaagaattttgttgttgatgatgacgtttggaaaagagtcttcattaaaaacatatgttgcttgtattaatctataatagctgctaattcatttttcactaatgaagaaattgtaatgccacataaatttagatcacatctgaagataaaaatttgttttaacagacctaaccttagggttttgttgggggactcagatacttggacataataacatttcaattttattcctagttctgggtgtttacttttaaaaagcactcctttcaactctgtttataactttccccccttctttctcaggtttgtttaagcatcttaaatacatggcatggaagaccagaagagaagtggaatcctcagacctcaagctttttgcaagtaaacaaatttctcttacagtttcacttagaaaataaagaaccatatatgtttaagaactttttttttagtgaccaagaataaacaaaccataaaaaataaaaatgcagattgatagaaagtacatatgaaatagcttataggtaagcaattcgtacaatggaattatatctcatttggagttgagattcttaagttaagacattaaaaatttctttttgtcaaaattccctgttaaaaaaatccctgacttgccttaaagtacactcaggtgcaacaggatcagataagttagattagcctctcccatctcccagtcagtccctactggttcaaactcaggtgagtagaatttaataactactagtattatgtaggagaaggcaatggcaccccactccagtactcttgcctggaaaatcccttggacggaggagcctggtgggctgcagtccatggggtcgcaaagagtcagacacgactgagcgacttcactttcacttttcactttcatgcatggagaaggaaaggaagcccactcc

SEQ ID NO: 54444 - DNA, 1464 bp, Bovine  19866880867700
ctagcgctgtaaacagtgagtggcttgctctgagccaggtttccaaaaggttttgatatcgaagaagctgttccttgttacaggcttttagtgaaagcagagtactgtagtgtcagaaaaaagagaacaaatggtgacttaattttgaaaggaacagctggcatatgattacagctgaatttgcactattttttaagtttcacgacagttatttttatcagtataatgacttctaagtattttcaataaaattctgttttagtataaaacttttgcccatggttgatttgatttcatctaaatgaatattccaagaattccattcaaaatttctaaattgaaatattgaatgaatagggttagtttatacatactattttacactaaaatgtaaagatttctgtttctggatgaaagcaagggtaccacattcttcagatttctttaacatttttttttttagtctttttatatgccaggcgctattttcttggctttgcatgtgtaatctgtttaatcctcacaattaccccctgaggtgaagatactgttgggcttccctgatagctcagctggtaaagaatcctcctgcaacacgggagacctgggttcgatccctggattgggaacattccctggagaagggaaaggctacctacgccagtactctggcctggagaattcagggtcgcaaagagtaacacgactgagcgactttcactcactcaatgacaaatttttatggaaaatgataaatgaaattataacattttgaaaatccctcctttcatttctaactccagtttgctgagatcttttccctctaactactcatttgcattgttcattagtataaaaaaaagcagtctgcagttcacgtgtagtgtctccactactaactccacaaactgttctagtttttcagtttcattgaaatctatttcctttgtgggcccttggactggaaagtaggatataaggaaggaggcaggtattcatgggcttggagtgaaaggacagagaggaggcttcagaaagttgaagaaaggagacacatttaagaaaagaatactgtgtgtttttggagggaaattttttattaactactttatttaccacctttaaggaagatccaagatcacctgaggaggatgaagaagcatatactattatccctttctagagaagcactattttattgcactattttattataatagagtcctttgaagtttactaatctaggtcaaaagttgaatagagggatatatttgaaggtagatcatttgttgcatttgaaaagagaatgccagtacacacaaggaaattttgttaacactgggtgatgggagttgggaggtagcaagagagatcaacgaaaacttaggctttaaaaaaaggtcctagactcttaaaattaaagagaaatcagttccatgtgaagggtaagtgatgaaagtggaa

SEQ ID NO: 54445 - DNA, 1344 bp, Bovine  19866880871943
cctcaatgatttttttcatatctgcttaacctaataccagctttttctgttctcttattacccttttgtcaagtcattcaaattcttcaggccttaaaaaaatgtcttccaccaatgtgttttcataatacctgaatgctatgaataaaactaaggcttcacatactatctgttatattccacctttacacacagttgcatttgtgtcttacttctacagtctataactgagtagtgacctatagatatgaatatacagcacagtttaaaaaaaaaaatccttgtgcatgaaaagaattccccgccctattctcaaacaatgtgtcataaacaaccgatttacatataaaacatctaaacatccctttaatagtataatcctaataattttttaaaattcctaattttatggaaattcttatctgtatttacatatgatatgtagctgcttcataaagtcttgttaacttggaaaacaagaagaaaataatttatcttacactttgattttctttcatttaaaaaattttctgtgcttcaagcttatggagattacaactcacaaaaatctaggaatttctgtatcttggcataaatgtcatttgcagttaatagaaacattttataacagtaaatggaatgacatactaaataccactaaaactacaataacccttcacagacttccttctcattaacttcacttatatatatgttattcctggtaaaggtaacgaatatcttacatatattacatatagctggactctccaggccaaagtcagttctggaaaaattgcatattcattcaaaatccccaccagcagattattataaacgtctgatacctgtcataaacctctccctgtctttaccattcaaaggtttctttgcagctgctgcttcatcttccacagttgccacataatccagcaacctggacacgagcataacaacccaactgatcatggggatatctagtactcctgtacagaaatgaaagggggagaaacagtcatgtgaccctaagaatcctaatgaagtctggtaaaataattataaaattaagatattttataactccaaaatacaccatataactatcaatactaatatttatttatattaagcctcaaaattgaaacctgtggccacaaattgaataacacatcaaatctaatggaagatttaacaaatctttcatggtacaaaaacgattcataagtataatttgaaatctaataggtaataacttacagaaaacaaggtataagaaactattcttagacttaaagggggctgaaatttttttaaaaaggtctcaatttataagtcatatagttt

SEQ ID NO: 54446 - DNA, 2609 bp, Bovine  19866880873527
gaaacagtgaaacagtggctgactttatttttctgtgttccaaatcctgcagatggcaactgcagccatgaaattaaaagacgcttactccttgggaaaaaagttatgaccaacctagatagcatattcaaaagcagaaacattactttgtcaacaaaggtccatctagtcgaggctatgatttttccagtatggatgtgagagttggactgtgaagaaagctgagcgacgaagaattgatgcttttgaactgtggagttggagaagacgcttgagaatgccttggactgcaaggagatccaaccagtccatcctaaaggagatcagtcctgaatattcattggaaggactgatgctgaagctgaaactccaatactttggccacctgatgcgaagagctgattcatttgaaaagaccctgacgctgggaaagattgagggcaggagaaggggatgacaggatgagatggttggatggcatcaccaactcaatggacatgggtttgggtgaactccagcagttggtgatggacagggaggcctggtgtattgcagttcatggggtcacagagtcggacacgactgaacaactgaactgaactgaactgaatcagacaaaattcaagttgagggtaattgtacagaataactggcttataaatttccaaagtgtcaagatcataaaagtcaagcaaaaatgaagaactattccaaactgacagaaagaatacaaacataaatgtaacacatatgttccagactggatcctgtgctataaaggagattactgggacaactggcaaaacttgaatggggtctgagtacaatgtgatagtaaagcatgagtgctaatttcctgattttgataaatgtatcatggttatgcacagaagctcccttgtttgttgaagacacacactaaagtatttagcggtgacagaatgtcatgtcaaaaaatcattctcaaaagtctttgcaatgccttgcccttgcaacttttgcccaaatttgaaatcactttaaaacataaaatgaaaaacgatttctactacacataaggttctactatattaaaaattctatcctctgaatatacatgtcctcaaagatcaaagtagtcacctctcctaaatatttcattaggattctattcaggtggcctttcccttctccaggggatcttcccaacccagggatggaacccaggtctcctgctttgcaggcacattctttaccagctgagccacaagggaagcccagccaaggctaacagaaggaattttctttaccaagcaaagagacgggtaagtataccaacttacaggagagtcctaatctctaaccctttcattggttgcccaactcttctctatcttcataaccgttacaagactcattcacccagaactctggggaccttttgaacaaagatttccgcaacacaagagaatcaatacgcaagaaattcaaggtggccaaataagtcattaacttaccagattccaaggataacagcaagctcttcagcacatagatcaggcatctgaaactgttcacaatctgctaactttatctcatttagaacggtatcatcattgagctcaagattctggtggaataccaaagaaaatatttaaaacaaaaactaagtttgatttattcaatagactatatgcaacagactgctgggtaggataacatttttttgtttaagattttacagtgtctatacatggtcaataggctgttctccttgtgaaacacatatatgggaacaatttactgtgcagaaatggaggacatgccatctatatatgccaggaatgcactgacatcatcaataacagggagtaactgctactccctgtttgattgagcctagtaggcaaaagctcctctctgatatttcagatctttctaaatcggtttctaaatcataatctgaaacatagattcccaactctgtttctcaagaagatctagaatagaagaaaaaaaagccaattgaaatagaaataaagcctgaagaattacagaacttggtagagtacgtgatttcaagaacagctacaaagccaacacagtgttgtactaacacgaagacagaaatatagatgaaaggaagagaacagagtccaaaatttcagacccatattatatggtcaactgattttcaacaaggtggctagatgactcaacaaagcaaagttttttcaataagtgatgttagaagaactttatattcacttgggaaaaaataatgctctgcccagatctcataccatacacaagaattaaatcaaaatgaatcacagaccttactataaaagctgatactaaaaaacttctaagaaagaaatcataggagaaaagacttgcaactttggggtaggcagagtctttaattaggatacaaaaaaaacttgaaccatcaaataaaaacttcagctctttgaaaacactgttaagaaagtgaaaagtcaagctacagattgagaaaacatactcaccaaacaaatatctgggaaaaggcttgtaatcaaagtatggaattacagcttaataagaagataaaaaaactcaacataaatataactttacaaaagacc

SEQ ID NO: 54447 - DNA, 1065 bp, Bovine  19866881046309
aaattatttttgtgaaacaataaaagaagatgattttccccaccccctagtctgtaaagtatatagaccattattagtaatttgttaacgttgagtaaaaggaattttggctttggaatcagaccggagacccttaggccagtgaattactctgaatatcagtttcctcatttataaagtggacttgagttggcaagcaattactgggtttcttttgagtacactcatgcgccttgccttctagaaggttattcactagtatgacttgtcaatcagaacaagtaataagtgcactagtcagaagataggatctgggaactgtctaaagcaagacttcaagtttcctttttcatcaatgcctcagattttctattaagtgattcttaacagatagaaaaaggtacttttattttctagtaaaaaaaaatagatcatgctttctttctttgcttcacactcccccttctcccatgtgaagattttcgattaaagagttagtttatagatctgatttttaagagctgagcatcataagttgtatttttttaattaatcatttatttattgacaaacaacccttggtggtttagtcactaagttgtgtctgactcttgtgaccccatggactgtagcctgccaggctcctctgtccatgggattctccaggcaagaatactggagtggtttgccgtttccttctccatatatgtttttttaacaggggcagtctgtttgactggatctatcttaatttccatgtctagaaaaggaaagaatatgttgccagacctgactcacttactgctgacagcagataaggacagataattggaatatagactgacttcattagcttagtgatagcaaaagaatgaaaatgaggcaacaactcagggaattacattaaaaatgatgtgaaacttctttctattagataattctacctttcgtttccttacatggcctgaggaaatagcattagtaattagaaaagatttttttttttcatttgtgattttatcattgttgcaacagttgtgtgtagcagtttagaagggaaacagg

SEQ ID NO: 54448 - DNA, 876 bp, Bovine  19866881141241
aaaactgaaggagttcatttttggcaaagactcctcattgtaatgttggtggttaccgcacccaaggctccccacttaattggaaacagtggaatgtaatttagttatggttgtttctctagctgttaatttagctgatttgaatgccattaagattttaatggaaacaattcctggctaattaagcagaacttccatctgctggtagctgattacaggtaggatgtgcacagaattcactcttccatgcttcttaaagcaagctctgcaaagacactcagccccagctccgaatacatttggcatctaaaaactctggtgtttgtaatcaaaaccagagtctgttcagtgaccaaacactaaaactgctaggtttcgtttttctcgatgaatttccagtgacagaatattgaaaatgttttgtttattggctcttcccaggagatctgctgctcagataaggttaaagctttataactttgtttaaaaggagaaattagcatctgaagaaaatgtctttaaaaaaaaaagtcaatactttccacttcattattttaataagacttcaaatctgatattgtgtgctcactcttgtggactgattgtggttttctaagttttctgcaggaaggttcaagctgatcaggcatccccctgctgtgaaacctttacaagacaggaacagcgatccatctcagtcatttctccagatcaggaaccaacctcagcccagttctgagggaagagacctgaaccccagctgttcctgctttgggcacatctaggtgcttctttcccccttctatagatgactctgtgccatggaactctaaaaccaaactttcttctacagggtcatggtaaagtaataatttt

SEQ ID NO: 54449 - DNA, 816 bp, Bovine  19866881183314
atgccgattctaatgattggtggggaggaaagagagagacataggaaaaaatgtctgggagagctgggaattgtgaaggaaagggtcattctgtagcataagcatggtaattggaaggacattcagttctactcttgaacaaagatgcctcaggccatatacatttcttgccaatttcctttcaacctcaactaataacttttcatctttaaactctgtctgagctagttggcatagtgtaaaagcattttctgtttgtgtttggtatagttagatttccatgaagctttttgccctcatcattttgtttataaatttctgcccaacatgaacctttcttaataggctacctgggaaatgtgtttggtgttcagtcacaaagtcgtgtctgactctttgagacccagcggactgcagcatgccagatttccctgtccttcgctatctcctagagttggctcaaactcatgtcattgagtcggtgatgccatccaaccatctcatcctccgttgcctccttctcttcctgccctcaccttttcccagcaaaaggtgagaggtagcaatattcatcagtagctgcactttttacttggtagaatttatcttccagtggtgaactctagctgtacaacggaagcatgtttacccctgaaactggacatggaagcaggatcttaacgatcccagaatggaacgccagcctggcataacaagggatgtgcagtggagatgaccctggcattagagccgcaaagactaggacttgactccaggttgtaacacaaggacaatagtgactaaggactgactgaa

SEQ ID NO: 54450 - DNA, 2740 bp, Bovine  19866881280227
cagcagcagccttttcaagatgtgaatacataaatttgtaaaagcaaacttatctctctgaatcaggttgttactcttaaaatactggtgtgtatacatggtattcttaagtaccctagaagtggaaaaaatgctgctttgagtttttggtttgtgtttttttgccatcagtatagttctgatttttttttaaattattttttaacagagtaaaatggagcaggtattgtgtacttgcagatgtttaacattttattttgtaaataacagtgtaaaagacgattattcatgtcagtcagggcttacatttcagcatcactccttttgttgtccttgttaatctggagctcattaaatctcagtcagggctcttctgaggttgattttggatttctccaataataagttccttttctataatttgaaatatctgaggtggatttttcttatgcctgtatggactccgtgctagttactttagcctacattattaacttaggctatttgacaaatgttgtaattgattagacaaaaacatggattaaaattcctttcttttaaaaccaatttcaaattctgcattcactgttattaaggagttgatttattggtggaccagccattcaccgttgacatcttgacatctctagtggagctaacccgctttgaaactctgactccacggttttcagctactgttccaccatgctgggtggaggttcaacaagaacagcagcaaaggaggcatcctcaacatttgcatcagcagcatcacggggatgctgctcagcatactagaacttggaaactacagactgacaggtaaaacattcttccaaggtatttaaattcagtttaattttataacttaagttcatcttatagtaacaacatagaattattattatatgttactctttctgttaacttttacatgttaacagttttgtttgtttcatttgtcaccttggttttagaaattcctatattcttttttttaaaaaaatatttatttttggctgtgctgggtcttcgttgctgcgtggactttctagttgcagctaggggctactctgtagttgtggtgtgtgggcttctcgttgcgatggcttttcttgttgtagttcatggactttagggtgtgtgggtgtctgtagttgtggtacatgatctcagtagttgtgattcccaaactttaggttacagattcaatagttttgacgcatggaattagtttctccatggcatggtgggatcttccttgattagggattgaaccagtgcctcttgctttaccactgaacccatcgaggaagcctggaaattcctgtatgcttgttcttagttgtaggataaaatcctgagagtaatccagccttccagttagttagttaaatagatctgtagattgtgtgactaaatatttaaatgtctgttttgtacaggtacttttgttgttgttgttattgaagtgtagttggtttacaatgtgttaagtttcagcggtacagcagagtgaatcagttatacatatacccactctctttttaaagattcttttcccatataggacattacagagtattgtgtagagttccctgtgctatatggctacatagtagtgtgtacatgttaatcccagtctcccagttgtgcaggtactttggaagttactagtaaaatggctcttaggaaatttacattctagtggtgatagacaggcagttaagacagatatctactatgtcatatagtcataaaagctttgaaacacattaaaatagaatggcaatagagttgttgggtgtacatctctgtgagagaaaatgtgtgtgatatttttatataaggggtctcagaaaggcttccatgaggacattaatttggagacaataaaaagtacagagatcctgaggagtatatgttatgaattttaggaggagcatggaggctactggttaagtgcaatgaacatggaggagagtgataggaagtgagatcaaaggaaatagttgatcatgaatgtctttataggccacagtgagacttttacattgagtgagatgggaaaggtgttagatagttttgaatttaggagtgatgcgatataatttatgtattagaaggatatactaagactactgtgttgatagtatatgagtggttgtggtgtgtgtattagagggaagaggcaggagcaagaattctaacttgaatgctgttgtggtaattcagataatcatggtggtggtgatggtgaattggaccatgatgataattgacagaggcattgagaatcgtggtcagatacagcttggaggtagaaagaatcgtaaatgctgatgtacggagtgtctggtgtgagtaagagttgttagggatgactaatgttttggactgagcacgttaaaaaatggaatttctttttacagcttttagagttggttatcaagtagtttggggttatttatgttaaatttgagatacctaataggcatttggatttgaatctgaaatttagtggaggaattttacttttcagcacatatacagaatttaaaatcagaggatggacatgtataagaaatacaaaatgttcttattttaaaatacaaattcctgtgaccccactcttagaatcagagtgggcccataagtctgcacataattctgatgcacagtagttcacacttagaggaacaagggtttttttgagtgtacagtgcccaaggtaggtatg

SEQ ID NO: 54451 - DNA, 1338 bp, Bovine  19866881293121
atgaaattaaataataaagatagccaacagcatttttaacttcttcctgatattaatgggaacttttaaaataaacataatagagtctggtttgttcatgttttttttgtaattttaaataagatgatacaataatatttcattaaaagtttttctcagaaagcaacattggcttttatgaagtatctcatagtatgctgaaacgattcataaatatgatatatagtatatgatattgaagtattcatggattttaagaatcaacccattatggtcacagtttattctttttaatctattgcttgactttggtaataaattttatttaggattttgatacgagattaatatttttcttttttaagatatctttatcaagtaggtttcaaataaaattactagtagctttaattccttacctttattctagaataatttaaagagcttcaggtaaatttcaggtagaaggtttataactactaatctatgaacccattagtccattaacaatagaagaagcttaggatctgggagagccataatgaaaagaaaacaatcaggaaacatatcaataaatctttccctcttaattcttgatatcatcctgcttgtctatccccagataaactcccaacaaatgataagagaaactttatttggaggattacctattgcttctattaatacatcaggaatatatgttaatgacattgaagtttacctttctgttgaaagtatatgaattagcttgagcaaaaattcactgaatatctgaggacatgttgaagaaagatgcacttgcaatcgggtaagaaattcttgcatagcttgcgtagctgttggaccaacctgaagaaaaatgtaattctactgaaaactgcttagtgattccatttactgaattattcatttaaaagtatcaagtgttaagagccatatggttgaaacttctcatttgaaaaacaagataatatgaaaccaactaagcttttaggtcctgatatgtttcaaactgaaaattacagattctatggtcaatatttttccattacgtcagacttatttagttcaatatagaaaaagactcacctaaattacacaaaaaatatctctacaatgctttcaaaagcacaaaaactgtgatttttcacaatcttaattatcccatttcaacagacaggctaagtgatccacaaaaggtcatgcttctgatgactacaagagcaaatactaaaatgaatggagggaaaaaactctccaaactagaaccatagagctaaaaataaacctgtagcaatctgcaaaagaaaaataaaaaagcttttcaaacttctatct

SEQ ID NO: 54452 - DNA, 1452 bp, Bovine  19866881414595
acaaaagcccacctgggtctgaatctcctggctccttttctttctttacctgaatagctgtcagtttatgtcttatattcactaagataattcttgctaataacagcaggataggctttgtggtcaggctgtagattgattcaccatctagaacgagcagactcagaagaaacgcatccagcgctttgatctgaaaaaaaaaaaaaaaatatatatatatatataagttcaaataatttagaaaaaagttaacctttgtatgtcttaaaaggatacataattcccagttactcagttctgaaacacaatcatttatctattacacagcaactggcactggaccaagtcctaatattataaatgcctttagagatctacaactccagcctgccctgatcaatgaccacccatctgcttatattttagaggaacagaacaatcaagaaaatgctactattgaagaggcaccattatcttacagacttacttacaacaaagtgttttctcagtaaagccatctctatgtgaaagtattcatattaaacacctacatttcatatacgcttcaccagtcagctaatgtcgttacaaaccacagctgccccttaattactctcaggccaaagaacaacaaagtcttgcatatcagatgctgagtaggcatacaatcacggaccgacgtgaacagagcctgcccaacaggaaggtctctgaaaaacccagttctcaactgaacagattttctacactggaccagacactcatgtttttaaaatgtgggctgaataattttgacagttgccacaaaatcaacagcaggaatgctcaacatcaggaaaacaggctctaagtcaccgacacaggatggagtccttttactgtttattagtttgtgggcataggcagatttcttttaactgagcctcagcttcctcaattataaaatcaaataacagaacctacacctcacacgtttcttgtaaggattaaataatccaagtgatgccagtgccaggctcaatgctttatgtgaaagtgaagtcgctcagtcatgtctgactcttcgcaaccccgtggactgtagaccgccaggctcctccgcccatgggattctccaggcaagaatactggactgggttgccatttccttctccagggaatcttcccgacccagggattgaacccaggtctcccacattgtgggcagacactttaacctctaagccaccagggaaatccctgctttataaaaacattaaataaaggtacagaaggaacagccccttcatcatcactgaaaagtgtacttgaggaataaagacaatgtgaatgaccaccagcaaaccaccaataaagcttactgttaacctacactgagggtagaatgaattttttttttcaagttcaataatcaaggaactattctgaagtattacaactgcctcaatctca

SEQ ID NO: 54453 - DNA, 808 bp, Bovine  19866881531933
cttgccgtgaagggtctagtaagaagatttttgtgatactgtgaaagtcattttccttggaattgaaatacagactgcctcatgtagttttccttacgagtgagtattgttacgagtacattgttagtgttatgctctttaaggacaatttgagcaaaatgatgtctaaattgatatgagatgtttataagcaagtgttttttcaggagttttaggaaataggatattgaaacctatgattctttttcaaggattcaagaatgtaaaacatatgatatataaaaattatataagattctgttgtacctttgctttaatgaagtatttcggtgtcagttattaacatcgacttcatggtaataaaattatatggaagcatttactcaaagggactccagttgatgaaggaaggtattagttcaccggcagtaaaatgtcctgtcgtaactggtttttgtttctttgtttgtcaggtgttggtgtctgttcagtcccttatattagtagcggagccttattttaatgaaccaggatatgaacggtctagaggcactcccagtggcacacagagttctcgggaatatgacggaaacattcgacaagcaacggttaagtgggcaatgctagaacaaatcagaaacccttcaccatgttttaaagaagtatgtttaataaaattaatgaaatacttttttaaagacactatataatatagtttattagtatcatgcttgcgtttatacttagtgtatctgtgctgtatttactattgtctttatcattaaaaatcagtagtagtaagtacaga

SEQ ID NO: 54454 - DNA, 1037 bp, Bovine  19866880451697
ggagtgcgggcagttgaaggaggtagctagaatgtggtacaaatcctgactcttggccgtgaccctagatagaacactgagcctccctgagactcggttcagcctcagcaaagcaggaataatgaacctggccacacagagctgctgggaggatgaaatgcactaatgaaagcagctaactggggccagcccagctccagcgaacgtaagagccctccctccccaacctcgctgatgagaagagcacgtccaaagcaaagcagaaacttaattaggattggaaaaatgtgaattccaaggcttattaaattcatgatatttttacttaccatgtacccagaaatatatttagcaaagcaatttacaccatcactggctgatggattgtggttttccaagttgagttttaagatgtaaatgggctccaatcagggcttggctgtgagaagatgctcccctcccatcctgtcctggccctttgggctccagcctcacctgggcagcctcctggggtggacagatggccctgagctcctacctcccagggaggctctgctgggaacgtctctgcctggcgggagagggaaggggtggggagcaaagaggcaatataataacagtgataacaaccatttatcaagcacttaccgtgtgccagatactgtgagcttcaccacgggtaactcactcacccctcccagcaaccccaggagataaagagcacctaggcacctcttctgagcagctgtgtgactttgggcatatggtctgacccctctctctttctctgcctcagtttcctcatctgcaaagtgagataataagagctatatgtgataagcgctaagcacaattcctggaaattagtcaactctcaacatgagatatcagtgagtctatgaagcgacaaatctcttgctcaagatcaaacagctggcaagcatagaatcgggattcagcatcaggtgcacagactctgaagctctaaactgtaggtggggatggccccacagtatacggtacccaggccaagcctc

SEQ ID NO: 54455 - DNA, 1243 bp, Bovine  19866880452327
ccgccctgcctgctgtctaggctgcattcccccagattcttagttaaaaagatgctaatgcttttcttccatcatttcaacttctcccatcatttcaacagatgcctgcagggcaaaggcccccaagcctccctccccccatccaccccctaaccaccccgcaggttttattctgcctcccaccccactccccacccgtgacagcaaaggctggtgtgagactactgggccagcgagaagccctgaagcgatcgctggcccacccacccctttaagaacgcgagcccccttccccaacttctagcctggtgacttcagaccaggggctgaatctcatcaacaagaaatttgaagccattaaaatacaataaaatagaaattaaatataatcgctccgtaaattataactaattgaaacatcaattgtaatttttatgatccgcattctgagtgagtgatgcctggagttacaaaatgaaagttaaatgacggtgatggtggaggtgtcctggaatgccccccgccccccagattccaccccctccatcagccgacatccttcccttctctgccagactccaccccaaagtgctatcttctagaagcttcccccagggagcctcaagatctcacatccatggaggtctcagcttgctcttgttggcagtgttttctgtatacggcccctgtatgctcttttgtttccctgaaacccaagaagacctgggtctcctccatctttcctgctcccccatggttggaccagaatgtcaggtccacccaacacacgtctggcagtcagatcgcaagcatgagagtgccagaaagcccagattctgtgatgctcccagaccttcctcatgtcagccacactatgttagactcatcttgtccattcccctgcctctctctcagctgggcactggggttccacagcaccagggccagctttccaactgctgatctacccaagcagtgctgtgatggggaaaatcacaccagcgagggggccctgctacgttcggtgtctcctcccgcctccctctttgcctccacaggttcatccctctccatctgctgctccatccactccatccaggcacctggagggcacagggggtgcagggtgaagacaagcagatctgcattcaaagctcctccacaaagtagcaatgaggccgcggacaagccacctagcttctctcaaaggctccttttgttcaatagtaacttcaagacaata

SEQ ID NO: 54456 - DNA, 1344 bp, Bovine  19866880481362
aaaacaatgcctctgttctcgctcctggcttggccttgggaagcaccaagaaggaaagcaaagctgttaacaatatgatctgggctaaagaggctatttttgtcttcctaggcttacctcgtgctcttaagaccccttgtgtcccctaggagctggccgtctcgtggcagttgtctcttaacagagggagggataagcagcctgtagttaccagagtctgcagtccttgggggcgagcgctgggaggtggaggggcggggacgcaggcgcagccctgctgtgtagttcagcaatgtgctggcggccagggtgatgctcactgggtgtgcacgcttttccacgaggctcactcttgtccatgaaaaataaacccttagggcaacctgctgtcatccgtgcttctgtccccatcctctgttctccaagccattgctcctacccttcctgggtgtagaaaagttgccaaaccacaggaaagagtgaaaaatattgctccctgcaagtctgatggagaatgagctgtactggggctgagaagtaggcagttgggacggtggtaccgtctccaacaaacaacacctgcggatgcaaagtggcctcgtagttaaccttaacctcatcgccctcacccccgtcccagctgctccagggcctgaggccacccaggcacatgcttctaggctgccacagagctcttggccctaaatctcgggggacagcagcctggacccacctgtctggttccttaaagccctggagttgggggaggaaggacagatgcatatctggtcctaatagtcatctggagtgaccgtactaatgtctaagcctcatctcagacatgtagaccagtgtttacaggaagggggctgggaatctctatgttttgaagggacattccagatttgagaaatgttggttgtgagattaagagccctcactttaagttggtggttctcatccttggctgcatgctgagagattatgatttaattagtctgcagttcagcctgagcatcatggttttttccagagccctccaggtgtttctaagtgtgtagccaaggttgagaagcactactgtattttcgtttgtttgttttggctgtgggatctcagatcagggactgaatcctgcccaccctgctgcgatccattttgagtcatctttttgtatggctcgaggtagaacctggggtcatgcttttgcctgtgaatgtacagcatccccagcatcatctttttaaaagatcatcctctccgcattgtgttcttagcaccttcattgaaaatcaattgaccatagatataaaggtttatttctgagctctcaattccattcca

SEQ ID NO: 54457 - DNA, 1330 bp, Bovine  19866880482580
ttagtggcattaagaacattcacgatgttgtgcaatcctgagcactatccagttctggaaatttctcaataccccaaatggagatccacactcactgagctctcactctcacttccttttcctttataagccatttctcacgaaacctagatgtctcaacagggcggagtcactggccttggagaccccagcgtggcatggaatttatggctgttgtcttgtttaggaagttcctgtgaacaagactgctctggccccagtgacagcagctcaccctgggaaagcaggacagtcaatgtgtttgaactggaagttattggaaacactcatcatgtgttttggccaaatcagtgtgattttcatgccgctgatttaggaatatgacaacagggtcatcccctcagtctaatcttctccgggcagttgttgacataatcaggagctgatcacctactttggacagaccaggagaaatcttgggttttgaacagcaacacgacactcagttctcttatcttagaggcacctgtgaccagaacgttctatgggaccatttctttttcacgagctgggcgggtcctgtaggtatgaatccctagccccctcagatgcctctcccagctgttgttgttgttcagtcgctcagtcgtgtctgactctctgcgaccccatggactgcagcatgccaggcctccctgtccctcaccatctcccggagtttttccaagttcacattcactgcatccgtgatgctgtccagccatgtcatcctctgacgccctgttctcctgccctcagtctttcccagcgtcagggacttttccagtgagtcgtctgttcatatcagatgaccaaaatactggagcttcagcttcagcatcagtccttccagtgaatattcagggttgatctcccttaagattgactggtttgatctccttgctgtccaagggactttcaggagtcttctccagcaccacagttcaaaagctgcaccaaatgcctaaaacaactctagcaagagtcttagaggggaggccagagagaggagatcttgatttgcattcgcctggcccagggagtggttggtactggggcttgtcctgaccctgggcaccaagctgggactgggggtgattctgccctcacacatcccgcatccgcactggtccactggcttcccatgggaatggagtcacgcagtcccacttaccagccctgacccacaaccctgccagaccacacctccactggcctgacccttggctcagggacccacctcatgttccgacatgctggtggagcactggatgcccgtgtccaccggggt

SEQ ID NO: 54458 - DNA, 1525 bp, Bovine  19866880535516
ggaggcttgcctggattgtgcagtggccccggggacccaggcgagttgatggcggctctaggtcaggggtctacggggtcagcctggagcctgactgcctctcttccccaacttctctacgcctgctttctcatctgggagatgcagatactaatcagacttgccttacaggtcgggggaaagtgagggaaaatgtggaactcagggacttcccctgcagtccagtggttaagactccgtgcttccactgcagggatcatgggttcaatccctaatcagggaacgaagtcctacaaaccgtttgttgtcgccagaaaaagaaaaagcatggaactcagggcagcgcctggggcatggaaataaaattcagcatctttgtttttcttttgtctttttctggttgagccatgcggctcacaggaatcttagttcccggactagggaacgaacccgaccccagctgtgaaagcgccaagtcctaacggctgggccgcaggtgatttcctcagtctcctcattactggctccctgattggccttcagcacatccacgagggcagcaatggtgtgaatggatgggggaaaaaaaaagaataaagggataaagggaagggagtggggagagagagagaacccacaacttccagaacctgaccaacggcggaaatgtgcccatgtgtttcaaggcatcctttccagggatgtagcccccacagaacaagcctggacacgtcaagatgaaggaagaggggagatggggcacccaacccctgacatctcaaaaccaagccttcgctgcacagtgagcaaaattcaacatgaaatgtgtgtttagcacaaggactgatgtcgagctcagctactttggaaaaccagacagagacaatcgttttcgcttgttatttctttcttttgctgtcacttcaaagccatttgattggtctgtgttcaagaaatgttttttaatctcccatattatggcttctctatatgttcttgtcattgtaaattacattgtgagtccctgagccaattttttttttttttttttgctgatgtcaattaaaaattccctgcacgggcctctgctgcgttctacctgcacgctgctcccatttctgcggctgcctcacttctgcctctgttttctccccaaatccggcttcctggaacctgcagaagcatcagcttcgctcagctccttaccctggggaccgctgggacagctccaccatagctgcgggggcggggcagcccgccgtaagcaagccctggtccccaggccgccccaggagaagtgtgactcccagaggcccttcggcccctgaggaccggcgctcccgcggccgggacgcagctctggacccggtggccctggcctccaccagctgcgggtgatgctaatcgcctggcacctcggctgcgcttgtcacatcacccagccttcccggctaatgagtcatccgtacgcggccatgtgtttgtgcgggcttcagacagactaatgcttttaatggcacataat

SEQ ID NO: 54459 - DNA, 3022 bp, Bovine  19866880588059
atccaacccatgtctcctgcgacttctgcattgcaggaggattctttactgctgagccaccagggaagcccctaaggtgagactggggatgacagaattgggggagtagagaggagttaagatgcctggaccaacccccgaaggtctgagcatcccatgttggatttgtcccaggtgttcaccaaacagttgccatctggcttccccctctgtatctgctgcatcctccgaccgctgcctgatgactgcattaaaccagattgcacagaaacttcctttttaaaaacatttaaaaataaactctgagtagctgtaaggctacttcctgctcagagagagggaagcacactttctccaggcgcccctggtttcttggtcctgttgctgccgcctcccctcgggccaccggcccggccctgaccatgaacctgctccactttgctctcacccagcctgttccctccgtggtctgcggggatgccgtgccgagtggccctcttggcgcttctgctttcaggaaatattgcctctcacctcacatttgtcctgcccctcatcaccactcggggacggaggctagggcgggctcccagccatctattttcctgcctgtgctggaggaggcggacaggctggcaccaggactgccagggggagggctggggctggggagatggagccctcgttcagtaagctgcaagtatttattaggagctcgctgtgtgccggaagggcagggaccagaaggagcagagcccgggggacactgccatcccctctggactcggaacagtgcagctgatccctttagaaactggagcctcgaactccgctggcggaagttggtagaaatgggttggagggcaatttgaaagcgggttttgcaaagctgacacgtgggggtttcctgggcggttcagtggttaagaatccaccttccgaaacagatgatgcaggttcaaatcctggctggggcgctaacagccctcatgccttggggcaatgaagcccgcctgctacaatgaacacctgatacagccaattataaatatatatttttaaaaactggcatgtgctctgaaccagcagtccacttctagaaactttcctaataagtgtgccaagagctttatcagcgcatcacatagagcaaacagaccactggaaagcagcctcacaggaattggacgtgactgaagcgacctggctcacatgagtacgctgggcatttttatacacacacattttttttttacccaaatgaataggctacttttttaccctgtctcatctccctccccgaaagtcctagggaaattttggttaccaaaaaaaaaaaaaaactagatggggtggagactagggagtgagagaactgtggccccctgggccgctcacggagccacactgtcacatgggcctctaaaatggtgtttatcgtgagacccccttagagctgggtatcatttagaaaggcagccacatatgtaacatcatttaacattttttccacttaatacagccagcaaaaaaaagttctgatagcaaacgaggacatttgttattgaaaatgtaagtgtgtggaaaagctcatacgttgcagtcaaataaatatgtgtgagacctgagtgtcatcagggtctctcattttcttattagaagcttttttttttttaagcctccatcccaggctgtaggcatcatttggaaaatccccgaatatcctctacctgccatgaagccctggataaggcaatggcaccccactccagtactcttgcctggaaaatcccatggaccgagggagcctggtgggctgcagtccatggggtcgtgaagagtcagacaggactgagcaacttcactttcactttcactttcctgaattggaaaaggaaatggcaacccactccagtgttcttgcctggagaatcccagggacaggggagcctggtgggctgccatctatggggtcacacagagtcagacacgactgaagcgacttagcagcagcagcagcagccatgaatcccaaatgcttagaaagaaaggtgtaaaggcaacaagaacttagaaattgtccagggaagcgtctgttttagcaactgtgggcccagtgctaagcaaaaggcctgagatgaatgagtgagaacgtggtctctgagttcaggtgtgggtaaggtggaggtgagctgcagcgatgcccaggggcttccaggaagtcacagctggacctgaaggtgcagggaggttccagctggcaggtgaggatgatccatatcagcaggacaaccagctgagactcagtgagttcttgtgaattacacccatcatgcagtttcatagggagacttgaactctgatgatgctctggcttctgaaggaccacgcaggccacccatggctcctgactgggaaggaccaagtctggtgaggaggagtgggggacggccacctcactccacttgatgaggtatctcgtacatggttatcatgtgctggatgctgcagagacaagccctgcctcgcatcccgctcatttgcatgtgtaaatgtatgtgtatatatattgcttattagtgtcagtggcatttgcattttaagtggattggttcgttgggcatgttttttagagccctggacttgaaaggaatattccaacttcaatgtcatgcaataaacaacgggttctttccgaggggctgatgagaggtgggtaggttcgttgtggagggaggaaaggaagggtgagccgggtgggtgtctgggcatcagggtccactcccagctcagccaagagtgaccggtgaccttgcgcaggcagcagcgttcctgggtctctgtctgcatttctgccccatcgtgcctgcctgcctcgtggacagactgagaatcacagggaggggaactgcaccgtgagtagggccttgtgagactctgcagttggtcctgcaacccaacaccgctggcccacaccacgtccagttctcagctgtgcatctgtctctgtgcctctacccag

SEQ ID NO: 54460 - DNA, 1759 bp, Bovine  19866880590381
ctggtgtgttttaggtgttgtgtgttttttttttttcccttctcccctggggtctgaaaaccaggcatttgtgcgtttacccagtgcatttattcgctgccagaaattgacatatggactcattaattcctccacactcgttctcacccctaaacactcacttggctgaaccaggaggggagctgtgtccaagagggctcttctgaaggaattatgtagacctgggacatgccttaaacatgccttcagggcttccctggtggtccagtggctaagaattcaccttgcaatgcaggggacgctggtttgatccctggtccaggaagatctcacatgggcgactgagcccctgtgccacagacactgaaagctgggcgccctggagcccgtgctctaacaagagagtagatgcccactcgccgcaactagaagcctgtccacaggaatgaagggccagcacaaccagaaataaaaacaaagttataaattttaaaaagaaaaagcatgcctttgggccccaccccccagagtttctgacccaggcatctctaacaagttcccagatgacattgatgttgtggtcttaggttccacacttggagaaccaccggcctaaatccttgctcctcaaagtgtgggcctgggaaccagtaggatcagcatcgcctgggagcttgttagggattcggactcttgggcctcacctcgggtctaatcaaaatgtgcattttaacaggatgattggaatgtatattacaatttgagaagcactggcctagatgatttctcaaggctctttgcagctcagtggcctctgtcttgactgcacgttacgtttaaccccggggagcttttaaaccatcgtgagcccaggctgtgccccagaccaattaaagcagcatctctgggggtggggcctgggcatctgtgtttcgtaaaagctccccaggtgatcccagtgtgcagccccatctgagaaccactgttccagctggaagggtgaaatcagcaaaacgcctcatgcagccttgatcttaaatggagaaagagacatttgttcttccctccacggtcactcacccacatccgcttttttttttttttctgacccggagagagctcagctttggttgctctgctgctgctgctgctgctaagtcgcttcagtcttgtcggactctgctcgaccccatagacggcagcccatcaggctcctctgtccctgggattctcaaggcaagaacactggagtgggttgccatttgggttgtctatcttcctggcatgccttctgtggatcacagccttgcctcctctctctcatttccatctcgcggactaggcaaaccgaaagagatgagacggggacctgcgggctgctggctgagctaagaacttcatcttcagaaaacagacaaagacccagatcctggcacctggcttccccagcccagttgggaggcagcccaacagggacgtgtgtacagatagcagacatgcaaaggagttgatgctgatgcagcctgagcatacttctgagagtatcaatccccagcggtggagtggatggagttggggcctaagtggccctgactgtattttgtggcctggtgctcctgatttagaggccacctgtcccccagcctggctgcctcttctcccctgtccatttcctccccccagccattacctccctatcccagggggctcctctctgaccctctgaagcagggaggtcaaagggagatgctgctctgac

SEQ ID NO: 54461 - DNA, 1356 bp, Bovine  19866880664040
cccgctaattctaattgaaacacgggaccgtatttccaggcagagagtggcaggctcaagtctgggaggacatctagaggggccccccggcttcacatggagaaaactgtggggcctcctcgggcattctgctagaataggccaaggcggcagcgcttgtacggctgccaggaaccacagctgatgataaaagccattaaaggtcagctgggaatagaaaactatttatgttaaatgtcacagattaagccgcagaatgggcctcgggtgaagagcagagggtgaggtgagaaagactggtcaccgtgcttgcctctcgaggggcctcgaaggggtgggtggccttgagaggtagtggacggggctgggggggcggggctggcggtatgcttggtttccagctgctccagcctcgggaagcaggtggatgtcagcagccacaggtgattggccaggctgaccacccatctaggttgctaggcgacctgagtgcaggttcagggagagaggacccagctagtctccatcacatcatagtggaaggggtctggggtgtctccaccacctcagagaaggcagcctgggtgtgtcccaaggtccgtgcaatggactctgagtccagacagactgctctcacctacagaggggacccaggccggctctgttttcctgtttatcatcctgggtttggcatggctgtgcttaatcataatggagatttaatgcaacacaactgagccaaggaggtcacagagagagaacaggaccttctcttctccaaggatcctggatgtggggctctgaagggcgcgagagggactgccaaggctgtgatgctcccgggaggggctttggggctcagcggggcctggaccaagttctgaaacggcaggtccgcccagggaaccaggtagcccgcagtttccccaccataaatgcactggggctcccaacccgggcctgagcccccggcaagagtcccccgcgtggtgtctgaccccatccattcaccaaaggcacgtaaagacggagtctccgctgacaggtggaaatcgcccccaggaggccccacaggaaaaaccactgcaactacacacactgcctacctggggactcttcattttgcaggttgaggcagagccttaatttccatatttttcaaccacccacccttcctctggacctcccagccattatatgagttgctgtgtgtacagggactataagcacattttaatattggtgtaagcgggcataattaggaaggtaaatctagtggaaaaatacactcaggctaaataaataaataccactccaaccccgtccttccatcaagtaacaagagggtgggctgca

SEQ ID NO: 54462 - DNA, 777 bp, Bovine  19866880715261
ggtgagcacggcagtaaccccttatttattggactcctccagccccacaattgctggttctgctcaatatttcattcttgttgctcctgcccgggcagcagagctacaggcatgtttgataaatggattgaaaggtttgtctagttttgctgaagcttcagtaggtgcttctgtgtcttccacagaaattatatttcccagcttcctccaaggatgcctctcctctagggacgcctctcccactgcctgccgcttctcactcaccctctccccttctcccttccttgtgcacgcacacacgcacacacacgcacagtattcagagatgtgtgtatccgcacactcacaaactgacttgtacacaggtgtccatcggcatccaaggagccagggagcgaaccttccccattgataaagaagcacacacaccagccatgcacgcaagcacacgccctcacgcgcaccaaggcagagccactgaaatccctcggttgccttttctgagcccatctggtctctgagttgtgaatgtgtgacccggccttcctccaccctgagtcggggggctgcagagacccaaggctcacccaagcaaagggtggacaggggtggggcggactccaggaaggaggagcccagggacccctgcctgtcctcctctcgggggaggctccgaggagccctcccgcccgccagttggcagcttcctccagccgtcctgcccccttgtccacctgcctgggcctggcagccccactgggccagctggaggcttta

SEQ ID NO: 54463 - DNA, 1163 bp, Bovine  19866880715266
acccagacaccaaggccctctgcatccgtggcgttttctccctcagcccaactcttcgtccagcccgagccccctgcagggtcctcgccaccctcactcccaggcagaccccatgcctttgcccacactgatccctcatgcccttcttctctattcactcaacaaaaccttctctctagtcagctcttaatgaagccccctgcaaactccagtccttaaccacatcccctgtgcaccccctcatctgccctgtggtacccagtctgctcagccagacccacgtcctcaagagcaccaactgtgtgcgccgcacccctgcagccctggggacagcacacagtaggggttcagggtgaggccaatcacgtgacctgttcccttgtctcctctgggactatgtcagctcttggtctccgtccagaatacccacttctcctcccaggaggccacccctcttctgttagttgatatttatgggtaataagccaagcacatcaaaacccgaggtgaaatgcctcttcaaataagtacgctcctcaacaagtccagccagccagccagcatgggcgttgttggcagccggggaagtgcaggggcgaaggtgggagagggaggagagggtgcccctctccctgggacactgagggaggggagtggggtgcatcactccactggggggccgtcggggagagtggaagtagaacccatcacttctaggccttggcagccgggaagaagtgggtcaccatagaggctggctctcaatggcgaagatgacagctcagagcggatgttcctccaaagtggggagggtgaggaatcaaggccgcagaagtcagcaaagcttccttctgcatcgctccggctgggatgtccctgggaaatgagagaggccggtgctggagcacaggaggccccaggacatggacggggccctctctgtgagcgagggctcaacaggtcatcaggtccagccccctgcctcttcactgacccgtcactcaacccaccctcagggtacagcaacctctccaggtccactcaggtggggtggggtggggtgtcactggacccaacctgaggaatggaaaatcactctcgttccaacatccactccctcccgtgagggtttcagcccgcgtctacatccacagttgagtcct

SEQ ID NO: 54464 - DNA, 1602 bp, Bovine  19866880962130
tttcctcctctgtaaaatggggataatgatactgaaataggatcactgagagttgacacagatgaaaggactttaaaccacacggtaaaccttcttgttcggtttcgttctggtgtgctgcagcaaactcccaccctgcacctggacccagtgcggccgcccctgcacgtcacccgtgacctcttgtccgggagcctgcaaacctgaggctgcttgtgttattatttatctcagtgtgactattgtgctgctgcgcgctgcactgagcggcggggacgcctctgaggcgcgctggcctttccaatgaggcgggattgtattagctcctgattacagcccgcagaacacaatagaggcgcccggcgcggaaggcggccccctgcctctgcctcatctggactgctttgtgcttgattcccttctctgcggccccattttcctttgtctcttctttacttttctcccgctcccccctcctaatctgcttaacaacttgcctggctccctccgccgcgccccgtgcccaccgtgtctgaacacctctcccggcccctaatagcaccgctgctcctgcttctaataaaagctgctgacggggaaatccgggctaactgaattacttcctcattaacgcggcgggcagatgctccacacctcccgtgtcctccagccaccccttcctgcaggcccctcccagccgcggcagttaggtgaagatgctctggggaccccgtgcaggcctgggtcctagagaggacaggaggggctgtgggcttctctccagggtggctcctagctctgcttactcccccaccttcccagacatcggggtccccagccttggacctcccagctggctgggaggacagaagaagggggtgacttgccctcactcacccaggcctcctcctcttacctgctgtccctcctcctgacccctttgtccggggcaggtgagccggtgatgtgcaaggccagcctttggcttcagaggaatctgcttcctgggaaggctatgtacgaggagatgttctctagctggggggttcccccaagagaaaggaaagaggatccagactccaggtatcgaccccaactcctcctgcccacctctcagaggcccgtgtctgtccgacaagcacccttgggggtccccaggtctgtgctttctcgggcttccccctgggtcttccatggttggacatgctcatctgctggtaccccaagcctccatctcccaatctgcgcagtaaacgtcttgtctgcaatgcccccgcctgcatatcctaccgagagctccagggtgtcgggggagcccccccgtgccaatcagctagtaagagctttgcaggtgcagcgagcagggagaccagaaacagttattttaacagccggctgcactacgagcattttactaccaggcgatggaagatttacctgctcctttgtttgggaaagcaccttaatgggccttttggcccctgggtatctctacatgggagaagattgagacaaagaaacactgacttgctctgcgtcataaagtaaagaaagttctggctccttaagcagcccaggaatgggggagatggtagagtcggg

SEQ ID NO: 54465 - DNA, 783 bp, Bovine  19866881000524
caaagttagcaaaggaaggaaaataagctggttgggggccaggcgtgcacaggagtggagcttggcccagctcaagctctgttgtcaccactccaggggagcgggttaattaagggccccctgctgcagagccttcggaaaggtaagaattctttggaaatgtaactaattaccccctacctgactttaagactatatttttgtgtctgcgcctccttcaaaagaagccttacctgtgttgctgccggcccaggtggactcatggtgtggaacggttgggggagtaagggagggaccaggtcaaatggacaagtgagaagtgaaaatctgcccacctcctggtgcccagtaggatcagtgtcctccgcttcctacctttggcccgaattgtagcaggagtaaaactgagttctgtcctcttcctcccccaccccatctctggtggagatgctaaggagctggagggaccagggctgggagatgcaaccagggcatcatgtgggacttgacagaagctctcaaataacaggatgacatccatactcccgggcacaagggtctgcagaccaatggagatgagaagaaaaatgtcactgtcgtcatccctggaggaggaagagacagaggaagaggaagcagcaaaagaggaagggaccacatgaagctctggtttaggaagttaaaatcaaactcgaagaccagtgccctacacagggcttcattctaagaagatgcaataaagagaaggcagtcaggagggaagatggagggagagaataaggg

SEQ ID NO: 54466 - DNA, 1579 bp, Bovine  19866881067094
cacagggatcctccacccaacctggatttctcaccttgtcttctatcctaggggtcatctggttcccaaaatgcaaaccaattcaaagcagcttcaagaaaaggtagaaatctgtgtgcaggggaggggtgagcttcacaggacctggaagagaacgtttaagctgctgtcacagccgcgaggaaggtgtccaccagctcctctttctccgaagctcctgtccctgactccagtgttcatgcacctaccttggcttctcccgaagaggctccccgggcccccggtttggatgaaaccccagacaatcagccacaaaacaaaccagaggctctaagctctggctccaaacccaggattgtcccagcttggcccaatcatccgaggccttggggcagggtcacattgtcatggggaagagggagtcacatggctgctgtctctttagctgggagccctggggccaactcagagccgagaaactggcccacctcacagactagcggccaaggccatgaggacaggaaatgtgttgattcatctcgagaccccccagtcccagcacagagcaggggcccaatacatatttgtaaattcaagcaatcacctcaatttgaatccttctctcagcaacctgtgacccacttggtccctggagagggaggcaaagggctttgaggaattcaatggggaaatgctccaagctcaagtaacgaggcgtccttttccttcagtttctggctgtgtgaccttgagcaagtggcttaacatctctgtgcttcaaggacctcgcttgcaacacaaggactgtgatcttgcctaatgcatggctgtggtgaggatggtgggacatggtggtcccacagcagctggtgtggcacccaacaccgtgtgtgtgttagtcgctcagtcgtgtctgactctttgcaacgccctggactgtagcccgccaggctcctctgtccatgggattctccaggcaagaatactggagtgggttgccatgccctcctccaggggatcttcccagcccagggatcaaaccctgtctcctgcattgcaggcggattctttaccactgagccaccggggagcccctggagcttctgtcctgttctaccctgaacccacagaacagggtcccccactgctctcccattaggcttcctctccaggtctgatgtgactccagtcagccgcacacagcgcctcttccaaccccaccagggccctgctcccagagggataagtctgcatggacacccaagggcagccactcccccctactcccgccctgcccccagatctcccccaaagacctcacctgctgtccttcacaagccggctgcatctgccttcctccaccaacaggagagcaatctgccctgcaagggctgagggggaaattctgaacaggaaagaaggaggcagagttgggaggacccaactgcccttcggccttccccccacttcctatcaccccccgtctgggagggtaactttccagagaccacaggctacttctcggggagggatgtgccgtgctcagtcatgtctaactctgcagcctcaccccatggga

SEQ ID NO: 54467 - DNA, 773 bp, Bovine  19866881263413
tggccctgactgtaaacatgtgtatacaaagcgagtgtcacttcagctaatttgagagggcctggctgctttgctggttgctgcagctgtacccaggggtgtggggcggggcaaagtcagggacagcagggtgcacaggctggcggcctttcttccagcaacatctgcgggcggccggagggaggcttcagacacccagcccgggcagcatgggcccacgcttcctcagggcccacagtgccctcccatccggctctctggccatcattgctccggcatttaattcacgctcctggcagactgtaaatgccctaaaggcaggccgtgcgactctcctgtttctccgtgtcaagagacttgcacttgagacgttatcattgaattaaaataaatccctaccagaaatttcttcttcatgtcaattgcacagcccttctgctctttctgcatagatttccactctttctgcctttgctgggcagagagaggcactgaatccccatccctctggggtaagaggaagagttctctttgagccaggaacttggagatcttagctttgtcttacactctccccaaggtctcacttttatcatccttgtaatgggatctgtatggcctcgcctatgcaggcaccatcagaggtcccccagcctgggttcctgcctgaagatggggcggggaggaggggtggttcaggcccacccccgtatccaagtgttggatccagtgcagggtgcggccaccagggtgcgcacgctcaaaaggcccca

SEQ ID NO: 54468 - DNA, 1259 bp, Bovine  19866881280069
gctcttgtcttccctgttggccttgattgcttttgaacctggaggctcccgaggatcgggctcttgtttctcttccctccagatgtgcgggcagggaggcaggaccagctcccgtgtacagatcatcagtaaaatgtcctccagcccccttcactgcagggctcagggtctggcagctattaaatatttttctaaccaactataggcaaatcatcgaccccctggacccctcatttatcctcctctgggtcatgggaaaatagctgattcacccagaggggcagagggagctgggggagaaggtggcgaatgcaggcgattgccggaagttgctgattgtttagtcgctcagtcgtgtccgactcttttgtgactccatagactgtagcccgccaggctcctctgttcatgggatttcccaggcaagaatactggagtttgaaatggcaaaaaaaaaaaaaagaatactggagtgagttgccctttcctcctccaggggaccttcctgacccagggatcaaacccatctcttctgcattgcaggcagattctttaccactgggccacctgggaagccccggtttagtagaggtgggtctaaaagaaggaccttttctgactttcgtgagtaattaaaagctgtgtatggtctcccaaggcactgcggtgaaagagctgtcacaaaattagcttcaaaggtggtggctttccccagatgtttgcttcagatgcttggcttctagcatttaaattcccattaaggagctgccgtggctgcgggcaggccaagcccactctttacttgaaagggatcaaatccttggccagaaatttgacttgaattgtgattgttcttattcatcttgaaattcattgaaggccataaatccactcatcctgcctcattctcttaactctatgaagattaaattgatggggaaaaaaaagtcatacttcggaaggtttagaatttgggcacaagttggctcaggtgggagagggcctggaaaccaggtggtgagggttccagctgtgcttgcaaattcagttatgagctctgctaagatgggctcagccctttcagatggctgctggaaatctaaaagaagcccttgaggactttacaatataaaggttttaaggaataggtactgaccagttctccaaccccacagacagcaaagcaggagagaatcttccagagagagaagcaagttggacaggagaaactttgttcctacaggttgcagaactagcag

SEQ ID NO: 54469 - DNA, 863 bp, Bovine  19866881280291
cagggtccctgatggagccccaggaggcaaagagagagggaactttataaatcaccagctccctttaaaaaatggagtttaacctccctcagctttcctcctgaatttattagcagtttcatttccttgggtaataattcattatctctttcccaagcttgggggggcagtgctggcctagaagtggcatttaccttccacaactttaagtgatgcttttttagctgtcatcttcagatcactttcagccccggccctgtacttctcatccccacggacaacatcgacgtgtctgacacagacttggaggggtggtcctctcctcacctccacttcccctctcctcccctccccgccccagcactgcaacccatctgtattctgatgctgtttgcaccggagcctttctctattgtgaagtaagacagccgcgagctgcagggagatagagccgttctgttggagccgagataagtgctgctgggagggaacccagtggagggttggagggggccacatgtgtcagcttaacgggaggatctgaaaaagttatttcaatcccgtctctatgtgggaaactggcagatgcccttctgtggagtgaaagtttttctcttcctctccatcctctctgccaaggaagggagcttgattatcaaggggcgtgaggatgctttttcactggggaaaaaaaagtccttttcccaaatccagtctctgctctaatgccagaaacactgcattctaacgcccaatatggcaggctggggaggaggatgggcagtcaatcccatcagccagcgtgcgttcctccacgtgttggtgcactgctgtcccctgtcagcacctactgtgtccagaca

SEQ ID NO: 54470 - DNA, 1804 bp, Bovine  19866881306809
ttggcagttattcagctacacaagcacagtatgcaggctgtgggaagccagaagtaacaagctgcaaacctgtataatcttatttcccactgcacgtggcgtgaaacctaccaaaatcctcacaacaaagaacacagcctcctggaggctgcacacaagctcagatctgatccgggccggccagggtgtcagaccccctcccctgccgcagcttggctctccttcagcccgccccgattgcaggggggcaaatgctgtccccaagcatgtcaggccatcctctgctctctgggatcagcatattcatcaggtggaaaacaattcctggctctggggcgagggggctgctgggcagacggatgtaccctgcttccgtttcatcttcctcttaaaatgaggtcgtttggttgaggagggatttggggccaaatagcacacgaaatgtattattctctgggtttctgactgtctgctaaaataaatcgcttggcttgtgaaattcaaacacattgatgaaaaatagcagatgcccgttaaatctgacaattagctttgggactagaaagctaatcagaagcagagccctgacagcggtgatttgatcctgtcttcctgaggattcctgctgacgttcatcagctacagcacacagagccacgcacacacactcacacgcaccgagtctcctgtggcaacaggcattctcagtctcgtttctttcctaacacctctgaactgtcaccttgaggcagaacaaaggcagagatgctcacatcccaggggagacccaggcagggtcctcagaggcatctgaatgcccgcaagcaattttaaaaagtaaatgggggtcaaactctatcaggggaagtcggtgacaggatctccacggcccaggacgtacatggtgctcagattcctgctccgaggatgttttcttccttcctagcctgtcgtgcagcatttccatcttctctccaatccaagcgccagcatccacgcctggcctgcaggccagctcaccagttgcagtcacttttgtctgtcgcttggctccaggatgaaacaaatttcccaatgcaaactgggaaaatccccaaagcacagaagctgaggtgggcccttgcagaataaggatggaaccttgtcgagttctatccccagctcccttcctcctacaaagctgcctgcgctctaagaacctttgcaatctgccaagctgcgcacaggagggacccttctaactcttgcggctgagtctgtcctaaaccagctcagagattacctctaaaagatcctcttcctgggcccaggcagccgtgatgctgagagcaagtgaggagccctctgggctggagggtttgctcagctgtgagccctgatgcggcagagcaatggcttttcgcctgcgttggtgtattcctgctgaggactggtttatgttcccacagtccataatgggatttaattgtagtgattaggtattgaatttcccttaacaatcagggggaatgtatcctgacttggtaaaatgtgtttacaaatagtgggatgattagacctgtgtgtgcacctctgctctgggtgtgcagaagtgggggtggtcaggaccgaggggaggaggtgggctttgaggaggtgggaccagacctgtggtgggtgattgcagaagactgctctctgccccggggtcttccctccacaagcttgtggtagagctgggttgtgtgggtggattgtgatcaattgcatgcactgatgcagttgggaacttaagccacaaggttcagagtaacaaacatcatca

SEQ ID NO: 54471 - DNA, 869 bp, Bovine  19866881402775
aaatgacttaatgactgaacaacagctaggagactgggcatggtaactatttttcagtctgcttaggaactttcctattgtcagaagttaaagaataattttccccaaaaaaggcaaaatcatgactctcctactctacatgtattaaagattttatttggcttggtaattagtgaggaaactaggcagatgttacaactaatccaaaggagaaatctaaaaagtgtaaatttacatggagtgaaggaaagtggaggtgaattgacaaatagttggaaactggctctttccttaaggaagagggaaatctattgaaccaccagacagaatttatttgcatgtctatagacaaagaattattttgcattgctatcggttatctacaacttacaggaccgtaaaacagtgcaaagacactgaaaggctagaatcagacagcctacaaggatgttctctgaacggccccattttttccatcagcaacacccagtgatcttggggatttattccaggtttcgtcacgggaacaagtctagacaatcttagcacctcattctgcctgataatagcagttaatatcaggagtgagaaatcagaatgcttccctgatggctcaggggtaaagaattcacctacaatacaggagatgcgagtttgagtcctgggttgggacgatcccctggaggagggcatggcagccccctccagtattctggcctgggaaatcccatgggcagaggagcctggcgggctgcagtccatggggttgcacagagtcggtcacaactgaagcactaacactttcgcaacagagagtgcaggatagcagactgggcgaggacctgctcctatccctggtgccctgatgc

SEQ ID NO: 54472 - DNA, 1581 bp, Bovine  19866881434557
agctatgaaatgatgaggaggtatctacagtggtagagtgcattcaaatcagattaattagttaattacaaataaaaagacccattaagatcattaggaacactcagttgatttagcatcccagctgtaaacccctcgcagcttttctcaggactgtctcattgatgggtgagcccggctctcacggcctgattggtgaagctggatctgcaggccttcatttatgtaacgagcatgcatttccaagtggctcggtggtaaagaatctgcctgttgggcaggagatgtgggttcagtccctgggcagggaggatcccctggaggaggaaatggcaaccagctccagtattcttgcctggagaatcccatggagcctggcgggctgcgtggggtcgcaaagactcagacacaactgagcgactaagccaccactgggcaccatgccttcggctgagcctggggacccaaagcggagcaagacggggcctcatccttgccctttcttgggagtggggagggagacagcccagggaatgactggtgctggctcaggagccgggctgagcactgggaactcggaaggaagcacagcttggggaacaggaagcctgacgcccagagaggctcgtgaaaaccaccagtgaccttattggtgctgcccgccatgatgatcatgaatgtctggctcagcggatcagtgctgctgaactctgacaaggcgttgttgctggtgttcagttgctaagtcgtgtccgactcttattttcccaggcaaggatactggagtgggttgccatttccttctccaggggatcgtcccaacccaggggttgaacccgcatctcctgcattgatgctggtgggttctttaccactgagccaccagggaagccccgtgcagcccataagtccgcccaaacccattccccatccccagaactcagaaagcatcacagtgtcctctggcttcccagggcacatcccgtccccactgaaggaggaggccagctggcacttctctccccctttgcggctccacccacatcgtatctttgctcagtgttatgtttcagttaacaaccccaatcctctggatccaatttctcatttgccagggttatgcgtagtgaaaatactcactctgatgataaatattggctgtggctctgtgctctgcccagggccccagctctgcccacgcagcgtaattaaaaagccagccacgtgggcacatggaaagcctgatgccccctccggccacagagaggacacaggaggcccgtggactccaaacaggccattaatgccaggctggagccaccagcaaataccgaacaaaacaaacgaagccaagggagaagcctaataaatcttgcccaaagtagctttcacttggggccgtgagctgtgactgggggtggggtggggctgcggggagcctgctctggaagccggctcactctttgcctttgctctgagtgctgacccctgggcccccgccacggggagggcgggcaccacagctccccctcacttacttcccatctcaccctgacctgcctctggggctcccggggcagc

SEQ ID NO: 54473 - DNA, 679 bp, Bovine  19866881636172
gaaggttatctgctgcctccgtatgtttcctatgaactcaagttctatcattagagactgatttatttaggtcaagccctgactccccctaggagcttcccatggtttcttgcttgtaatagaccattcagtaaatatttgtcaactgagcctccattaaaatggaaatatccccgaggagggatcaaccggttgctcctttgctaacacttcactgtgaatcagtttatcagctaactagcgctctcaccaggcttctcggggcagaggcccagagcagatgtgttctgagggcctgcctggggggacagggccatctggagctcagtcctgagtccggctgtgaagaggctaagagcaagggccaggggctcaaggtcagtgcaaggacactggggatgcctgtggcccacagatgtgatcatgcccctcctctgacagctctttaatgctctcctcaggaaaatgtcccaactcatcaccagggatacgtatacagaccctcctgactggaccccctctcacccttccagccgcaagtcttgacattctattttttaagaacctgtatttatttatttaaaattgacgtatagttgatttgccatgttgtgttaatttcaggtgtacagcacagtgatcacaaacacacacacacacacacagatctattctttat

SEQ ID NO: 54474 - DNA, 984 bp, Bovine  19866882025613
cgtacatgtactccgagacgggggcattggagatggtctgggctgggtgcaggctgccctggctgcccaggccgctgctgtagctacagaagctgcgaagctgcccccgaggtgggttgtgggtggcgatgcgccgggcctgggggttgaaggggtcgtcgtcgtcaatgtcgtcatagtccctgtccctaggatgacacgcaggacacggccgtgaggggcaggggaggggcgccaggcagtggggtcccggcccacttcccaatctttcctcccaggactccccctctggctgcaggtgtctccttgaggttctctgaaagtatggtcttcagccccgccttatacatattactctgctccgttcccagctgcacacccacctcctccaggcagcccaccctgctgaccacctgcacgctgatcctccctaccctgcctccttttctgattactctcgagacactgaaaatgctatcttgtctgtctcctccatgagactatagatgccctggtatcagtgctacaatctgttccttccggcattctgggggcacccctcccagcagcagcatcaccctgcaaagtcctgcagaggaacaggggacaagctaaggaggccaggctgtggcacaatgccctcatcatccttggccctgctctggccccctccaacctccttctggggtcctgcctggactttcagggacgctgcctcagaaatccagccagcctgttggggctgaatgcccggtccccttgctgcccctccccaccccaggttatcggttctcagctcagccagagagcagagcctcccgcccccttccccaggaagcccacctggtggcacagtgcttccaagcccctggccccaggcagatcatgatggaaaaggccagggcggccaggagggagaagaggccgaggtacagcaggccctcgaggccgtcgtagcagatgccggcgagggcgtccagatag

SEQ ID NO: 54475 - DNA, 851 bp, Bovine  19866880168997
actttactagcgtgtgagatgagtgcaattatgtggtagtttgagcattctttggcatttcctttctttgggattggaatgaaaactgaccttttccactagaataccttatgactatttaagtcaataacacgttaagctgattagatgagaaagtgaagtgcctaagagggatagaaaaattaaagatagcacaaagaaagcaaagagctttaaacgtgagttagtggggtcagtagatgatgtcattactaggaatatggaaaaggaaaatgaacaggtttgggagagaagaattaatgtcatttcttacagtttaaagggctgtctttcaattggatgtatgtctctgttttcatcaggttacttattttatagtcttctatgtcttgtacacatcagatttgaaagcaaaattttttttaacttgtagattcttttcattggagactcaaccaacagagggataatgtactatctgattgaaagattaaatgaaaccctggaggaatggcagaaagtgcatggcactaaattctaccacaatgtcaatggagggaagaccttgatcagttattcctactatccccggttttggatgagcccttcattgagaccaacatttgaaaaagcccttgaacatctcttgcaaaggtacaatggaacagttttgaatgaaaccataccacaatgtagtgatattttactagcagtcaagattgtttgctgtgtatcagatgtgctgaaaagtttaaataccaagtattaataatatggctgaaaacgaggtagaaatgataaggaggtcttgtgatcaggatgccagctagggttcaatgaatgtgaggcgg

SEQ ID NO: 54476 - DNA, 1462 bp, Bovine  19866880349559
aattttctgtctggttacattctgaaaattaccaagtgagtttatcaataagcctgtgttatcacttcccatttctgctgttcctcaactttggtatgggagtctgactttgatctttgcatggtaatgattgccaagtataaaattcttactacggcaattttctgggtcataattttctttttcaataagaaaaatatggcatttttaactggtttatattgttttatggtactttacaaaatattatgtgcctacaaaaattaaatggaaaagtttccataattaaagaattaaactaccagttagaaatgtggttttatctttggtgtaatgtccatgtttatggctgagataaagaatcaactgaattaactagatggaatttaacagaaatgtatgtcatattttctgcttataattttacaagtatttaacaagatccatcaagtacaacttgtcaaataaaaggcttagaagttgtgttggacagtaagcttcatgccagtcaagagtagctttgaaaaagtgaatttgttattttgctatcttataatagaatattgtgttggataatctactcttctctttactggttaggttatatctgatgtattctgtataatctagtcatcacagttcatgttttttctaaaagatacaggccagggtcccatacagtatttcatggaacatattttatcaacagctgttgggggaaaaagaggttctgaggtcagccactgaagtaaacagatttctttattgtaaggctttgcaatgcttttaacatgcaaagcacagtttacctctatgagaggatatagtgtatacattttattccctaaggtaattgacactagaattctcttttcatacagaagctattaccatattgaaaaataacccaagtgataactgggttctacagaatacatctgagaatatgctgatacattcgactgggacttgatcaaacaagaataaccagcaaagcatttttccattcctggcctggcctcctcatcacaccagtgtctctcttctggtctcttttctgtgacctagatgttgtcttgaagtttgacttatactcagataaaaagaaaaatttattttttgccttatgaagtatctgatgcagactcaagaacagatttgcttgctcaaatttaaaagtcaaaactgggatattagaatgtatgcaagctgttgaaggtgacatatttacaatgtagtgctttcctttaatatggaacacttctattggaattaccatttagagatggagtttgttactgactgttccatagcttcatgcatgcatgctcagttgcttcagttgtgtctgattctttgtgaccctatggactgtagcctgccaggctcctctgtccatagggattctccaggcaggaatactggagggattgccaggcttcctccaggggatcttcctacc

SEQ ID NO: 54477 - DNA, 1652 bp, Bovine  19866880479606
ttttcttgaaacgttgacatgagccagtatgatcccatagaaatgtacaagacttagttggctggattaatgaaaggtccatccccttcttcagattctaagaatctcccagtgatgaaagagaaatttgtgtttcgtgtgtgtatagtttttattcccccaaaatgtaacagaataaagggtgactggcattatgttttaagaacaatgttatagaagtctacatagcttatagtgggaggatgataaaggaggtttgtgtgggataataagcaaagaggaagagaagcaatggtatgtggaatttgaaagaaattgtcagatcagggacttctagtctctggtggtccagtggttgagacttagcgcttccaatgcagggggcatggattcaattcctggccagggaactaagatcccacatgctgaacaatgaagcaaaaaaaaaaaaaaaaacttaccaaaaaataaaagttctaaagaaaagaaattgtcagaggatatagagaagatagatgacatgtgttttgggaactttactgtgaagaaaaggggagaggtaaaatgaatactaggcgttgaataggagattttccattatgctcgttttaaataggagtgatctgggttttagctggtaagagtgatccatttaagaaagcaaaattgaaaatacaaagtggagggaaatagttgtgttcagttcctgagaggatgatagagaatggattagaacacaaatgcagaaattagaaaggaagtagaacaacaactctgttacaacaggatgagaagagcggaggtcgatttggttggtcctggtgggttttgatgttttaatgctagtaagagttgagtttttgtctggtggcttctactgcctctgtaatcaggaaaaccatctgctgagaatgaggagagaagaaaatggaggtttgaatagagcagagcaaattttaatagagcaaatagagcaaagtttaaatgtcttggtagagggtaagagtgtggtgtgataccagaaaactggcaagtatccagatttagaaaagtgagaaagaattcagaaactacatattgctaaggttaacactgatcttcaccaaaactgtatcaaattataaagcaaatgtttgtaagaacttctaaggaaagaagagtgttttccaccaagagtgagccgaggcaaactgttcttatttccttttgcatgaagttttggggcttgaagatgagaagaatatttattcaggaaattatgtggtaaaatcttctagttgtccttgtgaacatggcatcaatcagaatgcaaaattttatcaaggaatactactagggaggaaatggatctggagaatctaagagaatatccattttagcattaatacaatccagagcattaaggctgactcacttctcaggattgtcgcatatgccttaagattaaaaaaccactttaaaccaactgaataattaagctgtagataacaatgcagtcattaagcttgaaatcttgtgtttcatacatgtagctttctgtgtgtttgagacaaaagctcatgagcacacatggcttaagattcagattctttctactgatattggtcaggttctcactgaccaatttgtacttggtcatttttttctttttt

SEQ ID NO: 54478 - DNA, 943 bp, Bovine  19866880508449
ttatgtaatgttcagcagtattggaaaactgaaatttgaaattttctttgagcaattctgtattttccaagctaacagtattattttttttccttttctctctttccatccaaaagtagaccaataaagctgaaatagttgaataaaaatgttaataattttgtttttaattttgtagaacttgacctctttcccgaattaattggaactgaagaaataatcaaggtatcatagctattttttattcaagtgcgtaaatattaaaaagtctattttgaattattggttaggtttcagatgttgcgttaataaaaagttcgtgttgcatgcatgattcattgtttgtagcactagttgctgagctttgtagattaatgtataattaataacatgagttttatgaagaagttggaagacactttaattggtatagtttttaaaaagagataggaaaggtttgttgataattagaaaaatgatggactttaaaaataatgatagctatgaactgtagttgcaaattggaactttttcattttctaaatgtttctaacaaactaaagtaatatttaagcaattcataatgtcgctacagcttatttttgactaacttaaccagtgattgatagattgataataaatgtgaaccagaatataaagtgtatatattcttttgcccatttaatttgattatttttgtttggactatgcatattataaagtctgttgccagcacaaggtccttgaagtaaatgggcctttaaggatatttataaattttaacattgtcctaagttttgaaatagagagaaaatgactgtttgtatcttatatttcatcctaagcccaaatatgctattcaccagaactgagataatatgttaaatccaggttttctattgttaatggtagtaggaatgtgtccattagtacatatatgtgt

SEQ ID NO: 54479 - DNA, 896 bp, Bovine  19866880568892
ttactcttttaaaaataaaaacttctaaatccatgctgcattaaatgtgtatttaaaaataatactgcacattacaaagtaagtttgaaaattttataaaatacagtgataatatagttgcttaaggaaatgtttgattctgaatataattttctacttttggatgaatttcctagaggtcaaaatattatattctgggggcatttagtatttgcatttctaccactgctctttcagagtcaagtgcttttgctgggataaaatgatcccaaccattaaagtaaaatgagaaaaattttaaatgattccttatctcataaatggaatgttcaccactagtccatatataattctacataagttctatgtttgactcaaggcaaacatctgtataagatcattagccacaacattttttcaaaggcggcccagggagcttaactcttccatcaggcaataatggaagcaggaactgtgccccagctttttcagccaaggaaactggaatgaagaaataatggcttaattcagtcctgaagtacagtagtttcagcataatttaatattgaagcctgggagagaagtgaaaagaaaaacctgcatacacttgtatgaaattgtgatccctgacataatgactcccatcaagtgtgagcctcaggcagcctttcatcttccaaggataggactcagttagacaacaggacagaatcacagcatcactatgtccatattcttttattctcagctcccccacccttttttttcctaacaaattccactctttttttcattgctcatgatcccaccaacagagttccttgtttgaatggagaactttttttctaaaatagaaatagcccaaatctactaaaatataacaatcagaagttttt

SEQ ID NO: 54480 - DNA, 1397 bp, Bovine  19866880592821
agctactgcttgcctagttactacatgcatcatctcccaactttctgagcaacctttgaagtatctatcaaaattcccccattttctgatgaggggcctgaatcattgagagatgtgagcaatttgcctaagacctcatagctgaacatagcagatccaggactcagacgcatgtcttaaatactttttgcgtgtgctacattgcttctctttccatgataccagaccttaaatccaaggacaaagggatttatctgtgcctctttttaaagggcaggacaaatatttaaggtttgtaataaaacatatgcatagtatactgctcttgtttttattcattcatttattcattagttcagcaagtaggcattggaaacacaggcattaatacaacactccagaaagaattctaaagtaatcatattcagtagagaaatcaaatactcagagactttaatcacttaatgcacttaataggttgttctgggatatacacataaaaagaaaatgcatttagaaatgattctgaaggtagcaaaatagtagatggttggaaagcaaagaactacacaaagaaggaaattattttgccaggtcaagagaaagcaacatgataatcattttccagtgtatgaaatgttgttatcctgacaatgataacagactgttctccatttctaaatgaaatgagacagaaagaagtataagaaagcatagatggtttgcctaaatgtattcagtagtctcctgggcatgtttttaaattttggtttaatttatggaaaaaagatcataaaacttcccagaatggtggactctaatcacacaagagtgtataaactctggtggtttacaaatgataaattatgattttctttaagtaaggtacatgtgaagagaagaatgggggggaaatgacattaaaatagctgacatctccaaaattgtgtagaatgaagcatgttaatatcactatcctgcaaaacacctagttttaccactttccaccttaagttattctaattattcctgcagaagagttagccaatatttccatgaccatgtatatcttggtggccacagccttgcccttctccgtcacatctacatgtgatttggagcaggtgttatctgaagagctcccttcccaaatctttcctaatgcaagaacccttaagttttatagatgtaaaaactacatgggtaatcactggtgctgactcacaattatggggccaaaataaaactaaggagatgaagtaggaaggagaaaaaaaaggtcagtaatatatttagaagggattcaggaatgacacttgagcaagctttgtatctctcttttatttattatttttttattgatgtacagttgtgaaatattatatattacgggtata

SEQ ID NO: 54481 - DNA, 1873 bp, Bovine  19866880594280
tggaagaagattttaaatgtacacaggttagtccccagtactaacacaagctgaaatacttttttctctttctgaatatgaaggttcctcccaccactccacacctgtaggcaaatagttaaagaaaatgattaaatactctatagacagattctacacctttgaatacagttctgtttcaaatacctacaacatgttccagctattatgccttaaaatgatttgtttagagaagggtttaacaaactacagcccatgggtcaaatctagccagctggctggctggctgttttgtttttccactcatgagcttagaatggttcttatatttttatatagttacatttaaaatgattatgtaagtacctacatcatatccttggttttatcttttggtcctcccagccaaaaatcctatcttgctcgtcaatgtggaaaaaaaaaatccctcaaaatagtccaccacataacttgtgtacaaacattaagacaataataaaagatgaagtattattcccaatatctaaaaaaattatccccaattctctaaaaaaaaaaaaaaaaaagctataattcatgtatcatgtggcacctcatatttatacctggggattttctaaatatttctaactaatgagaagtttgaaatccatctaatttccataatatatcttgacggcatctacttgtcctttaaaccatgaccatgaccctattttaatctttgtttgtactggggtttctaaatcttagtctacgatgatattataggtttgataattcatgaggaagggctgtcctgtgcactgtaggaaatttaagagcatccttagtctctacaagaagcacctccgtaactttgatgccccaaaatgtccacagaccttgacaaatttcccctagggagaaaactgcccccactgagaagcactgatctggactagtagtctgcaaaatgagtttgtgtatacttacagcatgtgtaggaaaatattaaaatttctacttatgtattcttaggatccacttacatatttcagtgagcacacatgcaaacaagtctcttgccaactgtgtgtggcagggggggaatcgaaagactgtgccagcacctgggaaaggccctccaattgctctgtctactcttacttctctcatcatgttatccagcagtcagatcattttcttcaatataaatgaagtgaagacatgccagactttgaaaaccttcaacaacctctcaacactctcagaaaaagatctcatctccttttccacacggcctgtaagttccaacgacctggccgttatccacttctctccagctctttcccacgttgggccttcaagcttgctctttagaatggtcttcccctggcggtcttccttcttatcctttaattctcagactaaatatcactgttttagagaaacattccttgacccactcactctaaagttggacacctttatctcatctcactgcccccatcagtatctatcacaccctgcccagagcagcacaatttctaactatttctttgcatttactccttaaatatccttctccctaccagactgtgtgttccatgagagcaggaactgtgctcagtaaatacctgttgaataaaaagtggatggaatgaatgatgctaagaaaattcagacttctttaaaatttttatggaaaaatcaatacagaattagaacatactggaaagaaagcactagactgaattgtccctaccggttctctactaggtatacctggtcaatagttcagtcccctatttcaaggactagatttcagggcctggggcataactataaaatcccatcaattattcactctctcacaggaaggcagaaaaat

SEQ ID NO: 54482 - DNA, 1102 bp, Bovine  19866880605579
tatgtagaatgacagaaggtgctggagtatttcatatggtgtggggttgaatgaagagtcagagtcagttgtaatttttcagtattgtccacactgaatcttgaacatctcaagtgttcttgaaaaatcacatctgaatatatgaacctgtgaaatgagacccagctgcatacttctctttttggcacagtcaccctctgaagagtcaccctctggggagaagagaatccacacccaccttctctagttcatactgtaggaaaataatttctatagctttcacaatgagagagatatttttgtttctagtttctgcattttcctttgtataaaagatcctatgcatatttgtccaattgatagcaaataaaaagttttaaaagaaaattaaatacaaattttttttgcaagattgctttaataacagaaaatagcatggattcatttttttttaaggtttatgtatttgtgggtaatttttaaataagggaagacagtaacacataaggatgaaaaatatataactttgaatttgaattgtctaaagtcagtagtaatttctgtttgctactcttcagcttacaaaattaatgagaaagtcctattcaaaaattacccttttagaaaaaaattttagatgcacgcaattcaaattttaagtatttgtcataataattctctgctaatggattcacgttggacaagatcatatgtcttatacagtgtagagtatatttcagttatgtaatgtgctatgaattcaatctcttttaggcaaaacgggagaactaatagacaccagattttttgacatgtggggaggaagtaagtatgaattacgtgtaactgttctgttgcttgcactaaatcataccaatataatgtagtctgttgatgagaaaataatggtactatttggttttcattttgtttcttttcactgaatgtccagctcatatttaaatgattagtcatactggatgcacttcacttttttataaaaattgttggtgatgtgtaattaagagcagtgataatcacacttgagatttgttaaagtctgagtcctgttttctgcaggacaactaattcaaagctttag

SEQ ID NO: 54483 - DNA, 1381 bp, Bovine  19866880644213
attgattttaaattaagcctgtaagaaggctttatatcccatgcttgtctctgacagaacaaggaaaagtgcattttcacatttaaatggcaaggaaatgaaagtagcaataaacctagattttctctttaatgccatagagttttgagaatacatccttgggaacttacttgaactgttcagatcacggttgtcaggggaaaagaaaaatataattattttactatgttttataatctgatggtggtgagtagagataaccgagtgggacatgtagatgttgaaatatcagtcattagcttataaccagcaaaggcagaagaggaattgctctcccattctatggaatacatttgtcttagtacaactaacaattatcttaatctactaagaagtgtcttacttacaaaaaattattttttcagagggtaaacatttaatcgatccaacctgatgacttctgctgaaatatatttgtctgtgacaatagataaaaataagtaacaatgtatgtgagctatgggacttcccatgtggcacagtggtaaagaattcacctgccaatgcaggagatacaagactcaggtttgatacctgggtcaggaagctcccctggagtaggaaatggcaacccactccagtattcttgcctgaaaaattctatggacagaggagcttggtgggctacggtccataggaatcacaaaagagttggattcgactgagtgactgagtgcacacccatatgagctatatgggaacaatgtattactgtcatagtataaaaagcatagatactttacttcccctttaattccatattttattcactgactctacagtattcttcagtttcttagcacttccactgaatttacaagtcaaacagattatgcagataaaacaccccccttctaccatctgcctctatctttatgttaggaacactttggaaataatttgccaagtaaggatgcttatgggaaacaatggacatttcacaaccacaaatgactaaccctgacatcagacaattcccagatatataaatgtgagatggtaagatttagcaaataaaaatataggccatctggttaaatttgagtttcaaataaacaataaacttttaaaaatagaaatatgtccaaatattgcatgggggtacattaaaaattattttgtactaaaaatttatttactgtatttgaaattactctttaaatttatccattaaatttagtgcattataatgtactaaattatcctgtactaaaaaattattcagttaatcttaaatttaatttggcattctgtattttatctggaaatcttctgcaatgatagtttgtagtaactttgtcttcctcttctgtctgagtgc

SEQ ID NO: 54484 - DNA, 2054 bp, Bovine  19866880718186
cctgtagttactgattttcctcaattcatctactcaccacccaatatgacactttttaaaacactgattttacctcttcttgtaggatgattatgtacttgaagtgcggcactttcagtgtcccaaatggccaaatccagacagccccattagtaaaacttttgaacttataagtattatcaaagaagaagctgccaccagggatgggcccatgattgttcatgatgagtaagtgccacaccttaaacctctttcacacctgacatgctctgggtgtgtgtatatttctgttatctttgtactaacctaatattttggacccatggtgaattattcagccagggtagattattgcttctcatggacatgattaacacagaatagtttggggttttttttccacttagagctcctgctgaaggcagaagatgggtgcagggtcataggcatttgctcttgcattctatgctgagaacactttgtgtgatgagtcagtgttttagaacctggatttttacacgttctaaccagggagacattcctcagccactgacttcatgggattggaataaaattgatatcatgatatcatttttatttaccagaaatagaaatctgtatccaattgatctttccaagtttctgttgtaaaccaaaatgcatgtgcatattatatatgatacttagattaacctcaatcagattattttgatttatggccaacccattccatagtataataaaacgaaatgtataaccaaatacttaatttctataaagtgtctcattactaatattgtgaacattccacagtgtttcagattaaagcatagttccatggacaataaagtgaggagacaatatattaaaaatttcattgtccttactgccaagttgtcaaggccacaggctctgtgagttccaaatgtgaatgtttgatgcatctgaatggagtctttgtcccttccatttgcctccaggcatggaggagtgaccgctggaactttctgtgctctgacgacccttatgcaccaacttgaaaaagaaaattccatggatgtgtaccaggtagccaagatgatcaatttgatgaggccaggagtctttgctgacattgtaagtaacaagacagcgactcaagcttttcctgttagagcacctgttactttctaggggctaccaaaatcattttgttgtgtatcaaaaagaacacattgataacattaacatgaagttttcaagctgaattataatccatttgcaatccatagaactggaactataaacaataaacttttaaagtttatcttccagaaaattgatggatcaaaaattttcaatttcattgtgtgccttttttgtgagacttagtataattctgaaaaaatatctgtagtagaagcaccaactaatctgatttatccagcaaaataaacattttattccagcgttcaagttctgcatagcctcaaagagcagtcagaaaatagaattcagttgttcgcttttttatcaagccaaattcattttctaaacttaagaagtagctaattctaagagtacttttaaaaaagagaaagacactcatacaatcaagaaaaagcataacacatctggaaagataagtctcaactctgagaataatttggaagcttttatactagaaacaagggctagaaagacaacagggaactttgtgcatgccctagtgggagaagcttaggtgaatgcagaaatcataggctcccttctaaccttctggtctgtatatggaagggccttataaagggtccatcttcaaagctccagcccacaccagctggtcagagagcagggaaggccttgtgcacacacacttcagaggagcccttgttaaaagtctcattcaggcaaggtgagttgtatgtaccaagcttgtcatttgaaattgctttctggagactaaacctacacccaagtttcacaaatgcatttactaagacatgtggtgccaatggtttcctactgtggtgccagccattagctcacagcctttgcaactggcttgcccccaa

SEQ ID NO: 54485 - DNA, 1381 bp, Bovine  19866880739364
ctaaaacaccttaccttttcggcctctcgagttgagtttagattcgggtctgccttctcgccctactgcagttgccttgaatacagttttctttgcctgtttcattctgtatgccgcaatttttgttttgatgttggctgtgccactttctatttatccattcatcaactgttggatacttgtgttgtatcctctttggggctattgtgaaaaatactgctttgaatgttcatgcatatatttgcttttctatttaaaaattaaacattaggctcataacacattttttagaattgtccataaaagggtagtcatttaaggttaaattctggggacaagtgttttttcatgatcaaggaatacatacaactagatgtgaggacctcaaaggtcatttgattcagaatttaacagcctacaaaatttcctattttagagataagacaaatcttttcaatggaaatttaaatggtttgtacaggcaaaaagtgaaaaaaatggaaacaataatccatggctcctgcctcctactcactaagtcttccccaatatcaagggttcctaacaatctggagttactggttattctcttaagttctctgcctgagtaggaacctcttcaagagaaacaaaataaaaaaaaaatttactggggttgaatttcccagtaggaattatttgggcaaataaagagaattgaccatatatctgacctgacctggccatcacttggaattttcctctgaaactttgccctgcccatagggaaaggtttattctcatcatttatgttttgaataaaaatattttttttaatgtaaagacatttttgacatataaatgtattttggtgatttcagaagaccaaatgccatgtagaacctataattaacaagtattccactggaaaaaaaaaacaaacagtaagctcttgttttaatgattcaggctaaaggacgacagcaaaatatcagcagattttagctttccttggagggctttactgctacacaatcagcatttgtccttggtttttaattacttacgttaagaaagcttttttcaatacaagattcccaggtgttggtagctctcttcagttcctttatgtactgttcccttaattgttacttcaaacaatccgttacacattcatatgctaattacatggtccttgggcgtgagagagtaccccacttttaaaattctacttagaggtctgatagatgagatgtgatagctccaatgaacaagaaaaaaagaatctaggttcacttttttttgttgcattgtatactttgaaaaccagtaaatcctatatagagtagagtctatcaaagtgcttacatattttaaaatcaattaaaataatgaaatatag

SEQ ID NO: 54486 - DNA, 1078 bp, Bovine  19866880770543
taatgactctccttataataaccatatagaagataagtgctagtgtctccccccacaatattcaaacattatttcatgaacttttaaatttgtggaaaaagaaacttactacaaattctcatgcttggaatttcaaggtaatttgcaagttgtgacgtaaaaattcaaagcatattttatcaaagatagagaaaaaataaagatcacaaacaaaaatttggatatcatttgcatatgtgctgctctgtctgctcaaaattgtaaataaaaaggtcttggatatgcaataacaccttgggtaggaaggcaaataaaaacatgaaactaactgcctttcttctcctgggtctgttttcttaattatgttatggtagggcaaccagtatagctactaaaaacatgcatttcataataattggtgttgtatccagttcattgggtatagttcttgacactcttaatacattatcatacatggctaattagctgtttgaaaagcattcacaatgtcctgtgtcaggtgacttcatgcccactgcagttactacctgcccactgcaattttcccagcacattgtttcctccagtcttgttagaatagggcttatgaattgcttgagcagagaatctcagttagcaacagcaagcggtgcatctaaaaatccattaggaaactgtgataattggacacaggtcagcaatagcaattcatcacaagaacccccagtaaacacggtttgcccataatcaccaaaggcagttgcttgctgagctttgcacttacaaattacggtgcttcatagagatggagaatgaagtgcagaaggtagccatgttgaacttgacctttctttctctagtttctaccacaacctccactataacttagatattgattccacagcttaaaattatattcctaattccaggcagggcttccctggtggctcagtgataaagaatccacctgccaatgcaggagacgtgggttcaatacctgatttgggaaaataccacattccatggagagactaagcctgtgcgccacggaactactgagccccatgtgttgcaacta

SEQ ID NO: 54487 - DNA, 1196 bp, Bovine  19866880814042
ctattaatttttctgtcaattggaataataagcaggtacatgttcttcattaactgcctactatatgcaagggatttttttcctatcaagctaaatcaagtaaaataatttatgaaaatgtgctctgagaaacactaagctccgtagagttaaatcctgtgtgtatatgtgtctgcatgttatctgctcttgaactctgcatttcaccaaattctccttatggtgattgcattgctttattttatccatatttgcccaagtttctgccttggagtcttacaaaggtatcatcatttaaattgtgcatcacgttatttgtctttgtatcatagaatataaatgtgaataatattcacatgtataataaaaatgctttcttttcttatttttaaggacaaaagtgtaatggaattaaaagacattagaataaaattccttaaaaataccttcggaaaatttagttaactccgggtatttaaaagtatcttattttctagggcaggaaactcgccccaaatttcagtacaaattcagcaggtgttatccccagattcaaaatcagtcttctcttttatccttcaaacctgagcggtagtgtgtcaatttggactgatgctattgtgggctgaggaattgcaggaaaacctgccagatcagagcctcccaatatcattgagttcctagcagtgtctcatttgttgaagacaaattgttgatttgtctcattgttgaagaagttggtctttattgcatcctcttgatgcagtttaccgatagaagggagttaaaacggttcaagtgttttggtgagcatccgttctgtcctccatgacttgcaaattggcaacaccttacatgatgcctgaactgcttaataaaaagtgagctcctcagtcaagaatctgagcaagaggcagtcctaaatcataagtgatgactgtaatgaaggatgatcaggtttcaacgcataaacttacattcttagatttttggctttctttggacaatttgttttatggctacctggcattgattgagctctctttttcttatatccttcggacacttaaaatctgaacaaaagttggcagattgcaatatttttaacatttatttacctggagatattttaaagaattgaaggttttgtgaatatcaaatgccatcaatttaactgaatcagtgtgtgcaccata

SEQ ID NO: 54488 - DNA, 1017 bp, Bovine  19866880860919
cttctcgtcgcaggggcttctcttgcggagcacgggctccagggcacacaggcttcagtggttgcagcacgtgggctcagtagttatggctcctgagctctagagcacaggctaaatagttgcagtgcctgggtttagttgcttctcggcatgtgggatttaacttgtgtctcctgcattggcgggcagcttctttaccgctgagccatcagggaagcccccaagatattttttaatgaaataatctttaaaatatattactgtatctcgtttatagtttttaaagatctgtatgtatgtacacatatgaatttcaatgcctagaatgggctctagaaatgcacacagctttctggtagtgattacctctgagagggttatacgggaagggtgagtgtttagagaatctgtgtatacactttggtgacagccctcctaagtctgaatcctggccacttgctgtatgtcctctctagatccttcagtctcctcatctctaaagtatctgggtgcctgtgagtattgctttgaacagatacagagcataatcaacattatatgaattagcaagtgtgaaacaaaggttcatcagcattattaagggagaattttagtgcaactgctgttttatttaactcttgcagaataaatcaatgtactagcttatagtctaaaataagagcaaatccagaaattttgatgtaattgttctaataacgatggaattgtgtaacaatgttgaggcattgagttccaagacctcctgcccattcactgctaactgaactaaactactcagagtaaataattgctcctctgctatctcaagggcaggaaattattgctctttcccctttatgaatcccacagtgctgtgtacacagcgggtgtgcgctgtttgctgataatgataatagtggggatgctgacagctgtgacacactataaagcttaatttaaaagccatcaggaaaatgtaacacaaaatatggcccttctgaattttgtctgcatggg

SEQ ID NO: 54489 - DNA, 1654 bp, Bovine  19866880889136
ctggtcttacggaaaacgatgatctagagtcggcagttcctgccgagcgcttgcacacagagagatgcctttgtgaagtcagccatagaaacctgcagaaaattggccttctttccttaatagaaccacgcgaacaaagatgagtttgttgctgactcagagctgaaagctttgttttgtaaagctctctgaatatattgcactctgccaaagcagaagggctccttcttaaaaaaaaaaaaaaaacgaggaagaactgtcagcggaaaccagacaacaaatcaaagtgcacacccttggggtggatatttgtgagcaaagtggtctgaaacttttttttttttttggtgaatactggtcacatttcacaagctgaataaaaatgaaagggaaaggaactttaattgatgggttgccttttgatttgcagagcaaaactgccagagcagatgtaccagcaaagaggattagattgtccctgctatgatgcactgaaattttctttttttcccctgtagtaaccccattgaagagaggctgtctttagtgtctaagattcagcgctgcaaagaaactgttgtccttgagtacaatgggccactctcccaaggccagacagaatatgtgaggagaaagctaatatctctttaaatccaggcaagacagtttcagttttactgttttcaaaaggcaaaaataaaagagaaattcgtggatgcattcagagttattaaaatatgcattcgtgtgaagcttaaaacgttcatgactaccgttcattattttcaaaactcaaattgaatcaagaagggctcacagcttgttttcttgtttaatttcatcagtccaggatgtttagagcatttgtttgtttgttttgatttgtttttctgttcttgttgagattctcatcagaaagatagcgctcactctcattaaaagggaataattaccagaatgttcatttgaattgccatctgagaaaccaaaatgatctgtaaatcacactgatggtaaatggtgtgcttcagtgagtctcaagtgaaggaagatggagcgggttgttcttgttatcacccttagtatgcttgggggaggaaatgaagaattggagaagtgcgtttcttcttatagtctagtgccacatcgttttgtatttttcagttctgggaaaaaaagtaaaagggcagaatgctactcagctggggtctgagtcccctgaaaatagctgtggttctctgtacaacctaggttgtggaaaagcatgaatgctggcaacaccacagactcacttattcaagggaaaagtgaggtcaaccgactgcagaagtgaaagaaacagtcctctctccctctcctcatcctccccactacagctccttagtgatgagctgcaggtctgccccaggggagagaaaactatttatgcaaatgatttctttctacactggctagccccagggtcaggccatctcttttcagctgtgaagttctgccttcggacaataacaagtaaatgcacagttcacacacacaaataagcaactgcacaaataagctagcatccccctctgttttgatagcagttatcacttcttaagatataattaattctcatgtgaaaaataactttcaccttatggtctcagtgatg

SEQ ID NO: 54490 - DNA, 1539 bp, Bovine  19866880897074
tagacagacgctttaccatctgagccaccagggaagtccaagaggtgagagaggcttgacaaaaaagcccttggacatctactgcataaggtctttactgagctcctagcttttaatccagtttcaatggtaatgtccttttgtctaccagagtccatgaattaaagataaagctgcacgaagtagaaagcttctgaagaagggggtttccaaaacaagacttccttccattgagagggctttaaatttctcttttaagcaacacaacctttaggggttcagtttttctgtatgattttgcttttctaattttatcattctgctgggtagtaacaactttcattgtactgcctaggaatttatttcaatgtccatgagctcaattcaagcttttggaaacaaactaaaatcacgctttttacacatagagttttctgagcaattcctaaaggtaggcaatggttttctgtaagagtattgaattgaagatcaatttaaggcatctttttgggggcatggggaggagtattgggttttttaaattagtcttctgtgttcattaactattgctaactttcaatcttgtgttaattagccatatggatagtgcagctcatgttcaaggctataacactgacttactttaatggtaaaatgaatagatgccaaataaattttaaatgagatgaacacaaggaaaaaatcatttcagtttgctataacccatttggacaaagcaatatttgcagcagttactaaagttcacgtactctggaaatcatgaatacaggacttttgatattagacacaaatcttaggttttctaacaaactttggacaacctgtctaagctctgaataatttgaatctatctctcaagttccaagaatgggtttggccttaacaacatgaaggctgagttatttgaaacaaaatggattcaattcagtaaaaccagcaaatggccattgtttccaaaaaaactgactttgggtctgtctctctctttctcttcccatgtctctttctttgattttaatggacgtgtgatataattaactttatgtgtttgacatatttcacccgggcttttggctaagacattaacattccattccactttctcgtttgtagcgcatggcagttagaaaaggcagatgccctgtccactgctctgtggtccctgctgtcaggagccggctgtgtgaatgtgggggccaggcttcctctattagacctgccacagcagctgggcatttgtctatcagtccatctgtcaacccctagcaaaatcacacaagtatttccgaggctaatgctgactctggtactaagataatgagctcagataatgaggcaccacttccctttggatagcttagttgcacaaaaatgttgtgatgagaaaggactatttaggtctaatgaaagtatttcttagaaaatttaatgcacacacaattcctccaaagagtgcatttttaacaaactggaaaattcttgtggagagatacaatctccaaatggaagaagagatta

SEQ ID NO: 54491 - DNA, 1925 bp, Bovine  19866881040216
gagttaaaaggagattaggtaatcacttatagtaaactgtatctttatttactctaaccagctttatatggtgaactgtcacttaccttgtgacttgataaactcacagggaaaacactgcttgacagtatgatttgtttttataaagcagaggggaggatttcagggttatattctgagtagtaaatggccataaatacaattcttcaaaggcctggaaaacacaaagattgcttataataaaaaccatcccctagtatatcttaaataacaattaattatctatattgtgctgacacacactttacattcaattttttcttcctggtgtcatacatctttataatgatgaagaaataaagctaccatatgttatatgcttccagatttatgacaattacaaacaagaagaagcagagtaagctaatttcacaaaagagagaaatctatttattgaaaaattcagtacctagctggcagtgatttgcaaactgtgaccagaagagctcttaagaaatgaaatatccatgttagtaatgtgattccactgaagacatttttcatatgttattttccatttttccactgttttcactagtaaaaccaatagaaatcatctaaattaaatctaataggaaatctgatcactcagaatcagtaatggtaaatagagattcactgtaaatcctcctgctcagttcagcccagatctacaagcatctaagagctgtttggccctctgttagcaatcttggcagaaattcagaagattgaatggagatgaattcttaatgacttcctaacatgtaggtggggggctctttccagaaggagactgagacacaagatctgtaattacagaatgaggaaattgggtacattgaggcttctcctcaggatggaaatacaggaagtcagttagcagaaatgcgattctgccgttagattcaaataacaacagaggagttctcaatatgcatttaaaatattagtttcgtttgaacaagaagcatttattcatgttggttgtctactgagactttttcggctattgaaaggccgctatgtggctttcttgagtcttctcgggtctaggatatgaattctgttttgtgatcaatttcacatttgacatttggtcctcatgctatggatctctaggtggtcgtattttgcatcttggagatgtgaaatattatgtgccaggttattcactccttgcctagtttgtgtgtcttggaaagttgtttcaaataaccaaattgccttgctgtacacctgaaacattgtaaatcaatgatatttcaataaaaaataaaatataatcataaattctagaatgagaatatctttccttgtgttaccatggttttccttaagtcagattaaacatatgcctgtttcctgtccaatatggaaggcacaagccacaagagaccagtcagcacccacactggggctgttctgattgacttgcaatatgaatataaaatacacaccagattttgaagctgtcatatgaaaaaagaatgaaaatatctcagtaaggtatttgtatcagctacatgatgaaatgatattttagatatgctgtattaaatgaaatacactattaaaatgaattttatttgtttatttttacttttaaagatatgtggctactagaaaatttgaaattttacatgtgcctcatattgtgtatctattaaatagtgctgtatagctatatagtcaatatattatagctacaaattccgagcgaatcactttaatttctttcccctgtcccagtttgtatgttttatgcagcctacaagacatttgttgtgggagaatacacaaggttcatatgaggcagagtcattggtcacccagaatatgaccctcaatagcagcaatactgccggatcagcaggaaagaaggg

SEQ ID NO: 54492 - DNA, 943 bp, Bovine  19866881099297
agtttgttttggctaattgacaaaaccagtctttggttgggagagtgaagatggtaaggtgtggcagagttttgaatactttcatggaccttcaattttctaacagttaaaacaaagaaataaaatatgttcttttatttctaaaatatttatgggaaaacagaagcatactgcccatgcaatggttaaaaagacttaaaaaaaaaatgattgtccttacacatctgtaaggaaattatatgaattctgacctcaatctatccacttcctacccaaacacaaagcatgaaatgatacatctgctaaaaatggtagagctttgctttaattcctcctctctcaattttacaaacaaattccaagaggccaaaggaaacatattattttgaaagtgtagttcatttctcaaagatattattatttccctcatcacacagtatgaagtttcatgtggtagcccatgtaatttttatagctaaacatatggttcaaggacaaaacagtcatggtccacagaaagcagagattcaacaaaatggccgccattgcttcacttaagtgggttgatcctgactttcttatatatctgggaaagtgtataaaaaatcttcatgatttaaatatcctggggcactattcatcacagaaacaaagtgaaaaagaagtaagttaatttaaggtttattatctttaaagagatttagtgttaaaattctgattgccaatttgcaccatatttatgtttggttatggaaggcttcaattctctctttatgcaccttggctcctgtccgtaggcggatacccattttttttcccttggaagagatgttgggatttgaggttgggccaagaaaagctaaagcggctaggaggcacttacagatggagataattagcatattaaaaataggccagccagatttttttttttttttttttt

SEQ ID NO: 54493 - DNA, 819 bp, Bovine  19866881156651
tctttcctaatttttgttcccctctcttgctggcattccctattctgttgctgagtgaaggaattagttagggtaagatagaataggctccctttataggaaaggtcacttacagatttaaaattctgggatgaaaatggaatgcatgaccatgatgctctatttctatttctgaaacaattaagtcttccctcatggcaggattattatttaaccccttcacatccactacagagtgggtatggtaatgtgcaattcaccttggatttgcacagctcatttctgtcactggatgtgttcttacctatcacttcaacagaaggtggtaaaatttgataaagataaaattctgtgcttttatacattcagagtgatcgttcacagctcctctgggacaaaaataaaaagagcgtaggttgggggaaaatataggtctacccacagttttgcaagaatttttctttctgtttcttcccaaatagtgataataatcagctcagaattgattaggtttaatagattaaagaaaaaaaatctcatctagcaaaaaacctctttcttttaaggagttttatgcttcaaattttaatggcatagccttttaactgtttactttgaattatgtaaagactaaaaatgtatgttagtttttttaaatctctaattacttggtttaattaatagagacaatttcacagcatagacgaaaaccaaagcttttatgagtcactaatttatttatcataggaattaatttaattgcctgtttcatgcttaaaacagctttataatactggttaagtaagtttcaatacaatc

SEQ ID NO: 54494 - DNA, 1784 bp, Bovine  19866881208051
attattttatgattattttaaaatgtattaacccgagtactcttctttcttgtaacagtatttctcattagaaatggatttatcacatttctcttaacgctgtagtttgtgaaacgagaacgaattatagaccttttcagaagaactttttaaaataactagatgatttctcctctgtatcatttgttagtgtcacagggatgagaaaacaactttaaactgacttttctggaaagcaaatgagatatatttttgggaagggtgtgggttatgctttcaaggggtcaggtctaatgaccagatttcaaggaggaaacattttagttttgataaagcctcagattggcatattttgatagaaatggtgatttggagtcagttgacttgattgatgaacatatttcaaaaactctggtcacttgtttgctgctgctactgctgctaagtcgcttcagtcgtgtccgactctgtgcgaccccatagacggcaggcagcccaacaggctcctctgtccctgggattctccaggcaagaatactggagtgggttgccatttccttctccaatacatgaaagtgaaaagtgaaagtgaagtcgctcagtcgtgtccgactcttagcgaccccatggactgtagcccaccaggctcctccgtccatgggattctccaggcaagagtattggagtggattgccattgccttctccatctggtggttcataacaaagctcaaaaaagtacattgtcatttgtgatggttaatttcacttatcaacttggttaggcaatggtggtcactagcttggtcaaaccagtcacaccaaatgttaccatcaaggtattttttaagatatgattgacatctaaaccagtaagagttccagtaaagtgggtgaggctcggaaatatcagttaaagaactcgagagcaaagactgaggtttcctgaaaaagaaggtattctcaagactgcaatgtagaaattttgcctgaatttctagcttggaataaattcttaaaaacaaaacaaaacaaaacaaaaacctctctctctaaatacatatatatttatataagcatacacatatatgtttttctaaggaaccctgacttataacttgctctttttcttttcctccttctcagtttccactattttagttggatgtgcagttatcaaatggcacaagaactgttgttcgtgtttcactgaaattattggcactacaaagaatgtggtgccaaagccacatctgggattaagaggtttggaagacatctttgggatggagctgtagctgtgataagaacagttttcttttttgactgtgctgggtcttctcattgaggtggcttctcttgtggagcatgcaccccaggctcatgggctcagtagctgcagtgcgggagcttagttgccccacgacatgtaggatctcagttccctggccagggttcctacccacatccgttgtattagaagatggattcttaaccactggaccaccagggaagtcccaattaagaactctaagtgcctttagttacgtgtatttttactctgttttggttataccacttgttccctttaaacaagatggtatgatggaccgagatgtgtaattcaattgatggtatccatcatgtgtggactcacctttttgatctttgtgtttcttagagtaaaattcctcacagtataataagcaagcacttgaatactcttttgagtaaccagaaagttcccatactcttcactcccatccacaggccagtacggtcaca

SEQ ID NO: 54495 - DNA, 2242 bp, Bovine  19866881211349
ttgtgtggagtctttagggttttctatatgcagtatcatgtcatctgcatataatgacaattttacctcttccccaccaatccgaatactttttacttctttttgagactatttgattcttgaataaactacagagaatgagaatttttaactcttattatcattaatttaatttatatttgttaaatttaccattctttctccaaagtagaatttaaacttaaactatgagctaagaaaccccacagcacccttgattaatgctgaaaaacattataaagatttccccatctgtctacaatttctatgacagcttctcgtcaaagtgatgaagtatttgcatccattatcaagcaaacaacctgaatctcctgccttgagatagatcccacaaaaagtaactactatttcaaaggctttagaaatcccacagacctatttttgctttataagaaattctacttcaatgtcacaaggcaaagtaactgacaaagtgatatagaaaacagctagcgttcagaaagtttgatgagttctgtacctgttcacatcttcggtttgatgtctgtttttgaatcctttatggtctacttttttcctttcatccacttaacatcccacagtgaagtcctcttggggacaaacttttctttcagatgcttttcctttctccacccattaccaggagcaaaatcatcaataatgactgggatcctgagtctacctgaaatgaagagaaatgtagagtctttccaggaaccaaagaaattctaggtttgcatgggtttgagaaggaacaatattgaggattccaatatcaaagaaggcttagaaataagagtccaaagcagctggcatgtcaaccaagtattttttaaacctctccatgtgctcagaggtaaaccagtaagaaaggggtgaaagtgaaagtgaaggtatcagtcatgtccgactctttgcaaccccatggattatgcagtccatggaattctctagcccagaatactggagtgggtagcctttcccttctccaggggatcttcccagggatcaaactcaggtctcccacattgcaggtggattctttagcagctgagccacaagggaagcccaagaaagggtaacaattgggaaatatcaaccaaaggtgtgaaatgagggagcagtagcgtaaaggaatcttactgatctaatagtctgtaattcatgttcttttccattgtagagcttaagcattaaggtaggttgggagggagcccaatcctatgtgtagcaagtttacagttttctaggttattatttgcaagtcatttaaactttttgtacagatcattaaaagaaagaccctggcctagaaagaaaaactcatgtaaatcaaaatgacattgaccaaaaaagaaagaaagaaactaacaagaaagaagtatgtaaaggcctgggaatataagagataggtaaatttgggatcaatgagttaggattacagttaatacttagcaaatgtttatttaacactagtatttgctcaaaatgttatacttattatctcacttaatagagaggtaaagtagtcatcttaagcctgcacagatacttattacacttgaagacagaaaactcgattctctgcctccagggccaatggcctagtgtttttaactcggcacgtgttcataatctggagccttaaagtctcccaaactgatggcctgattttaattgttcaaaggagcaagagcaattgctactagatgcaattgactacggagaatttgtttttacaagtagccagttaacacgaatgaattatgaggtgacttgtcactggcaaagatcagagatcctgtctctcaggtacccacaggggttggagaactatatccttgggctcttccctcttaagggtctgtactttttgaaggggaaggaaatgctggaatgaggactactgtcaccacagggtcagcaagaaagtcagtcctctgagaagagcagatctaatggtgaagtcagcggcccaagataatgaaagaaaccctgggggaataaaagcaggaaagaaacgatctggagatggttaacaggaaaatactagtgcacttgcaagaaagaaatccatcagtataaagtaaaaactgaagaacccttgggaaatcgagaaaatgctgggagaagtcaagggtttcttctattttctttctccttggtctccaggtaacagttatatggcacaagcatattt

SEQ ID NO: 54496 - DNA, 794 bp, Bovine  19866881260796
aatagcagcatcaagaatgtactgattttcgaaatgtgggacagaccattgttctaatcttgaaaattttcaagatctttgctgtcgtcccatcataaaaactaccaagacacattcgcagtattttatttttcttacatctatattttggttgcatactcacttatggcctcttcctattattataataataataatatgataataatatatgttattataattttctatagagagaacaggaagatttcctttttgcagtatgatgaataacgattaaaaattattggtaattttaaaaagtttctcctgattttacagcctcctattggtaatgtgcttcccttgtggctcagctggtaatgaatccgcctgcaatgtgggagacctgggtttgatccctggcttgggaagatcccctggaaaagggaaaggctacccactccagtattctggcctgaacaattccatggactgtatagtccatggggtcacaaggagtcagacatgactgagcgactttcactactggtaatgtcacactaagatgtgctctgacatgatgaaatacataaaatatacaactttgcccacagactttggtgctattgtcttaacacaggacatctaataattatatttcacaaattagccatcaggaaagacaaaaaacatgtggcacatttataactgtatatgctgcattattggacatattcttaacaagaaagaacttgttttgactagacactgatgaggaccaaatcctccccttctaactgtatacgtctcat

SEQ ID NO: 54497 - DNA, 658 bp, Bovine  19866881262828
gtttcttcttctctgccttggctctcagattggctcataagactagaaatagaattgttgtagaagatattttcaagtatgtaaaagtttatagattactcatatactcattatctaggaagtatttttgttattgccatttagacaagagatcaaacaatagtttgactaaatttttttgtggacctcaccacagtgtcagtatgttgttatcctagggaaattgctgaagggaagtgtataaattcgaattgggcagataacagggtttccttttttctttataccatctttctccatttctgtgatgagcttgccaattaaaaatacattttgattgaggtctgaaactgatattttggactcaaaattcaatgaaaaagaaccacagaggcatgcgaccaataaccactcaaatttaagcgaattagaactcttctgttttgccacactagtcagaaagccacaggcattccaccaccccaaaaagatctggagaactgacggaaagtataaaaaatgaacacagattgtacataattgtgctcctacattcttactccaacaaccatagaaagaaccccaaatttcaattcaaaggtctcccttgcaaaaataagtttttctaataacaatttgactaagtttttcactcaag

SEQ ID NO: 54498 - DNA, 1173 bp, Bovine  19866881279596
gaaaagctagcataatctaatgattgacagttataataaatgccagatagatttccttctctaatcaacttgatatggcaggatgagtcaactgtggatatagaatctgttattttaccatcatattcacattagagcttggttttgtgatttgagaaatagaaccccttaatggaattaattttgacattgacaaatactggtgattcacttagctttaccttacatacttctgaagtgaaatttcaaaaggttattttgttattatttcaagcataaaaggatcaaatccttaaatgcactcggtttagatgtacctgtatattcctgcatgtacatagctaaagactaaatattcttttaagtggatttgggggcggggatagtagtttggacagaggctctaaagaataggcactaaataaattatgccttcaattcttaaaaaacaaaagctcagcaatttgataaatgtctatgaagttggatttcctttcatcccctactaaggaaacttactcgcagtccaaatggttaataacttttattttgctagaattttatataattcaagtgaatagagtcagagtcaaatataggagatgagaccacccacaaagcagtttagcaatatagtaagaacactagtgctgaaatcaggcctggggttcaggcttagttcctgcacttaattgtgtaatattgggtgtgttatttaacctttttaagcctcagttactcatctgtaaaataaagcttgaattattgaactcaaagaaacatttattttctagaagagtgcctggtaaatagtaaatgctcaatgaattatttctattataatatcaataaacattagcatatctgtattagggttctccagagaaccagtatgaacctacagagatatagatacatatgtattagttggagttctctagaaacccaatatgaacctatagagatatagatatgaaatatatagataagtgtgtatatgggggggaggtggagagagagatttattgcaggaattggctaatgctatgacagaggatgtgaagtcccacagtctgctatctaaagctgatgaaacaggaaagccagtatcgtaacctactctaagtccatgagcactaatgtccaagggaaggagaaaaggatgtccagctc

SEQ ID NO: 54499 - DNA, 1112 bp, Bovine  19866881280576
actttgcttgcttcacagcttgtttaccggcaaataagaattcccccccatatactcaaggttatctttaattgtaaaagaaactttttgttgtttcattagtactagtttaacatctttaagcttttaatcagagtgagttcacaattgcattttatataattgaattgaagttttaaaaattggtaaatttgatagaccttattttaatattgttttctgatttagttgtctgtattttaaaaaatataaaccttttatggtataaagaatcaggttattttatatcataaatatctaaatgtataatctttaatgtcgcaactatttaaatttataatcttttagagcctggtttttagataagtccctcatcttaaattattatatcctaattcctgaaacaaaaatatgttacctgcacattaaataaggatctattattcttgatatacaaaatgaaaatataaaatcaaaggagaatgggtttaatgtacatttggccaaaaatatgggagaaacctattttgttttctgcaataaccaaagtaatgctgtcattaacacaatcatgttttcaatctgtgtagataaaatttgtttcaaaaagatatactttagttatttggaattgccgagttggaaagagagcaaaattaccttgtgggggaacaatgaaaaggaagacttaagggcaaaatggaaaaatggagaaaacaactagaatcaaggaaattctattttcaggtcatatgcattggatatggaaaagactgtggtgaacagaatgagattgttaggtttggaacagcagttattgtctaaaaggttagctataaataccagcagccagtctgcagagatagaatccaagttacacattagcctattcattcacatttaaacatgcaggaagtgagagttaaattgcttcaccatgacgaacatctttaaatattagaaaaatgcacttgattgattgagaaaagacttctcagctcttgtgctgaggaatatcaaatacttaatgtctgaaaagtaggctatgtgtgaaacaaaaagatgcctatactttagacgggtgggggtggggttggggtgaagtgtggaat

SEQ ID NO: 54500 - DNA, 1198 bp, Bovine  19866881302820
actagccaagaaatccatttaagattaaaagcagtatacgtttttcttaacaatatcttgatttttaaagaatcagttccaagtcttctgttattcaaatcttgttaaatatcagtaatttatggtaaccttgaaaagaaataaaccattgggattttaaatcatgtttatatgaatttcagtggatctttgctgaatgccttatactatattttaattattttattaacttttctgatactggaagattagactcaagaatcgtgtaaaaaagaggggaacaaagattttttttcctttgattttcattttcatcattttctcacttttcaaatattaaaaagtatgcattggtattttactcacccttctttattttaaactctatttttccccagttgatatttttatgctggacactgatggagtaataaatactttactacacaaaatgttttttagaatgtgctcctatttagaaggtatatagtacaaagatattgaagtacaggtaactatagatattttcttgaactattgttcattcaggaaatatttatttaggccttaagtgccaggttctaagaaaggttctgtgaaattacagtatgagcaagaaacagaaacatactgtattccaaatagatccaggctatcttagccattcaggcttctacaacaaaataccatagactggtggcttataaacaacagaagtttatttatcacagttctgaagaaccgaaagttaaaggtcaaggcaccagcagactttgtatctagtgagggctgtttcttagatcactgttttttcactgtaacctcatatttaggaggggcgagggatctctctggggtctctttaataaaggcactaatccttgatgtcagtcagagcctttatgacctaatcacctcctaaaggccccacctccaaaggctatcacatggagagtaggattctaacatataaattttgggagggacttaaaccttcagtccattgcactgggattgggcttccctggtggctcagacagagaagagtctgcctgcaatgctgaagacctgggttcaatccctatatcaggaagatcccttggagaaggaaatggcaatccattctggtactcttgctggaaaattctaggacaggggagccggcaggctatatagttcagcagtgcaaagagtcaga

SEQ ID NO: 54501 - DNA, 1676 bp, Bovine  19866881336361
ggatgggcctgtcactgctgcccacataccattggttaaaacccaaccatatggtcacacacctgactgcaaggaagactgaggaaatgtagtcatgctttgtgccaggaagcgaaagaaatgagtatgatgaatgcctagctagtctttaccatattctctcacatgctaagtgtgggaaaaaagaaaaaccactaaattcagattttccacctgtgatttagccaaagtatgaagtatatggagggcttcctttgtagctcggtcagtaaaggacctgcctgcaatgcaggagacccggtttcaatccctgggtcaggaagatcccctggaggaggaaatggcaaactactccagtattttcacctgggaaattccatggacagaggagcctggagggctacagtccatggggtcacaaaacagacacaactaagtgactaagcgacaacatgaagtatatgaaaggctaaacttatcatccatacgatgcatagaaggacgtctgctcttagagaaattggttctctgggacaaatacaaacaagaacaatcatttatcagtgaaaatgcaataaacactttcagaatttttgattaaaatataaaataaaacaattttcatcccattttctttcatcatggataaaggaaactaatgatgatgacacccaaatatgtaaatattttactccattacctcctttctccacactcaccaatagtaacaaggcatagttagcaaagcgagttataaagaaacgaagaggggcaatgggggctcactgtgataactcaataggtagcttgttggtctcagatttttctgatctgttggagctggcaaagaagtgggtatatgtagaatcaatagatagggagataaatccttgatttaaaataattttccatcttcctttcctcttgcataggttctacaatattcacataaatggggatatttcttcagagccaacaaagtgcgtgtagatgccagcacagatctcagccggttaataggaacccactggaaccttccaagaggggaaattacataggagctccttgtccattaatcctgacaacacctacttactgaggagctctcatcatggtaaacaacggaaatgaaagtgaagtgaggcgtagtcttattcattacatctaatccagggccaagcatagcctatacatttagaaagctccacggtaactcccatgagcctcatgattgagcaccaccactctcataagataactgccaagtgaggtagtggagggtgagtcagctctaatatgaaggggagaccaatcagatggctaatgatatttagggcaggatgaaaatcaagctcaacaaagcatttctctatgaaatgtaatatgattgcaatgaatgtttttcaatgatgcattttgatcaaactagctatagatgaccaaccaaagtgctctttggggtcaagatcagatgaaaatttacgtagagacaagtcactctaaaacacatgaaatttggcaaaaatgaaaacaaacaacaatatcacctagacatggattgtctagctgcttgaaacaaaggtgacttctagtcttctatatacagaggagagccctttcctgtgtattgtgggctttatgtgtatgccatcctttcctgttaagagtcaggtaca

SEQ ID NO: 54502 - DNA, 1041 bp, Bovine  19866881422560
aaaagcacaagagccactcttcagacctttggaaccttgccagaggcagacagccatcagcaacagaaataaagcatgatgggtgtgaatgtttaggataaataatgaaacaagaaagcctttttctaacagagaaagtggaatttagataacacaatactgggacttcctggtagtcccatgactaagactctgctcccaaagcaggggccaggattcgatccctgctcagagaactagatcccacatgcctgcagctaaagatcctgcatgccacaactaagacctggcagagcccaataaataaataataaaggtaaattcttttttaaaaaatagataaacccagtatttcaacaatcactgatcacagtgaataatacatgactagaacataggctgtcatttaactaagcattactgattaaactccaacaaaatattccatttctgatttttcaaatccatggcgcagtggtaaagaatcctcctgccagtgcaggagatacaggagacatggcttcaatccctgggtcaggaagatcttctggagcaggaaatggcaacccaccccagtattcttgccaggaaaatcccatggacagaagactctggtgggctacaatccatagggtcaaaaagagtcggacacaactgagtgactgagcacacacatacacacacacacatccagtcacagtacagtaagaacgccccaatatgaactgatctagaaagcagaagaaaagtggaaataaagtaaacctcatctccaatgtcaggaacattcttaataaagtatgcataatgagaggcaaatgcaattgtaatgaagcatgatggcagttacaaaataacatttcccatgaaacaagtaagcagaatgggtgaaataagagtgtcagtaagtgctttggggaagggctggcatttcattttacaacagatttcttagatacagaagaccagaacattcataagatcactccaaagttctacttatagccacagagatgttgctgatgctaccagtccacttac

SEQ ID NO: 54503 - DNA, 1033 bp, Bovine  19866881487177
tcatttaatcattttcttgtttttaaaacacactaatttgacctggagtttttctctagtttaactctagagctttaaagaacaaatgttaattacatctaaattcttttacattaatatgttagaaataataaaaattcctttattagatattatttaaactgaagtgaaaactcattcatttaatctttttaaatgtaagactttatcaaaaagagacatggtgtcagcaggaattactttagtgaaataaattagaatttcaaaaaaaaagtgaaaagcttacatagctatttactgattttcctatttcctaattttccattttgaatcaatattcaaattgaactgaatactcaaatttgaatttaaaatgttacagtgatatattgagttttcagttttagtattttaaaccaaagtggttaagtaaagaaaactggcagaaacttgcaactattccaagcgggttccatttattcactttccaaaaatgtaaaacaaatgcaacatatactttaaatattcctgagagataccgcaacttactttaatttattgcaggagaatgtggcagattgcaacgactactttgggacctttgcaggttattgaatatttacaataatataggatatgtggtgatattcctgtcctgaaaagattattaccaaatagaaaatatatattcctaagagaggttttaactgtttttggaaagtcactatgaattgccaagtaattcaactatgttgtagaactcaaagcttattgcatcaatattcattaaaataagtatataaaagttaaattaagctacagattactccattttaagaaaatttagtattaaaaattcatttataaggttaattaggaaggtaattcttcaaattttcctctccttgaatctttaatatatctctattttaaaataccaaatatttaatacatctatagtttctttacatttatttatctttctcagtttttacagtgaatctacattgctttataataactagttccttta

SEQ ID NO: 54504 - DNA, 905 bp, Bovine  19866881526848
aattgagggttgcatttatgttcaagatttaatctttattagatttaatctgaaaatatgtttttattacatgaacattgtataaaaggaaaaaatagataagcacacagaagaaaataaaaatcccctataatgttattatccagagataactgctatgagaatttgggggaatatctttctagcctttctcttaagttaaaaatatattattatgtctcacaaaaatgaggctgtaccatacttgttttttgattttgcattactgaatgatataaatatatcattaataccattcttaattttatgtatagtatcgtcatagcaatttattaagtttgtcacccagcttgggactttcaggttatacttatttattttgctattttaaatttctaatgtcctcattttgaccaagagagaaggaaaacgtgtcatgaaaattgttagaatcctactcttggtaaatgcatggtagaaaaatatattatgcaaaatacattgcaagtaattgcaaaagccatgtgaggtctgcatatccatgtaaacttcttggggggagagatcaagccttatttgtttttttttttttttttgcattcataggaaaactcaataaacatttgtgactgaatgagtattttaccagaactcagtcctctatttttgcatttttacatagcattgctatttattaaaaggcatgcatttttggcatcatggaatgcacgctggctcttctaagaatcacagaatttagtagaaccatttgatcttgaaggaattagtaaaaattgtcttttagttcatgagaaatatatgtcagtaaccacacaaacaggaggtgatgtccagctttgtcccctgcctcccaggaaccaatacctgcccgctgccctctcctt

SEQ ID NO: 54505 - DNA, 3051 bp, Bovine  19866880633962
gttctgccacagtggcccatgagataacagctgcccttcttacccatgtacagtttgagaaaaaggttgagatctcttagaccccaaggtctctaataactcattttactgaataaacctatgtgcccctcagagtacaagctatccagaaggaaacctgaaaagaactaacttcactttgctgtatagtagcaaataaattttgcctcttttgaaaaatacatccaattcccactgtttgtgttggtgattttatcatatacctaactcatacatatgaaattttagaagcacacacatgtgagttcctgtgcctatttaaaggcaacatattctcatgtaacttttttttacattacttctgcacccctgcaaaaacaactgtaatgttttaactatatggctcaaagtatgtttgaagttctgaaaagtcaagtgtcttctcatccttcatctcttccaaaaactgtctgtctttttcacttgtttattatttcagctgaaattctggaatcatttggtcatgctccaaataacatatgtgtgttacgtttataaataaattttggaagaattatttttgtgtgaacaaatattaaaaacacaaatttttttaaatgacaactgtttgaaagattgttgaaagaatattatcttctgtaacaacaaacccagtaaagtgctatttccccactacaagaacatcttagctcaatgtgtcaaaaaaaacccaaaatgcttttatcattatttcattagtgtatggttctgctgacaaaaaaaaaaaaaaacacccagacagaaaggaatactcatggagggaaacaggctacatgcattccagaaaagtttggttatgtttttgaaactcttaccaagaaaggtttctagtgtttgactcactaatttcactgctaggaatctacctattaaaaaaaccaccacactattaagggtctactgtattgcacagggaactctactcaatactcagaattgatctgtatgggaaaagaatctaaaaacagagcagatatatgcatatgtgtagctgattcactttgctgtatagcagaaactaacacaacattgtaaatcaactatacctcaaaaactatttttaaatcatcagagatacaatttaatatttatgcacaagatgttgttattcagcaaaaaaacatatgtaactttgcaaaaataaggggcaaataaattagggttaattcaaatgacaagctatccagctgctaaaagacatgtatttgtgaagaactgctaatgccagacaaaatgttcctggtattacacagggaaaggagagtaggattttaaatataatagtatgaccccaaagcaatatgtaaaaaatatatgtgcacacaaacacaagaaatatttacactggcacctataaggtagttaagagcatgggcttttgaaacaaagcgacctggttcaaatcccagatgtgtggctttccagctgtgtaaccctgggcaagtcagttaacctctctgtgcctcagaatgctcacctggaaaaatggggataacagtacctacctcacagagtggaacattaactgagataattcacgcaaatacctcagtatcatgcctggcacactgcaagtattaactcctagcaattattagtaccattaacaccgaaaatgaatgggaggaattgcaccaaaacgctaataggggttatctatcttgagataagattcctccaggttctttcaattttctcctgtgcaactcttctggtttttttcaaagtttctatagtattatagaatcggaaagaaaaaggtgtcacgaaaaagaacgtcttagtatttgcctcgtgctgtagtggatgaaggcagaaagggtacaagacttagagcggagagtgagcaacactctccctcatgtctagcggtttctagtggtttctccgtgcgctgtggctgcagccctctgaacctcgctactcacaggcgcggtccctcggaagccgtcctccccggtgttggtcacaggaaactcgccttgccagatgttggcataatgctggcctttcggctgcagtttgttgccccaggggaaaagtctgttagaagagacacaggcatcagcctgtcaaacatgcacaggcttctggccacaagtcaagaagaggaaggcagtgaaagggagagagcacactgctcgcttgttccaagtgagttattttatttttttaatacataaagcttttaatcaggaatttttttaacttccacacaaccaaatcatgtcaagctcacaacaacatcagtctctcccgaggcctcaggaggcctgatataaatcacctcactaaaagacgggcttataggaggctgggagagcagccatcattctggacttatatggaagcataacggggcaccataacactgcactttttaataaagccttcactattttaaggagcctttttagaagctgaggcccaatcgtgagttttctgtctcatggctctggaagcagagaaatactgatgtttcaggagacgcctaaaataagaaacccctaaaagcgaaggcagcctgccagaggggctcgaaggaggaccacgtggcaccgggatggggctgcgtggccggcgcccaccccaccagccatgcgcccacctctgcctgggtatttcctaaggaacttcaccaacgtgagtaaagcccagtaggaaagagctgccctggtggttgtggttttaaatcaactgtccagagtaagttcctgtggatttagaaagaggatccacatactattaagcaaggggagaccctccaagtacctattttgcaggcctcctcgacagctgtactcccattcggcctccgtgggcaaacgctttcccgcccacgtgcagtaggcgacggcgtcgttccaggagacatggagaaccggggtggtccggcctggggaacagagagcgcatagtgaggagggcggaaccggaactggaaacagggaccggctccagccaaccgcccatcttcgccttcacctaaat

SEQ ID NO: 54506 - DNA, 1570 bp, Bovine  19866880798447
taagaatggcatttttcatgatcaagtgatgagaagtatttgcgtacccagcaacttacttatctgataataatctgacccgagattcagtccgaggtggggagtggctcttgtaggaaagatgtaggaaaaccactagcactggagtaaagagcccacctaacctgagagctagcatctggcccaggctctgccaccaaccactgtgacaccgtgggggaaatcactgcattttctccaggcttcggttttcccatctgttcagtgggctttagcttgaagccgtgatcagcaccagaagcaggctggttaccatttcacaaggcagcgctggtgtccaggagccttgtctgtccagaagtaggtttctctttctttgggattataggtcttctttgtcaagataagacaagtggatggaaacagccaagtcttattctaaggccaggtggggacacggccaggatcttgggtcacagggtcccctggactagggtggcagtagcaaactcagcactcaactttctttcacacctgctgtcctttgctgcccgtagtctaattgttgctaagcaacattatttctgctttttttttttccctcccttttctttcggcaaggccttgaaggcatgaaccggtatcttatttagtttttaaatacccacatgccaaggggagggccgctcttaaattttgtttgttcttttgattgtaatccatgatgggcctttcgcagtgggactctgtttctgcctgtcgtgttaaataaggcagagaaatcagtctatttaaggtgcttgtcaagtatatgccttgaggcacattcaaggttttgtgtgtgcgcgcagctgctttgtgggaaaagtctctggcaacttactccgtattcacaaaatcaattcaaatttaataaaaagattagtaggttttttataatattcatttcagatttacccgcttatcccaatctcgcaccaacagactccatctaaagagaacaacactgtaatttaaatcaattccccgggcaacatagaaggctcccagcatgtcacacagtcactggtgcgatgcctgctgcttgattataccagagtcccacacactgcacatggcccttgctggattcctgccgacttgctcacagctttgagatgcttgtctgaaggtgctgggtgtcctgcgcatgggcataggaaagctttttgctccgttgccttggatggctttgtttttgaacagctgagtcacccctggaaagtagaccttagacccctgttgtatattcgttgactcacaatcatctctctgctaatggagagcacatttcagctctgcgtgcacagagtgcttccagagtaagggatctgttttctttgtcatctaattgaatctcgggtctgctgttgtggcttcctccattgagggcaaaattaaagtggacagagagcacgtgtaattgggtcatattttcatactgctctacagttctcctgaaagcacaacctagtggttgatgaaggactttcttttggcaaaggcttctataatcctgtcttcagagcat

SEQ ID NO: 54507 - DNA, 1267 bp, Bovine  19866881392693
aaataatttaaatgacttagtagaattacctaaacaactattctctaaaactggcatgtaaattaacattaaagataccacagaaaacattaacaggctgaccagaatattatgagccaacagactgccctcccttttctgttttctttctaattattgctaggctaacaaatgacattttcattggtactaaacctgccagaggttctttgtgagctggcttgaagaggaaaaacttcataattatacaatctatgtagcaataagcagatctaatatttttcctttaaagagaactttggggaacagatggaccacacactatcagaatattttcaaattcaagtattgggttggccaaaaacttcatcccagtgtttccataatatcatactgaaaaacctcaacaaactttttttagccaacctagaattaacagaagtttgggggtcattcatgtcagttttttcccctgtgttttaatatttgagacagaggtcaagttctgcttttaaattcagcctctttgttttctccttcttggccctctgttttgctctctcaactttgctctctgttctaagctgaaacccagaactgaccaggacggtctggcggtaccttcctgctcctctgatcctaacaatcatactcactataaacaagtaccaatagccagggagtttgggatggacatgtacacacagctatattccaaatggatacccaacaaggactcactgaatagcacagggaactttactcagtgttctgtgtcagcctggatgggaggggtgtttgaaggagaacggatatgtgtatatgtatggccgagtcccttcaccgttcacctgaaaccaccgtactccaatacaaaattaaaagtttaaagtctgaaaaaaagaaacaagtaccaagcaagcacttacccaagtaatttctactaaacactttatttttgcattatttcatctctcctcacaaccccaagaggcaggtgctattaccatccccatttcacctgagaagatgttacctgcctgaaggtggcaaggtgagtaggtggaggagcaaggaaatgatcccagataatctgattttggtgctctctccacacaatgctaagggctttttatttttatttttttaaagacttattttgatgtggaccattttaaagtatttcttgaatgtgttaaaatattgtttctgggattttttttttttttttggccatgaggcatgtgggatctcagctccccagcca

SEQ ID NO: 54508 - DNA, 788 bp, Bovine  19866881713019
tttctcagaatcattcggagagaagcaagtgagtgactgtggagtagacctttcagcagatgtagtctgtaccctctgatattgggtacactttcactgacccagaagtcacctttctttaggatgatgctactgtgtaccataagggcttcccaagtaactcagtggtaaagaatctacctgccagtgtaggagacgtgggttaaatccctgagtcaagaagatcctctcgaggaggaaatggcaacctgccccagtatttgtgcctgggaaatcccatggacagaggagcctggtgggctacagtctataagatcacaaagggttggaacacaacttagcaatttaacaacaacatctatatactatgccttgtttaggatgaaataaactgatttctctgttcttcagaaccaacctcttcaggattggatagactgtgcacgctcttttgtgtagtatgttagcatattaagctttctgaaattaaagaactacctgcattattagatgacaaattctgtttagcaatgtatgctatcagcagatgatgagaaagttagttcttggttgtggaaatccagtgtgttacttattttctcttaatagttgcttcctctgtgtttaggttgatgggtttttagcatttagttattttatggccttgtgttgaaaaactaccatggattttcacaatttttatgatccatatctcaaataaaacatatgtatctaccattgtagaagtcatagtgttaaccattttcttgggactttgcgctttttct

SEQ ID NO: 54509 - DNA, 878 bp, Bovine  19866880574056
atgcccagcagtgggattgctggatcataaggcagttctatttccagttttttaaggaatctccacactgttctccatagtggctgtactagtttgcattcccaccaacagtgtaagagagttcccttttctccacaccctctccagcatttattgcttgtagacttttggattacagccattctgactggtgtgaaatggtacctcatagtggttttgatttgcatttctctgataatgagtgatgttgagcatcttttcatgtgtttgttagccatctgtatgtcttgaattgaaaaatgaatttagaaagaccacaagagacagaatgacttctggcatgttaataaaagaaaattgatgctttgcattttttctactgtctaaaatgtgtatatccattaggtatttacatctgtagtcttaggcaaaaagatcagttttccatcaatgagaagaaatccgttccccaggtgtatattatatgtgagcatgcttgtaattttcttgctgacaccacaaattctcaataagcctttgactattgaacttcaagttctaacagttgattgggagagaaggcatttgaataccaattcagatcctctcaactcagtagaaatctgtagtgctagttatttgatgagagttgaacactagcctcttctttggaggatttgcctccatgcggtgaaacacatgaaaatgggaaatgttttgttttagaatgactgaatacaagatcaatatttatcatggagactgttgacatcccattaagaaaagttcaactgcaatttggagagatgcttttggtgggtttgtgagggaaatcggctttccattgaatgcagaaggcagtttgtaataaattcaaa

SEQ ID NO: 54510 - DNA, 980 bp, Bovine  19866880857653
cacgactactggaaaaaacatagttctgacagatggacctttgtcatcgatagtgtatgtgtgtccatccctatctaccctttcttatcccttctttcctatctcttctgttaacatttatatgcagtctcaccccctttcaggggccttcctgagagctccttcctcagctctcctaacaccgcctgcctctgcatctcaccccaccacgtcacaatacaacacctgctgggcttgcaattccctcccaaaggcgaagtcttcttcggagaagacctgtgtttgtttgttttcttacctctctgtccagacaacctatattatctactcaatgaatcagaattaaatacaagaaccaattctctccatttaatgaacattttcctgagactaaatactcggctccatatttgtattagttgcccatgtaagacataaatatttatggaaataaagcgtgggaacatctattgcgcttaggacagtctcttgctgttctgatctaatttaaaattagattcttttttcaagcaccttagttggctctcggagacattcctaagcgtgggcatctggttttatgtagcgaggtgcccttttctgtagacagggggcgctctatagttctcggtggtttgttcctttaagaacctgactctccagccttaggtcatcgggccttctatttctgttgatgaagagattgcctgaaagcctcttcccaaattctgactgctcagcttttggactcttgcccggtgcttgataactctttttaattagccccttggtgatcttccctctctccaaaaataccattttgttgtagagagacaaggacaatctctttgccccaagagacaatcctcaatccccactgcagaatcagatgactgctgtaatggatttcagaggtcccggtgatggaaacgtgtgtgctaaaccatcgttgtccatttcttcatggtgactgtcattca

SEQ ID NO: 54511 - DNA, 3221 bp, Bovine  19866880859619
atatatgtgtgtgtgtgtgtgtgtgatagtgaaggcttttgttgttcagttgctaagtcatttccgactctgtgacttcatagactgcagcatgccaggcttccctatgcttcactatcccctggagcttgctcagactcatgtccaatgagttggtgatgccattcaaccatcttaacttctatcacccccttcacctcctgtcctcactctttcccagcatgaggttcttatccaatgagccagctcttcgcattaggtggccaaagtattggagcttcagcttcagcatctgtccttccaatcaatattcagggttgatttcctttaggattgactagcttgatctccttgctattcaagggactctcaagagtcttctccaacaccacagtttgaaagcattgattcttcagcacaaaatctgataaagttattgtactatatgcaaactttcttttgttgattcaaaaattacaattgtatcacttagcttgtatgattatttgaaaaataaatgattgtgatgatatcagcacagtttccaatacgtggttaaatgttcacttaatgatagtttattgtatctatttctgggttatatacataaacatgccttccatgattgtctgtctttttaattcatgatctgtctttaggattttataatctaagatgaaactcagtctgttttttcagagttcatgaggttaatcaactcaaattatgggtggcaaattctcatggattctcagcatatttataaagcagatgagaattttgtattcttgaatacattaaatcaagccaaaggcctgatatgataagcattcagaatttcttttctgagatggatccccccccccctttttttttttttcagaaaactagtgaaaatttgtctcagatttaacagctgaaaccagatgcatttatgaaagagctggcaatctatatgcaatttgagtgctctgtcccaaaacaaagaggagtagaaactgtaagtggccaataaatatttgtcaagtatgccttgtgaagatctatcccttgtttcattttgattaagcaacactttctgtatatttgttgtaatgtgattctttccctctgagttaaagcatgttcccatatcagaaatgggtctcccttcaaagagtttttagtctcagtgggacaaagacaaaactttatcatttttataatatgcaaaaactgtagaaggcttatgtaattgaataacaaaatgaacactagaggaaaagatgaagaggtacaggaaacagaggtatcaaagagatttgtgtagtcaaaagacagaagtatgatcacaaaaaccatgatagtacgatcaactcaagtcacagatagagatgccctgcactcaagaaatattttaaattaaaaaatgcctcgttagttagaataactctttctgtttagatgcacttttaagaaatctgaaattcattttctaatactgtgtacatttgagacataatgatttgcgggattgcaaaacatttttgttaggattgctagatattgttctgttacaagtttattttgttatagtacatatcctattcatgacaaacatgcatggttagtcgtgtccaactcttcgaaagcccatggactgcagcccaccaggctcctctgtccatggcatttttcaagcaagaatactagagtgggttgccatttcctactccaggggatcttgcctacccagggatcgaacccacgtctcctgtgtctcctgcattggtaggcagatttgttgcctctgagtcacctgggaagcccccatggctggccagtattgatgaggagaggaaagggtgctattttgttcactcaagaacaagttgatacgtgatttaccactttgtaactgcattaatggaaatgcaagggcatctgggacttcacaacagagggagaaatagctgtatgataatgtattaggctcttacatactctgaacatattcacactctgttctagggttgtcaatcagctctagtcacatactcctgtctaaatgcaaagacttttgggaaaatatgggagagcagatagaatgtgtgttagcgtagccatccttttccaaagggaagtgattcaatttctaacttcaaactaataagctcatcatggtcaaagtcaggaatttctcagttcatttcagttgttcagttgtgtctgaatctttgaaactccatggactgcagcacatgagggtgccctcttcttcaccaactcccagagcttcctcaaactcatgtccattgagttggtgatgccatctaaccatctcatcctttgtcgtcccttctctcacattcaatctttcctaccatcagggtcttttccaatgaatcagttcttcacatgaggtggccaaagtactggagtttcagcttcagcatcagtccttcaaatgaatattcaagactgatttcctttaggattgacttgttggatctccttgcagtccaagagactcaagagccttctccaacaccacagttcaaaggcattaattctttggtgctcagctttccaactctcatatccatacacaactactggaaaaaccatagctttgaccagacggaccttttttggcaatgtttctgctttttaaaatgctgtctaggttggtcatagctttctttccaaggagcaaacgtcgtttaatttcatggctgcattcaccatctgcagtgattttggagccccccaaaataaaagtctctcactgtttccactgtttccccatccatttgccataaagtgatgggaccacatggcatgatcttcgttttctgaatgttgagttttagtcctactttttcactttcctctttcactttcatcagagcttctttagttcttcttccctttcttccataagggtggtatcatctgcatatctgaggttatcgatatttctcctggcaatcttgattccatcttgtgcttcatccagcccagcatttctcatgatgtactctgcatagaagttaaataagcagggtgacaatatacaaccttgatgtactcttttcccgatttggaaccagtctgttgttccatgttcagttctaattgctgcttcttgatctgcctacagacttctaagggggaagatcaggtggtctgatattcccatctctttaagaattttccacagtttattatattcacacagt

SEQ ID NO: 54512 - DNA, 1204 bp, Bovine  19866880895159
ggtggggagatttgggagaatggcattgaaacatgtataatatcatgtataaaatgagtcaccagtccaggttcgatgcacgatgctggatgcttggggctggtgcactgggacgacccagagggagggtatggggaaggaggagggaggagggttcaggatggggaacacagggtatacctgtggcggattcatttcgatatttggcaaaactaatacaatattgtaaagtttaaaaataaaataaaattaaaaaaaataaagatcatttagtcaagggctaaagaatgaagcttgcccatcagctgtttttgtaaataaagttttattggagcacaactgtgtccattcacttaaatattatctatgactatttccacagcaaaatgctgaactgagtagtttcaacagagagcatattgcctaaaatatttatattagtatgtgtttgctgactcatgatttgttatagtccacacctctcatttagcagatcgaaagcctgagccccccatgtatgacaggacctactcaaggtgacacagtcttagaggaaggtgagaatcagaacctgaatctcttcactgccatccattagcaccttcttttgccacaatgcatctcatcatcctaaagagttgcacatcacagacaattaattcaactttgttataagatgcagtcaaattcacttattttatgagaaatagatattatctatcaatctatttagatagatatatatctattctatatcacctatatctatatgtagtggtgtgtgtatgtggtttttattgtatatgcaaagtccgacatctaacagctgttttgtaacatctggcacacaagaggacctgggaccagcaaacccccaggggaagctgcaacatcattaatcgagcttataaaagccaagctggaaactgtcacaaaatcacacaaagtttcatagaaaattgatctgaaaaagatgaagctacaccaatagctcaaaagccaattgtattaagatgccagctagctcttttcctttaggggatttttctataaacatgaaaaataaatgtatgttgctcagtggtatattgtagaaaatggggagggtgtgtgttcataatagaagatatgggaaatttgggtagtaataagaacaccagtgttttacaggaggtatctgagtcatcttttccttatggggtgg

SEQ ID NO: 54513 - DNA, 1008 bp, Bovine  19866881000015
catgaaagtgaaaagtgaaagtgaagtcgctcagtcatgtctgactcttcgtgaccccatggactgcagcccaccaggctcctccatccatgggattttccaggcaagagtactggagtggggtgccatcgccttctctgcctgcattggcaggcagattcattaccactagccacctgaagtatatttgcactaccttgtttaaaatggacttcccaggtagcacagtggtatagaatctgcctgtcaatgcaggaggtgcaagagatgcagctttgatccctgggttgggaagataccctggagaagaaaatagcaacctactccagtattcttgcctgggaaatcccatggacagagggctgcagtccacgggggtcacagagttggacaagactgaaatctctgagcacagcacatccagcacatttatcaaagctctactaactagttgcatatactttgaccagaaatttagcctcataaataattatcctagtagaataattgaatcaatttccaaagatttaatactataattttatctcaggtctatttataatatggaaaaagtagaagtgcccaaactagccttcaagggagaattggtaaataaatcatgctttgttcatttcatagattgatcattcagaaatcattaaaaatgacattgcaaacctccacttaatgaagtgaaatggcatgcagtgatcaattttgttaatacacacatccatgtaaatatatatatagagagagacacatggactattataaaccagaatagtaattattataatttatgagtgtgagattatgatctaatttttgatatatttgtattttgttgtgtttccatcatgtcataaactttttaaactttattaaaagaagaaagtaaaaacacaagctgtatttaatgatacagttattgttcagtcgttaagtcatgtctgactctttgtgactgcaggacgaagcagatagccttccctgtccttcaccgtc

SEQ ID NO: 54514 - DNA, 1199 bp, Bovine  19866881116030
cttttaaaggtgttgttttctcatttaaaccgctgacaatctagtgggaatgggaagggtaatttttatatttctgtaactgaaagaaagaacaaataggagtctttctctcttccttgcgctttctctaagaaggaactgtttatattgaatgtgtgtactgaatttattattaccttcaagcttacatatttgagatatatgctgtacatatcttatcatcttcataccattgtactagcctgcctcaaaaaggagtagaatttggaattaaaagacatggatggttgtgcatctgaaactaacacgacatagcaaatcagctataattcaacaatgtttacaatttgacaacatatataattcaatagtgtatatgagagtatttgttactcagttgtgtccaactctttgtgatccccatggactgtagcccaccaggctcttctgtctatgggattctccaggcaagaatactggaatggtttgccattccctactccagggcatcttccccacccagggatcgaagccaggtctcctgcactgcaggcagattctttaccagctgagccacaatatataaagaagtgcaaacaaataaacaaaaaagatctagatgtgaatctcagttctgtctcctactattttgttttgtactatttcatttctcaaactggctgtgggtcacagtgatgatactgggaactgtcgtgtataggtttggagactgggaggggaaccagactggaagaaccaccatttagccaagggtgtagtagaagctgtgtcttaacaaggacggtctcttctgaattgttttttctgaggcaatgtttttctttgacatgcctttggacctatccattatagcttctctatttcatgtcatgacctggctactctatccatcacttttgttggcagagcaacactggcttcttctgacaggaagagcttggcacggcttttgccttcatacctggctgggactcttagctttggataacttctcaaatttttattttattttttttaaaaataaaggttcagtaaagtatgttccatcaccatgctaatattttgaaccaaatattcaatgtaaatgtgttgcttctttaactggttaatttgaaacgaattttatccaaaatattttatgcaagaaatctagctgtttatcacatgtgtgtaggtgt

SEQ ID NO: 54515 - DNA, 571 bp, Bovine  19866881157955
aaaaaagttaatcttccaaggttttctgagggatgtagcatcaaagtaaagttttccagaatgaggaggtgttgcaaaggcacttggaaggagaaatgacagaatcatctgtattccaggccagaaaaaaagtatgttccagatacttgtggtaggcagattcttgggaggtattaattcaaaactcgtactttttatcccaagtaaaacttgcaaaaactagaaaaatggcaacactgtatttactagtttagaggtcagagattcagagttgcctcaaatttgcataaggaagagatggtaagcagtcctcactagcgtatctaaagggatggtgggatgatagatggcattttacaggttttgatatgtatagaggtttcaccaaggaatgtgaaccaaatccatctaaagaactcagagcttgccctgaggccttgaaagaactttctcctgttttcaatacctcctgctttccctgggaccactgtcagaatggtgaaaagccagactgcatttggagaaggaaaaaaaaaaaaaattacagacagtgagagtataaggaagtcat

SEQ ID NO: 54516 - DNA, 951 bp, Bovine  19866881257496
gtttctgcatccatttggtggtcacagcctctgtacaacacccccacaagccctccccacagtatgcttattgcaggtatcctctcttgctaagtgttaaggggggagggtaaaatgaactttcaaagtcttcactctgtaagtatacataggtgggcagagtaccattttatgatctcaagacattcagcaaaacatctggtttccccttccaattagcactctcaagatacctgagctgtattcttacatgccagtaatcagtgagagctgaatcattaagaaaactgcactacaaagacacaaggattaggatggtgctataaagggcttccctggtgactcaagtggtaaagaatttgcctgcagtgcatgagacctggctttgatgccctggtcgggaagatcccctggagaagagaatggcaacccacccccagtattcttgcctggagaatcccatggacagaggaagccagtgggatacagtcaaatggggtcccaaaaagttgtacacaactgaacaactaacacacacacactgatatggtgctacaaatttcatttgtcccgtcaccctcattttattataactggggtgtaggaaaggtgaaaacacagtgaaggcagtgatacccttgcagaagccaaaatgcaaattcatgtctggaaaaaatattcatttcctgccttagatttttgcaaacgttaatgacaagactatcacattatgcatgaatatgattagcataattctgcctaatgaattaattccttctatgaaactaaaagtagaaatgtttctctttcctctaagcttctctaatagatgcagttttgctaacagaaattattattttctacattatgatacatttattaggtggattctcagcttatgcatagatgggtgaatagcgaatatacttaattgctgtctgtgcaagtacg

SEQ ID NO: 54517 - DNA, 2253 bp, Bovine  19866881288645
aatttatatcattaaaagacttatcaaaaagtttgaacactgttatttggaaagtcatatttaatttttaaatgaatctgggttttccataattcaagggttttatgctatacatagtgtgttttaccaatatagacttcatatatcttttgtttaatatagaaaaattcacaaagaacctataatatgcattgggacatatttgtttttgttctttagaacacaatgttgaacatttaaaacattttttcatttacagccccattctctcttttagttaaccacaggtaccagttttgttaattaagaaagaaaaacattttaactcctttctattttttctttcattatcgtttagtgtctaaaaattctttgtaatgtctatttccaaatatacctggcaagatccttatttagttaaaactgttctggaaaacaagggtttagacagtgagcttgcttttttctctttttttcaaaactaaaatgtattatcattaccaaaattggaatatatttttataattttgaaatattttagagtagtaggaagttggaaagttatcacagaaagtttctctgtaatcgtcttccagaatccctattggttacatcttattatataaatagaatcaaagggtcacatatttatgactatttgtataatattctcaaaatgacacaagtatagagatggagaacatagtaatgattgtaagagataggaatggtaggtataatgattacctggatctaaacatatgatcggagaaggcgatggcaccccactccagtactcttgcctggaaaatcccatggacagaggagcctggtagtctgcagtccatggggttgcgaagagtcagacatgactgagcgacttcactttcatttttcattttcatgcattagagaaggaaatggcaacccactccagtgttcttgcctggagaatcccagggatgggggagcctgttgggctgccgtctatggagttgcacagagtcggacatgactgaagcgacttagcagcagcagcagcaatggtaaagaacctgcctgccactgcaggagacataagagatgtgggtgcgatcctttggtcaggaagatcccctggagcaggacatggcaacccactccagtattcttgcctgaagattcccatagacaggggagcctggtgggctacagtccacagagtcacaaagagttgtacaggactgaagcaacatagaatgaacacatacatgcataaaatgaatattcaaaattatgcataacccatgtgaaaacccaaagtaagtgatatatgatcatgtttacatggttcaaacatacagagtagatagaaggaaactgttatttctcactatgactgtggtaaccatgttaagacacacctttgtgatttgaaaatcagaatgtttatttttagaatagatatctgaaaagtttgttttcctctaataaaagtatttccattctaaaagccccatttacttaaaaacattctgtattttctcctttaacgttgccagatttttttacaacatgaaaaaatctcattcccatgagaaaaaaggcagctgtgtgcctaatatagaactgaagcataactgctttaaaaatgggccttgacaaatccattcaaacttttcccatcttcagttgttagacagtcagtggaaaggcaatgatgggttatggaaaatgtaaggaactttaaaaataaaattttctcttaagctcactattttaaaaaatatcaaaacagtgagaagttattttcacttgatcatttttatttttcctatctttttttctgatttatattcctactaaagaatcttaaaccatctgagattttcatcctgattcagtcttgaataggaccatcttaagtgagaatgcttggaacactgaatttcagaggttttaaaatttattacagatggaaacaggacattccaattaaaattaagacttttcagaagaatcatcaatatttcccatgtgatccatttcttgctgcccttctttctcttccatccgacatgttttatggatactttaaagcagtagctcaaattattacagttctgtgtccatacgtggcagtcgtaatcactctttagcactaagtaattttataatgttagaaatgacactcagacaacttgaatgaaactcattaattttgcaaatgcagaaactggggaccatagatggaaaatggattttcatgtgaca

SEQ ID NO: 54518 - DNA, 1559 bp, Bovine  19866881313918
gtcttagtagacaagatgcatttagaggagagcttacgaattgctctgagagactgaaagccactctgagctttcctggagtgctctgtcaacaatgtagtgactggaaactataaaaatgagaaagtcatttgtctcttaatggcagcagtttacaatggcagcctatgagttattaaattatcagttcaataaagcccagataaccccactctagtacacactacaatttagtaagaattaatgcttgcttcttagctgcataatttttcattgtcattttaacctaaatgcttccttcttttctgatgctgtttcttcttcctggaatgttcttccttctggccacttgataacagtaaaaactagctgactccttatctgtcctctgaatccatttttgttgcccaaagagtagaaaaggcagcctaagatcaggcttgggctctgccatttatttccatttaatcttgggaaatttagtcttcctgatccttggtttcctgtctataaaataggaaaaatactacctatatcttaaagatgttcagataaataagtaccttccaaataacaacaaagcaccgcctgtgcacagagctggagttgataaagatatgggagtttctaactcccctctgtcctctctttctctctttatttatttttttgaactttatagcattttcctatgtgtctctggcatcctttttgatgctataattatttaacacaaatttttatgtgttctcagactggggcaattgtgaaatactggatcatcatttactcccataattgtcactttgccagttgagatatattgtatgaactaaactgtttatggaggacaggacggcagagaagaagagaaggatggaggaggaaagagtgagaattgtatggattctggagaagggaatatgtggattattaatgcaaccacacataaatttgtgcttctgttgaagcagaactgcagttggcaaaggaaactccagactgatcaatattttaaagggatagatgaataattctgaagaaactttcaaatgacttcccaaccttcctaaaaattctgggacttaatcatctatttgaaaacctctcttttcctgccatacttcgatgctttaaaaataatattttgtggggaagatggaataaattttcaactgattgacaactaaaatggaaaagccattcttattcagggcagaggctgccaaaaacaaaaataaaaacccaaagggtagacctggcctttaaaatgcaacctgtcttctgtgtgagttcccaccttgccctcaatttcagcagcccttccagggtgatccattcacaagggatccactcactgatcacattattgatcagtggtaagtctagactactcatgtgttggcactaggtctctcctccccacagagccctatggtatctccagttaaaatttctctactgtgaatgtgaatacagagctgtcatcatttgttacacccctttccatatctctgccttcaactgaggctcacctggactcacagaaaaagccagtc

SEQ ID NO: 54519 - DNA, 1025 bp, Bovine  19866881371697
aatgcaggggaaaatataaagctaagaggaaaaatataaatgattttttttccacagggctcagtttaaataacaaatcagttgcagaatgagaacagcatgctgtaactcttctattgttatacgcactgctgtggaatcttgcttgtataactcagaacatgtgacacataattgacagagagacataaaacaggctaataacaaggggaatcactaacaataacaggaaatatgcaaatctctctctcaagcctgtcaaggcacttctttacttagtgttaagagaatccctcagagataacactagtgacttttgaagaaaacaagcttcatataaaaaagtagtaggtggtggatgatctaataaagcacggtcagttccctcagtcatgtccgactctttgcagccccatggactgtagcccgccaggcttgtatgtccatggaatttcccaggcaaggatactggagtgattgccatttcctactccaagtaatcttcctgacccagggatcaaacctgtgtctctccagtttcttgcattggcaggtggattctttaccacttgcaccacagaacactccagtactcttgcctggaaaatcccatggatggaggagcctggaaggctgcagtccatggggtcgctgagggtcggacacgactgagggacttcactttcacttttcacttttacgcattggagaaggaaatggcaacccactctggcattcttgtctggagaatcctggggatggggcatcgtggtgggcagagttggacatgactgaagtgactcagcagcagcagcagcaccaccacagaaagcctcctaataaagtgtgttatgaaagagagagagagagagagaaaggggaccattttaagcaatttgtggattttttttttcctggataccccatgtcttttaaatgaaacataattatttgggggatttttcttaatacgagattttgttgttgtcctttttaatttggttgtttcattttggccacaaaat

SEQ ID NO: 54520 - DNA, 854 bp, Bovine  19866881391656
tgctaacactagtggctgttgggaggatgaaagaagataaagcatttaatagagatctgcagtctctcagggacttcaaaaggaaagggatagatctttctagttctaaactatccctccaaagcatagccagcatattgatagcacacactggttggaggttaaggactcctgacttctgtctctgcttgactgaaaggaagtaatgaacaagaacaggatctgactaggagagagattcttgcaaccagttttgtgggggcaggtgagccagctgacggctctaccagatcgaactaattacagtgttgatttctctatcaacaaataaaaaataacatcttgcagtccaggtttatgtccctgagaaacacgcttattttataatgtataaacattatagagtacttacttggtctaaaccaagcactgccaaaacctgccgtccaaaaaatgctgttggaactgttaatgttggcaaaatgatcgctatgtgaacagatctgtctgttaaatagactttgtagaggggaatcctaaaatcccagcgttcttcatgcatactaaaagaaaatggctatcaatgccattatttttcacagggaaatagaattattgagtctcagtgaagaaatcgaatacattgtgcttctggtcagtgtgctttgatttactgcatgtgtgataaattaaatgatatcaattgttatttgtctcatagagctatcattcaataatcagcaccattagtccacctcaattcttatatgcaattttgaaaaagaaaattgatccaggcacatatttaaaaatgaataattagaagttatgagcacatatactgtactaacatg

SEQ ID NO: 54521 - DNA, 828 bp, Bovine  19866881607977
ctggccttaccctggatattaggctctggacattctttttctttttcccacttttgtgctgtgtggtttcacctaaaatattgctcaaatataggagctcactcttccattctcctcttactgtttactagaaaactaatttaatttttaaatttcctgttcagaacctggtacgtagaagtagtgaatggtagattcactttaaatatggtgggcttccacttacaagtttgaggtttagaacccccagtgaagacagttaagcaaacctcataatgctgtaattgaaatgttaacagataactgcctatgtaattattcctggtcattttactatcagtaagagagaataaaagcagtacaattcctttttttttttgtttgttttgttcattgcaggtttatttttaatggctaacaactggaaacaacacttcctacaacaggtgattagttaaacctatgatacagcttggagatctcaagaatagaaaagcacgaactattggtaggggcaacaatttggatgaatctcaacgacgttatttccagtgaaaaaaacagctggtctcaaatggtcacacaactggggtagttccatttattgtatctttctcagaatgactgttatgaaatggagaatacaaggaaatcagtgatttcctggaattaggaatgttggagggtggatatttaagtgtaatccaaaggagacgcttatgttgtagtagaactctgtatctcgattctggtgtgtgcgtgcaggcatgcctagccacttcagtcgtgtctgactctttgcgaccccatggactgcagcccaccaga

SEQ ID NO: 54522 - DNA, 693 bp, Bovine  19866881775697
tatgataatctctggatccttcctgttgctgtggattgctttgtttctcctttttttatggctgagtaacattctttacccattcatctctcagtggacatttaggcaatatttccaccctttatatcatgtttcagcaggccaggaattgtatctttagtcattttctaaacatgtacatatttctctcagccctctctcacactgagaatcaaaaaggctgtggatgtgaaaaaaaaaaaaatgcatgtatacaacacatccaggatctttgtgatcatagaatccaacctatcttattcaagtattcagcaacagactttgatttttttaagtgcaattatttttctgtatttttttaatgtagccttttgagacgttttggcattagtttgcaacacattcatgcactagaagttaatgtacattaagtcagttccaggtttggaaccaatccttgttgatgtgaaggtaatatatggtgcttgtcatcggaaatgtgtgtgcaggtgcaatgtatgccgacaatgtgcaattggaattaacattaatcacaggtttgaatttagcagatgctagattttataacatgtataatctagtattaccacaaatggcagttataaaccttctctttttttctgagagacaaattagaaggtaattagagtcacaggcatgaggatatgtgta

SEQ ID NO: 54523 - DNA, 1794 bp, Bovine  19866880368611
aaattgcacaaacattatacacggtatgtattttgccacaaggattaacttggcatctagaaaaatgcttcctttcagtgcctaagaaaaacaaaatctgtgccttttaaagtaacacagtttggagaaaaactgaacacccatgaaatataatttatcatttttaatatcaatgaaaaagtgtgtgtttttggaattttttttttaagttttaagtgatcattcactatcattagtccccaaatgatgagtgcactttcaatttcaaaaaaagatctgtacttatcctgagcttggagatcacttacaatttgggcatatatatatatatttttttttcctcccaacttagtttagctgataacgtaagaatttaaagagagattgatcaaataaacctttgaaatagcttcaatcatgttttaagaaatagctttgttacctgatggcccctggttttatgtttggtaaaagggatcaagtaggttaaaatgtttttaaagtaaaaaccacacatttttcaagaggctgctgctgctactgctaagtcacttcagtcgtgtctgactctgtgtgaccccatagacggcagcccacttaggctcctctgtccctgggattctccaggcaagaatactggagtggattgccatttccttctccaatgcatgagagtgaaaagtgaaagtgaagtcgctcagtcatgtctgactctttgcgaccccttggactgcagcctaccaggctcctttgtccatcggagtttccaggcgagagtactagagtgggttgccattgccttctccaggatggacatgagtttgagtaaactccaggagttggtgatggacagggaggtctggcatgttgcagtccatggcgtcgcaaagagtcggacacgactgagctactgaactgaactgaactgagtgtcttctaggaaactagatctcaaataatacgtttcacaagtataaaatacgttggtattcaaataacattttaactactttggatcaaactcgatatgactatatgtttggaaattaccccaaaatacatgtatatagaatataagtatatcttcaattacccttaatttgtcaatttagtcataaaaatacttcaatgaaacaggaagttcaagttgaaataggagatgttttaagaagatagataaagtggaaactattttgtttggaaaaaatttacactttttccaattttatggccaaatatttgcattaaaaatgaaattgagaatatctagcataaaaatgtaagagctgataaagaagaggaaatcgaaattaatcttcaagtatcttcaagtgaaaggatgcaaattgatctaatcatcttccctctaaagatgttttgttttcattctggcatcaatttttgggaccatagcacttctgctaatttccctgtttgtcttaattattaacttgtttttaagagaatgatttacagtataatgtgtcaccattgttatttgtgtcagaagctggatttaagctttttgagctttctaacatggtcaagagtagtccctggagaaatcagtgttttaaattatgcatttagctattagcaggcaagagataaacaaattgatgtccttggagaaaaccaagtaagtacaaaaaactctgttataaaaaaaaaaaagaggatataaaaggatgatctaatatacatttaacagattccagagaaagagagtatgaaacatgaattgcctgaaactgtagcaggtagataatctctatgaattttcatgtccatgaa

SEQ ID NO: 54524 - DNA, 1804 bp, Bovine  19866880674850
caaagcagatgttaaagaaaagttctgcttcagtgtcaccataggcatttggtttattttatgttgtcttttatatcccgcttatctttttagcaacaaataattctgtattgtttattataccttttagtacattcaggccccccctttgtccagaagaaatgaaatgaaaactctctcaagatgaaggaaaactatagaatcgtataatatctgagccaaaggggtctttagagatcagatctggtatctaaggtttagacgtgagttgccaaaggcaatgaaatcgcttgttctggtcacagctagttaatgtcagattttagatcaaaatgtgaatatcctgactgccggataagtaatgttttttagtgaattatgctatttttctagggtagcctctgactctctttgctttgtattagttttaggaggagttactggttcctgtcacttccccaagacttttgcctgctttgtttcttctaccttttgtttcaaagaacagtatcccatgagttatccattttctttatctctttctgtagctccttccatccccttctcccatacctgccaaagtcgaagtcatcttcttccttgtccagaactttcaccacaccatttatttagcaaataataattgagtacatatgacgtaccaggcaaatatcaatagaagtctaagatccagattctgacctcaaagattttgtaatcccattaaagagaaaagacatatacatattaaagtgtcatttgagtgatacagaaaatatatacaatagttgtttaaaggagatttctataggtttgtatttttaaaggcgggataagatgctggctgagacctgttaaaggaaaaaaaaaaagtgtgatagggaagaagagagggaaatgtatcattggcagaagactcagaacaagaaaatagtttaggcagaagttaagaaggtgagctttgggacaaggaatagactggccctgtcacaggatagataaggccttgctttttcagagctttaatatttaggttacagggtttgtactcctatttgttacccctagaaagcaattgaagtgaaaggatgggcttgacttggtctgcaacacgcagtcaagtggtttctcagtctgcagcttacattttatgaagaagaagtggatctcttttctctgtgttattgaaatgaaagcaaagaacccacccttgtccttgatcattgaagttctgaaaaaattctttgcctgggatcacgagtacttcttaagtgaaattctgaaatgaaataaaggggtatttttttaaacacatggccatatcaaatgattaagcagagaaaagtttccttaatctaagggagatgcattggaagccaccttaaaagtaccattagcatctttgaggaatatagtatattgtctccaaggcattcatagtgtttctaattttaagagatttcctttactgaaattatatatgtgtgtgtgtgtgtgtaatcattgtatcattttatacaatataaaattatttatcagaatttaaaattaaattaaaattgaaagcaattttagtagaatgcgttcattgtagtgatattttctaattctacatgaactcaggaccccagacctatttgaattatgaattttactttttactttgtcatctagtgaaaaataattaaatctcactaggccttgatttatatttctgtagaatgggtacttggtttccatctaacttccaaggataatattggaattaacagaaagatgcatagaaccctgggcttattggtag

SEQ ID NO: 54525 - DNA, 2954 bp, Bovine  19866880701045
aaaagtgaaagtgttaatcatccagtcactctatgacctcattgacttaaccccaccaggctaacaaattcttcttatcatatcaagtaaacttgtgatagactatactagttattagcttatcatctgctgctgctgctgctgctgctgctgctgctaagtcacttcagtcgtgtccaactctgtgcgaccccatagatggcagcccaccaggcttccctgcccctgcctgggattctccaggcaagagtactggagtgggttgccatttccttttccaatgcaggaaagtgaaaagtgaagatgaagtcgctcagtcacgtctgattcttagcgaccccatggaatgcagcctaccaggcacctccgtccatgggattttccaggcaagagtactggagtgggttgccattggagggtatcagctccaaatccatctccctcatctccccattttgtgatactgaagctggaccctgtaaacatttctcctttgtcaagtaactcagtgttagattttgtcaatagagtacactggggactactgtaagttagagcacaggaaagggcttctctattttttttttaattgaaatatagttaatttgcaatactgttatttttgggtgtacagcaaagtgaattggttatatgtatatatgttgaattttttccattacaaatgattacaagagatcgaatatagttcctatgctacatagtaaatccttagtgttttatctattttataaggttaaagcatctgcctggaatgggggagacccgggttcaatccctggatcgggaagatcccctggagaaagaaatagcaacccactccagtacttctgcctggagaatcccatggagggaggagcctggtaggctacagtccatggggtcgcaaagagtctgaaaagactgagcgacttcattttcctttcactttcagtgtacatttgttaatcccatgctcctaactgatccctccttccttcccctttaataactaaatttgtgttctatgtctgtgagcctgtttctgctttgtaaacatgttcatttgtactgttttttagagtctacatatatggcatatcatgatatttgtctttctgacttatttcacttagtatgatattctctaagtccatctgtattgttgcaaatggcatcatttcattcatttttatgggcgagtaatatgtaccacatcttctctatccatttgtctgtcgatgggcacttttaggttgcttccatgtcttggctattttaaatgatgctgcagtgactgttgtggtgcatgtatcttttcaagttagagttttcatcttttccagatatatacccaggaatgagattgcggcatcatatggaaactctatgtttagtttttaaaggaacatccttactgtttcccagagtggatatacaaatttacaacagtagtatgggatatttcccttttctccataccctctctagcatttattgtttgtagatatttttgatgatggctgttgtgattggtgtgaggtgataactcactgtagttttgatttgcatttctctaacaatcagtgatgttaagtatcttttccatgtgtctggggaccatctgtatgtcttctttggagaaaagtctatttagatcttttctttctgtttctaatatgacacttcttagcatgcatgtggggataggcatgcaggaacccaacgctgctggcccttcagtgagtttttccccctcaatttttggagaacttctccagcacaccagtggttgtgggttgactctacactatgccacccagcaggtaacttcttgtgtaccagctctggcccacaatgctcaaggaaactctgatgtcaacacagattgtggcttccaatgagccagctccaagctgggataccccaggcagacctttcctagaagtctgaatatcagtcttgtggcaagggaatggaagagcttacaatgtggccccttttttagattttatctattagccctagagatagagctttctccctaaattttttatttgtgtagatttcagaaagttgattttctaaggaggtgtgctttgggggaaggactcatcagcagagacagttactgggaaggctagtagacaacctttccagcaaccaaggggaataagtcctttagtcttgaaagtcttgaaaaggaatctagaacacacagagcagaattggtaatacatatattttttgtgtttcatagacaaaaactgtatcatccatctctttttagcaggaatgaccctgctttgcagcgttgtccatcaataaatttgtagaattgaagcaaaatcatatgcatgatcctgggatagtgggtataaagagaagattaagacatggtatcagtttttaatgacaattagtgtcagactgggagaccaaattataagttttaaaaggaaacagtataagtgaaaagaaaatgtaagtaacagtttgatgtagcagcagaacagatgccacaaggaattatattacatgattaatcaccaaatgagccacattaaatctttgctggaacaaacaaaaataaattactaaattaatgatatagacaattattgctacaggagtttagttggagtggaaagttaggaaaactgagcagttggaggtaaggttgaaaggcttataaataaggaatttaaaccgtttcttccaggatcctagaaatgtttgaaggtgttgacagaagtattgtgaagaccttagggagaaattgggctggcagtagtgtagtagcttaaagtaggatactggggatggtagaccactaataggcaattttcaaagtctagacttaggtgacagaggagagatggaaatggaagcaactctctttattggaacttcctaattctctgcttcgtgtgatttttccttctcttcgccccagg

SEQ ID NO: 54526 - DNA, 1127 bp, Bovine  19866880740341
aaattaattttaaaaactgttgaaaatgttctagacaaaaaaatattttaaatggtggatggatacctcttgtggtttttagtttgctttggaaacaagtgtgaaaacccattcctttttgaacaggtaataggacatgtttctctgtacaactgcccttcctgttgccaatgtaatgaaacgggaaatggacaaggtggagaccttttgcagataggttcaaggacatgtctttgaaccataataatccagcaaactgtaatatgctctttcaagttcatggagaggaaaccttcatatgtactaaggtgctgtatataataaacccaactttcctcacttgctccttctctctacctccccctccctacacaaatcacttacattcctttagttgaacaacagtgaaatgcagaccatggggtgaggagtgagtatgccagaggactgctccagtcacagtgatgccattggaaggcaataactggaaatatttaaatagaatttggatagcccagtttcagaagtgttgaaaagtagatcttaccatgagtgagaagtttaccatctgttctctgaacacccaccaactagcacattctatggttgtaatcccatactggagaaaatgaggtttagtcaagactattggaacttaagatttcagatttcttgatccatgacctaccctattttaacacatgggatgctatttatcatttttataagattgaaataatgtgaaaatgaaaaaaagggaaaactgttactggcatgcaagacaggacaactatcttcctcacactccttaatgcaagacccaagccagccaaggaaattacttaaaatagacaatatcacttattttttttttctttctagaagatgtaaattcactaggcccatttagcttaatagactgtccaaacataatttctgttattactggtgaagaactgatataataaaaaccaattagttacacatttataaaagcaggttcagcatctctgaattcagtacatggtgggatataaaacctagaatgctcttgttttaaccattcagtattggggttcactttccatcctttactaatagcttgaatagattctacaacttttcca

SEQ ID NO: 54527 - DNA, 1335 bp, Bovine  19866880793467
taataaatgttcctatggaaaaaaattttttttatttataaatttttataaacatttctattacttccttaggataaattcttaacaatggtacacttaatcaaagtatgtacatttttaaaatttccatgtgtatgtccacataactcttcaaacctcatataatggttttccagttttcctctgttatggattgaattatgtctcctaaaaaatatatattgaagtcttgactcctagtacctctgaatgtgaccttatttggaaatagtttttgtagatataatcaggttaaaatcaggtcactgaggatgggtggcagtcatttgatatgactgatgtctttgtaagaacaggagaatttgaacacaaatacacatagagaagaacatcacatgaagaaacttgtgttgttttaagccatctcagtttgtggtaatttgttaacgtaaccctaggaaactcatacaacctctgataatattatgagagttcattcttattcatattcttcttagatgtgagcattcttactattttattcctttcatcagtcagaaaaataaaatttaaaagagacttcatgaaacgtattatatagaagacagagaattattatatcatttataatataagagtatgtaagaatgcacgctcagttgcttcagtcatgtccaactctttgtgaccccatggaccataagggccaagcaccccaccaggtgtctctggggaaaccaatcatttatatgtatttatttgggaagcccacatatttatttataggggcttccctggtggctcagatggtaaagaatatgcctgcagtgcaggaagatccctgtttgatctctgggtcaggaagatcccccagagaagggaatggctacccactctagtattcttgcctggagaattctgtatatatttatttatactttatctaaatatctaccaattaacctacctttaatccttttctttgtttagtaaaaaagatttaagcagctgttttccagttagtatagaaaaaatgctgtaaatttgaaggaagggaaatttacattaagtaaataggcttatgtatcatcctctcagctgaataactggcaaggtctaggtatttaagctgatggctcaagtagtaactggattgtagggtgcaaaccttatgtttgtgatttctggctaacctcttatctctttgcttcaggtcttggcaaagacctaggatggcaaagagtcatctgctatttctatgggatataaggcagagagttcttgtcattaatgttcagcctttctctcaaaagagctaaaatatgcagagttagt

SEQ ID NO: 54528 - DNA, 3079 bp, Bovine  19866880794921
tccttattaacttttttaaaatttgagtcctctttttttttttttttttcttggatagtatagcaaatggtttgttcagtgattttatttttcttgtttttagctctggaaatatatgtttcttcccctgctgcataccagcattctctcctctaccataaagagttagaaacccattctgatatccatagttttgttgtagccaatattttactttaaatgttcatcatataatgtggcataaacattttaaacattaacattgaactgaagctgaattcattttatgattaaatagtagaataggagatgccatatgaggaggccaaggttagttgttttattttttgcttagtaattaaaatctcttatagatatgtgttccctttagagtcactcaagcataaatgaaggtcaagattctattcaatgcaattcaaaatttattgcaagatgttgtttctcacaaagaatcggtattattttctactgtagcaactgtgtcgttttacttgacctcagtttcttcttttagaatcatttaagttagatgattaatgtgtggtggtggtactgctctggtaatggtggtggaagtcttgtctactataggattatggcatgaagagagtaggaagacctcaaaatttattctaatcctcttctgtagaacatgtgtctgttttaaacttgatggcgacaaagacagttcaaggaaacaaagctattgaaggaagccataattctgaagatgtatattcctctttgataattgtggtgagaatgagctctagtactcactctgttccgtgatccatttcttttccttttagagtatttctatcatttttcactcgcacatgagtaaattgcagacttagttttatttatttctaatctctagagcttagcactgttcctggcacattatgccataatgtgtgataaccttgtggtggaggtatttttgccaagcctgacttctatattttatttatttatcttttttcagggtgttcatttattatagatcactttaaactttgtgggacaggacaaagattcaaataacatttcaatacaaacaaacagcatttatcaaatttaagttgagaattaggaaacaacaaaagctaaggaatgtcctgcctcctaacttggtagagtttaaaagctggctctagaagaatgtcctttaagttataaaagtattttgccaataaagctaaactcttactggactctgtagttagtttcttcctctaaagaaaatcgtgtaacttacaggcagttcccatcatgctgtgtttatttctctgtaatacactggaatttttagtttgtactgtgaaagttaggttttgattattcctgttattaagattatgtataaaactatatcatagaacataaattgaaagggaatattatttttgaggaagaataatagatgttatggaaaccatttattaaaaaaataaaggggtaataaaaagtaactgcagatttaataacagcaaagatgtgttttaaatccaatcagggcaactgtcgtatgaataagctgttaaaatatatgtatatttttgataagttctaatgtaaaagtgttacctctttattttgttaagaaggaaaagaaaacatgttagtaaagagttccatgctaaatttttggatagaaacattacagaagagtgaagaattggaaagtaggcaatgtgtacttgaagtgtttcactgtcattattaaatcttaatcaccatatgttaggactgcatagttccatggcagtacagggcttagttctgtaaaaacaatacaaagcacactgctagtgtcgcactataaaacctggtttactgtatgttttagtggagaacaaggtgaatctagaatgccaactttaaattaaaaaattataatctaagatgtaattgtacatcagataatcatattaaatactatcatttttcaaaacagctactaaattatctaacaaaaggatttcagatatgtcatttaggatatgtttatctttacaaacagttcctatattaatttcttgaaaatgctgttctttattgtatgctgggggaaataagattgaaatgaatacctctgttatatgaagagttgacttttcaaagacaaatatgttgtacctgtcattagttaatattatcacataatttattcatattttagataattttattatttcttatatgcaatatatgttataatatttttattatgttcaaagatgagagagcagaaagaaattgtccctaagcctcaaccaattaaattctttcattatagatggtgacaacacaatattatactaggtagtcttaggttaattcagtatatatgtgtgtaatacttttctaagattttgttagcaaaccatgcttttaattaaatacaagtgaaaaaattagacaatatctaaaaaaagtttcagttaaataaaagaaaataaatgtgtacaatagtataaaatgtaaatgatcatactataagcccataagctgtatattttttccattcaggaattttggtgcatttgggaagtaaccattccatgttagtaaataggtctttattttgctggtaatttgagaagaaacataacagtatgtggcttttttttttccttccttttggttggtttgcttttagtcaaatcatgatttcatgtaaaaaatataaacagtatcctgttctttaattccattaattgaacatatttctgaggctttctcaaagacacagtaattttgtttctgtttttattaaaaccattaagctctggctttataatcgtcacatagtaaagcaagcgattgattatgggctttgcagctggccacattttgcattatattggtcttaaattaacatctgtagcctagtctgtgtgtcctttcattatcattttcatttcatggcctcacttggcattaaaggctccttttctgtgtaacctatgtcagaatttctatgtttccacctcctctgctttcaatctagagatttgtgcggaaaggctaactaataaacagtgtcatt

SEQ ID NO: 54529 - DNA, 720 bp, Bovine  19866880964563
gggtggtcatggggtgataaagaccatttggatttaatggaatttaaaacaacagagcactgaacacaactcttaccgaacaagaattttaatggcccattctgggtgctgactaaatagaacgcccttaacaagtttaatcgaaagggcaaggcagattagctctatatagtctttatagttgaagattgtggagttaaaattatacctttaaaagactcattaatgcattttcaagatttaatgtaggttaaataagctttcttcagaccttcaccatgtactgtgaacctaggtttaggaccaagttttaataaggaaatacctttaagagctcactttataaatggaactatatgtgttttttatttcaaaagtaaaagacatttaaaattctttgagaggatccagggtgttgagggtaagtgatgatgaatcctttcatttcactaactgaaaaaagcaaatttgagttttctttaaactttttttttttctttaaacagaacttatttgtactagagaaactgcaaaaataattttaaaaaatgttcttctgcagtttcagtggagtcctggatacttgaccttggtcttatgctgtctttttaattcttcccttgtttttcttaatgaaacttctttgttcaggttaccatactttagtgcattcaggttccttctgcccctgaaaaggacagttctttggtttacactgag

SEQ ID NO: 54530 - DNA, 1813 bp, Bovine  19866881039934
gattgcaaagaatcgacatgactgaattaaattagcacacatgcacttttttaaagataccttgagaagaaaacaattagatgacaatttagtaataataatagaggcagatgaaagtatggaaacaagcattggaatgagctttgatgttccacctttttatttcataacagcatgagaaattcaaacagtgatggagtaggtgatttctgaattttctttaagatattaaatactttttgttcagttattatttaatatatagctgatactggtgacacaacagaaaataggaaagatatttgtccttctggatcttatatactggtattgtgtatttgactgatttgttgtattacagcttgaagtagatagagtttgtgcttacaatgcaagcattgtttatttaaaaaaaaaagcagaactatgaaaattggcctgaggctaggaagtatagcgtatgtttgaggaaaagttagcaatgtattttacttgggtactggtagaaattttagaaggtctcagaaaagaatttcagttaagacacaacaaaatccactaccaaagagatcttaaagaggaagaaaacataaaattgatttatcagttagtcctaggtgtcttctgagtaaaattcaatgcagtagcaaggcaaagccagattgaagaaatttacagtgtaggtgggtggtaataaagtataggcagcggcatatgggttatgtttaaagaaatatttgtagtttataaacatgggtcaaggaaaatagggtggtgagttacagaatggcaggaacatttttatgttgttttgaagggaaaatagaaaatattggtagacaaagaagcatatgagaatagatttgggcaacataatgatgtctggaagctaagtcagggcaaacttgagtggttaagcttgaggaagatagaagtgaaagaaagaggaaggtgaagatgcagagaaacaaagtattgtttgaacatcaacagactttcaaaatcaggaaaagcttgaaatagttattttagagaacatgatggggagctaaaaacaaggaaacaaaagggaaaaaaggaagaaaagtcaagagaatgagaagataagccacagacagaaaatatttgcaaaagacacatctgagagagaactgctttccaaatcatacaaagaactaatatatcttaaaaataagcaggcaaccaaattttaagaagggccactccagtgttcttgcctgtagaatcccaaggacaggggagcctgttgggctgccatctctggggttgcacagacttggacatgactgaagcgacttagcagcagcagccgcagcagcagcagcagcagagaccttaagaggcaccttaccaaataaaacatacagataacaagaatgaaaaaaatctgtcacataacttgacattagggaaattcaaattaaaacaacagtacaataccataaccctcctattagaatggacaaaatccagaacaccagaccatcaagtgctgatatggatgtggagcaataataactctcattcaatgctagtggaaatgcagaatggagcaaccattttgaaagacaatttagtggtttctttcaaaactatatatagtcttaccacatgatccagtaatcatattctttggtatttacttaaagaaactgagaccttgtgtccacacaaaagctggcgcacagatacttatagcagctttattcataattgtcaaaacttggaagcaatgaagatgcccttttaatagtggaatgaataaactgtggtacatctggatgataaaata

SEQ ID NO: 54531 - DNA, 1032 bp, Bovine  19866881100266
atgcttagtaaggagttagcgaaaatactgcttttcatgatgagttccaaacaatactcaatgatagaaaatgattgagtaagcagagtataatatagcagaagaagtgctgtgatctcagtgggacattggtgaagcatatgtcaagaacacagtgctgtaattacttaaaataaacacactaggttgtgttgatagaaaagtgtcaaaacagccttgatactgggttaagtgctttcacctcttttcggtgtattgtaactaatttagttttctcacctccctccttctcttcttcttttcttcccttttcttttattttaaaaaataatttggagaaaaatgagattacctgggaaagacaatagcaatgtctttatttttgaagaatatgctggagaaaattaacagagtttagactctctgaataggatatcttgtattctcaacagaagtttaaagctttcctgttacatgtcatcactgatgacaatgcaggatgggctctgccttttgattcactgaacttccgtgtttgtgttccactgaataggcttgcactgcaccctggggaaggaacacttttatcctgccttggaagtaaagtgtgtgtaactcaatttgttgcaccctgtaagacctgcaccattgttgaggatcctgtatgaatcaccactgaagtgcttcgctctataatatctcctctcagttattattttattttggattcatacccgtgatatacttccctctttcgatgtgctatggattttttttccaaagcaacttgccttctttgagtggcctcctctacaccatgctctgtgcttttatacatttcaaataatttaatctttaaactggatctttgatatagctatcatgctgctcattgattggcaaaataggttcagaaaagttatcttgctccaggctttccaaggcagtggaggagcctgaagttcaaaccctggctttctcactgtacagcctgcacatttcttccaaacctgttgagttgcactcaagggg

SEQ ID NO: 54532 - DNA, 1402 bp, Bovine  19866881137283
tagcttagccattgtaatgatcagtttctttacctgtaaaatagagataaacatgttacctatctcatggggttatttacaaattaaatgttaatgcatataaagtgcttaacacagtatctggtcaatgttctatatatgtgaattgatatttattaatagttattattttgattctaattattttaacttggtcccacatcaagctttggcatccatcctataacaagagctggcagttgtctgatatggaaacctctatcaatagtttcaagttcagcatcagtctaactacaggttctgcttgatttattttgtttattcatgcatttatttattcaacagatgtttattgactctctgtccttgaggaattctattctagtatagaatattatgataagcaaaaaaatatatcaacagagaagataatttggctgaatgataagtactatgaagaataatcaggagaaggaaccaaaggtcggtggggtggggaagactgttctatagagagtgtgttcagggaaggcctttctcagcagatgatgtttgaacagagactgcatgaggagatgaagacgtcacaggaagatattttaggaaaaaattccaagtggaggaaatggtagaaataaaagcaaatagatgagaaagtgtttggtgcatttgagttttagagatttagaatcaatattgaagcatctagaccacagggaacaaggatacttctgggatgagaaggggctggggaggctgggagggcagatggccaaggccctgaaacctgtgatgaggtgtttggatggtttatacccagctgcctaattaagttgctcttgatcacctcaaaagcaattcaaactctgcattatctttaaataagcctttaaccatatttttggagggtaaaaactgaaataccattgtggttttaatatatgcccttcattagtttagtgctttcaataacctactatataagaaggttgcaaatttaggagcattaaaagtgtttccctgttgatttctcctaagggacccagtgccttagcctccttcttctaaaccatcaacacctttctcctgggccacaggagagaccaggtgccatggtctctcttggttcctcaggtacacagaagatcagcattcaagctacaggcataggccctgagttaactcctaatgccagaaggatttctgctactaacaagatacttgcattcagtttcagacttttctctgacctccccaaagtgaatttaacctacatattctggtcccaaggtcccaaatccaaaaatatcatcctgaagaaatacttatgtgctctagtaaagatatataatgatggaaaaaaagcattattctgtagaccagaagagcccaaatatgaacc

SEQ ID NO: 54533 - DNA, 947 bp, Bovine  19866881230811
cacagagcagtggaaatttatatgtgccctggacagaagttgaacaaggagatgctctgctcttgtgtttcagctctcatactataagcaagtgttcttttaacagtatgcatgataccaacatttttgcattttttgtcctttttatcagtgatttcactgtttaaaatggcccccaagtgaaatgctgaagtgctatctggttttcccaagcacaagaaggctgagatgtgccttaagggggaaaaaaaaaacgtggtatataagctttcttcaaggcatgagttacagtactactgaccatgacttccatgttaatgagtcaacaatatatattttaaaaggtgtttttaagcagacagacacataaaacaatgttatatattgataagctgaaatgttttgaccagaggctcacaggaacctaaccttacatttcttctatgagcaatgggtcaatgctcacacattcagtgtttgtaatatattctggaggagggaacagcaaaccaccccagtatacttgccatgagaacctcatgaaccaaataaaaggacaaaaagatttgacaccgcaagatgagtcccccagatctgaaggtgtcctatatgctactgggaagagcagaggacaactcctaatagccccagaaagaatgaagcagctgggccaaagtggaaatgatgctcagttgtggatgtatctggtgatgaaagtaaaatccgatgctgcaaagaacagcactgcgtaggaacctggaatgttaggtccatgaatcaaggtaaactggatgtggtcaagcaggagacggcaagaataaatatcaacatcttaggaatcagtgaactaaaatggacaggaatgggtagatttaattcagatgaccattatgtctattactgtgggcaagaatcccttagaagaaatagagagccctcaaagtcaa

SEQ ID NO: 54534 - DNA, 1593 bp, Bovine  19866881240304
cctatgttctgcctgccctttgaattctatctttatgaataaaaataagtttccacatttcagaaccatgtcagggtgatgaaaggttttgaaggctgaaaaagggggtaaaggttattgtgaaatacgacgtgtgtcatcataattgcaaaataagtcattagctgcaagacaaaagcatttgattagtgacatcattcatgattatttccattaggaagaagaagctctgtctcaaatgaaataatttagaccaaagaatatggaatatgagtacagtataaataaaatattaatagatttcctaatggtgacttcaaagtagcaacataaaaaaaaaagtagactagaatgttctgataacaaacatcttactaccttgggaatatcttagcaaaactatgaggtggtaaactcatttggtttttagaatattaaaaaatatttacagatttttcactcattaaaaatccattgggaatctaattcctgaagtgacttttgcctgaagctgaaaaaagctcatataagtgtatgaataactttctttgtgagatacttaaatggtggatgtcatggtgtggatcttgtcttgggaagcacttgcttgttgacctatgactgcttgggtggcacagcaatatgtaaagagataatatgaagtgaaagttgctcagtcgtgtctggaattctcatcccaaaatactgaagtgggtagcccattcccttctccaggggatcttcccaacacattggaggcagattctttaccatctcagccaccagggaagcccaagaatactggagtgggtagccaatcccttcttcagcagatctgcccaacccaggaattaaaccggggtctcctgcattgcaggcggattctttaccagctgagctaccagagaagcccactaataaaaaggagagatctaatatagttttgaatcttatgagacctcaataatatatgtgatactgatatgatttattataaaataccaattcatttggacattgttaaactttttaaaatttgtttttccaagaatgtatgttcaatgtttaaattttcactgatcaatgatcttatatttttaatagataatactgttttgctcaataaattctgatgcattagaatttgaattattatttgaatcatatattgcttttgaatgactcctctgataccccaaaactctattttttctttgaaacacacttcagaagctctgtataagctaaaataatgtttttaacttttcttgatttgtgacttgtcaaaaatctagagaaggaagatcttttatttttcagtgtatgtgaattaaaatttatgtgagtgaaaaacttgaggctccaaactttctactgattcagaattctgattattactttaaaagtaagaatctatgtgttcaaaaactatatatttatatcgaattgaatttttgaaaaaagattaaacaaatgtgttttttttcctacaatttatttattaaatatctctgtgcttaagaatccatccatcaaattgcattttatgtggcaaaatctctgaaggaaaaatcagtaaattttgcacagtag

SEQ ID NO: 54535 - DNA, 1127 bp, Bovine  19866881256844
atataacatacacaacaccaaaattataataagatgcgttatttgggagctttcaataaaggcatagcagagttctgacttttagcaaaggacctatgaaatatctcattatgaattatgctattcatttcctctttcatttatacccaatactggattgaaagaagctttcataagcaattctatcagaataaagttcaggggtttatgggacaaaaataaagcatttttagacaaggatatcttcttttattttttcattccttgctggtgaggtttccacagcttgaggaagtcatgttttgggaaaacaaaaagttgtgctaatgagaattctttgcatttccaaaggctttataacatgtaatacaataaagagaaggcaggctgtccagggaaagcattgagtaaattgcatgttgtgggaggagtgcttggggagttttgagatgcccagaaatagaactgtttctcaaactttctaggcagcccaggtgccacccaatccaggactaggttttcgctgtgcacagctgggagtgggtggatcacttgtacccacccaagctgtgaactgaagaccaattttttgaaattgccttagttagaaaggattctcttcctcgattcacccaccagtcagcctcaggcactggatgttttctgtgtctggaaccactgaggatagtgaaggtcctctccattccttttcaacagatccaaccccatggttttaatattttacatttcattaaatacactggcatcaccgatgtgaggttccggaagatggtgatggacagggaagcctggtgtactgtagtccatggggttgcaaagagtcagacaggactgagtgactgaactgaactgaactgaatcctggcagcaggaattctaatctctgtgttacagaggaaggacacagaggctcaaaggggttgaaggaaattatcctgactgtcaaagaggtgattgggaagctcagatcacagggaaggttttaccctttattctttcaacttgggagagtgtccgtggaaaccattcactccttcatacacctcacggaagaacatgatattctggtcaatgtttggtatgctccttggtccttatacgaatag

SEQ ID NO: 54536 - DNA, 1857 bp, Bovine  19866881309514
ttgtatgggctttgcttgtcagatgacgttgtctgggcagctacagaaggatggacgagagcatgtgacagactgtagcaatggggatagtattaaagatgaaaattagtagagcagtaggcaacaaatctttaaaaatacttttattgttctttgtatgctttataacttactagtctcaataataacatgggttttatagttataatgtggtaggataaaacattgagctattgatttatggcaggtataatcacaggtttttaatttgaaaaaaatagaaaagtccaccacaaatgacaacatactttacaatatgcaaaatatttctttctgtagtaaaacatgctagttaaaaaaaatcataaacttggattaagcttgaagctagacactggtacgtttaaagattacgtttctaagtaaagtaaatgcaacaaagaaaatgaaaacatagatcaggtattcatatttttatatcatgtattatgttaagaaagttgaaatgtgctatttttattttgttgcgttttctatcatttcagtagaaattcttttgttagagaatcagtgcttgtgtttcgttctcttaaggtatagtctaattaaaactgtcattcctacattctaagaacatttagattttaatcatgcaattgtatagggacttatttttaatactgtacttcctagataactgtgtttccctcatattgctatcctggttaaaatatacacacacctgttggattttaattatgaatcttaggatattccaaaaggaatatttttaaaatatcatctgtagcgcaatattctaggattctttttattctttgtttttaattaaattctcacaagataagtgtattgagagggatattcagtgtttattcttacttcattttacactgttccctgttttgtgggcccagaatcctgggaaataaactcccctaattcttttgttggtatgattccagtttttatcaatgaaagtcacttgataaaatttgaaagttgtaaggaaagtagagaatattgttcttctgctaatagtaataaatagatatgtgtgcttcagtaaatatgacttttgagaaaactttcagttgagatataacatatatcctgtaaggtgcattaatattaagtttatggcttgatgaatatttacttatatgtgtatttatttatgtaatcaacaccctgttaaagacacagaatatttttaacacccaagaaaaatccttcctgttacatgtcaatcagtctcactctctaatctctgaggtgaccactcttccaacttctgacaccttagatcatctttgtttgcttttggaattcatataaagtgatacacacagtatctactcttccccagattaattgaaatataatttacaaacagaattataatatatttaaagtgttgatttgatatatgtatgtgttgtcatcaaccacttcacatatttacttttctttggtgaaaacacttgtattccttcttaggaaatctacacaatacagtattatcaactattgtcactatgttataaatcagatcttcagaccttattcattttataattaaaaccttgtaaccttttaccaacttcttttttttcttttttaattaatttattttttattgaaggataattgctttacataattttgctgttttctgtcaaacctcaacatgaatcagccataagtttacatacatcccttccattttgaacctccctcctgtctccttccccatcccacccctctaggttgatacagagcccctgtttgagtttccgagccatatggcaaattcccgtggctatctattttacatat

SEQ ID NO: 54537 - DNA, 1596 bp, Bovine  19866881496175
tgactttgatttaatattaatattgaagtgcagctaaagaaattcaacatgataaataaacacgtataaaggatgatgcaagattcattgacgtatattcatataagtgacatgtagtttaaagttaatccaaaacattttttaaagctctattttctcatccatgtatcaagtagttgtcaatacatgttctacctaagttttcctttacatcaggacaaagcagggagaaatgttatctgcaggcacaacattgttagggaatgtcctgagtgcttaaatcaaaagcatagaaaggaggaaacctggataaaaagaaattacagatcagttttgagtgtagagacagagggaattcgaggcaaaatgttcataaataaaggtgaagatattgaagtcagagaatgagttgaaaaagcacctctattacatatttttcaggtgggaaattataaacatgcatggactgttcacacagctatgttgaaaggaggattgggccaagtggacataagtcacacaaaacacaaaatgctattttaaccaaattcccaacattatatctgtgaaatagaatatttccaacttatattacatagaattatatctgaaagtgaaaatgttagtcactcagtcatgtatgtctgattctttgcaatcctatggactgtagcctgccaggcttctttgtcctggggattctccacccaagatacaggagtgggttgcaatgtcctccagggaatcttcccgacccagggatcaaacccatgtctcttatgtctcctgtattggcaggtgggttctttgccactagcaccaccttggaagtaacttactaaattaagaaaatcacctattatgattatcagaaattatgagctagttaatgtatgtgccccatgtaattttactcttacatatatgcagtgcctccctgatatttggttcatgtgatgagagtatatagaaatatagatatatttttcttaggagagggctgtattcattttagagaaatacttatatagagcattccatctgtattttctgtaatattttcctatagcatgagaaaaaggtttcccaaatgtgatattacacctgctgtaacatatgaagctgtcatctattcaaagactaaaccttgctcattcggaagtaaaaaatgaaaaaaagtcaactttaatattacttggagtcatctcttggcagcatattctataatacctaattttatgagatcgtagtgcctcaagtatgagttcccactcttcccactaaaatctgttgacggcttttcatatttaagacactatcctaggatagaaatgagctttgtagcttgaagaagtttatagtgttataagaaaggagtaataatattaagcaactggactttacttttcatatgtaaaaatggtgataaaatttcctgtcctgcccacctcatggtattcttggaagagtcagatgagtactgaaagcactctgtaagatatgaataaatatacaaacctcaattattgttgttatgatgagtatattatagcaaattatcaaagaccaaaatatgttgagcaataaggcctgggg

SEQ ID NO: 54538 - DNA, 1228 bp, Bovine  19866881691486
gttcctgtgcaatattgctctttacagtattggaccttgcttctatcaccagtcacatcccccaactgggtattgtttttgctttggctgcatcccttcattctttctggagttatttctccactgatctccaggagcatattgggcacctactgacctggggagttcctctttcagtatatcctatcattttaccttttcatactgttcatggggttctcaaggcaagaatattctgtgcggtctgttgcagccaccacgcttctgtgtggtcccttacagaatataactactgtaaatagtaagaatcaactgtatgtatttaattatttttattttttctcctaccaaattgaatttctttgctactttatgtcagtgggtaatcctttctataactattagatatttatttccctaaacaaatttttgtacaactctagtcagttccatgtgtaaataatcagaaacaatggatactttcagactcaatgcatgaaaaaatcaaaatacacagactattaggtagttaagatttaaacatttcctctctaaggccatattccaatccaaccaggtgtgtttctagtaacccaggaacatggcttggggagggggttgtccttgtaaacactgtattatttttagaggcatagaattctatcatatacttgggtttgaaagaactagaacacttaaaactaatgtcagagacttcttgaattagagtaagatttatatgtgttgaatgtgaggaacgtgatttagtcgaactgctaataaggtgatcagttttactatacttttttttaaagactgtatgagtaaatcagtgttactattcctgaggtaaattgttatggttatttcatttcctttttttatatttaacaagtattctttataatcttgtctcatacagccaagatgtaaacaatctacatcatagaaaggtataactgtcattaaacaggtaagtaagatcacgtggtgtattaagatgttaagaaattccatttcagtttttcaagcttagtattaaccatctggtaagttagctacagaactagccgtatgtttaagtcatttctcttattctgtgtgtatagttttaaaaacagtctttagctgctgttgtccaaaaaccctgcagaatgtatcccaaggtattttcttaataacaaaggagaattatttgaaggagtttagttgagtcatcagtaaggaa

SEQ ID NO: 54539 - DNA, 739 bp, Bovine  19866881835125
tgttgcttctaaaaatatttttctaataaagctattcaatcaaacattaaaaacattgcagtagaccctaaagtccacaagaggagggattatgtctgtctctgtccccttcaaatggccttgcacatgattacactctataaatactattaatagataagtgaataataagcatctacaatttactgtctttaataattagttggaattattatatgtatgctaaagtaactaaatctgtatttgtaaaaacaaattattctaggcttgctttaataaacagacaaaaatcaattcataaataatagcatgcatttacatatgaacaatgttctaaagtcttctaaaattatgttgtctctttcataaaggttaaatacctcccatcatcttctttaagctattcatctgttcagttaaaatttccttcaatgtaatacgaaaggaaatgtcagtcttggcaaatgatcgccaattccaaattaaatagactctgaattaatgaggttttatggtattttcaaaacaacaaaattcactcacctcaaggtcattgcttccatttttaaatgataaatttaacttttatgtcagtagtgattctcaagccctatggtacattcgtatcttgcaatcatgtcttgggaaacattaaaataattattgctattaaacttcatgtcttcagtataaacaacactatacttttacagcttttttaaatcacatagcttcttta

SEQ ID NO: 54540 - DNA, 1662 bp, Bovine  19866880263460
ttggtaagtgtttggtgtctcaaaaaagaattttttaaaagtccattgttaacgccccattatacaagatacacaaaaaggagatgaatacagcttcagatcatttcagtgacattccaaacccagggaggattaatgcctgtgaatactcaactaaatcagtattttgtcccctcagtgcataatcactacatgatcaggatggagtgtgaacattaataaaagctggtccaatatggaattaactcaatttcagtcagtggatgaacacttcaatcctctagaaccagataactttttaaaaactcctgatatctgttgtaatgcaactaatatcactatcagttgttcaaattctacaataaaagacatacacatgttaatgtttgacaaaagttaggttaatttaccattcattcctcccaaattctgagtgtccttgaaaataggagtttacaaaagtttctttctttcttaggattaaaaaaaataataaaactttgtcaagcattggagtcaagaaaatattatataataaaagctaatgtggactccttgtatgttcagcactattctgaatacattacatacattacacgtgttggtccattataatcatcacagcattttccctgctggctcagatggtaaagaacctgcctgcaatgcgggagacctgggctcgattcctgggttgggaagatcccctggagggaggcaggtaacccactccagtattcttgcctggagaatccccatggacagtggagcctggagggctacagtccatggggccacaaagggttggacatgactgaacgactttaactttcacttacgagtcatacactctatttccttaatatggataaagaaactgatgcatgggtgggtgaagaaacttgtccacggccactgttagttaaatgatggagacaggatttgaacatgggtagtcaggtttcagcggagaaggcaatggcaccccactccagtactcttgcctggaaaatcccatgaaccgaggagcctggtaggctgcagtccatggggtcgctaggagtcagacatgactgagtgacttcactttcacttttcactttcctgcattggagaaggaaatggcaacccactccagtgttcttgcctggagaatcccagggacgggggagcctggtgggctgccgtctatggggttgcacagagtgggacacgactgaagtgacttagcagcagcagtagcagcagcagtgtgtgtatgttagttccaaactcctagtttattgcctccctcctcacacccactatcttctctggtacccataagtttgttttccatgtctatgagtctatttctgttttatatattgtttaattttttaggttacacatataagtgatattacatgatatttgtcttcctctgtctgattcagctcacttaatatgataatctctgggtccacccatgttgctacaaatgacattatttcattcttttttatgactgagtagtttttcattgtacacacacacacacacatacacacacacacacacacaccccatcttgattatccattcatctgttgatggagacttgagtttttcccatgccttggctattataaataatgctgctgtgaacactgggatccatgt

SEQ ID NO: 54541 - DNA, 2343 bp, Bovine  19866880457688
tcgccatggtgatcgtccttttagtcatgtgcatctacaccaggtccatgttcatcaccctgatgacgatgtttgccatcatcagttctttgatcgtgtcctattttctctaccgcgtggtgtttaactttgaatttttcccttttatgaacctcaccgcgctcattattctggtgggcattggagcagacgatgcttttgtcctatgtgacgtctggaactacaccaaatttgacaagcctcatgcggaaacatcagagacagtgagcatcacgctgcagcacgctgccctgtccatgttcgtcaccagttttaccacggcagctgccttttacgccaactacgtgagcaacatcacagccatcagatgcttcggggtttatgcggggacagccatcctcgtcaattacgtgctgatggtcacgtggcttccggcggtggttgtcttgcacgagcggtacctgcttaatatcttcagctgtttcaagaaaccccagcagcagatttacgacaacaaaagctgctggacggtggcctgtcagaagtgccacaaagtcctttttgccatttcagaagcatctcgaattttttttgaaaaagtcctgccgtgcattgttattaagtttcgctacctctggctattctggttcctggccttaacggtgggcggggcctacatcgtctgcataaacccaaagatgaagctgccctccttggagctgtccgagtttcaggtgtttaggtcgtcccatcctttcgaacgttacgacgccgagtacaaaaagctgttcatgttcgagcgcgtccaccacggagaggagctccacatgcccatcacggtcatctggggtgtatccccagaggacaacggcaaccccctaaaccctaagagcaaagggaagctgaccttggacagcgccttcaacatcgccagtccggcttcgcaggtctggattttgcacttctgtcaaaaactgagaaatcagaccttcttttaccagaccgacgaacaggacttcaccagctgcttcatcgagacctttaagcagtggatggaaaaccaggactgcgatgagcctgccctgtacccatgctgcagccactggagcttcccctacaagcaggagattttcgaactgtgcatcaagagagccatcatggagctggagaggagcacaggctaccacttagatagcaagaccccagggccaaggtttgacatcaatgacaccatcagggcagttgtgttagagttccagagtacctacctcttcaccctggcttatgaaaagatgcatcagttttataaagaggtggactcatggatttccaatgagctgagttctgcccctgagggcctcagccacggctggtttgtcagcaatctggagttctacgacctccaggacagcctctccgatgggcaccctcattgccatggggctgtccgtggccgtggccttcagcgtgatgctgctgaccacttggaacatcatcataagcctttacgccatcatttcgattgccggaactatatttgtcaccgtgggttctctcgtcctgctgggctgggaactgaatgttttggagtcagtcaccatttcggtggctgtgggcctatctgtagactttgctgtccattatggggtggcttatcgcttggccccagatgctgaccgagaagggaaggtgatcttctctctgagtcgcatgggctctgccatcgccatggctgcgctgaccaccttcgtggcgggggccatgatgatgccctctacggttttggcttacactcagctgggcaccttcatgatgctcatcatgtgtattagctgggcttttgccaccttctttttccaatgcatgtgccggtgccttgggccgcaggggacctgcggtcagatccctttacctaaaaaactccagtgcagtgccttctcccacgccttgtctgcaagtcctggtgacaagggaccaagcaagacacacaccctgaatgcttatcatttagatcccaggggccagacatcagaaatggaacacgagttttatgaattggaacctctagcagcccacagctgcacagcctctgagaagaccacttatgaagagacccacatctgctctgaattttttagcagccaggcaaggcacttagggctgcctgtccacgcagcttacaacagtgaacttaacaaaagcaccaaaaatgaaacgagccctgccttgttgcaggcctctcttgaacagcacaccatgtgtcacttcttctctctgaatcagagatgcagctgcccaaatgcctacaaacatttgaaatatggcccgccctcttgccagcag

SEQ ID NO: 54542 - DNA, 3651 bp, Bovine  19866880490346
tcttctaagttaatgcatctttatgcgttctttggcatgtacttttttttaatagttctcgcttatctttttagtctctgctggatctctcattttatccctttttatttttaatattactcatgcatttctttcttgaacaattctgctagaggcttccctatttcattcatgttttctaagaagcaacttttggtttttggaaatcatgtccattaaatctttgctttctgttgcattaattttgacacctatagttatctttgtttaaatttattctgttgttcttttaaaaatttcttaggttgggtacttagcttattaattttcagcttttcctctcttatactaataagcatttaagtctctacatttctctcatgtctcttatattatctttctaactgcatgccagaagacttggtatattgtattttcattattgtttagatctaaacgtatttaaagttcaagtttttaaatccagaagacatttaaaagtgagatttaaaagttctaaaagtgagatttaaaagttctaagtatatttttgaggtctaatttaattgcactgtggtttaaaaacttggttcatatgataatggatatttgaaaattttaattctcaaatatgatctattttaatttaataactatcttaattctcaaaccatggtctattccatggttggtctttgtaaatattgtcgtatggaatctatggatgtcctataagcaaaactttatcattgcatttttatatttttactaattttttgttctatcagtaaaaaaaagagctaccttgaacatcacccactctaaagatgaggttaattttcctatgtactttatcaattttacttcagatataacataagactttttagaattgttctatcttccaaatgcatcaaacattttgttacttcatagagctctacctatacaatgcgtttctgtattaaagtctagctgacagtagaaatttttcatttggttaatatttgcttcataaatctttcatctccagcatctccctgtccttatgtttgtatatgtcccctgtgaatagcacagcactgaatgctttaaaacatctagtgtggcgacctctgtccattgcgtagtgagtttaatcttttttcattatagtgatgccagatttgtctgtcttttcactatgctgttaccttctgcttcctatttatttttccttctgcctacttttctcttctttactattaaaactttccattttaatttgctttctctttccatttttttttcttacttgtttggaaacaatgttatactgatttttctctgagggttacctttgaaattataccatgcaaaactactacacattaacaggagcacctcaaccttcctagcagatcacacaatttcctctcaaatttcatactattagtctgactatttgtgttggccaaaaagtttgttcaggtatttccatcacagcttatggaaatacctgaatgaaaattttgccaactcagtattttcaatttttgtccttttaactgtttttgtatttctgtatgttagacatggaaattaaatgataatattttatggacagtattaatatgtgcctacttctttgcatctcagagctgtcttccaagattttctcccatcttcctggagtgcatcttttaaagttcttctggtttaggtcaattggtagtaaacttggtttctgtttctctagaaatgcttgtatttcagtctcgtaagtggagatatttttgttggctggacaattctaggatgactgtgattttccttcagcatttagaagatactattccattgtctcctggctttggttttcgtggttgggaaaattgctgtctgtctgtcattcctttgaaagtggtgcattttctcttttttaatgctttgaaaattttcagtttgcatttgctatttgccatgttgttttcaatgtgtccaggtttgggtttactttgtcttgttggataactgccatgattactgtgtccttgcattcatgtaccccagttctagaaaattgtctttaaattcaccctgtcccctatcttttctactccttcctcctggactctgatttgatattgtaacttctttatcttccttgtctctttttctctcttttgtactttacatcttatttctttatactgctttctagaacatttctacagatctaccttcaagttcaccaattcgctcctcagttgtgtttaatagtgtacttacttcaccctctgaatttttaatagttttaactatatattccattcaaaaagttctgtgtctttttcaaatctgcctgttcatatttcctattctctcctgctaggtcatctttaggagtccatgtttttcttaaaacattttatatatggttattctctattctgattctgagaattgtaatgtttcaaatctgtatgggtcctaatctattttattcctgttgatcatcattcatgatgatttgtatccttggatgattatctttgtgagctcacatatggctgctcttgatctgtggaaaacagacatgtatgcttgtctccagagtggtttctttattaggaccaggaacactgctgatctggaccagtgtcatccccttccatagtccctggactaaactgagaatctcagagtcagcttctctctcttgacatactgttatctggaactgtcctcagagcaactctgtctgtatgtgtagtaactgctcaggtctctgactgtgtgtgtgtgtgtgtgagtgtgtgtgtgtgtgtgtgtgtgtgtgtggtgttcccatgaaggtttcccgaatttccattaacccagcaatgcaaagaaagtgtattttatgaaagatatgcgtgcaagcatgctaagtgacttcagttgtgtctgactctttgtgaccatatggaccatagccctacaagatcctctgtccatgggattctccaggcaagaatcctggagtgggttaccatgccctcctccaggggatcttcctgacccagggattgaactcgtgtctctttcgtcttctgcattggcagatgggttctttaccactagcgccagctgggaagcccatgaaagatatacctattctgaaacagaagaatcctcaaagtcattagtccctgatacgataagcagaaatttgggcctgttttttcatcaataaaagagaggagtatgagaattcagggaaagatggaaacatttcattaccattaaagcaactctaaataaatcctagttattgtttgtggcatataatttcctaaatctcatcatcctgtcattgctttctgatcacctcatgtgtatgaagcttgcttcctaagttccaagggctacacagtatcctttcttttatttagcatctcaagagcgcttttgcccacttcatctcattttgcaatggccacatgaggcctgacttgcagactgaatggattataatgctgtatgcaataaacttgtaatggacagagacaagcccaaaggaagggcttgggtcccaaattggtccaacccaagtctttcctggaatcttccatactggaggcaaagaagtctctcttctggattgcaagtgaaaacataagactgagg

SEQ ID NO: 54543 - DNA, 1191 bp, Bovine  19866880521005
gatcttcccagaccagggattgaaccaatgtcccctgcactgcaaggcagttcttccccccccggaccaccagggaagcccaatactagcattcttaatgttcaaaagaggctaaaagttcatttctgaagtcttttctcttattatggtacttatattaaatttagaaggaataatttatctttaatttattcaggagctcgtgtcctaataaagtgatttctacttattatattattggaatagtttattaaccttattaaactatattttactatgttactagaaaaatattaagtatactcatgctgtgagtgatgtatgctggtaaatgcaaatcctaatttatgttgaggctgatcttattgacattttagatgaggatttaattgttaatatttctaaaataaagaaattaaatagctgccataaacccttttaggaacaagttggaacataaaaatgcaaaaatggattatgacatagtaagtgttctgttgggttaacattttattttagtattagttgaatgatttaagaaaaatttcttcccttcaatgttaattccaaatcaggctagtatgaaatacatgttagtaatgctcagaatggaaaatatacacctgtggtagaagaatatgtcatagtaaatatgtttatacagctgtgtggtaatgttagttattacagagtacatttacagaatcatgtaatgagactcattttcaaacaaccattaacttcggcatagaaatagctaattaaagaataacttcatttttcagatgcagactatataagcagtatctagcatcactgtagctatctgcaaactctgaatgcataagtttgattataagtatatgttagctaatttttgagacattacagacttctataagactatgttttatttataatttatgttttcattgaatataatgcctactcttagtaccagactgagtttccattaaactttattgcacttacatggactcttctgtcatgctttaataaaattataacattgatttaattgggtctgtgtgaaagcttcttttagcattaataattccatttattccatggggttattagttttggataacttgtatgacttcattcagatttgtgctagaatatgaataaatattatttaaaatttaagtaagcatgagtaaaagcaaa

SEQ ID NO: 54544 - DNA, 1174 bp, Bovine  19866880572574
gcagcctgccccactcactcagatctgcagttcacccacaaatgcaatccattctccctgctccttctgttatctgtcgttttatagaaggagaatgaatccttcatatctgtgctgtttgatacgtgacctcttgagatgatgatgtgctcttttatattgggttggtcaaaaagttcattcaggtttatctgtaccaaataaaaaacccaaaccaactttctggccaatccaatccaacagggccatgggtagtgctgcgggcctaacctaagcagctgatacagcagtagggccttgaggaaaaccatcacctggtcagtcagtcattaagaaaagactgcctgctgtcatccaggagccagagaagtggatggcacatacagttatgttgtagtgtggtctaaagatgtacaaaattagatcaggcagatgaaagacaattactacatggtatacagaggaacatattatagtaaaagagtggtcctttgggaaattcttccaatgcatgtgtagttgacttttcagagaaaagaatgcacaggtcctttattcaaatttaaacttagaatatgtaccttgaactcagatgcatcatgaagggaattagctagaaaactgtagctgtaagatttataggtcatttttaatttcctttacttctccaattttcctgctttattagattttgtcataatattacaaccattgtctgggtttcatattatatatgaaacttttgtttcccacatggtgcccgtagttacacaacatcttagcatagacagcaggaagcagaaatggcctcagttactgtgtgatatttagcagaaaccactgtctgagtaatatttactcaaaagagttagggctttccccccgtggtgcttgatgtcctcaggatagtgattccatttcttaagtgcgagcagttgtctcaaagaaaggttagcatgtgaaacatgtgctgtgtgaggaagtggatttgtaatagggtaaggttaaatgtgtttggaagaaatgtgctgaaatcactaataccgtaaagtttccatatgtagtccatgcacagatatggtagagaccagtgctgtaaaatcaaaaccaaatgttttcaaaagcaagaaaaagcaattattgaatgagtttttaagattgctgtgcatgtgtg

SEQ ID NO: 54545 - DNA, 1583 bp, Bovine  19866880657203
ttgcctggaaaatcccatggatggaggatcctggtaggctgcagtccatggggtcgctaagagtcagacacgactgagcgacttcaccttcacttttcactttcatgcgttggagaaggaaatggcaacccactccagtgttcttgcctggagaatcccagggacgggggagcctggtgggctgccgtctatggggtcgcacagagtcagacacgactgaagcgacttagcagcagcagcagcaagagagagcagggtctgtttttaagttttgaaagatgtcccttgggtgtggaatagggaggaaaatatgaatgaggataatgataacaataaactctttgtaaagcatgcataacataatttaatttgaccatgatgttttataatataaaaataagtatttacaaaaaaaaaaaaaaataagtatttactaaatgctagggatgcgtatggaagagaagcttcagataagttttttatcctcctctttgctgagatatgtaacataccaaagaatcaggccgttttgtcacagtaaataggtgatcattattatgtcaaatcatcttgttttaatgcagttcacctctggagtagctgtgaggaacgtatttattttctgttgaaagctatccatcaccttgacattgccttcccaagctgttataactatacttagcctgaaatgaagtacactaatgggaatttgtaatattttgccttagggttttgaaccaagagggactgcaataggccagagactggtcacatggaataacatggtgaaaaatacaggatacaaagcaacattagcaaattacccctttaaatatgcagatgaacaagccaaaaggtaaccatttattaacttttagacaaaacactgctaatgaattccacttataaacactgcctgcgcaaaacgattacatctaaaatgtgtggctcaaaatctttaccactgaatgtgtcgaaattgtcagtgtcttttaagattgtgttgtctgttagtgaatgtttgggtttgggtttgttttgttttgtttgtttgttttcctttttcagaagtgagaaaattaatggtggttgcttatgcccatccgtccaacttcataccaagcactaaataggtcatgactttgaggcagtattgttaccagtaggcttctcatccttggaatggtgaggacttgactgaagatcaaattgtgttctatttcagccatcgggatgataggtggtcagacgatcattatgaaagagagaagagagaagttgactggaacttccacaaggacagctttttctgtgacgttccaagtgagtagcatcataaatgacaaacctctctaagtttcctgggattgaacgtgactgataacctagactgtctgggtgtatgtgactggtcacacagctttactgtttctatcatgcttcaagagattttgtttaattaacttgtaattttacttctctaggttagtcaaccactaatctgaacccactccagtgttcttgcctagagaatcccaggaccagggtgggctgccgtctctggggtcgcacagagtcggaca

SEQ ID NO: 54546 - DNA, 1589 bp, Bovine  19866880725145
aatggtgattgatcttaggttttggctttatgaaagacgttttaaaaattccttcacattcttttgcttcacagtatgtggatgtagaatttttgtattttgatttatctctgtgatggtgttttcctttgagctgctaaattttgaggttttgagatgtgcaaaatattaaacattcatggtgtctttagacttgattgtgtgatctctgttcaacaacatgagtcaagctcagtcatatgattctgtttctactggggaagagctgtagtgatacagacagattgctcaatgctttgtgattttagttagagcaaaataatttcaggtgaaatcttacgacttaaagatagatctatcacatcttgggggttctgtttattaccaaagcatcttgtgattaattgggttttttttgttgttagtgggataccaggctagattagtaggtctggtgtctggaggctgtctgactctagaattggaacgtttaaaatgcagtcagaaggctttttctttctttttcctttccttttccttccttcctcccctctcttttttttccttcttgctttcttccttcattctctctctccctttctttccttctctttttggtacaaagctttagggagcatgctcttttaatagagagggttgggactttacattggagattgaccaggtgttggggagatatttttttcttgagggttaaataaacttgttagtcaaattggctatattctaaactctattcagatgatcataagtatgggcttggccaaagagttcattcaggtttttgcataacatcttatgaccaacccagtaattgagaccatgtgacaagttgttttgtatttccacaacattgttccacatgaatttcacactgttgcctctcaaactaatgtgttattgaggatttctcttcctggcatccttgtccccacccttataacctcaagggtaacccaaaaagaagtaaaactaatccaaatactataatacattctaacatgaagtaccaggtccaaatgttttagaatatacaataacagtctgcatttcaagcaatattttctgaaacagtattgaatattttgagagttagttgcttgcacttataaattaatcagcattaattaaataaagtataaatcagtagttctcaatcctagctgcacattagaattatctggggagtatttaaataatgctaatgcccataccccattataatatgaattaaatcataacctctgggaccagagccccgtgtctgtaattgtttcgtattaccgaagtgactctagtatgtagaaggagttgaaaccactgtaatagacttgtaactttgtgaatatttgttatattgattatgttcccttcaagacttgcagcagagtccaaatgaatgtctcagctggttcttgagttagataacaactttttagggggctttctagaatttttttgaaagaccagagattgattttttttttttttaattgaagtatagttgatttacagtgtcgtgccaatctctgctgtacagcaaagtgcctcaggtatacatatatata

SEQ ID NO: 54547 - DNA, 1848 bp, Bovine  19866880877318
tgaaacccacccctcagacgtgatggtgtttggaggtggggcctggggcctctggtgacaattaggtcataagggtgcagccctcatgaatgggattagtgcccttgtaaaagggaccccagggagcctcctaaccctctttccatcatgtgaagacacaagatgatggcaatctgcaacttggaagaggaccctcctcagaaccgcctgggctgacactctggtcttgggctccagcttccaaaactgtgagatgtaaatgtctgtttcacccagtctatggtacttcgttacagcagctggaatggaccaagactgccacctacccttagcctctctaagcctcaatttcctcagcagccagctggaaaaacagtaccctctgataggtgtttggggaaggctgtcatttgtagtgttaatagctagattttaatggagtactgacccacatgctggactctgttctgaacacatggaccaattcatttaaccatgatcgcaaccttatgaggtaggtaccataattttttccactgtcagatgagaaaattgaggatcagaaaagtgaacaatcaccaggtggcccaaagccacctgagtggcagctagatggcagctagagggtcacctccgtgccccttactcttagccaatacgttctgtcaattagaggagataaagcataaaatatttcatagaaattctggcatatataaaaactcaaatactgttagctgtttttgcggttaattttgcacattagtgggatggagaggaaaagccaaataggagggtgatgtagaaattccactggagggatgctacaaccctgggtcccttgcttcccactctagcccacctctctgcagacagggttctatttcagaagcttctccctccatagacacttatataattttcccaaaacagaaggttgggtttggggagctgggaaagaactgagtgaccctctagcccaggctcctcatgttacaggtgagccagcgtcacagaggggagccagtagggagtctgggtcccctgacaattcctctactgcaggcttaatgtcctacagtcttctttgcatattgctttccataaatttgcatactgggctctagagactcagcatatgaaacaaaataaaagaatttatggacgctgaattccaacgtaataatcaactcaacatacttgaaatgcagaacagaacccccaggctgccaggaaggggctgagggcctggtgaggcaggacaggcatgcaggacatagcctcactctgcacacgatcaggagcatcgtcccattcccaggatgacccaggagctgccccaaggagccaagggacacctccttgacagcccaccagaactaggacacaatctccccatatagccttcacgagggcaagggagggtgaagcaacttctctacgatcgccagacagctcatgacagagccaagacagggactcccagccccactgagacatccaccttccaggtgaagccatcatgagacctctctgaagtgcaatctcttccttctctggctggggaggaggagcctctaatccccttggatcagagctgtacctctaaggaattgtccacttggaatacacagagactacgagcagatgagcccaaggattggtaagtgctgtgctgtatggacttaccctgggtggtccctggtggtacatccctgagccaggcgggcccccatgctggtaggcttcacctgggggcatggttgggaggtggggccaagggagagagagaaataaaaacactcaccagagcccacatgggaaaaaaagagaagccaacaaagcagt

SEQ ID NO: 54548 - DNA, 1760 bp, Bovine  19866880950943
acagagtgacctcaaccttgaatgcgcgtgaaagtaccctgagaccccctctagacgctccaaaatgtctctgtttccctgtcttctcattgactctgtttctcatcaggaaaaataatttctctttttctgtgtaacaagaatgacagctatcattctctcttatttttattgccaaagcatcattttgtagttacataagagttaaatagatttttgcaggtcagccaaaggacctaatcacgatttacaacattttttctagcggtgtggtaaactgcagttcaagtgccaaataacttacttacaaatgaacttttggaacataacttgtttggtaacttggagacttcttgtaatgaagtaggtatgagtggatagtaaagaataattgaactatgactttggttttatttgaagtaactcacatgagctttctgagattcagtttctttaagcataaactgggaacaatcaaattgcctttataaataagttgcagattatgttaaaaatgatgaaaaagcaaaagctggcacaaaattgttctcagaaatgtttacagattaagttcaattagtgtatctgtgtaagaattcaggtgaccaggacaatggcaaaatttccacctaaagtcaagagttgactttaaggccacaaagagaaagaccttgtttctttagaacttcacccgaagtttcttcactgaaacaagtgaaaaaaaattcgatcagagtcagaaagaacagcgcaagagatgagctagaggaagattcaacatcataaaaaggaactattgtgacaaatgtaatgctatgtgattacaaatgcagtgacagttattatttaccgtggaagtttaaaataagtcttggatcaaatataatgaatgactttagaagagctatgttgaaatcacctgttttccccagggccataacacacagggaatgccaaaagaaagctattcttgaggcgctggcttgaggtgtggtgaggcccgatagcaagtattttagtgcctttcctgttgttcatgagtataacaagccaatatcaatatacccaaagccactaatctcacacctcctctttcaacctttctactagcatttttatgtcctgagtgctttaccggttctgaggcttatacggccttgggccaaggaccatcttttgattacattttaaaatttaagattttttttctttgggcctcagttcttcacaagtgtaaatcaggatacaaatcaatgtccacctcatatgactactctgagaatgtaaaaatatatttaaaaccataaaaggctatgtatttacaatgaaagaattattattattgcttaagtgaggagaatatttaaaaaacatgaaatgatgcttcctagtttcaaagccaaaactatgttttaaaatggcatcagtgatatctgtagcttagaagaaatggcctggatgagtctcaattttaaagctgactctactagttactgagtacctgggtcaaattatttacattcttagagtctcaaagtctttactctttttagagttaaattgtttgaaaagcaaactaatgtaaccttctgaaagagcaacatggcattactattcaaaatgtagaaataccctcatcctttgactcgcaattctcctagggtttacagtttggatatccttgagcagtgggtaaacgcaaatgtccagagaaagatgttgactgcaccactgcccgtgacagggcaaactggaaatga

SEQ ID NO: 54549 - DNA, 737 bp, Bovine  19866881223487
cccacctagttgcctgaaccgctggccacatggggccagagcttcaaggctactagactcacaaagcacatcctgtggcctgaaacctacaccagctgctgccgtcctgcgctccctaaggaagggtgggcccagcagagaggagagaagccggaaggaggaaagggcagggctgagggctggtccccgggggagataagcctctaatggcggcagcatctgatccgcctctccttcctgctaatcctaaatcacaacactgtgaaatctgagcaagtgtgaacgccttgggctccagctgtttttcgtgtcaggcctccatcccagcctgtcacagcaagaagcctgaggatgcagtggtgagatggtgtggggcgggggcccaatacctgcagaggggaggggggacactccaggctgaggtgcactgtggggacccccgcctgatctctgctgcccggctgtccccgaggctctgggtcagccccctgttgctgtcccctgctctttccccactgacttctcctgctcccagggactccagttctgccttccttccccttgtgagtttcatggcctctgggatgcaaaccagggactgagggatggacaggggcagctgtctccctggccagtggggacccggagagacagccagccccagcaactgggagcttggagacagatcccgaccaggccaggtgacagaccagggaatcggtgcagaaggaggttca

SEQ ID NO: 54550 - DNA, 1723 bp, Bovine  19866881260156
ttaattgcttacaggaccagtcagatatagtcaagtactcccaataatatagaaccaatttacaggtaattatatttccatgcaaagcctacatctgtaggtgagaaaaggagatacacctcttcaaaatgttcttcgtctctttccattttgaaactgtgatgaaacacgtataatgttcggcttaggtgtactctataaattttacagactttattcagtgatgaatcgtttttcttttaaatcacggtttttaaacagaacacctgagattagttattttaaataatgaaaaaaaaattaatttctgcactatgcgatactaaaatcagacttacacccatgtagaatttctctctcaagatatatctagacccctgactatgaccattcttaccttcaataataaatgtctacactttgaatataaaaatgtatgttcttttgataactgacaggaacatgccagccaaaggcagaagaaatgtccatggattataggcaatcctacagctgaatttcctttgccatctttcacctccttctattgcttaagccatcagcggctattgattagctaagaaaaactcacctccaatttagctgttaaataattttcaattttctccctagagacattaggaatacctcagagatgtgataaaagattgctgtgaacaatgataaaaatgtgcatttccacatatttataaatctacatgctaactttactaaacttgctggcaaagacaactatctgatatttaaggaagttagtcaatgggaaaactgacaggcgaaactgcccactcactggatctctagacgtcacttcaattagtgattgagactggcagcccacaaaggcatttctgtgtgatgttccataagaaaaatatgctttgtacataatgtacaatattccctgtctgtcccactcagactcaaaaccctataaagctggaacaaatcagactttcatgtaacagcttgagttccaatttaagttaaaaagaaatttttctcttattagtagagcctggccctaataagcaagaaagaaatgatgttgttttttccccagttattgcaataaataagaaaagaactgtgttatatggatctgggtgagaacagggaggggggtaatttcctcttatataattaaataattatttcttcttaaaaagttggagttctaggcctggcagatcagtcgtcaaagggcagctattctgcccttcattcaaagaagagggaagcagagcatgggaaattcattttcagacacatttcgcccttgccactttcaaatacatctgtccctgtagtactggaggccagtatttcacatggttctggtcctatgcaatgcacaccccaagaggaatctaagaatgattttaaaagaaatagtttaaaacaatgagcattctgaaaaagacaactggttaattaaaaatattttttaagggttgaaaagtatctttgcttaaaagaaacattcttcctcagcccatgaacttaaatttgcatagtttagctggagttataaactgaacagctccatgtgttacattttaaagttatactaaattataaagcacttgcccttaaactcaagcctttccatgccagacttgctataagccccgaaacaaaacatgctaaatgagactatagtatatacttttcttaataagatgtgaataataatcactaa

SEQ ID NO: 54551 - DNA, 3115 bp, Bovine  19866881309977
tttactttaattcctctgtaaatgccctgtctccaaacacagtcacattctgaagaactaagggttaggaattcaaccatgggtttgggggaaggggacacaattcattccacaaaattggtatcgctcaggaaacaccagttgctcattcagtcaatcttttgttcactcaagaaatatttatggagcatcctctctgtggcaggcactgtatttggtgctgaggatacaaagatgaatgaaacacaggcttggtcctcaagaaacttgtaataaggagacaagtgcacaactaactcagtacgatacagatctgccttcctgagtccagccaccagctgtctgctgaccttattttccaagccaccaaccaccgtggagcctcctaggcttagctctgcttcctgggtgggacatctgccatgtgatctcctttaatacaaactccttgcctgaaccagaaattgccagcatggatcatcatctgtgactcatcatccatttattcaagactcatctattaagcacttatgataagccctgttctgtatactcagagttacaatcaagcagacacatccccaacctcaaggagtgagtgagtgaaagtcgctcagtcatgtccgactctctgtgaccccatggactctatagtccacggaattctccaggccagaatattggagtgggtagcctttcccttctcaaggggatctttccaacccaaggactgaacccaggtctcctgcactgcaggtggattctttaccaactgatctatcagggaagcccgacctcaaggagtatataatctaaaatagggcaacatacagtgatcaattaaacaagaaagcatactcactgtgatgaaaataaactcttaaagcatatatatagatatagagtgattagaagggttattttgaataaggtggtgatgaggtgactgttgagcagacagacctggggaggtgagctctttgggtgagtgtctgggaagagcattgaatagggcagataaaacagcaagtgctcaggatgggagcatggactatttgggggagagcagagaggtcagagggccatcactgagtgggcaaatatgatctggcacagaacagaggaggcactttcctgcaggacctggtgagttctgggaggaagttgtgctcactctgtctgcagtggggctgtctgtgtgagagacgattccaggattttgagattgatcgctcacactggctgtgtggaggggacagcaaatatttggcagctctacaagcactctggggagagaagacgggggtcctagccctggggtggtaagaagcaatgagatcaaatgtagagccgaaaggtgatgaggtgaatgactcagacatgctctcgatttagtctagaaatggacagaagatgtaaaaccagggtcagtctctctcagctcaacttgctagtccaaaatcaacagccagcatcatgagtggggccagtggtgatgctctagaaaggcacaatgacgtgatgtctgactgttatcaaatatcgtgagcaaagtgatgaaatcacatggaaacaaaggtatgcgcaccatcacagtacaaacgaatttgctctgaattcagccaaggaccagtctgaagccctttttcggatctgatggccaaaatcactgtgaaagactcaagccaaggactgatgtgcccgtcctacaaatggggccagaggggcagagctgtgtttgagttcttcccggtgctgctggacagagtgctgggttttgagagtctccgaaatggtgactgtcacagaaagcaaaaccatttcaactcaaaatttctgatcacaaaactgaacatttaggcctgaggtcaagcaccagcccagcccggttctacccactcatgtctccggacagcctggcccaggggactgggcagtggtaggcagcgtagattctggccctagttctgctttgatttaatgctgtgacccagtttctccatttatacagtggtaacagtatcttccctttccttccttgctgagagatgaaggccctagctatatccaagacactaatgcagtctttggcaagacctaacaatgctgattggattgctctctcagtgcagggaagatgggattgcatggggtcgaatgcaattactttaccttacacaatagtgcttttatcatcaaagcactttctaccattattctggggaaaaagacaaggaaacccactgtcaccatctccatttaactttataccataaggcaaaagaaagaaaaatgaagaaactgttcagaaaagaagtaaaactacctctgttagcagctgtgattgtatacgtcaaaagttcagaacaatccacaattagaattagaattaattagaactagattaattagaattaatagaattaataagtggatttaactatatcactgcatagaaagtcaatataaaaaattaatcatatttctaaatatatgctagcaacaaagaattggaaaagaaaatttcttatagagagataattgatttacaatattatagtagtttcagatgtacaacatgattcaaaatttttatagattatacaccatttaaagttattatgaaatgttggttatatcccctttgttgtgcaatatatccttgtagcttaagtattttatacatagcagtttgtaatccttaatcccttaccccatcttgctattcctccctgataattactagtgttttctctatatctgtgagtctgtttctgttatgttcattctttttttttcatattccacatatgtgatatcatgctgtatttctttttctttgattcattttacttaacataattccctccaactatccatgttgctgcaaatggcaagatttcattctttttttatgactaagtcgtattccttatatatatatataccccccttttgttacccattcatctggtgatgactctgaagttgctcccatatcttgactactataaataatactgctatggacatgagtttttctggtcactcagatggtaaagcatcttcctgcaatgcgggagacctgggttcaatccctgggtcaggaagatcc

SEQ ID NO: 54552 - DNA, 588 bp, Bovine  19866881370729
atcggtgccccctatcccacccccaccccctcacccctgaagctgtgcagccctcccccaccctcagtgggaaatagacaagaaatcccattagggagggaggagggagagaaagacctaaagtgctagacatgtcataactgtcatttcatcctcacaactacttgtaattgatttatcccccactttactccagaaatgggttaagaagccttgtgagactacataaaaggccaactagcatgaattacaagcagaagcagaagaaaaaagtaacagggcacataaaccaagattaaagtgccaaatatgtccataaagtctgtgctctgcatgggccatagctttgcctcgaatacccactgcagccaggaggacctgagcaacagctgaggcaggcgccctgttcagttgagggtgaggaaactgaccagaaggttgagtgactcagccaaggtcacacaaccgggtgactggaaggtggccatgcgatttaaatctaggcctacccgaacagaagacccttccttaagtctgtaagaccctcccccgaactcccttctgaacaaaaagcatccatcagcctcc

SEQ ID NO: 54553 - DNA, 787 bp, Bovine  19866881404341
gggttcttatgtgaaaccgtattttttggttttggcattgaggtttcctggtcctcatcagacgcattgtgtctttcttcagggacaccgtaatgtggtgactctgagatgaaaagcaggccagaacccctcctttggggctgctgaataatactgatctttaatttcatctgtctgcatgtctctgagcaagtcaacaccatgttctatccgatctggaaataagcaaaggtccagcctcctcatttgcttccttgagtggacacatttattggccttttgtgttgttacaacacaaccaaagtggaaaatgttacatgcggtataatgtttattgattttccctgagctgaaagcaaggttttggacgtagccttggaaacagctatgattttggcatggagggtgccagccagcttcctggaatcattactgccagacttggaaccagccagtacagtggcagttctgattattggaagccagcagcagtcctgaaggcagaggtttgcctggttccgtccgtggatagagcaatgcctgctctcttcctctagagctgctgcaacatcatgctgctggtcttaagatggtgatgcctttggacttgagacacagaatcaccagccggcgcaccacctccccatgctctgccaggccagctgagggccagagtctatattaagagcgacttctctctcctcatcaccgctgagctcagctacaaagcttcctcgaggtcttgggcagcgcttctcagactggactgtgtgtgtgaatcacgtgg

SEQ ID NO: 54554 - DNA, 1069 bp, Bovine  19866881630983
gctgagtggacacagacagaggccagctaactgctgagatcatgagattcggtcaccaaggcaagtggaagaggctgcgatattttagtgagtcccatctccatcttgaagaaagaggaggcatctggcccatgtgtccccgttgaggatggggacctttgcaaatccaacaccattcacctctgaacgactgttgtcttctcttgaaagccattgagtttcagctcctctaaagggccctgcatgatgcaattgttttatctcgagagtgctgccctcagtttccctgggaatgtgaatgaggtccctctacttcctgatctgaaggcaggctttcctgaggtcaagcccgggacgggctctctcatctctgtggggatcaccgtgcgtctgtcagtaactcttctcctctggggtctccaggctcctactgcctgggtacgtcggcgcttgcaggagatgggagaacaagacagtgacaaaacatagaaatagtttcattccttgtttcctggaccaggcttaccagacgcttctaggaaaggaagaaggaaaatagggctagttcttggtgcctgtgacagaggctactaagcctggacattgagactgactgagtgagcactgctcccagctggctcttggatattttacttcttaccttgtgtctactgaacacctactatgtgcagcacattgagctgtggcttcaggaaggggcagagttggttatcagttgctgaaccaataacatttcccaatctcttccttcctttctggtccagtaggccacccccaaggcccaaccttgattaaggaccttgcaaggaaagtcacacacacaaaaggagtcttccagggaaagattttctctgtggaaaaaagagaaatggggaaagaggttgtcctcctattttgtgatgtgactgcctgaggctgtgtggttggccgccatcttgctactttgagggggaaaggcagacactaaggatggaagagggggaaagtggaaggcagtaagtccttgatgacttcatcacactgaattaaccgattacctggggatatt

SEQ ID NO: 54555 - DNA, 714 bp, Bovine  19866881798351
agccctgatcctagaggccggccgctccgggggtgcccagccttcctcacctctcagctctctccacgagggtcctgggagctgagaggagctcaaggatcacaggctgacctgattttggtcctagctccagggcggcatctggatcccctaaggtctgctggctgcctccttcctcaggaatctcaggcttcctctggccccctgacctcagcacacccaccaccctgggccatcagagagctcagagcagctagtcagaggtgaggctgccggccgcctccccggctcctttaccacatcagggaacaattgtgcttgggccctggaatagcccaatatccagtttccaggaaggtggactgcattatttgaacctgaaacacaccaggggtaataagatcactctgagaaagctgagaagcctataatttattgagaagatcttggcggacagaaaccaccagcctccactgtgaccctggggagggggtggtgctgggatgaaagagtcatctcttcactgcaaagtgattccctctcactcgggaagcaggaacctgggggccctggagcacggacggatggttgccagacttcacgacggggcccagactgacacctccccctgggccgttgccaagacacagtggctgttgctgagggcctggggcttcagagagctgctgccaggttctgaggacagcctgtcat
